United States Patent 11,078,247 (RNA ENCODING A THERAPEUTIC PROTEIN) - sequence listing, part 32

SEQ ID NO: 54676 - RNA, 2274 nt, Artificial Sequence
  derived and/or modified sequence opt3 from COMP__Homo_sapiens__NP_000086
auggugcccgacaccgccugcguccugcuccuuacacuggcugcauugggcgccagcgggcagggacaauccccuuuagguucugaucugggcccacagaugcuaagagagcuccaggaaacuaacgcggcucugcaggacguuagggagcuucugcggcaacaggugcgcgaaaucacguucuugaagaauaccguaauggagugugaugccugcgggaugcagcagucagugcgaacaggacucccgaguguccguccccugcugcacugugcaccuggcuuuugcuucccagguguggccuguauucaaacugaaagcggggcuagaugcggacccuguccugcaggcuuuaccggcaacgggucccauugcacagacguuaaugaguguaacgcccacccaugcuuccccagggugcgguguauaaauaccucuccuggauuucgcugcgaggcuugcccaccggguuacucgggccccacucaucagggggucggacucgccuucgcgaaagcaaacaaacagguguguacagauaucaaugaaugcgagaccggccagcacaacuguguaccuaauucaguuugcauuaacacgagagguagcuuucaaugugggccaugccagcccggauucgugggcgaccaggccaguggcugucaaaggcgggcucagcgcuuuugcccugauggguccccaucugaaugucaugagcacgccgacugcgucuuagagcgagauggaagcagauccugugugugcgcaguggguugggcuggcaaugggauccugugcggaagggacacugaucuugacggcuuccccgaugaaaaguugcgguguccggagcgucagugccgcaaggacaacugugucaccguuccuaauucaggucaggaagacguggauagagacgggauuggcgaugccugcgaccccgaugcggacggagauggcguaccaaacgagaaagacaauuguccucuggugaggaaccccgaucaacggaacacagacgaagauaaguggggagacgccugcgacaauugucgaagucagaagaacgaugaccagaaagauacugaccaggaugggcgcggugacgcaugcgaugacgauaucgacggcgauagaauaaggaaucaagcugacaacuguccacggguccccaauagcgaucagaaggacucugacggggauggaaucggcgacgccugcgauaacuguccucagaaauccaauccagaccaggcugauguggaccacgauuuuguuggugacgccugcgauucagaccaagaucaggacggggauggccaucaggacagccgcgacaacugcccgaccgugcccaauagugcacaggaggauucugaccacgauggacaaggcgacgccugugaugacgaugacgauaacgacggggucccugauuccagagacaauugcaggcuagugccaaaccccggacaggaggacgcugaucgugacgguguaggcgauguuugucaggacgauuucgacgcggauaagguggucgacaaaauugaugugugcccugaaaaugcagaggucacacucaccgacuuucgggccuuccaaacggugguucuggauccagaaggggacgcucagaucgaucccaacugggugguacuuaaucagggacgagagauuguccagacuaugaacagcgacccgggccuggccguggguuauacagcauucaacgggguugacuuugaaggcaccuuccaugugaauacugucacagaugacgauuacgccggauuuaucuucggcuaucaagacucgucuuccuuuuacgugguaauguggaagcagauggagcagaccuauuggcaggcuaacccuuucagagccguggcagagccagggauacaauugaaggcgguuaaaucaaguacgggacccggcgaacagcucaggaaugcucuguggcacaccggugauacagagagccagguccgcuuacuguggaaggacccucggaacgugggguggaaagauaagaaauccuacagaugguuucuccagcacaggccccaagugggauauauucgcguccgauucuacgaaggcccagagcuuguugccgacucuaauguggugcuggauacuaccaugcgggguggccguuuggggguauuuuguuucagccaggaaaacaucauuugggcaaaucuaagauacaggugcaacgacacaaucccugaggauuaugagacucaucagcugcgccaagccuga

SEQ ID NO: 54677 - RNA, 816 nt, Artificial Sequence
  derived and/or modified sequence opt3 from COMT__Homo_sapiens__NP_001128634
augcccgaggccccuccacugcuccuugcugcagugcuguugggcuuaguccugcuaguugugcuccugcuucuguugagacacuggggguggggacucugccugaucgguuggaacgaguucauucugcagccgauacauaaucucuuaaugggcgacaccaaggaacaaaggauccugaaccacguacuucagcaugccgaacccgggaaugcgcagagcguguuggaggcuauugauacauacugugaacagaaagagugggccaugaacgucggagacaagaaaggcaagaucguggaugcaguuauucaagagcaccagccuuccgugcugcuagaacucggugccuauugcggguacucugcuguccggauggcacgccugcuuucaccaggagcccgacugaucacuauagagaucaaucccgacugugcugccauuacgcagcguaugguggauuuugcgggcguaaaagacaagguuaccuugguggucggcgcaagucaggauaucauuccucaacucaagaaaaaguaugacguggauacacuggacaugguguucuuagaucauuggaaagacagauaccugccagauacucuccuucuggaagagugcggguugcuaaggaagggaaccguccugcucgccgacaacguuaucugucccggugcuccugacuuucuggcccacgugcggggcagcuccugcuucgaguguacacacuaucagucuuuucuugaauaccgcgagguaguggaugggcuggaaaaagcaauauauaagggaccaggcucggaggcugguccguga

SEQ ID NO: 54678 - RNA, 3702 nt, Artificial Sequence
  derived and/or modified sequence opt3 from COPA__Homo_sapiens__NP_001091868
augcugaccaaguucgagacaaaaagcgccagagugaagggccucuccuuucaccccaaaaggccuuggauccuuacuucucugcauaacggggucauucaguugugggacuaccggaugugcacguuaauagauaaguucgacgaacacgauggaccaguucgcgguaucgacuuucauaaacaacagccgcuguucgugucaggcggggaugacuauaagauuaagguauggaauuacaaacuacgacguugucucuuuacccugcuuggacaccuggauuauaucagaacaacuuucuuucaucacgaguaccccuggauuuugagugcuagcgacgaucagaccaucaggguguggaacuggcagucccggacaugcgucugugugcucaccggccacaaucauuauguuaugugcgcacaauuccacccuacugaagaccugguggucucugccucgcuggaucagacagugcgcguaugggacauaucaggucucagaaagaaaaacuuaagcccaggggcgguugagagugaugugaggggaaucaccggcgucgaccuguuuggcacgacugacgcuguggugaagcauguccuugaagggcacgaucggggaguuaauugggccgcauuccaccccaccaugccuuugauuguguccggugccgacgaucgccagguaaaaaucuggcgaaugaacgagucuaaggcuugggagguggacacauguagaggccauuacaauaacgucagcugcgcaguguuucacccaaggcaggaacugauucuauccaauucagaggauaagaguauccggguuugggacaugagcaaacguacuggggugcaaaccuuccgcagagaucaugacagguuuuggguccucgccgcucaccccaaccugaaucuuuucgccgcgggacaugauggcgguaugauaguguucaagcuggaacgggagcgaccugcauaugccguacacgggaacauguugcacuacguuaaagaccgcuuucucagacagcuggauuucaauucuuccaaggacguggcugucaugcaguuaaggucaggaagcaaauuuccaguguucaacaugaguuacaauccggccgagaacgcaguccugcucuguacacgggcuucuaaccuugaaaauuccaccuaugaccuguacacgauucccaaggaugccgacagccagaacccugaugcgccagagggcaaacgcucgucuggcuugacugccguguggguugcaagaaauagguuugcugugcuagaccguaugcauucccugcucaucaagaaccugaagaaugaaauuacaaagaagguacaaguccccaacugcgaugagaucuucuaugccgggaccggaaaucuucuguugcgggacgcugauucaaucacucucuuugacgugcagcagaaacgaacacuggccaguguuaagauuagcaaagugaaguacgucauaugguccgcagauaugucucacguggccuuacuggcuaagcaugaacacagcuguccucuaccacucaccgcgaucguaauuugcaacagaaaacuggacgcacuuuguaauauccacgagaacauaagggugaagucaggugccugggaugagaguggcguuuucauuuauacgaccuccaaucauaucaaauacgcugucacaacuggggaccacggaaucauucgcaccuuggaucugcccaucuaugugacacgggugaagggcaacaaugucuacugccucgacagagaaugcaggccgcgcguucugacuauugacccuaccgaguuuaaauucaaacuugcccugauaaaccgaaaguacgaugaaguguugcauauggugcggaaugcaaaacucguaggucaaagcaucauugccuaucugcagaagaaaggguaccccgaggucgcuuuacacuuugugaaggacgaaaagacacguuucucucuggcccuagaguguggcaacaucgagaucgcacucgaagcggcuaaggcccuggaugacaagaacugcugggagaaacuuggagaaguugcauugcugcagggcaaucaucagauuguggagauguguuaucaaagaaccaagaacuuugauaaacucucauuccuguacuuaauaacugggaaucuggaaaaacuuaggaaaaugaugaagaucgccgagauucgcaaagacaugaguggacacuaucagaacgcuuuguaccucggugaugucagcgagcgggugagaauccugaagaauugcggccagaagucccuagccuaucugacggcagcuacacacgggcucgacgaagaggccgaaucucugaaagagaccuucgauccagagaaggaaacuauuccugacaucgaucccaacgcgaaacuuuugcagccacccgccccuauaaugccacuggacaccaauuggccguuacucacaguuucgaagggauuuuucgagggcaccaucgcuagcaaagguaaagggggcgcacuggccgcugauauugacaucgacacugugggaacagaaggcuggggagaggaugccgaacuucaacuggacgaggauggguuuguagaggcaacggaagguuugggcgacgaugcgcucgggaagggacaggaggaaggcggugggugggacgucgaggaagaucuggagcuacccccugagcuggacauuuccccaggcgccgcuggaggcgccgaagauggguucuuugugcccccuaccaagggaacuucaccaacacagaucugguguaacaauagucagcuccccguggaccauauacuggcaggcucuuucgagaccgcuaugaggcuuuugcacgaucaagucgguguuauucaguuugggccguacaagcagcuguucuuacagacauacgcccgaggacgcacuaccuaucaagcacucccuugccugccaagcauguacggcuaucccaaccggaauuggaaagacgccggucuuaagaacggcgugccugcuguagggcugaaacuaaaugaccucauccagagacugcaguuguguuaccaacugacgaccgugggaaaguuugaagaggcggucgaaaaguucagguccauuuuacucucagugccccugcuuguuguggauaacaaacaggagaucgccgaggcacagcagcugauaacaaucugccgugaauauauugucggcuugagcguggagacugaacgcaagaaacucccaaaggagacccuggagcaacagaaacggaucugugaaauggcugccuacuuuacacauucuaaucuacagccuguucacaugauucuggugcuuagaacugcccucaaccuguucuuuaaguugaagaacuucaaaaccgcugcaacguucgccaggcgacuguuagagcucgggcccaagccagaagucgcgcagcaaacacggaaaauccuguccgcuugcgagaagaauccgaccgacgccuaucagcuuaacuacgauaugcauaauccuuuugacauaugugcagccaguuaccgccccauuuauagaggaaaaccaguagaaaagugcccccugagcggcgcuugcuacucuccugaguucaaaggucagaucuguagggugacuacaguuaccgagaucgggaaggaugugauuggauugcggaucuccccacuccaguuucgauga

SEQ ID NO: 54679 - RNA, 2862 nt, Artificial Sequence
  derived and/or modified sequence opt3 from COPB1__Homo_sapiens__NP_057535
augaccgccgcugagaacgugugcuacacacugaucaauguccccauggacagcgaaccuccauccgagauuucucucaagaacgaucuugaaaaaggcgacguuaagucaaaaacugaggcacugaagaaagugauaaucaugauuuugaauggggaaaaguuaccgggacugcuaaugacgaucauuagauucguacucccccugcaggaucacaccaucaagaaacuucuguugguguuuugggagauagucccuaagacaacuccagacgguaggcuccugcaugagaugauccuggugugugaugccuaucggaaagaccuccaacaccccaacgaguucauucgcggcaguaccuuacgauuucugugcaaacuuaaagaggcggaauugcuggagccucuaaugccagcuauccgugccugucucgagcauagacacagcuacguuaggcggaaugcagugcuggccauuuauacaaucuaccgcaacuucgaacaucuuauacccgaugcuccugagcugauucacgacuuuuuggucaaugaaaaggaugcauccugcaagagaaacgccuucaugaugcucauccacgcugaccaggauagggcccuggacuauuuaucuaccuguauugaucaggugcagacuuuuggggacauccugcaacucguaaucguugagcuuauuuacaaagugugccaugcgaauccaucggaacgggcacgcuucauacgauguaucuauaaccuguugcagucaagcaguccggccgucaaguacgaggcugccggaacccuagugacacuguccucugcacccacggcuauuaaagccgcggcccagugcuacaucgaccucauaauuaaggagagcgauaauaacgugaaacugaucguccuugacagacugaucgaauugaaggagcacccugcacaugaaaggguucuccaggaucuggugauggacauuuuacggguacuguccacuccagaucuagaggugcguaaaaagacccuccaacuggcucuugacuuggucucaagucgcaauguggaagaacugguuaucgugcucaagaaagaggucauuaagacaaacaaugugagcgaacacgaggauacugacaaauauagacagcugcuuguaaggacccugcacucuuguuccguucgguuucccgauauggccgcuaacgugauaccugucuugauggaguuccucucagacaacaaugaagccgcagccgcugaugugcuggaauuuguccgagaggcgauccagcgcuucgacaacuuaagaaugcugauuguggagaagaugcuagaaguuuuucaugcaaucaaaagcgugaagaucuacaggggcgcccucuggauucugggugaguauugcaguacaaaggaagacauacagucuguaaugaccgagauccggcgcucccuuggggagauuccaaucgucgaaagcgagauuaaaaaggaagcuggagaguugaaacccgaagaggagaucacggugggcccgguucaaaagcuggugacugaaaugggcacauacgccacccagucggcacucucuuccucaagaccuacuaaaaaggaggaagauaggcccccacugcguggguucuuacuggacggagauuucuuugucgccgcuagucuugccacaaccuugacgaagauagcacuccgguauguggcgcugguacaggagaaaaagaaacaaaauagcuucguggcugaagccaugcuacugauggcaaccauccuccaccuggguaaguccucucuuccuaaaaagcccauuacagacgaugacguugaucgaaucagcuugugucugaaggucuuaucagagugcaguccacucaugaacgacauuuuuaauaaagagugcagacagucccugagccauaugcuuucugccaagcuggaagaggaaaaauugucacagaagaaagagagugaaaagaggaacgugacugugcagcccgaugacccuaucagcuucaugcaacucaccgcuaaaaaugagaugaacuguaaggaggaucaguuucagcugucccuacuggccgcaaugggcaauacacagcgcaaggaagcugccgacccacucgcgucuaaacugaacaaggucacucaacuuaccggguucucggauccgguuuacgccgaggcuuaugugcacgugaaucaguacgacauaguauuggacguccuggugguuaaccagacaagcgauaccuuacagaauugcacucucgaacuggcaacgcuuggagaccugaagcuaguggagaagcccuccccucucacacuggccccacaugauuuugcuaacauuaaagccaaugucaagguggcaucaaccgagaacggcaucauuuucgguaacaucguuuacgacgugaguggggcggccucugaucggaauuguguagucuugagcgacauacacaucgauauuauggacuauauccaacccgcuacuugcaccgaugccgaauuuagacagaugugggcagaguucgaaugggagaacaaggugacagugaauaccaacauggucgaccugaaugauuacuuacagcacauucucaaauccacuaacaugaagugucugacaccugaaaaagcucuuucaggauauugcggcuuuauggccgcaaaucuguacgccaggagcaucuucggcgaggacgcuuuggcgaacguuucuauagagaagccaauucaucaggggcccgaugccgcagugacgggacacauccgcauccgagcuaaaucccaagguauggcccucagucugggcgacaagauuaaucuaagccagaagaaaaccucuaucuga

SEQ ID NO: 54680 - RNA, 2721 nt, Artificial Sequence
  derived and/or modified sequence opt3 from COPB2__Homo_sapiens__NP_004757
augccccugagacucgacaucaagaggaaacuuaccgcccggagcgaucgcgugaaguccgucgaccugcacccuacagagccauggauguuggcuucuuuauacaacggcucaguuugcguguggaaucaugaaacucagacgcugguaaaaaccuucgaggugugugaucuaccgguccgagcagccaaguuuguggcgcguaaaaacuggguugugacaggggcugacgauaugcaaauuagagucuucaauuauaacacucucgaaagggugcacauguuugaggcccauagugacuacauacggugcaucgcaguacaccccacccagccuuucauucugacaagcuccgaugacaugcuuaucaagcugugggauugggacaagaaauggucuuguucgcagguuuuugaaggacauacccacuaugugaugcagauugucaucaauccaaaggauaacaaucaauucgccucagcuagcuuggaccgcacuauaaaaguguggcagcucgguaguuccucucccaacuuuacacuggagggccacgagaagggggugaauugcaucgauuacuauagcggaggcgacaaaccuuaccugauuuccggugcagacgauagacucgucaagaucugggacuaucagaacaagaccuguguucagacguuagaagggcaugcccaaaaugugucaugcgcuaguuuccacccagagcugcccauuaucauaacuggaagcgaagauggcaccguaaggauuuggcauucuuccacauaccggcuugagucaacuuugaacuacggcauggagcgcguguggugugucgccagccugcgagggaguaauaacguggcgcuaggauaugacgaagguucuaucauuguuaaacucggcagagaggaaccugcaauguccauggaugccaaugggaagaucaucugggcuaaacacagcgaggugcagcaggccaaccugaaggcaaugggagacgcugaaauuaaagauggcgagaggcuuccacuggccgucaaggacauggguucgugcgagauauacccgcagaccauccaacacaaccccaaugggcgguuugugguaguuuguggagauggcgaauauauuaucuacacagcgauggccuugcguaacaaaucuuucggcuccgcacaggaguuugcuugggcccaugacucaagugaauaugcuauacgcgagagcaauuccauugugaagaucuucaagaacuuuaaagaaaagaaaucuuucaagccugauuucggggccgagagcaucuacggagguuuucuccugggcgucagaucagugaauggguuagcauucuaugacugggacaacaccgagcugauuaggcggaucgaaauucagccaaaacacauauuuuggagugauuccggagagcucgucugcaucgccacggaagagagcuucuuuauucuuaaguaccugucugaaaagguguuggcugcgcaagagacucaugagggcguuacagaagacgguaucgaggaugcauucgaagugcuaggggagauccaggagauuguaaaaaccggccugugggucggagacuguuuuauauacacuucaagugugaaucgacucaacuauuacguuggcggggaaaucgugacaauugcccaccuggaucgcaccauguaucuucugggauacauccccaaggacaauagauuguaucucggugauaaagagcugaacauuaucagcuacuccuuacuggucucugugcuagaauaucagacggcuguaaugaggcgggacuucucgauggccgauaaggugcucccuaccauaccaaaagagcagcgcacaagaguugcacauuuucuggaaaagcaaggcuucaagcagcaggcccuuacugucagcaccgaccccgagcacagguuugaguuggcucugcagcucggggaacugaaaaucgccuaccaacuugcaguggaggcggaauccgagcagaaguggaaacagcuggcugaauuggccauuucaaagugccaguucggacucgcacaagagugccugcaccaugcccaggauuacggcgguuuacugcuacucgcuacagccagugggaaugcaaacauggugaauaaacuggcugagggcgccgaacgugacggaaagaacaaugucgcguuuaugucuuauuuccuucagggcaagguugaugccuguuuggagcugcucauccggacugggcgacugccggaagcugcauucuuagccagaaccuaccugccuagccagguguccagggugguaaaacuuuggcgcgagaacuugucaaaggucaaccaaaaagcugccgaaagccucgcagaccccacagaguaugagaaucuguuuccaggacuaaaggaagcguucgugguugaggaaugggugaaagagacccacgccgaccuguggccugcuaagcaguacccccucgucacuccaaacgaggaacggaaugugauggaggaagguaaagauuuucagcccucuagauccacggcccaacaggagcuggacggcaagccugcaaguccaacaccgguuauuguggcuagccauaccgccaacaaggaagagaaaucucuuuuggagcuggaaguagauuuagacaaucucgagcuggaagauaucgacacuaccgauauaaaccuugacgaggauauucuggacgauuga

SEQ ID NO: 54681 - RNA, 927 nt, Artificial Sequence
  derived and/or modified sequence opt3 from COPE__Homo_sapiens__NP_009194
auggcucccccugccccaggcccggcaagcgggggauccggugagguggacgaacuguucgaugucaagaacgccuuuuacaucggcucuuaucagcaaugcauuaaugaggcgcagagaguuaaacucucaagucccgaaagggacguggagcgggauguauuccuuuaccgcgcuuaucuggcccagcgaaaguuugggguggucuuggacgaaauaaaaccuagcuccgcaccagaguuacaggccgugcguauguucgcugauuaccuggcacacgagucuagaagggacucgaucguugccgaacuagaucgggagaugucacgcagcguggacgucaccaacacaacuuuucuccugauggcugccaguauuuaucuucaugaucaaaaucccgacgcggcacugagagccuugcaccagggagauucccucgaauguacggcuaugaccgugcagauccugcugaagcucgacagguuagaucuggcccggaaagagcuuaagcgcaugcaggacuuggacgaggaugcaacacugacucaacuagcuaccgccuggguaucucucgcgacaggcggugaaaagcugcaggacgccuacuauauuuuccaggagauggcagauaaaugcagcccuacccuucuguugcucaacgggcaggcugccugucauauggcucaaggacgaugggaagccgcagagggccuguuacaggaagcccuggacaaggauuccggcuacccagagacucucguuaaucuuaucgugcugucacagcacuuggggaaacccccugaggucacaaacagauaccuaagucaacugaaggacgcucauaggagccacccauuuauaaaagaauaucaggcgaaggagaaugauuucgaccggcucgugcugcaguacgcaccgucugccuga

SEQ ID NO: 54682 - RNA, 2181 nt, Artificial Sequence
  derived and/or modified sequence opt3 from COPG2__Homo_sapiens__NP_001276962
augaucaagaaauucgacaagaaagaugaggaaagcggcuccgggucuaaccccuuucagcaccuggagaagucagccgugcuccaagaagcuagaauuuucaaugagaccccuauaaacccaaggcggugccuucauauccugacaaaaauuuuguacuuacugaaucagggagaacacuuugguacuacggaggcaaccgaggccuucuuugcgaugacacgccuauuccagaguaacgaccagacucuccgacguauguguuaucugaccaucaaggaaauggcuacaauuagcgaggaugucaucauaguuaccuccucucuuacuaaggacaugacaggcaaagaagauguguacagagggccggccaucagggcacugugccggauuaccgacggaacgauguugcaagccaucgagcgcuauaugaagcaggcuauuguagauaaagugucgucagucagcaguuccgcacucgugucuagccugcauaugaugaagaucuccuacgacguugugaaaagauggauaaaugaggcccaggaagcugccucaagugauaacauuaugguccaguaucacgcgcugggcgugcucuaccauuuaaggaagaaugaccggcuggcaguaagcaagaugcuuaacaaauuuacuaagucugguuugaaaucccaauucgccuauuguaugcugauccgcauugcuucacgacuacucaaggagaccgaagaugggcacgagagcccccuguuugacuucaucgaaaguugccuuagaaauaaacacgagaugguuaucuacgaggccgcaucugcuauuauacaucugccuaacuguacagccagggaauuggcgccagccguguccguccuccagcuguuuugcagcucgcccaagccugcauuacgguacgcugccgugcguacucugaauaaaguggcuaugaagcacccaucugccgucaccgcauguaaccucgaucuugagaaucugaucacagacuccaaccgcucaauugccaccuuggcuaucacgacucuacugaagacaggaagugaaagcuccguugacagacucaugaaacagauaucuagcuucgugucagagauuagugaugaauuuaagguaguggucgugcaggcgaucuccgcacugugccaaaaauaucccaggaagcauagcguuaugaugaccuuccuuucuaauaugcugcgggacgauggcggcuucgaguacaaacgagccaucguggacuguauuaucucaauugucgaggaaaacccugagaguaaggaagcuggguuggcccaccucugcgaguuuauagaagauugugagcacacugugcuggcaacaaagaucuuacaucugcuaggaaaagaggguccacgcaccccgguacccagcaaguauauuagauucaucuuuaacaggguugugcucgaaaaugaggccguccgggcugccgcaguguccgcgcuggcuaaauucggcgcccagaacgaaucucuuuugccuucgauccugguccuccugcagcgcugcaugauggacacggaugacgaggugagagauagggcaaccuuuuaccuuaauguucugcaacagcgucagauggccuugaacgcuacauauauuuucaaugggcucacugugagcguaccaggaauggagaaggcccugcaccaguacaccuuagaacccuccgagaaaccuuuugacaugaagucaauaccacuggcaauggcucccgucuucgaacaaaaggccgagaucacucuaguggcgacaaaaccggaaaagcucgccccuagucggcaggauauuuuucaggagcagcuggcugcaauccccgaguuccuuaacauuggcccauuguuuaaaucuagcgaaccuguucaacugaccgaggccgaaacagaguauuucgugcgaugcaucaagcauauguuuaccaaucacauagucuuccaguucgacuguacuaacacgcucaaugaccagcuguuagaaaaagugacaguacagauggagcccuccgauucauacgaggugcugagcugcaucccagcucccucucuuccuuacaaccaaccagguauuuguuauaccuugguuagacucccggacgaugaccccacugccgggaccaauccucagaagggaggcgauacauga

SEQ ID NO: 54683 - RNA, 555 nt, Artificial Sequence
  derived and/or modified sequence opt3 from COPRS__Homo_sapiens__NP_060875
auggaccugcaggccgcuggcgcacaagcccagggggcggcugagcccagcagaggaccuccacucccguccgccaggggugcacccccuucuccagaagccggcuucgcuaccgcagaucacucaagucaggagcgggaaacagagaaggccauggaccgccuugcucgagggacucagagcauccccaacgauuccccugcccguggagaaggcacgcauucugaggaggaagguuuugcgauggacgaggaagauucggacggggagcugaauaccugggaguugucagaaggaacaaacugcccacccaaagagcaaccuggcgauuuauucaaugaagacugggauagcgagcugaaggcagaccagggcaacccauacgaugccgacgauauucaggaaaguauaucccaggagcuaaaaccguggguguguugcgcuccccaaggggacaugaucuaugacccuucuuggcaccauccacccccucucauuccauacuauagcaagauggucuuugagacuggacaguucgaugacgccgaagauuga

SEQ ID NO: 54684 - RNA, 1353 nt, Artificial Sequence
  derived and/or modified sequence opt3 from COPS2__Homo_sapiens__NP_001137359
augagcgacauggaggaugacuucaugugcgaugacgaagaggauuacgaccuggaauauuccgaggauucuaacucagaacccaauguggaccucgagaaccaguacuauaauaguaaggcccuuaaagaggaugacccuaaggcugcacugagcuccuuucaaaaagucuuggaauuagagggcgaaaagggggaguggggauucaaagcccugaagcagaugaucaagauuaacuuuaaacuaaccaauuucccagagaugaugaacagauacaagcagcuccugacauauauaaggucugcgguuacucggaauuacucggaaaaaucaaucaacagcauucuugauuauaucaguacguccaagcaaaauucugacuuucugugucaaauggauuugcuccaggaguucuacgaaaccacacuggaggcucugaaagacgccaagaacgaccgccucugguuuaagacuaauaccaaauuagguaagcuguaccuugaacgagaggaguauggcaaauugcagaagauucugcgucagcuacaccaaagcugccagacagaugacggggaagaugaccucaaaaagggaacccagcugcuugagaucuacgcacuggaaauacagauguauacugcccagaaaaacaauaagaaguugaaagcucucuacgagcagucccugcauaucaagucagcaauuccgcaccccuuaaucaugggcgugauuagagaauguggugggaaaaugcaucugagggagggagaguucgaaaaggcccacacagacuuuuucgaggcuuuuaaaaacuaugaugaaaguggcagcccucggcgcaccacgugccucaaguaccuuguacuggccaauauguugaugaagucuggcaucaacccauucgauucccaggaggcgaaacccuauaagaacgacccugaaauacuagcaaugacuaaucuggugucagccuaccaaaacaaugauauuaccgaguuugagaaaauccucaagacaaaccauagcaauauuauggacgauccauucaucagagaacacaucgaggaacugcuuaggaacauucggacucagguccugauaaaauugaucaagcccuacacccgcauucacaucccuuucauaaguaaggagcucaauauugacguggcugacguugagucucuguuagugcaguguauccuggauaacacaauccaugggcgaauugaccaggucaaucaacuacucgaacuggaucaccagaaaagaggaggugccagguauaccgcacuugacaaguggacgaaccaguugaacucccugaaucaggcugugguaagcaaacucgccuga

SEQ ID NO: 54685 - RNA, 1212 nt, Artificial Sequence
  derived and/or modified sequence opt3 from COPS3__Homo_sapiens__NP_001186054
augacccagcugugcgagcucaucaacaagagcggcgaacuucuggccaaaaauuugucccacuuagacacagugcugggggcucuagauguccaagagcauucucucggaguucuggcagugcuuuucguaaaguuuucaaugcccagugugccugacuucgaaacucuguuuagccagguccaguuguucauuuccacguguaacggugagcacauaagauacgccaccgauacauuugcgggccucugccaucagcugacuaaugcucugguggaaaggaaacaaccacuccgggggaucggaauuuuaaagcaggccaucgacaaaaugcagaugaacaccaaucagcugacaucuauucacgcagaucuuugucaauugugccugcuagccaaguguuucaagccggcucuccccuaucuggacguugauaugauggacaucugcaaagagaacggcgcauacgaugccaagcauuuucuuuguuauuacuauuacggugggaugauauauaccggacugaaaaauuucgagcgcgcuuuguacuuuuacgaacaggccaucacuaccccugcgauggcagugucgcacauuaugcucgagucauauaagaaauacauccuggucagcuuaauucugcucggcaaggugcagcagcuuccaaaguauacaagucaaaucguaggccgauucauaaaaccccuguccaacgccuaccacgaauuggcucagguuuauucuacgaauaacccuagcgagcuacguaaucuggugaacaagcauuccgagacuuuuaccagagacaauaacauggggcucgucaaacagugccugucaagucuuuacaagaaaaauauucaaaggcugacaaagacuuucuugacccucagccugcaggauauggccucucgggugcaguuauccggaccacaggaagcagagaaauaugugcugcacaugaucgaagacggugagauuuuugcuucaaucaaccaaaaggauggcauggucagcuuccaugacaaccccgaaaaguacaauaacccugccaugcuacacaauaucgaccaggagaugcucaaauguauugagcuggaugaacgccuuaaggcgauggaccaggagauaacaguuaacccacaguucgugcagaaaaguauggggucucaagaagaugacuccggaaauaagccgagcucguacucuuga

SEQ ID NO: 54686 - RNA, 1059 nt, Artificial Sequence
  derived and/or modified sequence opt3 from COPS4__Homo_sapiens__NP_001244935
auggccgcugcagugagacaggaccuggcccaacucaugaacagcuccggcucucacaaggaucuugcggggaaauacaggcagauccuggagaaggcuauucaguugucaggagccgaacaguuagaggcacugaaagccuucgucgaagcuaugguuaaugagaacgugagucuaguaauaagccggcaacuccugaccgacuuuugcacacaucuucccaaucugccugauuccacugcaaaggaaaucuaucacuucacguuggagaaaauucagccacgcgugaucucuuuugaggaacaggucgccucgauucgacagcaucucgcuucaaucuacgagaaggaagaggacuggcguaacgccgcgcaagugcugguugguauaccgcuggagaccggccagaagcaguauaauguggauuacaaacucgaaacauauuuaaagaucgcaagacuguaccuugaggacgaugaccccguccaggccgaggcuuauauuaacagggccagcuugcugcaaaaugagaguacuaacgaacagcuacagauccacuacaaaguguguuacgcacggguacucgauuaucgcagaaaguucauugaggcugcccaaagguacaaugagcuguccuauaaaaccaucguucaugaaucugagcggcuugaagcgcugaagcacgccuugcacugcacaauacucgcaagcgcugggcagcagcgcucccgaaugcuggccaccuuauuuaaggacgagagaugucagcaacuggcugccuacggcauucucgaaaagauguaucuugauaggaucauucggggaaaccagcugcaggaguucgcagccauguugaugccucaucagaaagcuacuacagcggacgguucaaguauccuagaucgugcagugaucgagcacaaucugcucagcgccucuaaacuguacaacaauauuaccuuugaagaacuuggggcucuguuggaaauaccagccgcaaagcaugagaaacccugccaacgcggaaucuccagaucaaaccacuucgucagcaaguga

SEQ ID NO: 54687 - RNA, 1005 nt, Artificial Sequence
  derived and/or modified sequence opt3 from COPS5__Homo_sapiens__NP_006828
auggccgcuagcggcuccgggauggcacagaagaccugggagcuggccaacaauaugcaagaagcgcagucuaucgacgagauuuacaaauaugauaagaaacagcagcaagaaauacucgcugccaagcccuggacaaaagaccaccauuacuucaaguauugcaagaucucagcacuugcccuguugaaaauggugaugcacgcuagaaguggagguaacuuagaggucaugggccugaugcuagggaagguugauggagaaacuaugauuaucauggacagcuuugcacucccuguggagggcacggagaccaggguaaaugcccaggcugccgcguacgaauauauggcagccuacauugagaacgcuaaacaggugggucggcuggaaaaugccaucgggugguaucauucccacccaggauacggcuguuggcuuucuggcauagaugucucgacacagaugcugaaccaacaguuccaggagccguuuguggcaguugugaucgaccccacucgcaccauuucagcugggaaggucaauuugggagccuuccgaacauacccuaaagguuauaagccacccgaugagggcccuagcgaauaccagaccaucccacucaacaagauugaggacuuuggggugcauugcaaacaauauuacgcgcuggaaguaaguuauuucaaguccucucuggaucguaaacucuuagagcugcuuuggaauaaguacuggguuaacacuuugagcuccucaagucugcuaacaaaugccgacuauaccacgggacagguguuugaucucagcgaaaaacuggagcagucugaggcacaacuuggcagagguuccuucaugcugggguuggaaacucacgacaggaagucagaggauaaacucgcuaaggccacccgggacagcuguaagacaacuaucgaagcuauacacggacugaugagucaggucauuaaagacaaguuauuuaaccagaucaauauuucuuga

SEQ ID NO: 54688 - RNA, 984 nt, Artificial Sequence
  derived and/or modified sequence opt3 from COPS6__Homo_sapiens__NP_006824
auggccgcugcagccgcggcugccgcagccaccaacggcacagggggaagcuccgguauggagguggacgcugcagucguucccucugugauggccugcggcguaacugggucagugagugucgcucugcacccucucgugauccuuaauauuagcgaucauuggauaagaaugaggucccaggaaggacggccaguucaagugaucggcgcccugauugguaagcaggaggggcgcaacaucgaagucaugaacucuuucgaguuguuaucgcacacgguggaagagaaaauuaucauagacaaggaguacuauuacaccaaagaggaacaguuuaagcagguauucaaagaacuggaguuucuaggaugguauacaacuggcggcccgcccgauccuucagacauccauguucacaagcaagugugugagauuaucgaaagcccacucuuccugaaacuuaaucccaugaccaagcauacagaucugccugucaguguguuugaguccgugauugacaucauaaauggggaagcgaccauguuguucgcagagcucacuuacacacuggccaccgaagaggcugagcgaauuggagucgaucacguugcccguaugacggcaacugguucuggcgaaaacagcaccguggcugagcaccugaucgcccagcauuccgcgauuaagaugcuccacucaagaguaaaauuaauccuggaauaugugaaggccagugaggcaggggaagucccauuuaaucaugagauccuuagggaggcuuacgccuugugccacugucugcccgugcuaagcacagacaaauucaagacugauuuuuaugaccagugcaacgauguuggacucauggcuuaccugggcaccauuacaaagaccuguaauacgaugaaccaguucgugaauaaauuuaacguccuuuacgaccggcaagguauagggcgcagaaugaggggacuguucuuuuga

SEQ ID NO: 54689 - RNA, 828 nt, Artificial Sequence
  derived and/or modified sequence opt3 from COPS7A__Homo_sapiens__XP_005253752
augagcgccgaggugaaggucaccggccagaaccaagaacaguuccugcuccuugcuaaauccgcaaagggggccgcgcuggcuacauugauccaccagguuuuagaggcccccggaguguacguauuuggugaacugcuagacaugccuaaugugagagagcucgcagaaucugauuucgccucaacuuuuaggcugcuuacggucuucgcuuauggcaccuacgcagacuaucuggccgaggcucggaacuugccaccgcucacagaggcccagaaaaauaagcugcgccaucugagugugguuacucucgcggcaaaagugaagugcauucccuacgccgucuuacuggaagcucuugccuugcgaaacgugcgucaacuggaggaucuaguaauagaagcaguuuaugcugacgugcucagagggagccuggaucagaggaaucagcggcuugaggucgacuacuccaucggacgcgauauucagagacaagaccugucugccaucgcgaggaccuugcaggaguggugugugggcugcgaagugguccucucggguauugaggaacagguuucacgggccaaccagcacaaggagcaacagcugggguuaaaacagcaaaucgaaagcgagguggcaaaucugaagaaaacaauaaagguaaccacugcugccgcugccgcagccacaagucaggauccugagcagcaucucaccgaacuucgcgagccagcucccggaacgaaccagcgacaaccuuccaaaaaggcgucuaagggcaaaggccugagagggagcgcaaagaucugguccaaaucaaauuga

SEQ ID NO: 54690 - RNA, 630 nt, Artificial Sequence
  derived and/or modified sequence opt3 from COPS8__Homo_sapiens__NP_006701
augcccguggccgucauggcugagagcgcauucuccuuuaagaaacugcucgaccagugcgaaaaccaagagcuugaagccccuggcgggaucgcgaccccaccgguuuacggacagcuguuggcuuuauaucugcuacacaaugauaugaacaaugccagauaccucuggaagaggauucccccugcaauaaaaucugccaacucagagcuggguggcaucuggaguguggggcagcggauuuggcagcgcgacuucccaggaaucuauacaacuauuaaugcucaucaauggagcgaaacgguacagcccaucauggaggcacuucgagaugccacccguagaagggcuuuugcccuggugucccaggcguacacaucuauaaucgcagacgauuucgccgcuuuugucggcuugccuguggaggaagccguuaaggguauucucgagcagggguggcaagcagacucgacuacccggauggugcugccacgcaaacccgucgcuggagcccuggaugugucauucaacaaguuuaucccucucagcgaaccagcgccgguacccccuauuccaaaugagcagcaguuagccagacugacagacuauguugcauuccuugagaacuga

SEQ ID NO: 54691 - RNA, 633 nt, Artificial Sequence
  derived and/or modified sequence opt3 from COPZ2__Homo_sapiens__NP_057513
augcagagacccgaggccuggccuaggccacacccgggcgaaggggcugcagccgcgcaagcuggaggucccgccccuccagcacgggccggcgagcccagcgggcugcgccuccaggaaccuucccuuuacaccaucaaggcuguguucauucuggacaacgauggacgacguuuguuagcaaaauauuacgacgauacauuuccaucuaugaaggagcagauggucuucgagaaaaauguuuuuaacaagacuucaagaacggaaagugagauagccuucuuuggcgguaugaccaucguguauaaaaauagcauugaccuguuccuauacguagugggguccucuuaugaaaacgagcucaugcugaugucgguccuuacaugccuguuugaaucauugaaucauaugcucaggaagaacguggagaagcgguggcugcuggagaauauggauggagcuuuccucguuuuagacgaaaucguggauggcggcgucauucuggagagcgacccccagcaagugauccagaaaguaaacuuucgcgccgaugacgggggacuuacugaacagaguguugcacagguguugcaauccgcgaaggagcagauaaaauggucucugcuaaaguga

SEQ ID NO: 54692 - RNA, 1266 nt, Artificial Sequence
  derived and/or modified sequence opt3 from COQ2__Homo_sapiens__NP_056512
augacccccaucagccaggugagaaugaggaagggcuccgcccacacagcugcacaaccugggcggcugggacuccauccagccggugcgacugcucacgccugccgcggcaugacgucuauucgagcacguccggggcuuaccucagccaugcugggaaguagagcugcaggcuucgccagggguuugcgggcugucgccuuagcguggcugcccggguggcgcggaaggagcuuugcacuagccagagcugccggcgcaccucauggcggggaccuccagccacccgcuuguccugagccacggggacgccagcugucccuuucugccgcggccguuguggauucggcaccccgaccucugcagccauacuugagacucaugaggcuggacaaaccgauagguacauggcugcucuauuuacccugcacuuggucaaucggccuggcugccgaaccuggguguuucccagauugguacaugcuuagcuuguuuggaaccggcgcuauucugaugcggggugccgggugcacaaucaacgacaugugggaucaagacuaugauaagaaaguaacccguacugcaaaucgccccauugccgcuggagacaucaguacauuccaguccuuuguguuccuaggcggccagcucacccuggcgcuugggguccuguugugucucaacuacuauucuauagcacugggagccgguagcuuacugcucgugaucacguacccucuuaugaagagaauuuccuauuggccacagcuggcuuugggccuaacuuuuaauuggggagcccugcucggguggucagcaaucaaaggcaguugcgaucccagcguuugucugccgcuuuacuucucuggugugauguggacccugauuuacgacacaaucuaugcccaccaagauaagagggacgaugucuugauagggcucaaguccacugcucugcgguuuggcgagaacaccaaaccuugguuaucaggauucagcguggccaugcugggcgcacuaagucucguagggguuaauucuggacagacagcgcccuacuaugcugcccugggugcagugggcgcccaucuuacccaccagauuuacacguuggacauccaccgaccagaagacugcuggaacaaguuuauuuccaaucgcacucuggggcucaucgucuuccugggaaucgugcuuggcaaccuguggaaagagaagaaaacagauaagaccaagaaagguauugaaaauaagauagagaacuga

SEQ ID NO: 54693 - RNA, 1110 nt, Artificial Sequence
  derived and/or modified sequence opt3 from COQ3__Homo_sapiens__NP_059117
auguggagcggcagaaagcuaggguccucuggagguugguuccucagggugcuuggccccgggggaugcaacaccaaagccgcucggccucugaucucaagugcagucuacguuaagaaucaguugagcggcacauuacaaauuaaaccagguguguuuaacgaguaucgcacuauaugguucaaguccuaccgaacgaucuuuucuugucugaaucguauuaaaucguucagauauccgugggccaggcuauacucaaccagccagacaacuguagacaguggggaagugaagaccuuucucgcgcuggcucacaaguggugggaugagcagggagucuaugcaccccuucauuccaugaacgaccugcgggugccuuucauccgcgauaauuugcucaaaacaauuccaaaccaccagcccggcaagccucugcugggcaugaaaauccucgacguugggugcggagguggcuuacugaccgaaccacuugggagauugggagccucugugauaggcaucgaucccgucgacgagaauauuaagacugcccaaugucauaagagcuuugauccugugcuggacaaaaggaucgaauaccggguaugcucccuagaggagauuguugaagagacagcugaaaccuucgaugcaguggucgccucagaggugguggagcacgucaucgaccucgaaacguuucugcaguguugcugucagguucuuaagccaggugggagucuguucauaacuaccauuaacaaaacacaguugagcuaugcucucggaaucguguuuucugagcaaauugccuccaucguaccgaagggcacucauaccugggaaaaauucgugucacccgagacacuggaaagcaucuuagagaguaauggccugucuguccagaccgugguugggaugcucuacaacccuuuuuccggauacuggcacuggagcgagaauacgucgcuuaacuaugcggcauacgccgugaagucucgcguccaggaacacccagcuuccgccgaguucgugcugaaaggugaaacugaggaauugcaggcaaaugcuugcacaaaccccgccguacaugagaagcugaaaaaguga

SEQ ID NO: 54694 - RNA, 798 nt, Artificial Sequence
  derived and/or modified sequence opt3 from COQ4__Homo_sapiens__NP_057119
auggccacccugcucagacccgugcuuaggcggcugugcggcuugccuggguuacagcgcccagcugcagagaugccgcugcgagcccguagcgacggagcggguccccuauacucccaccaucucccuacaucuccacugcaaaaggcccuucuggcugcaggcucagccgcuauggcauuguauaaccccuacagacacgauauggucgccguucucggggaaacuacgggacauaggacccugaaagugcugcgggaccagaugcgcagagauccugagggcgcucagauccuccaggaaaggccacggauuaguacaagcacuuuagaccuggguaaacuucaauccuugcccgaggggucucugggacgcgaauaucuacgauuccucgauguaaauagagugucgccugacaccagggccccaacacgguuugucgaugacgaggagcuggcguacgugauacagcguuaucgcgaaguucacgauaugcuucauacccuguugggcaugccgacuaacauccucggcgagauuguggucaagugguucgaagcagugcagacagggcugcccauguguaucuuaggagccuuuuucgguccuauuagacugggcgcucagucacuccaaguacuuguuagcgagcugaucccaugggccgugcagaaugggaggcgggcacccugcgucuugaaccuauacuaugagcgacgcugggaacagagucugagagcucucagggaggaacugggaauaaccgccccuccaaugcacgugcagggccuugcguga

SEQ ID NO: 54695 - RNA, 984 nt, Artificial Sequence
  derived and/or modified sequence opt3 from COQ5__Homo_sapiens__NP_115690
auggccgcucccggcagcugcgcacugugguccuacugugggagaggauggucuagggccaugcgggguugccagcuccuuggccugcgcucaaguuggccuggggacuuguuaagcgcgcgacugcuaucccaagagaagcgugcugccgaaacccacuucggauuugagacagugucugaagaggaaaaaggcgguaaggucuaucagguuuucgagucgguggccaaaaaguacgauguaaugaacgacaugaugucacucgggauccauagaguguggaaagaucugcuucuguggaagaugcacccauugccgggaacucagcuccuggacgucgcaggcggcacgggggauauugcuuuuagguuccugaauuaugugcagagccaacaucagcggaagcagaaacgccagcucagagcacaacagaacuuaaguugggaggaaauagccaaggaguaccagaaugaagaggacucccugggagguucuaggguuguggucugugauaucaacaaagagaugcuuaaggugggcaaacagaaggcuuuggcccaaggguaucgggcgggacuggcauggguacuaggcgacgccgaagaacuccccuuugaugacgauaaguucgacauuuacaccaucgcuuuugguauucgcaauguuacacacaucgaucaggcccugcaggaagcacaucgagugcuuaaaccugggggaagauuccugugcuuggaguuuagccaagucaacaauccacucauauccaggcuguaugacuuauacucauuccaggugauccccgugcugggcgaagucauugcuggcgacuggaagaguuaccaguaucucguugagagcauccggcguuuuccuucucaggaggaguucaaagauaugauugaggacgccggguuucacaaggugacuuacgaaucccuuaccucaggaaucguagcgauacacagcgguuucaaacuguga

SEQ ID NO: 54696 - RNA, 1407 nt, Artificial Sequence
  derived and/or modified sequence opt3 from COQ6__Homo_sapiens__NP_872282
auggccgcuagacugguguccaggugcggcgcaguccgggccgcgccccacuccgggccucucguuucuuggcgccgauggucaggagcuaguaccgacacaguguacgauguaguggucagcgguggcgggcuugugggagccgcaauggccugugcucugggcuaugacauccauuuccacgauaagaaaauuuuguuacuggaggcagguccaaagaaaguucuagaaaagcucuccgagacuuacucuaaccgugugucgucaauaagcccggggagugccacgcugcuuuccucuuuuggagcuugggaccauaucugcaauaugagauauagggccuuccggcgcaugcaggucugggaugcguguagcgaagcacugauuauguuugacaaagauaacuuggacgauaugggcuacaucguggagaaugacguaauuaugcacgcccucaccaagcaacuggaagcuguuuccgauagagugacaguccuguauaggucaaaggccauccgguacacuuggcccugcccuuucccaauggcagacaguagccccugggugcauauaacccucggcgaugggucuacauuucagaccaaauuacugaucggagcugacggucacaacuccggcgugcgccaggccgucgggauucagaauguuucauggaacuaugaccaaagcgcggugguagccacucuucacuugagugaggcaacagagaauaacguggcuuggcagcgauuccugccuucuggaccaaucgcccuacucccccuguccgauacccuuagcucgcuggucuggucuacgucccaugaacacgcugccgaguuggugucaauggacgaagagaaguuuguugaugcagugaauagugccuucuggagcgacgcugaucauacugacuuuauugauaccgcgggcgcaaugcuccaguacgccgucucccuguuaaaaccuacaaaggugucugcuagacagcugccaccgagcguagccaggguugacgcaaaaucacggguccucuucccccuuggucuggggcacgccgcugaguacgugcguccucgcguggccuugaucggagaugcagcgcacagaguccauccacuagcuggccaaggcgugaacaugggguuuggagacauaaguucccuggcccaccaucucagcacugcagccuucaaugguaaggaucugggcucuguuucacaccuuaccggguaugaaacagagaggcagcggcauaacaccgcucuguuggccgcaacggaccuccugaagcgauuauacaguacuagcgcuagcccccuggugcuacuccgcacauggggacugcaggccaccaaugcgguaucuccucuuaaagaacagauuauggccuuugcuucgaaguga

SEQ ID NO: 54697 - RNA, 540 nt, Artificial Sequence
  derived and/or modified sequence opt3 from COQ7__Homo_sapiens__NP_001177912
augacccuggacaacaucagcagagccgcuguggauaggauuauacgggucgaccacgcaggcgaguacggggccaaucgcaucuaugcgggacagauggcuguucucggucgaacauccgugggccccguaauucaaaagaugugggaucaggaaaaagaccaucuuaagaaauucaacgagcugauggugacuuuucgugucagaccuacgguguugaugccauuauggaauguucugggguucgcccuaggagcaggcaccgcccuccuggguaaggaaggggcuauggcaugcacaguggccgucgaggaaucuaucgcucaccauuacaacaaucagauuaggacucuuauggaggaggauccggaaaaauaugaggaacuguugcagcucaucaagaaguuucgggacgaggagcuggaacaccaugauauaggacuggaccacgaugccgagcucgcgcccgcauacgccguguuaaaaucaaucauucaagcuggcugucgcguagccaucuaucugagugaaagacuuuga

SEQ ID NO: 54698 - RNA, 957 nt, Artificial Sequence
  derived and/or modified sequence opt3 from COQ9__Homo_sapiens__NP_064708
auggccgcugcagccgugagcggcgcgcuggggagagcuggauggaggcuccuucagcugcggugcuugcccgucgcccgcugucgacaagcauuaguuccucgugccuuccacgcuuccgcagugggucugagaucuucagacgaacagaagcagcagccaccgaacaguuuuagccaacagcauuccgaaacccagggcgccgagaaacccgauccugaaucuucgcacucaccacccagguacacagaccaagggggagaggaagaggaggauuaugaaagcgaggaacagcuacagcaucggauccucacugcugcccuggaguucguaccugcgcacggcuggacggcagaggccauugcugaaggugcccagagucuugggcuguccucugcagcugccagcauguuuggaaaggacggcuccgaguugauacuccauuucgugacccagugcaauacacgccugacuagaguccuggaagaggaacaaaaacucgugcaguuaggccaggcggagaagaggaaaaccgaucaauuucugcgggacgccguugagacacgccuucgaauguugaucccauacauugaacacuggcccagagcacugucaauccuaaugcucccucacaacauuccaaguagccugucucuucugaccuccaugguggaugacauguggcauuaugcuggggaucagucaacugacuucaauugguacacaaggcgggccauguuggcugccaucuauaacaccacggagcucgucaugaugcaggauagcaguccggacuuugaagauacuuggcguuuccuggagaaucgcgugaacgacgcaaugaauaugggacacaccgccaagcagguaaagucuacaggugaggcuuuaguucaaggccugaugggggcggcagugacucucaaaaaccuuaccggacugaaucagagaagguga

SEQ ID NO: 54699 - RNA, 3129 nt, Artificial Sequence
  derived and/or modified sequence opt3 from CORIN__Homo_sapiens__NP_006578
augaagcagagccccgcccuggcuccugaggaaagaugcaggcgggcaggcuccccaaaaccggugcuccgcgccgacgauaacaauauggggaacggauguucucaaaagcucgcgaccgcuaaucuguugcgauucuuacugcuaguccucauccccugcauuugugcccugguucuucuguuggugauacuccugucauacguagguacacugcagaaaguguauuuuaagaguaacggcagcgagccucucgucacugacggggaaauccagggauccgaugugauuuuaacgaauaccaucuacaaccagucuacaguugugucgacugcacacccagaccaacauguccccgccuggaccacagaugcuucacugccuggcgaccagagccaccguaauaccagugcaugcaugaacauuacucauucccagugucagaugcuuccauaucacgccacauugacuccccugcuaucugugguaagaaauauggagauggaaaaauuccucaaguuuuucacguaccugcauaggcuuagcugcuaucaacacaucaugcuguuugguuguacuuuggcuuucccugagugcauaaucgauggggacgauucccacggacuccugccaugucggucauuuugcgaggccgcgaaggaaggcugugagaguguuuuaggcauggugaacuacagcuggccggacuuccugcgcugcucucaguuuagaaaucagaccgaauccucaaacgucagcaggauuugcuucaguccccagcaagagaaugggaaacagcuccuuuguggacggggugagaacuuucugugcgcaucuggcaucuguauuccugggaaguugcagugcaauggauauaacgauugugacgauugguccgacgaagcccauugcaacuguagcgagaaucuauuccacugccauacaggcaaaugucugaacuacucgcucgugugcgacgguuacgaugacuguggggaucugucugacgaacaaaauugcgauugcaacccaacuaccgagcaccgcuguggagacggccgaugcaucgcuauggaaugggugugugauggcgaccacgauugcgucgacaaguccgaugagguuaauuguucaugccauagucaggggcuuguggaguguagaaacggacagugcauacccagcacauuucagugugacggugacgaagauugcaaagacggcuccgaugaggaaaauuguucuguaauucaaaccagcugccaggagggggaccagaggugccuguauaacccuuguuuggauucaugcggaggcaguucccucugugacccaaauaacagccugaauaacugcucucagugugaacccaucacguuagagcugugcaugaaucuaccguacaacucaaccaguuauccuaauuacuucggucaccggacacaaaaggaggccagcauuuccugggaaucuucgcuuuuccccgcacuggugcagaccaacuguuauaaguaccuuauguuuuucagcugcacuaucuuggucccaaaaugugaugugaacacaggggagcauaucccucccugccgugcucugugugaacacuccaaggagcgcugcgaaucaguucucggcauugugggacugcaguggccagaggacaccgauugcagucaguuucccgaggaaaauucugacaaccaaacgugucuuaugccugaugaguaugucgaagagugcagcccaucccauuucaaauguagaucaggccagugcgugcuggccagcaggcggugugacgggcaggcggauugcgacgacgauucugacgaggaaaauuguggaugcaaggagcgagauuugugggaauguccguccaacaaacagugccucaagcacaccguaauaugugacgguuuucccgauugcccugacuacauggaugagaaaaauugcaguuucugucaagacgaugaacuggagugcgccaaccacgcauguguuagccgcgacuuauggugcgauggcgaggcugacuguucugauuccucagacgaaugggacugcgugacacugaguaucaaugucaacagcucguccuuucuaauggugcauagagccgcuacugagcaccaugucugugccgauggguggcaggaaauucucucucagcuggcaugcaagcaaaugggacuuggcgagccaagcgugaccaaguugauccaggaacaggagaaagagcccagguggcugacacuccacucaaauugggaaagucugaacgguacuaccuuacacgagcugcuuguuaaugggcaguccugugaaucucggagcaagauauccuugcucugcacaaaacaagacuguggccgcagaccugccgcuaggaugaacaagcguauucugggaggccggaccucacgaccagggagauggcccuggcagugcagccuacagagugagccgucuggacauaucugcgguugugugcugaucgcgaaaaaguggguacucacugucgcacacugcuucgaaggcagggagaaugccgcuguguggaagguugugcuggggauuaacaaucuugaucauccuuccgucuuuaugcagacgcgcuucgugaaaacaaucauuuugcacccacgguacagcagagccguaguggacuaugauauaucgaucguugagcugucagaagacauuucugagaccggauacgucaggcccguguguuuaccuaaccccgaacaauggcucgagccagauacuuauugcuacaucaccggcuggggucauauggggaacaagaugccuuuuaaacugcaggagggcgaagugcgcaucauuagucuugagcacugucaguccuauuucgacaugaagacaauaaccacucgaaugaucugcgcaggauacgaaagcggcacagucgauucuuguaugggggacagcggaggcccccugguuugcgagaaaccaggugggcgguggacguuguuuggacucaccuccuggggcucaguguguuucaguaaggugcuggguccgggcguauauagcaaugucucuuacuucguggaauggauuaagcgucagaucuacauucaaacuuuucuacugaacuga

SEQ ID NO: 54700 - RNA, 1386 nt, Artificial Sequence
  derived and/or modified sequence opt3 from CORO1A__Homo_sapiens__XP_011544016
augagcagacagguggucagguccucuaaguuccggcacguuuuuggccaacccgccaaagcugaccagugcuacgaggaugugcgcguaucacagaccacaugggacaguggguucugugcagugaacccuaaguuugucgcccugaucugcgaagcgagcggagguggcgcuuuccucgugcuuccacuggggaaaacuggacgaguugauaagaaugccccgacgguguguggccauaccgcacccgucuuggacauugccuggugcccucacaacgauaaugugauagcuuccgguucugaggacuguacaguaaugguuugggaaaucccagaugggggauuaaugcugccccuacgugagccuguggucacucucgaaggccauaccaaaagagugggcauuguggcauggcacacaaccgcccagaacguccugcuuucggcugggugcgacaauguuaucauggugugggauguaggaacuggugccgcgaugcugacauugggcccagaggugcaucccgacaccauuuauucagucgauuggagcagggacgggggacucaucuguacgaguugccgggauaagcgcgugagaauaaucgagccuaggaagggcacuguuguggcagaaaaagaccggccacacgaggguacccgcccgguccgagccguguuuguauccgaagggaagauucugacaacuggauucucuagaaugagcgagaggcaaguugcucugugggacaccaaacaccucgaggaacccuuaucccugcaggagcuugauacaucaaguggcguguugcugccauuuuucgacccugauaccaacaucgucuaccuauguggcaagggggacagcucuauucgguauuuugaaaucacguccgaggcccccuuccuccauuaccugucaauguuuagcaguaaagaaucucagcguggaauggguuauaugccuaagcgcggccuugaggugaauaagugcgagauagcaagauucuacaaacugcacgaaaggcggugugagccaauugcuaugacugucccccgaaaguccgauuuguuucaggaagaccucuauccgccuacagccgggcccgauccagcgcugaccgccgaggaaugguuaggaggccgcgacgcagguccucugcucaucagccuuaaagauggguacgugcccccaaagucgagagagcugaggguuaaccggggcuuggacacuggacgcagaagggcugcccccgaggcuucuggcacaccuuccucagaugccgugagucgucuagaagaggaaaugcggaaacugcaagcaaccguacaggagcuccagaagcgacuggacagacuugaagagacgguccaggccaaauga

SEQ ID NO: 54701 - RNA, 1470 nt, Artificial Sequence
  derived and/or modified sequence opt3 from CORO1B__Homo_sapiens__NP_001018080
augagcuucagaaagguggucaggcaguccaaauuucggcacguuuucggccaacccgugaagaacgaccagugcuacgaggauauccgcguaucucgagugaccugggacucaacauuuugugccgucaauccuaaauuccuggcugugauuguugaagcaagugggggaggugccuuucucgugcuuccacugagcaagacuggccguauagauaaagcguauccgacggucugcgggcauaccggacccguguuggacaucgauugguguccucacaacgacgagguaauugcuuccggcucugaagauugcacaguuaugguguggcagaucccagagaaugguuuaacuucgccccugaccgaaccugucguggugcuagaggggcauacaaagagagucggaauuaucgccuggcacccaaccgcaaggaacguucuccugucagccggcugugacaaugugguacuuauauggaacgugggcacugcugaggaacuguaccgguuggauagccuccaucccgaccugaucuauaaugucaguuggaaccacaaugggucccuguucugcucugcauguaaggauaaaagcgugcgcauuaucgacccuagaaggggaacacucguugccgagcgggaaaaggcucacgagggugcccgcccaaugcgagcgaucuuuuuagcagauggcaaaguguucaccacgggguuuuccagaaugucagagaggcagcuggcccuuugggacccggaaaacuuggaggaacccauggcucugcaagagcuagacaguagcaauggagcccuccugccuuucuacgauccagacacuucugucguguauguaugcggcaagggugauuccucaauucgguacuuugaaauaaccgaggagcccccuuauauucauuuccuuaacacauuuacuagcaaagaaccacagcgugggaugggaaguaugcccaagcgcggccuggagguuucuaagugugaaaucgcaagauucuacaaauugcacgagaggaagugcgaaccgauugugaugaccgucccucggaaauccgaccucuuccaggaugaccuguaccccgauacagcuggcccagaggccgcguuagaggccgaagagugggugagcgggcgagacgcagauccuauccugaucucgcuccgcgaggcuuauguccccucuaagcagagagaccuuaaaauuuccaggcggaaugugcugucagauagucgcccagccauggcucccggaagcucccauuugggugccccugcaucuaccacgacugccgcugacgcgacaccaagcggcucacuagcaagagccggggaagcuggaaagcuggaagagguuaugcaagagcucagggcccugcgugcacuugugaaagaacagggcgaccggauaugucgacuggaggaacaguuggguagaauggagaacggggaugccuga

SEQ ID NO: 54702 - RNA, 1584 nt, Artificial Sequence
  derived and/or modified sequence opt3 from CORO1C__Homo_sapiens__NP_001098707
auguacggcccagggagccagcugggaaaguccgguaacaauucuugggccaaagagagaggcugcucaaucgcuugucaagggagucucaccagcgcaaggcuucacgccccuuccauuggagaacggccacugucucauaugcgcuggaaggacacaaugcgacguguggucagacagucgaaauucaggcacguuuuuggccaggcggugaagaacgaucagugcuaugacgauauacggguaucacgcgugacuugggacagcaguuucugugcugucaauccgagauuuguggccaucauuaucgaggcauccggugggggagccuucuugguuuuaccccugcauaaaacgggcaggauugauaagucuuacccuaccgugugcggccacacagggccaguccuagacaucgauugguguccccauaacgaccaagugauagcuagcggauccgaagauugcacuguaaugguuuggcagaucccugagaauggucucacccugucacuuacagaaccaguggucauucuggagggccacaguaagcggguggggaucguggcauggcaccccaccgcccgcaacgucuugcucagcgcuggaugugacaaugccauuaucauauggaacguuggcacuggugaggcgcugauuaaucuggaugacaugcauucugauaugaucuauaacguguccuggaaucgaaacgggucacucauuugcacagcaagcaaagacaagaaaguaagagugaucgacccuaggaagcaggaaaucgucgccgagaaagaaaaggcucacgagggagcccggccaaugcgugcaauauuuuuagcugauggcaauguguucaccacgggcuuuagucgcaugucugagagacagcuggcccuuuggaacccgaagaauaugcaagaacccauugcguugcaugagauggacacuuccaacgggguucugcuaccuuucuacgauccagacaccagcaucauuuaucucuguggaaaaggugauucgucuaucagguacuuugaaauaacagacgagucccccuaugugcacuaccugaacacuuucucaaguaaggaaccucagcggggcaugggguacaugccaaaacgaggacuugaugucaauaagugcgagauugcccgcuuuuucaaacugcacgagagaaagugugaacccaucaucaugaccgugccgaggaaaagcgacuuguuucaggaugaccucuauccugauacagcaggccccgaggcugcccuggaagcugaggaaugguucgaggguaagaacgccgacccaauuuuaaucucccugaagcauggguacauuccuggcaaaaaucgggaccucaagguaguuaaaaagaacauacuugauucuaaacccaccgcaaauaagaagugcgaccugaucagcauucccaaaaagacgacugauacagccucagugcagaacgaggcuaaauuggacgaaauccuaaaggagaucaaaaguauuaaggauaccauaugcaaucaagacgaacgcaucuccaagcuggagcagcagauggcgaaaauugcagccuga

SEQ ID NO: 54703 - RNA, 1578 nt, Artificial Sequence
  derived and/or modified sequence opt3 from CORO2A__Homo_sapiens__XP_011517288
augagcuggcacccccaguacagauccucuaaguucaggcauguguuuggcaaaccugccucaaaggagaacugcuaugacagugucccaaucacccggagcguucacgauaaucauuucugugcugugaacccgcacuuuauugcaguagugacagaaugcgccgggggaggugcguuccuggucauaccccuccaucaaacuggcaaacuugacccucacuacccaaaggugugugggcaccgcggaaauguucuggaugugaaauggaaccccuuugacgauuucgagaucgcuuccugcucugaagacgccacgauuaagaucuggucgauuccuaagcaguuguuaacccgaaaucugacagcauaucguaaagagcuagucggccaugccagaagggugggucucguagaauggcacccaacugcugcaaacauccuguuuucagccggguacgauuauaagguuaugauauggaaucuugacaccaaagagagcgugaucacaagucccauguccaccauuucuugucaucaggaugucauccugagcauguccuucaacacuaauggaucauugcucgcuacaaccugcaaggaccggaaaauucgcgugaucgauccuagagccggcacggugcugcaggaggcgaguuacaagggccacagggcaagcaagguccuguuucucgggaaccugaaaaaguuaaugucuacuggaaccucccgguggaauaaccgccaaguugcccuuugggaccaggauaauuugucagugccacugauggaagaggaccuagacgguagcaguggcguacucuucccguuuuaugaugcugacacaucuaugcuguacguggucgggaaaggagauggcaacauacgauacuaugaaguguccgccgacaagccccaccuuagcuaccugacugaguauagaucguacaauccucagaaagguauugggguuaugccaaagaggggauuggaugugucuuccugugagaucuuccgguuuuauaaacucauuaccacaaagucacugaucgaacccaucaguaugauugucccucgucgcagcgaguccuaccaggaagacauauauccacccaccgcaggcgcucaaccgucuuuaacggcccaggaguggcugagcggcaugaacagagauccuauccucgugucacuuaggcccgggagugaacuguugcggccacauccucuacccgcggagcgaccaauuuucaacuccauggcccccgcaagcccucgccugcucaaucagacugagaagcuggcugccgaagacggauggagaucuucaagucuucuggaggagaaaaugccaaggugggcugccgaacaccgguuggaagagaagaaaacauggcucaccaacgguuucgauguauuugagugcccgcccccuaagacugaaaaugagcuguuacagauguucuaccgccaacaggaagagaucagaaggcugcgugaacuacucacacagcgggagguucaagcaaaacagcuggagcuugaaauaaagaacuugcgaaugggcagcgagcagcuguga

SEQ ID NO: 54704 - RNA, 1428 nt, Artificial Sequence
  derived and/or modified sequence opt3 from CORO2B__Homo_sapiens__NP_001177385
augagcuggagaccccaguacagguccucuaaguuccggaacguguauggcaaagucgccaaucgcgagcacugcuuugacgggaucccuauuaccaagaacguucaugauaaucacuucugugcugugaacacacgauuucuggcaauaguaacugaaucagccggagguggcaguuuccucgugaucccacuugagcaaacggggcguauugaaccgaauuaccccaaagucugcggacaucagggcaacgugcuggacaucaaguggaauccuuuuauugauaacaucauagcgagcuguuccgaggacaccucuguuagaaucugggaaauuccagaggguggguugaaaaggaauaugacagaggcuuuacuggaacuacacggacauucgcggcgcgugggccucgucgaguggcaccccacuaccaacaauauccuguucucagccggcuaugauuacaaggugcuuauuuggaaccuggacguaggggaaccuguuaagaugaucgauugccacacagacgugauauuguguaugagcuuuaauaccgauggaagucuccugacuacaaccugcaaagacaagaaacugagagucauugagccaagguccggucgggugcuccaggaggcaaacuguaagaaucaucgcgugaaccgagucguuuucuuaggcaacaugaaaagacugcuuacgacuggggugucuagguggaauacccggcagaucgccuugugggaucaagaagaccugagcaugccccuaauugaggaagagaucgauggacucuccggccugcuuuuuccuuucuaugacgcugacacacacaugcuguacuuggcagguaagggggauggaaacauccguuauuacgaaauuucaacugagaagccauaccucaguuaucugauggaguuucgcagcccggcuccccagaaaggcuuaggcguaaugccuaagcaugggcuggacgugucugccugcgaagucuucagauuuuacaaacucgugacccuuaagggacugauagagccaaucuccaugauuguucccaggcggucagauagcuaucaggaagacaucuacccuaugacaccagguaccgagcccgccuugacgccggaugaauggcuaggcgggauaaaucgagacccugugcugaugagucucaaagagggauauaagaaaucuuccaagauggucuucaaggcgcccauuaaagagaagaaaagcgugguaguuaacggcaucgaucugcuugaaaaugugccaccucgcacugagaacgaacuguugagaauguucuuuaggcagcaagacgagauccggcgccucaaggaggaacuggcacagaaagauauuagaaucaggcaguuacagcuggagcuaaagaaucuccguaacucgcccaagaauuguuga

SEQ ID NO: 54705 - RNA, 1419 nt, Artificial Sequence
  derived and/or modified sequence opt3 from CORO6__Homo_sapiens__NP_116243
augagcagaagggugguccggcaguccaaguuccgccacguuuuuggccaagccgcuaaagcagaccaggccuacgaggauauccgagugucuaagguaaccugggacucaaguuucugcgcggugaaccccaaauuucuggcuauuauagucgaagccgggggagguggcgcauucaucgugcucccucuugccaagacagggcguguugauaaaaauuauccacuggugacuggacauacggcuccggucuuggacauugauugguguccccacaacgacaaugugaucgcaagcgccuccgaugacaccacaauuaugguauggcagaucccugauuacacuccaaugagaaacauaaccgagcccaucauuacauuagaaggccauucuaagaggguugguauccugucguggcacccuaccgcucggaaugugcuacucucagccgggggagacaacgucauuaucauauggaaugugggcacuggcgaggugcugcuuagccuggaugacaugcauccagaugucauucacaguguuugcuggaacuccaaugggucuuugcucgcgacaaccuguaaggacaaaacgcugcgcaucauugaccccagaaagggacaggugguagcagaaagguuugccgcucacgaggguaugcggccuaugcgcgccguguucacucgacaaggccauaucuuuaccacaggguucacuagaaugagccagagggagcugggacucugggauccaaacaauuuugaggaaccggucgcauuacaggaaauggacaccuccaacggcgugcugcuucccuucuaugauccugacucaaguaucguuuacuugugcgguaaaggggauagcucuauucgguauuuugagauaacagacgagccacccuucgugcacuaccugaauaccuuuuccucaaaggaaccucagcguggaaugggcuucaugccaaaacgcggccuagaugucagcaagugugagaucgcuagauucuauaagcuccaugaaaggaaaugcgagcccauuaucaugacggugccgcggaagagugaccuguuucaagaugaccuuuacccugauacucccgggccagaaccugcccuggaggcggacgagugguugucuggacaggacgccgaacccguacucauaucccugcgagaugguuacguuccacccaaacaccgcgaguuaagagugacaaagaggaacauucuggacguccggccuccaagcggcccgcgcagaucgcagucugcauccgaugcuccccucucacagcaacacacccuugaaacucuguuggaggaaaucaaagcccuaagggagcgugugcaggcucaggagcaacggaucacagcccuggaaaauaugcucugugagcuggucgacgggaccgauuga

SEQ ID NO: 54706 - RNA, 2523 nt, Artificial Sequence
  derived and/or modified sequence opt3 from CORO7__Homo_sapiens__NP_001188402
augaacagauucagggugagcaaguuucggcacaccgaggccaggcccccucgacgugaauccuggaucucugacauuagagcuggcacagcaccaucaugcaggaaucauauaaaaaguagcuguucccugaucgccuucaacucugaucggccggggguccucggaauuguuccccuucagggucaaggcgaggacaagcgcagaguggcgcaccuggggugccauucggaauuggcugcccacggagauuuaguacagucagcaguguggagcagggacggcgcccuggucgguacugcuuguaaagauaagcagcuacggaucuuugacccucgcacgaaaccacgagcaagucaguccacccaagcccaugaaaauucuagagauagcaggcucgcuuggauggggacaugggaacaccugguguccacuggauucaaccagaugcgggagcgugagguuaaacuuugggacacccgcuuuuucucaagugcccuggcgagcuugacacucgauaccucucugggcugccuggugccccucuuagacccugauuccggccugcuugucuuggcagggaagggagaaagacagcuguacuguuaugaggugguaccacagcaacccgcccuaucaccuguuacucagugcgugcucgaaagcguccugaggggugcugcccuugugccacggcaggcacuggcugugaugaguugugaggucuugcgaguucuccagcugucugacacagccauugugccgaucggcuaccacguaccccgcaaggcgguggaguuucaugaagauuuauucccugacaccgccgggugcgucccagcaacggacccccacuccuggugggcuggagauaaucaacaggugcagaagguuagccugaacccugccuguagaccacaucccucguuuacuucuugccucgugccgccugcugagccccuuccagacaccgcccaaccugcagucauggaaacacccgugggcgaugccgacgcuuccgaggguuucucaaguccacccagcucccugacuucuccuagcaccccaucaaguuuggggccgucccuaagcucuacaucaggaauaggcaccagucccagccugaggucccuccagucucugcuuggcccuucgagcaaauuucggcacgcgcaggggacgguacugcaccgcgauucccauaucacuaauuugaagggacucaaccugacaaccccaggugaaucagacggcuucugugcaaauaaauuaagaguugccgugccccugcuaaguucugggggacaggucgcugugcucgagcugaggaagccuggccgucuuccagauacugccuugcccacacugcaaaacggugcagccgucaccgaccucgcuugggauccguuugacccucaccggcuggccguggcaggggaggaugcgcgaauuagacuuuggaggguuccagcugaaggccuggaggaaguguugacgacccccgagacaguacucacuggacauaccgaaaagaucugcagccugcgcuuccacccuuuagccgcaaauguccuggccuccucaagcuaugaccuaacagugcggauuugggaccuccaggcuggcgccgauagacugaaacuucaggggcaucaggaccaaaucuucucuuuggcauggucccccgauggacagcagcuggcuacuguuugcaaggacgguagggugcgcgucuaccgaccacggaguggcccugagccccuccaggaggggccaggaccgaaaggcggucguggggccagaauaguguggguaugugauggccgcugccuguuagugagcggauuugacucucaauccgaacgccagcugcuuuuguaugaggcggaagcccucgcuggcgggccucuggcaguucuaggacuggaugucgcccccucaacccuccugccaaguuacgaccccgauacaggucuuguguugcugaccggcaagggggacacucggguguucuuauaugagcuccugccugaaagcccauuuuuccuugaguguaacucguuuacgucccccgauccucacaaaggacuggucuugcucccgaagacagagugcgacguuagagaaguggagcugaugaggugucuacgacugcgccagucuagccucgaaccaguggcuuuccggcugcccagaguaaggaaagaguuuuuccaggaugacgucuuuccugacaccgccgugauuugggagccaguucuuucagcagaagcgugguugcaaggcgccaauggucagcccuggcuguuaagucuccagccuccggauaugucccccgugucucaagcuccacgugaggccccugcacgccgggcucccagcuccgcccaguaccuggaagagaagucagaccagcagaagaaagaggagcuucugaacgcaauggucgccaagcuagggaauagagaggauccacucccucaagacagcuucgaaggcguggaugaggacgaaugggauuga

SEQ ID NO: 54707 - RNA, 3147 nt, Artificial Sequence
  derived and/or modified sequence opt3 from CORO7-PAM16__Homo_sapiens__NP_001188408
augaacagauucagggugagcaaguuucggcacaccgaggcccgcccuccucgacgugaauccuggaucucugacauuagagcuggcacagcaccaucaugcaggaaucauauaaaaaguagcuguucccugaucgccuucaacucugaucggccggggguccucggaauuguuccccuucagggucaaggcgaggacaagcgcagaguggcgcaccuggggugccauucggauuugguaacugacuuagauuuuucaccuuucgacgauuuucugcuagcuacgggaagcgccgacaggaccgugaaacucuggcggcugccaggccccggucaggcacuuccuagugccccaggggucgugcugggacccgaagauuugccuguugaggugcuccaguuccacccaacauccgacggcauccuggucucugcugcaggcacuaccgugaagguaugggaugccgcuaaacagcaaccgcugacagaacucgccgcgcauggggacuuaguucagagcgcaguguggucccgcgauggagcccuggucgguaccgcuuguaaggacaagcagcuucgaauuuuugaccccagaacuaaaccuagggccucacagaguacacaagcacacgagaauagccgggauucucguuuggcuuggaugggcaccugggagcaccugguguccacgggguucaaccagaugcgcgaaagagaggugaagcuaugggacacuagguuuuucucaagcgcccucgcgagucugacccuugauacaucucugggaugcuuggucccacuccuggaccccgauuccggcuuacugguucucgccgguaaaggggaacggcagcuuuacuguuaugaggugguaccucagcaaccagcacugagccccgugacucagugcgucuuggagucggugcuacgaggagcugcccugguuccgcgccaggcucucgccgugaugucuugugaaguccugagagugcuucaacuguccgacaccgcaaucguaccuauaggcuaccauguucccaggaaggccguggaguuucacgaagauuuguucccagacacagcuggcugcgucccugcgaccgauccccauucauggugggcaggggacaaucaacaggugcagaaagucagucucaacccagccugucggccccacccuagcuuuacguccugccuggugccaccggcugagcccuuaccugauacugcccaaccagcaguuauggaaacacccgugggagacgccgacgcuucugaggguuucagcucaccuccaaguucccugaccagccccucuacuccgucaagucuaggcccuagccucuccucuacaucggggaucggaaccagcccaucccugcgcucacuucagaguuugcugggccccucuagcaaguucagacacgcccaggguacgguacuccauagggauucccacauuaccaaucugaaggggcuuaaccugacaacuccuggcgagucagacggauuuugugcaaauaaauugcgugucgcggugccccuccugagcucuggcgggcagguugcuguguuagaacugcggaagccaggacgacuaccugauaccgcccuccccacacugcaaaacggugcagccgucacugaccuugcuugggauccauucgacccgcauagauuggccguggcaggcgaggaugcuaggauccgccuguggcggguaccugccgaagggcucgaggaagugcugaccacacccgagaccguuuuaacuggacacacggagaaaauuugcucccugagauuucauccacuugcggccaaugucuuggcuaguagcucuuaugaccucacagugaggaucugggaucugcaggcaggcgccgaccgccuaaagcugcagggucaccaggaucaaauauucucccucgcuuggucacccgacgggcagcagcuggccaccgugugcaaagauggccgaguccggguuuaccguccuagaaguggaccagaaccccuucaggagggcccugggccgaagggagguaggggcgcacgcauugugugggugugugacgggcggugcuugcugguaagcggauuugacucgcaauccgaaagacaguuacuccuguaugaggcggaagcccuugcuggcgguccacuggccgucuuggggcucgauguggcacccucuacucugcuaccuagcuacgacccagauaccggccugguucuccugacaggaaaaggcgacaccaggguguuccuuuaugaguugcugcccgagucacccuuuuucuuagaauguaacaguuuuacuuccccggauccccacaaggggcucguccugcuuccaaagacagagugcgacgugcgagaaguugagcugaugcgcugucuacggcucagacagucuagccuggagccuguggcuuucagguugccccguguacgcaaagaauuuuuccaagaugacgucuuuccagauacggccgugaucugggagccugugcuguccgcagaagccugguuacagggagcuaauggccagcccuggcuccugucacuucagccaccggacaugagcccugucagucaagcgccccgggaggccccagcaagaagggcucccucuuccgcccaguaccuggaagaaaagagcgaucagcagaaaaaggaggaauugcucaacgccaugguugcuaaacuggguaaucgagaggacccucuaccacaagauucguucgaagggguggacgaggacgaaugggcaaaguaccuggcccagauuaucguaaugggagugcaggucgugggccgggcguucgcucgcgcccuuagacaggaguuugcagccucaagggcugcagccgaugcgcggggucgagcuggccauagaucugccgcagccaguaaccucuccgggcugagcuugcaagaggcucagcagauccugaacguuucuaaguuaagccccgaagaggugcagaaaaauuaugaacaccucuucaaggucaacgacaaauccgugggaggcucauuuuaccugcagaguaagguugugcgcgccaaagagaggcuugaugaggagcugaagauucaggcacaggaggaccgugaaaaggggcaaaugccucauaccuga

SEQ ID NO: 54708 - RNA, 429 nt, Artificial Sequence
  derived and/or modified sequence opt3 from COTL1__Homo_sapiens__NP_066972
auggccaccaagaucgacaaagaggcuugcagagcagccuacaaccuggugagggaugacggcagcgcggucauuuggguuacauucaaguaugauggguccacuauagugcccggagaacagggugcugaguaccaacacuuuauccagcaguguacggacgauguacgccucuucgccuuugugcgguucaccacaggcgacgcaaugucuaaacgaucaaaguuugcccuuauuacuuggaucggggaaaaugucaguggacugcagcgugcuaaaaccggcacagauaagaccuuggugaaggagguugugcaaaacuucgcaaaagaauuugucauuagcgacagaaaggaguuagaggaagauuucaucaaauccgagcugaagaaagccgguggggcuaauuaugacgcccagacugaauga

SEQ ID NO: 54709 - RNA, 720 nt, Artificial Sequence
  derived and/or modified sequence opt3 from COX10__Homo_sapiens__XP_005256515
auggccgcuagcccccacacccuguccucuagacuccuuacaggcugcgucgggggaucagugugguaccuggagaggcggacuauccaggacaguccucauaaguucuugcacuuacugcgcaacguuaauaaacaauggauuacguuucagcauuucagcuuucuaaagcgaauguaugugacccagcucaaccguucccacaaucagcaaguaagaccaaaaccggaacccguggcaucuccuuuccuggagaagacaucgucaggucaggccaaagcggaaauauacgagaugaggccacuuagucccccuagccuguccuugucucggaagccaaacgaaaaggagcucaucgagcuggaacccgauagcgucauugaggacuccaucgaugugggcaaagaaacuaaggaggagaaacgcuggaaggaaaugaaacugcagguuuaugaccucccugggauuuuagcuagacugucaaagaucaaacuuaccgccuugguggucaguacaaccgcagccggauuugcucuggcaccaggcccguucgauuggcccuguuuucuacucacuagcguggguacagggcuggccucuugcgcugccaauuccauaaaccaguucuuugagguaccuuucgacucaaauaugaacaggaccaagaaucggccacuuguucgcggacaaauccgacagagcuuuuucaguucuuuuuga

SEQ ID NO: 54710 - RNA, 693 nt, Artificial Sequence
  derived and/or modified sequence opt3 from COX11__Homo_sapiens__NP_001156333
augggcgggcuguggagacccggauggaggugcgugccuuucugugguuggcgguggauccacccaggcagcccgacccgcgccgcugagcgagucgaacccuuucuccguccugagugguccgggacaggaggcgcagaaagaggucuuagguggcuggggacuuggaagcggugcucuuugcgcgccagacauccagcguuacagcccccuaggcggccaaaaucaaguaaccccuucacgcgcgcucaagaggaggaacgaagaaggcagaauaagaccacacugacuuacguugccgcaguggccguaggaaugcuaggcgcuagcuaugcagccgugccucucuaccggcuguauugucagaccacaggccuugggggauccgcugucgccggucacgcgucugacaaaauugagaacauggugccaguuaaggaucguauaaucaaaauuucguuuaaugcagacgugcaugccucacugcaguggaacuuccgcccgcaacagaccgaaaucuacgucgugcccggcgagacugcuuuggccuuuuauagagcaaagaauccuacagauaagccaguaauugggaucagcaccuacaacauaguucccuucgaagcuggacaguauuuuaauaaaauccaggugcucaguuccaggcugcaaucuugcacggagagcacuuucuga

SEQ ID NO: 54711 - RNA, 174 nt, Artificial Sequence
  derived and/or modified sequence opt3 from COX14__Homo_sapiens__NP_001244062
augcccaccggcaagcagcuggccgacaucggguacaaaacauucagcacuuccaugaugcuccuuacgguguauggagguuaccugugcucugucagaguuuaucacuacuuucaauggaggcgggcucagcgccaggcagccgaggaacagaagaccucaggcauuauguga

SEQ ID NO: 54712 - RNA, 1167 nt, Artificial Sequence
  derived and/or modified sequence opt3 from COX15__Homo_sapiens__NP_004367
augcagagacugcucuuucccccucuuagggcccugaagggccggcaauacuugccauuacuggcuccgcgcgcagcgccccgagcccagugcgacuguauccguagaccucuaaggccagggcaguauagcaccauuuccgagguggcucuccagucuggacgggguacagucucacugcccaguaaagccgcagaacgcguugugggcagauggcuucugguaugcagcgggacuguggccggagcugucauauugggcggugugacgaggcucaccgaguccgggcugucuaugguugauuggcaccugaucaaggaaaugaaaccuccaacaucgcaagaggaaugggaggcagaguuccagcgguaccagcaguuccccgaauuuaagauucucaaccaugacaugacuuuaaccgaguucaaauuuaucugguauauggaauacucacaccgcauguggggacgacuggugggccuugucuauauuuugccugccgcuuacuucuggagaaagggcuggcugagcagggggaugaagggacgggugcuagcccucuguggucugguaugcuuucaaggccuucuggggugguauaugguuaaaaguggauuggaggagaaguccgauucucaugacaucccacgugugagccaguaccgccucgcggcacaccugggcuccgccuuaguccuguacugugcuucacucuggacaagucuuagccuguugcuaccgccccauaaacugccugaaacccaccagcuccugcagcuuagaagguucgcccacgguacugcagggcugguguuuuugacagcucucucuggagccuucguggcgggccuggaugccggcuuagucuauaauuccuuuccaaagaugggggagucauggauacccgaagaccuguucaccuuuagcccuauccuacggaacguuuucgagaauccaacgauggugcaauucgaucaucgcauucucggaaucaccaguguaacugcaauuacagugcuguacuuucuuucucgaagaauccccuugccgaggcggacuaaaauggcugccgucacccugcucgcucuggccuauacacaggguccugugcuuuucaacuuuaccuucaagauauccgaccuggaugaaggcauucgcaauaucuga

SEQ ID NO: 54713 - RNA, 321 nt, Artificial Sequence
  derived and/or modified sequence opt3 from COX16__Homo_sapiens__NP_057552
auguucgcccccgcugugaugagagcauuuaggaagaacaaaacccugggcuacggggucccuaugcuccuucugaucguuggagguagcuucggcuugcgggaguuuucccagauucgcuaugacgccgugaagucuaaaauggauccagaauuagagaagaaacugaaggaaaauaagauaucacuagagagugaauacgagaaaaucaaggacagcaaauucgaugacuggaagaacauucgagggccgcgucccugggaggauccugaccuccugcaaggaagaaauccagaaucccuuaaaacaaagacuacguga

SEQ ID NO: 54714 - RNA, 192 nt, Artificial Sequence
  derived and/or modified sequence opt3 from COX17__Homo_sapiens__NP_005685
augcccggccugguggacagcaacccugccccaccggagucccaggaaaagaaaccccucaagccuugcugugcuugcccagagaccaaaaaggcaagagaugccuguaucauugaaaaaggggaggaacacugcggacaucuuauagaggcgcacaaggaguguaugagggcucuggguuucaagaucuga

SEQ ID NO: 54715 - RNA, 1005 nt, Artificial Sequence
  derived and/or modified sequence opt3 from COX18__Homo_sapiens__NP_001284661
augcugugcagacucggcgggagguggcuucggccccugccugccuugcaguuaugggcucgcgaccugccacuagcaccggugcccaccagcggagccaagcgaccuacacucccagucugggcgguugcucccguguccgccguacacgcaaacgguugguacgaggcccuggcugcaucuucaccugugcgugucgccgaagaggugcuucugggcguucaugcugccacuggguugccaugguggggaaguauccuccugagcacgguggcgcugagaggcgcagucacccuccccuuagccgcuuaucaacacuacauucuggccaaaguggaaaaucuucagccugagauaaagacaaucgcaaggcauuugaaccaggaaguagcuguucgggccaaucagcuggguugguccaaacgcgaugcgagacuaacuuaucucaagaacaugaggcggcugauuucugagcuuuacgugcgcgacaauugucacccauucaaagccaccguccugguguggauccaauugccgauguggauuuuuaugucguucgcacuccgaaaccugucaacaggggcugcccauagcgaggcuggauuuagugugcaggaacaguuagccaccggcggcauccugugguuccccgaucucacugcaccugacuccacauggauacuuccaaucucugucgggguuauuaaucuguugaucguggagauuugcgcccuacagaagaucggaaugagcagauuucaaaccuauauaacguacuucguaagggcuauguccgugcugaugauucccaucgcggcaacugucccuucaaguauugugcucuauuggcuguguagcucuuuuguuggucuuucccagaaccuguugcuccggucaccaggcuuccgucagcugugccgcauccccagcaccaagagugauucugaaacaccguacaaagacaucuuugccgcuuucaauacuaaguuuauuuccagaaaauga

SEQ ID NO: 54716 - RNA, 273 nt, Artificial Sequence
  derived and/or modified sequence opt3 from COX19__Homo_sapiens__NP_001026788
augagcaccgccaugaacuucggcacaaaguccuuucagcccagaccuccagacaaagggucuuucccgcuggaucaccucggagagugcaagucauuuaaagaaaaguucaugaaaugucuucauaauaacaauuuugagaacgcucugugcaggaaggaaaguaaggaguacuuggaaugucggauggagcgcaaauuaaugcugcaagagccccuagaaaagcucgguuucggcgaccugacuagcgggaaauccgaggcaaagaaauga

SEQ ID NO: 54717 - RNA, 510 nt, Artificial Sequence
  derived and/or modified sequence opt3 from COX4I1__Homo_sapiens__NP_001852
augcuggccaccagaguguucagccucgucggcaagagggcuaucuccacaucuguuugcgugcgggcacacgagucaguagugaaaagugaagacuuuagccuucccgccuacauggaucgccgagaccauccucugccagaggucgcgcacgugaagcauuuguccgcuucucagaaagccuuaaaggaaaaagagaaggcaucguggucaagccugaguauggaugaaaagguugagcuauaucguauuaaauucaaggaguccuuugccgaaaugaacagagggucuaaugaguggaaaacuguggucggaggugcuauguucuuuauaggcuucacggcacucgugaucauguggcaaaagcacuacguauaugggccgcugccccagagcuuugacaaagaauggguugccaagcagaccaagaggaugcuugauaugaaagugaacccuauucagggacuggcuuccaagugggacuacgagaaaaaugaguggaagaaauga

SEQ ID NO: 54718 - RNA, 516 nt, Artificial Sequence
  derived and/or modified sequence opt3 from COX4I2__Homo_sapiens__NP_115998
augcugcccagagccgcuuggagccucgugcuuaggaagggcgggggaggucggcgcggcaugcacuccucugaggggaccacacgaggaggcgguaaaaugucaccuuacacuaacugcuaugcacagcguuacuauccaaugccggaagaacccuucuguacggaacugaaugccgaggaacaagcguugaaggagaaagagaaggggaguuggacccaguuaacacaugcugaaaaagucgcccuguacagacuacaguuuaacgagacuuucgcagaaaugaauaggcggagcaacgaguggaagaccguuaugggaugcguguuuuucuuuaucggcuucgccgcucucguaauuugguggcagcgcguguaugucuuuccuccaaagcccauaacacugaccgacgagagaaaagcacaacagcuucagaggaugcuggauaugaaggugaauccuguucagggcuuggccucccggugggacuacgagaaaaagcaauggaaaaaguga

SEQ ID NO: 54719 - RNA, 453 nt, Artificial Sequence
  derived and/or modified sequence opt3 from COX5A__Homo_sapiens__NP_004246
augcugggcgccgcucucagaaggugcgcaguggccgcgaccacacgggcugacccccgcgggcuucugcacagcgcccgaacuccuggaccagcagucgccauccaguccguucguuguuacucucaugguucacaagagacggaugaagaguucgacgcuagaugggugaccuauuuuaacaagccggauauugacgcaugggaauugaggaaaggcauaaauacauuaguaacuuacgauauggugcccgagccuaagaucauugacgccgcucugcgggccugccgcagacuaaacgauuucgcgaguaccgucaggauccucgaagugguuaaagacaaggcagggccacacaaagagauuuaucccuacgugauccaggagcugcggccuacacuuaaugaacugggaauaagcaccccagaggaauugggccucgauaaggucuga

SEQ ID NO: 54720 - RNA, 390 nt, Artificial Sequence
  derived and/or modified sequence opt3 from COX5B__Homo_sapiens__NP_001853
auggccagcagacugcucaggggcgcugggacccuugcagcccaggcgcugcgggcucgcggacccuccggugccgcagccaugcgaucuauggcuucaggcgggggagugccuacagacgaggaacaagcaacuggcuuggagcgugaaaucauguuagccgcuaagaaaggucuggauccauacaacguccuagccccgaagggggcgaguggaacgagagaggaccccaaucucguuccuagcauuuccaacaaaaggauagugggcugcaucugugaagaggauaauaccucuguagugugguucuggcugcacaagggcgaggcacagcggugcccacgcuguggggcccauuauaaacuugucccccagcagcuggcucacuga

SEQ ID NO: 54721 - RNA, 330 nt, Artificial Sequence
  derived and/or modified sequence opt3 from COX6A1__Homo_sapiens__NP_004364
auggccguggucggcguuagcuccgugucuagacugcucgggaggucacggccccagcuuggacgcccuaugaguagcggugcucacggcgaggaaggguccgcacgaauguggaagacccugacauucuuuguagccuugccaggaguggcggucucuauguuaaacguguaccugaaaucgcaucacggcgagcaugaacguccggaguucaucgcuuauccccaccuaagaauuaggacuaagccuuuuccauggggugacgggaaucauacccucuuccacaacccccacguuaauccucugccaacgggauacgaagaugaguga

SEQ ID NO: 54722 - RNA, 294 nt, Artificial Sequence
  derived and/or modified sequence opt3 from COX6A2__Homo_sapiens__NP_005196
auggcccugccccucagaccucuuaccaggggccuggcuagcgcagccaaagggggacacgguggcgcgggggcucggacauggcgcuuguuaacuuucgugcuggcccuaccauccgucgcacucugcacguuuaacucuuaccugcauucaggacaccgaccgcgucccgaguucagaccuuaucagcaucuuaggauccggaccaagccauaccccuggggcgacgguaaucacacacuguuucauaacagucacguuaauccuuugccaacuggguaugaacaccccuga

SEQ ID NO: 54723 - RNA, 261 nt, Artificial Sequence
  derived and/or modified sequence opt3 from COX6B1__Homo_sapiens__NP_001854
auggccgaggacauggaaaccaagaucaaaaacuacaagacagcucccuucgauagcagauuuccuaaucagaaccaaacuaggaauugcuggcagaacuaucuggacuuccaccggugucagaaagcaaugacggccaagggcggggauauuuccgugugcgagugguaccagcgcgucuaucaaucucucuguccaaccucauggguuacagacugggaugaacagcgagcggagggaacuuuuccggguaaaauauga

SEQ ID NO: 54724 - RNA, 228 nt, Artificial Sequence
  derived and/or modified sequence opt3 from COX6C__Homo_sapiens__NP_004365
auggcccccgaggugcugccuaagccaagaaugaggggccuccuugcucggcgccugcgaaaccacauggcagucgccuucguuuugagcuuagggguggcggcucuguacaaauuucguguagccgaccagagaaagaaagcauaugccgauuucuacaggaauuaugacgugaugaaggauuuugaagagaugcggaaagcuggaaucuuccaauccgucaaguga

SEQ ID NO: 54725 - RNA, 240 nt, Artificial Sequence
  derived and/or modified sequence opt3 from COX7A1__Homo_sapiens__NP_001855
augcaggcccugagagugagccaagcucucaucagguccuucucuucaaccgcacggaaccgcuuucagaaucgaguccgugagaagcagaaacuuuuccaggaagacaacgauauuccccuguacuugaagggcgggauaguugacaauaucuuauauagagugacaaugacucugugccuaggagguacgguauacagucucuauagccugggcugggccuccuuuccuaggaacuga

SEQ ID NO: 54726 - RNA, 348 nt, Artificial Sequence
  derived and/or modified sequence opt3 from COX7A2__Homo_sapiens__XP_011533748
augcacacccaggacagcgaggugguccccguuccugccuggccauucucccuggugguauuuucuugcggcggguguuggucagugacagcuaagaugcucagaaaccuucuggcauugaggcaaaucggacagcggacuauuaguacggccagccgccgacauuucaaaaauaaggucccggaaaaacagaaguuauuucaggaggaugacgaaauaccccuguaccuaaaagguggcguggcggaugcucuccuguaucgugccaccaugauccuuacaguugggggaacugcauacgccauuuaugagcuggcuguggcauccuucccuaagaagcaagaauga

SEQ ID NO: 54727 - RNA, 345 nt, Artificial Sequence
  derived and/or modified sequence opt3 from COX7A2L__Homo_sapiens__NP_001305965
auguacuauaaguucagcggcuuuacccagaaacuggccggggcuugggcauccgaggccuacucuccccaaggacucaagccuguggucucaacagaagcgccaccgaucauuuucgcuacucccacgaaacuuaccagugacagcacaguuuaugauuacgccgguaagaacaaagugccugagcugcagaaguuuuuccagaaggcagacggcguaccaguguauuugaaaagaggguuacccgaucagaugcuguacaggacuaccauggcccuaacagucggaggcaccauauauugccucaucgcucuguacauggcaucccaaccuaagaauaaauga

SEQ ID NO: 54728 - RNA, 246 nt, Artificial Sequence
  derived and/or modified sequence opt3 from COX7B2__Homo_sapiens__XP_005248113
augauguucccccuggccagaaacgcucucagcucccuuaagauccagucuauucugcaaucaauggcaaggcacagucaugugaaacacagcccugacuuucaugauaaguacggcaaugccgucuuggcguccgggaccgcuuucugcguugccacauggguguuuacugcaacgcagauaggaaucgaguggaacuuaucuccaguaggucgggugaccccgaaagaauggaagcaccaguga

SEQ ID NO: 54729 - RNA, 243 nt, Artificial Sequence
  derived and/or modified sequence opt3 from COX7B__Homo_sapiens__NP_001857
auguucccccuggucaagagcgcccucaacagacuucaggugagguccauccaacagaccauggcucggcagucucaccagaaacgcacaccugacuuucaugauaaguacggcaaugcaguucuggccucaggggcgacuuucugcauugugacguggaccuauguagcuacacaagugggaauagaguggaacuugaguccagucggucgagugacuccgaaagaauggcguaaucaguga

SEQ ID NO: 54730 - RNA, 192 nt, Artificial Sequence
  derived and/or modified sequence opt3 from COX7C__Homo_sapiens__NP_001858
augcugggccagagcaucagaagguucaccacauccgugguccggcgcucucacuacgaggaagggcccggaaagaaccucccuuuuucaguugagaauaaauggagucuucuggccaagaugugcuuguauuucgguagcgcuuuugcaacuccauucuuagugguacgacaucaacugcuaaaaacguga

SEQ ID NO: 54731 - RNA, 210 nt, Artificial Sequence
  derived and/or modified sequence opt3 from COX8A__Homo_sapiens__NP_004065
augagcgugcugacaccccuccuucugagaggcuugaccggguccgccaggcgguuaccugucccacgcgcuaagauccacucucugccgcccgagggaaaacuagguauuauggaacucgcaguuggccugacuucaugcuucgugacguuucuucugccugccggguggauauugagucaucucgagaccuaccgacguccagaauga

SEQ ID NO: 54732 - RNA, 1260 nt, Artificial Sequence
  derived and/or modified sequence opt3 from CPA1__Homo_sapiens__NP_001859
augagaggccugcucgugcuuagcguccuguugggggccguuuucggaaaggaggacuuugugggucaccagguauuaaggaucuccguggcugaugaagcacaaguccagaaagugaaggagcuggaagaccuagagcaucuccagcuggauuucuggcggggccccgcccacccugggucuccaauugacguucgcgugccguuucccucaauacaggcggucaaaaucuuccuugaaagucauggaauuagcuacgagaccaugaucgaggaugugcaaucccuguuggacgaggaacaggaacagauguuugcuuuccgaucucgugccagaucgacagauacuuuuaacuaugcaacguaccacacccucgaggagauuuaugacuuccuggaucugcucguagccgaaaauccucauuuaguuucaaagauccagauaggcaacacauacgaggguaggccaaucuaugugcugaaauuuagcacugggggaaguaagcggcccgcuauuuggaucgacaccggcauucacucccgcgaaugggucacacaagcaucuggcgugugguucgccaagaaaaucacccaggauuacgggcaggacgcugccuuuacugcgauacuugauacauuggacauuuuccuggagaucgugaccaauccugacggauuugcauucacgcacagcacuaacagaauguggaggaagacccggucccauacagccgguucacuaugcauuggcgucgauccaaaucgcaacugggacgcuggguucggacucaguggcgccagcucuaaucccuguuccgaaacuuaucacgguaaauuugcaaacucagagguugagguaaagagcaucguggauuucgugaaagaccaugggaauaucaaggcuuuuauuaguauacacucuuacucccagcugcuuauguacccuuauggauacaagaccgaaccagucccggaucaagacgagcuggaucaguugagcaaagccgcggugacagcccucgcaucgcuguauggcaccaaguucaacuacggcucuaucauuaaagcuaucuaucaggccuccgggucaacgauagacuggacuuacagucaaggaauuaaguauagcuuuacauucgaauuacgagauaccgguagauacggcuuucugcuccccgcuucccagaucaucccuacugccaaagagacauggcuugcacuguugaccauuauggaacacacgcuaaaucauccauacuga

SEQ ID NO: 54733 - RNA, 1260 nt, Artificial Sequence
  derived and/or modified sequence opt3 from CPA2__Homo_sapiens__NP_001860
auggccaugagacugauccucuucuuuggcgcucuuuucgggcacauuuacugccuggagaccuuugugggagaccaggucuuggaaauaguucccagcaacgaggaacaaaucaagaauuuacugcagcuagaggcacaggaacaucuccagcuggauuucuggaaauccccuacaacuccaggugagacggcccacgugaggguaccguuugugaacguccaagcggugaagguuuuccuugagucucagggcauugcuuauucaaucaugauugaagacgugcagguccuguuggauaaagagaaugaagagaugcucuuuaaccggcgccgagagcguagugggaauuucaacuuuggagccuaccauacccuggaagagaucagccaggaaauggacaaucugguggcagagcaccccggccucguauccaagguuaacauagguucuucguucgaaaauagaccuaugaacguguuaaaauuuucaacagggggagauaagccagccaucuggcuggacgcuggcauucaugcaagggagugggucacucaagccaccgcucuuuggacagccaauaagaucgugagcgauuauggcaaagaccccaguauuaccuccaucuuggaugcgcuggacauauuccuacucccugugacuaacccagauggguacgucuuuucucagacaaagaaucggauguggcgcaaaaccagaagcaagguuuccggaucacuguguguggguguagaccccaacaggaauugggaugcaggcuucgggggaccuggcgccaguagcaacccaugcucugacuccuaucacgguccgucagcuaacagcgagguggaagucaaaaguauuguggacuucaucaagucucacgggaagguuaaagccuuuauuacgcuucauuccuacagccagcuguugauguuccccuauggauacaaguguacuaaacucgaugacuuugaugagcugucggaaguggcacagaaggcugcccaaucuuuacggucccugcacggcaccaaauacaaggucggcccuaucugcucagugaucuaucaggcgagugggggaagcauugacugguccuacgauuaugguauaaaauacucuuucgccuuugagcuccgcgacacaggccgauauggguuccuucugccagcaagacagaucuugcccacugcugaagagaccuggcuaggacugaaggccauuauggagcauguaagggaucacccuuacuga

SEQ ID NO: 54734 - RNA, 1254 nt, Artificial Sequence
  derived and/or modified sequence opt3 from CPA3__Homo_sapiens__NP_001861
augagacugauccuccccgugggccuuauugccaccacacuggcuauagcaccugucagguucgaccgggagaagguuuuucgcgugaaaccacaggaugaaaagcaagccgacaucauuaaagauuuggcgaagacuaacgaguuagacuucugguacccgggggcuacgcaccauguagccgcaaauaugaugguggauuuucgagucagcgaaaaagagucccaggccauccagucugcucuggaccagaacaagaugcacuaugaaauucuaauccaugaucuccaagaggagauagaaaagcaguucgacgugaaagaggauauccccggacgucacucauacgcaaaguauaauaacugggagaaaauuguugccuggaccgaaaagaugauggacaaauacccugagauggugaguagaaucaagauugguagcacagucgaagauaauccacuguaugugcuuaagaucggcgagaaaaacgaaaggcggaaggcuauauuuacugacugcgggauucaugcccgcgaguggguaucccccgcguucugucagugguuuguuuaccaggcaaccaaaacauauggaagaaauaagaucaugaccaaacuguuggauaggaugaacuucuacauucucccuguguuuaaugucgacggcuacaucuggucuuggacuaagaaccggauguggcgcaaaaaucgaucgaagaaccaaaauucaaagugcaucgguacagaccugaacagaaauuucaacgccagcuggaacaguauuccaaauaccaacgaucccugugcugacaauuauaggggguccgccccugaaucugagaaagagacgaaggcagugacuaacuuuauacggagccaccugaaugaaaucaaaguguacauuaccuuccacuccuauucacagaugcucuuauuuccauacggauauacaaguaagcugccgcccaaccaugaggaucuugcuaaagucgccaagaucggcacugacguuuugagcacccguuacgaaacacgcuauauauacggcccuauugagucuaccaucuacccaaucuccgggucaagccuggauugggcguaugaccuaggaauuaagcacacguucgccuucgaacucagagauaaagguaaguuuggcuuccugcuucccgagaguaggaucaaaccuacuugccgggagacaaugcuggcagugaaguuuauugcuaaauacauauugaagcauaccucuuga

SEQ ID NO: 54735 - RNA, 1167 nt, Artificial Sequence
  derived and/or modified sequence opt3 from CPA4__Homo_sapiens__NP_001156918
augagauggauccuguucauuggcgcccucauagggagcuccaucugcggacaggagaaguuuuucggugaccaagugcuuaggauuaacguccggaauggcgaugaaaucucuaaacugucacaguugguuaacaguaauaacuuaaagcugaauuuuuggaaaagccccuccucuuucaaccgcccuguggacgugcuaguaccaucggucucacuccaggcuuuuaagagcuuccugcgaagucaggggcuugaguacgcagugaccauugaagaucugcaaaucuaucacgagauggacaauauagccgcggauuuuccggacuuggcucguagaguuaaaaucggacauuccuucgaaaacaggcccauguacgugcucaaguuuucuacaggcaaggguguccggcgcccugccguguggcugaaugcagggauucacagcagagaguggaucucccaggccacugcuauuuggacggcaaggaaaaucguaucagauuaucagcgggacccagccauaaccaguauucuggagaagauggauaucuuccucuuacccguugcuaacccugacggauacguguauacacagacucaaaaucgccuguggcgaaaaaccagaagcaggaacccagggucuuccuguauuggcgccgaucccaaucggaacuggaaugcgucauuugcaggcaagggagccagcgacaacccuugcagugaagucuaccaugguccacacgcuaacucugagguggaagugaaauccgucguugauuucauccagaagcauggcaauuuuaagggguucaucgaccuucacagcuauucgcaguugcugauguacccguacggauauucugugaaaaaggcccccgacgcagaggagcuagauaaaguagcucgucucgccgcgaaggcccuggcauccgugucaggcacagaauaccaggucgguccuaccuguacuacaguguauccagcuagugggagcuccauugacugggccuacgauaacggaauaaaauucgcuuuuaccuucgagcuucgcgacacgggcacuuauggcuuucuguugcccgccaaucaaaucauuccuaccgcagaagagacauggcucgggcugaagacuaucauggaacacguuagagauaacuuauacuga

SEQ ID NO: 54736 - RNA, 1314 nt, Artificial Sequence
  derived and/or modified sequence opt3 from CPA6__Homo_sapiens__NP_065094
augaagugccugggcaaaagaagggggcaggccgcugcauuccucccccuuuguuggcuguuuuugaagaucuuacaaccuggacacagccaucuguacaacaaucgguaugccggugacaaagugauucgcuucauaccaaagaccgaggaagaggcguacgcucuuaaaaagaucuccuaucagcucaaggucgaucuguggcagccgucuucaauuaguuacguuagcgaaggcacagugacugacguacacaucccccagaacgggucccgagcccuucuggcauuuuugcaagaggccaauauucaguauaaagugcucaucgaagaucugcagaagacgcuggagaaaggaucuucgcuccauacccagcguaacagaaggucauuaagcggcuacaauuaugaggucuaccacagucuggaagagauacaaaacuggaugcaucaccuuaauaagacacacuccgguuugauccauauguucucuauugggcggagcuacgaaggacgcucccuguuuauccuaaaacucggcagaaggucacggcugaagcgcgcuguguggauugacugcggcauccacgcacgagaguggauagggccugccuucugucagugguuuguuaaggaggcucuacugacuuauaaaagugauccagccaugagaaagauguugaaccaucucuacuucuauauuaugcccguguuuaaugucgacggauaccacuucagcuggaccaacgauagguuuuggcggaaaacacguucucgcaauuccagauucaggugccgggguguggacgcgaaccgaaauuggaagguaaaauggugugaugaaggcgcaucaaugcacccuugcgacgauaccuauugugggccauuucccgagagcgaaccugagguuaaggccguggcuaacuuccugcgcaaacauagaaagcacaucagggccuacuuaaguuuccaugcauaugcucagaugcugcucuacccauacucuuauaaguacgccacuauuccgaauuuucggugcgucgaauccgcggccuauaaagcagugaacgcccuucagagcguguacggaguccgcuauagauacggccccgcuucgacaacccuguauguuucuuccgguucaaguauggacugggcuuacaagaacgggaucccuuacgccuucgcauuugaguugagggauacgggauauuucggcuuucuacugccagagaugcucaucaaacccacuuguaccgaaacaaugcuggccgugaagaauauuacuaugcaccuucugaaaaagugcccuuga

SEQ ID NO: 54737 - RNA, 5799 nt, Artificial Sequence
  derived and/or modified sequence opt3 from CPAMD8__Homo_sapiens__NP_056507
auggcccccggcgcucugagagggggaugcgagcagagggcaccugguggcggggcccggaccgcggcucucggaccauggccguggcccagcccuggcccagcccccuccccuggugcagccccaccccgcucucgaaagaugucaggggcucuucuguggccuuuguuaccacugcuacuccugcuucugagugcacgugacggagugagagccgcucaaccgcaggcccccggcuacuugaucgcggcaccuagcgucuucagggccggcguugaagaggugauuuccguaacaauauuuaacucuccacgggaagugacuguccaggcucagcucguggcccaaggggagcccguugugcagucgcagggagcaauccuggauaaagguacgauuaagcugaaagucccuaccggccuccgcgggcaggcuuuacugaagguguggggaagaggcuggcaagccgaagaggguccacuuuuccacaaucagacaucaguaacuguugacgggaggggagcgagcguguuuauccagaccgauaaacccgucuaucggccgcagcaucgcguguugauuaguaucuucacaguguccccuaaccugcgacccgucaaugagaagcuagaagccuacauacucgacccaagaggcucuaggaugaucgaguggcggcaccugaagccuuuuuguugcggcauuaccaacaugagcuucccccuuuccgaucaaccaguucugggggaaugguuuaucuucguggagaugcagggacaugcauauaauaaaucauuugagguacagaaguacguguugcccaaauucgaacuccugauugacccuccacguuauauccaagauuuagacgcuugugagacugguacaguccgcgccagauacaccuuuggcaagccgguggcuggggcccugaugauaaacaugacgguuaauggagugggcuauuacagucacgaagucgguaggcccgugcuccggacuaccaaaauucuugggagccgagauuucgacaucugcguacgcgauaugauuccugcagacguuccagagcauuuuagaggcagggugucuaucugggccauggucacauccguggauggaucacagcaggucgcuuucgacgacagcacucccgugcagcggcaacugguugauauccgcuacaguaaggacaccagaaagcaguucaaaccuggcuuggcguauguggggaagguagaacuaucuuacccagauggaucccccgcagagggugucacagugcagauuaaagccgagcugaccccgaaggacaacauauauacgagcgaaguugugucgcagaggggccucgucggguuugagaucccuucuauuccaacuuccgcucaacacguguggcuggaaacaaaaguaauggcccuuaauggaaagcccgugggcgcacaguaccugccuucauauuugagucucgguagcugguacucccccucucaguguuaucugcaguuacaaccaccuagccacccccugcagguuggggaggaagccuacuucucagucaaaaguaccugcccauguaacuuuacucuauacuaugagguggcugcccguggcaauaucgugcucuccggacagcagccggcacauacaacccaacagcggagcaagcgagcggcuccugcccuggagaagcccauaagacuuacgcacuugucugaaaccgagccacccccugcaccagaagccgaggucgauguuugcgugacaucacugcaucucgcugugacucccaguaugguaccucugggcaggcuucuggucuucuacgugcgcgaaaacggggagggaguugccgacagcuugcaguuugcaguggagaccuucuuugaaaaucaagucuccgugacauauucugcuaacgagacucagccgggugaaguuguggaucuccggauuagagccgcgaggggcucguguguaugcgucgccgcuguggacaaaagcguguaccuguuacgcuccggguuccgacugaccccagcacaggucuuucaggagcuagaggauuaugacguuucagauaguuucggagugucucgggaagacggccccuuuuggugggccggucucacagcucaacguagaaggcgcagcuccguauucccuuggccaugggggaucaccaaggacucaggcuuugccuucacugagacgggacugguggucaugacagaucgggugagccuuaaucacagacaggacggcggguuguacaccgaugaagcaguucccgcguuccagccucacacuggaucucugguggccgucgcuccguccaggcaucccccacgaaccgagaaacgcaagcggacauuuuucccugaaaccuggaucuggcacugucucaacauuagugaccccagcggcgaggguacucugucugugaaaguuccagauuccaucacaucaugggugggggaggccgucgcauuaaguacgagccagggacugggcauugcugaaccuucgcuuuugaagaccuuuaagcccuucuuuguagacuucaugcucccagcccugauaaucagaggugagcaagugaaaauuccgcuauccguuuauaacuacaugggcacuugcgcagaaguguacaugaagcugucugucccuaaagggauccaguuugugggacaucccggcaagaggcacguaacaaaaaagaugugcguggccccaggggaggcugaacccaucugggucguucucagcuucucagaucugggacuuaauaacauuaccgcgaaggccuuggcauauggcgacacaaauuguugccgugauggucgcaguuccaaacauccugaggagaaccacgcugaccggagagugccaauagggguggaucacgucaggcgaucugugaugguugaagccgagggaguaccccgggccuacacuuauagcgcuuuuuucuguccuuccgaacgcgugcauaucucaaccccgaauaaguacgaguuucaguauguccagagaccacugagguuaacgcgguucgacguggcaguucgagcccacaacgaugcgagaguggcucucagcaguggcccccaagacaccgccgguaugauugaaaucguccugggcgggcaucagaauacacgcucuuggauuuccacuagcaaaaugggagagccuguggcaucggcccacaccgcuaagauccuuucaugggacgaguuuaggacauucuggauaucuuggcguggcgggcugauccagguaggacacggccccgaaccaaguaacgaguccgucauuguggcauggacuuugccucggcccccagaaguucaauucaucgguuuuagcaccggguggggaucuaugggcgaguucagaauuuggaggaaaauggagguggaugaaagcuacuccgaggccuuuacgcucggugucccucauggcgcgaucccggggucagaacgcgcuacagccaguauaauuggagacgugaugggccccacccugaaucaccuaaacaaucugcuccgacugccauucgggugcggagagcagaacaugauccauuuugcaccuaauguuuucgugcuuaaguauuugcagaagacucagcaacugagccccgaagucgagagagagacaaccgauuacuuagugcagggcuaccagcggcagcucacuuauaaaaggcaagacgguucuuacuccgccuuuggggaacgcgaugcuucaggaaguauguggcugaccgccuucguacuuaagagcuuugcacaggcucguuccuucauuuuuguggacccaagagagcuggccgcggccaaaucuuggaucauacagcagcaacaggcagauggcucguuccuagcuguuggccggguccucaacaaggacauccaggggggaauucacgguacagugccucugacggccuauguggucguagcuuugcuggaaaccggcacugcaagcgaggaagagagggggucaacagauaaagcccgccauuucuuagaguccgccgcuccccucgcgauggacccguacaguugugcacugaccacauaugcccuuacucuguugcgaucuccagcugccccugaagcacucagaaagcugcggagccuagccaucaugagggauggagugacccacuggucccugucaaauucuugggacguugauaaaggcacguuucuuagcuucagugaccgcgugucccagagcgucgugucugcugagguugaaaugacagcguacgcccuccugaccuauacuuugcugggugacguggcagcugccuuacccgucgugaaguggcucucacaacagagaaacgcacuggggggauuuuccaguacccaggauacaugcguagcccuucaagcucuggccgaguacgcgauuuugagcuacgcaggcggcaucaaccucacugugucgcuggccucuaccaaucuagacuaucaggaaacauucgagcugcacaggacgaaccagaagguucuucagaccgcugccauaccaucccuccccacugggcuguuugucagcgcuaaaggagaugguuguugcuugaugcaaauugacgugacauacaaugugccugauccggucgcaaagcccgccuuccaguuacugguuucacuccaggagccagaagcucagggccggccucccccuaugccagccagugcagcggaggggucucguggagacuggcccccugccgaugacgaugacccagcugccgaucaacaucaccaggaauauaaagugaugcuggagguauguacccgcuggcuucaugcaggcuccagcaacauggcugugcuggagguccccuugcuaucagguuuucgagccgacaucgaaagucuggagcagcuccugcuugacaagcacauggggaugaaaagauacgaaguggcaggaaggcggguuuuauucuauuuugaugagaucccgagccgcugccugacuugugugagauucagggcccuccgggaaugcgucguaggccgaacauccgcuuugccugugucuguuuacgacuauuacgagccagcguuugaggccaccagauucuacaaugugagcacgcauuccccccuggcacgcgaacucugcgcuggcccugccuguaacgaggucgaaagggccccagcacgggggcccggaugguuuccgggugagucaggcccugcuguggcccccgaagagggggcggcuauugcccguugcggaugugaucacgacugcggcgcacaggguaauccagucugugggucugauggagugguuuaugccagugcuugcagacugagggaggcagccugucgccaagcggcuccucuugaacccgccccacccucgugcugugcacuggagcagcgguugccugccagcuccucuucaacuuacggcgacgaucuagcuagcguggccccaggcccgcugcagcaagacguaaagcucaacggggcaggauuagaaguggaggauuccgaccccgaaccugagggugaggcugaagaucgagucaccgccggcccaagacccccuguuaguucugggaaucuggagagcucaacacaguccgcgaguccauuccacagguggggacagacccccgccccucagcgccauagcggccggguggucggugcacacagaccggggcuucugucuccaguguucguauauucccccgcuuuucaaucaggaggcgaagagggccucuggaugagcaacacuugcacauugcguuga

SEQ ID NO: 54738 - RNA, 1254 nt, Artificial Sequence
  derived and/or modified sequence opt3 from CPB1__Homo_sapiens__NP_001862
augcuggcccuccuugugcuggucaccguugcuuuggcaagcgcccaccauggcggggagcacuucgaaggagagaagguguuuagaguaaacguggaagacgagaaucauaucaacauuauaagggaauuagcguccacaacucagaucgauuucuggaaacccgacucugucacgcaaauuaagccucacucaaccguggauuuucggguuaaagcugaggacacagugacugucgagaaugugcugaagcagaacgaacuacaguacaaaguacucaucaguaaucugcgcaacguuguggaggcccaguucgauagccgaguccgugcaaccggucauuccuaugaaaaguacaauaagugggagacaauugaggccuggacccaacagguggcuacugaaaacccagcacuuaucucuagaucggugauaggcacaaccuuugaggggagggccaucuaucuguugaaagucggaaaggcuggccagaauaaaccggccauuuucauggacugcgguuuucacgcgcgggaauggaucucacccgcauucugucagugguuuguucgcgaggccgugagaacguacgggagggaaauucaaguaacugagcuccuggauaagcuggacuucuaugugcucccugucuuaaacaucgauggauacauauauaccuggacaaaaagccgguuuuggcgcaagacucgaaguacccacacaggcuccucuugcauuggcaccgacccaaauagaaacuucgaugcuggguggugugagaucggagccagcaggaaucccugcgacgaaacguacugugguccugcagcugaguccgaaaaggagacuaaagcccuggcggauuuuauucggaacaaacuuucaaguaucaaggccuacuugacaauccauagcuauucucagaugaugauuuacccauauuccuacgcauauaagcugggcgaaaauaacgcugagcuaaacgcccucgcuaaagccaccgugaaggagcuggcaucacuucacgggacuaaauacacauauggacccggcgccaccacgauauacccugcugcgggugggagcgacgacugggcauacgaucagggaauccguuauaguuucaccuucgaacugcgcgacacaggcagauacggcuuuuugcucccagagucucagauuagggccacuugcgaagagaccuuccuggcuaucaaguauguugccuccuacguguuagaacaucuguauuga

SEQ ID NO: 54739 - RNA, 1161 nt, Artificial Sequence
  derived and/or modified sequence opt3 from CPB2__Homo_sapiens__NP_001265470
augaagcugugcagccucgccgugcuuguccccaucguucuguucugugagcagcacguguuugcuuuccaauccggccagguauuggcagccuuaccuagaaccucuagacaggugcagguccugcaaaaccuaacaacuacguacgaaauugugcucuggcagccaguuaccgcggaccugauagugaaaaagaaacagguccacuuuuucgugaaugcuucagauguagacaacguuaaggcccaucuuaaugugagugggaucccgugcagcguccuguuggcagauguggaggaccucauucagcaacagaucuccaacgauacagugucuccccgggccucggcuucauauuacgaacaguaucauagccugaaugagauuuacaguuggaucgaauuuauaacugagcgccacccugacaugcugaccaaaauccauauuggauccucuuucgagaaguauccacucuacgucuuaaagguuagcgguaaagaacaggcagccaagaacgcuaucuggauugauuguggcauccacgcccgagaguggauaucccccgcguuuugccugugguucauugggcacaaucguauguggaggaaaaacaggucauuuuaugcaaauaaccauuguaucggaacagaccuuaaucggaacuucgccaguaagcacuggugcgaagagggcgcuucuagcuccucauguagcgagaccuacugcgguuuguacccugaaagugagccagaagugaaagccguagcaucuuuucugcgcagaaauauuaaccaaaucaaggcuuauaucuccaugcauagcuacucgcagcacauuguguuccccuauucuuacacuagguccaagucaaaagaucacgaggaacuaagucucgucgccagcgaggcggugcgggccauagagaagaucuccaaaaauacacgcuauacccaugggcacggaucugaaacgcuguaccuugcaccuggcggcggggacgauuggauuuaugaccugggaaucaaguacagcuuuacuauagaguugcgagauaccgguacauacggcuuccuccugccagaaagauauauuaaaccgacuuguagggaggcuuucgccgcuguuucaaagaucgccuggcaugugauccggaacgucuga

SEQ ID NO: 54740 - RNA, 3402 nt, Artificial Sequence
  derived and/or modified sequence opt3 from CPD__Homo_sapiens__NP_001186704
augagauucgugcugagcggcaaccuccacgggggauccgucguugccucuuaccccuuugacgauucaccugagcauaaggcuaccgguaucuauaguaaaacaagcgacgaugaaguguucaaguaccuugcaaaagccuaugcguccaaucacccaauuaugaagacuggcgagccgcauugccccggggacgaagaugagacguuuaaagacggaauaaccaacggcgcucacugguacgauguagaaggugggaugcaggacuauaauuacgugugggccaacuguuucgagaucacacuggaguugucuugcuguaaguauccuccagcaucgcaauuaaggcaggaaugggagaauaaccgggaaucacugauuacucuaaucgagaagguccauauuggagugaaaggcuuuguuaaggauagcaucaccggcagugggcucgagaaugccacaauauccguggcuggaaucaaccacaauauuaccacuggucgcuucggcgacuuuuaccgacugcuuguccccgggacauacaaccugaccgugguauugacgggauauaugccucucacuguuaccaauguggucgugaaagaaggcccagcaacagagguggauuucucucugcgucccacugucaccagcguuaucccugacacaaccgaagccguguccacggcuucaacuguagccauuccaaacauccugagugguacauccucuuccuaccagccgauacagcccaaggauuuucaccaucaccauuucccugacauggagauuuuucucagaagguucgcgaaugaauauccaaacaucacccgguuauacucacuggggaaaagcguggagagucgcgagcuuuaugucauggaaauuucugacaaucccggagugcacgagccuggcgaaccagaguuuaaguacaucggcaacaugcacgggaacgaaguugugggaagagaguugcugcuaaaucucaucgaguaucugugcaagaacuucgguacugaucccgaagucacagaccuugugcauaauaccaggauucaccugaugccguccaugaacccugauggcuacgagaaaagccaagaaggggacucgauaucuguaaucggacggaauaacuccaauaacuucgauuugaaucgcaacuuucccgaccaguucguucagauuacggauccaacccagccugagacaaucgcagugaugucauggaugaagaguuaccccuuuguccucagcgccaaucugcauggcgguuccuuaguggucaacuauccauucgacgaugacgaacaagggcuggcuacuuacucuaaaagccccgaugacgccguguuucagcagauagcacucucauauaguaaggagaauagccagauguuccaaggccgaccuuguaaaaacauguacccaaaugaguauuuuccgcacggaauuaccaacggcgcuagcugguacaacguucccgggggaaugcaggacuggaauuaucuucagacaaacugcuucgaagugacuaucgagcuggguuguguaaaguacccuuuggaaaaagagcuaccaaauuuuugggagcaaaacagaaggucucugauccaguucaugaagcagguccaucagggcgugcggggguuuguucucgaugccaccgacggacguggcauucugaaugcgacaaucucaguggccgaaauuaaccaccccgucaccacuuacaagacgggugauuauuggcgccuucuggugccugggacauacaaaauaaccgcaagugcuagaggcuauaauccaguaacuaagaacgugaccguuaaaagcgagggagccauccaagucaauuucacauuggugagguccucuaccgacucgaacaaugaaagcaagaaaggcaagggggcuuccucaaguacuaacgaugccucugaccccacaacgaaggaguuugaaacccucauuaaagaucugagcgcagagaauggauuagagucccugaugcuacggucaagcucuaaccucgcccuggcucuuuaccgauaucacuccuacaaggacuugagugaguuccugcgcggucucgugaugaauuauccgcauaucacuaaccugacaaaccuuggccagagcaccgaguacagacacaucuggucucuggaaauuuccaauaaaccuaacgucucagagccagaagaacccaagauaagguucguugcggggauccauggaaaugcaccugugggcacagaguugcuccuggccuuagcugaauuucugugccuaaacuacaaaaagaaucccgccgugacucagcucguagaucggacccgcauugucaucgugccaagucugaacccugacgguagagagagggcacaggaaaaggauuguacgagcaaaauugggcaaaccaaugcccguggcaaggaccuugauacagacuucacuaacaaugcuucgcagcccgagaccaaagccaucauagaaaacuugauccagaagcaggacuuuucccugucuguugcacucgauggaggcagcaugcuggugacauauccauacgacaaaccgguccaaacuguggagaauaaggagaccuuaaagcaccuggcgucacuuuaugcuaacaaucacccuaguaugcauauggggcagcccuccugcccaaacaaaucugaugaaaauauucccggaggcguuaugcggggugccgaguggcacagccauuugggguccaugaaggacuacucagugacguauggacacuguccugaaaucacaguauacaccagcugcugcuauuucccaagugcagcccgacuccccucucugugggcugauaacaaaagaucccuacugagcaugcucgucgaggugcauaagggcgugcacgguuuugucaaagacaagacuggcaaaccuauuucgaaggccguuaucgugcugaacgaggggauaaagguacagacaaaagaaggaggcuacuuccacgugcuuuuggcaccggggguccauaauauuaucgcuauugccgauggauaccagcaacagcacucacagguguuuguucaucacgacgcggccucuaguguggucaucguguucgauaccgacaacaggauauuuggccugccacgcgaguuaguugugacugucuccggugcuaccaugagcgcacucauccugacagccuguauuaucuggugcauuuguucuaucaagagcaaucggcauaaagauggguuccacagacuuaggcaacaccaugacgaauaugaggaugaaauacgcaugauguccacgggaucaaagaaaagucuguugagccacgaguuucaggacgagaccgacacugaagaggaaacacucuacucuuccaagcauuga

SEQ ID NO: 54741 - RNA, 1476 nt, Artificial Sequence
  derived and/or modified sequence opt3 from CPEB1__Homo_sapiens__NP_001073001
augcuguuccccaccagcgcccaggaguccucuagaggccucccugacgcuaacgaucuuugccugggguugcaaucauuaagucugacaggaugggacaggccauggagcacucaggauuccgacucuucggcacagucaagcacgcacagugugcuauccaugcuccauaauccgcuggguaacguccuuggcaagcccccucugagcuuuuugccacucgauccccuggggagcgaccugguugauaaauucccugccccauccgugcggggaucacgccucgacacccgacccaucuuagauagucguucuucuuccccuucagacagcgauacaaguggcuuuucuuccgguagcgaccaccugucggaucuuauuucuuccuugagaauaucaccaccgcugcccuuccuaagucucagcgggggaggcccuagggacccacugaagaugggcguagggucccggauggaccaggaacaagcggcucuugccgcagugacucccucuccuaccagcgccucaaaacgcuggccaggagcuagugucuggcccuccugggaucuguuggaggcaccgaaggacccuuuuagcaucgaaagagaggccaggcuccaucggcaggcugccgcggugaaugaagcaacauguaccuggucuggucagcugcccccacgcaacuacaaaaauccuauuuauucaugcaagguuuucuuaggcggggugcccugggauaucacugaggccggacuggucaacacauuucgaguguucggcagucucagcguagaguggccagguaaggacgggaaacaccccagauguccuccaaagggaaauaugccgaaaggcuacguuuaucuuguguuugaacuggagaaguccgucaggucuuugcuacaggcuugcucgcaugauccccugagcccugacggccucuccgaauacuauuucaaaaugucaagucggcguaugcgcuguaaggaggugcaagugauuccauggguccuggccgauucuaacuuuguuagaagccccucccagaggcuugacccuucacggaccguguucguaggggcacugcacggaauguugaaugcugaggcccucgcggccauccugaacgauuuauuugguggcguggucuacgcagggauagacacggauaagcacaaauauccaaucggaagcggccgagugacuuucaauaaccagcgcucuuaccugaaggcuguuuccgccgcuuucguggaaauuaaaaccacaaaguuuacuaaaaagguccagaucgaccccuaccuagaggacagucucugccauauuuguagcucucaaccggguccuuucuuuugcagagaucagguguguuucaaauauuuuugcagguccuguuggcacuggcggcauucaauggaagggcugcgccaccacaguccacuuaugagaaaucagaagaacagggacagcucguga

SEQ ID NO: 54742 - RNA, 2055 nt, Artificial Sequence
  derived and/or modified sequence opt3 from CPEB3__Homo_sapiens__NP_001171608
augcaggacgaucugcucauggacaagagcaaaacccaaccccagccucagcagcaacagagacagcagcaacagccacagccggaguccucugugucagaagcccccaguacaccucuuagcuccgagacuccaaagcccgaagagaacucugcugucccugcacugucgccagccgcggcucccccugccccaaauggcccggauaaaaugcagauggaaucacccuuguuaccugggcugagcuuccaccaaccaccccagcagccuccacccccgcaagagccugcagcccccggagcuagucuauccccaucuuuugguagcacgugguccaccggcacaacuaacgcaguugaggacucauucuuucaggggaucaccccugugaauggaacaaugcuguuccagaacuuuccccaucacguaaauccaguguucggcgguaccuuuaguccccagauugggcucgcccaaacucagcaucaccagcagccuccaccgcccgcuccugccccacaacccgcgcagccugcacagccaccccaggcccaaccgccucagcagaggcggagcccagcuucucccucccaggccccuuacgcacaacgcucagcugccgcggccuauggacaucagcccauaaugacaagcaagccaaguucuuccagcgcagucgcugccgcugccgcagccgcugcggcaucgucugccuccucaaguuggaacacccaccagagcgugaaugcugccugguccgcaccuucuaaccccuggggcggccuucaagccgggcgagauccacguagagcuguuggagugggugucggcguggggguaggaguuccgagcccucugaaucccaucucaccauugaaaaagcccuucaguuccaacgugauugccccuccaaaguuucccagggcagcgccucucacgagcaaaucuuggauggaagacaaugcuuuccggacugauaacggcaauaaccugcugccguuucaggaccgcucaagaccauacgauaccuucaaucuccacaguuuagagaacagccugauggacaugaucaggacagaucaugaaccccuuaagggucggauggggauuaacuuucaccauccuggaacugacaauaucauggccuugaacucccgaucuucgcuguucccauucgaggaugcauuucuagacgacagccacggcgaucaggcccucuccucaggccugaguucucccacccgcugccagaauggggagagagucgaaagguauagccggaaaguguucgugggaggucuuccuccggacauagaugaggacgaaaucacagcuuccuuucgucgcuucggcccccuggucguugauuggccacacaaggccgagucaaaaagcuacuuuccucccaagggguaugcauucuugcucuuucaagaagagucuuccgugcaggcucugauugacgccuguuuagaggaagauggaaagcuguaccucugcguaaguagcccaaccaucaaagacaagccugugcagauuagacccuggaaccuuucugauuccgacuucgucauggauggcucacagccacuggacccgaggaaaacgaucuuugugggugggguuccucggcccuugcgagcgguggagcuagccaugauaauggaccgccuguauggcggagucuguuacgcuggcauugauacugacccagaacucaaguaccccaaaggggcaggaagaguggccuucaguaaucaacagagcuauaucgcugccauuucggcaagguuuguacagcugcagcauaacgauaucgacaagcggguugaggugaaaccuuacguccuugaugaccaaaugugcgaugaaugucaggguacacgcugcggcgggaaguucgcgccauuuuucugugccaaugugaccugccugcaguauuacugugaguauugcugggcuuccauccacucuagagccggaagggaguuccauaagcccuuggucaaagaaggcggugaccguccucggcacgugccguuucgauggagcuga

SEQ ID NO: 54743 - RNA, 2190 nt, Artificial Sequence
  derived and/or modified sequence opt3 from CPEB4__Homo_sapiens__NP_085130
augggcgacuacggguucggagugcugguccagagcaacaccgguaauaaguccgccuuucccguuagauuccacccucaucuccaaccaccgcaccaucaccagaacgcuacacccucuccugcagccuuuaucaauaacaauacugcggcuaacggcucaagugccgggagcgcauggcuuuucccagcccccgcuacgcauaauauucaggaugagauacugggauccgaaaaagcaaagucucagcaacaggagcagcaggacccuuuggaaaaacaacaguuaucgccaucacccggccaggaggccgguauccugccugaaaccgagaaggcuaaaagcgaggaaaaccagggggauaauaguuccgagaacggaaauggcaaggaaaagauuaggaucgagucuccagugcuaacaggcuuugacuaucaagaggccacugggcucggaaccagcacacagccgcugaccuccucagcgaguagccuuacugguuucucuaacugguccgcagccauugcucccucaagcaguacaaucauaaaugaagaugccuccuuuuuccaccagggcgggguaccugcagcuucugccaacaauggagcgcuguuguuucaaaacuucccacaccaugugagccccggcuuuggugggucguucucuccucagaucggaccacucucccagcaccauccccaccacccgcauuuucagcaccaucacucacaacaucagcagcagcggcgcaguccugccagcccccacccaccucccuucacccaccgaaacgcagcuuucaaucaacugccacaucuggccaacaaucucaacaaacccccuuccccauggucuagcuaccagucaccgagucccacgccuuccagcucuuggucaccaggcggcgggggauaugguggcuggggagggagucagggccgugaccacagaagggguuuaaaugggggcauuacuccccugaacagcaucuccccucuuaagaaaaauuuugcuucuaaccauauucaguugcaaaaguacgcccggccaucgagcgcauucgcccccaaauccuggauggaggauucacugaaucgcgcugacaacaucuuuccguucccugauagaccaaggaccuuugacaugcacagucuagaaucuagccucauagauauuaugcgggcggagaaugacacaaucaagggacgccugaacuauuccuaccccggcucagauagcucucuucugauuaaugcacgaacuuaugggagaaggcggggacaguccaguuuguucccuauggaagacgguuuucucgacgauggccguggggaccagccccugcacagcggauuaggcucuccacauugcuucucccaccagaacggugagcgcgucgagagauacucaaggaagguguuuguugggggccugccucccgauaucgacgaagaugagaucaccgccaguuuccggcgauuuggaccacucauuguggacuggccgcauaaagcugaaagcaagucguacuucccucccaaaggcuaugccuuucuucuguuccaagaugaguccucuguccaggcauugauagacgccuguaucgaagaggaugggaagcuauaccugugcgugagcucaccaacaauuaaagacaagcccguacagauccgcccuuggaaucucagugauuccgacuucguuauggacggaucucaaccacuggaucccagaaaaaccauauuuguggguggcgucccuaggccgcuucgggcuguggagcuggccaugauuauggaccgcuuguaugggggaguguguuacgcaggcaucgauacggacccagaacucaaguaucccaagggugcggggagagucgcuuucagcaaccagcaguccuacaucgccgcaauuucagccagguuuguucagcugcaacacggcgagaucgauaaacguguggaaguaaagccuuauguguuagacgaucagcugugcgacgagugucagggagcucggugcggcgggaaauucgccccauuuuucugugcaaacgucacuugccuacaguacuacugugaauauugcugggcugccauucauagccgagcgggaagagaguuucacaagccccucgugaaagagggcggugauaggccucgccacauaaguuuccgguggaauuga

SEQ ID NO: 54744 - RNA, 2352 nt, Artificial Sequence
  derived and/or modified sequence opt3 from CPED1__Homo_sapiens__NP_001099003
auggugugcagacccgucuucccuuguaggcggcgcuuuugcccacgaccguuccugguuggccucgugguagccaucugucuguuuuaccagacccugacauugcgugggagcagaaaguuaacugcugcagcccccggagcggugccucacacguccaccgagacacaggcuucuaggugcaaaaaggguuucucacaagacaaacaguguuuucugcuaaguggcaacgcccaggaaacucggaaggucaaagagagcauggaaacccauuucgggucccacggacgcagagcaauucucuauaggccacccuuuuacucuaagacagagcugcaacuucaucagcacauacugacccagcauggcuauacugugguuaucgccgaggaacgguugaaugcuggucucgggccuggacugcuggagcagggcgaucucggcucgugggacuuacugauuugccuuucaagcaagaaagcagaagggacaccauguaucaguaaggaggugaugugccaauugggacugcaccagaaagccaaccgccuacccgaaauucagcagccucucugucgaaaggagggucugugccaaaucgucagaagguucccagagcuucagcugccggugucccccucuguauguuuggaucagggcaugcaacucaaaccuagcaccuccucacaccuguuaaagacgguuaagccacggguguggaaacccggggacuggagucgugaacagcugaaugagacuaccguccucgcuccucaugaaacaauauuucgcgccgaggaucuuagcgugauccugaaggcguacguguuggucacuucucuaaccccacugagagcauucauucacuccacaggaaccguuuggaaucccccgaaaaagaaaagguuuacggugaagcuccagacuuucuuugaaacauuccugcgggccucaagcccucagcaggcuuucgacaucaugaaagaggccauuggcaaacuucuguuggcagcugagguauuuagugaaaccucuacucucggucccaagacauuccaucgaugccgcuuuugcuuccaacuguuaaccuuugauaucggguauggauccuucauguacccagugguccuucaggugcacgagcaccuaaauuuucaggacuaugauaacauggacuucgaagaucaaaauacggaggaauuucuccugaacgacaccuucaauuuucuuuucccuaacgagagcucguugucuauauuuuccgagauuuuccagagacuguacaggucagauguuuucaagggcgaaaauuaccagaaggagcucaaccagugucugagucuugaagagaucaauagcauuaugacauuuaucaaagaacugggcuccuuggggcaauuccagcuccuguuucccucuacuaccccaggaauccagagcuuaaugcaugaguucuaugacguggccaaccccgucgguaauccuggcucagugcugacacaguacuggagucuacucaacguauuugagcaauuccaguuuaugaacaagaaaacucagccacacccgcuggaauggaacuccuucaccgaggacaagaacauugaaaagccccaaguuccuuuugaugcgauagagaauaaaaaggccgcagugccacagaucaaaaacgagaauaaggaaauucauugcagcgacgaugagaacacacccugucacaucaaacagauauucacccauccucaccuugaauugaauccagacuuucaccccaagauuaaggauuauuacugcgaggucccguucgacguggucacugugacgaucgggguugaaacaccuaaaugucugugcaaggugcaucucuaugagcaggcuggaccaucuuuugccucauacccccugggcuuagguaugaacaaaaucaguauuuucguagucgaugagagcccugcucacggggaaacccugaucacuuauaaacuuaccauuuaccgggaggaccgccccuccuugccacucuucgaagccuuuacagcauguggcuucgugcaagauugcggacugcuaauacauccugaggaaaccuguggccugcagcccaucucuucggacuacauugaggccauccuccagagcgagcugaagagaugcccauccggggauaugaagggacaguggaucguuccgugucuuucaugcagugacaauaggacuugcgacuggcgugaaauuacauggcaaccucacaacugucaguaugguguguugacgaagccccagcugcagcaaugcuuaggcgggcggaaacucggagucgaugugcagcgaguaccaagaucuaggaauuga

SEQ ID NO: 54745 - RNA, 1431 nt, Artificial Sequence
  derived and/or modified sequence opt3 from CPE__Homo_sapiens__NP_001864
auggccggcagagggggaagcgcucugcucgcacuuugcggugcccuggcggcuuguggcugguuguuaggggccgaggcacaggaacccggagccccugcugcaggcaugaggcggcgccgacgucugcaacaggaggacgguaucuccuucgaauaccacagauauccagagcuaagggaagcccucgugucugucuggcugcagugcaccgcuauuucacggauauacacaguugggcgcaguuuugagggaagagagcuucuggugaucgaauugagcgauaacccgggcguacaugagcccggcgaaccugaguucaaguauauugggaauaugcacggaaacgaggccguggguagggaacuccugaucuuucuggcgcaguaccucuguaaugaguaucaaaaaggcaacgaaacuauugucaauuuaauccauuccacgcggauacacaucaugccaucucugaaccccgacggguucgagaaggcagccucgcagccuggagaacuuaaagauugguuugugggccgcucaaaugcucaggguauugacuugaaccgaaauuucccagaucuggacagaaucguuuacgugaacgagaaggaagggggacccaauaaccaucuacucaaaaauaugaagaagauugucgaucagaacaccaaacuggccccugagacaaaggcagugauccacuggauaauggacauuccauuuguacuuagcgcuaaucugcacggcggcgauuugguugccaacuauccguacgacgagacuaggaguggguccgcgcaugaauacucuagcucccccgaugacgccaucuuccaaucacucgcacgggcuuauaguagcuuuaacccugccaugucugauccaaaucgucccccuugccgcaaaaacgacgacgauuccucauucguggacggaaccacaaaugguggcgcuugguacagcgucccagggggaaugcaggauuuuaacuaucugaguucuaauuguuucgagauuaccguggaauuauccugcgagaaguuucccccggaggaaacucugaaaacauacugggaggacaacaagaauagccucaucucguaucuugaacagauccacagaggcgugaaggguuucgucagggaucugcaggggaacccuauugccaaugcaaccauaucuguugagggcaucgaccaugaugugacguccgccaaagacggagauuacuggcgguugcuaauucccggcaacuauaagcugacugcuucagcgccaggguaccucgcaaucaccaaaaagguagccgugccuuacagucccgcugccggagucgacuucgaacuggagagcuuuuccgagcgaaaagaagaggaaaaggaggagcuuauggaaugguggaaaaugaugucugagacacugaauuucuga

SEQ ID NO: 54746 - RNA, 3198 nt, Artificial Sequence
  derived and/or modified sequence opt3 from CP__Homo_sapiens__NP_000087
augaagauccugauucucggcauauuccuuuuucugugcagcacccccgccugggcuaaagagaagcacuacuauaucgggauuaucgaaacaacuugggacuacgcauccgaucauggagagaaaaaguugauuucuguggacacggaacacucaaacaucuauuuacagaaugguccugauagaauaggcaggcuguacaaaaaggcccuauaucuccaauacaccgacgagacauuccggacuaccaucgaaaagccagucuggcugggguuucuuggaccgauuaucaaagcggagacaggcgauaagguuuaugugcaucugaaaaacuuggcuagucgccccuacaccuuccacagccaugguauuacuuacuauaaggagcacgaaggggccaucuacccugacaauacaaccgauuuucagcgagcagacgauaaaguauauccaggagagcaguacacguauaugcuccuggccacugaagaacagucccccggcgagggcgacgggaacugugugacccguauauaccacucucauauugaugcuccuaaggacaucgcaucgggacugauugguccacucaucaucugcaagaaagauucauuagacaaggaaaaagagaagcacauugacagagaguucgucgugauguuuagcguuguggaugagaauuucaguugguaucuggaagacaacauaaaaacauacuguuccgagcccgagaaggucgauaaagacaaugaagauuuucaagagucuaacaggauguacagcgugaauggcuauacuuucgggucccuuccuggauugucaaugugcgccgaagaccggguaaagugguaccuguuuggcauggguaacgagguugaugugcaugcugccuucuuucacgggcaggcgcuaaccaauaagaacuaucgcaucgacacaauuaaucucuucccagcaacccuguucgaugccuacauggucgcucagaacccgggagaauggaugcuuaguugucagaaucugaaccacuugaaagccggccuccaagcauuuuuccaggugcaggagugcaacaagucuagcuccaaagacaauaucagaggcaagcaugugaggcacuauuacauagcugccgaggaaauuaucuggaacuaugcgcccucagggaucgauauuuuuacgaaagagaaucugacugccccuggaagcgacagugcagucuucuuugaacaggguacaacccggaucggcgggucuuacaagaaguuaguuuaccgcgaguauacugacgcuuccuucacaaaccgaaaagaaagaggaccagaggaggaacaucugggcauucucggucccgugauaugggccgagguaggggauaccaucagggugacguuucacaauaagggcgcuuacccucuuagcauugaaccaaucggaguccgguucaacaaaaauaacgagggcaccuauuacucgcccaauuauaacccgcaaucucguuccgugccucccucagccagucauguugcaccaacagagacuuuuaccuacgaauggacagugccuaaggaggucgggcccacuaaugccgacccagugugucuggcuaaaauguauuacagcgcgguagaucccaccaaggacaucuucacaggauugauugguccuaugaagauaugcaaaaagggcucccuacacgcaaacgggcgccagaaagauguugacaaggaauuuuaccuguucccaaccguguuugaugagaaugaaucucuccugcuugaggacaacaucagaauguucacuacggccccggaucaggucgacaaagaggaugaagacuuccaagagagcaauaagaugcacucaaugaacggauuuauguauggcaaccagcccggucugacaauguguaagggggauaguguggucugguacuuguucuccgcuggcaaugaagccgacgugcauggaauuuauuuuagcggcaacaccuaccucuggaggggagagcggcgagacacugcaaaucuguucccucagaccucuuuaacacugcacauguggccagauaccgaagggacuuuuaacguugagugccuaacaacggaccauuauaccgguggcaugaaacagaaguacacugugaaucaaugucgcagacagucagaggauaguacauucuaucucggggaaaggaccuacuacaucgccgcuguagaggucgaaugggacuauagcccccagcgggagugggaaaaagagcugcaccaccuucaggagcaaaacguguccaaugccuuuuuggauaagggagaguucuacauuggcucuaaauauaagaaaguuguguaccgccaguauacagacucgacuuuuagagucccuguggaaaggaaggcagaagaggagcaucuggguauccucgggccacagcugcacgcggauguaggcgacaaggugaaaauaaucuucaagaacauggcuacccgucccuacagcauucaugcccacggaguucagacggaauccucaaccgucacaccgacucuuccuggcgagacccugacauauguguggaaaaucccagaacggaguggggcaggaacugaggauucugccugcauucccugggcuuacuacagcaccguggaccaagucaaggauuuguauuccggccucaucgguccucugauaguuugccgaagacccuacuuaaaaguguuuaauccaaggcgcaagcuggaguucgcccuacucuuucugguguucgacgaaaacgagucaugguaucuugaugacaauauuaagacguacagcgaccauccugaaaaaguaaacaaggaugacgaggaguucaucgaaucuaauaaaaugcacgcaauuaacgggcggauguuuggaaauuugcagggccugacaaugcacgucggugaugaagugaacugguaucucaugggcauggggaacgagaucgaccugcauaccguucacuuccauggacacuccuuucaguacaagcauagaggcguguauaguagcgaugucuucgacauauuucccgggacuuaccagacauuagagauguucccaaggaccccgggaaucuggcugcuucacugucacgugacugaucauauucacgcuggcauggaaaccacauacacgguuuugcaaaaugaggacaccaaaucugguuga

SEQ ID NO: 54747 - RNA, 405 nt, Artificial Sequence
  derived and/or modified sequence opt3 from CPLX1__Homo_sapiens__NP_006642
auggaguucgugaugaagcaggcccugggcggggcuaccaaagacaugggaaagaugcucgguggcgaugaagagaaagaccccgaugcagccaagaaagaagaggaaagacaagaggcgcuuaggcaggcugaggaggaacggaaggccaaguacgcaaaaauggaagccgagcgcgaggcuguccgacaggggauccgugacaaguauggaauuaaaaagaaagaagagagagaagcagaggcccaggcugccauggaagcgaacagcgagggcucccugacaaggccuaagaaggcaauaccaccggguugcggggaugagguugaagaggaagacgagucuaucuuggauacugugauuaaauacuuacccggaccucugcaagacaugcuaaagaaauga

SEQ ID NO: 54748 - RNA, 405 nt, Artificial Sequence
  derived and/or modified sequence opt3 from CPLX2__Homo_sapiens__XP_011532721
auggacuucgugaugaagcaggcccugggcggggcuaccaaagauaugggaaagaugcucgguggcgaggaagagaaagaccccgaugcacaaaagaaagaagaggaaagacaggaggcccuuaggcagcaggaggaggaacggaaggcgaagcacgcucgcauggaagccgagcgagagaaaguccgucaacagaucagagacaaguacgggcugaaaaagaaagaagagaaggaagcagaggaaaaggccgcuuuggagcagccuugcgagggcagcuuaacaaggccgaaaaaggcaauuccagccggauguggugaugaagaggaagaggaagaggaguccauacuggacacuguucuaaaauaucuccccgggccucugcaggauauguuuaagaaauga

SEQ ID NO: 54749 - RNA, 477 nt, Artificial Sequence
  derived and/or modified sequence opt3 from CPLX3__Homo_sapiens__NP_001025176
auggccuucauggugaagaccauggucggcgggcagcugaaaaaccucacaggaagccuugguggcggggaggacaagggagauggcgacaaauccgcugcagaagcccaagguaugucuagagaggaauacgaggaauaucagaagcagcugguugaggagaaaauggaaagggaugcgcaguuuacucaacggaaggcugagcgcgccacguugcgaucacacuuccgugacaaguacagauuacccaaaaaugaaaccgaugagagucagauccagauggcagggggagacguggagcugccuagggaacuagccaagaugauugaggaagauacagaggaagaggaggaaaaagcuagcguacucggccagcuggcaucccuuccaggccugaacuuggggucucucaaggacaaagcccaagcuacucugggagaucugaagcagucggccgagaagugccaugugauguga

SEQ ID NO: 54750 - RNA, 483 nt, Artificial Sequence
  derived and/or modified sequence opt3 from CPLX4__Homo_sapiens__NP_857637
auggccuuccugaugaaaagcaugaucuccaaccaggugaagaaucucggcuuugggggagguucugaggaaaacaaggaggaaggcggggcuucagaccccgcagccgcgcaaggaaugaccagagaggaauacgaggaguaucagaaacagaugauugaagagaagauggaaagggaugcugccuucacacagaaaaaggcagagcgggccugccuucgcguccacuugcgagagaaguaccgucugccuaaaagugaaauggacgagaaucaaauacagauggcuggcgaugacguugauuuaccagaagaccugagaaagaugguggaugaggaccaggaagaggaggaagauaaagacagcauccuaggucagauucaaaaccuccagaauauggaucuggacacuaucaaggagaaagcacaggccacguuuaccgaaauuaagcagacagcugagcaaaaguguuccguaauguga

SEQ ID NO: 54751 - RNA, 1332 nt, Artificial Sequence
  derived and/or modified sequence opt3 from CPM__Homo_sapiens__NP_001005502
auggacuuccccugccuguggcucggccuucuguugccuuuaguagccgcucuggauuuuaacuaccacagacaggaggggauggaagcauuccuaaagaccgucgcccaaaauuauagcuccguuacacaucuccacucuaucggaaaaucagugaaggguaggaaccuguggguacuuguggucggccgguuuccaaaagagcaucgcauugggauaccggaguucaaguacguggcgaauaugcacggagacgaaacuguuggccgagaacuguugcuccaucugaucgauuaucuggugacgagugacgguaaagaucccgagauuaccaaccucaucaauagcacacguauucacaucaugccuuccaugaacccagacggguuugaggcugucaagaagcccgauuguuacuauucuauaggaagagaaaauuacaaccaguaugacuuaaauaggaacuucccugaugccuuugaguacaauaacgugucgcggcagccagaaacuguagcaguuaugaaauggcugaagaccgagacauucgugcuuucagccaauuugcacggcggcgcucuggucgcaagcuaccccuuugacaacggggugcaggccaccggagcucuauauagucgcucccucacuccugaugacgauguguuccaauaccuggcccauacauaugcgucuagaaauccaaacaugaaaaagggugacgagugcaaaaacaagaugaauuuuccgaacggcgucaccaauggguacagcugguauccccuucagggaggcaugcaggacuacaacuauaucugggcacaguguuucgaaauuacgcuggaguuguccugcuguaaguacccuagggaagagaaacucccaucauuuuggaauaacaauaaggccagucugaucgaauacauuaaacaaguucacuuaggugugaaggggcagguauucgaucagaacggaaauccccugccuaacgugaucgucgaggugcaggaccggaaacauauaugcccauaucgcacuaauaaguacggcgaguauuaccuccuucuguugcccggcagcuauauuaucaacguuaccgugccggggcacgauccucacauuacaaaagucaucauccccgaaaagucucaaaauuucuccgcucuaaagaaagacauucugcucccauuucagggacagcuggauucaauaccugugagcaaccccaguuguccaaugaucccccuuuaccgaaaucugccugaccauucugccgcaacuaagccauccuuguuccucuuucuggugagcuuacugcacauuuucuuuaaauga

SEQ ID NO: 54752 - RNA, 1419 nt, Artificial Sequence
  derived and/or modified sequence opt3 from CPN1__Homo_sapiens__XP_011537601
augagcgaccugcucuccguguuccuucaccuguuguuacuguuuaagcuagucgcccccguuaccuucagacaucacagguacgaugaccucgugcggacacuguauaaaguacagaacgagugcccuggcaucacucgcguguacucuauugggcgaucagucgaaggacgucaucuuuaugugcuggaguuuagugaucacccagguauacaugaaccguuggagcccgaaguuaaguacgugggcaauaugcacgggaacgaggcucucggaagagagcugaugcugcaacucagcgaguucuuaugugaggaauuuaggaaucggaaccagcgcaucguccagcugauucaggacacgagaauccacauucuuccuuccaugaauccagauggcuaugagguggcagccgcgcaaggucccaacaaaccuggguacuugguaggaaggaauaacgcuaauggcguugaccugaaccggaauuucccagaucuaaacaccuauaucuacuacaaugagaaguauggcgggcccaaccaucaccucccucugccagacaauuggaaaucucagccgcagcuugcccugcaucgccagcccuuggcaucgucacaaguggaaccugagacacgagccgucauaagauggaugcacagcuuuaacuucgugcucagugcuaaccugcacggaggugcaguggucgccaauuacccauaugauaaguccuuugaacauaggguucggggcgugcgucgcacugcuucuacccccacaccugacgauaaguuauuccagaaacuggccaagguauacagcuaugcgcacggguggauguuucagggauggaacugcggcgacuacuucccagaugguaucaccaauggggcauccugguauucacucaguaaaggaaugcaggacuuuaacuaccuucauacuaauuguuucgagauuacacuggaauugagcugcgacaaguuucccccggaggaggaacuacaaagagaguggcugggcaacagggaagcccucauccaguuccuggaacaggugcaccaaggcauuaaagggaugguccuugaugaaaauuacaacaaucuggcuaacgccgugaucucuguuuccggaauaaaucaugacgugaccucaggugaucacggcgacuauuuccgguugcuccugccugggauuuacacggucagcgcaacugcucccggauaugauccagagaccgugacaguaacuguuggcccugccgagcccaccuuagugaacuuucaccugaagcgaaguaucccacaggucucucccgugcgcagagcgccuuccaggcggcaugguguccgcgccaaggugcagccacaggcaaggaaaaaggaaauggagaugagacaacuacagcgugggccggcuuga

SEQ ID NO: 54753 - RNA, 1638 nt, Artificial Sequence
  derived and/or modified sequence opt3 from CPN2__Homo_sapiens__NP_001278917
augcugcccggcgccuggcuccuuuggaccagccuguuguuacuggcuagaccugcacagccaugcccgauggggugugacugcuucgugcaagaggucuuuuguuccgaugaagaacuagccacaguuccccucgacaucccuccauacacuaagaacauuauauucguggaaacgucuuuuaccacacuggagacuagggcguucggaucaaaucccaaccuuaccaaaguaguguuucugaauacacaguugugccaguuccggccugaugcuuuugguggccucccacgccuggaagaccuggaggucaccgggaguagcuuccucaacuuauccacuaauaucuuuucuaaccugacaucgcuuggaaaguugacccugaauuucaacaugcuagaggcccuccccgaaggccuguuucagcaccuugcagcccuggagucauugcaucuccaagguaaucagcugcaggcuuuaccucgacgucuguuccagccacucacgcaccuuaaaacucugaacuuggcacaaaaucuacuggcccagcucccggaggagcuguuucauccccuuaccagccugcagacauugaagcucaguaacaaugcucuguccggguuaccucagggaguguucggcaaacugggcucucuacaagaacucuuccuggauagcaacaauauuuccgaacuuccaccccagguguuuucacaguuguucugucuggagagacucuggcugcaaaggaacgccaucacucaccuuccucugaguauuuuugcgagcuuggggaaccucaccuuccugucuuuacaguggaauaugcugcggguucuaccagcaggacucuuugcccauacacccugccuggucggucuuuccuugacccacaaccagcuggaaacgguggcugagggcacuuucgcccaccucucaaaucugcgcagcuuaaugcugaguuauaacgcaaucacacaucuuccggcugggauauuuagagacuuggaggagcucguaaagcuguaccuaggaucuaauaaccugaccgcccuccacccugcgcuguuccagaaucuuuccaaguuggagcuguuaagccucucgaaaaaccaacugacuacacuucccgaaggcaucuuugauaccaauuauaaccuguucaauuuggcccuccaugguaacccauggcagugugacugccaccuggcauaccuauuuaauuggcugcagcaguauacggauaggcuccugaacauucaaaccuacugugcugggccugccuaucuuaagggacagguugugcccgcuuugaaugagaaacagcuggucugcccagugacacgggaccacuuaggcuuccaggugacuuggcccgaugaaucuaaggccggcggguccugggaccucgcaguccaagagcgcgccgcucgaucacaguguaccuacaguaacccugaaggaacaguugugcuggcgugcgaucaggcacagugcagauggcuuaacguacaacugagcccacagcaggguucccuaggccuccaauacaaugccucucaggagugggaccugaggagcucaugugggaguuugcggcugacuguguccaucgaggcucgugccgcaggaccguga

SEQ ID NO: 54754 - RNA, 1611 nt, Artificial Sequence
  derived and/or modified sequence opt3 from CPNE1__Homo_sapiens__NP_001185792
auggcccacugcgugacccugguccagcucagcaucuccugugaccaucuuauugauaaggacauaggcucuaaaucagauccccugugcguuuuguuacaagacgucgggggagguaguugggcugagcugggcagaacagaaaggguacggaacuguagcuccccugaguucucuaagacucuacagcucgaauaccgcuuugagacggugcagaaacugcgauucgggaucuaugauauugacaauaagaccccagaacuucgugaugacgauuuucugggaggcgcagagugcucguugggucagaucgucucaagccaagugcucacacugccgcugaugcucaaacccgggaagccugccggaagaggcacuauuaccguuagugcgcaggaguuaaaggacaacaggguggucacaauggaaguggaggcucggaaucuggauaaaaaggacuuccuuggcaaauccgauccauuuuuggaguucuuucgccagggggacggaaaguggcaccugguauacagaucugaaguuaucaaaaacaaucuaaaccccaccuggaagagguucagcgugccuguccagcauuuuugugguggcaauccauccacucccauacaagugcagugcucagacuaugauagugacgggagccacgaucucaucggaacauuccauaccucucuggcccagcuucaggcagugccugccgaguuugaauguauucacccagagaagcaacagaaaaagaaauccuacaagaacucaggcacgauccgggucaaaauuugccgcguugaaacugaguauagcuuccuggacuacgugaugggugggugucagaucaauuuuaccguaggaguggauuucacaggcaguaacggcgacccgucuucccccgauagcuugcacuaucucucgccuacuggggucaaugaauaccugauggcuuuauggucugugggauccguugugcaagacuacgauucagacaagcuguucccagcauuugguuucggcgcccaggugcccccugauuggcaagugagucaugaguuugcucucaacuucaauccaagcaaccccuauugcgccgggauacagggaauuguagacgcguaccgacaggcacuuccgcagguuagacuguauggcccuaccaauuuugcccccaucauuaaccacguggcuagguucgccgcacaggcugcccaucaggguacagcguccuacuuuauguugcuacugcucaccgacggggccgucacggauguggaggcaacucgggaagcugucgugcgugccucuaaccugccaaugagcguuaucaucgugggcguaggaggcgcugacuucgaggccauggaacaacuugaugcagacgggggaccucugcacacacgcucaggucaggccgcugcgagagauauuguccaguuugugcccuauaggcgguuccagaaugcaccacgagaggccuuggcucaaaccguucucgccgaagugcccacucagcuggucaguuacuuucgcgcacagggcugggccccuuuaaaaccacugccgcccuccgcuaaggacccugcccaggcaccacaagcguga

SEQ ID NO: 54755 - RNA, 1647 nt, Artificial Sequence
  derived and/or modified sequence opt3 from CPNE2__Homo_sapiens__NP_689940
auggcccacauccccagcggcggggcuccugcagccggagcggcuccaauggguccgcaguacugcguguguaaggucgagcuguccguuucuggccagaaccuccuugacagagaugugaccucaaaaagugaccccuucugcguacuguuuacagaaaauaacgggagguggauugaguaugaucggacugaaacggccauaaauaacuugaauccugcauucagcaagaaauuuguguuagacuaccauuucgaggaaguccagaagcugaaauuugcccuauucgaucaggacaaguccucuaugcgccucgaugagcacgacuuucugggacaguucucguguucacuuggcaccaucgugagcaguaagaaaauuacacgaccacuguugcuccugaacgauaagcccgcugguaaagggcugaucacuauugcagcccaagagcucuccgacaaucguguuaucaccuuaucucuggcuggaagaaggcuugauaagaaagacuuguuuggcaagagcgauccuuuccuggaauuuuauaagccaggcgacgacgggaaauggaugcuagugcaucggacagaggucauaaaguacacccucgaucccguguggaaaccuuucacuguaccacugguuucccuuugcgacggagauauggaaaagccgauccaggugauguguuaugacuacgauaacgacgguggccacgauuuuauuggggaguuccagacaucagucagucagaugugcgaggcccgcgacagcgugccccuggaguucgaauguaucaauccuaaaaagcaaaggaaaaagaagaacuauaaaaauucuggaauuaucauauugagauccugcaagauuaaccgggauuacucauuucucgacuacauccugggcgguugucaguuaauguucaccguggggauugauuuuacggcgagcaauggaaacccacuggaccccaguucucuccauuauaucaauccuaugggcacuaacgaauaccuuuccgcaaucugggccgucggccagauuauacaggacuaugauagcgacaaaauguucccagcucugggguuuggagcccaauugcccccggauuggaagguuucgcacgaguucgcaaucaacuuuaauccuaccaaccccuucugcucugguguggacggcauugcucaggccuacuccgcgugucuaccacacauccgcuuuuaugggccuacaaauuucucacccauaguaaaccauguggcccgauuugcagcucaggccacucaacagagaaccgcuacacaguacuucauucugcucaucaucaccgauggagucauuagugacauggaagagacgaggcacgccgugguucaggcaagcaaacugccaauguccaucauuauagugggcgucgguaaugccgauuuugcugcgauggaguuccuugacggggauucucggaugcugcguagccauacuggcgaagaggcagcccgcgacaucgugcaauucguacccuuuagagaguucaggaacgcugccaaggaaacauuggcaaaggccguucucgcugaacugccucaacaggugguccaguauuuuaaacacaagaauuuaccaccgaccaacucagagcccgccuga

SEQ ID NO: 54756 - RNA, 1614 nt, Artificial Sequence
  derived and/or modified sequence opt3 from CPNE3__Homo_sapiens__NP_003900
auggccgcucagugcgugaccaaggucgcacugaacguuagcugugccaaucuccuugacaaagauaucggcuccaagucugacccccugugcguguuguucuuaaacacaucagggcaacagugguacgagguagaaagaacugagaggauuaaaaauugucugaacccucaguuuaguaagacguucauaaucgauuauuacuuugaagugguccagaaacuaaaguucggaguguaugacauugauaauaagaccaucgagcucagcgacgaugacuuucugggugaaugcgaguguacacuuggccaaauuguuuccucuaaaaagcugacucggccauuggugaugaaaaccgggcgcccggcgggaaagggcucgaucacaauaucagcugaggaaaucaaagauaaccgagucguacucuucgagauggaagcccguaagcuggacaauaaggaucuguuugguaaaagcgaccccuaccucgaguuccacaagcagaccagugaugggaacugguuaauggugcauagaacugagguugugaaaaauaaccugaauccugucuggaggccauuuaagauuucccuuaacucuuugugcuauggagacauggacaaaacaaucaagguggaauguuacgauuaugacaaugauggcagccacgaccugauuggcaccuuccagacgacuaugaccaaacuaaaggaggcaucccggucaagucccguggaauuugagugcaucaacgaaaagaaacgccagaagaaaaagagcuacaaaaauucuggggucauauccguuaagcaaugugagauuacaguggagugcacuuuccucgauuacaucaugggagguugucagcugaacuuuaccguaggcguggacuucacagggucaaacggagauccuagaagcccagacagucuucauuauauuucucccaauggcgucaacgaauaccugaccgccuugugguccgugggucucguuauccaggauuaugacgcugauaagauguucccugcauuuggguucggagcccagaucccaccgcaauggcaagugagccacgaguuucccaugaauuucaacccuucgaauccauacugcaacggcauucagggcauagucgaggcuuauaggucuugccugccccagaucaaauuauacgggccuacgaauuuuuccccaauuaucaaccauguggcccgguucgcggcagccgcuacucagcagcagacagccucacaauauuuuguacugcucauaauuaccgacggaguuaucacugaccuugaugaaacacgccaggcaaucgugaaugcuagucgacugcccaugagcauuaucauugucggugugggcggggccgacuucuccgcgauggaauuuuuggauggagacggcgguucucuaagaagcccgcugggggaggucgccauaagggauaucgugcaguucguuccuuuucggcaguuccaaaacgcacccaaggaggcucucgcccagugugugcuggcugaaauuccacagcagguagucggcuacuuuaauaccuacaaacuucugccucccaagaacccagccacgaaacaacagaagcaguga

SEQ ID NO: 54757 - RNA, 1728 nt, Artificial Sequence
  derived and/or modified sequence opt3 from CPNE4__Homo_sapiens__NP_001276041
auggccguggagcccagcuccucugaaucaaucaagagaagggcuggccggcgcaugaaaaagaugaguaacauuuacgagagcgcagccaauacccuggggauauucaacuccccuugccucacaaaagucgaacuucgaguugcguguaagggaaucucugaccgugaugcucugucgaaaccagacccgugcgugauuuugaagaugcagucacacggucaaugguuugagguagauagaacugaagugaucaggacguguauuaaucccgucuauagcaaguuauucaccguggacuuuuacuucgaggagguucagcggcugcgcuuugaagugcaugauaucaguuccaaccacaauggccuaaaagaggccgacuuccucgggggaauggaaugcacacugggccagauagucucucagagaaaacuuagcaagucccuguugaagcaugguaacacugcagggaaaucaaguaucaccgugauugccgaggagcucagcggaaaugaugacuauguagaacuggcuuuuaacgcaaggaagcuggaugacaaggauuucuuuucuaaauccgacccuuuccucgagaucuuucggaugaaugaugacgccacacaacaguuaguucaccgcaccgaaguggucaugaacaaucugucaccagcuuggaagaguuucaaagugagcgugaacucucuuuguuccggcgaccccgaucgaagauugaagugcauugucugggacugggauagcaauggcaaacaugacuuuaucggggaguucacuucgacauucaaggaaaugaggggagccauggaggguaaacagguucagugggaguguauaaacccuaaguacaaggcgaaaaagaaaaauuauaagaacucuggcaccgugauucugaaccuaugcaaaauccacaagaugcacuccuuucucgauuacauuaugggagggugucaaauccaguucacgguagcaaucgacuuuacugccucaaauggcgauccacggaacaguugcagccugcauuauauucaccccuaccagccuaaugaauaccuuaaggcucugguggccgucggugagauaugucaggacuaugauuccgacaaaauguucccagcauuuggguucggagcucguaucccgcccgaauacaccgugucucaugauuuugccauuaacuucaaugaggacaacccugaaugcgcgggcauccaaggcguuguggaggccuaucagagcugcuugccaaagcuccagcuguacgggcccacaaauauagcaccuauuauccaaaaagucgcuaagucagccagugaggaaacuaacaccaaagaggcuucccaguauuuuaucuuacugauucucacagacggagugaucaccgauauggccgacacgcgcgaagcaauuguacacgccagccaccuuccaaugucuguuauaaucgugggugucggcaaugcugauuucucagacaugcagaugcuggauggggacgauggaauuuugagaagucccaagggcgagccggugcuaagggacaucguccaguuugugccuuuccggaacuuuaagcaugcgagccccgcagcccuggcuaaauccguucucgccgaagugccaaaucaaguagucgauuacuauaacgguaaggggaucaaaccuaaguguucuucggagauguacgagagcucccgaacucuggcacccuga

SEQ ID NO: 54758 - RNA, 1902 nt, Artificial Sequence
  derived and/or modified sequence opt3 from CPNE7__Homo_sapiens__NP_055242
augagcgccggcuccgagagaggggcugcagccacccccggaggucugccugcgccaugcgcuucuaagguggaacucaggcuuucaugucggcaccuguuggaccgcgauccguuaacaaaaagugaccccagcgucgcccugcuacagcaagcacagggccaguggguucagguggggcgaacugagguagugcguuccucucuccauccugucuucucgaagguguuuacgguugauuacuauuucgaagaggugcaaagacugagguuugaagucuacgacacccacggaccaucaggcuucagcugccaggaggaugacuuucuuggugggauggaguguacacugggacagcccgcccagaaaugguugcuccaagugguaaugcggguuaguguggauguccugggcccugcuggccauugcgcaaagcacuuccuguguugcacugaauccucucaucucgcccgcaccgggcccagcuuuuuacugagauaugacgaucuuuguuugccaugggcuacagccggagcggugaggugguggaccugccgggguggccacacucagggguggcagaucguggcacagaaaaaggucacacgcccucugcuacucaaguucggacgaaacgccggcaaauccaccauuacgguuauagcugaggacaucucagguaauaacggguacguggaacugaguuuuagagccaggaaacuugaugacaaagaucuguucagcaagucugacccauuuuuggagcucuaucggguaaaugacgaucaaggacugcaguuaguguaccguacugaggucgugaaaaacaaucugaacccgguuugggaagcauucaaggugucccucucaagccuuuguaguugcgaggaaacccgcccccugaaguguuuggucugggacuaugauucuagaggcaaacacgacuuuauuggcgaguucuccacaacuuucgaagagaugcagaaggcuuuugaggaagggcaagcccagugggauugcgugaauccuaaauacaagcagaaaaggcggagcuacaagaacucgggaguaguugugcuagcggaccugaaauuccaucgagucuauucuuuucucgauuacaucauggguggcugccagauucacuucaccguggccaucgacuuuacagcauccaauggggauccacgcaacucauguagucugcauuauauaaaucccuaccaaccuaacgaguaucuuaaggcucuggucagcgugggagaaaucugccaggacuacgauuccgacaagagauucucugccuugggcuuuggugcuaggauuccacccaaauaugagguuagccacgacuucgccaucaauuuuaacccggaagaugacgagugugaggggauucagggcgugguagaagcauaccagaauugccucccucggguccaacuguacggacccaccaacguggccccaaucauaucaaagguugcucgcguggcggcagccgaggaaaguacgggcaaggcuucccaguauuacauuuuacugauccuaacugauggggucgugacagacauggccgauaccagagaggcaauuguaagggccagccgucucccuaugucuaucaucauugugggaguugguaacgcugacuucacugauaugcagguccuggacggcgaugacggggugcuucggucaccccgaggagaaccagccuugagagauauagugcaguuuguccccuucagggagcugaagaaugcaaguccugcggcucucgccaaauguguucuggcagaggugccaaagcaagugguagaauauuacagccaccgcggccuuccgccccggucccugggugucccugccggggaggcuucuccaggcugcacacccuga

SEQ ID NO: 54759 - RNA, 1695 nt, Artificial Sequence
  derived and/or modified sequence opt3 from CPNE8__Homo_sapiens__NP_705898
auggacagcagauacaacuccaccgccggcaucggggaucugaaucagcucucugcugcaauucccgccacaaggguggaggucucaguuaguugccggaaccuucuggaccgcgauacuuucagcaaguccgacccuauauguguguuguauguacaaggaguggguaauaaagaauggcgagaguuuggccguacggaagucaucgauaacaccuuaaauccagacuucgugagaaaguuuauucuggauuacuucuuugaggaaagggagaaccuacgguucgaccucuaugauguugacucuaaaucgccgaaucugucaaagcacgauuuucuuggacagguguucugcacacugggagagaucgucggcagccaggguagucgcuuggaaaaacccauuguggggaucccuggaaagaaguguggcacuauaauccucaccgcggaggaacugaacugcuguagagacgcuguacugaugcaguuuugcgccaauaaacucgauaagaaagacuucuuuggcaaguccgacccauucuuaguuuucuacaggucuaacgaggaugggagcuucacaauuugucauaaaaccgagguggucaagaauacucugaaccccguguggcaagcauucaagaucuccgugcgggcccuuugcaauggagacuaugaucgcacaauuaaagucgaaguuuacgacugggaucgagacgguucacacgauuuuaucggcgaguucaccacgaguuauagagaauugagcagggggcagucucaguuuaacguguacgagguagugaauccuaagaaaaaggggaaaaagaaaaaguacacuaacuccggcaccgucacacugcuaucauuccucguggaaacugagguuagcuuucuggacuauauaaagggugggacccagauuaacuucacaguggcuaucgauuuuaccgcaaguaauggaaacccagcccaacccacgucucuucauuacaugaauccuuaucagcugaacgcuuacggcauggccuugaaagcggucggcgagauugugcaggacuaugauuccgacaagauguucccagcacucggguuuggagccaaacugccgcccgacggucggaucagccacgaauuugcuuuaaauggcaacccucagaauccauacugugaugggaucgagggaguaauggaagccuauuaccguucgcugaagucuguucaacucuacggccccacuaacuuugcaccugugauuaaucaugucgcucgcuaugccuccucagugaaagacgguagucaguacuucguccuucugauagugacagaugggguuaucagcgacauggcgcagaccaaggaguccauugugaacgccucuaaguugccaaugagcaucauaauuguaggcgucggacccgcagaauuugaugcuaugguggagcuagacggcgaugacguuagagugucaaguagggggaaauaugccgagcgggauaucguccaauucgugccguuccgagacuacaucgaucgcuccggaaaucacauucugagcauggcuagacucgccaaggacguacuggcagaaaucccugagcaguuucuuucuuauaugagggcccgggguauuaaacccucaccagcuccucccccauacacucccccuacacacgugcugcagacccagauauga

SEQ ID NO: 54760 - RNA, 1125 nt, Artificial Sequence
  derived and/or modified sequence opt3 from CPO__Homo_sapiens__XP_011508929
augaagccccugcucgagacccuuuaccuguugggcauguuagugccugggggacuggguuaugacagaagccuagcccagcacaggcaagaaaucgucgauaaauccguuucuccauggucacucgagacauacaguuauaacauuuaccauccgaugggcgaaauauaugaguggaugcgggaaaucagcgagaaguacaaagaggugguaacucagcacuuccugggggugacguaugaaacccaucccauguacuaccuuaagauuucccagccuucuggaaaucccaaaaagaucauuuggauggacugcggcauccacgcucgcgaguggauagcaccagccuuuugucagugguucgucaaggaaauccugcaaaaccauaaagauaauucgucaauucgaaaguugcuccguaaccuggacuuuuaugugcugccuguucucaauaucgaugguuacauuuauacauggacuaccgacagauuauggaggaaaagccggaguccacacaacaaugggacaugcuucggaaccgaucugaaccgcaauuuuaacgcguccugguguucuaucggcgcuagcagaaauugccaggaccagacuuucuguggcacagggcccguguccgagccugagaccaaggccgucgcaucauuuauagaaaguaaaaaggaugacauucuuugcuucuugacgaugcacagcuacggacagcugauccuaacuccauaugguuacaccaagaacaaaucuuccaaucauccggagaugauucaagugggccagaaggccgcuaacgcacucaaagccaaguaugggacaaauuacaggguaggaucaagcgcugauauccuguacgccaguucuggcuccagccgggacugggcgcgcgauaucgguauucccuuuucguauacuuucgaacuucgagacucugggaccuacggauuuguucugccugaggcacagauacagccaacaugugaagagaccauggaggccguguuguccguccucgacgauguguaugcuaaacacuggcauucagacagugccggcagagugacgagcgcaacuaugcuguuaggccugcucgucuccugcaugucucuucuguga

SEQ ID NO: 54761 - RNA, 1365 nt, Artificial Sequence
  derived and/or modified sequence opt3 from CPOX__Homo_sapiens__NP_000088
auggcccugcagcucggcagacuuagcuccgggcccugcuggcugguggcuaggggagguuguggcgggccucgggcauggucucaaugcggaggcgguggguugcgcgccuggucacagcgaagugcggcuggacgugucuguagaccaccgggccccgccggcaccgagcagagcaggggguuaggacacgguuccacaucucggggcgggccuuggguuggaacuggccuggcagccgcucuagcaggucucguggggcuggccacggcugccuucggacauguacagcgcgcggaaaugcuuccaaagaccucgggcacaagagcaacuucacugggcaggcccgaggaagaggaagacgaguuggcccaccggugcagcaguuuuauggcuccuccagugaccgaucucggggagcugcgccgaagacccggagacaugaaaacaaagauggaacugcucaucuuagagacccaagcccaggucugucaggcacuggcucagguggaugguggcgccaacuucuccguugacaggugggaacggaaagaagggggaggcgguauuucuugcgugcuucaagaugggugugucuuugagaaggcgggcgugagcauauccguaguucauggaaauuugucagaagaggccgcaaaacagaugcguagucgcggcaaggugcugaagacuaaagacgggaagcuaccuuucugcgcuaugggagucagcucugugauccacccgaaaaacccacaugcccccacaauucacuuuaauuacagauauuucgaaguggaggaagcugaugguaacaagcaguggugguuuggcgggggaugugaccucaccccuacguaccugaaucaggaggaugccguccacuuccauaggacucuuaaagaggcaugcgaccaacacggcccagaucuguaucccaaguuuaagaaauggugugacgauuacuucuuuaucgcccaucggggugaacgacgcgggauuggcggaaucuucuuugacgacuuggauuccccuucaaaggaggaaguuuucagauucgugcagagcugcgcuagggcgguagugccaaguuauauaccccucgucaaaaagcacugcgacgauucuuuuaccccgcaggagaaacuguggcaacaguuacggcgcggcagauacguggaguucaaccugcucuaugacagggggacaaaguuuggacuuuucacuccugguucccguaucgagagcauucugaugucguugccccuaaccgcacggugggaguacaugcacucuccauccgaaaauucaaaagaggccgaaauccuggagguucuccgacauccuagagauugggugagguga

SEQ ID NO: 54762 - RNA, 519 nt, Artificial Sequence
  derived and/or modified sequence opt3 from CPPED1__Homo_sapiens__NP_001092925
augagcgccgcugaggcaggcgggguguuccacagagccaggggacggacccuggcggcuuuucccgccgaaaaggaguccgaauggaaagguccuuucuacuuuauccucggcgcagacccacaguucgggcuuauuaaggccuggucuacaggagauugcgacaacggcggugaugagugggaacaagagauacgccugacugagcaggcuguccaggcaaucaauaaauugaacccgaagcccaaauuuuucguuuuauguggggaccugauucaugccaugccuggagugaagguaguguuuucaggccacuaucaucgaaaugcuggcgggacguaccagaaccuagauauggucgugaguagcgccaucggaugccaacucggucgugacccacacggccugagaguuguggucgugaccgcggaaaagauuguacauagguauuacucccuugaugagcugucugaaaaagggaucgaggacgauuugauggaccucauaaagaaaaaguga

SEQ ID NO: 54763 - RNA, 1419 nt, Artificial Sequence
  derived and/or modified sequence opt3 from CPQ__Homo_sapiens__NP_057218
augaaguuccugaucuuugccuucuuuggcggggugcaccuccuuagccugugcuccggaaaagcuauuuguaagaacgguauaucuaaaagaaccuucgaggaaaucaaggaggaaauugcaucaugcggcgacgucgccaaagcgaucauuaauuuggcuguuuacgggaaggcccagaacaggaguuaugagcgguuagcacugcuaguggauacaguaggaccccgccucagcggcuccaagaaucuggaaaaagccauccaaauaauguaccagaaccuucagcaggacggucuggagaaggugcauuuggagccuguccgaaucccacacugggaacguggggaggaaucugcugugaugcucgagccgaggauucauaaaaucgcaauucugggacugggcucgucaaucggcacucccccugaggggauaacggccgaaguucucguggucaccagcuuugaugaguuacaaagacgggcuagugaagcccgcggaaagauugugguauauaaucagccauacaucaacuauuccagaacaguucaguacaggacucagggugcgguggaggcagccaaagucggcgcucuggccucucuuauucggagcguggcauccuucucaaucuauaguccccacaccgggauccaagaauaccaggacggagugccuaagauuccaacagcuuguauaaccgucgaggaugccgagaugaugagccgcauggcgucucauggcaucaagauuguuauccaguugaaaaugggugccaagacuuaccccgacacagauuccuuuaauaccguggcagaaauaacggggucaaaauauccugagcagguagugcuggucagcggacaccuagacaguugggaugugggccaaggcgcuauggacgaugggggaggugccuucauuucuugggaagcucucucccugaucaaggaccuuggccugcgaccaaaaagaacuuugaggcucguucuguggaccgccgaggaacaagggggagugggcgcauuucaguacuaucaguuacacaaggucaacaucagcaauuacucgcuggugauggagucugaugccgguacauuccucccgacugggcuucaguuuaccggcuccgagaaagcucgggcgauuauggaagagguaaugucacuguugcagccccuaaacaucacacagguucugagucauggagaaggcaccgacauuaauuucuggauacaagcaggggugccuggagccagccuccuggacgaucuuuauaaguacuuuuucuuccaccauucccacggugacacgaugacugucauggauccaaagcagaugaacguggcugccgcagucugggccgugguuucuuaugugguagcugacauggaggaaaugcugccccguagcuga

SEQ ID NO: 54764 - RNA, 4521 nt, Artificial Sequence
  derived and/or modified sequence opt3 from CPS1__Homo_sapiens__NP_001116105
augccccagaucauuaagaugaccagaauacugacagccuucaaaguggucaggacucucaagacgggcuuuggguucaccaacguuacagcucaccagaaauggaaguuuagccggccuggaauccgccuucuguccgugaaagcacagacugcccauauuguauuggaggacgguaccaagaugaagggcuacucuuucgggcacccaucaaguguggcgggagaagucguguuuaauacaggcuuagguggguauccggaggcuaucaccgaucccgccuacaaaggacagauucugacuauggcaaacccuaucauaggcaauggcggggccccagacacaaccgcucuagaugaacucggacugagcaaguaucuugaguccaacgguaucaaaguuucuggccuguuggugcucgacuacucgaaggauuauaaucauuggcuggcaacgaaaucacuggggcaguggcuccaagaagagaagguccccgccauuuacggaguggacacucgaauguuaaccaagaucauucgugauaaaggcacaaugcuggguaagaucgaguucgaagggcagccuguagacuuuguugauccaaacaaacagaaucuuauagcugaggugagcacuaaggacgucaaaguguauggaaagggcaaccccaccaaaguggucgccguugauugcggcauuaagaauaacgugaucagauugcugguaaagaggggagcggaagugcaccuagucccuuggaaucaugacuucacaaaaauggaguacgaugggauucucaucgccgguggcccagggaacccggcacuggcugagccccuuauccagaaugugcggaagauucuggaaagugaccgcaaagagccuuuguuuggaauauccaccggcaaccucaucacgggucuggccgcaggggcuaagacuuacaaaaugucuauggccaauagaggccaaaaccagccaguuuuaaacauuacaaauaagcaggcguucaucaccgcccagaaccacggauaugcacuggacaauacucuccccgcuggcuggaagccucuuuuugugaacgucaaugaucaaacaaacgaagggauaaugcacgagagcaaaccauucuuugccgugcaguuccaucccgaaguaaccccgggaccuauugacacggaguaccuguucgauuccuuuuucucauugaucaagaaagguaaggcuaccacaaucacuuccguucuacccaaaccagcccugguggcaagcagggucgaggugucuaagguccucauucugggcuccgggggacuuucaaucggccaggccggugaauuugacuauagcgggagucaagcugugaaggcgaugaaagaggaaaauguuaagaccgugcugaugaacccuaauauugcaucuguacagacaaacgaggucggcuugaaacaggccgauacuguguacuuccuccccauaaccccacaguuuguuacagaagugaucaaggcugagcaacccgacggacugauuuuaggcaugggaggacagaccgcccugaauuguggugucgagcuauucaaacggggcgugcucaaggaauaugggguaaaggugcugggaacuuccguugagagcaucauggcaacggaagaucgccagcuguuuucggacaaauugaacgagaucaaugaaaagauugccccuucuuucgcugucgaguccauagaggaugcccugaaagcagcggacacaaucggcuacccagugaugauucgaucagcuuaugcccucggugggcugggcaguggaaucugcccgaacagagaaacccuuauggaucugagcacuaaggcauuugccaugaccaaucagauuuugguggagaaauccgucacaggcuggaaggaaaucgaguacgagguugugagggacgcugacgauaacugugugaccguaugcaacauggaaaaugucgacgccaugggggugcacacuggagauucuguuguggucgcacccgcucaaacacucagcaacgccgaguuccagaugcugcggcguacgucaauaaaugugguucgccauuuaggcaucgugggugaauguaacauucaguuugcgcugcacccuaccaguauggaguacugcaucauugaaguaaaugccagacuauccaggagcucugcucucgcaucaaaagccacuggguauccacuggcuuucaucgccgcaaagauagcgcuugggauucccuugccugagaucaagaacgucgugaguggcaaaacaagcgccuguuuugagccaucccuggacuacauggugaccaagauuccccggugggaucucgaccgauuccacgguacaucuucgcgcaucggcagcuccaugaaaucagucggggaaguuauggcuauaggaagaacuuucgaggaaaguuuucagaaggcccugaggaugugccauccgucuaucgagggcuucaccccucgguuaccaaugaauaaagaauggcccagcaaccuggaucuucgcaaggaguuguccgagccuucaagcacgagaauuuaugcaaucgcuaaggccauugacgauaauaugucucucgacgaaaucgagaaacugaccuacauagauaagugguuucuauauaaaaugagggacauucugaacauggaaaagacacucaaagggcuuaauuccgagaguaugacugaagagacccuuaagcgugcaaaggagaucggauucagcgauaaacaaaucucuaaguguuugggccugacagaagcccagacucgggaguuacgacucaaaaagaacauucaccccugggugaaacagaucgacacccuggcugcggaauacccauccguaacgaauuaucuuuacgugacauacaacggucaggagcaugacgucaauuuugaugaccacgggaugauggugcugggaugcggcccuuaucauauugguucaaguguugaguucgauuggugugccgugagcucgauaagaaccuugaggcaacucggcaagaagacugucgugguuaacugcaaccccgaaacaguguccaccgacuuugaugagugcgacaaacuguacuucgaggaacuaucucuggaacgcauccucgauauuuaucaccaggaggcaugugggggaugcaucauuagcgucggcgggcagaucccaaauaaccuggcuguaccgcuuuacaagaauggagugaaaauaaugggcacuucaccuuugcaaaucgaccgggccgaggauagaaguauuuuuagugccguucuggacgaauuaaagguggcucaggcacccuggaaagccgucaacacccucaaugaggcgcuggaguucgcuaagucuguggauuauccaugucuucugaggcccagcuacguacuauccgguucagccaugaacguggucuuuagcgaagacgaaaugaaaaaguuccucgaggaggcaacacgcguuagucaggaacacccuguggugcugacgaaguuugucgagggggcccgagaaguggagauggaugcuguuggaaaagacggccggguaaucucucaugcaauuuccgaacacguggaggacgccgguguccauagcggcgaugcgaccuugaugcugccaacucagacaaucucgcaaggggcuauagagaaggugaaagacgccacccguaagauugcaaaagccuucgcuaucucaggacccuucaauguucaguuuuuagugaagggcaacgauguccucgugaucgaaugcaaucugagagccucuaggaguuucccuuuuguauccaagacacuuggggucgacuucauugauguggcaacuaaaguuaugauaggagagaacguggacgaaaagcaucugccgaccuuggaucacccaaucauucccgcugacuaugucgccaucaaagcgccuauguuuagcuggccacgccuccgggaugccgaccccauucugagaugugagauggcaucuacgggcgagguggcuugcuucggugaagggauccacacagccuuucuaaaggcuaugcugagcaccggauucaaaauaccucagaagggcauccuuauuggcauccagcaauccuuuaggccgcgauuccucgggguugcagagcagcugcacaaugaaggauuuaaguuguucgccacugaggccaccucagauuggcugaacgcuaauaacgugcccgcgacaccagucgcauggccuagucaggaaggucagaaucccagcuuaucuuccauucgcaaacucauccgggacggcucaauagaccuggugauuaaccuuccaaacaauaacacuaaguucguacaugauaauuacgugaucagaaggaccgccguugacagugggaucccucuguugacaaacuuucaagucacgaaacucuucgcugaggccgugcaaaagagccguaaaguggauuccaagucucuguuucacuaccgccaguauucggcaggaaaggccgcuuga

SEQ ID NO: 54765 - RNA, 4332 nt, Artificial Sequence
  derived and/or modified sequence opt3 from CPSF1__Homo_sapiens__NP_037423
auguacgccguguauaagcaggcucaucccccuaccggccuggaguucagcauguacugcaacuuuuucaauaacuccgaaagaaaucucgucguugcagggacaucucaacuuuauguguacaggcugaaccgggacgccgaggcguugacuaaaaaugaucgcucaacggaaggaaaggcucaccgagagaaauuagaacuggccgcaaguuuuagcuucuuugguaacguaauguccauggccucugugcagcuagcuggcgcaaagcgugacgcccuccugcuuucguucaaagaugcuaagcugucagucguggaguaugacccagggacccacgauuugaagacacucagccugcauuacuuugaggaaccggagcugagagacggauucguucagaaugugcacacucccaggguccggguggauccugacggccgcugugccgcgaugcucguauaugguaccagauuaguugugcugccauuuaggcgggaaagucuugcagaggagcaugaaggguuggucggagagggccagcgcuccucuuuccugcccagcuacaucauugaugugcgagcccuagacgaaaaacuccugaacauaaucgaucuucaauuucugcacggcuacuaugagccuacauugcucauucuguucgaaccaaaucagaccuggcccgggagaguggcugucaggcaggacacuugcuccaucguugccauuucauuaaacaucacacagaaggugcacccuguaauauggagucugaccagccucccauuugauuguacgcaagcacuugcugugccgaaacccaucggaggugucgugguuuucgccguaaauucucuguuguaccuaaaccaguccgucccuccauauggcguggcgcucaauucacugacuaccgggacaacugccuucccccugcggacccaggagggaguacguauuacacuugacugcgcacaggcuaccuuuaucagcuacgacaagaugguuauuagucugaaaggcggugagaucuauguguugacgcucauaacugaugggaugcgcucugucagagccuuccauuuugacaaggcugccgcauccgugcugacaaccagcauggucacuauggaaccuggauacuuauuccugggcucgaggcuaggcaacucucuccugcuuaaguauacagagaaauugcaagaaccacccgccuccgcugugcgggaggcggcagauaaggaggaaccgccuagcaaaaagaaacgaguugacgccaccgcuggguggagugccgcaggaaagagcgugccccaggaugagguagacgaaauugaggucuacgguuccgaagcccagucuggcacgcaacuggcuaccuacagcuuugaggugugugauucaauccucaauauugggccaugcgccaacgcagcgguuggagaaccugcuuuccugagugaggaguuucagaacucccccgaaccagaccuugagaucguggucuguagcggccacgguaaaaauggggcccugucuguguugcagaagucaauccgcccccagguagugacaacuuucgaacucccuggcugcuaugauauguggaccguuauugcaccagucagaaaggaggaggaagacaacccgaaaggagagggcacagaacaagagcccaguacuaccccugaagccgaugacgacgggaggcggcauggauuucugauauuaagccgcgaggauuccacaaugauccugcagaccggucaggagauuauggaacuagacacuucuggcuucgcuacgcaggggccaacaguguuugccggaaauaucggcgauaacagauacauagugcaagucucgccccucgguauuaggcugcuugaggggguuaaucaguugcacuucaucccuguggaccugggcgcaccaaucgugcagugugcuguagccgaucccuaugucgugauuaugagcgcggaaggacacguuaccauguuucuccugaaguccgacucauacggcgggcgucaucaccgguuagcccugcauaaaccgccucuucaccaucagaguaaggugaucacuuugugccucuaucgagaucugucuggaauguucaccacagagagcagacuagguggcgcuagggacgaacucgggggacgcuccggcccagaggcagagggucuggggucagaaaccagccccacugucgaugacgaggaagagaugcuguacggcgauucuggaucccuuuucaguccuagcaaagaagaggcccggagaucuucccaacccccagcugacagggauccugcccccuuucgcgcagagccaacacacugguguuugcuggugcgagaaaacggcacgauggagauuuaucaguuaccggacuggcggcucguuuuccuggugaagaauuuuccuguagggcagcguguccuuguggacucaaguuucggacagcccaccacucaaggcgaagcgagaagggaggaggccacacgccagggugaacugccauuggugaaggagguccuccugguugcucuagggagccggcagucgagacccuaccugcucgugcacguagaucaagaacugcuuauauacgaggccuuuccucaugacucccaguugggacagggcaaccugaaagugagguucaagaaagucccacacaauaucaacuuucgagaaaagaaacccaagccuucuaagaaaaaggcagaggguggcggggcugaggaaggagccggcgcacgcgggcggguggccagauucagguauuuugaggauauuuacggauauagcggcguuuucaucugcgguccgucaccacauugguuacucgugaccgggcguggagcucugcgccuucaccccauggcgaucgacggcccugucgauaguuuugccccauuccacaaugugaacugcccccgggguuuucuguacuucaauagacagggcgaacuaaggauuuccguucucccugcauaucugucuuacgacgcuccguggcccgugcgaaaaauaccauugcgguguacagcccauuaugucgccuaccacguagagagcaagguguacgcuguugcaacuuccaccaacacgccuugcgcccgcauccccagaaugaccggggaagagaaagaguucgaaacaauugagagggaugaacgguauauccauccacaacaggaggcguuuucaauucagcugaucagcccugugaguugggaagcuauacccaaugcccgaaucgaguuacaggagugggaacacgucacuuguaugaagaccgugucucucagauccgaggaaacaguaagcggacugaagggcuacguggcagccgggacuugccuuaugcaaggagaggaggucaccugucgcggcaggauucugaucauggacguuauugaaguggugccagagccgggucagccuuugacgaaaaacaaguucaaaguccucuaugaaaaggagcagaaagggcccgugacagcucugugccauuguaacggacaccuaguuucggcaaucggccagaagauauuucuguggucacuucgugccucugaacucaccgguauggcguucauugauacucaacuguacauccaccagaugauuagugugaaaaauuuuaucuuggcugccgacgugaugaaguccauaagccuguuacgguaucaggaggagucuaagacacucagccuggucuccagagaugcaaaaccacuugaaguguacucaguugacuucaugguggauaacgcccaacugggcuuuuuggucagugacagggaccgcaaucucaugguguauauguaccugcccgaggcuaaggaaucauucgggggaaugcgacuacugagacgggccgauuuucauguaggcgcacacgucaacaccuucuggaggacuccuugccgcggggcuaccgagggacuuucuaaaaaguccgugguuugggaaaauaaacauaucacaugguuugccacgcucgacggcgguauugggcuguuguuaccaaugcaggagaagaccuaccguagacugcucaugcugcagaacgcgcuuacuacaaugcugccccaccaugccggauugaauccucgggcauucaggaugcuacacguggaucgccgaacccugcagaacgcugucagaaaugugcucgacggcgagcugcuuaaccgguauuuauaccugucaacaauggaaaggagugagcucgccaagaaaaucggcacuaccccggauauuaucuuggacgaucugcucgaaacggaccgcguuacagcucacuucuga

SEQ ID NO: 54766 - RNA, 2349 nt, Artificial Sequence
  derived and/or modified sequence opt3 from CPSF2__Homo_sapiens__NP_059133
augaccagcaucauuaagcugacaacucucuccggcgugcaggaggaaucugcccuuugcuaccuguugcaagucgacgaguucagauuuuuacuggauugugggugggacgaacacuucucaauggauauaaucgacagucuaaggaaacauguucaccagauugaugcugugcuccugagccaucccgacccucuucaccugggagcauugccauaugccguagguaagcucggccugaacugcgcgaucuacgcuacgauuccgguguauaaaauggggcagauguuuauguacgaucuguaucagucccggcauaauaccgaggacuucacacucuuuacuuuagaugacgucgaugccgcauucgacaagauccaacagcugaaauuuucucagauagugaaccuuaagggaaagggccacgguuugucgaucacaccccugccugccgggcacaugauuggaggcaccaucuggaaaauuguuaaggauggcgaagaggagaucguguacgcugucgacuucaaucauaaacgcgaaauacaccuaaacggguguucacucgagaugcugagccgaccaagucuucugauuaccgacuccuuuaaugcaacuuaugugcagccccguagaaagcaaagggaugaacaguugcucacaaacguacuggagaccuuacggggagacgguaauguucugaucgccguggauacggcuggccgcguccucgagcuugcccagcuguuggaccagauuuggagaacuaaagaugcggggcuaggaguguacucucuggcacuccugaacaaugugagcuacaacgucguugaguucuccaagucacaaguggaauggaugagugacaaacuuaugaggugcuuugaagauaaacggaauaacccuuuccaguuucgccaucugagcuugugucacggccucucugaccuggcccgaguaccaucccccaagguggucuuagcuucacagccugaucuggagugcgguuucagcagagaccuauucauccaauggugucaggauccaaagaauaguaucauucucaccuauaggacaacuccggggacccuggcccgguuucuuauagacaaccccucugaaaagaucacagagauugaguugcguaaacgcgugaagcuggaaggaaaagagcucgaagaguaccuggaaaaggagaaacuuaagaaggaggcagcuaaaaagcuggaacaguccaaagaggccgacaucgauagcucggacgaaucugauauagaggaagacauugaucagccuuccgcgcacaagaccaagcaugacuugaugaugaaaggcgagggcucaagaaaggggaguuucuuuaaacaagccaagaaaagcuauccaauguuccccgcaccugaggaaaggaucaagugggaugaguacggagaaaucauuaagccagaggacuuucucguucccgagcugcaggcuacggaagaggaaaaauccaaguuagagucuggucugacuaauggcgaugaaccgauggaccaggaucuaagcgacgugccuacaaaaugcaucucaaccacugagaguauugagauaaaggcccgggucacauauaucgauuacgaagggcgauccgacggagacagcauuaaaaagaucaucaaccagaugaagccccgccaacucauuauagugcacggcccaccugaggcuucucaggaucuggccgaauguugcagagcauucggugggaaagacaucaagguauauaugcccaaacuucaugagaccguugaugccacgucagaaacccacauuuaccaggugagguugaaggacagucuggucagcucccuccaguuuuguaaagcuaaggaugcggagcuggcauggaucgacggcguguuagauaugcgggucucuaaaguggacacaggaguuauucuggaggaaggcgagcuuaaggaugacggggaagauucggagaugcaaguggaagccccaagcgacuccucaguaaucgcucagcagaaggccaugaaaaguuuguucggagaugacgagaaggagacuggugaagagucugaaauaauccccacccucgagccucugccaccgcaugagguccccggccaccagagcguguuuaugaacgaaccucgccuauccgacuucaaacaaguucugcucagagaggggauucaggcagaauuugugggaggcguccuggugugcaauaaccagguagccgugaggcguacagagacuggucggaucgggcuugaaggcugcuugugucaagauuucuaccgaauuagagaccuguuauaugagcaguacgcuaucguuuga

SEQ ID NO: 54767 - RNA, 2055 nt, Artificial Sequence
  derived and/or modified sequence opt3 from CPSF3__Homo_sapiens__NP_057291
augagcgccauccccgcugaggaauccgaccagcugcucauuagaccucuuggcgcagggcaagaggugggaaggucuugcauaauccuggaguucaagggucggaaaauuauguuggauuguggcauccacccaggguuagagggaauggacgcccugccguacauugaucuaaucgaccccgcggaaauagaucuccugcuuaucucacauuuucaccuggaccauugcggcgcuuugccuugguuccuccagaagaccaguuuuaaaggucgcacauucaugacucacgccacgaaggcaauuuaucgauggcugcugagcgauuacgucaaaguuuccaacaucucugccgacgauaugcucuauaccgagacagacuuagaggaaucgauggauaagauugagacuaucaauuuucaugaagugaaggagguagcugggauaaaauucugguguuaccacgcaggacacgugcugggcgccgcuauguuuaugauugagaucgccggcgucaaguuguuguauaccggggacuucucacgucaggaagauagacaucugauggcggcagagauuccaaacaucaaacccgacauccuaauuauagaaagcacauacggaacccacauccaugagaagagggaagaacgggaggcccgcuuuugcaauacugugcacgacauuguuaacagagguggcagggggcucaucccuguguucgcucugggacgggcccaggaacuucuguugauacucgaugaguauuggcaaaaucacccagaacugcaugacauucccaucuacuacgcaaguuccuuagcuaaaaaguguauggccgucuaucagacauacgugaacgcgaugaaugauaagauccgcaaacagauuaacaucaauaacccuuuuguauucaagcacauuucuaaucugaaaagcauggaccauuuugaugacauaggcccauccguugugauggccucaccggguaugaugcagagugggcucagccgagagcuuuucgaaucuuggugcaccgauaagagaaacggagucaucauugcaggcuauuguguggagggcacgcuggcuaaacacaucauguccgagcccgaagagaucacuaccaugucagggcaaaaguugccucuaaaaaugagcguggacuacauuaguuucucugcccauacagauuaucagcagacuuccgaauuuauaagggcucugaagccaccccacgucauccucguucacggagagcagaaugaaauggcccggcugaaggcagcccuuauucgugaguacgaggacaacgaugaagugcauaucgagguacacaauccucgcaacaccgaagcugugacacugaacuucagaggugagaaauuggcgaaggucaugggcuuucucgcagacaaaaagccagagcaagggcagagggugagcggcauucugguuaaacggaauuucaacuaucauaucuuaucgcccugcgaccugucuaauuacaccgaucuagccauguccacggugaagcagacucaagcuauaccguacacaggaccuuuuaaccuccuguguuaucagcuucagaaguugaccggugacgucgaggaacuggaaauccaggagaaacccgcccucaagguguucaaaaauauuacuguaauccaagaaccagggaugguugugcuggaguggcuugcaaacccuucaaaugauauguacgccgacacagucaccacggugauucuggagguccagaguaaccccaagauccgaaaaggcgcugugcagaagguuagcaagaaauuggaaaugcacguguauuccaagcgccucgagauaaugcugcaggauauuuuuggagaagacugcguaucugucaaagaugacagcaucuuaucagugaccguugauggcaagacagccaaucugaaccuagagacuagaaccguggaaugugaggaggggagugaagacgaugagucccucagggaaauggucgagcuggcagcgcaacggcuuuacgaagcucuuacaccagugcacuga

SEQ ID NO: 54768 - RNA, 1983 nt, Artificial Sequence
  derived and/or modified sequence opt3 from CPSF3L__Homo_sapiens__XP_011539949
augcccgagaucagagugaccccucugggcgccugcccaguccucagcuggaaccuuguucugccgcccgggaggggaucccgggcuccuucuucaacagacacucgcacggguuuccacguguugccacauggccccuuaggguguggaccuguaauucugaugugcggcgcagguuuugggcacuucgaauggcuagccggaggcggcgcggggcaggaugugggacgaaguuguauacucgucagcaucgcugguaagaaugugaugcuggacugcggcaugcauaugggguuuaacgaugaccguagauucccagauuuuuccuacauuacccaaaauggaaggcuuacagacuuccuggauuguguuaucauuucucacuuucauuuggaccacugcggcgcccuccccuauuucucggagaugguggguuacgaugggccuaucuauaugacucacccaacccaggcaauauguccgauccugcuggaagacuaccggaaaauugccgucgauaagaaaggagaggcuaacuuuuucacaucacagaugaucaaggacugcaugaaaaaggugguagcaguucaucuccaccagaccgugcaagucgaugacgaauuagagauuaaggccuauuacgcuggccaugugcugggcgccgcgauguuucagaucaaaguggggagcgagagugucguuuauacuggagacuacaauaugacacccgaucgccaccuuggugcagccuggauagacaaguguagaccuaacuugcugauuaccgaauccacguacgcuacuaccaucagggauucuaaacggugccgcgagcgagacuuccuaaagaaagugcacgaaacaguagagagaggcgggaaggugcucauuccagucuuugcccugggaagggcacaggagcuuuguauccuguuggaaacuuucugggagcggaugaaucucaaggugcccaucuauuucagcaccggccugacagaaaaagcuaaccauuacuauaaguuauuuauuccuuggaccaaucagaaaauacguaagacguucguucaacgcaacauguuugaguucaaacacaucaaggccuuugauagagcguucgccgacaauccaggucccaugguggucuuugcaacuccggggaugcugcaugcuggccagucccuccagauuuucaggaaaugggccggaaacgaaaagaauauggugaucaugccuggcuacugcguacaggggacaguuggacacaagauacuuucaggucaacggaaacuggagauggagggccgacagguguuggaagucaagaugcaaguggaguauaugaguuuuagcgcucaugccgaugcaaaagggauuaugcagcuagucggacaggccgaacccgagucugugcugcucguucacggcgaagcuaagaaaauggaguuccugaagcagaagaucgagcaggaacuucgcgugaacugcuacaugccagcgaauggugagaccguaacucugccuacaucccccucaaucccagucgggauuagcuugggccuccugaaaagagaaauggcacaaggauuacugcccgaggccaagaaaccuaggcuacuccacggcacccugaucaugaaggacaguaacuuucggcuugugucuuccgaacaggcuuugaaagagcuggggcucgccgagcaucagcugcgcuucacguguagaguucaccuucaugauaccaggaaggaacaggagacagcacugcguguguauagccacuugaagucgguccucaaagaccacugcgugcaacaucugccagauggaucuguaacuguggaauccguuuuacugcaggccgcugccccgucagaggaccccgguaccaagguccuacucgugaguuggacauaccaggacgaggaacugggcagcuuucuuacuuccuugcugaaaaaggggcucccucaggcaccaucuuga

SEQ ID NO: 54769 - RNA, 735 nt, Artificial Sequence
  derived and/or modified sequence opt3 from CPSF4__Homo_sapiens__NP_001075028
augcaggagaucauugccagcgucgaccacauaaaguucgaucuggaaaucgcugucgagcaacagcucggcgcacagccccuuccuuuuccagggauggacaaauccggagccgcgguuugcgaguucuuucugaaggcugccugugguaaaggcgggaugugcccguucagacauauuucuggagaaaagaccgugguauguaaacacugguugaggggcuuaugcaagaagggugaucagugugaauuucugcaugaguacgacaugacaaaaaugcccgagugcuauuucuacucaaaguuuggggaauguaguaacaaagagugcccuuuccuacacaucgauccagaaagcaagauuaaagacugucccugguaugaucggggauuuugcaagcauggcccucucugucgccaccgacacacucguagagugaucugcgucaauuaccuggugggcuucugcccagaggggcccuccuguaaguuuaugcauccuagguucgagcuuccaaugggaacgaccgaacaaccgccccugccucagcagacacagccacccgcaaaacaacggacuccucagguuauaggugugaugcagucucagaacucgucagccggcaaucgcgggccaagacccuuggagcaagugaccugcuauaaguguggagaaaaaggccacuacgcuaacaggugcacaaagggucaucucgcauuucugagcgggcaguga

SEQ ID NO: 54770 - RNA, 1767 nt, Artificial Sequence
  derived and/or modified sequence opt3 from CPSF6__Homo_sapiens__NP_001287876
auggccgacggcguggaucacaucgacauuuacgcugaugucggggaggaguucaaccaggaagcagaauauggaggucaugaccaaauagaucuguacgacgauguuaucagccccuccgccaauaacggcgacgcgccugaggauagagacuauauggauacccucccaccgacagugggggacgauguaggaaagggcgcugcccccaauguggucuacacuuauacggguaaaaggauugcacuuuacaucgggaaccugaccugguggacaacugacgaagacuugaccgaggccgugcacucuuuaggaguuaaugauauucuggagaucaaguuuuucgaaaaccgggcuaauggccagucaaaaggcuuugcccuagugggggucggaagugaggcaagcuccaagaaacucauggaccugcuuccuaagcgcgaacugcauggucagaacccagugguaacacccugcaauaagcaguucuugucucaauuugagaugcagucgcgaaaaaccacucagucaggccagaugagcggggagggaaaggcuggcccuccaggugggaguucccgugccgcguucccccaaggaggcagaggcagggggcgguuuccuggagcaguuccagguggcgaucgcuucccggggcccgccggaccuggcgguccacccccuccauuucccgggaaccucauaaaacaccuggugaagggcacaagaccgcuguuccucgaaaccaggaucccuuggcauaugggacacucuauugaggaaauccccauuuuuggcuuaaaagcugggcagacgccaccucggcccccacugggacccccugguccaccgggucccccugggccacccccuccaggacagguccuucccccgccuuuggccggcccacccaaucgcggugaccgaccucccccaccugugcuguuccccgggcagccauuuggccaaccgccucuaggaccccucccacccggcccuccacccccugugccgggguauggaccacccccugguccacccccuccgcagcaggggcccccaccucccccaggcccuuuucccccaagaccgccuggaccccugggcccaccccuuacucuggcaccuccaccccacuugccugguccgccacccggggcuccucccccagccccucaugucaaccccgcguucuucccaccuccgaccaauagcggcaugcccacauccgauucaaggggaccaccucccacugacccauacggccggccucccccguacgaucguggggacuauggaccaccuggccgcgagauggauaccgccagaacaccccucagugaagcagaguucgaggaaaucaugaacaggaaucgggcuauaucuagcuccgccauuucacgagcuguuagcgacgccagugcaggcgauuacgggucugccaucgagacccuggugacggcuauuuccuuaaucaagcaaagcaagguaucggcggacgaccgcuguaaagugcugaucucuucccuccaggauugccuucacggaauugaaucaaagaguuauggcagcgguuccagaagggagcggucucgcgaaagagaccauagcaggucacgugagaaaagucggcgacacaaguccagaagcagggaucgccacgacgauuacuaucgggagagaucuagggaacgcgagcgacaucgggaccgugauagagacagggaucgcgaacgggacagagagagggaauaccgacaccgcuga

SEQ ID NO: 54771 - RNA, 1416 nt, Artificial Sequence
  derived and/or modified sequence opt3 from CPSF7__Homo_sapiens__NP_001129512
augagcgagggcguggaccugaucgauauuuacgccgacgaagaguucaaccaggaucccgaauuuaauaacaccgaccaaauagaucucuaugacgauguccuuacagcuacuucccagccuucugacgauagaucaaguagcacggagccaccgcccccuguuaggcaggaaccaucccccaagccuaauaacaaaaccccagcaauccuguacacauauucuggguugcggaaucgccgagccgcgguguacguaggaucguucucaugguggacuaccgaccagcaauuaauucaggugauccguagcauuggugucuaugaugugguugagcugaaguuugcugagaacagagccaauggccagaguaaaggguacgcagaaguggucguggccuccgagaacucuguacacaagcuacucgaacugcuucccggaaaaguucugaauggcgagaagguggacgucaggccugcuacacggcagaacuugagccaauucgaggcacaggcccgcaagagagaaugcgugagggugccacggggugggaucccgccccgcgcucauucccgagauucaagugacagcgccgacggcagagcgaccccuucugagaaucucgucccauccucagcaaggguugauaaacccccuagcgugcugccauauuuuaaccggcccccgagugcccugccucucaugggauuacccccaccucccauaccacccccuccaccgcugucuuccagcuucggcguacccccuccacccccugggauccacuaccagcaucuuaugccacccccgccucguuugccaccccaccuggcugugccucccccaggagccauuccucccgcacuacaucucaauccagccuuuuucccgccucccaacgcuacugucgguccacccccugacacauacaugaaggcgucggccccauauaaucaccacggcucucgcgauuccgggcccccuccgucaaccgugagugaagcagaguuugaagacaucaugaaaagaaacagggcuauuagcuccucugccaucagcaaggcuguuucaggagccagugcaggcgauuacuccgacgccauagagacgcugcuuacugcuauugcggugaucaaacagagccgggucgcaaacgaugagcgaugucgcgugcugauuucuucauugaaggacugccuccaugguaucgaagccaagaguuauagcguaggggcuuccggaucuucgagcagaaaaaggcaccggucccgcgagagaucaccaaguaggucucgugaaagcucccggcgacauagagaucuguuacacaaugaggacaggcacgaugacuacuuccaagaacgcaaccgggagcaugagagacacagggaccgcgaacgagaucggcaucacuga

SEQ ID NO: 54772 - RNA, 2418 nt, Artificial Sequence
  derived and/or modified sequence opt3 from CPT1A__Homo_sapiens__XP_005273819
augcagcaccugagcuccgaggcccucucuaccgaacuuucaccccaacugggcacagcuggguuggacuuaccuacugagagauacagucugaagauggcagaagcccaucaggcgguggcuuuccaguuuacggucaccccagauggaaucgaccuaaggcucagccacgaggcccugcggcagauuuaucuuuccggucugcauucuuggaaaaagaaauucauacgcuuuaagaacggcaucauuacagggguuuacccggcaucgcccucaagcugguugaucgugguagugggagucaugacuaccauguaugccaaaauugauccuagucucggcaucauagcuaagaucaaucgaacacuggaaaccgcaaacugcauguccucucaaacuaagaaugugguuagcggugugcuguucgggacaggacucugggucgccuuaauugugaccaugcguuacucccugaaaguacuuuugucauaucacggcuggauguuuacggagcauggcaagaugaguagagcuacuaaaaucuggauggggaugguuaagauuuucagcggaaggaaaccaaugcuguacucuuuucagaccucccuaccccggcucccugugccagccgucaaggacacagugaaccgcuaucugcagucagugagaccccuuaugaaggaggaagauuucaaaaggaugacugcgcuggcacaggacuuugccgucgguuugggcccucggcuccaaugguaccugaaguuaaaaagcuggugggcuaccaauuacguuagugauuggugggaggaauauaucuaccugcgcgggcgaggaccacucauggugaacucuaauuauuacgccauggaccuucuguauauauugccgacacacauucaggcagcuagagccggcaacgcgauccacgccauucuacuguacaggcggaagcucgaucgugaggagaucaaacccauccgccugcuugguuccaccauuccucuguguagcgcacagugggaaagaauguucaauacgucgaggauaccaggggaggaaacugacacaauccagcauaugcgggauucuaagcacauuguaguguaucaucgaggacgcuacuuuaaagucugguuguaccacgacggcagacuccugaagcccagggagauggaacaacagaugcagcggaucuuagauaacaccuccgagccucaaccaggcgaggcucgccuggccgcucuaacugccggggacagagugcccugggcaaggugccgucaggccuauuucggacgggguaagaauaaacagucacucgacgcuguugaaaaggcggcauuuuucgugacacuggaugagaccgaagagggcuaccgaagugaagacccggauacgagcauggacuccuaugccaaaucucuuuugcacgggagauguuacgauaggugguucgacaagagcuuuaccuucgucguguuuaaaaacggaaagaugggccugaaugcugagcauucaugggccgaugcaccuauaguagcccaccucugggaguauguuaugaguauugacucccugcagcuugguuacgcugaagaugggcauugcaagggcgacaucaaccccaauaucccauauccuacacgccugcaaugggauauucccggagagugucaggaagugaucgagacuagcuugaacaccgccaaccuccuggcaaaugacgucgacuuccacucuuuuccauucguggcguuuggcaaagggauuauaaagaaaugccggacaucacccgaugcuuucguccaguuagcccugcagcuagcacauuacaaggacaugggaaaauuuugucucacuuacgaagccaguaugaccagacuguucagggagggucgcacagagaccgugcgaagcugcacuacggaauccugugauuuuguucgggcuaugguggacccugcccaaacaguagagcagcgucuuaaguuguucaagcuggcaucugaaaaacaccagcacauguauagacucgcuaugaccggcucggggaucgauaggcaucuguuuugcuuauacgucgugagcaaguaucuggccguugaguccccauuccuuaaagagguguugucagaaccguggcgccucaguacuucucagacaccccaacagcaggucgagcuguucgaccuagaaaacaauccugaguacgugagcuccggaggcgguuuugggccaguagcggaugacggcuauggagugucauacauucugguuggcgaaaaccucaucaauuuccacaucagcucuaaguuuuccugucccgagaccgauagucaucgguucgggagacaccugaaagaggccaugaccgacauuauaacucuuuuuggauugagcucuaacuccaagaaguga

SEQ ID NO: 54773 - RNA, 2217 nt, Artificial Sequence
  derived and/or modified sequence opt3 from CPT1B__Homo_sapiens__NP_001138606
auggccgaggcucaccaggcaguggccuuccaauuuaccgucacacccgacggcguugauuucagacugagcagggaagcgcucaagcauguguaccuuuccgggaucaacucuuggaaaaagcggcugauucgcaucaaaaauggaauauugcgagguguauauccuggcucaccaacgaguugguuaguggucauuauggcuacuguggggagcuccuuuugcaacguugacaucucucugggccuagugucguguauucagcguugccucccgcagggauguggucccuaccagaccccucaaacaagagcccugcuuucaauggcaaucuucagcacuggggucugggugaccggaauauuuuucuuuaggcagacacugaaguugcuccugugcuaucacggcuggauguucgagaugcauggcaaaaccaguaaucugacucggaucugggccuaccucgaauccguacgcccauuacuggaugacgaggaauauuacagaauggagcuuuuggcuaaggaguuucaggauaagacagcacccaggcugcagaaauaucuaguucucaagucuuggugggccagcaacuacguguccgacuggugggaagaguacauuuaucugcgggggcgcucaccucuuauggucaauaguaacuacuaugugauggaucugguguugaucaaaaauaccgacguccaagcugcccgacucggaaacauuauccacgcgaugauaauguacagaaggaagcuggaucgggaagagauuaaaccaguuauggcauuagguaucgugcccauguguagcuaucagauggagcguauguucaauacgacucgcauuccuggcaaggacaccgauguacugcagcaucucucugacuccagacacguggccgucuaccacaaggggagguuuuucaaacuuuggcuguaugaaggagcucgguugcuaaagccacaggaucuggagaugcaauuucagcgaauccucgacgacccgucacccccucagccaggcgaagagaaacuggccgcacuuacagcuggugggcgcguggaaugggcccaagcgagacaggccuucuucagcaguggaaagaacaaagcagcucuggaggccaucgagagggcugccuuuuucguugcauuggaugaagagucuuacuccuacgaccccgaagaugaggccagccucucgcuguauggcaaggcuuuacugcauggcaauugcuacaaccggugguuugacaaaucuuucacucuaauuuccuuuaagaaugggcagcucggacugaacgcggaacacgcaugggccgaugcuccuauaaucggucaucuuugggaguucguguugggcaccgacucauuucaccugggguauacagagaccggacacugucucggcaagccaaaucccgcccuggcaccgccuacgcgccuucagugggauauucccaaacaaugccaggccgucaucgaaaguagcuaccagguggcuaaggcccuggcagacgauguagaguuguauuguuuccaguuucucccauucgguaaagggcugauaaagaaaugcagaacuuccccugacgcguuuguucaaauugcuuuacagcuggcccauuucagggaucguggcaaguuuugucuaacauacgaagcaucuaugacccggauguuccgagagggaagaacugaaacagugaggagcugcaccucagagaguacggccuucguccaggcuaugauggagggcucccacaccaaggccgaccuccgcgaccuguuucagaaagcagcuaagaaacaucaaaacauguaucggcuugccaugacaggggcgggaaucgauagacacuuguucugccuguaccucgugagcaaguaccugggugucucuucacccuuuuuagccgaagugcugagugagccauggaggcuuagcacuucccagaucccccagucucagauucgcauguucgacccugaacaacauccaaaccacuugggcgcugggggaggcuuugguccgguugcagaugacggguauggcgugucguacaugaucgccggagagaauaccauuuucuuucacauaagcuccaaauucucaaguucugagacaaacgcucagcgauuuggcaaucauauccggaaggcccuccuggauauugcagaccuauuccagguacccaaggcguauagcuga

SEQ ID NO: 54774 - RNA, 2379 nt, Artificial Sequence
  derived and/or modified sequence opt3 from CPT1C__Homo_sapiens__NP_001129524
auggccgaggcucaccaggcagugggcuucagacccagccugaccuccgacggggccgaagucgagcucucugcgccuguucuucaagaaaucuaccugucaggauugaggaguuggaagcggcauuuaagccgcuuuuggaacgauuuccugacagguguguuuccagcuuccccgcuaucuugguuguuccuguuuucggccauucagcuugcaugguuccugcaguuggaccccucacucggccugauggagaaaauaaaggaacugcucccugauuggggagggcagcaccauggcuuacgagguguacuggccgcugcacuuuuugccagcugcuuguggggagcucugaucuucacucuacacguggcccuccgucugcuucugaguuaucaugggugguugcucgagccacacggcgcgauguccucucccacgaaaaccuggcuggcauuagucagaauuuuuagcggcaggcacccuaugcuguucuccuaccaacggucacucccacgccagcccgugccuaguguucaggacacagugagaaaguaucuugagagcgucaggccaauccugucugaugaagacuuugauuggacugccguguuggcucaggaguuccuacggcugcaagccucccuccugcagugguaccuucgccugaaaucauggugggcaagcaauuauguaagugacuggugggaagaguuuguuuacuugcgaucuagaaacccgcucauggucaauuccaacuauuacaugauggcugccagggcggggaaugccgugcaugcacuguuacuguaccggcaccgucuaaaccgccaggagauucccccuacccuccugaugggaaugagaccacuuuguagcgcucaguaugaaaagaucuucaauacaaccaggauacccggugugcaaaaggauuacauccggcauuugcacgacucgcagcacguggccgucuuccaucgaggccgcuuuuucagaauggggacucacucuaggaacucccugcucucaccucgggcucuggagcagcaauuucagcgcauucuugaugacccaagucccgccugcccgcaugaagaacaccuggcagccuugacagcugcgccuagaggaaccugggcacagguuaggacgagccucaaaacucaggccgcugaagcccuggaggcaguggagggcgccgcuuucuuuguauccuuagaugccgaacccgcaggucugacccgugaggacccagcggcuucucuagacgccuaugcacaugcccuccuggcugggcggggacacgaucgaugguucgacaagagcuuuacacuuaucguguucucaaauggcaaauugggccugagugucgaacacuccugggccgauuguccuauuagcgggcauaugugggaguuuacucucgcaaccgaaugcuuccaacugggauacucuacagacggucacuguaagggccaucccgauccaaccuuaccccagccucagagacugcagugggaccuuccagaucaaauccacucaaguauaagccucgcucuccgcggggccaaaauucuguccgagaacguggacugccacguugugccguuuucucuauucggaaagucguuuaucaggcggugucaucugagcuccgauucauucauucagaucgcgcuccagcuggcccacuucagagacaggggccaguuuugccuuacguaugagagugcuaugacucgcuuguuccuggaaggucgaacagagaccguccggucuuguacucgugaagcaugcaauuuugugagagccauggaggauaaggagaaaacagacccccaauguuuagcucucuucaggguagccguugacaagcaucaggcacugcuuaaagcggccaugagcgggcagggcguggaucgccaccuguuugcuuuguacaucgucucccgguuccuccaucugcagucaccuuuucuaacccaagugcacagcgagcaguggcagcugucuacgucccaaauuccaguccagcagaugcaccucuucgacgugcauaacuaucccgauuacguuaguagcggaggcggguuuggaccugccgacgaucacgguuacggcgugucuuauauauucaugggggacggaaugaucaccuuucauauuuccucaaagaaaaguagcacaaagacugauucgcacagacugggccagcauaucgaggacgcacuuuuggauguagcuucccuguuccaagccggucagcacuuuaaaaggcgauuccgcgggucuggcaaggaaaauagccggcacagaugcggauucuuaucaaggcagaccggcgcaaguaaggccuccaugacaucuacugacuuuuga

SEQ ID NO: 54775 - RNA, 1431 nt, Artificial Sequence
  derived and/or modified sequence opt3 from CPVL__Homo_sapiens__XP_011513739
auggugggcgccauguggaaggucaucguuagccuggugcuccuuaugcccgggccuugcgacggacuguucagauccuuguacaggucuguaucaaugccaccgaaaggugauaguggccagcccuuauuucugaccccuuauauugaggcugggaagauacaaaaaggacgggaacuaagccucgugggcccauuccccggucugaacaugaaguccuacgcaggguuucuuacagucaauaaaacuuauaacucuaaucuguucuuuugguucuuuccugcccagauccagccagaggacgcgcccgugguuuuguggcuccagggaggcccuggcgggucgucaauguucggacuguuuguggaacacgguccauacgucgugacgagcaacaugacccugcgcgaucgagacuucccguggacaacuacccucaguauguuauauauugauaaucccguaggcacaggguuuuccuucaccgacgauacucauggauacgcuguuaacgaggacgauguggcccgugaccuguauucugcacuuauccaauuuuuccagauuuucccugaauacaagaauaacgauuuuuacgucacaggcgagagcuaugccgguaaguacgugccagcuaucgcacacuugauacauucccugaaucccgugagagaggucaaaaucaaccuaaaugggauugccaucggagacggcuauucagauccugaaaguauuaucggcggguacgcugaguuccucuaucagauaggacugcuugacgaaaagcagaaaaaguacuuucaaaaacagugucacgagugcauugagcauaucaggaagcagaacugguucgaagccuuugagauucuggacaaguugcucgauggugaccugaccagcgauccaucuuauuuccagaauguuacgggcuguuccaacuacuacaacuuuuuacggugcacugaacccgaggaccaacuguauuacgugaaauuccucucacuuccggaaguacgccaggcgauccacguggggaaucagaccuuuaacgauggaacaaucgucgagaaguaucugagagaggacacugugcaaagcguuaaaccuugguugaccgaaauuaugaauaacuacaaggugcuaauauauaauggccagcuggauaucauugucgcagccgcucucacagagaggagucugauggguauggacuggaaagggucucaggaauacaagaaagccgagaagaagguguggaaaaucuucaaguccgauagcgaaguagcaggcuauauacggcaggcuggagacuuucaccaaguuauuauccgcggcgggggacauauccuucccuacgaucagccacugcgagccuucgacaugauuaacagauuuaucuacgguaaaggcugggacccuuaugugggguga

SEQ ID NO: 54776 - RNA, 906 nt, Artificial Sequence
  derived and/or modified sequence opt3 from CPXCR1__Homo_sapiens__NP_001171700
augagcucccccaccaaggagggcucugacacagccgggaacgcucacaaaaauucagaaaacgagccuccaaaugauugcaguacugacaucgaaagcccguccgcagaucccaacaugauuuaccagguggagacgaauccuauaaacagagaaccaggaaccgccacaucucaagaggacgucguuccccaggcggcugaaaauucggaacuggagacugaaauccagaaggaucagagggaggaggaccucaaagaggagcuucuguuguuacaaaccccuauuccacggaagcuggugucacauaaaccccuaaacgaucgcagccgaagucacuccgguaagguagaaaugaaggccaauaacuucccuaucaaucauaaaacacguuuuagacucucuaccagcuggagggugccauucauuaacucccacgagauccggucaaugauacugcaucuucugugugaccgcuauuuuagucaggcagccggcugccagaauacuaugugggucaagagaaaauacaucgcuuguuuguaucacccgaacagcuucacacaccaugaaagggcaauuaccuuucggcgccccucucgagugcacuacuauagaccucucacggagaggaugacuuccgggaaguucugcaaaucaaccgauacaaagggaaagugucgguuucgugccaucguucgcagcgugcuguucgucagucagauucaaaucgagucuauauuuaauauuaaaggcuucguggacauccugacuuacauucauaccaugaacguaaugaucacaaacaccaauaacgguuggaaguauuuuugcccaaucugugggagacucuucaauacguacuccgaauuaaggcagcacagcugcucgucuuccggaaacuga

SEQ ID NO: 54777 - RNA, 1959 nt, Artificial Sequence
  derived and/or modified sequence opt3 from CPZ__Homo_sapiens__NP_001014447
augcccccuccaccgccccugcuccuucugaccguguuggucguugccgcugcaagaccuggcugcgaguucgaaaggaacccagccggggagugucaccggcccccugcggcugacagcgccacaugcguggauuuacagcugcgcacuuguuccgacgcagccuacaaucauacgaccuuuccaaaccuacuccaacaccgaucuugggaaguaguggaggcuucaagugaauauauccugcuuagcguccugcaucaguugcucgagggacagugcaaucccgaucugcgucugcucgguugugcaguguuagccccuagaugcgagggcggguggguuaggcggccaugucgccacauuugcgaaggacugagagaggugugucagccggcuuucgacgccauagauauggcguggcccuacuuucuugacugccauagguauuucacacgggaagaugagggcuguuacgacccuuuggagaagcugcgcggugggcuagaagcagaugaggcccucccauccggacugcccccuacuuuuauccgauucucucaccacucguaugcucaaauggucagagugcuuaggcggaccgccucacguugcgcacauguagcucgcacauacagcauuggcagaaguuuugacggcagggaacuguugguuaucgaguucuccucucggccagggcagcacgaacucauggagcccgaggugaaacugauuggaaacauccaugguaaugaagucgccggccgagagauguuaauauaucuggcgcaguaccucugcagcgaauaccuucuggggaacccgcgcauccagagauugcuaaauaccacuaggauucaucugcucccuuccaugaaccccgauggauaugagguggccgcagcugaaggcgccgguuacaauggguggacaucaggacggcaaaacgcucagaaucuggaccuuaaccgcaauuuuccagaucugaccagugaguauuacagauuggccgagacgaggggcgcacguagcgaccacaucccuauuccccagcacuauugguggggcaagguggccccagaaacuaaagcuaucaugaaguggaugcagaccauacccuucguccucucugcgucccugcacgggggagacuuaguugugucauacccuuuugauuucagcaaacauccacaagaggaaaagauguuuaguccgacacccgacgagaagauguucaaacugcuaucucgggcauaugccgauguacacccuaugaugauggaccgauccgaaaacagaugugguggcaauuuccucaagagggggagcauuaucaacggagcugauugguacucguuuacuggcgguaugucugacuucaacuaccugcauaccaauugcuuugagauuacaguggagcuugggugugucaaauucccacccgaagaggccuuguauacccuguggcagcacaacaaggaaucccuccugaauuuuguggagacgguucaccgcggcaucaaaggaguggucacugauaaguucggcaagccugugaaaaacgcacggaucucaguaaaggggauuagacaugacauaacaaccgccccagauggagacuacuggaggcuucugcccccggguauccacauuguuaucgcucaggccccuggcuaugcaaaagugauaaagaaagucauuaucccagcgcgcaugaagcgagcugggcggguggauuuuaucuugcaaccccucggaaugggcccuaaaaauuucauucauggucugcguagaacugggccccacgacccauuaggcggagccaguagccugggcgaggcaacagaaccugacccccuaagggcccgccggcagccauccgcugaugggucuaagccguggugguggagcuacuuuaccucacucaguacgcacagaccuagguggcugcuuaaguauuga

SEQ ID NO: 54778 - RNA, 6120 nt, Artificial Sequence
  derived and/or modified sequence opt3 from CR1__Homo_sapiens__NP_000564
augggcgccagcucuccccgguccccugaaccaguggggccgcccgcuccuggacugccauucugcugugguggcucacuccuugcagucguugugcuguuggccuuacccguagcgugggggcagugcaacgcuccugaauggcugccauuugccaggcccaccaaucuaacagacgaguucgaauuuccuaucggaacuuaccucaacuaugagugucggccaggcuacaguggucgcccguucagcauuauaugccugaagaacuccguguggacgggggcaaaagaucgaugucguagaaagucuugcaggaaucccccugacccagucaauggaauggugcacguuaucaaaggcauucaauuuggcucgcagaucaaguauucauguaccaaaggguaccggcuuauuggaagcaguuccgccacaugcaucauaucuggugauacugugaucugggacaacgaaacccccauuugugaucgcaucccuugcggccugccacccacaauuaccaauggggacuucaucagcacuaacagagagaauuuucacuauggauccgucgugacauacagguguaacccgggcucaggugggcggaagguauucgaguugguuggagaaccuaguauauauugcaccagcaaugaugaccaggugggcauuuggucuggccccgcuccacagugcaucauuccuaacaaguguacgcccccaaaugucgagaacgggauccucguguccgauaaucgcucacuguuuagccugaacgaaguggucgaguuccgaugccaacccggauuuguuaugaaagguccuagaagggugaagugucaggcacucaacaaaugggagccagaauuaccgaguugcucucggguaugucagcccccuccagacgugcugcacgccgagcguacucagcgcgauaaggacaauuucucccccggccaagaagucuuuuacagcugcgagccuggguacgaucuuagaggagcugccucgaugagguguaccccacagggcgacuggucucccgcggcaccgacaugcgaagugaaauccugugacgauuucaugggucaguugcugaacgggcggguucuauucccugugaaucuccagcugggcgccaaggucgacuuugugugcgaugagggauuccaacuuaagggcucaagugcuagcuauuguguacuggccgggauggaguccuuguggaacucuagcguuccagugugcgaacagaucuuuugccccucaccucccgucauuccaaauggacgacauacugguaaaccucucgagguguuccccuuuggcaagaccgucaacuacacaugugacccacacccggaucgcgggaccaguuucgaccugauaggagaauccacgaucagaugcacuagcgauccucagggcaaugguguguggucuucacccgcaccaaggugugggauuuuaggccauugccaagcucccgaccacuuucuguucgccaaacucaagacacagaccaacgcgagugauuuuccuaucggaacuagccuuaaauaugagugucggccagaauacuauggccgccccuucuccauaacaugccuggacaauuugguuuggucuucgccuaaggauguguguaaaagaaagagcugcaagaccccgccagaccccguaaacgggaugguccacgugauuacggacauccagguuggauccaggaucaauuacucauguaccacaggucaucgucuaauuggccacaguucugccgagugcauccugagcgggaacgcagcucauugguccacuaaaccuccaauuugucagcggauacccugcggacucccuccgaccaucgccaauggcgauuuuauuucaacaaaccgagagaauuuccacuaugguagcguggucacuuacagaugcaaccccgggucuggcggaaggaagguguuugaacugguaggcgagccauccaucuacuguaccaguaacgacgaucaaguggggaucuggagcggaccugcuccccagugcauuauaccaaauaaauguacaccucccaacguugaaaauggcauccuugucucugacaaccgcucccuguucucauugaaugaggugguggaguuccggugccagccagguuuugucaugaaggggccgagaaggguuaaaugucaggcccucaacaagugggagccugagcugcccaguugcagccgcgugugucaaccacccccugauguguuacacgcagaacgaacccagcgggacaaggauaauuucucgccaggacaggagguauuuuauuccugcgaacccggcuacgaccugcguggugccgcuucuaugagauguacuccucagggcgauuggagcccggcggcaccaacgugcgaggucaaaucaugugacgauuucauggggcaacuacucaacggaagggugcuguuucccguuaaucuucaguugggcgccaagguggacuucgucugcgaugagggguuucagcugaaaggaaguuccgcuucuuauugcgugcucgccggcauggaaagccuguggaacuccucaguuccugugugugagcagauuuucugccccagcccaccuguaauccccaauggucgccauacagggaagccacuugaagucuuuccuuucggaaaagcagugaacuacaccugugacccgcaccccgaccggggcacaaguuuugaucugauuggugagucuaccaucagaugcacauccgacccacaaggcaaugggguguggagcucgccugcccccagguguggaauauugggccauugccaggcuccagaucacuuccucuuugccaagcugaagacccagacuaacgcaucagacuucccuaucgggacaucuuuaaaauaugaaugucgacccgaguacuauggacgcccguucaguauuacgugccuggauaaucuagucugguccagcccaaaggacguuuguaaacggaagucuugcaaaaccccucccgauccagugaacggcaugguacaugugaucacugacauucaagucgguagcagaaucaacuacuccuguacaaccgggcacaggcucauaggacacucaagugcggagugcauucugagcggcaauacagcucauuggucuacuaagcccccuaucugccagcguauuccguguggucuucccccaaccaucgccaacggcgauuuuauauccacgaaucgcgaaaacuuccacuacgggucagugguuaccuaucggugcaauuugggaaguagaggcaggaagguguuugagcuggucggggaaccuagcaucuacuguacauccaacgacgaucaggugggaauuuggucuggccccgcaccucagugcaucauuccaaauaaauguacucccccuaacguugagaaugguauccucgugucggacaaccgaagccuguucucauuaaaugaagucguagaguuucggugccaaccaggguucgugaugaagggaccccgcagaguuaaaugucaggcccugaacaagugggagccggaacuuccuuccugcaguagggugugucagccacccccugagauauugcauggcgaacacaccccaucucaccaggauaauuuuagccccggccaagaggucuucuauuccugcgaaccgggguacgaccuccggggagcugccucacugcauuguacaccucagggugacuggucucccgaggcaccacgaugcgcugugaaaagcugcgaugacuuucuaggccagcugccucacgggagaguacucuucccccugaaccuucaguugggagccaaggugaguuuugucugugaugagggcuuccgccugaaagguuccagcguuucucauugcguguuaguggggaugaggucacucuggaauaacuccgucccagugugugaacacauuuucugccccaacccuccagcgauccugaauggacgucauacuggcaccccgaguggcgacauccccuaugggaaggagauuagcuacacgugugauccucacccagaccggggaaugacauuuaaccuuaucggugaaucgaccauuagaugcacuucugauccccacggcaaugggguuugguccagcccugccccaaggugugagcugucaguacgcgcuggacauugcaagacacccgagcaauucccuuuugcaaguccgaccauaccaaucaacgacuucgaauuucccgugggcacuucuuugaauuaugagugucgaccugguuacuucgggaaaauguuuuccauuagcugccucgaaaaccuggucuggucaaguguggaggauaauuguagaagaaagagcugcggacccccaccugaacccuucaacggcaugguucacaucaauaccgacacacaguuuggcuccacggugaacuacucuuguaaugagggguucaggcuaauuggaagcccauccaccacuugccuggucucagguaacaaugugacaugggauaaaaaggccccgaucugcgagauaaucucuugugaaccucccccaaccauuaguaacggcgacuuuuauucgaauaaccgcacuagcuuccauaaugggacuguagucaccuaccagugccacacgggacccgacggcgagcaacucuuugaacuggugggugagcguuccaucuauuguacaucuaaagaugaccagguugggguguggucaagcccuccacccagaugcauuuccaccaacaaguguacugcuccugaagucgagaacgccauccgggugccgggaaauaggaguuucuucacccuuacagagauaauucgcuuucgaugccagccaggcuucguuauggugggcucucauacuguccagugucaaaccaacgggagauggggacccaaguugccucacugcagccgggugugucagccacccccugaaauccugcacggugagcauacauuaucacaccaggauaauuuuucccccggccaggaaguauucuacaguugcgagccaagcuaugaccuccgcggggccgcgucucugcauuguacgccgcaaggagauugguccccugaagcacccaggugcaccgugaaaucaugcgacgauuuucuuggccagcugccacacgguagaguucuacucccucugaacuugcagcugggggcuaaggucagcuucgugugugacgagggauuuagguuaaaaggccggucggccucucacugcgugcucgcaggcaugaaggcucuguggaauaguuccguccccguaugugagcagaucuucugcccaaacccucccgccauucuuaaugggcgucauacuggaacaccguuuggugauauaccauacggcaaagaaaucagcuaugcaugugacacccacccugaucgcgggaugacuuucaaccugauuggagagucauccauccgaugcacaucugacccccaaggcaaugguguguggagcaguccagcccccagaugugaauuguccguuccugcugcgugcccgcauccacccaagauucagaacgggcacuacaucggcggacaugugagccucuaccugccuggcaugaccauaucuuauaucugugaucccggguaccuacuggucggaaaggguuuuauuuucugcacggaccagggcaucuggucacagcuugaccacuauuguaaagaggugaauugcaguuuuccacucuucaugaacgggauuuccaaggagcuggaaaugaaaaagguuuaccacuauggagauuacgugacuuugaaaugcgaggacggcuauacccuggaagguagcccuuggucucaaugucaggccgaugacaggugggaucccccauuagcaaagugcacaucgcggacccaugacgcucucaucgucgggacucugucaggcacaauauucuuuauucuucugaucaucuucuugagcuggauuauccucaagcaccgcaaaggaaauaacgcccaugagaauccuaaggaaguggccauacaucugcacucccagggcgggaguucuguacauccgagaacccuacaaacaaacgaggagaacagcagggugcugcccuga

SEQ ID NO: 54779 - RNA, 3279 nt, Artificial Sequence
  derived and/or modified sequence opt3 from CR2__Homo_sapiens__NP_001006659
augggcgccgcugggcugcucggaguguuccuugcacuggucgcccccgguguuuugggcaucagcugcggguccccuccaccgauuuuaaacggaagaauaucuuacuauucaacccccaucgcggugggcacaguaauuagguacaguuguagcgguacuuuucggcugaucggggagaagucccuacucugcauuacgaaagacaagguggauggaaccugggacaaaccugcuccaaagugugaauauuucaauaaauacucuucgugccccgagccuaucgucccaggcggcuauaagauacgcgggucaacacccuaccgacacggagauagcgugacuuuugccuguaagaccaacuucaguaugaaugguaacaaauccguuuggugccaggcaaauaacauguggggcccuacacgucugccaaccugugugucugucuuuccgcuugaaugccccgcccugccuaugauccauaaugggcaccauacuagcgagaacgugggauccauugcuccaggcuugucaguaacauauaguugugaaagcgguuaccuccugguuggggagaagaucauuaauugccugucuuccggaaaauggucagcagugcccccuaccugugaggaagccagaugcaagagccucggcagguucccaaacggcaaagucaaggagcccccgaucuuacgggugggggugacggcuaacuuuuucugcgacgaaggauaccgccugcaagguccucccaguucuagaugugucauagccggccaggggguugcguggacuaagaugccagugugcgaggagaucuuuuguccuucacccccacccauucuuaacggaaggcacauuggcaauuccuuggcaaacguaucguaugguucuaucgugaccuacacaugcgauccugacccagaagagggggucaauuucauccugauuggcgaauccacucuacgguguaccguggauucacagaaaacaggaaccuggaguggcccggcuccccgcugcgagcucagcacguccgccguucaguguccucauccacaaauacugcgagggagaauggugucuggacagaaggacagguauacuuacaacgauacagucaucuuugccugcauguucgguuuuacccuuaaaggcagcaagcagauucgguguaacgcacaggggacuugggaacccagcgcuccugugugcgagaaagagugucaagccccacccaauauccugaacggacagaaggaagaccgucacaugguacgcuucgauccgggcacaaguauaaaauauuccugcaauccugguuacguuuuggugggggaggaaagcauucagugcaccucugagggcgucuggacgccacccgugccucaguguaaggucgcggccugcgaagcaaccggaagacaacuccugacaaagccccagcaccaguucgugaggccagacguuaacucaaguuguggcgagggguauaaauuaagcggauccguguaccaagagugccaggguacuaucccuugguuuauggaaauccggcuguguaaggagauuaccugcccacccccgccuguaaucuacaauggcgcucauacagggucuucgcucgaagauuuccccuauggaacuaccgucacauacaccuguaacccaggccccgagcgagguguggaauuuagccuuauuggggaguccacuauacgcugcacgucaaaugaccaggagagaggcacauggaguggaccugccccacuguguaaauugucucuacuggcuguucagugcagccacgugcauaucgccaacggcuauaagauuuccgggaaagaagcacccuacuucuauaaugacaccgucacuuuuaaguguuacucaggauucacccucaagggcagcucucaaaucaggugcaaagccgauaacacaugggacccugagaucccggugugcgaaaaggguugucaguccccacccgggcugcaccacggacggcauaccggcgguaauacuguauuuuucgugaguggcaugacaguugauuauacgugcgacccuggguaccuucuggucggaaacaaaagcauucacuguaugccaucuggcaauuggucccccucagcuccucgcugcgaggagaccugucagcaugugagacagaguuugcaagaacucccggcggggagcaggguggagcuggucaacacuucgugccaggauggauaccaguuaacaggccacgcauaucagaugugucaagacgccgaaaaugguauaugguuuaagaaaaucccccugugcaagguuauucauugucacccaccucccgugaucgugaacgggaagcacaccggaaugauggcugagaacuuccuauacggcaaugaaguauccuaugagugcgaucaggguuuuuaccuccugggcgagaaaaaguugcagugucguucugacagcaaagggcauggaucauggaguggcccauccccucagugccuucggucucccccagucacacgaugcccgaacccugaagugaagcacggguauaaacugaauaagacucauagcgccuacucccacaacgauauuguuuauguggacuguaaucccggauucaucaugaacggcucaagagucauaaggugccacaccgauaauacgugggugccagguguucccaccuguaucaagaaagcauuuauugggugcccuccacccccuaagacaccgaacggaaaucauacuggcgguaacaucgcccgcuucagcccaggcaugaguauucucuacucuugugaccaaggguaccugcuugugggagaggcucuguugcucugcacccacgaaggcacauggucccagcccgccccucauuguaaagagguaaauugcagcucgcccgcagacauggaugggauccagaagggacuggaaccacggaaaauguaucaauacggcgcggucgugacuuuagagugugaggacgguuauaugcuggaagggucaccucagucucagugccagagugaucaccaauggaaucccccacuagcuguguguagauccaggagccucgccccuguccugugcggaauagcagccggccuuauuuugcugaccuuccucaucguuauuacgcuguacgugaucucuaagcaucgcgcucgaaauuauuacacagacaccagccagaaagaggccuuucacuuagaagcacgggagguauauuccguggauccguacaaccccgcuucauga

SEQ ID NO: 54780 - RNA, 414 nt, Artificial Sequence
  derived and/or modified sequence opt3 from CRABP1__Homo_sapiens__NP_004369
augcccaacuucgccggcaccuggaagaugagaagcuccgagaauuuugacgaacugcucaaagcucuuggggugaacgcaaugcugaggaaggucgccguugcggcugccucuaaaccucacguggagauccggcaggauggagaccaauucuacauuaagacaucaacuacgguacgcaccacagaaauaaauuuuaaagugggugagggcuucgaagaggagacugucgaugggcgaaagugccguaguuuggcaaccugggaaaacgagaauaagauccauuguacacagaccuuacuggaaggagacggcccaaaaacuuauuggacaagagagcuagccaacgaugagcucauucugaccuuuggugcugacgaugugguuugcacgaggaucuacgugcgggaauga

SEQ ID NO: 54781 - RNA, 417 nt, Artificial Sequence
  derived and/or modified sequence opt3 from CRABP2__Homo_sapiens__NP_001186652
augcccaacuucagcggcaauuggaagaucauuagauccgagaacuuugaagaacugcucaaagugcuuggggucaauguuaugcugaggaagauagccguggcugcagccucuaaaccugcgguagaaaucaagcaggagggagacaccuucuacauuaaaacaucaacuacggugcggaccacagaaaucaacuuuaaggucggugaggaguucgaggagcaaacuguggauggccgcccaugcaagaguuugguuaaaugggaaagcgagaauaagauggugugugagcagaaauuacugaagggggaaggaccgaaaaccuccuggacacgagagcuaaccaacgacggcgaacucauucugacuaugacagcugaugacgucgugugcacccguguauauguuagagaguga

SEQ ID NO: 54782 - RNA, 2196 nt, Artificial Sequence
  derived and/or modified sequence opt3 from CRACR2A__Homo_sapiens__NP_001138430
auggccgcucccgacggcagaguggucagcaggccucagcggcuggggcaaggauccggucagggcccaaaggggucuggagcaugccuccacccgcuugauucacuggagcagaaagaaacccaggagcaaacaaguggccaguugguuauguuacgcaaggcccaggaguucuuucagacuugugacgcggaggguaaaggguucaucgcucgaaaggauaugcaacgucugcauaaagaacuaccccucagccuggaggagcuugaagacguguuugaugcccuggacgcagauggaaacggcuacuugacgccucaggaguucaccacaggcuuuucccacuucuuuuucucucagaauaacccaucgcaggaagacgccggggagcaaguagcucagagacaugaggaaaagguguaucucucaaggggagaugaggaccugggugauaugggcgaagacgaggaagcacaguuucggaugcugauggaucgccucggggcccaaaaggucuuagaggacgagagcgacgugaaacagcuguggcuucaguugaagaaagaagaaccccaucugcuaaguaauuucgaagauuuucucacuagaauuauaucccagcugcaagaggcucacgaagagaagaacgagcuugaaugcgcccugaaaaggaagaucgcggcauacgacgaggaaauucagcacuuguaugaggaaauggagcagcagaucaagucugagaaagaacaauuccuccugaaggauaccgagcgguuucaggcccgcagccaggaauuagagcagaaacugcucuguaaggagcaagaacuugagcagcugacacagaaacagaagcgauuggaaggacaaugcaccgcucuacaccaugacaaacacgagacuaaggccgaaaauacaaagcugaaacucaccaaccaggagcuggcaagagagcuugaaaggacguccugggagcugcaggaugcucaacagcaguuggaaucacuccagcaagaggccuguaagcugcaucaggaaaaagagauggagguuuaccgggugacugaaaguuuacagcgugagaaggcgggccugcuaaaacagcucgacuuccugcgcgaaagaaauaagcaccuuagggaugagcgggacauuugcuuccaaaagaacaaagccgcaaaggcuaauaccgccgcuagccgagccucuuggaaaaagcgcuccgguucagucaucgggaaauauguggauagcagaggaauauugaggagucagucugaagaggaggaagagguauuuggcaucccucggcgcuccagccugggccucucgggguacccacugacagaagaggagcccggaacuggugaaccuggcccagggggaccguaucccagaccucuuaggcguauuaucucuguugaggaagacccacugccccaguugcucgauggcgguuucgagcagccucuguccaaguguucagaagaggaggaagugagugaccaagggguccagggccagauuccagaggcacccccguuaaagcugaccccuacaagcccccggggacaaccagugggcaaagaagcccuaugcaaggaggaauccucuccuagcgcucccgaccgacucuuuaaaaucguguucgucgggaacucagcgguuggaaagaccaguuuucugagaagguucugugaggaucgcuuuuccccagguauggcagccacggugggcauagacuaccggguaaaaacucuuaauguggauaacagccaggucgcuuugcagcugugggacacagccgggcaggagagauacaggugcauuacccaacaguucuuucgcaaggcagauggagugaucguuauguaugaccucacugauaagcagucuuuccugucagugcgacggugguuaaguagcgucgaagaggccgugggcgaccguguacccguucugcuuuuggguaauaaacucgauaacgaaaaggagagagaagugccuagggggcugggcgagcagcuagcuacagagaauaaccugaucuuuuacgaauguuccgccuauucuggacacaacaccaaagagucgcuccugcaucuugcacgcuucuugaaggaacaagaggacacgguccgggaggauaccauucaggugggccacccagcgaaaaagaaaagcugcugcggguga

SEQ ID NO: 54783 - RNA, 600 nt, Artificial Sequence
  derived and/or modified sequence opt3 from CRADD__Homo_sapiens__NP_003796
auggaggccagagacaaacaggugcugaggagccuccggcuugaacugggcgcugaggucuugguugaaggguuagugcugcaauaccuauaucaggagggaauccucaccgaaaaccacauucaggagauaaaugcacagacaacuggucugcgcaagacgaugcuucuguuggauauccuccccucccgaggcccuaaggccuucgacaccuuucuggauucucugcaagaguucccauggguacgugaaaaacucaagaaagcgagagaggaagcuaugacagacuuaccggccggggauaggcugacuggcauucccucacauauccuuaacaguagcccuuccgaccggcagauuaaucaguuggcacagcgccugggaccagagugggagcccauggugcuaucucucggucugucgcaaaccgauaucuacagaugcaaggccaaccacccucauaauguccagucacaggugguugaggcuuuuauaagguggcggcagcgcuucgggaagcaagcaacauuucagagccuucacaacggacugcgagccguggaagucgacccaaguuugcuccugcauauguuagaauga

SEQ ID NO: 54784 - RNA, 3810 nt, Artificial Sequence
  derived and/or modified sequence opt3 from CRAMP1L__Homo_sapiens__NP_065876
augaccgugaagcugggcgacgggggaagcggugaggauggccucaaaaagcuggggaaaagagccgcugacgaagagucccuugaaggagagggcgccgguggggccgaugcggcugaagagucuucaggaacaaagagggacgagaaaacuccccgggccggcgcagauggcccuccagccccgcccggggcuccucaggcaccaagucccccucaaggaagcccacaggaccagcaccauuucuugcgcuccucuguccgaccccagucgaagcguccuagaaaggauccaccgucagccguugguagcggcaacgcugggggaaguggccccagggguaaaggggccgaaggaggcggcuccucuagcgggaauguguccggaguagcgccugcagccccagcugguggcucacggaguagcucucgcaacuuaggguccucaggaggcgagaaggaagaggguaaaaaggugagaaggcaaugggagagcuggaguacggaagacaaaaauaccuuuuucgaggggcuguacgaacacggcaaggauuuugaggccauccagaacaauauugcacuaaaguauaaaaagaaaggaaagcccgcuucuauggucaaaaacaaggaacaggugcggcauuucuacuaucgcacauggcacaaaauaacuaaguacaucgacuuugaucauguuuucucccgaggccucaagaaaagcucgcaggagcuguaugggcuuauuugcuacggagagcugagaaagaaaaucgguggcuguauggacgauaagaaugccaccaaauugaacgaacucauucaagugggggcgacaaccgucagguauaagggacggaaucugcguaucaaggccccuaugugccgcgcacugaaaaagcucugugacccagacggcuuaucugaugaggaagaccagaaacccgugagacugccgcuuaagguaccuauagaguugcagcccaggaacaaucacgcuugggcccggguucagucccuggcucaaaacccacgacuacgcaugaucguggaacuccacagaaaagucucaagucugauugaguuucuuaagcagaagugggcccugcaugaggugagggugcggaaaacuuuggaggagcgccagcuccaagauagcugcuccgcaccuaugcaggaaaaggucacacugcacuuauuccccggugagaauuguacccugacgccacuccccgggguugccagagugguacauucuaaagcauuuugcacugugcacuggcaggaaggcggaagguguaagcagagcgcgaaagacgcacacguccuuccuccagcccaaauccugggcauucagucagggcagggaaccgcucguggucaggugaagugcccgcggaguggcgccgaggggaagggaguuggccgacccccuccagcagccgaugcuuugcaauccagcggugagucuucacccgaaagugccccuggggagggcgcagcgcuaagccuguccucuccagacgcucccgauagaccgccuccaaggcaucaggacacaggacccugucucgaaaagacuccugccgagggccgcgauucgcccacccgggagccaggggcacugccuugcgccuguggacagcuucccgaccuggaagaugaguugagccuccuggacccauuaccgagauaccugaaguccugccaggaccuaaucgugccugaacaauguaggugcgcugauacacgccccggcucagagcagccaccccucgguggggccgcaaguccugaaguccuggcuccagugucuaaagaggccgcggaccuugcccccaccggaccuagcccgcgaccaggccccgguuugcugcucgauguaugcacgaaggaccuggcugaugcuccugccgaggaacuucaggagaaaggcuccccagcugggcccccuccgucacagggacaacccgccgcacggccaccuaaggaaguucccgcgagccgucuggcccagcaguugagagaggaaggcuggaaccuccaaacuucugagucccugacauuagcugagguguaccugaugauggggaaaccaaguaagcuacagcucgaauaugacuggcugggaccuggcaggcaggauccccgcccagguagccuuccgaccgccuugcacaagcagcggcugcucucuugucuguuaaaacugauauccacugaggucaauccuaaacuugcauuggaagcuaacacaauuucaaccgccagugugagacccgcacaagaggaacagagcaugacgccacccgggaaagucgugaccguuucguccaggucuccucgaugcccacgcaaccaggccagccuccggucaaguaagacauucccucccuccucugcuccguguagcuccggacugagaaauccacccaggccucuacuggugcccggcccaucaagcacugguaguaacgacucugauggcgggcucuuugcgguaccuaccacacugcccccaaauucccgucauggaaaacuuuucagcccuucgaaggaggccgaguugacuuuucgccagcaccugaacucaaucucuaugcaaagugacuucuucuuaccgaagccccggaaacucagaaauaggcaucugcgaaagccacuugucgugcagcggacccuguugccucgccccuccgaaaaccagagccacaauguuugcucuuuuagcauucucuccaacucaagugugacaggcagagggagcuucaggccaauccagucuucccugaccaaagcagcucuaucacggccuaucguccccaaggugcugccgccacaagccacgagucaccucgccagcgcuauugaucuggcagccacuuccgcgggaauacuuucuggcaauccuuugcccgcucuggacacagaggguuuaucggggaucagcccacucucauccgaugaaguaaccggagccauuaguggccaggacucuacugguacccaucaggacggcgauacacugcccaccguugggggaagcgacccuuuuguguccaucccgucacgacccgagcaagagccagucgcagauucuuuccagggcagcagugugcuuucccugagcgaacuaccuaaagcaccccuccagaacgggcugucuauaccuuugucauccagugagagcucgucuacuagacuguccccacccgacgugagcgcuuuacucgauauuucacugccuggaccacccgaagacgcacuuagucagggcgagccggccacacacaucucugauuccaucauugaaaucgcgauuagcucaggucaauacggggagggagucccucugaguccagcuaaguugaauggcagcgacuccucuaagagccuccccuccccuucaucuaguccacagccccauuggauagccucgccgacgcacgauccucagugguaucccagcgacuccaccgauucuucacugagcucccuauuugcaaguuucaucucuccagagaaaagccgcaagaugcugccuacucccauuggcacaaacucagggaccucccuucucggaccaagucuguuggacgguaauagcagggauucuuuuguuucccguucacuggccgacguggcugaagugguagacagccaguuagucuguaugaugaacgaaaauucgaucgauuacaucucucgguucaacgaccucgcccaagaacugaguauugcagagcccggcagaagggaagcucuuuuugaugggggaggcggugggccugccguguccgaccugagccaguga

SEQ ID NO: 54785 - RNA, 1881 nt, Artificial Sequence
  derived and/or modified sequence opt3 from CRAT__Homo_sapiens__NP_000746
augcuggccuucgcugcaagaaccguggucaagccccucggcuuucuuaaaccuuucagccugaugaaggccuccucuagguuuaaagcgcaccaggacgcuuugccacgguuaccgguucccccucugcaacagucacuagaucauuaccucaaggcccugcagccaaucgugagugaggaagagugggcacacacaaaacagcuuguagacgaguuccaagccagcgggggagugggugaacgccugcagaagggcuuggaacgacgugcuagaaagacugagaacuggcucuccgagugguggcugaaaacggcauaucugcaguacaggcagcccgucgugauuuauucuucgccugggguuaugcucccaaagcaagauuuuguggacuuacagggacagcugcgguucgccgcuaaacuuauagaaggcgucuuggauuuuaaggugaugaucgacaaugagacccugcccguagaauaccuaggugggaaaccucucugcaugaaccaguauuaccaaauucugucaagcugucgcguuccaggaccgaagcaggauacagugaguaauuucuccaagacuaaaaagcccccuacccauaucacagucgugcacaacuaucaguuuuucgagcuugacguguaccauucugauggcaccccacugacugccgaccaaauuuuuguccaguuggagaaaaucuggaauagcucccuccagacaaacaaggaacccguuggcauacugaccucaaaucacagaaacaguugggcgaaagcauacaauacguuaaucaaggauaaagugaacagggacagcguacggucuauucagaaguccaucuucacugugugccuggaugccaccaugccucgcgucucagaggacguguaucgaagccacguugcugggcaaaugcuccauggagguggcaguagacuuaauucugggaacaggugguuugacaagacacugcaguucauuguggccgaagauggauccuguggcuuggucuacgagcacgcagcugccgaagguccacccaucgugacucuacuggacuauguaauagaguacaccaaaaagccggagcucguucggagcccuauggugccccugccaaugccuaaaaagcugcguuucaauauuacacccgaaaucaaaucggauauugagaaggcgaagcagaaccuuucuaucaugauccaggacuuggauauuaccgucaugguguuucaucacuucgggaaagacuuuccaaaguccgaaaaacucucacccgaugccuucauacaaauggcacugcaguuagcuuauuaccgcaucuauggacaggccugcgcuacguacgagagugccagccugagaauguuucaccuaggcaggacugacacaauucgguccgcaucuauggauagccucaccuucgucaaggccauggacgauucaagugugacugaacaucagaaaguugagcugcuucgaaaggcugugcaagcgcaccgcggcuacacagacagagcaaucaggggagaggccuuugaccggcauuugcuggggcucaagcugcaggcuauagaagaucuuguauccaugccugacauuuucauggauaccagcuaugccaucgcaaugcacuuucaucugucuacgucacaggucccagccaaaaccgacugugugauguucuuugguccgguugugcccgauggcuacggggucugcuauaauccuauggaggcucacaucaacuucaguuugagcgccuacaacuccugugcagaaacaaaugcggcucgccucgcccacuaucuggagaaggcauuacuggacaugagagcccuacuccagucucauccaagggcuaaacuguga

SEQ ID NO: 54786 - RNA, 3885 nt, Artificial Sequence
  derived and/or modified sequence opt3 from CRB1__Homo_sapiens__NP_001180569
auggcccugaagaacaucaauuaccuccuuauuuucuaucugagcuuuuccuuguuaauauacaucaaaaacucuuucugcaauaagaacaauaccagaugucugucaaacaguugccagaauaacagcacauguaaagacuuuuccaaggauaaugacugcucuuguucggauacugcuaacaaucuagacaaagauugcgacaacaugaaggaucccuguuucucaaauccuugccaaggcagcgcaacgugugugaacaccccaggggagaggaguuuucucugcaaguguccgcccggauauuccgguacaauuugcgaaacuaccaucggcucuugcgggaaaaauagcugucagcacggaggcauuugccaucaggacccuaucuacccagucuguauaugccccgccgguuaugcggggcgguucugugagaucgaucacgacgaaugcgcuuccucaccuugucagaacggagccguuugccaagauggcauugacggcuacaguuguuuuugcgugccaggguaucagggacgccauugugaucuggagguagacgaaugcgcaagcgaccccugcaagaacgaggccacaugucuuaaugagaucggucgauauaccugcauuuguccucacaacuacucuggcuacacuggggcucagugcgaaaucgaucugaaugaguguaacuccaauccaugccagucaaacggagaauguguggaguugagcagugagaaacaauacggccguauaacaggucucccgucuuccuucagcuaucaugaagcaucgggguacgucugcauuugucagcccggauuuaccggcauccacugcgaggaagacgugaaugaguguucuuccaacccuugccagaauggcgggacgugcgaaaaccugccaggaaauuauacuugucacugccccuucgauaaccugucaagaaccuuuuacgguggcagggacuguagugauauucucuuagggugcacacaucagcaaugucugaauaacggaacuugcaucccucacuuccaggacggccagcaugguuuuagcugucuuugcccauccggguauaccggcucuuugugugagaucgccacaacccugagcuucgagggagauggcuuccuauggguuaagucagggagugugacgacuaaaggauccgucugcaauauugcucuccgguuucaaacagugcagcccauggcccugcuucuguuccgcagcaacagagacguauuuguuaaguuggaacuccugucugguuacauacacuuaucaauccaggugaacaaucagaguaagguccuguuguucauuagccacaacaccuccgauggcgaguggcauuuuguggaagugaucuucgcggaggcagucacucuuacacugauagacgauucuuguaaagaaaagugcauugccaaagcuccgaccccuuuggagucggaccaaagcaucugcgccuuucagaauagcuuccuagggggacugcccguuggcaugacgucaaacgguguggcacuccugaauuuuuacaacaugccaaguaccccuucuuucguagggugucuucaggacaucaagauugauuggaaucacaucacacuggagaacauuagcuccggcucaagccucaaugugaaagcuggaugcgucaggaaggacuggugugaaucucagcccugccaaucccggggccgcuguauaaaccucuggcugaguuaucagugcgauugucaucgaccauacgaggggcccaauugcuuaagagaauauguggccggaagguuuggucaggacgauagcacuggcuacguuaucuucacccuggacgagucuuauggggauacaauuucccuaucaauguuugugcggacucuccagccuaguggacugcuuuuggcgcuggaaaacagcaccuaccaauauauccgugucuggcucgagcgcggcagacuggccaugcuuacaccaaauucgccgaaacuggugguaaaguucguuuugaacgacgguaaugugcaccucaucucccugaagauuaaacccuacaagauagaguuauaccagucuagccagaaccugggguucaucucagcaaguaccuggaaaauugaaaagggcgaugucaucuauauuggaggccuaccugacaaacaggagacugaacucaacgggggauuuuucaagggcuguauccaagaugugaggcugaauaaccagaaucuugaguuuuucccaaaccccacgaauaacgcuuccuugaauccuguccuggugaacguuacacaggguugcgccggggacaauucuuguaagagcaacccaugccauaauggaggcgugugccacucccggugggaugacuuuucauguagcugccccgcucucaccagugguaaagccugugaggaaguacaauggugcggcuucucuccguguccucacggggcacagugccagccaguccugcagggauuugaguguauagccaacgcuguguucaauggccaauccgggcagaucuuauuucgaagcaacggaaauauuacucgcgaacugaccaacaucacauucggcuuuagaaccagggacgcgaacguuauuauccuucaugcagagaaggaacccgaguucuugaauauaucgauucaggauucacggcucuuuuuccagcugcaaucugguaacaguuucuacaugcuaucccugacuagccuccagucugugaaugacgggacauggcacgaggucacgcugagcaugaccgauccucuuucccagacuucacgcuggcagauggaaguggacaacgagacacccuuuguaaccaguacaaucgccacuggauccuugaauuuccugaaagauaacaccgacauuuaugugggcgauagagcuaucgacaauauaaaggguuuacaaggcugccucucuacgaucgaaauugggggaaucuaccuguccuauuuugagaacguucauggcuucauuaauaaaccacaggaggaacaguuucuuaagaucucaaccaacagugucgugacagggugucugcaauugaaugugugcaacagcaauccuugucuccacggaggcaacugcgaggauauauacuccucuuaucacugcucguguccccuggguuggagcgggaagcauugcgaacuaaauauugacgaguguuucucaaacccaugcauccacggaaauuguuccgauagggucgccgcauaccauugcacuugugaaccgggcuacaccgguguuaacugcgagguggacaucgauaacugucagagucaccagugcgccaauggcgcuacauguauuucucauacuaacggguauagcugccuguguuuuggaaauuucaccggcaaauuuugccgucagucccggcucccuucaacggugugcgggaacgaaaagacaaaucugaccuguuacaacggaggcaauugcacugaguuccaaacagagcuuaaauguaugugccgacccgguuuuaccggggaauggugugagaaggacaucgacgaaugcgccucugauccauguguaaacggaggcuugugccaggaccuguuaaauaaauuccagugucucugcgaugucgcauucgcgggcgagagaugugagguggaccuggcugaugaccuuauuagcgauauauuuacuaccaucgggaguguuacaguggcccugcuacucauucuguugcuggcaaucgucgccuccgugguuacgagcaacaagagggcuacccagggaacuuauucucccucacgccaagaaaaggaggguucccggguggaaauguggaauuuaaugccuccacccgccauggagagacucauuuga

SEQ ID NO: 54787 - RNA, 3858 nt, Artificial Sequence
  derived and/or modified sequence opt3 from CRB2__Homo_sapiens__NP_775960
auggcccuggcuagacccggcaccccugacccacaggcacucgccagcgugcuucuguuguuacugugggcgccggcucuaucccuccuggccgggacaguccccucugagccuccaucagcaugcgccagugaucccugugcuccuggaacugaaugccaagcaacggagagcgguggcuacaccugugggccaauggaacccaggggaugcgccacacagccuugucaccauggcgcucuuugcguuccacaggguccggaccccacuggguuccgguguuauugcgugccuggauuucagggcccacgcugugagcuggauaucgacgaaugcgccucccgacccugucaccauggcgcgaccugccguaacuuggcagauagauacgagugccacuguccucucggguaugccggaguaacaugcgagauggaaguggacgagugugcuucugccccaugccugcaugguggcucgugucuggauggggucggaucauucaggugcgugugugcacccggcuacggugggacccggugccaacucgacuuagaugaaugucagagccagccgugcgcucacggaggcacuugucacgaccugguuaauggcuuucgcugcgauugcgccgggacaggauaugaggguacccauugugagagagaagugcuugagugcgcgagugccccuugugaacacaacgcauccugcuuggagggccuggggucuuucaggugucuaugcuggcccggauacagcggcgaacucugugaggucgacgaggaugaaugcgcuuccucaccaugucagcauggugggcggugccugcaacgcagugacccugcccuuuauggcggagugcaggcugccuuucccggcgcauucagcuuucgacacgccgcuggguuccugugucacugcccacccggauuugagggugcggacugcggcguagaaguugaugagugugcaucuagaccuugcuugaaugggggacauugucaggaccucccaaacggcuuccagugccacuguccggaugguuacgccgggcccacgugcgaagaggacguggaugagugucuguccgacccuugcuuacauggcggaacuuguucagauaccgucgcuggcuacauuuguaggugcccagaaacauggggcggacgggacugcagcgugcaacugacugguugccagggccacaccuguccccucgccgcaacaugcauaccuaucuuugagaguggggugcauucuuaugucugucacugcccacccggaacccacggcccguucuguggucagaauacgacuuuuuccguuauggccgggagcccuauucaggcuucggugccagccggcggaccccuuggccuggcauugcguuuccgcacaacccuaccugcggggacucuggcuacaagaaacgauaccaaggaaucucucgagcuggcccuuguagcagccacgcugcaagcuaccuugugguccuacucaacaacugugcucguccugagguuacccgaccuggcccuaaaugauggacauuggcaccagguggaaguugugcuccaucuggcaacccuugaguugcggcuguggcacgagggcugcccagcucgacucugugucgccagugguccuguggcgcuggccagcacagcuuccgcaacuccccuuccagccgggaucucuagcgcucagcugggagacgccaccuucgcaggcugcuugcaagacguacgcguugauggucaccuccuguuaccggaagaccugggcgagaacgugcuacucgggugugaaagaagggagcagugccggccucugcccuguguccauggaggcucaugcguggaucuuuggacacacuuucgcugcgacugugcgagaccacauagggggccuaccugcgccgaugagauuccugcugccacuuucggauugggcggugcaccaaguuccgcuagcuuucugcuccaggaacugcccgggccuaauuuaacggucucuuuccugcuucguacacgggagucagccggauugcuccugcaguuugcaaacgacagugccgcuggccuaaccguguuccugagcgaaggucgaaucagagcggagguuccgggcuccccagccgugguacuccccgggaggugggaugacggacugcgccaccuugucauguugucuuuuggcccugaucaacugcaggacuuagggcagcaugugcacguuggaggccggcuccuggcagcugauucgcagccauggggugggcccuucagaggaugucuucaagaccugagguuggauggcugccaccuccccuuuuucccgcugccccuagacaauagcucccagccaucagaacuggguggccgccagaguuggaaccucacugccgggugugugucugaggacaugugcagcccugaucccuguuuuaauggagggaccugccuggucacauggaacgacuuccauuguaccugcccagccaauuuuacugggccuacaugugcucagcaacuuuggugccccggacagccaugcuugccgccugcaacgugugaggaagugcccgauggcuucguaugcguggccgaggcgaccuuccgagaagguccacccgcugccuuuuccgggcacaacgcaucaagcggacggcuguuaggcggccucucucuggccuuccguacuagagacuccgaggcuuggcuucugagggcagccgcgggggcucuagaaggaguuuggcucgccguccgcaacgguagucuggcaggcggggugcggggaggccaugguuugccuggggccgugcugccaauacccggaccuagagucgcugauggcgccuggcacaggguucgauuagcaauggagcgcccggcugccacaaccagccgguggcuccuguggcuugacggcgcggccacaccaguggcacugagaggguuggcuucugaucucggauuucugcagggucccggcgccgugaggauccuacuggcugagaauuucacugggugucuuggacguguagcacucggcggucugccuuugccccuggcccgcccacggccuggggccgcucccggagcgagagaacauuuugcauccuggccaggcaccccugccccgauuuuaggcugccgaggggcucccgucugugccccaucaccuugccuccacgacggagcaugucgagaucuguucgacgccuuugcuugcgcguguggucccggcugggaggggccacggugcgaagcccacguggauccuugucauagugcacccugcgcucgcggaagaugucacacgcauccggacggcagguucgagugccggugcccaccugguuuugggggaccccgauguagacuuccaguucccagcaaagaaugcucgcugaacgugaccuguuuggauggcuccccuugcgagggcgggucuccggccgcaaauuguagcugccucgagggacuggccggucaacgcugucagguccccacacuaccaugcgaagcuaacccuugucugaauggcgggacuugcagggccgcgggaggcgugucagaguguaucugcaacgcacguuucaguggucaguuuugcgaaguugccaaggggcuuccccucccucugccauuccccuuguuagagguggcuguaccugccgcuugugcaugccugcuccugcuucuguugggacuacuguccggcauucucgccgcucggaaaagaaggcagucugagggcaccuauagcccaucccaacaggaagucgccggggcacgccuggagauggacucagugcuuaaggugcccccggaagagagguuaaucuga

SEQ ID NO: 54788 - RNA, 372 nt, Artificial Sequence
  derived and/or modified sequence opt3 from CRB3__Homo_sapiens__NP_777377
auggccaaccccggccuggggcuccuucuggcuuugggauuaccuuuccugcuagcaagaugggguagggccuggggccagauccaaaccacaagcgcgaaugagaacuccacugugcucccaucuucaacgaguagcuccucugacgggaaucugcggccggaagcuauuaccgccauaaucgucguguuuucgcuucuggcagccuugcuccuggcuguuggacuggcacucuuaguacgcaagcugcgagagaaacgucagacagaaggcacuuacagacccucaagcgaggaacaguucagucacgccgcugaggccagggcgccucaggauuccaaggagaccgugcaagguugccuuccaauuuga

SEQ ID NO: 54789 - RNA, 1326 nt, Artificial Sequence
  derived and/or modified sequence opt3 from CRBN__Homo_sapiens__NP_001166953
auggccggcgagggggaccagcaagaugcugcacacaacaugggaaaucaucugccccuccuuccugaaagcgaggaagaggacgaaauggagguggaggaucaggacuccaaggaagccaaaaagccaaacaucauuaauuucgauaccucucugccgacaucacacacuuacuugggugcggacauggaggaauuucauggcagaacguuacacgaugacgauaguugccaggucauacccguucugccucaggugaugaugauccuaauuccagggcaaacccucccccugcagcuuuuccauccucaggagguaagcauggugaggaaccugauccagaaagaccggacauuugcugucuuggccuauuccaaugugcaagagcgcgaagcacaguucggaacuaccgccgagauuuacgcuuaucgagaggaacaggauuuuggcaucgaaauaguuaaggugaaagcaaucggucgucagagauucaagguccucgagcugaggacacaaucugacgggauucagcaggccaaggugcaaauccugccagaguguguacuccccucgaccaugucagcuguucaguuagaaagccugaacaaaugccagauuuuuccuaguaagccagugucccgggaggaucaguguucuuacaaaugguggcaaaaguaucagaaacgcaaguuccacugcgccaaucuuacuagcuggccgagaugguuguacucccuguaugacgcggaaacacuaauggacaggaucaagaaacagcuccgggagugggaugaaaaccugaaggacgauucacuucccaguaauccuauagacuuuagcuaccgcgucgcagccugucugccaauugaugacguguugcgaauccagcuccugaaaauuggaucugcuauccaaagauuaaggugcgagcuggauaucaugaacaaguguaccucccucugcuguaaacagugccaggagacggaaauuacuaccaagaaugagauauucucacuuagccuguguggccccauggccgcauacgugaacccucacggcuauguccaugaaacauugacuguuuacaaggcuugcaaucuaaaccugaucgggcggccaaguaccgagcacucuugguuucccggauaugccuggacaguggcgcagugcaaaauuugugccucccauaucgguuggaaguucaccgcaacgaaaaaggacaugagcccgcaaaaauuuuggggccucacucguucggcucugcuuccuacaauacccgauaccgaagacgagauuucuccagauaagguaauccugugcuuguga

SEQ ID NO: 54790 - RNA, 348 nt, Artificial Sequence
  derived and/or modified sequence opt3 from CRCP__Homo_sapiens__NP_001035737
auggaggugaaggacgccaacagcgcucugcucuccaauuacgaaacccuuaaauauaucucuaagacacccugcagacaccagucaccugagauugucagggaguuccugacugcauugaaaagucauaaguuaacgaaagccgagaagcugcaacuacucaaccaccggccaguuaccgcgguggaaauacagcugaugguagaggagagcgaagaacgccuuacagaggaacagaucgaggcucuguugcauacugugaccuccauucucccggccgaacccgaggcagaacagaagaaaaauacaaacucuaaugucgccauggaugaggaagacccugcuuga

SEQ ID NO: 54791 - RNA, 300 nt, Artificial Sequence
  derived and/or modified sequence opt3 from CRCT1__Homo_sapiens__NP_061933
augagcucccagcaaucugccgugucagcuaagggcuucaguaaagggagcucccagggacccgcaccuugcccagccccggcgcccaccccugcuccagccucuucgucaagcuguugcgguaguggcagaggguguugcggagacuccggcuguugcgguucuagcuccacaucauguugcuguuuucccaggcggcgccgacgucagagaaguagcgggugcuguugcugcggaggcggcucucagaggucccaacggucaaacaaucgcagcaguggguguugcucuggauguuga

SEQ ID NO: 54792 - RNA, 1026 nt, Artificial Sequence
  derived and/or modified sequence opt3 from CREB1__Homo_sapiens__XP_011508947
augaccauggagagcggcgccgaaaaccagcaauccggggacgcugcagugacagaggccgaaaaucagcagaugacuguccaggcgcaaccccagaucgcuacgcuggcccagguuucuaugccugcagcccacgcuaccucaagugcaccaacagugacucucguacagcuuccgaacggacaaaccgugcagguccauggugugauucaggccgcucagcccagcguuauacaauccccucaggugcagacaguccaaucuucgugcaaggaucugaaaagauuguucucaggcacccagaucagcacuauugccgagagugaagacucccaggagucuguggauagcguaacagacucccagaagaggcgggagaucuuaucacgccgaccaaguuaccguaaaauucugaaugaucuaagcucugacgcgcccgggguuccuagaaucgaagaggaaaaguccgaggaggaaaccucagcaccagccauaacgacugugaccguccccacaccuaucuaucaaacuagcaguggacaguacauugcuaucacccagggcggugccauucagcucgcaaacaaugggacagauggagugcaaggccugcagacccuuacgaugacuaacgcugccgcgacacagccaggcaccacuauccugcaguaugcccaaacaaccgacgggcagcagauauuggugccgucuaaucaggucguugugcaagcagcuuccggagauguacagacguaccagauuaggaccgcccccacaagcacuaucgcuccugguguggucauggccucgucuccagcacuccccacccaaccugccgaggaagcugcgcggaaacgcgaggugagacugaugaagaacagggaagcagcccgggagugucgccgaaagaaaaaggaguauguuaaaugccuggaaaauagaguggcuguccucgagaaccagaauaagacauuaauugaggaacugaaagcccuuaaggacuuguacugucacaaguccgauuga

SEQ ID NO: 54793 - RNA, 1116 nt, Artificial Sequence
  derived and/or modified sequence opt3 from CREB3__Homo_sapiens__NP_006359
auggagcuggaacucgacgccggcgaucaggaccuucuggcuuucuuguuagaggaaagcggggaucugggaaccgcacccgacgaggccgugagagcgccucuagauugggcucucccacuguccgaagucccgucugacugggagguugaugaccuucugugcucauugcucagucccccugccagccugaacauccuguccucuucgaauccaugucucgugcaccaugaucacacauacucauuacccagggagacuguaagcauggaccuggaaagugaguccugccggaaggaagguacgcaaaugaccccucagcauauggaggagcuugcagaacaggagauugcccgcuuggugcugacagaugaagagaaaucucuacucgaaaaggagggccugauacuuccagagacucugcccuugaccaaaacagaggaacagauccucaagcgaguccguagaaaaauuaggaacaagcggagcgcucaagaaucccgcagaaagaaaaagguguauguugggggacuggagucaaggguguuaaaauacaccgcacagaauauggaacugcagaacaagguccagcuccuugaggagcaaaaucugaguuugcuagaccagcugcggaaacuccaggccauggugaucgaaauuagcaacaagacuucuuccucaagcacauguauccugguacuucugguuaguuuuugcuugcuccuggugccugcuauguauucuuccgauacccgcggcagcuuaccagccgagcacgguguccugucgcgacagcuaagagcgcucccgucugaagaccccuaccaacuggagcuuccugcauugcaguccgaagugccaaaggacucaacgcaucaguggcuggaugggagugacugugugcuccaagcccccggaaauacuagcugccugcuucacuauaugccucaggcuccauccgccgagcccccgcuggaguggccuuuccccgauuuguuuucugaaccacucuguaggggcccuauacugcccuuacaggcaaaccugacccggaaaggcggguggcuaccaacaggaagccccucagucauccuccaggaccguuacagugguuga

SEQ ID NO: 54794 - RNA, 1560 nt, Artificial Sequence
  derived and/or modified sequence opt3 from CREB3L1__Homo_sapiens__NP_443086
auggacgccgugcuggagcccuucccugcugauagacucuuuccaggcagcuccuuccuugaccugggggauuugaacgaaucugacuuuuuaaauaacgcacacuucccggagcaucuggaucacuuuaccgaaaauauggaggacuucucaaacgaucuauuuaguagcuucuuugacgaucccguccucgacgaaaaguccccucugcuugauauggagcuggacucuccaacacccggaauccaggccgagcauucguacucauugagcggugauagugcgccucaauccccacucguucccauuaaaauggaagacacuacgcaggacgcugagcacggcgccugggcacuggggcauaagcugugcucuauaauggugaaacaggaacagagcccugagcucccaguagauccguuagccgcucccuccgcaauggccgcugccgcggcaauggccaccacaccucugcuuggauugucaccacugaguaggcuacccaucccucaccaagcuccaggcgagaugacucagcuccccgugauuaaggccgaaccgcuggaggucaaucaguuccuuaaagugaccccugaagaccugguucagaugcccccaacaccucccagcucucacgguuccgauucagacgggagccaaaguccacggucuuugcccccuuccagcccagugcgcccgauggcacgaucgucuaccgcuaucuccacuucaccccuccugacagccccucauaaguuacagggaaccaguggcccacugcuccuuacggaggaagagaagcguacucugauugcggagggcuaucccaucccuaccaaauugccacuaacaaaggccgaagagaaagcacugaagagagucaggcggaaaauaaagaacaagaucagcgcucaggaaucccgcaggaaaaagaaagaguacguggaaugucucgagaagaaaguagagacuuuuaccucugaaaauaacgagcuguggaagaaaguugaaacacuugagaaugccaacagaacccuguugcagcaacuccagaagcugcagacguuagugacuaauaagauuagccggcccuauaaaauggcugccacacaaaccgggacuugccugauggucgcagcccuauguuucgugcucgugcugggaucacuugucccgugcuugccugaauuuaguuccgguagccagacaguuaaggaggauccacuggcugcggacggcguguacaccgcaucucagaugcccucacgcagucuccuguucuaugaugacggggccggacuuugggaggauggccgaagcacgcuguugccuauggaacccccagacgguugggagaucaacccugggggacccgcugaacagagaccaagggaucaccuccaacaugaccaccuggacuccacccacgagacaacuaaauacuuaucugaggccuggccgaaggauggcggcaaugggaccucgccugacuucagccauuccaaagaaugguuucacgaucgggaccugggacccaacacaacuauuaagcuaucauga

SEQ ID NO: 54795 - RNA, 747 nt, Artificial Sequence
  derived and/or modified sequence opt3 from CREB3L2__Homo_sapiens__NP_001240704
auggaggugcuggaaagcggcgagcaggggguccuccaaugggacagaaaacuuuccgaacugucugagcccggagauggugaagccuugauguaccacacccauuucucagaguuacuggacgaguuuagucagaacguucuaggccagcuccugaaugauccuuuccuuagcgaaaaguccgugucuauggagguagaaccaucgccgacaucacccgcuccucugauccaggcagagcacagcuauaguuugugcgaggaaccaagggcccaaucccccuuuacucauauuacgaccucugacagcuucaacgaugacgagguggaauccgagaagugguaccucucaacagauuuuccuaguacuagcauaaaaaccgaaccagucacagacgagcccccuccagggcuggugccgucuguuacccugacuaucacagcgauuuccacgccccucgagaaggaggaaccuccauuagaaaugaauaccggaguggauucaagcugucagacuaucauucccaaaaucaagcuggagccucacgaagucgaccaguuccuuaacuuuaguccaaaggagggcuugucugcucugcccgugucccuauggguaauggauaugguuagcgguucgaccgagcgggaauauggggagcgcgccggaaugucucucuaccaucgaugcuguuccuggcuguaugaaauagcacuuuuccugaaaaauaagaacuuugccucaaaauga

SEQ ID NO: 54796 - RNA, 1383 nt, Artificial Sequence
  derived and/or modified sequence opt3 from CREB3L3__Homo_sapiens__NP_001258924
augaacaccgaccuggccgcuggcaagauggcaagcgccgcgugcuccauggaucccaucgacucuuucgagcuccuugaucuguuguuugacagacaggaugggauuuuaaggcacguggaacugggagaggguuggggccaugucaaagaccaaguucuaccuaauccagauucagacgauuuccucaguagcauacugggguccggagacucucuuccgucgucaccccuguggagcccugaaggcagugauuccgguaucucugaggacuugccaagcgauccccaggacacaccuccacgguccgggcccgcuacuucaccagccggaugucacccugcacagccgggcaagggccccugccucaguuaccauccugggaacagcuguucuacgaccacaccaggacccgugauucagguaccugaagccuccgugacuaucgaccuggagauguggucaccagguggccgcauuugcgcugagaaacccgcagauccggucgaccugagcccucgauguaaucucaccgugaaggauuuacugcuuagugggucuuccggagacuugcaacagcaccaucugggcgccagcuaucuacuccgucccggugcugggcacugccaggaacugguucuuacagaggaugagaaaaagcuguuggccaaggaaggaaucacccucccaacucagcugccuuuaacaaaauacgaggaaagagugcugaagaaaauaaggcggaagauccgcaacaaacaaucggcgcaggagucuagaaagaagaaaaaggaauauauugacggccucgagaccaggauguccgcauguacggcccagaaucaggaacuucaacggaaaguccugcacuuggagaagcagaaccuaucacugcucgagcagcugaaaaagcugcaagcuaucgugguacagaguacuagcaaauccgcccagaccggcacaugcguugcagugcuuuugcucucuuuugcucugauuaucuuacccagcauaucaccauucgggcccaauaagacugaaaguccuggagauuuugccccaguccgcguguucucccgaacccugcauaacgacgcggccagcagaguggcagcugaugccgucccggguucugaggcucccggcccuaggccagaagccgacacaacccgggaggaaucacccgggaguccuggagcagauuggggcuuucaggacacggccaaucuaacuaacagcacagaggagcucgacaaugcuacccugguucuucguaacgcgacugaagguuuggggcaaguggcacugcucgauuggguagccccaggccccuccacaggaucuggccgcgcugggcuggaggccgcaggagacgaacuuuga

SEQ ID NO: 54797 - RNA, 1188 nt, Artificial Sequence
  derived and/or modified sequence opt3 from CREB3L4__Homo_sapiens__NP_001242908
auggaccugggcauccccgaucuccuugacgccuggcuggagccuccagaagauauuuucagcaccggguccguguuggaguuaggacugcacugcccgcccccugaagucccaguuacaagacuacaggagcaaggucuccagggcuggaagucugggggagacaggggcuguggucugcaggaaucagagcccgaggauuuucuuaaacuguucauagacccuaacgaaguguacugcagugaggcuagcccaggguccgauucuggaaucucggaagaccccugucauccugauucaccaccggcaccccgggccacuagcaguccuauguuguaugagguaguguacgaggcgggcgcucucgaacgcaugcagggcgagacggggccaaaugucggacugauuuccauccaacuggaccaguggucucccgccuuuauggugccugauagcugcaugguuuccgaacucccauucgacgcacacgcccauauuuuaccccgagcugguaccguggcaccggucccuuguacaacucugcuucccugccagaccuuguuucugacagaugaggaaaagcgucuacucggccaggagggggugucacugccaagucaccuuccucugaccaaagccgaggaaagaguauugaagaaaguuaggcggaagauccgcaacaagcaaagcgcucaggacucuagaaggcggaaaaaggaguauauagacggacucgaaucccgcguggccgcguguucagcacagaaucaggagcugcagaaaaagguccaagaauuagagcgacauaacaucagccugguggcccagcucagacaacuucagacucugauugcucagacaaguaauaaagccgcacagaccucuacgugcguguugauccuacuguucucccucgcucugauuauccuucccagcuuuucgccauuccaaucuaggcccgaggccggcuccgaagauuaccagccucacggugucacuucacggaacauacugacccacaaggacguuacagagaauuuggaaacucaggugguagagagucgucuccgcgaaccaccgggggcgaaggaugccaacggaagcaccagaacacuguuagagaaaaugggcggcaagcccaggccuuccgggcggauucgaucugugcugcaugcagacgagauguga

SEQ ID NO: 54798 - RNA, 1110 nt, Artificial Sequence
  derived and/or modified sequence opt3 from CREB5__Homo_sapiens__NP_001011666
auguucugcaccagcggcgggaacuccgccucugugaugucaaugagacccgucccuggaagucugagcucccuccuucaucugcacaauaggcagcggcaaccaaugccggcuucuaugcccgguacauugccuaacccaacuaugcccggcucgucagcaguuuuaaugccuauggagcgccagaugagcgugaauaguuccaucauggggaugcagggaccaaaccugucuaaucccugugccagcccucagguacaaccaaugcacuccgaagcgaagaugcgacuaaaagcugcccucacgcaucacccggcagccaugucaaacggcaauaugaacaccaugggucauaugauggagaugauggggagucgucaggaccagacaccccaccaccauaugcacagccauccucaccagcaccaaacucugccaccccaucacccuuacccacaucagcaccagcaucccgcucaccacccgcauccucagccccaccaucaacagaaucacccacaccaucacucucauucccaccuucaugcacacccugcccaccaucagaccucaccccacccaccccugcauacaggaaaccaagcucaggugagcccugccacccagcagaugcaaccaacucagacaauucagccgccccagccuaccggcggcagaaggcggcgcgucguggaugaagacccagaugagagaaggcggaaguuuuuggaacgcaaucgagcggcagccacgagaugcaggcaaaaacggaagguuugggugaugagucucgagaaaaaggcugaggaacugacucagaccaacaugcagcugcagaaugaggucucuaugcucaagaacgaaguggcccaauuaaaacagcugcuuuugacacacaaggacugucccauaacugcaaugcagaaagagucccagggguaucugagcccugagucgucuccacccgcuuccccgguaccugccugcucacaacagcagguuauccaacauaauaccauuacaaccaguagcuccgugucugaagucgugggaagcucaacgcuaagucagcucacuacacaccguaccgaucugaacccaauccuuuga

SEQ ID NO: 54799 - RNA, 7215 nt, Artificial Sequence
  derived and/or modified sequence opt3 from CREBBP__Homo_sapiens__NP_001073315
auggccgaaaaucugcuagacggaccaccuaauccaaagagagcuaaacuuagcuccccgggguucucugcaaacgauucaaccgacuuuggaagucuguucgauuuggaaaaugacuuacccgaugagcugaucccuaacgguggcgaacuggggcuccugaauagcggaaaccuugugccagacgccgcguccaagcacaaacaacugucugaguugcucagaggcgguucggggucaagcauuaaucccggaauaggcaacgucagugcuuccucuccuguucaacagggccucgggggccaggcccagggucaaccaaauagcgcaaacauggccucccugucagcuaugggcaagaguccccugagccagggggauucuuccgcaccuucauuaccaaaacaggccgcuagcaccaguggaccgacucccgccgcgucucaggcacugaauccucaagcccagaagcaagugggccuugcuacguccagcccagccaccucgcagacaggucccgggaucugcaugaacgcaaauuuuaaccaaacucacccuggauugcuaaauucuaacuccggccacucacuaauuaaccaggcuagucagggccaagcccaggucaugaaugggagccucggagcggccggucggggccgcggggcaggaaugccauaccccaccccggcuaugcagggcgccuccucuagcgugcuggcugaaacacuuacccaggucucaccucaaaugacuggucaugccgggcugaacacagcacaggccggcggaauggcuaagaugggcaucaccgggaauacgagucccuucggacagccauuuucccaggcggguggccaaccuaugggggcaacuggagugaacccccaguuggccagcaaacagucuaugguuaauucacucccaaccuuccccacagacauuaagaacacaagugugaccaaugucccuaacaugagccagaugcaaacauccgugggcaucguaccaacccaggcuauagccacggguccgacugcagaucccgagaaacgaaagcugauccagcagcaauuaguucugcuccuucacgcccauaaaugucagcguagagagcaggcuaauggggaagugagggccugcucucugccucacugucggacaaugaagaacgucuugaaucacaugacccauugccaagcaggcaaggcgugucaggcuauucuaggaucgccagccagcggcauccagaacacuauuggguccgugggaacaggucagcaaaaugcaaccucacugaguaaccccaauccuaucgacccaucuagcaugcagcgcgccuaugcugcccucggccugcccuacaugaaccagccgcagacgcaacuucagccucaggugccagggcagcaacccgcacagccucagacccaccaacagaugagaacacugaaccccuugggaaauaacccaaugaauauaccugcuggcgguauuacuaccgaucagcagcccccaaaccucaucuccgagucagcccugccgacuagcuuaggggcgacuaauccucugaugaacgacggcucuaauuccggaaacauuggcacccuaaguacaauccccaccgccgcuccacccagcucuacuggggucaggaaaggauggcaugaacacguuacgcaagaucuccggucccaccuggugcauaaacuuguacaggcaaucuuuccuacaccagaccccgccgcuuugaaagaccgccgaauggagaaucugguggccuaugcaaagaaagucgagggcgauauguacgaaucagcgaacaguagagacgaguauuaccaccuccuggccgaaaagauuuauaaaauacagaaggagcuugaagagaagaggcggagccgucugcauaaacaggguaucuuggggaaucaaccugcucucccggccccaggagcacagcccccugugauuccacaggcucagcccguucgcccuccgaacggcccccugucguuaccagugaauagaaugcaagucucccaggguaugaacucuuucaauccuaugagccugggcaacgugcagcuaccccaggccccaauggggccuagggcagccucacccaugaaccacaguguucaaaugaacuccaugggaucuguuccaggcauggcuaucagcccgucccggaugccucagcccccaaacaugaugggggcgcauaccaauaacaugauggcccaggcacccgcucaaucacaguuucucccucagaaucaguucccaagcaguucuggagccauguccgugggcaugggucaacccccugcccagacuggggucagccagggacaggugccgggcgcugcacugccaaacccccuuaauauguuggguccucaagccucgcagcugcccugcccaccugucacccagucaccccuccacccaacaccuccgcccgcgucuaccgcugccggcaugccaagucugcagcacacuacaccucccgggaugacgccaccucaacccgcagccccgacccagccauccacuccugugagcucuagcggacagacacccaccccaacacccggcuccguuccuucagcuacucaaacccagaguacgccgaccgugcaggcagccgcgcaggcucaaguaacaccccagccacagacuccuguccagcccccuagcguggccaccccacaaucuucccagcagcagcccacaccuguucaugcacaaccacccgggacuccguuaucacaggccgcugccaguauagauaaccgagugccuaccccaagcuccgucgcaucugcugagacaaauucgcagcagcccggaccugacgugccaguacuggaaaugaagacggagacccaagccgaagauacugagcccgacccgggcgaaagcaaaggugagccucgcucagagaugauggaagaggaucuucagggggcgucccaggugaaggaagagacagacauugccgaacagaagagugagcccauggagguugaugaaaagaagccagaggucaaaguggaagugaaggaggaggaagagucuagcuccaacggaaccgcaucacagucuacuagcccuagucagcccaggaaaaagaucuuuaaaccagaagaguugaggcaggcucucaugcccacccuggaagcccuauaccggcaagacccugagucccugccauuccgccagccggucgauccccagcuccugggcaucccugacuacuuugacauuguuaagaauccaauggaucuuagcacaaucaagagaaaauuggacacgggucaguaucaagagcccuggcaguacguggaugacguguggcugauguucaacaaugcuugguuauauaacaggaagaccucucguguauacaaauucuguucaaagcucgcagaagucuuugagcaggaaauugauccugugaugcagucccugggcuauugcugugggcggaaauacgaguucaguccacaaacucuuugcuguuauggaaagcagcugugcacaauaccccgagacgccgccuacuacagcuaucagaauagauaccacuuuugcgaaaaguguuucaccgagauccaaggcgagaacguuacauugggggaugacccuucgcagccgcagacuaccauuucuaaagaucaguuugaaaagaaaaagaacgacacgcucgauccagagcccuucguggacugcaaagaauguggaaggaagaugcaucaaaucugcguccugcacuaugauaucauuuggccuuccggcuuugugugugacaauugccucaaaaagacaggucgcccccggaaggagaacaaauucagcgcuaagagacugcagaccacuaggcucgggaaucaccuggaagaccgcguuaacaaauuucuucgacggcagaaucauccagaggcgggagagguguucguacgugucguggcaucaagugauaagaccguggaagucaaaccuggcaugaagucuagauuuguugacuccggcgagaugagcgaaucauuccccuacaggacaaaggccuuguuugcuuucgaggagauagaugggguggacguauguuucuuuggaaugcacgugcaggaauaugguagugauugcccaccgccuaacacucgccgggucuacaucagcuaucuggacuccauucauuucuuuagacccagguguuuacgaaccgccguguaccacgagauccucauuggcuaccuggaauauguuaagaaacuuggguacgugacaggacauaucugggcaugcccacccucugagggcgaugacuauauauuccacugucacccuccagaucagaaaauccccaagccuaaacgccugcaggaaugguacaagaagaugcuagacaaagccuuugcugagcggauuauccaugauuauaaggacauuuucaaacaggcgacggaggauagacucaccagcgccaaggaacugccguacuuugagggugacuucuggccaaaugucuuggaagaguccaucaaagaacuggagcaggaggaagaggaaaggaagaaggaggaaucaacugcagcuucugagacaaccgaggggagucaaggagacucgaaaaacgccaagaaaaagaauaacaaaaagacuaauaaaaacaagagcuccauaucucgugcaaauaagaaaaagcccucaaugccuaacgugagcaaugauuuaucccagaaacucuaugccacaauggaaaagcacaaagagguauuuuucgugauucaucugcacgcuggcccagucaucaacacccuucccccuauuguagaccccgauccacuguugaguugcgaccucauggauggccgcgacgccuuucugacgcuagcgcgggauaagcauugggaguucucuagccugagaaggucaaagugguccacucuuugcaugcucguggagcugcacacccaggggcaagaccgauuuguuuacacauguaaugagugcaaacaccauguggaaacccgguggcacuguacugucugcgaggauuacgacuuguguaucaacugcuauaacacaaagagucaugcacacaaaauggugaaguggggacuggguuuagaugacgaaggcagcucucagggggagccgcaguccaaaucaccucaggaaagccgcagacucucgauacaaagguguauccagucucugguacacgccugccagugucggaaugcuaacugcagucuucccuccugucagaagaugaagcgagugguccaacauaccaaaggaugcaagagaaaaacaaauggcgguugcccaguuuguaagcagcugauugccuugugcuguuaccacgcuaaacauugccaggagaacaaguguccugugcccuucugccucaauaucaagcacaaacugcgccagcaacagauucagcauaggcuacagcaagcacagcugaugcgucggagaauggccacuaugaacaccaggaaugugccacagcaaagccuuccuucacccacguccgcuccgccagggacaccuacccagcagcccucuacuccacagacaccacaaccuccggcccagccacagcccagcccugucaguaugucccccgcaggauucccaagcguggcgcgcacacagccucccacuaccguuucuacgggcaagccaacaucacaaguaccugccccgcccccucccgcucagcccccucccgcagcaguggaggcugcccgacagaucgaaagagaggcacagcaacagcagcaccucuaucgggucaacauaaauaacaguaugcccccgggcaggaccgggaugggaacuccagguucccaaauggccccugugagccugaauguuccccgcccaaaccaggugucuggccccgucaugccuucgaugcccccagggcaguggcagcaagcuccuuugccgcagcagcagcccaugccaggauuaccucgucccgugauuucaaugcaagcgcaggccgcaguagcuggcccaagaaugccuagcguccagcccccgcgguccaucaguccuucugcccugcaggaccuccugaggacacuuaaaagcccauccucaccccaacagcagcagcaagugcugaauaucuugaagaguaacccucagcuaauggccgcauuuauuaaacagcgcaccgcuaaguacguugccaaucaaccagguaugcagccccagccugggcugcagucucaaccaggaaugcagccccagccgggcaugcaccagcaaccuagccuccagaaccugaacgcgaugcaggcuggcgugccccgaccagggguacccccucagcaacaggccaugggaggucuuaauccacagggccaagcauuaaacaucaugaaucccgggcauaacccuaauauggccuccaugaacccacaguauagagaaaugcugcggaggcagcucuugcagcaacagcagcagcaacagcagcagcaacagcagcaacagcagcagcaacagggaucagcuggcauggccggugggauggccggacacggccaguuccagcaaccgcagggccccgggggauacccuccagcgaugcagcagcaacagcgcaugcagcagcaucugccccuccaagguagcucuaugggccagauggcugcccagauggggcaacugggacagaugggccagccuggucuuggggcagauuccacuccaaauauucagcaagcccugcagcagagaauauugcagcaacagcagaugaagcagcaaaucggcagucccggacagccgaacccuaugagcccacagcaacacaugcuaucgggccagccccaggcuucccaucugccugggcagcaaauugccacaucucucucaaaucaggugaggagccccgcaccaguucagaguccgcggccucagucccaacccccacauucuagccccucaccucguauccagccacagcccuccccucaccaugugaguccacagaccggaagcccgcaccccgguuuagcugucacgauggccucuucaauugaccaaggccaucuggggaacccugagcaguccgcgaugcuuccacagcugaauacucccagccgcucugcccucaguucggaauugucccuggugggagauaccacaggcgacacccucgagaaauuuguagagggucuguga

SEQ ID NO: 54800 - RNA, 1254 nt, Artificial Sequence
  derived and/or modified sequence opt3 from CREBRF__Homo_sapiens__NP_001161865
augccccagccuagcguguccggcauggacccaccguucggggaugccuuuagaucucacaccuucucagagcaaacacugaugaguacugaccuccuugcuaacagcuccgaucccgacuuuauguacgaacuggauagggagaugaauuaucagcagaacccucgggacaauuucuugucuuuagaagauugcaaggacaucgagaaccuggaaucguuuacggauguccuagacaaugagggagcacucaccucaaacugggagcagugggauacauacugugaagaccugacuaaauauaccaaacuuacaagcugcgauauuugggguaccaaggagguugacuaccugggcuuggacgauuucaguuccccauaucaagacgaagaggugauaucuaagacucccacacucgcccagcugaauagcgaggauucccagucaguaagugacagccuguacuauccugauucucucuuuuccgugaaacagaacccauuacccagcucauucccugggaagaagaucaccagucgcgcggcugccccagucuguucuuccaaaacgcugcaagcagaagugccgcuuagcgacugcguucagaaggccucgaaacccacuucuuccacccagauuauggugaagacaaauauguaccauaacgagaaagucaauuuucacguggaauguaaggauuacguaaagaaagcuaagguuaaaaucaacccugugcagcaaucacgaccauugcugagucagauucauacugacgcagccaaggagaauaccugcuauuguggagcugucgccaaacgucaggaaaagaaaggcauggagccccuacaaggucacgcgaccccugcacucccauucaaggagacacaggaacugcuucugagccccuugccgcaggaggggccuggaucccucgccgcuggcgaaucuagcucacugagugccuccacgagcgugucugauucaagucagaagaaagaggaacauaacuacagcuuauuuguguccgacaaucugggcgagcaacccacuaagugcucuccagaggaagaugaggaagacgaggaagacgucgaugacgaggaucacgacgagggguucggaucggaacacgagcucagcgaaaacgaggaggaagaggaagaggaagaggauuaugaggacgauaaagacgaugacaucuccgauacauuuucagaaccugguauaaucaugcuugcaagucugcccgacuga

SEQ ID NO: 54801 - RNA, 1065 nt, Artificial Sequence
  derived and/or modified sequence opt3 from CREBZF__Homo_sapiens__NP_001034707
augagacacagccugaccaagcuccuugccgcuuccggcucuaacucacccacaaggagugaaagcccugaaccagcagccacuugcucccugccgucugacuugacgcgggcggcugccggggaggaagagaccgcagccgcuggaucgcccggucgcaaacagcaauucggcgaugaaggggaguuagaggcaggacgaggcucacguggugggguggccgucagagcuccuagcccagaagagauggaagaggaggccaucgcgagucugcccggagaagagacagaagacauggauuuucuauccggccucgagcuggcagaccuucuggauccuaggcagccagacuggcauuuggaucccggccucucuagcccugggccacuguccucaaguggagguggcagcgacucugggggacuguggcggggcgaugacgaugacgaagccgcugccgcagagaugcagcgcuucuccgaucucuuacagagacugcuuaaugguauugggggauguucaagcaguucugacuccggcagcgcugagaagaggcggcgcaaaucgccgggcgggggagguggcgggggaucuggcaacgacaauaaccaagccgcgacuaagagcccccgaaaagccgcagcugccgcugccagauugaauaggcugaagaagaaagaauacguuaugggucuagagucacgggugcgugggcucgcagccgaaaaccaggagcugcgcgcugaaaauagagagcuuggcaagaggguacaggcgcugcaggaggaaagucgguauuugcgagcagugcucgccaacgagaccggacuggcucgcuuacugagcagacucuccggcgucgggcuuaggcugacaaccucuuuguuucgggauagcccugccggagaccacgauuacgcacuaccaguggguaaacaaaagcaggaccugcucgaagaggaugacucagccggcgggguuugccugcauguggauaaagacaaggucaguguggaguucuguuccgcuugcgcccgcaaggcauccucuucacuuaaaauguga

SEQ ID NO: 54802 - RNA, 663 nt, Artificial Sequence
  derived and/or modified sequence opt3 from CREG1__Homo_sapiens__NP_003842
auggccggccugagcagaggguccgcuagggcacuccuugccgcgcuguuggcuucuaccuuacuggcccuacucgugucacccgcacggggacgcgguggccgagaccacggggauugggacgaggccagucgucugccuccacuuccgcccagagaagaugcugcaagggucgcccgguucguuacacaugugagcgacuggggagcucuggccacuaucuccacguuggaggcgguacgcggcagaccuuuugcagaugugcucucucugucggacgguccacccggggccggaucaggcgucccuuacuucuaucugagcccacuccaguuaaguguguccaaccugcaagaaaaucccuacgcuacccuuacaaugacuuuggcccagaccaacuuuugcaagaaacacggcuucgauccucagucuccacuguguguucauauuaugcuaagcgggacagugaccaaggucaaugagacugaaauggacauagcaaaacacucccucuuuaucaggcauccggagaugaagacauggcccucaagucacaacugguucuuugcuaaacugaauauuaccaacaucugggugcuugauuauuucggagguccuaagauuguaacgccagaggaauacuauaauguuacugugcaguga

SEQ ID NO: 54803 - RNA, 1269 nt, Artificial Sequence
  derived and/or modified sequence opt3 from CRELD1__Homo_sapiens__NP_001026887
auggcccccuggccuccaaagggccuggugccggcuguccucugggggcuuagccuguucuugaacuuacccggaccuaucuggcugcagccaucucccccuccacaauccucacccccuccacagccgcaccccugccauaccuguagaggucuaguugacaguuuuaauaaaggccucgagaggacaauucgggauaacuucgggggaggcaauacugcaugggaagaggaaaaccugagcaaguacaaagacuccgagacgcgccuuguggaaguacuggagggugugugcucuaagucggauuuugagugucaccgauugcucgaacugucagaggaacuggucgagagcuggugguuccauaaacagcaggaggccccugaccucuuucaaugguuaugcagugauucccugaaacuuuguugcccagcggggaccuucggacccucuuguuugccuugcccaggcggcacagaacgucccugugggggauauggucagugcgagggcgaagggacuagaggaggcagcggucacugugacugccaggcuggguacggaggcgaggccugcggccagugugggcugggauauuuugaagcagagaggaaugccucccaucuagugugcucagcuuguuucgguccgugcgcacgguguaguggcccugaggaaagcaacugccuccaauguaagaaggggugggcccugcaccaccuuaagugcguugauauagacgaguguggaaccgaaggcgcuaauugcggugccgaucaguuuugugugaacacagaggggucuuacgaaugccgcgacugcgcgaaagcaugucugggcugcaugggagccggccccgggagauguaagaaaugcuccccaggauaucagcaggucgguucaaaguguuuggauguggacgagugcgagaccgaaguauguccuggcgagaauaagcaaugcgaaaacacugaagggggauacagguguaucugcgcugagggcuauaaacagauggaggguauuuguguuaaggagcagauccccggggccuucccaauucucacagaucugacccccgaaacgacucggcgcuggaaauuaggcagccauccucacaguaccuacgugaagaugaaaaugcaacgagacgaggcaacauuuccaggacuguacggcaagcaggucgcuaaacucgggucucaguccagacagagcgacaggggaacucggcuuauccauucgcaacaggccucuucccagcguuga

SEQ ID NO: 54804 - RNA, 1209 nt, Artificial Sequence
  derived and/or modified sequence opt3 from CRELD2__Homo_sapiens__NP_001128573
augagacugcccaggcgggccgcucucggccuucugccuuuguuacugcuacucccaccggcacccgaggccgcgaagaaaccuaccccaugccaccgcugucgagggcugguggacaaguucaaccagggaauggucgauacagcuaaaaagaauuuugguggcgggaacacugccugggaagagaaaacgcuuagcaaguacgaauccucugagauccgucuguuggaaauucucgagggacugugcgagucaagugacuucgaauguaaucaaaugcuggaggcacaggaggaacaucucgaggccuggugguuacagcuuaagagcgaauaucccgaucuguuugagugguucugcguuaaaaccuugaagguguguugcuccccuggcacauacgguccagacugucuggcuugccaagggggaucucagagacccuguucgggcaacggccacugcucaggggauggaagcaggcagggugacggcaguugucggugccauaugggguaucagggaccucuaugcacugauuguauggacggcuacuuuuccucucuccgcaaugaaacccacagcauaugcacaguaagaaccggucuguccgauucauauccaccguguugccuuagucugggguguuggaggggagugggccaugcauggauccggggccgcaacacucacacacagcccggguacagcucucgagucuggauugccgcuuucuccccugccugcgacgagucauguaaaaccugcagcggauugacgaauagagauuguggugaaugcgaggugggcuggguucucgacgagggggcguguguggaugucgacgaaugcgcagccgagccacccccuugcagugcugcccaauuuuguaagaacgcaaauggaucuuauacuugcgaagagugugacuccagcugcgugggcuguaccggugaagggccaggcaacugcaaagaguguaucucgggauacgcuagggagcacggccagugcgccgauguagacgaauguucucuggcggagaagacaugcguucggaagaaugaaaacuguuacaauacucccggguccuaugugugcgucugcccggauggauucgaggaaaccgaggacgccugugugccucccgcagaggcugaagccacagagggugaaucaccaacccaguuaccuagucgugaggaucuguga

SEQ ID NO: 54805 - RNA, 540 nt, Artificial Sequence
  derived and/or modified sequence opt3 from CREM__Homo_sapiens__NP_001254491
auggccgugcccaccagcaucuaccagacauccacuggccaauauauugcuauagcacaagggggaacgauccagauuucuaacccugguucagacggcguccaggggcugcaggcccucaccaugacaaauaguggagcgccaccgcccggcgcuacuaucguucaguacgccgcacagagcgccgaugguacccagcaauucuuugugccugggucccagguagugguccaggcugcaacaggagacaugccaaccuaucagauuagagcccccacugcugcccuuccucaaggcgugguuauggcggcaucuccaggcucgcugcacucaccccagcaguuggccgaggaagcuacaaggaagcgggaguuacgccugaugaaaaaccgagaagccgcaaaggagugccguagaaggaaaaaggaauacgugaaaugucuagagagccgggucgcugugcucgagguacaaaauaagaagcugaucgaggaacuugaaacccugaaagauauaugcaguccuaagacggacuauuga

SEQ ID NO: 54806 - RNA, 969 nt, Artificial Sequence
  derived and/or modified sequence opt3 from CRHBP__Homo_sapiens__NP_001873
augagccccaacuucaagcugcagugccacuuuauccucauuuuccuuaccgcccugagaggcgaguccagguacuuggaauuacgggaggcugcagacuaugauccuuuucugcuauucucugccaaucucaaacgcgaacuggcgggggagcaaccauaccgacgugcucuuagaugucuggacauguugucacuccagggacaguuuacauucacugccgauaggccgcagcugcauugcgcagccuuuuucauaagugaacccgaggaguuuaucacgauucacuaugaccaagugagcaucgauugucaggguggcgacuuccugaaggucuuugauggguggauucucaaaggagaaaaguucccuuccucucaggaccauccauuacccucggcugagcgguacaucgauuuuugcgaaucaggccugagccgcagaaguauaagguccucucagaacguugcaaugaucuucuuccgggugcacgagccugguaauggguuuacccuuacaauuaaaacugacccaaacuuguuccccuguaauguaaucagccaaaccccuaacggaaaguuuacacugguggucccacaucagcaccgcaauugcuccuucucaauuaucuauccggugguuauaaagauuagugaucuaacccucggccacgugaacggccugcagcuuaaaaagagcucugccgggugugagggaaucggugacuuugucgaacuguugggcgggacuggacucgaucccuccaaaaugacaccucuggcugacuuaugcuacccauuccauggccccgcccagaugaagguggguugugacaauaccguaguucgaauggugucaagcgggaaacacgucaacagagugacguuugaguauaggcaacuggaaccuuacgagcucgaaaauccaaacggaaauaguauuggcgaguucugccuuucuggccuguga

SEQ ID NO: 54807 - RNA, 591 nt, Artificial Sequence
  derived and/or modified sequence opt3 from CRH__Homo_sapiens__NP_000747
augagacugccccuccuugugagcgccggcguccuguugguugcuuuacugccuugcccaccguguagggcacuacucucccgggggcccgugccuggagcccgccaggcgccacaacacccccagccucuggacuucuuucagccacccccucagucugagcaaccacagcagccgcaggcucgacccguacuucugcguaugggugaagaguacuucuugagacucggcaaccugaauaagaguccugccgcaccacugucacccgccagcucccucuuagcugggggaucuggcucgaggccuucaccagaacaagcaaccgccaacuuuuuccgggugcugcuucagcaguugcugcuaccccgcagaagccucgauaguccggcugcccuggcggagaggggugcacggaaugcccuugggggacaucaggaagcuccugagcgcgagcgaagauccgaggaacccccaaucucucuggacuugacauuucaccuccugagggaagucuuagagauggcccgggcagagcaacuggcucagcaggcccauagcaaccguaaacucauggaaauuauaggcaaguga

SEQ ID NO: 54808 - RNA, 1335 nt, Artificial Sequence
  derived and/or modified sequence opt3 from CRHR1__Homo_sapiens__NP_001138618
augggcgggcacccccagcugagacucgugaaggcccuucuguuguuaggacugaacccugucagcgcuucccuacaagaccagcauugcgagucucucucacuggcaaguaauaucagcggucuucaguguaacgccuccguugaucugauugggaccugcuggccaaggucuccggcgggccaguuggugguacggcccuguccugcuuucuuuuacggagugcgcuauaauacaacuaacaauggcuaccgagaaugccucgccaacgguucgugggcagcccgugucaauuauucagagugucaagaaauacugaacgaggagaaaaagagcaaagugcacuaccauguugcugugaucauuaauuaucuggggcacugcaucagucucgucgcauuacugguggccuucguacucuuuuugagacugaggccaggauguacgcauuggggcgaccaggcugauggcgcccuagaaguuggggcgcccugguccggagcaccuuuccaggugcggcgcucuauuagaugccucaggaacaucauacacuggaaucugaucagcgccuuuauucuucggaacgcuaccugguucgucgugcagcugacaauguccccagaggugcaccaaucaaaugucgguuggugucgcuugguuacugccgcauacaacuauuuucaugugaccaauuucuuuuggauguucggcgaagggugcuaccuccacacagcuaucguacugaccuacaguacugaccgauuaagaaaguggauguuuauuuguaucggauggggcgugcccuucccuauaauugucgccugggcgaucgguaaacuguauuacgauaacgagaagugcugguuugggaagaggccaggaguguauacagacuacauuuaucagggcccgaugauccucguucuucugaucaacuucauuuucuuguuuaauauagugcggauccuaaugaccaaacugcgugccagcacgacuucugaaaccauucaguaccgcaaggcagucaaagcuacacucgugcugcuuccccuguugggcaucacuuauaugcuuuucuuuguaaacccuggggaggaugagguuuccagaguggucuucauauacuuuaauucauuccuggagagcuuucagggauucuuugugagugucuucuacugcuuuuuaaacucugaagugagguccgccauucggaagcgauggcaucgcuggcaagacaaacacagcaucagagcuaggguugcccgggcaaugucgaucccaaccucucccacacgcguguccuuccacucaauuaagcagaguaccgccguauga

SEQ ID NO: 54809 - RNA, 1317 nt, Artificial Sequence
  derived and/or modified sequence opt3 from CRHR2__Homo_sapiens__NP_001189404
augagaggccccagcgggccuccaggacugcucuacgugccgcaccuucuguugugcuuacugugucuacuacccccuccacugcaguaugccgcuggucaaucccagaugcccaaggaccagccucuuugggcacuguuggagcaguacugccauaccaucaugacacucacuaaccugucuggcccauauucauacuguaauacgacccuggaucaaauugggacaugcuggcccaggagugccgcgggagcucucgucgaacggccuuguccagaguauuucaacggcguuaaauacaauacuacccgcaacgccuaucgagaaugcuuagagaaugguacaugggcaagcaagauaaacuacucccagugugaaccgauccuggacgauaaacagcguaaguacgaccuucacuauagaauugccuuggugguaaauuaccuggggcauugcgugucugucgcugcacucguggccgcuuuucuccuguuccuugcccugaggucgauccgguguuugcgcaacguuauucacuggaaucucaucaccacuuuuauacugagaaacgugaugugguucuuacugcagcucgucgaucaugaggugcacgagucaaaugaaguaugguguagguguaucacaaccauuuuuaacuauuucguugugacgaacuuuuucuggauguuugucgagggaugcuaccuucacacugcgaucgugaugaccuauagcacagaacggcugcgcaaaugcuuguuccuauuuauuggcugguguauccccuucccuauaauuguggcaugggccaucggcaagcuguacuaugagaaugagcaaugcugguuugggaaggaaccaggagaccucgucgauuacauuuaccagggucccaucauccugguucuucugauuaauuucguguucuuguuuaacauaguacgaauccucaugacuaaacugagagcuaguaccacauccgagaccauucaguauaggaaggccgugaaagcaacguuaguccugcuaccucuccugggcaucacuuacaugcuuuucuuugugaacccaggggaagacgauuugucucagauaauguucauuuauuuuaauagcuuccugcaauccuuucagggauucuuuguuucaguguucuacugcuuuuucaacggcgagguccggagugcugugcguaagcgcuggcauagauggcaggaccaccauagccucaggguacccauggcccgggcgaugucuaucccgacauccccuacccgaaucucauuucacagcauuaaacaaacugccgcaguuuga

SEQ ID NO: 54810 - RNA, 3111 nt, Artificial Sequence
  derived and/or modified sequence opt3 from CRIM1__Homo_sapiens__NP_057525
auguaccugguggccggcgacagagggcucgcuggaugcggucaccuucuggucagcuuguuaggccugcuacuccugcuugcaagguccgggacccgggcccugguuuguuugcccugcgaugagucuaagugugaagaaccucgcaacugcccaggaucaaucgugcagggcguaugugguugcuguuauacaugcgcgagucaacgaaaugaaagcugugggggaacuuucggcauuuacggcacgugcgaccgugggcucagaugugugauaaggccgccccugaacggagauucccugaccgaguaugaagcuggugucugcgaggacgagaauuggacagaugaccagcucuuaggcuuuaaaccuugcaacgaaaaucugaucgccggguguaacauuaucaauggaaagugcgaguguaacacuauucggaccugcucuaauccauucgaauuucccucgcaggauaugugucuuucagcauugaaacgcaucgaggaggaaaagccugacugcagcaaagccagaugugaggugcaguucaguccaaggugccccgaagauuccguucugauagagggcuacgcuccuccaggugaauguugcccgcuacccucucggugugugugcaacccugcagggugccuccgcaaggucugucaaccaggaaaucugaacauccuugugagcaaggccuccggcaaacccggcgagugcugugaccuguaugagugcaagccuguauuugggguugauugucgaacaguggaaugcccacccguccagcagaccgcuuguccgccugacucauacgagacucaggugagauugacagccgauggaugcuguacccuccccacgaggugcgaaugucugagugguuuaugcggcuucccagugugcgaggucgggagcacuccucggauuguuucucguggagacggcacccccgguaaauguugcgacguguuugaauguguaaaugauacaaagccagcgugcguguucaacaaugucgaguauuacgacggggauauguuucgcauggacaacuguagauucuguaggugccaaggcggaguggcaaucugcuuuacugcccaguguggcgagauuaacugcgaacgguacuauguucccgagggggaauguugcccugugugcgaggauccagucuacccguucaauaaccccgcuggauguuaugccaauggucugauccucgcacauggcgaccgauggcgcgaagaugacugcaccuuuugucagugcgugaacggggagagacacuguguagcuacaguuugcggacagaccuguacgaauccugugaaagucccaggcgagugcugucccgugugcgaggagccuacuauaauuacagucgauccacccgccuguggugaacuuuccaacugcacccugacugggaaggacugcaucaauggcuucaagagggaucauaacggaugucggacaugccaauguauuaauaccgaggaguugugcucagaacgcaaacagggcuguacgcuaaacugcccguucggguuucugaccgacgcgcagaauugugagaucugcgaauguagaccuaggccaaagaaaugccgucccaucauuugugacaaguacugcccucucggacugcuuaaaaacaagcacgguugcgauauaugucggugcaaaaagugucccgagcugagcugcaguaagaucuguccauugggcuuccaacaggacucucaugggugccucauuuguaaaugccgagaagccuccgcaagcgcuggaccucccauccugucgggcacauguuuaacuguggauggucaccaccauaagaaugaggagucuuggcacgacgggugcagagaauguuauugccugaacggcagggagaugugugcccuaauaaccugcccaguuccggcuugcggaaauccuacaauucaucccggccaguguugcccauccugugccgaugacuuugugguacagaaacccgaacucucaacuccuaguaucugccacgcaccagggggagaguacuucgucgaaggcgagaccuggaacaucgauagcuguacacaaugcaccugucacuccggucgcgugcugugcgagacugaaguuugucccccucuuuugugccagaacccgucucggacgcaggacagcuguugcccacagugcacagaucaacccuuuagaccuucacugaguaggaauaacuccgugccaaauuauuguaagaacgacgagggggauauuuuccucgccgcugaaagcuggaaacccgacgucugcaccucuuguaucugcauugauucagugauaaguuguuuuagcgaguccugcccuucuguaucgugugaacgcccggugcugcgaaagggacagugcugucccuacugcaucgaggacacuauuccaaagaaaguugucugucauuucagcggcaaggcguacgcagacgaggaacggugggaucuugacuccugcacccacugcuauugucugcagggucagacauugugcucaaccgugaguuguccuccccucccaugcguggagccuaucaaugucgaaggcucuuguugccccauguguccagagauguacguuccggagccuacuaacauccccauugagaaaacaaaucaucguggggaaguggaucuggaagugccauuauggcccacgccuagcgagaacgacauaguacacuugccaagagauaugggacaucuacaagucgacuauagggauaaucgccuccaccccuccgaagacucaagccuggauucuaucgccuccgugguugugccuauuaucauuugccuuaguaucauaaucgcuuuucuguucauuaaccagaagaaacaguggaucccgcugcucuguugguaccggaccccaacuaagcccagcucucugaauaaccaguuagucuccguggacugcaagaaaggcacaagaguucaaguggauucaagucagaggaugcugcgaauugccgagccugacgcacgcuuuagcggguucuauucgaugcagaagcaaaaucaccuucaggccgauaacuuuuaccagaccguauga

SEQ ID NO: 54811 - RNA, 849 nt, Artificial Sequence
  derived and/or modified sequence opt3 from CRIP2__Homo_sapiens__NP_001257766
augcccccucaccaucugcucccauggcuugcccaggugccgagcgcugagggcgaacuggucagauugguuuccagggcagggggacggggugccugcuucuggcccgcggugaccauggagauggcuguagccgcaggcugugugugcaaagggggaggcuguugccaccgcgaaccuucucaagaccaucacgagucacaggaacaucgagguccauuagucgggagucagacaugucuggugcaccaggccgagggaacugcugagaaaguuagcucccuaggcaaggauuggcacaaauuuugccucaagugugaacguugcucuaaaacgcugacccccggcgggcaugcagagcacgacggaaagccuuucugucauaagccaugcuacgccacacuuuuuggucccaaaggcgugaacaucgggggagcuggcucguauauuuacgaaaagccucuggccgaggguccacaagucacugggccgauagaggugcccgcggcaagagccgaagagaggaaggcuucaggaccuccaaagggccccagccgggccaguuccguaaccacauucaccggcgaaccuaauacuuguccacgcugcucuaaaaagguuuauuuugcagagaaggugaccagcuuggggaaagauuggcacagacccugccucaggugugaacggugcggaaagacacugacgccggguggccacgcugagcaugacgggcagccuuacugucacaaacccugcuauggaauccuguucggcccaaagggugucaacacuggggccgugggcuccuacauuuaugaucgcgacccugagggaaaagugcagcccuga

SEQ ID NO: 54812 - RNA, 615 nt, Artificial Sequence
  derived and/or modified sequence opt3 from CRIP3__Homo_sapiens__NP_996805
augagcuggaccugccccagaugucagcaaccuguguucuuugccgagaaggucuccucucugggcaaaaacuggcacagguucugccucaagugugaacggugccauucaauccuuaguccagggggacacgcugagcauaauggucgcccguacugucacaaacccugcuauggcgcacuguuugggccucgaggaguuaacauuggcgguguggggagcuacuuguauaauccacccacaccuuccccaggauguacuacgcccuuaucuccuucgucauucagcccaccgcgucccagaaccggccugccucagggcaagaaaaguccaccccauaugaagacauuuacuggggaaaccucccuaugcccuggauguggugagccaguauacuucgccgaaaaggugaugucucucggcaggaacuggcaccggcccugccugcgcugucagagaugccacaaaacacuuaccgcggggagccaugcugagcacgacggagucccguauugccaugugccuuguuacggcuaucuguuuggucccaaggggguuaauauaggagaugugggcugcuacaucuacgacccagucaaaauuaaguucaaauga

SEQ ID NO: 54813 - RNA, 1341 nt, Artificial Sequence
  derived and/or modified sequence opt3 from CRIPAK__Homo_sapiens__NP_787114
augcacgagcccagccugugcgccaacguggaauguccuccagcucauaccugcccguguggcguccccgcaugcuccugugcccacguugagugcccuccagcgcauacauguagaugcggggugcccgcuuguucucacaugccuauguggucagccaggcuccuuacucgggcacauguagaaugcccacccgcccacacgcgcgugcacgucgaguguccuccagcucaugugccgauguggagugcacaccuguugaccugcgccgacguugaaugccauuuacugacacacgugcccauguggagcgcucgacuacucacuuguccuugcggagucccagccuguucccacgugcccaugcguucugcgagacugcuuaccagggcacaugccgagugcccuccagcucacacaugucccugcgguguaccggccuguucgcauguuccuaugcggucagcacgccuguugaccagagcugauguggagugucccccagcccacacuugcccuugcggcguccccgcguguagccaugugccaacauggagugccaggcucaucacccgggcacacguggaaugcucccccgcucacacgugccgcuguggggucccugccugcucucauguuccaauguggagcgugcgacugcugacuagagcugacgccgaguguccgcccgcacacaccuguaggugcggaguaccugccugcucccaugugccaauguggucagcucggcucuuaacaugucguugcggcguccccgcguguagucacgugccuauguggagcgcacgccugcuuacuugcagaugugguguuccagccugcucucacgugcccaugugguccgcuagguugcugacccgggcccaugucgaaugcccgccugcacacacaugucgacgcggggugccagccugcucaagagcucauauggagugucccccugcccauaccugccacuguggaguacccgcaugcagccacacguguaggugcggcguuccagcguguagucacgugccuauguggucugcucggcuacucacucgcgcccaugucgagugucccccagcacacacaagagcccauguggaaugcccgccugcucauaccugccccugcggcgucccagccuguucccacacuugccccuguggggugccugcaugcagccacaaggcucuggccuggugguucuguagguuuccaguucuucccgcggagucggaugccgugacaguacacucuacccauggagguuuccugauucguuuuuacgucaaagacccuuucuauauauccuugcaccucgaaaucacguga

SEQ ID NO: 54814 - RNA, 306 nt, Artificial Sequence
  derived and/or modified sequence opt3 from CRIPT__Homo_sapiens__NP_054890
auggugugcgagaagugugagaaaaagcugggcaccgucaucacacccgacacuuggaaagauggggccagaaacacgaccgaaagcggagguaggaagcucaaugaaaacaaagcucuuacauccaagaaggcacgguucgacccuuacggcaaaaauaaguuuucuacuugccgcauuuguaaaucaaguguucaccagccagggagccauuauugccaaggaugugccuacaagaaaggcauaugcgcgaugugugguaagaaggugcuggauaccaaaaacuauaagcagacauccguauga

SEQ ID NO: 54815 - RNA, 750 nt, Artificial Sequence
  derived and/or modified sequence opt3 from CRISP1__Homo_sapiens__NP_001122
auggagaucaagcaccuccuguuccuuguggccgcugcaugccuguugcccauguuaagcaugaaaaagaaauccgccagagaccaguuuaacaagcuggucaccgaucuaccuaauguucaagaagagauugugaacauacauaaugcgcucaggcggcgcguagugccaccggcuucuaacaugcugaaaaugucauggagugaagaggccgcacagaaugcccgaaucuucagcaaguacugugacaugacagaauccaacccccuugagcguagacugccuaauacuuuuugcggcgagaacaugcacaugacgucuuauccagucucguggucaagcgugauugggguuugguacagugaauccaccucuuucaagcauggagaguggacaacuaccgaugacgauaucacaaccgaccacuauacucagauugugugggcuacaagcuacuugaucgguugugcaauagccuccugcaggcagcaaggcucaccccgguaucucuacgucugucauuauugccacgaagggaaugauccugagaccaaaaacgagccauacaagacgggagugcccugugaggcuugcccuaguaauugugaagacaaacugugcacuaacccauguaucuacuaugaugaauacuuugacugcgauauucagguacacuaucugggcugcaaucauagcaccacaauccucuucuguaaggccacuugcuuaugugacaccgagauuaaauga

SEQ ID NO: 54816 - RNA, 732 nt, Artificial Sequence
  derived and/or modified sequence opt3 from CRISP2__Homo_sapiens__NP_001135879
auggcccugcuccccgugcuuuuccuggucaccguuuuguuaccuagccugccagcugagggcaaggacccggcauuuacagcccuacucacuacgcagcugcaagugcagagagaaaucguaaacaaacacaaugagcuuagaaaggcggugucucccccugcuuccaacaugcugaaaauggaauggucacgggaggucaccacaaaugcccagcgcugggcaaacaagugcacuuugcagcauagugauccagaagaccgaaaaaccagcacacguuguggggagaaucucuacauguccucugaucccaccucguggucaagcgccauucaaaguugguaugacgagauacuggauuucguguacggaguugguccuaaguccccaaacgcuguggucggccacuauacucagcuggugugguacucuacauaucagguagggugcggaaucgcauacugucccaaucaggacagccucaaguauuacuacguuugccaauauuguccugccggcaacaauaugaacaggaaaaauaccccauaccagcaggguacgccgugcgcugggugucccgaugacugcgauaagggauuauguacuaacuccugccaguaucaagaccugcuuucaaauugugauaguuugaaaaacaccgccggcugcgaacaugagcugcuaaaggaaaaaugcaaggcgacaugucucugcgagaauaagauuuacuga

SEQ ID NO: 54817 - RNA, 807 nt, Artificial Sequence
  derived and/or modified sequence opt3 from CRISP3__Homo_sapiens__NP_001177915
augaagcagauccugcaccccgcccucgagaccacagacccuugcagcacuggcuucguguuuccagcuaugacgcuuuucccgguccuguuguuuuuaguugcagggcugcuacccuccuucccugccaacgaagauaaagacccagcguuuaccgcucuccugacaacucaaacccaggugcagagagagauuguaaauaagcauaacgaacuuaggcgggccgugucucccccugcacgcaauaugcugaaaauggaguggaacaaggaagccgcugcaaaugcccagaaaugggcuaaccaauguaauuaccgacacucaaacccaaaggaucguaugacaaguuugaagugcggagagaaucucuauaugagcuccgccucuucgucauggagccaggcgauacagaguugguucgacgaguacaacgauuuugacuucggugucggccccaaaaccccuaaugcagugguugggcauuauacucagguggucugguacuccucuuaucuggugggauguggcaacgccuacugcccaaaucaaaagguacugaaauauuacuacguuugucaguauugcccggcugguaacugggccaauagacucuacgugcccuaugaacagggggcaccuugugcuagcugcccagauaacugugacgauggauuaugcacaaacggcuguaaguacgaggaccuguauuccaauugcaaaucacuuaaguugacccugacgugcaagcaccagcuagucagggauaguuguaaagccagcugcaacuguucuaauuccaucuacuga

SEQ ID NO: 54818 - RNA, 939 nt, Artificial Sequence
  derived and/or modified sequence opt3 from CRISPLD1__Homo_sapiens__NP_001273707
augaacauuuggggccagauuuggcccaaggccguguaccuggucugcaauuauagcccuaaagggaacugguggggacacgcuccauacaagcaugguagaccguguuccgcaugucccccuucuuucggcgggggaugcagggagaaucucugcuauaaagaaggcucagaccgguacuauccaccccgcgaggaagagaccaacgaaauagagcgacaacagagucagguucacgauacacaugugcguacuagaagcgacgauuccucuaggaaugagguaaucucggcccagcaaaugucacagauugugagcugugaaguccggcuucgcgaccagugcaaggguacgaccuguaacagauacgagugcccugcggggugucuggauaguaaagcuaaggugaucggauccguucacuaugaaaugcagucuagcauuugcagggccgcaauccauuacggcauaaucgacaaugauggcggguggguggacauuacacggcaaggacgcaagcacuacuuuaucaaauccaaccgaaaugguauucagacuaucggcaaguaucagucagccaacaguuucaccgucagcaaagugacaguacaggcuguuaccugugagacuacaguggagcaauugugcccauuucacaagcccgcaucucauugcccuagagucuacuguccaaggaauugcaugcaggccaacccgcacuaugcucgggugauagggacccguguguacuccgauuuaucaagcauuugucgcgccgcgguccaugcaggaguugugagaaaucacggcgguuauguagacgugaugcccgucgauaaaaggaagacguacaucgccaguuuccagaacgggaucuuuucugaaucccugcaaaauccuccaggaggcaaggcuuuccggguguuugccguuguguga

SEQ ID NO: 54819 - RNA, 1494 nt, Artificial Sequence
  derived and/or modified sequence opt3 from CRISPLD2__Homo_sapiens__NP_113664
augagcugcgugcugggcggggucaucccccucggacuucuguucuugguuugugguucccagggcuacuuacugccuaacgugacccuacucgaggaacugcuuucuaaguaucaacacaaugagucacauaguagaguaaggcgggccauuccacgcgaagacaaagaggaaauacugauguugcacaacaagcuccgaggacaggugcagccgcaggcuagcaauauggaguacaugacaugggaugacgagcuggaaaaauccgcagccgcgugggcuucucaaugcaucugggagcauggacccacuucgcugcucgucucaauuggccagaacuuaggugcccacugggggcguuauagaagcccuggauuucaugugcagaguugguacgaugaaguuaaggacuauacguacccauaucccuccgaguguaauccuuggugcccagagagguguucuggccccaugugcacccacuacacacagaucgugugggcaacuaccaacaaaauuggcugugccgucaauacaugccggaagaugaccguguggggagaaguaugggagaacgcuguuuacuucguguguaauuauagcccuaaggggaacuggaucggugaagcaccauacaaaaauggccgcccgugcuccgagugucccccuucauaugggggaaguugcagaaacaaucugugcuacagggaagagacuuauacaccaaagcccgagaccgaugaaaugaacgaggucgaaacggccccuauaccagaggaaaaucacguguggcuucaaccccgggugaugcgcccgacuaaaccuaagaaaaccagcgcugucaacuacaugacacagguugugcgaugugacacuaagaugaaggauagaugcaaaggcucuaccuguaacagguaucagugccccgccgguuguuugaaucauaaggcgaaaaucuuugggacacuguucuacgaguccucaagcaguauuugccgggcagccauccacuacgggauucuagacgauaagggcggccucguagacaucacccguaacgggaaagugccauuuuucgucaagucugagcgccauggagugcagucccugagcaaauauaagccuucgucuuccuuuaugguuucaaaggugaaaguccaagaucuugacuguuacacgacuguggcucagcugugccccuucgaaaagccagccacacacugucccagaauacacugcccugcacauuguaaagaugagccaaguuauugggcuccgguauuugguaccaauauuuacgccgacacuagcuccaucugcaagacagcgguucacgccggcgugauuucuaacgaaagcgggggagacgucgaugugaugcccgucgacaaaaagaagaccuaugugggcucauugaggaaugguguucagagugagucccucgggacgccucgggauggcaaagcauuccgaaucuuugcugugcgccaauga

SEQ ID NO: 54820 - RNA, 615 nt, Artificial Sequence
  derived and/or modified sequence opt3 from CRK__Homo_sapiens__NP_005197
auggccggcaacuucgacagcgaggaaagauccucuugguacugggggaggcugucacggcaggaggcuguggcacuccuucaaggacagcgccacggugucuuucugguucgagauaguagcaccucccccggcgacuauguguugucuguaucggaaaauucacgugugagccauuacaucauuaacaguuccgggccuagaccaccggugcccccuucuccagcccagcccccuccaggagucagccccuccagguuacggauaggcgaucaggaguucgacucacugccugcgcuacucgaauuuuauaagauccacuaccuggauacaacuacgcuuauugagccaguuagucgcagcagacaagguucuggggugauccugaggcaggaggaagcugaguauguccgggccuuguucgacuuuaauggaaacgaugaagaggaccucccguucaaaaagggcgauauucugcgcauccgagacaaacccgaggaacagugguggaaugcagaggauuccgaaggcaagagagggaugauaccugugccauacguagagaaauauaggcccgccucagcuagcguuagugcacugaucggaggucgguga

SEQ ID NO: 54821 - RNA, 912 nt, Artificial Sequence
  derived and/or modified sequence opt3 from CRKL__Homo_sapiens__NP_005198
augagcuccgccagauucgacucuucagauaggagugcuugguacaugggccccgugagccggcaggaggcacaaacccgccugcaggggcagcgacacggaauguuucucguccgugacuccucuacaugcccuggugauuauguucuuucggugucagaaaacagcagaguaagucauuacaucauuaauucccugccaaacaggcgguucaagauaggcgaccaggaguuugaucacuugccggccuuacuggaguucuauaaaauccauuaccuagacacuacgacccucauugagcccgcgccucgcuauccaucucccccuauggggagcguguccgcuccaaaucugcccacagccgaagauaaccuugaguacgucagaacucuguaugacuuuccuggaaaugaugcagaggacuugccauucaagaaaggcgaaauccucgugauuaucgagaagccggaagaacaaugguggucagccaggaacaaagauggucggguugggaugauacccgugccuuacgucgagaagcuggugcgcaguagcccacacggaaagcauggcaaucgaaacucuaauuccuacggcauccccgaaccugcucacgcauaugcccagccacagaccacaaccccgcugcccgcuguaucagggagcccuggagccgcgauuacuccccucccaaguacacagaacgguccuguuuuugcaaaagccauccaaaagagagugcccugugcuuacgacaaaaccgccuuagcacuggaggucggcgauauugugaaggugacgaggaugaauaucaacgggcagugggaaggagaggucaauggccggaaaggucuuuucccauuuacucacguuaagauauucgacccccagaacccugacgaaaaugaguga

SEQ ID NO: 54822 - RNA, 1269 nt, Artificial Sequence
  derived and/or modified sequence opt3 from CRLF1__Homo_sapiens__NP_004741
augcccgccggcagaagggggccugcugcacagagcgcccggcgcccaccgccccugcucccucuucuguuguuacugugcgugcuaggagcgccacgagcugguuccggcgcccacaccgcagucaucucuccccaagacccuacacuccugauugggucaagucuucuggccacuuguagcguucauggagauccacccggcgcuacggcagaggguuuguacuggacccucaacgggcguagacugccuccagaacuguccagggugcucaaugccucuacauuagcucuggcccuugcgaacuugaauggaucgcggcagcgcucaggcgacaaccugguaugccacgcaagagauggcagcauacuagccgggaguugucucuaugugggacugccgcccgagaagccugucaauaucuccugcuggucuaaaaacaugaaggaccuuacuuguagguggaccccaggugcucauggcgaaacauuccugcacaccaauuacagcuugaaauauaagcuccggugguacgggcaggauaacacuugcgaggaauaucauacagugggaccccacuccugucacauuccuaaagaccuggccuuauuuaccccauacgagaucuggguugaggcaacgaaucgccugggcucagcucgaagugaugugcucacucuugacauucuggaugucgugaccacagaucccccgccugacguacauguuagcagaguggguggguuggaagaccagcuaucugucaggugggugagucccccagcccugaaggauuuccucuuucaagcgaaguaucagauccgguaccguguggaggacucagucgacuggaaaguuguggaugacguaagcaaccagacuuccugccgccuggccggacuuaagccuggcaccguguacuucguccaggugagauguaaucccuuuggcauauaugggucuaaaaaggcaggaaucugguccgaauggagccacccaacagcugccucgacccccaggucugagcggccugguccaggcgggggagcuugcgagccgcgaggcggugaacccuccucagggccuguucgcagagagcugaaacaauucuugggcuggcucaagaagcaugccuacuguaguaaccugagcuuuagguuauaugaucaguggcgggcauggaugcagaaaucccacaagacgcgcaaucaggacgaaggcauucugccaucuggaagaagggggacugcccguggacccgcucgguga

SEQ ID NO: 54823 - RNA, 1116 nt, Artificial Sequence
  derived and/or modified sequence opt3 from CRLF2__Homo_sapiens__NP_071431
augggcagacuggugcuccuuuggggagccgcugucuuccuguuaggggguuggauggcauugggccaagggggagccgcggaaggcguucagauccagauuauauacuuuaaccuggaaaccgugcagguaacauggaaugcuagcaaguauuccaggacuaaccuaacguuccacuaccgguuuaauggugacgaggccuaugaucagugcaccaacuaccuccugcaagaagggcauacaucuggaugucuucuggacgcagagcagcgcgaugacaucuuguauuucucaauucgaaauggcacucaccccguguuuaccgccagucguuggauggucuacuaucucaaaccuagcuccccaaagcaugugagauucucuuggcaccaggaugcuguuacagugaccugcucggaccugucauacggcgaucugcucuacgaaguccaguauaggagcccguuugacacugaguggcaaaguaaacaggagaacacauguaaugugaccaucgaaggguuagaugcagagaagugcuacuccuucuggguacggguuaaagccauggaagacguguauggacccgauacguacccuucugacuggagcgaggucacuuguuggcagcgcggugagauuagagaugcuugcgccgaaaccccaacacccccuaagccaaagcuguccaaauuuauccuuauaucaaguuuggcgauccugcuaauggugagccuccugcuucugucuuuguggaagcucuggagggugaaaaaguuccugauucccuccgucccugacccaaaaucaaucuuuccgggcuuauucgagauucaucaggggaacuuucaagaauggaucacugacacccagaauguugcacaucugcacaagauggccggagcugagcaggaaagcggccccgaggagccucucgugguacaacuugccaagacagaagcagagaguccacggaugcuggauccccagaccgaagagaaagaggcuucugguggguccuugcagcuaccucaccagccacugcaaggaggcgacguggucacgauaggcggguucacuuucgugaugaacgaucgcagcuauguugcccucuga

SEQ ID NO: 54824 - RNA, 1329 nt, Artificial Sequence
  derived and/or modified sequence opt3 from CRLF3__Homo_sapiens__NP_057070
augagaggcgccauggagcuggaacccgagcuccuucugcaggaagcuagggagaacguugaagcagcccaaagcuaccggcgcgaguuggggcaccgauuagagggacugcgugaagcgagaaggcagaucaaggaguccgcuucucagacccgggacguccuaaaacagcauuucaaugaucucaaggguacacugggcaaacuucuggacgaacgcuugguuacucuccugcaagagguggauacgauugagcaggaaaccauaaagccucuggacgauugccagaaacucaucgagcacgggguaaacacagccgaagacuuagugagagagggagaaauugcaaugcugggcggugucggggaggagaaugaaaaacuuuggucauuuacuaagaaggccagucauauccaguuggauagccugccagaggugccgcuacucguugacgugcccugucuguccgcucaacuugaugacucuauucugaacaucgucaaggaucacauauucaaacauggaaccguggcaucgaggccuccaguacagaucgaagaguugauugaaaagcccggcggcaucauuguucgguggugcaaaguggacgaugacuuuacagcccaggacuaucgccuccaguuccgaaaguguaccucaaaucacuuugaggaugucuacguggggagcgagacugaauuuaucgugcugcacauagacccuaacgucgauuaucaauuuagaguuugcgcuaggggagacggucggcaggaguggaguccaugguccgugccccagauuggccauucuacauuaguaccucacgaauggaccgccggguucgagggauacagccuguccucacgucgcaauaucgcgcucagaaacgauagugaaagcucuggcgugcuuuauuccagggcaccaacguacuuuuguggucaaacucugaccuuccgggucgagacaguggggcagccggaccgacgcgauucaauuggaguuugcgccgagaagcaggacggcuaugauagcuugcagagagaccaagcuguguguaucaguacuaauggcgccgucuuugugaacgggaaagaaaugaccaaucagcuacccgcaguaacaucuggauccaccguuacguucgauaucgaggcugugacucuggguacaaccagcaacaaugaaggcgggcauuuuaagcucagggucacuauuucgucuaacaaucgggagguggucuucgacuggcugcuugaccaguccugcggaucacuguacuucggcuguaguuucuucuacccugguuggaaaguguugguguuuuga

SEQ ID NO: 54825 - RNA, 609 nt, Artificial Sequence
  derived and/or modified sequence opt3 from CRLS1__Homo_sapiens__NP_001120930
augccccaguacgagaacccuuggaccaucccaaauaugcugagcaugacaagaauuggccucgccccggugcuuggguaucugauaaucgaagaggacuucaacauugcuuugggagucuuugcauuagccggucugacugaucuacucgacggcuucaucgcgaggaauugggcuaaccaacgguccgcccuggggucugcacuugauccccuggccgacaagauuuugaucucaauacucuacguuagucugacguaugcugaucugaucccugugccacucaccuacaugauuaucagccgcgacguaauguuaauugcagccguguuuuauguccgauaccguacacugcccacuccuagaacccuugcuaaauauuucaauccaugcuacgccacagcgagguugaagcccaccuuuaucuccaaagugaacacugcaguucagcugauucuaguggccgcuucucucgccgcaccugucuucaauuacgcugauucgauauaucugcagauccuuugguguuuuacagccuucaccacggcggccucagcauacagcuauuaccacuauggacggaagacugugcagguaauuaaagacuga

SEQ ID NO: 54826 - RNA, 2061 nt, Artificial Sequence
  derived and/or modified sequence opt3 from CRMP1__Homo_sapiens__NP_001014809
auggccgacagaaggcgggcuuggaacaccgaggaugaccugcccguguaccucgcacgcccuggcagcgccgcgcagacaccacgacaaaaguaugggggaauguucgcugccgucgaaggugcauacgagaauaaaacuaucgauuuugacgccuauuccguuggccguagagggucugcuaggacgccgcggucagcaggacgccccgaugccgugggccuuccugguccagggggaagugaagacaccgcuagcgauguauccgagcccucuggcucggccgugucaagcccuggcgaaagagacgagaggccacccacacugcggauucgccgaccugcgccaagagauuugccguuagggagggacaacggacagagugaucggcugcuaauaaaggguggccguaucauuaaugacgaucagucccucuacgcagacgucuaucuggaggacgggcuuaucaaacagauuggagaaaaccugaucgugcccggcgguguuaagacuauagaggccaaugggcgcauggugaucccuggaggcauugaugucaacaccuacuugcaaaaaccaucucagggcaugacagcugccgacgauuucuuucaggggaccagagcagcucucgugggagguacuacaaugaucauugaccacguaguucccgaaccuggcagcucccugcugaccucauucgagaaguggcaugaggccgcggauacgaagaguugcugugacuauagccuccacguggauaucacuucuugguacgacggggucagggaagaguuagaagugcuggugcaggauaaaggagucaauuccuuucaaguuuacauggccuauaaggacguguaccagaugucagauagccagcuuuaugaggcauucaccuuuuugaaaggccugggugcuguaauacuggugcaugccgaaaacggggaccucauugcucaggagcaaaagcggauccuggagaugggcauuacaggaccagaaggccacgcccuuagucgacccgaggaacuggaggcagaagccgucuuccgcgcuaucacuaucgcggggagaauuaauugcccgguguacauaaccaaaguuaugucuaaguccgcagccgacaucauugcuuuggccaggaagaaaggaccucucguguuuggugagcccaucgcagccagccugggcacagaugggacccauuauuggucgaagaacugggcuaaagccgcagcguucgucacgucuccaccuuuaucccccgacccaacuacacccgauuaccugaccucacuccuugcuuguggagaccuacaggugacuggcaguggucacugcccuuauagcacagcccagaaggcaguagggaaagauaauuuuaccuugauaccagagggcguuaacggaauugaggaacggaugacgguggucugggacaaggccguggcuaccggcaaaauggaugaaaaucaauucgucgccgugacauccacuaacgcagcuaagaucuuuaaucuauacccgcgcaaggggagaaucgccguuggaucugacgcggaugugguaauuugggaccccgauaaacugaagaccaucacagccaaaagccacaagucagcugucgaguacaacauuuucgaagguauggagugucauggcaguccucucgugguuauaucccaggggaaaaucguguucgaggacggaaacauuaaugucaacaagggcauggguagguuuaucccacguaaggcauuccccgaacaccuguaucagcgggugaaaauccgaaauaagguauuugggcuucagggcgugagcagaggaauguacgauggcccuguuuaugaggucccagccacucccaaauacgcuaccccggccccuucugcaaagucaaguccaagcaaacaucaacccccucccauuaggaaccugcaccaguccaauuucucuuugucgggggcgcagauagacgacaacaauccacgccggacaggacacagaaucguggccccucccggcgguaggagcaacauuaccucccucggguga

SEQ ID NO: 54827 - RNA, 2511 nt, Artificial Sequence
  derived and/or modified sequence opt3 from CRNKL1__Homo_sapiens__NP_001265554
augaccgccacaguggagaaccugacuuuccagaaggacacgcucggcaaugcugucgauaaaaacagaaggcacgggagcaccgaaccccuuguucuggcaugguccucucaauuucggcgcuugacauggggaugcgccuuagacgcgcugcaucgaucaccuuguguggcugccagucagcacgguguaacucaucuaauccguagcuccagaaccccacacucuacaaggugccggaaggaggaugcacagccgggccaucacgggaauggagccgcuucggugaccgcacaggcccgcggccaaagaucaguccuccaggugccccugccuguuccaaggagcugucuuuucagugaauccuuuguggucucugugagcucccagucacgguuccuggcuaguguacccgguacugggguucagcgcagcacagccgcggacauggcagccucuaccgcugccggaaaacaacgaauaccuaagguggcaaaagucaagaacaaggcuccagccgaggugcagauuacggcggaacaguugcucagagaggccaaagagagggaacuggagcuguuacccccuccaccgcagcaaaagaucacugaugaagaggagcucaaugacuacaaacugcggaagcguaaaaccuuugaagauaacauucgcaagaauagaacagugaucuccaacuggauuaaguaugcacagugggaggaaucacuuaaagagauccagagggcucggagcauauacgaacgagccuuggacgucgauuaucgcaauaucacucuguggcuaaaguacgcugagauggagaugaaaaacagacaaguuaaucacgccaggaacauuugggaccgggcaaucaccacacucccccgcgugaaucaguucugguauaaguacaccuauauggaagagaugcugggcaacguagccggcgcuagacagguguuugaaagguggauggaguggcagccugaagaacaagcguggcauaguuacauuaauuucgagcuucguuacaaagaagucgaucgggcacgaacgaucuaugagagauuugugcugguucacccagacgugaagaacuggauaaaauacgccagguucgaagagaagcaugcuuauuuugcccacgcacgcaaggucuacgaacgggccguggaguucuuuggggaugagcacauggacgaacauuuguauguagcuuucgccaaauucgaggaaaaccagaaggaguuugagagaguuagggugauuuacaaauaugcacucgaccgcaucucuaagcaggaugcgcaggaacuguucaaaaauuacacuauuuuugagaagaaguucggagaccgacgggguaucgaagauaucauugucuccaaacguagauuucaauacgaggaagaggugaaggcuaacccccacaauuaugacgccugguucgauuacuuaaggcuggucgagagcgacgcagaagccgaggcugugcgcgaaguuuaugagcgggccauagcaaacgugccuccaauccaggagaaaagacauuggaagagguacauuuaucucuggaucaauuacgcucuuuaugaggagcuggaagccaaagaucccgagcgaacacgccagguauaccaggcgucguuggaacuaauaccgcacaagaaguuuaccuucgccaaaauguggauucuguacgcucaauuugagauccggcagaagaaccucucucuggcaagaagggcccuuggcacuuccaucgggaaaugcccuaagaauaaacuguucaaggucuauauugaauuggagcuccagcugcgugaguuugaccgcugucggaaguuauacgaaaaauuccuggaguuuggacccgaaaacugcacaucauggaucaaguucgcugagcuagagaccauucucggcgauauagacagagccagggcaaucuaugaacuggcgauuagucagccacgacuugauaugccugagguguuguggaaaagcuacaucgacuucgaaaucgagcaagaagagacggagcggacccgcaaucuguauagaaggcuccugcagcggacacagcauguuaagguguggauuuccuuugcccaauucgaacuuucuagcgguaaagaggggucacugacuaagugucgacagauauacgaagaggcuaacaaaaccaugagaaauugcgaagagaaggaggaacgcuugaugcuccuggagaguuggagguccuuugaagaggaguucggaacagccagcgacaaggaacgugucgauaaauuaaugcccgagaaggugaaaaagcggagaaaaguacagacugacgauggcucugacgcaggcugggaagaguauuuugauuacaucuucccagaagacgcugccaaccagcccaaucugaagcuacucgcaauggccaagcuguggaaaaagcaacagcaggagaaagaggaugcugaacaccacccugacgaggauguggacgaaucagagaguuga

SEQ ID NO: 54828 - RNA, 1488 nt, Artificial Sequence
  derived and/or modified sequence opt3 from CRNN__Homo_sapiens__NP_057274
augccccagcugcuccaaaacaucaauggcauuauagaggccuucagaagguacgcucggaccgaagggaacugcacagcacuuacucgcggagagcugaagcgauuguuagaacaggaguuugccgacgugaucgucaaaccucacgauccagcgacgguugacgaagugcugcgucuacucgaugaggaccauaccgguacaguagaguucaaggaauuucuggugcuugucuucaaaguggcucaggccuguuuuaagacucugagcgaguccgcagaaggcgccugcgggucucaggagucaggaaguuugcacagcggcgcuucccaagagcucggugaagggcagagaucuggaaccgagguuggcagggcaggcaaagggcagcauuaugaaggaucgucacaccggcagagccaacaggguagucgcggccagaauagaccgggggugcagacacaaggacaggccaccggcuccgcuugggucucuagcuacgauaggcaggccgagucccaaucacaggaacggauuaguccccagauccagcugagcggucaaacugagcagacacagaaggcgggggagggaaagcgcaaccagaccacggaaaugcgaccugagagacaaccacagacuagggaacaggaccgggcacaucagaccggcgagacagugacuggcucugggacccaaacacaggccggagcuacccagacgguagaacaggauuccucacaccaaacuggucguacaagcaaacagacccaggaggccacuaaugaccaaaaccgcggcacagagacccacgggcagggaagaagucagacgucucaggcaguuaccggcggucaugcucaaauucaggccgggacacacacucagacccccacacagacuguggaacaagauuccagccaucagaccggcucgacaucuacccagacucaggaguccacgaauggacaaaacaggggcacagaaauccacgggcagggacggucacagaccagucaagcggucacugguggccacacccagauacaggccgggagccauacagagaccguggaacaggaccgaucccaaacugugucucacggaggcgcacgcgagcagggucagacacagacgcaaccugggagcggccagagauggaugcaggucucaaauccagaggcuggagaaaccguucccggcgggcaggcccaaacuggagcuaguacagaguccgguaggcaggaauggagcucuacccauccucggcgcugugugacagagggccagggggauagacagccaacuguagugggagaggaaugggucgacgaucacucaagggagaccgugauccugcgucucgaccaaggcaacuuacauacgaguguuagcuccgcccagggucaggacgcagcccaaucugaagagaagcgggggauuaccgcucgagaacuguauucguaccuuagaagcacaaaaccguga

SEQ ID NO: 54829 - RNA, 5316 nt, Artificial Sequence
  derived and/or modified sequence opt3 from CROCC__Homo_sapiens__XP_011540774
augaccagcugggacccccagaacccugccggccugugggggagaacacucggaauggagccaaggacucuugaauccucugugcugugccaagagaaggguuugggcgcucgggauuuagcacaggacgcccagaucacgucacugccggcgcuaauucgcgaaauagucacccgaaaucucagucagcccgagagcccuguucugcuuccagcuacagaaauggccucccuguugucucuccaagaggagaaccagcugcugcagcaggaacucucgcguguggaggauuuacuggcacaaucaagagccgaaagggacgagcuugcuaucaaauacaaugcaguaagcgagcgguuggaacaggcccugcgccuagagcccggggaacucgagacucaggaaccuagaggacuggugaggcagagugucgagcuucggcgccaacugcaggaggaacaggcuuccuaucgaagaaaguugcaagccuaccaggagggccagcagaggcaagcgcagcucgugcagcggcugcaggguaaaauuuuacaauauaagaaacguuguucugaacuggagcagcagcuccuugaacgcagcggggagcuggagcagcaaagauugagggauaccgaacacucccaggaccuagagucagcacugauccggcucgaagaggaacagcagcgaagugccagccuggcucaaguuaacgccaugcuucgcgagcagcuggaucaggcaggaucugcuaaucaagccuuguccgaggacauuagaaaggugacaaacgauuggaccaggugccggaaggaacucgagcaucgcgaagcggccuggagaagggaggaggaaucauucaaugcauacuuuagcaacgagcacagucgucuguuacugcuauggcggcaggucgugggcuuccgaagacucguaucugaaguuaaaauguuuacugagagggaccugcuucaguugggcggggaacuggcucgcacaucccgggccgugcaggaggcuggacucggucugagcaccggccuuagacuggccgagucgagggcagaagccgcuuuggagaagcaagcgcuccugcaggcacaguuagaagagcagcugcgcgauaaaguccuacgagaaaaggaccucgcccaacagcagaugcagucugaucuggacaaagcugaccuuuccgcccgggugacggaguuggggcuggcagugaagcgucucgagaagcaaaaucuggaaaaagaucaggucaacaaggacuuaacugagaaacuggaagcccuugagucauugagacuccaggaacaagcugcccuggagaccgaggauggagaaggccuacagcagacacugagggaccucgcacaggcgguucugagugauagcgaguccggugugcaacuuucugggagcgaacgcacugcugacgccucaaauggaaguuugcggggccuguccggccagagaaccccaagccccccuaggcgaucuucaccagggcgcggacggaguccgagaaggggucccagcccugcauguuccgauucuucgacauuagcccucauccauagcgcucugcacaagcgucagcuucagguacaagacaugcgcggccgguaugaggccucccaggaucuguuggggacccucagaaaacagcugucagacagugagucugaaaggcgagcacuagaggaacagcugcaacggcuccgcgauaagacggacggagcuaugcaggcccaugaggacgcgcagagagaagugcagaggcugcggagcgccaacgagcuuuugucccgagagaaaucaaaucuggcucacagcuuacaagucgcacagcagcaagccgaagagcucagacaggaacgcgagaagcugcaggcugcccaggaagagcuuaggcgucaacgggauagacuggaggaagagcaggaagacgcagugcaggauggcgcgaggguucgccgagagcuagaaagaucucaccggcagcucgagcaacuggaggguaagagguccguguuggccaaagaacuggucgaggugcgcgaagcuuuaagucgugccacucuccagagagacaugcugcaggcagagaaggcugagguagccgaagcacuuacaaaagccgaggcugggcggguugaacuggaguugagcaugaccaagcucagggcggaagaggccucucugcaggauucccuaucaaaacugagugcacuuaacgagagccucgcucaagacaagcuggauuugaaucgccugguggcccaguuagaagaggaaaagucggcccuccagggccgacaaagacaggcugagcaggaagcaacugucgcccgggaggagcaggaaaggcuggaggaacuucgccuggagcaagaaguggcgagacagggauuggagggcucccucagggucgcugagcaggcccaggaagcacuggagcaacagcuaccaacacugcggcaugaacguucucagcuucaggagcaacucgcccagcugagccgccaguugucagggcgagagcaggaauuagagcaagcuagaagggaagcacagcggcagguggaggcccuggaacgcgcggcuagagagaaagaggcccucgcaaaggaacacgccggacuggcuguucaacuuguggccgcagagagggaaggucggacccugagugaggaagcuacgcgauugagacuagagaaagaggcccuggaaggcucccucuucgagguacagcgccagcuggcgcagcuugaagccaggcgggagcaauuagaagcagaggggcaggcucugcucuuggccaaggagacccugacaggagaacucgcuggccugcgucagcagauaaucgcaacucaagagaaagccucucuugacaaggaacugauggcccagaaguugguccaggcugagagagaggcgcaggcaagccuaagggaacaacgcgccgcucaugaggaagaucugcagcggcuccagcgagagaaagaagccgcauggagagaguuagaggccgaaagggcucaacugcagucccagcuucagcgcgagcaagaagagcugcucgcgcgguuggaagccgagaaggaggaacugucagaggaaauugcagcucuccagcaggagagagacgaaggucugcuucuagccgagagcgagaaacagcaagcacugaguuugaaggaaucugagaaaaccgccuuauccgaaaagcugauggggacacgucacagccucgcuacuaucucgcuggagauggagaggcagaagcgggaugcccagucacgccaggaacaagaccgaucuaccgugaacgcgcuuacaagugagcugagagaucucagggcacagcgggaagaggccgcugccgcucacgcacaggaaguucgcagauugcaagagcaggccagggaccugggcaaacagcgagacuccugccuacgggaggcugaagagcugcguacccagcucagacuucuggaagaugcccgcgacggauuaaggcgggaguugcuggaagcacaaagaaagcuccgcgagagccaggagggcagggaagugcagcgacaggaggcgggggaacugcggagaucucuuggagagggugccaaagaaagggaggcucugcgccguagcaacgaggaacuccgguccgccgucaagaaagcagagucagaaagaauuaguuugaagcuggcuaaugaggauaaagagcaaaaguuagcccuacuggaagaggcaaggacugccgugggcaaggaagcuggggagcuccgcacgggacuucaggaaguagagcgaagccggcuggaggcgagaagggaauugcaggagcugcgcagacagaugaaaaugcucgacucugaaaacacacggcugggcagggagcuugccgaacuccaaggucgucuggcauugggggagcgagcugagaaggaaucccgcagagagacccugggcuuacggcagaggcuacugaaaggagaagccucacucgaggugaugcgccaggaacuucagguugcccaaagaaagcugcaggagcaggagggcgaauuucggacuagggagcgacguuugcuggggagucucgaagaggcaagaggaaccgagaaacaacagcuggaucaugcucgcggccuugaauuaaagcuggaggccgcgcgggcugaagccgcagagcucgguuugaggcugagcgccgcugaagggagagcacagggacuagaggccgagcuggcgcgcgucgaagugcagcggagggcugccgaggcacaacucggcggucuucgauccgcccugagacggggcuuggggcugggaagggcucccucuccugccccacgccccgugccgggcucgccugcacgugacgcucccgccgaagggagcggagagggccucaauucaccauccacacuggaauguaguccugguucucagcccccaagccccgggccugcgaccuccccagccucaccggauuuagaccccgaggcagucagaggagcucuucgagaguuccugcaggaacucaggucugcccagcgggagcgcgaugaacuaagaacucaaacaagcgcacugaacaggcaguuggcugagauggaagccgagcgggacagugccacgucccgcgcgagacagcugcagaaggcuguugcagagagcgaagaggcccgaaggucuguggauggccggcucucaggugugcaagcugaacuugcccugcaggaggaguccguacgucgcagugaaagagagaggcgggcaaccuuggaccaggucgccacucuggaaagaagccuccaagcuacagagucggaauuacgcgcgucucaggagaaaaucuccaagaugaaagccaaugagaccaagcuggaaggcgauaaacgaaggcuuaaggaggugcuggacgcaagcgaaucacggacaguuaagcuagagcuccagagacguagucuggaaggggaguugcagcgcucuaggcugggacucuccgaccgggaggcucaagcccaggcacuucaggauagaguggacagccugcagcgacaagucgccgauucagaagugaaagcuggcacuuuacagcugaccguugagagguugaacggggcccucgcgaagguggaagagagugaaggagcacugcgcgacaaaguacggggccuaacggaggcccuugcucagagcuccgccucucugaauagcaccagagauaagaaccuccaccugcagaaagcauugacagcuugcgagcaugacaggcaaguccugcaggugcgcuga

SEQ ID NO: 54830 - RNA, 1923 nt, Artificial Sequence
  derived and/or modified sequence opt3 from CROT__Homo_sapiens__NP_001137407
auggagaaccagcuggccaagagcaccgaagagagaacauuccaauaccaggacucccuccccucucuuccugugccaucacuggaagagaguuugaaaaaguauuuagaaagcgucacuaggacgugcuaccagauccggggccuggauccggacgcuaaacgcggguuucuagaucucacccgagaggguauucagguuaagcccuucgcaaaucaagaggaauauaaaaagacagaggaaauagugcagaaguuucaguccggaaucggcgagaaacugcaccagaaacuucuggagcgugccaaagggaagagaaacugguuggaagagugguggcucaauguagcguaccuggacgugaggauuccuucucaacugaacgucaauuucgcuggaccagccgcacauuuugaacacuauuggcccccuaaagagggcacucagcucgaacgggguucgaucaccuuauggcauaaccugaauuacuggcagcuuuugcgcaaggagaaggugccaguucacaaaguggggaacacaccccuggauaugaaucaguucagaaugcuauuuucaaccuguaaggucccuggaauuacuagggacagcaucaugaacuauuuccggacagagagugaaggccgcuccccaaaucauauagugguacucugccgaggcagagccuuuguuuucgaugugauccacgaggggugucuggucaccccgcccgaacuucugaggcaauugacguacauucacaaaaagugccauucugagccugacggaccagguaucgcugcacucacuagcgaggaacggacccguugggccaaagcucgcgaguaccugauuggcuuagaucccgaaaaccuggcccuccuugagaagauccaguccucacuguugguguauaguauggaagacagcucuccucacgugacaccagaggauuacuccgaaauaauugcggcaauccuaauuggggaccccacugucagauggggagauaaaucauauaaucugaucagcuuuaguaacggcguuuucgguuguaauugcgaccaugccccguuugacgcuaugaucauggugaacauuucuuacuauguagaugagaagauauuccagaacgaggggagguggaagggauccgaaaaagugcgggacaucccucuccccgaggaacugauuuucaucgucgaugagaaggugcuuaaugacauaaaccaagccaaagcacaguaccugcgagaggcuagcgauuugcagauugccgcguaugccuuuaccucguucggcaagaaacucacaaagaauaagaugcugcacccagacaccuuuauccaguuagcacugcaacuagcuuacuaccgccuccacggccauccuggguguugcuaugaaacggccaugacuagacacuucuaccauggaaggacagagaccaugcggucuuguacuguugaagcugugcgcuggugccaguccaugcaggaucccucagucaaccugagagagaggcagcaaaagaugcuucaggccuuugcaaagcacaauaaaaugaugaaggacuguagugccgguaaaggcuucgaucgucauuugcuggggcuccugcuuaucgcuaaggaagagggacugccagugcccgaguuguuuacagacccucucuucagcaaguccggcggugggggcaacuuuguacugucuaccagcuuaguuggauaucugcgggugcagggcgucguggucccaauggugcacaauggguacggauucuuuuaucacauucgagaugacagauucguuguggcgugcucagcauggaaaaguugcccggaaacggacgccgagaagcuaguacagcucaccuuuugugcuuuccaugauaugauccaacugaugaacuccacacaccuuuga

SEQ ID NO: 54831 - RNA, 675 nt, Artificial Sequence
  derived and/or modified sequence opt3 from CRP__Homo_sapiens__XP_011507509
auggagaagcugcucugcuuccuugugcugaccagcuugucccacgccuuuggccagacagacaugucuagaaaggcuuucgucuuucccaaagaaucagauacgaguuacguuagcuuaaaagcaccucugacuaagccacuaaaagccuucaccgugugucuccauuuuuauacagagcuguccucuacuaggggguacucgaucuucucauaugcgaccaagcggcaagacaacgaaauucuuauauuuuggagcaaggauaucggauacaguuucacaguagguggcuccgagauucuguuugaagugccggaggucaccguggcucccguucacaucugcacuucuugggagagcgccuccgggauuguggaguucugggucgacggaaaaccucgcgugcgaaagucauugaaaaagggcuauacaguaggugcagaagccaguaucauacucgggcaggaacaggauagcuuuggaggcaauuucgagggcucucagucccugguuggggacaucggaaacgugaauaugugggauuuuguccugucaccagacgagauuaacaccaucuaccucgguggccccuucagcccuaauguguuaaacuggcgugcucugaaauaugaagugcaaggggaggucuucacgaagccacagcuuuggcccuga

SEQ ID NO: 54832 - RNA, 1938 nt, Artificial Sequence
  derived and/or modified sequence opt3 from CRTAC1__Homo_sapiens__NP_001193457
auggcccccagcgcugacccuggcauguccagaaugcugccauuccuccuucuguugugguuuuuaccgaucaccgaggggucucagagggcagaacccauguucacagccgugacuaacucaguccugccuccagauuacgacaguaaucccacgcaacuaaacuauggaguugcggugaccgauguagaccacgauggugacuuugagauuguggucgcuggcuacaaugggccuaaccucgugcugaaguaugaucgggcccagaaacgccuuguuaauauagcaguggacgaacgaagcuccccauacuaugcccugcgugauagacagggaaacgcuaucggcgucacagcaugcgacauugauggugacgggagggaggaaaucuacuucuugaauacuaacaaugccuuuucuggaguggcuaccuauacagauaagcucuuuaaauuucggaacaaucgcugggaggacauucugucggacgagguaaacguugccagaggcguggcgucacuguucgcaggcaggagcgucgccuguguggaucggaaggggaguggacgcuacuccaucuacauagcuaauuaugccuacgguaacgugggccccgacgcacucaucgaaauggauccugaggcuucugacuuaagccgagggauucuggcccuuagagaugucgcggccgaagcaggaguuuccaaauauaccggcgguaggggagugucaguagggccaaucuugaguagcucugcuuccgacauuuucugcgauaaugagaacggcccgaacuuccuguuucauaaucggggcgacgggacuuucguggaugccgcugccucagcaggagucgacgauccccaccagcauggucguggcguggcccuagcugacuuuaaccgcgacgggaagguugauaucguguacggaaauuggaacggcccucacagacucuaucugcaaaugagcacacaugguaaggucagguuccgggacauagcgaguccaaaauucucuaugcccuccccugugcgaaccguaauuacggcagauuuugacaaugaucaggagcuugaaaucuucuuuaacaauauugccuaccgcagcucgucugcuaacagacuguucaggguuauccggcgcgagcacggggacccauugaucgaagaacucaaucccggcgaugcccuggaaccggagggaagaggcacugggggaguggucaccgacuuugauggugacggcauguuagaucugauucucucccacggggagucaauggcacagccucuuaguguguucaggggaaaccagggcuuuaauaacaauuggcugcgugucgugccccggacacgauucggugccuuugcuagaggggccaagguuguguuguauacuaaaaagagcggcgcacaucuaaggauaaucgacggaggcuccggguaccugugugaaauggagccaguagcgcacuucggacucgguaaagaugaggcuucuagcgucgaggugaccuggccugacggcaagaugguuucacgcaacguggccaguggggaaaugaacuccguccuggagauucuuuacccccgggacgaggauacacugcaagacccagcacccuuggaaugcggacagggcuuuagccagcaggagaauggucauuguauggauaccaacgaaugcauccaauucccuuuuguguguccaagagacaagccgguaugcgugaauacguaugggucuuacaggugucgcacuaacaaaaagugcucacgaggcuaugagcccaaugaagauggaacagccuguguugcucaggucgccuuccucggcggguacaguagcgcagcuucccggauaucugagccucugucgcgugccagcuauuuaucccugggacuaggccucugccugcagcuuuacgcguuguga

SEQ ID NO: 54833 - RNA, 585 nt, Artificial Sequence
  derived and/or modified sequence opt3 from CRTAM__Homo_sapiens__NP_001291711
augugggugaagcugcucagcaucgucgccgaguucugcuuuucccccuuccuuguuaccgacgaagagacagcuucugaugcacuggaaagaaacucauugaguagccaggacccucaacagccaacuuccacggugucuguaaccgaggauucgucaacaagcgaaauugacaaagaggagaaggaacagacuacccaggauccggacuuaacaaccgaggccaauccccaauaccugggccuagcgaggaaaaagagugggauacuccugcuuacucugguguccuuuuugaucuucauucucuuuaucauuguccagcuguucaucaugaaacugcggaaggcucacgugauauggaagaaagaaaacgagguuucugagcauacacucgaaagcuaucgcucccgaucaaauaacgaggaaaccaguagcgaggaaaagaauggacagucuucccacccuaugcguuguaugaacuacaucacgaaauuauauucagaggccaagacuaaaagaaaggagaaugugcagcauagcaagcuggaagagaaacacauucaagucccagaaaguaucguguga

SEQ ID NO: 54834 - RNA, 1206 nt, Artificial Sequence
  derived and/or modified sequence opt3 from CRTAP__Homo_sapiens__NP_006362
auggagcccggcagaaggggagccgcugcacugcucgcccuucugugcguggcgugugcuuugcgggccgggcgcgcacaguacgaacgauauagcuuccguuccuuuccuagagacgaguuaaugccacuggaaucugccuacaggcacgcucuagauaaguauucaggugagcauugggcagaaagugucggcuaccucgagaucagccugcggcuucaccgccuguugagagacuccgaggccuucugccauaggaacuguucugcugccccgcaacccgaaccugcggcagggcucgccucguauccagagcugcggcuguuuggaggccucuuacgccgagcucacugccugaaaagauguaagcagggucuucccgccuucaggcagucacagccuagccgggaaguuuuggcagauuuucaacgucgcgagccauacaaauuccugcaguuugcuuauuucaaggccaauaaccuacccaaagcgauugccgcagcucauaccuuucuccugaagcacccugacgaugagaugaugaagagaaauauggccuacuacaaaagucuuccaggggcugaagacuauauaaaggaucuggagacaaaauccuacgaaucuuuguucaucagggccgugcgggcauauaacggagagaauuggcgaacuagcauuacggacauggaacucgcccugccggacuuuuucaaggcuuuuuacgagugcuuagcggcaugugagggcucccgcgaaaucaaagauuucaaggauuucuaucugucaauugccgaccacuacguagaggugcucgaaugcaagauccagugugaggaaaaccuuacccccgucauaggcggguauccuguggagaaauuuguugcuacaauguaccauuaccugcaguucgccuauuacaaguugaaugaucugaaaaacgcagccccaugcgcugugaguuaucuacucuuugaccaaaaugacaaggucaugcagcagaaccugguguacuaucaguaccacagagauacuuggggacuuagcgacgagcauuuccaacccaggccugaagccguacaguuuuucaauguuaccacacugcagaaagaguuguaugauuuugcaaaggaaaacaucauggacgaugacgagggugaaguggucgaguacguggaugaccuccuggaguuagaagagaccucuuga

SEQ ID NO: 54835 - RNA, 1953 nt, Artificial Sequence
  derived and/or modified sequence opt3 from CRTC1__Homo_sapiens__NP_001091952
auggccaccagcaacaaucccagaaaguucuccgagaaaaucgcucugcacaaccagaagcaagcagaagagacagccgcguuugaagaggugaugaaagaccucucucuuacuagggcugcccggcugcaguugcagaagucacaguacuuacaacugggcccuagucgcgggcaguauuacggagguagccuaccaaaugucaaccagauuggcuccgggacgauggaucucccguuccagcccucuggauuucugggcgaagcacuugccgcugcaccuguuucgcugaccccauuccaaucaagcgguuuggacacaagucgaacuacccgucaucacgggcucguggauagaguauauagggagcggggacgccugggcucuccccauagaaggccucuguccguggacaaacacggccggcaggccgauagcugcccauacgggacaauguaucucucacccccugcugacaccuccuggcgccgaacuaauagugauagcgccuuacaucagucuacaaugaccccaacgcagccggaguccuuuucaagcggaagucaagacguccaccagaagagagugcugcuuuugacuguucccgguauggaagagaccacaucugaagcggauaagaaccuguccaaacaggcaugggacacuaagaaaaccggcagcaggccuaagucgugugaggugccagggauaaauaucuuccccucugccgaucaagagaacacaaccgcucuaauuccugccacgcacaauacuggaggcucccucccagaccugacaaacauccauuuucccucaccgcuuccuacuccccuggauccagaggaaccuaccuuccccgcauugaguagcuccucuagcacagguaaucucgcugccaaccugacccacuuagggauuggaggcgcgggccaggggaugucaacgccaggaaguagcccccagcaucggccugccggugucuccccacugucucucucaaccgaagcacgucgccagcaagcuaguccgacacuuagcccccuguccccuaucacucaggccguggcuauggacgccuugucucuagagcagcagcugccauacgcauuuuucacccaagccggcucgcagcagcccccuccacagccccaaccgccuccacccccucccccagcuagccagcagccucccccaccgccucccccacaggcgcccguaagacucccuccagggggaccccugcuuccuuccgcaucacugacaaggggcccgcaaccacccccuuuggccguuacugugccaaguucucucccccagagcccuccggaaaaucccggucagccauccauggggauagacaucgcuucagccccugcacugcaacaguaucggaccagcgccggcucucccgcuaaccaguccccaacaaguccugucagcaaucagggauuuucucccggcuccucaccacaacacaccaguacuuuagggagcguguucggagaugccuacuacgagcagcagauggcagcgcgacaggcuaacgcccugucgcaccaacuagagcaguuuaacaugauggaaaaugcaauuuccucuagcucacucuauaguccggguuccacgcugaacuacucucaggccgcuaugaugggccuuacagggagccauggauccuugccugacucacagcaacugggcuaugccagccacagugguauccccaauauuauccucaccgugacuggggagucuccacccucccugagcaaagaacuuaccucgucacuggcaggcgucggagauguuucuuucgacagugauucccaguucccuuuggacgagcucaagauagauccacugacauuagacggccugcauaugcuaaacgaucccgacauggugcucgcugauccugccaccgaagacacuuuucgcauggacagacuguga

SEQ ID NO: 54836 - RNA, 2082 nt, Artificial Sequence
  derived and/or modified sequence opt3 from CRTC2__Homo_sapiens__NP_859066
auggccaccagcggcgcuaacgggcccggauccgcaacagccucugcgucaaauccuagaaaguucagugagaaaaucgcucugcagaagcaaaggcaggccgaagagacugcagccuuugaagaggugaugauggacauugguagcacgcggcuccaggcucagaaacuucgccuggcauacacccgauccucucacuauggcgggucguugccaaacgucaaucaaauaggaucaggcuuagccgaguuccagagcccgcugcauaguccccuagauuccucucguagcacaagacaccauggucucguugaaagggugcagcgggacccucgcagaaugguauccccacugaggcgguacacucgccacaucgauucaagucccuauagcccugcuuaccuuucuccacccccugaguccucauggcgaagaaccauggccugggggaacuuuccagcggaaaagggacagcuguucagguugccgagcgcacucaaucggacaaguucugacuccgcccugcauaccagcgugaugaaccccucgccucaagauacuuauccaggccccacaccuccaucuauucugcccucccgucgcggcgggauccucgacggagagauggauccgaaagucccugcuauugaagagaauuuacuggacgauaagcaccuuuugaagcccugggacgccaaaaagcugucaaguagcuccucuagaccaaggagcugcgaggugccugguaucaacauauuucccucaccagaucagcccgcaaauguuccugugcuaccaccggcuaugaacaccggcgggagucuccccgaccugacgaaucuucacuucccuccaccccugccuacuccauuggaucccgaagagaccgccuacccgucccucagcggaggcaacucuacaucaaaucugacucauaccaugacacacuuagguaucagucgggggaugggacugggcccuggcuaugacgcgccagggcuccauagcccccuuucccacccuucucugcagucgagcuuguccaaccccaaucuacaggccucacugaguucuccacaaccucagcuccagggaagccacucccaucccucacugccagcaagcucucuugcucgacacguccugccgaccacguccuugggucauccuagucucagcgcccccgcucugucuuccucaaguagcucguccucuacuagcucaccaguguuaggcgcccccaguuacccugcauccacaccaggggccucuccccaccaucgcagaguaccucugagcccgcuaucccuccuggcuggaccagcggacgcaaggcggucacaacagcagcuucccaaacaguuuagcccuaccaugaguccaacuuugucuuccauuacacaaggcguuccccuggauaccagcaagcucucgacggaccagcgccugccuccguaccccuauucaucuccaagucuugugcugccuacccagccccacacaccaaaauccuugcagcaaccuggucuccccagccagucuuguagcguccaguccucagggggccagccaccgggaagacaaagucacuacggcacuccuuaucccccagggcccagcggacauggucagcagucuuaccacaggccuauguccgauuucaaccugggcaacuuagaacaguuuucaauggagaguccaagcgccucccuggugcuagaucccccuggguucucugaaggaccgggcuuucucgguggggagggcccaaugggaggcccccaagacccucauaccuucaaucaccagaaccugacacacugcucgcgucaugggagcggacccaauaucauucuuacuggugacucauccccaggcuuuaguaaggagaucgcugccgcauuggccggggugccuggauucgaagucucugcugccggccuggagcucggucugggguuagaagaugagcugcggauggaaccccuuggcuuggagggacucaacaugcugagcgacccaugugcacuacugccugauccggcgguugaggaauccuuccgaucagacagacuccaguga

SEQ ID NO: 54837 - RNA, 1857 nt, Artificial Sequence
  derived and/or modified sequence opt3 from CRTC3__Homo_sapiens__NP_001036039
auggccgcuagccccggcuccgggucugcaaacccuagaaaguucucagagaaaaucgcccugcacacccagaggcaagcggaagagacacgggcuuuugaacagcucaugacugaccuuacgcugagucgcgugcaguuccagaaguugcaacaguuacgacugacccaguaccauggagguagccuaccaaaugucucccagcuccguucuucggccucagaguuucaaccgagcuuccaccaggcagauaacguuagaggcacaaggcaucacgggcugguggaacggcccagucgcaauagauuucauccucuucacaggcgguccggagacaaaccaggccgccaguucgaugguucugccuuuggggcuaacuauagcucccagccccuggacgagucauggccucgacaacagccacccuggaaggaugagaaacacccuggauucagauugaccagugcacucaauaggacuaacagcgacucugcccugcauacauccgcucugucaaccaagccacaggauccguacggcggcgggggacaaagcgccuggcccgcgccuuauauggguuuuugcgacggcgaaaauaacgggcacggagagguagcaaguuucccaggcccccucaaggaagagaauuuacugaacgugccuaaaccacuucccaagcaguugugggagacuaaagaaauucagucucuguccggucggccgcguagcugugaugucgggggaggcaaugccuuuccucauaacggccagaaucuagggcucucgcccuuccugggaacacuuaacaccgguggcucucugccagacuugacgaaucuccacuacuccacuccucugcccgcuucauuagauaccacagaccaccauuuugggaguaugagcgugggaaacuccguuaacaauauaccagccgcaaugacucaccugggcauccgcucuagcucaggucuccaaaguuccagaagcaaccccucuauucaggcuacccuuaauaagacagugcugucaaguagcuugaacaaucauccucagaccuccgucccaaacgccucugcgcuacacccgucgcugaggcucuuuagccuguccaaucccucacuuaguacgacuaaccugucugggccuagccggcgacgccagccacccguguccccuuugacacucucaccaggccccgaggcccaucaaggauucagcagacagcugucuuccaccaguccguuagcaccuuauccaacuagccagaugguaucuuccgauaggucacagcugaguuuucuacccacagaagcucaagcccagguuagcccucccccaccuuaccccgcuccacaggagcucacccagccgcugcuucaacagccucgggcccccgaagcaccagcccagcaaccccaggcugcgucguccuugccucagucugacuuccagcugcucccagcacaaggcagcucacugacgaauuucuuccccgacgugggguuugaucagcagaguaugcgcccuggaccggccuucccacagcaagucccccuugugcagcaggguuccagagagcugcaggacucuuuucacuugaggccuagcccauauuccaacugcggcucacuccccaauaccauccugccugauagcaguacaucuuuauucaaagaccugaacuccgcucuagccgggcucccggaggugagccugaaugucgauacucccuuuccacuugaagaggaauugcaaauugagccucugucgcucgacggacugaacauguuaucagauucuaguaugggccugcuugaccccuccguugaagagaccuuccgugcagaucgguuguga

SEQ ID NO: 54838 - RNA, 900 nt, Artificial Sequence
  derived and/or modified sequence opt3 from CRX__Homo_sapiens__NP_000545
augauggccuacaugaaccccggcccucacuauagcgugaaugcucuggcacucuccgggccaucugucgaccuuaugcaucaggccguuccguaccccucagcgccuagaaagcaaaggcgggagcgcaccacauucacucgaagucagcuggaagaguuggaggcuuuauuugccaaaacgcaguauccagauguguacgcacgugaagaaguagcccugaagaucaaccuacccgagagcagagugcaggucugguucaaaaauaggcgggcuaagugccgccaacagagacagcagcaaaaacagcagcagcaaccuccaggaggucaggcaaaggccaggcccgcuaagcggaaagccggcaccuccccucgcccaucuacagacguguguccggauccccucgggauuucggacucauauagcccuccacugcccggaccuaguggcuccccaacuaccgcgguugcaacagugucuauauggagccccgccuccgagucaccgcuuccugaagcucagcgagccggucuggucgcaagugggcccagcuugaccucugcuccauacgccaugacuuaugcgccugccuccgcauuuugcucaagccccagugcuuacggaucuccauccagcuacuucucgggccucgaucccuaucugucuccuauggugccacaacugggcgggccggcccucucccccuuaucaggaccuaguguagguccaagccuggcucagucccccacaucucuuagcggccagucauacggggccuauaguccuguugacuccuuggaguuuaaggauccaaccggaacguggaaauucacuuacaaccccauggacccgcuggauuauaaggaccagagcgcauggaaauuucaaauccuauga

SEQ ID NO: 54839 - RNA, 1761 nt, Artificial Sequence
  derived and/or modified sequence opt3 from CRY1__Homo_sapiens__NP_004066
augggcgugaacgccguccacugguucagaaaggggcugaggcuccaugacaaucccgcucuuaaagagugcauccagggagcagauaccauucgguguguuuacauacuggacccuugguuugccgguagcuccaacgugggcaucaaucgcuggcgauucuuguuacaaugccuggaagaucuagacgcgaaccuccguaagcugaacucuagacuuuuuguaauuagggggcagccagcugauguguucccgcggcuguuuaaagaguggaauaucacaaaguugucaauugaauaugacagugagcccuucggaaaagaacgcgaugccgcaaucaagaagcucgccacugaggcuggcgucgaggugauaguuagaaucagccacacgcuguacgaccuggauaaaauuaucgaacucaauggugggcagccuccauuaaccuauaagagguuucagacacugauuuccaaaauggagccccuugaaaucccuguggagacuauaaccucugaggucauugaaaaguguacaaccccauugucggacgaucaugacgagaaauacggagugcccucacuggaagaacuaggcuucgauacugacggccucagcagugcaguauggccugggggagaaacagaggcccugacccggcuugagcgccaccuggaacgaaaggcuuggguugccaacuuugagagaccaaggaugaaugcgaacuccuugcucgcaucuccgacgggucugagccccuauuuacgguucggcugccuguccugucgucucuuuuacuucaaacuuacugaccuguauaagaaggugaaaaagaacucaaguccuccauugagccuauacgggcaacugcucuggcgcgaauuuuucuacaccgccgcuacaaauaaucccagauucgauaaaauggagggaaacccuaucugcguccagauuccaugggacaagaaucccgaagcccuggcaaaaugggcugagggcaggacugguuuuccguggaucgaugccaucaugacccagcuucggcaggagggguggauucaucaccuggcgcgacacgccguggcauguuucuugacacgcggagaccucuggauaucuugggaagagggcaugaagguguuugaggagcuguuacuggaugcugacugguccaucaacgccggcucauggauguggcuaagcugcaguucuuucuuucaacaguucuuucauuguuauugcccugucggguucggaagaaggaccgaucccaacggugacuacauucggcgcuaucucccaguucugagaggcuuuccugcuaaguacaucuaugaucccuggaaugccccagaagggauacagaaaguggcaaagugucuuauuggaguaaacuaccccaaaccuauggugaaucacgccgaggcuuccagguugaacaucgagcguaugaagcagaucuaucaacagcugagccgguaccgaggccucggucugcuugcgucggucccaucuaauccgaacgggaauggcggauucaugggcuacuccgcagaaaacauucccgggugcucaaguagcggauccugcucucaggguagcggcauccugcauuaugcccacggggacucacaacagacgcacuugcucaaacagggaagaaguuccaugggcacuggucugagcgggggcaagaggccuucucaggaggaagauacacaaucaauuggaccaaaggugcagcgccagaguaccaauuga

SEQ ID NO: 54840 - RNA, 1599 nt, Artificial Sequence
  derived and/or modified sequence opt3 from CRY2__Homo_sapiens__NP_001120929
augcccgccccuccaggcagaacccacacaugguuccugcuccagagccuugaggaccuggauacuuccuugaggaaguuaaacucucggcuguuugugguccgcgggcaaccggcugacguuuucccccgacuauuuaaagaauggggagugacgcgucucaccuucgaguacgauucagaaccuuuugguaaggagagagacgcagccaucaugaaaauggcgaaggaagcuggcguagagguggucacagagaauagucauacucuguaugaucuugacaggauuauagaacugaacgggcagaaaccacccuugaccuacaagcgguuccaggccaucauuagccgcauggagcucccuaagaaaccagugggacugguuacaucccagcaaauggaaucuugcagagcagagauccaggagaaucacgaugaaaccuauggcgugcccucgcuggaggaacucgguuuuccuacugagggguuaggaccagccgucuggcagggcggcgaaacagaggcucuggcaaggcuugacaagcauuuggagcggaaagccuggguggcuaacuacgaacgcccgcgaaugaaugccaacucacugcuagcgagccccaccgggcucaguccuuaucugagauucggaugucuuuccugcaggcuguuuuacuaucgguugugggaucucuacaagaaaguaaagcguaauucuacgccaccccugagcuuauucggucagcugcucuggcgcgaguuuuucuacacugcagccaccaacaauccuagauuugacaggauggaaggcaacccaauuuguauccaaauacccugggaucggaauccggaggcucuugccaagugggcagaagggaaaacaggauucccuuggaucgacgcuauuaugacucagcugcgacaggagggcuggauccaccauuuggcccgccacgcgguugccugcuuccuaaccagaggugaucuguggguguccugggagucaggggucaggguguuugacgaacuccugcuugacgcagauuucagugugaacgcuggaagcuggauguggcugucuuguuccgccuuuuuccagcaauuuuuccacugcuauugucccgucggcuuuggccggcgcacagacccaucaggggauuacauuagaagguauuugccuaagcucaaggcuuuccccagccguuacaucuaugagccauggaaugcccccgaaaguauacagaaagcagccaaaugcauuaucggaguugacuacccucggccaauugugaaccaugcugagaccucucgacugaauaucgaaagaaugaagcagaucuaucaacaguuauccagguaccgcggucugugucuacucgcgagcguaccgucgugcguggaggaucugucucaccccgucgcagagccuuccucaagucaggccggcagcauguccucugcugggccacggccccuuccuagcggaccagccucacccaaaagaaaguuggaagcagccgaggaaccgccuggcgaggagcugaguaagagggcucgcguggccgaacucccaacgcccgagcugccuuccaaagacgcauga

SEQ ID NO: 54841 - RNA, 528 nt, Artificial Sequence
  derived and/or modified sequence opt3 from CRYAB__Homo_sapiens__NP_001276737
auggacaucgccauucaccaucccuggauaagaaggccuuucuuuccauuccacagcccgucccggcuguuugaucaguucuuuggcgagcaucuccuugaaucugaccuguuccccaccucaacaaguuugagcccuuuuuacuuacgcccacccuccuuccugcgagcuccuucuugguuugauacugggcuaucggagaugcgucucgaaaaggacagauucucagugaaccuggaugucaaacacuuuagcccagaggaacuuaagguuaaagugcugggagacguaaucgaggugcaugguaagcacgaggaaaggcaagaugagcacggcuucauuagucgggaauuucaucgcaaauauagaauccccgcagacgucgauccuuugacgauuaccuccucucucagcuccgacggggugcugacaguuaauggaccaaggaaacaggugucaggcccggagcggacuauccccauaacccgcgaggaaaagccugccgucacagcggcuccaaagaaguga

SEQ ID NO: 54842 - RNA, 648 nt, Artificial Sequence
  derived and/or modified sequence opt3 from CRYBA1__Homo_sapiens__NP_005199
auggagacccaggccgaacaacaggagcuggaaacacuccccacuacgaagauggcucagaccaacccuacaccaggcagccuugggccguggaaaaucacuauuuacgaccaggagaauuuccaaggaaagagaauggaauuuaccuccucuugccccaacgugucagagaggaguuucgauaauguccggagccugaaaguugaguccggugcauggauaggcuaugaacacacaucuuuuugugggcagcaguucaucuuggagcgcggagaauacccucgaugggacgccuggucgggcucaaacgcguaucauauugagcguuuaaugagcuuuagaccaaucugcagugcuaaucacaaggaguccaaaaugaccauuuucgaaaaggagaacuuuaucgguaggcagugggaaauaucugaugacuaccccagccugcaagccauggggugguucaauaacgaggugggauccaugaagauccagucaggcgcauggguauguuaucaguacccuggcuaucggggguaccaguacauucuagaaugcgaucaucacggaggugacuauaaacauuggcgcgaguggggcagucacgcccaaacuagccagauccagucuauuagaaggauccaacaguga

SEQ ID NO: 54843 - RNA, 594 nt, Artificial Sequence
  derived and/or modified sequence opt3 from CRYBA2__Homo_sapiens__NP_476434
augagcuccgcccccgcuccuggcccagcaccggccucucugacccucugggacgaggaagauuuccaggggagaaggugccggcuucugucagacugugcgaacgugugcgagcgcggagguuugccccgaguccguaguguuaagguggaaaauggcguauggguggcuuuugaguacccugauuuccaagggcagcaguuuaucuuagaaaaaggagacuauccaagauggagcgccugguccgguucuucgucacacaacagcaaucagcugcuaaguuucaggcccguccucugugcaaaccauaaugauucccgggugacacuguuugagggcgacaacuuccaagggugcaaguuugaucuuguugacgauuacccuucucugccaagcaugggaugggccuccaaagacgugggcucauugaaggucaguagcggcgcuuggguggcauaucaguaccccggguaucgcggauaccaguauguacucgagagagauaggcacucuggugaguucuguacuuacggcgaacuggggacgcaggcccauaccggacaacugcaguccauucggcgcguucagcacuga

SEQ ID NO: 54844 - RNA, 591 nt, Artificial Sequence
  derived and/or modified sequence opt3 from CRYBA4__Homo_sapiens__NP_001877
augacccugcagugcacaaagagcgccggccccuggaaaaugguggucugggacgaggauggguuccaaggaagaaggcacgaauuuacugcugaguguccuuccguucucgaacuugguuucgagacggugcggucucugaagguauugucaggcgcaugggugggguuugaacaugccggauuccagggccagcaguacaucuuagagcgcggugaguauccaaguugggacgcguggggagggaacaccgcuuacccggccgaacgacugacuagcuuucgucccgcagccugcgcuaaucacagagauuccaggcuaacaauuuucgagcaagaaaacuuucucggcaaaaagggcgagcugucugacgauuauccuucgcuucaggcaauggggugggagggaaaugaagucgguucauuccaugugcacagcggcgccuggguuuguagucaguuuccaggguaccggggauuccaguaugugcuggagugcgaccaucacuccggcgauuacaaacacuuucgcgaaugggguucucaugcucccaccuuccaaguccagagcauaagaaggauccagcaguga

SEQ ID NO: 54845 - RNA, 759 nt, Artificial Sequence
  derived and/or modified sequence opt3 from CRYBB1__Homo_sapiens__NP_001878
augagccaggccgcuaaggcauccgccucugcgaccguggcugucaaccccggcccugacacaaaagggaagggagccccaccggcagguacuucacccaguccuggcacgacccuggccccaacaacuguucccaucaccagcgcuaaagcagccgagcucccuccagggaauuacagacuugugguauucgaacuggagaacuuucaaggaaggcgggcugaguucuccggcgaaugcucuaauuuggccgaucgcgguuuugaccgagugcguucgauuauagucucagcggggcccuggguggcauucgaacagagcaacuuuagaggagagauguucaucuuagagaagggcgaauauccuagguggaauacauggaguuccucuuaccggagcgaucgccugauguccuuuagaccaauuaaaauggacgcccaggagcacaagaucucacuauucgaaggcgcuaacuuuaaggggaauaccauugagauccagggagaugacgccccgagucucuggguuuaugguuucagcgauagggugggcucugucaaaguguccucagggacuuggguaggauaccaauaucccggcuaccgggguuaucaguaccugcuugagccuggggacuuucgccauuggaacgaauggggagcauuccagccacagaugcaaagccugcgaagauugagggauaagcaguggcaccucgagggcaguuuucccguucuggcuacagaaccuccaaaauga

SEQ ID NO: 54846 - RNA, 618 nt, Artificial Sequence
  derived and/or modified sequence opt3 from CRYBB2__Homo_sapiens__NP_000487
auggccagcgaccaccagacccaagcuggcaagccccagucccugaacccuaaaaucauuauauucgagcaggaaaauuuucaggggcauucucacgagcucaacggaccaugcccgaaucuuaaggaaacagguguggagaaagcaggcucaguccugguucaagccgggcccugggugggauacgaacaggcgaacuguaagggcgagcaguucguauuugagaaaggugaauauccuagaugggauaguuggacuagcuccaggcggacggacucuuugucgucauuacgcccaaucaagguggauagccaggagcauaagauuauccuguacgaaaaucccaacuucaccgggaaaaagauggagauuaucgacgaugacgucccuaguuuucacgcucauggauaucaagagaaaguguccucuguucgagugcagagcggcacaugggucggcuaccaguauccaggguaccguggacuacaguaucuccuggaaaagggugauuacaaagacuccucagauuucggcgcaccccacccucaagugcagaguguaagaaggauacgggacaugcaguggcaccaacgcggggccuuucauccaagcaauuga

SEQ ID NO: 54847 - RNA, 636 nt, Artificial Sequence
  derived and/or modified sequence opt3 from CRYBB3__Homo_sapiens__NP_004067
auggccgagcagcacggcgcucccgaacaagcagccgcggggaagucgcauggagaccuggguggcuccuacaaagugauccucuaugagcuugaaaacuuccaggggaagagaugcgagcugucugcugaauguccuucauugaccgauaguuuacuggagaaagucggaagcauucagguugaguccggcccauggcuagccuuugaaucuagggcauuccggggugagcaguuugugcucgaaaagggggacuacccgcgcugggaugccuggagcaauucacgagacagcgauagucugcuuucccugcgucccuugaacauagacucuccucaccauaaacuccaccuguucgagaauccagcuuuuagcggaagaaagauggagaucguagaugacgaugugcccucccugugggcacauggcuuccaagacagggucgccucagugcgggcuauuaacggcacauggguuggguaugaauuuccuggauaccgcgguagacaguauguguucgagaggggcgaauaccggcacuggaaugagugggaugccagucagccacagcuccaaagcguccgccgaaucagagaccagaaguggcacaaaagggggcgguuucccucuuccuga

SEQ ID NO: 54848 - RNA, 528 nt, Artificial Sequence
  derived and/or modified sequence opt3 from CRYGB__Homo_sapiens__NP_005201
augggcaagaucaccuucuacgaggacagagccuuucaggggaggagcuaugaaugcacaacugauugucccaaccugcaaccuuacuucucccggugcaauucuauucgcguggagucaggauguuggaugauauaugaacgaccaaacuaccagggucaccaguauuuucuccguagaggcgaguacccggacuaucagcaauggauggggcuuagugauagcaucagguccugcugucugauucccccucauucuggagcuuaccggaugaaaaucuacgaccgcgaugaauugagaggccagaugucggaguuaacggacgauugcauuucaguccaggacagguuccaccugaccgagauccauagccuaaauguucucgaagguaguuggauacuguaugagaugccaaacuaccgggggcgccaguaucuucugcgacccggagaauacagaagguuuuuggauuggggcgcaccuaaugccaaggugggcucccuccggcguguaauggaccuguauuga

SEQ ID NO: 54849 - RNA, 525 nt, Artificial Sequence
  derived and/or modified sequence opt3 from CRYGC__Homo_sapiens__NP_066269
augggcaagaucaccuucuacgaggacagagccuuucaggggaggagcuaugaaacaacuacggauugccccaaccugcaaccuuacuucucccgguguaauucuauucgcguggagucaggaugcuggaugcucuaugaacgaccaaacuaccagggucagcaguaucuucugcguagaggcgaguacccggacuaucaacaguggaugggguugagugauagcauaagguccuguugcuuaaucccccagaccgucucucaccggcugcgccuauacgaaagagaggaccauaaaggacucaugauggagcugucggaagauuguccuucaauucaggacagguuucaccuuagcgagauccggagucugcauguuuuggaaggcugcugggugcucuacgagcugccaaauuaucgcggucgacaauaccugcucagaccccaggaguauaggcggugucaggauuggggagcuauggacgcaaaggccggguccuuacgucgcguaguggaucuguacuga

SEQ ID NO: 54850 - RNA, 525 nt, Artificial Sequence
  derived and/or modified sequence opt3 from CRYGD__Homo_sapiens__NP_008822
augggcaagaucacccuguacgaggacagaggguuccagggaaggcacuaugaaugcagcuccgaucaucccaaccuccaaccuuaccuuucucgguguaauucagcccgcguggacagugguugcuggaugcuguaugagcagccaaacuacagcggcuugcaguauuucuuacgacguggggauuacgcugaccaccagcaauggaugggacuguccgauucugucagaucguguaggcuaauuccgcauucaggcagccaccggauacgccucuaugaaagagaggacuacaggggucagaugaucgaauuuacagaggauugcaguugucugcaggaccgguuucgcuucaaugagauucauucccuuaacguucuggaagggucuuggguguuguacgagcucagcaauuaucgaggaagacaguaccugcugaugcccggcgauuauaggcgguaccaagacuggggcgcaacuaacgcccguguagggucccuccgcagagugaucgauuuuucauga

SEQ ID NO: 54851 - RNA, 537 nt, Artificial Sequence
  derived and/or modified sequence opt3 from CRYGS__Homo_sapiens__NP_060011
augagcaagaccgggacaaaaaucacuuucuacgaggacaagaacuuucaggggagaagguaugauugcgacugugauugcgccgacuuccacacguaccugucccgguguaauucuauuaaaguggaaggagguaccugggcugucuaugagcgccccaacuuugcaggcuacauguauauacucccucaaggggaauacccagaguaucagcgauggaugggacuuaaugaucgucugucaaguugcagagccguucauuugccgagcggcggucaguacaagauccagauuuucgaaaaaggggacuuuuccggacaaauguacgagacaacugaggauugucccucuaucauggaacaguuccacaugagggagauucauucgugcaagguguuagaaggcguauggaucuuuuaugagcugccuaacuaccggggccgccaguaucuacucgacaagaaagaguacagaaagccaauagauuggggcgcggcuucacccgccgugcagagcuucaggcggaucgucgaauga

SEQ ID NO: 54852 - RNA, 960 nt, Artificial Sequence
  derived and/or modified sequence opt3 from CRYL1__Homo_sapiens__NP_057058
auggccagcuccgcugcaggcugcguggucaucguugggucuggagugauugguagaucaugggccaugcuguucgcgaguggcggguuucagguaaagcucuacgacauagagcaacagcagaucaggaacgcucuugaaaauauucggaaagagaugaagcuguuggaacaggccggcagcuuaaaaggaucccugucuguggaggaacaacuaucgcucaucucagguugucccaacauucaggaggcagucgagggggccaugcacauccaggaaugcgugccugaggaucuggaacuuaagaaaaagauauucgcucagcuggacagcaucauugaugaccgcguuaucuugaguuccucuaccagcugucucaugccauccaagcuguuugcaggacuggugcaugucaaacaaugcauuguggcccacccgguaaaucccccuuauuacaucccacucguugaguuagugccccauccugagacagcuccaacuacggucgaucgaacccacgcccugaugaagaaaauaggccagugucccaugcgugugcagaaggaaguggcgggcuucguccuuaacagauugcaguaugcaauuaucucagaggccuggaggcugguugaagaggggauugugaguccuagcgaccuagaucucguaaugucugaaggacuggguaugcgguacgcuuuuaucggcccacuugagacaaugcaucugaaugccgaggggauguuguccuauugcgaccgcuacucagaaggaaucaaacacgugcuccaaacuuucggcccgauucccgaguuuagcagagcaaccgcugaaaaggucaaccaggauauguguaugaaggugccugacgauccagagcaccuggccgcgaggcggcaguggcgcgacgaaugcuuaaugcgacuggccaaacucaagagucaaguucagccccaguga

SEQ ID NO: 54853 - RNA, 945 nt, Artificial Sequence
  derived and/or modified sequence opt3 from CRYM__Homo_sapiens__NP_001879
augagcagagugcccgccuuccuguccgcugcagaggucgaggagcaccucaggucuucaagucuucugaucccuccauuggaaaccgccuuagcgaacuuuagcuccggcccggaagggggaguuaugcagcccgugcggacaguagugccugucacuaagcaucgcgguuaccugggcgugaugccagcuuauucugccgcagaagacgcccuaacgaccaaacucguuacauucuacgaggaucgagggauuacuucggugguccccucacaccaagcuaccgugcugcuuuuugagccuagcaauggaacacuguuggcaguaauggacggcaacguuauaaccgccaagcguacugcugccgugagugcgaucgcaacaaaauuccucaagccacccuccucugaaguccugugcauucugggugccggggugcaggcuuauagccauuacgagaucuuuaccgaacaguucuccuuuaaagaggugagaauuuggaauaggacgaaggagaacgccgaaaaguucgcagauacuguccagggagagguucggguguguucaaguguacaagaagcuguggccggcgcggacgucaucauaaccgugacacucgccacugagccuaucuuauuuggcgaauggguuaaaccaggggcacacauuaaugcugugggagccagccgcccggauuggagagagcuggacgaugagcuuaugaaggaagcugucuuguauguggacucucaggaggccgcacugaaagaauccggugauguacuacucucaggcgccgagaucuucgcugaacugggggagguuauuaagggagugaaacccgcgcauugcgagaagaccacagucuuuaagagccuuggcauggcaguggaagacaccgucgccgcuaaacugaucuacgauaguuggucuuccgguaaguga

SEQ ID NO: 54854 - RNA, 1050 nt, Artificial Sequence
  derived and/or modified sequence opt3 from CRYZL1__Homo_sapiens__NP_665857
augaagggccuguacuuccagcaaagcuccaccgacgaggaaaucacauuuguguuccaggagaaagaagaucuccccgucacugaggacaacuuuguuaaacuucaggugaaagccugcgcucugucucagauuaauacgaaguuguuagcagaaaugaaaaugaagaaggaucuguucccuguagggagagagauagccggaaucgugcuagacgucgguucaaaagugagcuuuuuccaaccagaugacgagguugugggcauucucccgcuggauagugaagaccccgggcuuugugaggucgugaggguacacgaacauuaucugguucacaagccugagaaagugaccuggacagaggcggcuggauccauccgggauggcguccgcgccuacacugcauugcauuaucucucucaccugucgccagguaagucagugcugauuauggacggggccagcgcuuuuggaaccaucgcaauacagcucgcccaucaccgaggcgcuaaagugaucaguacagccugcuccuuagaagauaagcagugucuggagcguuucagacccccuauugcgagggucaucgacguuucuaacggcaaggugcacguagcagaaagcugccuugaggaaaccgggggauuggguguggauauuguccuggacgccggcgugcggcuauacuccaaagacgaugagccagcuguuaagcuccagcugcuuccccauaaacacgacaucauaacucuguugggggugggaggccauugggucacaaccgaggaaaaucuccaacuggauccuccagacucacacuguuuauuucugaagggugccacgcucgcauuccuuaacgaugagguguggaaucugaguaacguacagcaggggaaauauuugugcauucuaaaggacguuauggaaaaacugagcacuggaguguuucgcccgcagcucgaugagcccaucccucuguacgaagcuaaggucucuauggaggccgugcaaaagaaucagggcagaaagaagcaggucgugcaauucuga

SEQ ID NO: 54855 - RNA, 1482 nt, Artificial Sequence
  derived and/or modified sequence opt3 from CSAD__Homo_sapiens__NP_001231634
auggccgacagcgaggcucugcccucccucgcaggcgauccuguggccgucgaagcgcuucugagagcuguuuucggggugguaguggacgaggccauccagaagggaaccucugucucacaaaaagugugcgaauggaaggagccagaagaguugaaacaguuacuggaucuagagcucaggagucagggugaaagccagaagcaaauucuggagcggugucgcgcaguuauacgauacuccgugaaaacaggccacccgagauuuuucaaccagcuguuuucugggcuugacccccaugccuuggcuggacguaucauuacugaaucgcucaauacgucacaguauaccuacgagaucgcaccugucuucgugcugauggaggaagagguacugaggaagcuccgggccuuaguuggcuggagcaguggugaugggaucuuuugcccaggaggcuccauuucuaacauguaugcugugaaucuggcccgcuaccagagauaucccgacuguaagcaaaggggccuucggacauugccuccacuggcgcuauucacuagcaaagaaugccacuacuccauacagaagggggcagccuuucucggacuggguaccgauucaguccgcguggugaaagcugacgagcgaggcaagaugguccccgaagaucuugagagacagaucgggauggccgaggcagaaggagcuguuccuuuccuggugagugccacaagcggcaccacuguauugggugcguuugacccacucgaggccauugcagaugugugucagaggcaugggcugugguuacacgucgacgcugccuggggaggcucugugcugcucucccaaacacaucggcaccuucuggauggcauccagcgugcugacucaguugccuggaacccgcacaaauugcuagcagccgggcugcagugcagcgcucuccugcuucaagacaccaguaaucuguugaagcgcugucauggaucucaggcguccuaucucuuccagcaggauaaguuuuacgacguggcacuggauacgggugacaaagucgugcaaugcggcagaaggguagauuguuuaaagcuguggcuaauguggaaagcccagggggaccagggacucgaacggcgaauugaucaggcuuucguucuggcccgcuaccuuguggaggaaaugaagaaaagagagggcuuugaguuggucauggaacccgaguucgugaacgucugcuucugguuugugccuccaagccugagggguaagcaagaaucgcccgacuaucacgagcggcucucuaaaguugcaccugugcugaaggaacgcaugguaaaggagggguccaugaugaucggcuaccagccacauggaacuagaggcaauuucuuuagggucgugguugccaacucagcucuuaccugugccgauauggacuuccuguugaaugagcucgaacgucuggggcaggauuuauga

SEQ ID NO: 54856 - RNA, 333 nt, Artificial Sequence
  derived and/or modified sequence opt3 from CSAG3__Homo_sapiens__NP_001123300
auguggaugggccugauccagcucguggagggggucaagagaaaagaccaaggauuccuugaaaaggaguuuuaccacaaaaccaacauuaagaugaggugcgaguuccuggccuguuggcccgcuuuuacaguuuugggugaagcauggcgggaucagguggacuggagccgcuuacugcgagaugccggccuaguaaaaaugucccguaagccuagagcgucuucaccacucaguaauaaccauccgcccacuccuaagagguucccacggcagcccgggcgcgaaaaaggaccuauaaaggaggugccaggcacgaaagguagccccuga

SEQ ID NO: 54857 - RNA, 2748 nt, Artificial Sequence
  derived and/or modified sequence opt3 from CSE1L__Homo_sapiens__NP_001243064
auggagcugagcgacgccaaccuccagacccuuacagaauaccugaagaaaacuuuggaucccgacccugcuaucagaaggccagcagagaaguucuuagaauccguggagggcaaucaaaacuauccgcugcuacuccugacgcuucuggaaaaaucucaggauaaugucauuaagguuugcgccucagugaccuuuaaaaacuacauaaagcggaauuggcgcaucguagaggacgagcccaacaagauuugugaagcggaucgaguggcuaucaaagccaauauuguccacuugaugcucaguagcccugagcagauccagaagcaacuguccgacgcaauaucuaucauugggcgugaagauuucccacagaaauggcccgaccugcucacagagauggugaacagauuucagucgggagauuuccauguuaucaaugguguguuaaggacugcccacucacuguuuaagcgguaucgccaugaguucaaaagcaacgaacuuuggaccgagauuaaguugguccuggacgcuuuugcacuaccucucacaaaucuguucaaggccaccaucgaacuuugcaguacucacgcuaacgaugccuccgcgcugagaauauuguuuucuagccucauucugaucuccaaauuauucuacucacugaauuuucaggaccucccagaguucuuugaagauaacauggagacauggaugaauaacuuccauacccuucugacguuggacaacaagcuacugcaaacugaccucgugaguaaugcaauucaguuccuggccagcguaugugagaggccccacuauaaaaaccuuuuugaagaucagaauacccugacaucuaucugcgagaagguuaucgugccuaacauggaguuccgggcugccgacgaggaagcauuugaggauaauuccgaggaauacauucgccgagacuuggagggcucagauauagacacuagaaggcgggcugccugugaucucguccgugggcugugcaaauucuuugaaggaccagugaccggcaucuucagcgguuaugugaacaguauguuacaggaguacgcgaagaauccgucugucaacuggaaacacaaggacgccgcaauuuaccugguuacaucccuagcuagcaaggcccaaacccagaaacaugggaucacgcaggcuaaugaacucgugaaccugacugaguuuuucguaaaucacauacuucccgauuugaagucggccaacgugaaugaguuuccuguccugaaagcagacggaauuaaguauaucaugaucuuccgcaaccaagugccaaaagaacaucuccugguuucuauuccccuucugaucaaucacuugcaggccgaguccauugugguccacacauacgcugcgcaugcacucgaaagacuguuuaccaugaggggcccuaacaacgccacuuuauucacagcugccgagauagcaccauuuguggagauccugcuaaccaaucucuucaaggcccugacgcuucccggcucaagugaaaacgaguauauuaugaaggcuaucaugcggagcuucuccuugcugcaggaagccaucauuccguacauaccuacccucaucacacagcugacucaaaaauuacuggcaguaucuaagaaucccagcaaaccacacuuuaaccauuauauguucgaggcgauuugucuuucaauccgaauuaccugcaaggcuaauccugccgcaguugugaacuuugaagaggccuuguuccucgucuuuacagagauccugcagaaugaugugcaggaguucauacccuacgucuuucaggugaugagucuacugcucgaaacucacaaaaacgacaucccauccagcuauauggcucuguucccccaucuuuugcaaccuguucugugggaacgcaccgggaauauuccagccuuagugagacuccugcaggcauuucuugagaggggaucuaacacaaucgcuucagccgcggccgacaagauuccgggucuguugggcguauuccagaagcucaucgcuaguaaagcaaaugaucaccagggguuuuaccugcuaaacagcauaauugaacacaugcccccugaguccgucgaccaauaccggaagcagaucuucauucugcucuuucagcgccugcaaaauucuaaaaccacuaaguucaucaaaucguuccuuguguuuauaaacuuguauuguaucaaguacggagcccuggcuuuacaggagauuuucgauggcauccagccaaagauguuugguaugguucucgagaaaauuaucauacccgaaauucagaaggugagcgggaaugucgagaaaaagaucugcgccgugggaaucacgaaacugcuuacagaauguccuccaaugauggacaccgaauauacuaagcuguggacaccccuacuccaaucccugauuggcuuguucgagcugccggaggaugacaccaucccugaugaagaacauuuuauugacauagaagauaccccaggcuaccagacugcauucucacaguuagcguuugccgggaaaaaggagcacgaccccguaggacagauggugaacaacccuaagauccaucucgcucaaagucugcacaaacuuucuacagccugccccgguagaguuccaagcauggucuccacgucacugaaugcagaggcuuugcaguaucuccagggcuaccugcaggccgcaagcgugacccuacuguga

SEQ ID NO: 54858 - RNA, 2919 nt, Artificial Sequence
  derived and/or modified sequence opt3 from CSF1R__Homo_sapiens__NP_005202
augggccccggggugcugcuccuucuguuggucgccaccgcuuggcacggacaggguaucccuguuauugagccaagcgugccggaauuaguagugaagcccggcgcaacagucacucugagaugcguggggaacggauccguugagugggacggcccuccaucuccccauuggacgcuauacucagaugguaguagcuccauacucucuaccaauaacgccacauuccaaaauacugggaccuauagguguacagaaccuggagacccacugggcggcucggcggcuauccaccuuuacgugaaagaucccgcccggccuuggaacguccuggcacaggaggugguaguuuuugaagaccaggaugccuugcucccaugccugcugaccgacccggugcucgaggcuggggucucauuagugcgcgugcgaggacguccccugaugagacauacuaauuauagcuucaguccuuggcacgguuuuacaauucauagggcaaaguucauccagucccaagauuaccaguguucugcccuuaugggcgggcggaaagucaugagcauuuccauccgcuugaagguucagaaagugauaccaggacccccugcucugacccuaguaccagccgagcucgugagaaucaggggcgaagcggcacagauugucugcucagccaguagcguggacguuaacuuugauguguuccugcaacacaauaacacgaaguuagcuaucccccagcagucugacuuucacaauaaccgguaucagaagguccugacuuugaaucucgaucaaguggacuuccagcaugccgguaacuacuccuguguagcaucaaauguucaggggaaacacagcaccaguauguuuuuccgcguggucgagucugcuuaucugaacuuauccagcgaacaaaaucugauucaggaggugacagucggagagggccucaaccuuaaggugaugguugaagccuacccgggccugcagggguuuaacuggacuuacuugggaccuuucucggaucaucagcccgagccaaaacuagcgaaugccaccacaaaggacaccuaucgacacacguuuacucugucucucccuagacugaaacccuccgaagcagguagguacucauuccuugcucggaacccaggcggguggcgugcccugacauucgaguugacccuccgcuaucccccugaagugaguguaaucuggacuuuuauaaauggaagcggcacacuguuaugcgcugccuccgguuacccacaaccgaacgucaccuggcugcaguguucugggcacacggacagaugcgaugaggcacaggugcuacagguuugggacgaucccuauccugaggugcucagccaagaaccauuccauaaggucaccgugcagucacugcuuacaguagagacuuuggaacacaaucagaccuacgaguguagggcccauaacagugugggcuccggaagcugggcuuuuauucccaucucugcgggcgcacacacacauccuccagacgaguuccuguuuacucccguugucguggccugcaugucaauuauggcucuccugcuucuguugcuccuguuacugcuauauaaguacaaacagaagccgaaauaccaagugcgguggaagaucaucgaaaguuaugaggggaauagcuacaccuucauugauccuacacagcucccauauaacgaaaaaugggaguuuccccgaaauaaccugcaguucggaaagacccuuggugccggcgcauuugggaaagucguugaagccacugcuuucggauugggcaaggaggacgccgugcugaagguggcaguaaaaaugcucaaguccacggcgcacgcugaugaaaaagaggcccugaugucugaguuaaagauaaugucgcaccugggucagcaugaaaauaucgucaaccuuuugggggcauguacacacggcggaccugugcucguuauuaccgaguacugcugcuauggcgaccugcuaaauuuucugcgcagaaaagccgaagcuaugcucgggcccagccuguccccaggacaagauccugaggguggcguggacuacaagaacauccaucuugagaagaaauaugucaggcgggauucaggguucaguucucagggaguggacacuuacguugaaaugcgccccgugagcaccuccucaaaugacagcuuuucugagcaggauuuggacaaggaagauggcagaccacuggaguuaagggaccuccugcacuucuccagucaaguagcccaggguauggcauuccuugcuagcaaaaacuguauacaccgugaugucgccgcgcggaacgugcuguugacaaaugggcauguggccaagauuggcgacuuuggacucgcucgagauaucaugaacgacucuaauuacaucgucaaaggcaacgcaagacugccgguuaaguggauggccccugaauccauuuucgauugcguguauaccguacagucagacguguggaguuacgggauccuacugugggagauuuuuagccucggacugaaucccuauccaggcauacuugucaacucgaaguucuacaaauuggugaaggaugguuaucagauggcucaacccgccuuugcaccuaaaaauaucuacuccauuaugcaggcguguugggcccuggagccaacucacaggcccacauuccagcagaucugcucuuuucuucaagaacaggcucaggaggaccgccgggaaagagauuauacgaaccucccuagcucaaguagguccgggggaucuggcagcuccucaagcgagcuggaagaggagaguucuuccgaacaucuuaccuguugcgagcagggugacaucgcccaaccgcugcuacagccaaauaacuaccaguucuguuga

SEQ ID NO: 54859 - RNA, 435 nt, Artificial Sequence
  derived and/or modified sequence opt3 from CSF2__Homo_sapiens__NP_000749
auguggcugcagagccuccuucuguugggcaccguggccugcuccaucucugcucccgcaagaucaccuaguccaagcacacaaccgugggagcacgucaacgccauucaggaagcgaggcgguuacugaaucuaucccgcgacacugcugccgagaugaacgaaacgguugaggugauaucugaaauguucgaucuccaggagcccaccugucugcagacacgacuugagcuguacaagcaaggguugcguggaucgcucacuaaacugaaggguccucugaccaugauggcaucacauuauaaacagcacugcccacccacaccugaaaccagcugugccacucagaucauuacauuugagaguuucaaggaaaaucucaaagacuuuuuacugguaaucccauucgauugcugggagcccgugcaggaguga

SEQ ID NO: 54860 - RNA, 1305 nt, Artificial Sequence
  derived and/or modified sequence opt3 from CSF2RA__Homo_sapiens__NP_001155002
augcugcuccuugugaccagccuguuguuaugcgagcugccccacccugccuuccuacucaucccagaaaaguccgaccugagaacagucgcuccggcaucuucacuuaacguuagguuugauagucggacuaugaaucugagcugggacugucaggagaacacgaccuucuccaaaugcuuuuugacagauaagaaaaaucgcgugguagaaccccgacucucuaacaaugaguguucgugcacuuuccgugaaauuugucugcaugagggcgugaccuuugagguccacgugaacacaucacaaagaggguuccagcagaagcugcucuacccuaauagcggaagggaagguaccgccgcgcagaacuuuaguugcuucauauauaaugcugacuuaaugaacuguacuugggcccggggcccaacagcaccccgcgauguucaauacuuucuguauaucagaaauuccaaaaggcggcgcgagauucgaugcccuuacuauauccaggacucugggacccaugugggaugucaccuugauaacuugagcggccugacguccagaaauuacuuccuagucaacgguacuucaagggaaauugggauccaguuuuucgacagucuccuggauaccaagaagauagagcgguuuaauccacccagcaacgugacaguacguugcaacacuacccauugucuuguucgcuggaaacagccuagaacauaucaaaagcugucuuacuuggacuuccaguaccagcucgaugugcacaggaaaaauacccagccaggaacggagaaccuguuaaucaaugucuccggcgaccuggaaaaccgguauaauuucccgucaagcgagccccgagccaagcacagugugaaaauucgcgcugcagaugugagaauccucaacuggucuuccuggagcgaagccauugaguuuggcucgcauucugucacucaagcugggguucaguggcacaaucuuggaucccugcagccuccaucacccagguugaagcgguucaguugccuacgccugccugguagcgacgacggcaaccucggguccguguacaucuauguacugcuuauagugggaacacuggucugcggcauuguguuggguuuucucuucaagagauuucugaggauccaacguuuauucccacccguuccgcagauuaaagauaagcugaaugacaaccaugaaguggaggaugagaucaucugggaagaguuuaccccugaagaggggaaaggauaccgggaagagguccuaacugugaaggagauuacauga

SEQ ID NO: 54861 - RNA, 2694 nt, Artificial Sequence
  derived and/or modified sequence opt3 from CSF2RB__Homo_sapiens__NP_000386
auggugcuggcccagggccuccuuagcauggcucuguuggcauuaugcugggagagaucccuggccggggcggaagagaccaucccccuacaaacacucagguguuacaacgacuauacuucucacauuacgugccggugggcugauacccaggacgcccagcgccuggucaauguuacacuuauacgacgugugaacgaagaucuguuggagccuguaucaugugaccucagugaugacaugccauggagcgcaugcccgcaucccagaugugugccuaggcggugcgucaucccaugucaguccuucgugguuacugauguggacuacuuuucuuuccaacccgaucgcccucugggaaccagacugacagucacccucacucagcacgugcagccacccgaaccuagggacuuacagauuucgacagaucaagaccauuuucugcuuaccuggucaguagccuuggguagcccacagagucacuggcuguccccgggcgaucuagaguucgagguuguguauaagcggcuccaggacucuugggaagacgcugcaauccugcuuagcaauacgucccaggccacucuggggcccgagcauuugaugccuucaaguaccuacgucgcucgcgugcgaacaagacucgccccaggaagcaggcugucuggccggcccuccaaauggucaccugaagugugcugggauagccaaccaggugacgaggcgcagccccagaacuuagagugcuuuuucgauggggcagccguccugaguuguucuugggaaguucguaaggagguggcuuccagcguaucguuuggacucuucuauaaaccgucuccugacgccggcgaagaggaauguucccccgugcuucgcgagggccuggggucauugcacacuagacaccauugccaaauuccagucccugaucccgcaacccacggacaguacaucgugaguguucagccaaggcgggcugagaagcauauaaaaagcuccgugaauauccagauggcgcccccuucucuaaacgucacaaaggacggugauagcuauucacugcgaugggaaaccaugaagaugcgcuacgagcacauugaccacacguuugaaauccaauacagaaaagauacugccacauggaaggacaguaaaaccgagacucuccagaaugcccauuccauggcacugccagcucuugaaccgagcacaagguauugggcccgggugcgcguaagaaccucuaggacgggcuacaacgggauuuggucagaguggagugaggcucguagcugggauaccgaauccguucugcccauguggguguuggcccucaucgucauauuccugacaauugcaguguuacuggcccuacgguuuugcggaaucuauggcuaccgacucagaaggaagugggaggagaaaauuccuaauccaucuaagucgcaccuguuccagaacgguagcgcugagcuuuggcccccuggguccaugucagcguuuacuagcggaucuccaccccaucagggcccguggggcagccgcuucccugaauuggagggggucuucccagugggauuuggugacuccgagguuucaccccugaccaucgaagacccuaagcacgugugugaucccccaagcggcccugacacaacucccgcagccucugaucucccaaccgagcaaccgccuaguccccagccagggcccccugcugccucccauacaccagaaaaacaggcaagcucuuucgacuuuaauggacccuaucugggcccuccgcacucccggucacuuccagauauccugggucagcccgagccuccacaagaagggggcagucagaagagucccccuccgggaucguuggaauaccucugccugcccgccggcgggcagguacaguuagucccacuggcucaagccaugggaccuggucaggcaguggagguugaaagaaggcccucccagggcgcggcugggucuccaagccuagagucaggaggcgguccugcacccccagcccucgggccgcgcgugggcggacaagaccagaaagauaguccugucgccauucccauguccucuggcgacaccgaagauccagggguggcuagcggauauguauccucagccgaccugguguucacucccaacagcggugcaaguucuguuucccuugucccuagcuugggccugccaucggaucagacgcccucacucuguccugggcuggcuucuggaccgccaggcgcccccgguccugugaagaguggguuugagggcuacguggaguuacccccaauagaaggacgauccccucggagcccccguaauaacccagucccuccggaggcgaaaucucccguucugaauccaggcgaaagaccugccgacgugagccccacauccccacagccugaggggcuuuuggugcuccaacagguaggagauuacugcuuccugcccggccuagguccggggccacugucacucaggaguaagccuagcucucccggaccaggccccgaaaucaaaaaccuggaccaggcuuuucaggucaagaagccuccgggucaagcagugccccagguuccagugauucagcuuuucaaagccuugaagcagcaagacuaucuguccuuaccucccugggaggucaacaaaccuggcgagguguguuga

SEQ ID NO: 54862 - RNA, 624 nt, Artificial Sequence
  derived and/or modified sequence opt3 from CSF3__Homo_sapiens__NP_000750
auggccggccccgcuacccagagcccuaugaagcugauggcacuccaacuucuguuguggcacuccgccuuauggacagugcaggaggcgacuccacuggggccggcuucuucacuaccccagaguuuccuccugaaaugccuugaacaggucagaaagauccaaggagacggugccgcacugcaggagaaauugguuagcgaaugugccacguacaagcucugccauccugaggaacuggugcugcucggccacuccuuagggauuccaugggcuccccugucuucguguccuucacaggcacuucaguuggccggaugccugagccaacuacauaguggccucuuucuguaucagggucuucugcaggcuuuggaggggauauccccagagcucggacccacccuggauacauuacagcuggacguagccgauuucgcgacuaccaucuggcaacagauggaggaacucggcauggccccugcacuucagccaacacaaggcgcuaugccggccuuugcaucugcuuuccagaggcgggccgggggagugcuggucgcgagccacuugcaguccuuucuagaagugucauaccgcguucugcgacaucucgcccagcccuga

SEQ ID NO: 54863 - RNA, 1599 nt, Artificial Sequence
  derived and/or modified sequence opt3 from CSGALNACT1__Homo_sapiens__NP_001123990
augaugauggugagaaggggccugcucgccuggaucagccgggucguugugcuucugguauuguuaugcugugcuauuuccgugcuguacaugcuagcaugcacccccaagggggacgaggaacagcucgcccugccucgcgcgaacucuccaacaggaaaagaggguuaucaagcuguccuucaggaaugggaggaacagcaccgaaauuacgugucaagucugaagcgucagauagcccaauugaaagaggagcuccaggaaagaagcgagcagcugaggaacggccaguaucaagcauccgaugccgcugggcugggacucgaccggucuccgcccgaaaagacucaggcagauuuacuggccuuccuucauucgcagguugacaaagcugaggugaaugccggcgucaaguuggcgacggaguacgcagccgugccuuuugauucauucacccugcagaagguauaucaacuagaaacaggucucacucgccacccagaggaaaaacccguuagaaaggacaaaagggaugagcugguggaagcuaucgagagcgcccuugagacccugaacaguccugcagaaaauuccccaaaccaucggcccuacacagcuucugacuuuauugaggggaucuaucgcaccgaacgagauaagggaacuuuguacgagcucacauucaaaggcgaccacaagcaugaauuuaagagacugauuuuauucaggccuuuuggcccaaucaugaaagucaagaaugagaaacugaacauggccaauacccucauaaacgugaucgugccgcuugcgaagcgggucgauaaauuccgucaguuuaugcagaauuuccgcgagauguguauugaacaagacgggagaguucaccugacggugguauacuuuggaaaggaggaaaucaacgaggugaaagguauuuuggaaaauacuagcaaggccgcaaacuucaggaauuuuaccuucauccagcuaaacggcgaguucucccgggggaagggacuggaugucggcgcucgauuuuggaaagguucaaacgugcuccuguucuuuugcgacguugacauauauuucacaagugaguuucuuaauacuugucgccugaacacccagcccgggaagaaaguguucuacccugucuuguuuagccaguauaauccaggaauuaucuacggccaccaugaugccgugcccccucucgaacaacagcugguaauuaagaaagagacaggcuucuggagagacuuuggguucggaaugaccugccaguauaggucugauuuuaucaacaucgguggcuucgacuuagauauuaagggguggggaggcgaagacguucaccuguaccggaaguaucuacauuccaaucucauagugguccgcacgccagugagaggucuguuucaccuuuggcacgagaaaagguguauggaugaguugacucccgaacaguacaagaugugcaugcaaucaaaagcuaugaacgaggccagccaugggcagcugggcaugcucgucuuccgucacgaaaucgaggcacaucugcggaagcagaaacagaagacaaguucuaagaaaaccuga

SEQ ID NO: 54864 - RNA, 1629 nt, Artificial Sequence
  derived and/or modified sequence opt3 from CSGALNACT2__Homo_sapiens__NP_061060
augcccagaaggggccugauccuccacacccggacacauuggcuucuguugggguuagcccugcuaugcagccucgugcuguucauguaccuucuggagugugcuccucagacugacggaaacgcauccuugccaggugucguuggcgaaaauuaugggaaggaguacuaucaagcccuccugcaggaacaggaggaacacuaccagacgcgcgcgaccucucugaaacgacaaauugcucagcucaagcaggaguuacaggagaugucagagaaaaugcguagucugcaagaaagaaggaacgugggagccaauggcauagguuaucagagcaacaaggaacaggcaccguccgaucuuuuggaguuucugcauucucagaucgacaaagccgagguaucgauuggggcuaagcuacccucagaauacggagugaucccuuucgagagcuuuacacucaugaaggucuuccaacuggaaaugggccuuacucggcacccagaggaaaaacccgugcgcaaggauaaaagagacgagcugguugaggugauugaagcaggcuuggaggucaucaauaacccugaugaagacgaugagcaggaagacgaggaggggccacucggagaaaagcugauauuuaaugagaacgauuucguggaagguuauuacaggaccgagcgggacaaaggcacacaguacgaauuauuuuucaagaaggccgaucugaccgaguaucgccauguaacucucuuucgacccuucgggccucuuaugaaaguuaagagugagaugaucgacauuacaagauccaucauuaauaucauagugccacuggcugaaaggaccgaggccuuuguccaauucaugcagaacuuucgggaugugugcauucaccaggacaaaaagauccacuugacgguggucuacuucggaaaagaaggccuaucuaagguuaaaagcauucuggaguccgugacuucagagaguaauuuccauaacuauacccucguaagccugaaugaagaguuuaaccguggucgcgggcuuaaugugggagcgagagcaugggacaagggcgaaguccugauguucuuuugugauguggacaucuacuucucugccgaguuuuugaacuccugcaggcucaacgcugaaccgggcaagaaaguuuucuaucccguggucuuuucacuguacaauccugccaucguguaugcaaaccaggagguaccacccccuguugagcaacaguuagugcacaagaaagauagcggguucuggcgggacuuuggauucgguaugacaugucaguaccgaagugauuuucugacuauuggcggguucgacauggaagucaagggauggggcggugaggaugugcaucuauaccgcaaauaucuccacggggaccugauagucaucagaaccccagugcccggccuuuuucacuuguggcaugaaaagaggugcgcugaugagcugacaccggaacaguaccggauguguauucaaucuaaggccaugaaugaggcgucccacagccaucucggaaugcugguuuuccgcgaggaaaucgagacccaccuucauaaacaggccuauagaacgaacucggaagcagugggcuga

SEQ ID NO: 54865 - RNA, 654 nt, Artificial Sequence
  derived and/or modified sequence opt3 from CSH1__Homo_sapiens__NP_001308
auggcccccggcagcagaaccucccugcuccuugcuuucgcacuguugugcuuaccuuggcugcaggaggccggggcggugcaaacagucccacuaucuaggcucuuugaccacgcuaugcugcaggcccaucgggcacaccagcuugccaucgauacuuaccaggaguucgaagaaacguauauuccgaaggaccaaaaauacucauuucugcaugauagucagaccagcuucuguuuuuccgacucuauacccacaccuucgaacauggaggaaacucagcagaagucaaauuuggagcuccugcgcaucagccugcucuuaauugagaguuggcuggaaccaguucgauuccuucguuccauguuugcuaacaauuugguguaugauaccucugacagcgaugacuaccaucugcuaaaagaucucgaggaaggaauccaaacacugauggguagacuugaggacggcuccaggcggaccgggcagauucugaagcagacuuauucaaaauucgauacaaacagucacaaucacgacgcauugcucaagaacuacggacuguuauauugcuuucgcaaggauauggacaaaguagagaccuuccugagaauggugcaguguaggagcgucgaaggcucuugcgguuuuuga

SEQ ID NO: 54866 - RNA, 654 nt, Artificial Sequence
  derived and/or modified sequence opt3 from CSH2__Homo_sapiens__NP_066271
auggccgcuggcagcagaaccucccugcuccuugcauucgcccuguugugcuuacccuggcugcaggaggcgggggcugugcaaacagucccucuaucuaggcucuuugaccacgccaugcugcaggcacaucgggcccaccagcuugcuaucgauacuuaccaggaguucgaagaaacguauauuccaaaggaccaaaaauacucauuucugcaugauagucagaccagcuucuguuuuuccgacucuauaccgacacccucgaacauggaggaaacucagcagaagucaaauuuggagcuccugcgcaucagccugcucuuaauugagaguuggcuggaaccuguucgauuccuucguuccauguuugcaaacaauuugguguaugauaccucugacagcgaugacuaccaucugcuaaaagaucucgaggaaggaauccaaacacugauggguagacuugaggacggcuccaggcggaccgggcagauucugaagcagacuuauucaaaauucgauacaaacagucacaaucacgacgccuugcucaagaacuacggacuguuauauugcuuucgcaaggauauggacaaaguagagaccuuccugagaauggugcaguguaggagcgucgaaggcucuugcgguuuuuga

SEQ ID NO: 54867 - RNA, 387 nt, Artificial Sequence
  derived and/or modified sequence opt3 from CSHL1__Homo_sapiens__NP_001309
auggaggaaacccagcaaaagagcaaccuggagcuccuucacaucucccuguuguuaauugaaucuagacuggagcccgugagguuccuacggucaacauuuacuaauaaccucgucuacgacacgagugauagcgacgauuaucaucugcuuaaagaccuggaagagggcauacagauguugauggggcgccucgaggauggaucccaccugaccggucagacacugaagcagacuuacucuaaauucgacaccaauucgcauaaccacgaugcccucuuaaagaauuauggccugcuucauugcuuucgaaaagacauggauaagguugaaacauucuugcguauggugcaauguagaucaguagaggggagcugcggauuuuga

SEQ ID NO: 54868 - RNA, 1401 nt, Artificial Sequence
  derived and/or modified sequence opt3 from CS__Homo_sapiens__NP_004068
auggcccugcucaccgcugcagccagacuucugggcacaaagaacgcgagcugcuugguguuagcugccaggcacgcauccgccucuucaacuaaucugaaagacauccuagcugaucucauucccaaggagcaggcacggauaaaaacguuccgccaacagcaugggaagaccgucguuggacagaucacaguggacaugauguacgguggcaugcgagggaugaaaggacugguauaugaaaccagugugcuugauccugacgagggcauucguuuuagagguuucagcaucccagaaugucagaagcuguugccgaaggccaaagggggagaggaaccccucccugagggccuguuuuggcugcucgucacuggccacauuccaacagaggaacaaguguccugguuaucuaaggagugggcuaaaagggccgcgcugcccucgcauguugugaccaugcuugauaacuucccuacuaauuugcacccaaugucacagcugagcgcagccgucacagcucuaaacagugaauccaauuuugcccgggcauacgcucaggggaucucucgcaccaaguauugggagcucauauacgaggacagcauggaucugaucgccaaacuucccugcguggcggccaagauuuauagaaaccuguacagggaaggauccgguaucggcgcaauugacucaaauuuggauuggagucauaacuucacgaauaugcucggguauacugaccaccaguuuaccgagcugacacgguuauaccugacuauccacagcgaucaugaaggaggcaacguaucugcucacaccucccaucucguugguucagcccuuagcgacccuuaccugaguuucgcugccgcaaugaauggguuggccggaccacuacacggccuggcuaaccaagaggugcucgucuggcugacacagcuucagaaggaagugggcaaagaugugucugacgagaagcugcgcgacuauauauggaauaccuugaacuccgggcgagucguuccgggauacggucacgcggugcucagaaaaacggaucccagguauacuugucagcgggaguuugcacugaagcauuuaccuaaugacccaauguucaaacugguagcccaacuauacaagauugugcccaacguccuccuggaacagggcaaagcuaagaacccuuggccaaauguggaugcccacagcgggguucuuuugcaguauuacggaaugacagagaugaacuauuacaccgugcuguuuggcgucucgcgugcacucggugugcuggcccaacuuaucuggucucgcgcucugggguuccccuuggaaagaccgaaguccaugucaacugagggccucaugaaauuuguagacaguaagagcggauga

SEQ ID NO: 54869 - RNA, 1353 nt, Artificial Sequence
  derived and/or modified sequence opt3 from CSK__Homo_sapiens__XP_005254222
augagcgccauccaggcugcauggcccuccggcaccgagugcauugccaaguacaacuuccacgggacagcggaacaagaccugccuuuuuguaaaggagaugugcucacuauagucgcuguuacgaaggacccaaauugguauaaagccaagaacaaaguggguagagagggcaucauuccggcaaauuacguacagaagagggaaggggugaaggccggaaccaaacuuucucugaugcccugguuccauggcaagaucacacgggagcaggcugaacgcuuguuauauccuccagagacuggucuguuucuaguccgagagucaaccaacuaccccggggauuauacacucugcgugaguugugacggaaaaguugaacacuaccguauuauguaucaugcaagcaagcuguccaucgaugaggaaguguacuucgagaaucuuaugcagcuggucgagcacuacaccucugacgccgauggcuugugcacuagacucauaaaaccuaaggugauggaaggcacaguagcugcccaagacgaguuuuauaggucggggugggcgcugaacaugaaggaacugaaacucuuacagaccaucggaaagggugaguucggcgauguuaugcugggggacuaccggggaaauaaaguggcagucaaguguauuaaaaacgaugccacggcucaggccuuucuugcagaggcuucagugaugacucaguugcgccauagcaaucuggugcaacuacucggcgucaucguugaagagaagggugggcuguauauugugaccgaauacauggccaaaggaagucuuguagacuaucugagauccaggggccggucuguguugggcggggauugccuccugaaguucagcuuagacgucugugaggcgauggaauaccuggagggaaacaauuuugugcaccgcgaccucgccgcacgaaacguucuuguguccgaagauaaugucgcuaaggugucagacuucggucugacaaaagaggccaguagcacucaggauaccggcaaguugccaguaaaauggacagcucccgaggcccuaagagaaaagaaauuuucuaccaaguccgacguuuggucauucgggauccugcucugggagauauauagcuuuggaagggugccuuacccacggauuccgcugaaggaugucgugccccgugucgaaaaaggcuacaagauggacgcaccugaugguugcccacccgccguguaugagguuaugaaaaacuguuggcaccuugacgcugcgaugcgcccuaguuuccugcaguugagagaacagcucgagcauaucaagacgcacgagcugcauuuauga

SEQ ID NO: 54870 - RNA, 10695 nt, Artificial Sequence
  derived and/or modified sequence opt3 from CSMD1__Homo_sapiens__NP_150094
augaccgccuggagaagguuccagucccugcuccuucuguugggauuacuggugcugugcgcucggcuccugacagcggccaaggggcaaaacuguggaggucuuguccagggccccaaugggacuaucgaauccccuggauuuccacacggcuacccgaacuaugcgaauugcacguggauuauaaucaccggugaacgcaaccguauucagcugucuuuccacacauuugcuuuggaagaagacuucgauauccucucaguuuacgacgggcagccccaacagggaaaucugaaagugagacugaguggcuuucagcucccuagcuccauuguaucuacuggcucgaucuuaacccugugguucacaaccgauuuugccgugucagcacagggguucaaggcccuuuaugaggucuugccaagccacacuuguggaaaccccggugaaauacugaaaggcgugcuacaugggacaagauuuaauaucggagacaagauuagguacaguugccucccuggcuauauccuggagggucacgcuauucuuaccuguaucguuuccccagggaacggagcaucuugggauuuccccgccccuuuuugccgggcugagggcgccuguggcgggacgcugcgcggaacuagcuccucaauaaguagcccacauuucccgucugaauacgagaauaacgcggacugcaccuggacaauuuuggcagaacccggugauacuaucgcccucguguuuaccgacuuccaacuggaggagggcuaugauuucuuagaaauuuccgggacagaggcuccuucaaucuggcugaccggaaugaaucucccaagccccgucaucaguucuaaaaacuggcuuagacugcacuuuacguccgacagcaaucacaggcggaagggcuucaacgcccaguuucaggugaagaaagcaauugaauugaagucgcgcgguguaaaaaugcuaccuucuaaggaugggucccauaaaaauucaguucugagucagggcggaguggcucucgucagcgacauguguccagaucccggcauaccggagaacgggcgacgagccggauccgacuucagggugggugcgaacgugcaauuuucuugcgaagacaauuacguccugcagggcagcaagucaaucacuugucagcggguuacagagacccuugccgcauggagugaucaccguccuauuugccgcgcuagaacuugcggguccaaccugaggggacccagcggcgugaucacaucuccaaauuacccuguacaauaugaggacaacgcccauugugugugggucauaaccacgaccgaucccgacaaggugauuaaauuggcuuucgaagaguuugaacucgagcgggguuacgauacacugacuguuggggacgccggcaaggugggagauacccgaucagucuuauaugugcugacaggcaguagcguaccagaccuaaucguuuccaugucuaaucagauguggcuccaucugcagucggaugacagcaucgggucccccggauucaaagcaguguaccaggaaauugagaaggguggcugcggggauccuggaaucccagccuauggcaaacgcacugguucaaguuuucuucacggggacaccuugacauucgaguguccggcugcguuugaacuggucggcgagagagugauuaccugccaacagaacaaucaguggucuggaaacaagcccagcugugucuucuccugcuuuuucaauuucacugcaucaagcggcauaauccucucuccuaacuacccagaagaguaugggaauaacaugaauuguguguggcugauuaucuccgaacccggaaguaggauccaucuuauuuuuaacgacuucgauguugagccucaguuugacuuccuggccgugaaagaugacggcauaagcgauaucacgguauuggguacauuuucugggaaugaggucccaucccaacucgcuucaaguggacacauugugcggcuggaguuccagagcgaccauucgaccacuggccgcgguuuuaacaucaccuacacaaccuucggccagaacgagugccacgaucccgggauuccgaucaauggaagaagguuuggcgaccguuucuuacugggguccucuguuagcuuucauugugaugacggauucgugaagacucagggcucagaaaguauaacaugcauccuacaagaugguaacgucgugugguccucuacgguaccucggugugaggccccaugcgggggacaccucaccgcaagcuccggcgugauucugcccccugguuggcccggcuacuauaaggacucacuucacugcgaguggaucauugaagccaaaccagggcauagcaucaagauaacuuuugaucgauuccagacagagguuaauuacgacaccuuggaagucagagacggaccugcuaguucuagcccccugauuggcgaguaucacgggacacaggccccacaguuccucaucagcacuggaaacuuuauguaccuguuauucaccacggauaauucgaggucaucuauuggcuuucugauccauuaugaaagugugacccuugaguccgacagcuguuuggauccggguauaccugugaacgggcaccgccacggaggcgacuucgguauccggucuacagucacuuuuagcugcgaucccggcuacacccucuccgacgaugagccacugguuugugaaagaaaucaucaauggaaccacgcacuacccucaugcgacgcgcugugugggggauauauucagggcaaaagugggacagugcucagcccuggauucccagauuuuuaccccaauucucugaacugcacuuggaccaucgaggugucccauggcaaggguguacagaugauuuuccacacguuucaucuugaaucaagucacgacuacuugcugaucacagaggaugggagcuucuccgaaccugucgcuagguuaaccggaucugugcucccgcacacuauaaaagccggccuguuuggcaauuucacagcacaacuucgcuucauuucggacuuuagcaucucauaugagggguucaacaucaccuuuuccgaguacgaucuggaaccaugugacgaccccggaguuccugccuucagucgacggauugguuuucauuucggcgugggggauucuuugacuuuuagcugcuuccucggauaucgucuggagggcgcuaccaagcuaacaugucugggugggggaagaagggucugguccgccccacucccccgcugcguggcagaauguggcgcuucaguuaagggcaaugaggggacgcugcuuucuccuaacuuuccgagcaauuacgacaacaaccacgaaugcaucuauaaaauugagaccgaggccggaaaggguauacauuugcggacuagaaguuuccagcuguuugaaggcgauacauuaaaaguguacgacgggaaggauuccagcucuaggccccucggaaccuucaccaaaaaugagcugcuuggccugauccuaaacucaacuuccaaucaccucuggcuggaauuuaacaccaaugguagugacacggaucagggguuccaguugacauauaccagcuucgaccugguaaagugcgaggauccaggcauuccuaacuacggcuaccgaauccgcgacgagggccauuuuacugauaccgucguguuauauucguguaaucccggguacgcgaugcacggaucuaacacacucacuugccuguccggugaccggagagugugggacaagccacuuccuagcuguauugccgaaugcggcgggcaaauccacgcugcaaccucaggaaggauacugagucccggcuauccagccccguacgauaauaacuugcauuguacauggaucauugaggcugacccugguaaaacgaucucucuccacuucauugucuuugauaccgaaauggcccaugacauccugaagguuugggaugggcccguggacuccgauauacuacugaaagaguggagcggaucagcacuuccagaagacauucacaguacuuucaauagccucacacugcaguuugauuccgacuucuuuaucucuaagagcggcuucuccauccaguuuucaaccucuauugcggccacuugcaacgaucccggcaugccucagaaugggacacguuauggagacagucgcgaggcuggugauaccguaacguuccaaugugacccaggcuaccaguugcaggggcaggccaaaauaacuugcgugcaacugaacaaucgguuuuucuggcagcccgacccuccgaccuguaucgcagcuugcggaggcaacuuaacagguccagccggggucauucucucgcccaacuauccucagcccuacccaccuggaaaggagugugauuggagagugaagguuaaucccgacuuugugaucgcacugauuuucaaaucauucaacauggaaccauccuacgauuuucuucacaucuaugagggcgaagacucuaauucaccucugauaggcagcuaccaagggucccaggccccggagaggaucgaaaguucuggaaacagcuuguuccucgcuuuucgaucagaugcguccgucggucugaguggcuucgccauugaguuuaaggagaaaccccgggaagcaugcuucgacccagggaauaucaugaacggaacccgcgugggcacugauuuuaagcuagguagcacaauuaccuaucagugcgacucuggguacaaaauccuggauccuuccucaauaacauguguuauuggcgcugacggaaagcccagcugggaucaggugcuuccaucgugcaaugccccuuguggcgggcaauauacuggaucugagggugucguacucagucccaacuacccgcauaauuauaccgccggccagaucugccuguacuccaucacggugccaaaagaguucguuguguuugggcaguucgcuuacuuucagacagcauugaacgacuuagccgagcuguucgauggaacccacgcgcaagcuagacuccugagcucacuuuccggcucucauagcggugaaacucugccuuuggccaccaguaaucagauucuacugagguuuuccgcaaagagcggggccucugcucggggcuuccacuucgucuaucaggcagugccccgaacaucagacacucaguguaguuccguaccagagcccagauacggacgcaggaucggcagcgaguuuucugccgggucgauagugcguuucgaaugcaacccuggauaucuccugcaagguucaaccgcgcuucauugucagagcgucccgaaugcuuuagcccaguggaacgacacgauucccuccugcguugugccauguaguggcaauuuuacacagcggagagggaccauccugucuccuggauaccccgagccuuauggcaacaaucucaacugcauuuggaagaucauagugacugaagguagcgggauucaaauccaggucaucuccuucgcaacagagcagaacugggauucauuggagauucacgacggcggagaugugaccgccccaaggcugggcaguuuuucugggacuacaguucccgcucuccugaauagcaccuccaaccaacuuuaccugcacuuccagucagacaucagcguagccgcagcuggauuucauuuggaauauaaaacggugggccuagccgcgugucaggagccugcccugccaucuaauuccauuaagauaggugaucgcuacauggucaacgacgugcucaguuuccagugcgaacccggguacacuuuacaaggacgaagccacaucucgugcaugccgggcaccguuagacgguggaauuauccuuccccacuguguauugcaacaugcgguggcacccuuucuacacuagggggagugauccucucacccggcuuuccugggagcuacccaaacaauuuggauuguacuuggaggaucagucugcccauuggauauggcgcucauauacaguuccucaacuuuuccaccgaggccaaucacgacuuccuggaaauccagaacgguccguaccacacgucuccuaugauugggcaguuuagcggaacagaucuucccgcugcacuacugucaacuacccaugagacauugauccacuucuauuccgaccauagucaaaaucgccagggcuucaaauuagccuaccaggccuaugagcugcagaacugcccagauccucccccauuucaaaaugguuacaugauuaacagcgacuacucugucggccagucaguguccuucgaauguuaucccggguacauccucauaggacacccuguacugaccugccagcauggcaucaaucguaacuggaacuauccauuuccgagaugugacgcucccugcggguacaaugucacuagccaaaacggaaccauuuauucuccuggcuucccagaugaguaccccauccuuaaggacuguauuuggcugaucacagugccuccaggucacgggguuuauauaaauuuuacgcucuugcagacugaagcggugaacgauuacauugcagucugggacggacccgaucagaauaguccucagcugggcguguucucgggcaacaccgcccuagagacagcuuacuccagcaccaaucaaguucugcucaaauuucacucagacuucucuaacgggggauuuuucgugcuuaauuuucaugccuuccagcugaagaagugccagccgccacccgcagucccucaggccgaaauguuaacugaggaugacgauuuugagaucggugacuucgugaaauaucaaugucaccccggcuacacauugguagggaccgauauucugacgugcaagcucagcucccagcugcaguucgaaggaagucuuccaacuugcgaggcucaguguccugcgaacgaagugcggacaggcucaucugguguuauccugagccccggguauccaggaaauuacuuuaacucccaaaccugcaguuggagcauaaaagucgagccgaauuauaacaucaccauuuucguggacacuuuucaguccgaaaagcaguucgaugcccucgagguguuugacggaucuucaggccagagcccuuugcuggucguauuaucggggaaucauacagagcaauccaacuucaccaguaggucuaaccagcuauaccugcgcuggagcacagaccacgcaacuagcaaaaagggauuuaagauccgauaugcugcccccuacuguucccucacgcacccacuuaaaaaugguggcauucugaacagaaccgcaggggccgugggaucuaagguucauuacuucugcaaacccggcuaucggauggugggucacaguaaugcuacauguaggcgcaacccuuuggggauguaccagugggauagccugacuccacucugccaagccgucuccuguggaauccccgaaucaccuggcaauggcagcuuuaccgggaacgaguucacacuggacucuaaggugguuuaugaaugccaugagggauuuaaacuugagaguucccagcaggcgaccgcagugugucaggaagauggucucuggagcaauaagggcaagccgccaacuugcaaacccgucgccuguccuucaauagaggcucaacugucugaacacgugauuuggagauugguauccgggucgcugaacgaguacggagcccagguguuacuaagcugcaguccaggcuauuaccuggaagguuggaggcuccuucggugucaggcuaaugggacguggaacaucggagacgagcgucccucuugccgcguuaucuccugcggcagccugucauucccucccaauggcaacaagauugggaccuugacagucuauggagcaacugccaucuuuaccuguaauacagguuacacccuggugggcagucaugugcgagagugccucgcuaacgggcugugguccggaagcgaaacuagaugucuugccggccacugcgguucuccagauccgauagucaaugggcacauuucaggagacggcuucagcuacagggauacaguuguguaucaguguaacccuggcuuccgguuaguagggacguccgugcgcaucugccugcaagaccauaaauggucuggacagacccccgucugugugccaauuacuugcggucacccuggcaaccccgcacauggguuuacaaauggaagugaguucaaccucaaugauguugugaacuuuaccuguaauaccggcuacuugcugcagggugucucgagagcgcagugcaggagcaacgggcaaugguccucaccacuaccuacaugucggguagugaauugcucugaccccggauucguugaaaacgccauccgacacggccagcagaauuuuccggagagcuucgaauauggcaugaguauacuguaccauugcaagaaaggguuuuaucuccuuggauccucagcucugacuuguauggccaacgguuugugggauagaucucugccaaagugccucgcaaucagcuguggccacccuggggugcccgcuaaugccguccugacgggagaguuauucaccuacggcgcagugguccacuauuccugccgcgguagugagagccuuauugggaacgacacaagggugugucaagaagacucucauuggucaggcgcccugccacacugcacuggaaauaaccccggcuuuuguggggauccuggaaccccggcucaugguucccggcucggcgacgauuucaaaacaaagagccuacugcguuuuaguugcgagauggggcaccaguugagaggaucuccagaaaggaccugucugcucaauggcuccuggucgggucuucagcccguuugcgaggcggugagcugugggaacccuggcacucccacgaacggaaugaucguaucauccgacggcauucuguucucuaguagcgugaucuacgccugcugggaaggguacaagacaucaggauugaugacccgccacugcacugcaaaugguaccuggacaggcacugcuccagauuguaccauuaucuccugcggggacccuggaacacuggccaacggcauacaguucgguacggauuuuaccuucaauaaaacugucagcuaucaauguaaccccggcuacguuauggaggccgugacaucugcaaccauucggugcacuaaggacgggcgauggaauccaaguaaaccugucuguaaggcugugcucugcccgcagcccccaccuguacagaacggaacaguggagggcuccgauuuuagaugggggagcucaaucucuuauucguguauggacggauaccaguuaagccauuccgccauccugaguugcgaaggcagggguguuuggaaaggggagauuccccaaugucuuccaguguucugcggagauccuggcauacccgcggaaggucgccugucuggcaagucauuuaccuauaagagcgaggucuucuuucaguguaaauccccguucauccuaguggggaguucucggagagucugccaggcugacggaacguggagcggcauucagccaaccugcaucgauccugcccacaauacaugucccgacccagggacuccccauuuuggcauucaaaacuccucacguggcuacgagguggguagcaccguuuucuuuaggugccggaagggguaucacauccagggaucuacaacucgcaccugucucgcaaaucugacaugguccggcauacagaccgaaugcaucccucaugccugucgacaacccgagacuccagcucacgcagacguaagagccauugauuugccuacguucgguuacacacugguguacacaugccacccgggcuuuuuccucgcagggggaagugaacauaggacuuguaaagcugacaugaaguggaccggcaaaucacccgucugcaagagcaagggggugcgggagguuaacgaaacagugacgaaaaccccagucccuucggauguguucuuuguaaauucccuuuggaagggauauuacgaguaucugggcaaacgccagcccgccacuuuaacaguggacugguucaacgcaaccucuaguaagguuaaugccacuuuuagcgaggcuucaccagucgaacugaaauugacagguaucuacaagaaggaggaagcccaccuccugcuaaaagcauuccagauuaaggggcaggcugauaucuuuguguccaaauucgagaacgacaauuggggacuugauggcuaugugucuagcggccuggaaagagggggauuuaccuuccaaggugacauacauggcaaggauuuugggaaauucaagcucgagaggcaggacccucugaaccccgaucaggacaguuccagccacuaccacggaacaucuucaggcuccgucgccgcggccauuuugguuccguuuuucgcacugauccucagcgguuuugcuuucuaucuuuacaagcaucgaacucggccuaaagugcaguacaacggguaugccggacacgagaauaguaacggccaagcaucuuucgaaaauccaauguacgauaccaaccugaagcccacggaggcuaaagccguacguuuugacaccacauuaaauacuguguguaccgucguguga

SEQ ID NO: 54871 - RNA, 10824 nt, Artificial Sequence
  derived and/or modified sequence opt3 from CSMD2__Homo_sapiens__XP_011538874
augccccgguccaggggccgggagcuggggcgcugcggcuguccugccggucgagcucguggcgaaaccgggaucuccgcacucgugccaggcgccggcucucgcugggguaggccgcccccuccaacacccccuccacuucuguuguuacuggggugcggacugcucucagucagugcggcugccggccagaauuguacuuuccaacugcacggccccaaugggacgguugagagcccuggauuuccauacgguuauccgaacuacgcaaauugcaccuggacaauuacugccgaggaacagcaccggauacagcuuguguuccaguccuuugcucuggaagaggauuucgauguauugucuguguuugacggacccccucaaccagagaaccuccgcaccagacugacaggguuccagcugcccgcaaccaucgucucggccgcuacuacacucucauuaaggcugauuuccgauuaugccgugagugcgcagggauuucacgcaaccuacgaaguucuuccuucccauacguguggcaauccaggucgguugcccaacgggauccagcaaggaucuacuuucaaucugggcgacaaggugcgcuauagcugcaacuugggcuuuuuccucgaggggcacgccguccugaccugucaugcuggauccgaaaauucagccacaugggauuuuccgcuuccuaguugccgagcagacgaugcuugugguggcacucugagagggcagagcggaauuaucucuagcccccacuucccaucagaguaccacaacaaugccgacugcaccuggacaauauuggcggagcucggcgauaccaucgcccugguguuuauugacuuccaguuagaagaugguuaugacuuccuggagguaacggggacugaaggcagcagucucugguuuacaggagcaucucuuccugcucccguuaucuccagcaaaaacuggcugagguugcauuucaccucggauggcaaucaccggcagcguggguuuucugcccaauaccaggugaagaaacagauugagcuaaagucccgcggagucaaacugaugccaucaaaggacaacagucaaaagacuagcgugcucacacaggugggugucucccagggccauaauaugugucccgacccugggaucccagaaagaggaaaaaggcugggcucugauuuccggcuugguagcucaguucaguuuaccugcaacgagggguacgaccugcaaggcaguaagcgaauaacgugcaugaaaguguccgauauguucgcugccuggagcgaccaccgcccgguauguagagcaaggaugugcgaugcccacuugcggggacccucuggcauuaucaccucaccuaacuuuccaauucaguaugacaauaacgcucauuguguguggaucaucacagcgcucaaucccaguaaggucauuaaacuggcauucgaggaauuugauuuagagcgcggguacgacacucugaccgugggagaugguggccaggacggggaucagaagacaguucuauauauacucacuggaaccagcgugccugaccugaucgucuccacaaaccaccaaauguggcuuuuguuccagaccgacggcucugguucgagccugggguuuaaggccuccuacgaagagauugaacagggcucaugcggagauccaggcauccccgcuuaugggagaagggagggaagucguuuccaucacggcgacacucucaaauuugagugucagccggccuucgaacuggugggucaaaaggcaauaacgugccagaaaaauaaccaguggucugccaagaaaccuggguguguauucagcugcuuuuucaauuuuacauccccaucaggaguugugcuuagccccaacuacccugaggauuauggcaaucaucugcacugugucugguugauucucgcucggcccgaaucucgaauccaccuggccuucaacgacaucgauguggagccacaguuugacuucuuagucauuaaggauggugcaaccgcggaagcuccugugcugggcacuuuuuccgggaaucaacuacccaguagcaucaccucuuccggacauguugccagacucgaguuccagacagaccacucaaccggcaaaaggggguuuaacauuacuuucacaacguuucgccauaaugagugcccagauccgggagugccuguaaacggcaagcgguucggugacagucugcagcuugggagcucgauauccuuuuugugugaugaaggauuccugggcacccaagguucugagacuaucacaugcguccucaaggaaggcagcgugguuuggaacucagcagugcugagaugcgaggcccccugugggggacacuuaaccaguccauccggcacaauucugucucccggguggccuggauucuacaaagacgcucuuagcugcgccugggucaucgaggcacagccaggcuaccccaucaagauuacuuuugauagguucaaaaccgaagugaacuaugacacguuggagguacgcgacggucgaaccuacuccgcuccucucauagggguguaucacggaacacagguuccgcaguuucugaucucaacuagcaacuaccuauaucuacucuucaguaccgauaagucucauuccgacauuggcuuucaacugcgguacgaaacaaucacucuucagagcgaucacuguuuggacccagguauucccgucaauggccagcgucaugggaacgauuucuaugugggagcccuggugaccuuuucgugcgacucaggcuacacguuaucugauggggagccucucgaaugugagccaaauuuccaguggaguagagcgcugcccuccugcgaggcccuuuguggaggcuuuauccaagguagcucugggacaauacugagcccuggauucccggacuuuuaccccaacaauuugaacugcaccuggaucauugaaacuucccacggcaaaggcgucuucuucacauuucauaccuuccaccucgagucagggcacgauuaucugcuaaucacugaaaauggaaguuuuacccagccacugaggcagcucacagguagccgccugccugcucccauuucugcaggccuuuacgggaacuucacggcccagguucgguuuaucuccgacuucucaaugaguuaugagggauuuaauauaaccuucagcgaauacgauuuggagccaugugaggaaccugaggugcccgcuuauuccauuagaaagggccugcaauuuggugugggggacacuuuaacauucucuugcuuuccaggauacaggcucgaaggcaccgcccgaaucacaugucugggcgggcgccggagacuuuggucgagcccgcugccuaggugcguagcagagugcggaaacucagucacugguacccagggcacgcuacucucccccaauuucccagugaacuauaauaacaaucaugaauguauuuacaguauccagacacaacccgggaagggaauacagcugaaagcgcgugccuuugaguugucugagggcgauguucugaagguguacgacgguaacaacaauagcgcucgcuuacucggggucuucucccacucagaaaugaugggagugacccugaacucuacuagcaguucccuuuggcuggacuucaucaccgaugccgagaauacaagcaaaggcuuugaauugcauuucucuucauuugagcucauuaagugcgaggacccuggcacuccaaaauucggguauaagguucacgaugaaggacauuuugcagguuccagugugagcuucucgugugaccccggcuacucucugcggggguccgaggaacuacugugccuuagcggagagagaaggaccugggaucgaccucucccgacauguguagcugaaugcggcgguacggucagaggggaggugucaggacaggugcugaguccaggcuaucccgccccuuacgagcacaacuugaauuguaucuggaccauugaagcagaggccggcugcacuaucgggcugcacuuuuuagucuucgacacagaagagguucaugaugugcuccgcauaugggacggacccguagaaucuggugugcugcuuaaggagcuguccggcccagcuuugccuaaagaucuccacagcaccuuuaacucagucgugcugcaguucaguacugacuuuuucacaagcaagcaaggguuugcgauucaguucuccguuucuaccgccacgagcuguaaugaucccggaaucccacagaacggcuccagaucaggugacucuugggaggcaggggacaguacuguguuccagugcgauccuggauaugcucuacaaggcucggccgaaaucagcugugucaaaauugagaauagguuuuucuggcagccgagcccuccaaccugcaucgcccccugcggcggggaccugacaggacccucuggugugauucuuucacccaacuacccugaacccuauccgccaggcaaggagugugauuggaaaguuaccgugagcccugacuacgucauagcucucguauuuaauaucuucaaccuggaacccggguacgacuuuuugcauauuuaugacggacgggauuccuuaaguccacugaucggcucuuucuacgguagccagcuccccgggcgaauugagucauccaguaauagccuguuucuugcauucagaucugacgccuccgugucaaacgcgggcuuuguuaucgauuauacugagaauccucgcgaaagcugcuucgacccgggaucgauaaagaacggcacaaggguggggucugaucugaaguugggaaguuccgucaccuacuauugucacgguggcuacgagguggaagggacaagcacucuaucaugcauccugggacccgacggcaaaccaguauggaacaauccucgucccguguguaccgcuccuugcggugggcaguaugucggcuccgauggaguugugcucucuccaaacuacccccaaaauuacacgagcggccagauuugucuguauuuugugacagucccuaaggacuacgugguuuucgggcaguuugccuucuuccacaccgcacuuaacgacguaguggagguccaugauggacacagucagcauucccgguuacugagcucucucucagguagucacacuggcgaguccuugccacuggccaccagcaaucaagugcucaucaaauuuucugcuaaggggcuggcacccgccagaggauuccauuuuguuuaucaggcggugccgaggacaucggcuacucagugcucaagcgucccugaaccacgcuacggcaaacgacuugguuccgacuucagugugggggccauuguaagauuugaguguaacucuggcuaugcacugcaaggaagccccgaaaucgagugcuugccugucccaggcgcccuagcucaguggaauguguccgcccccaccuguguugugccgugcgggggaaaccugacggaacggaggggcacaauacucucaccugguuuccccgagccauacuuaaauagucugaacugcgucuggaagauugugguuccugagggggcaggaauccagauccagguggucucuuuugugaccgaacaaaauugggauagccuugagguauucgacggcgcugauaacacugugacaaugcuggguuccuuuucaggcaccacuguucccgcccucuugaauagcacaucuaaccagcuguaucuccacuucuacuccgacauuagugucagcgcggccggguuucaccuggaauacaaaaccgugggacuuucguccuguccagagcccgcagugccuucuaauggcgucaagacgggggaacgcuaucuaguaaacgaugugguuucauuccagugcgagccaggauacgcucugcagggccaugcccacauaagcuguaugccggguacugugcguagauggaauuaucccccuccauugugcaucgcucaaugugggggaaccgucgaggaaauggagggcgugauuuuaagucccgguuuuccuggcaacuacccauccaacauggacugcucuuggaagaucgcacugcccguuggguucggagcccauauucaguuccucaauuuuagcacagaaccuaaccacgauuauaucgagauacggaauggcccguacgaaaccucaaggaugauggggcgcuucuccggaagugagcugccaagcucucuucugucaacaucccacgagacuaccguguauuuucauagcgaccacucucagaaccgacccggcuucaaacucgaauaccaggccuacgaguugcaagaauguccugaucccgagccauuugcuaaugguaucgucagaggggcgggauauaacgugggccagaguguaacguucgagugccugccuggcuaccagcuaacagggcaucccgugcugacuugucaacacggaaccaaucggaacugggaccauccacucccgaagugcgaaguuccuugugguggcaauauuacaucguccaacgggaccgucuauagccccggauuuccaucacccuacucuagcucccaggauugcguguggcuuaucacugugccuauuggccacggugucaggcugaauuuaaguuugcugcagaccgagccaucaggggacuucaucacaauaugggacggaccccagcaaacggcaccucgccucggcguuuuuacuagaucuauggccaaaaagaccgugcagagcuccaguaaccagguacugcuuaaauuccacagggaugcugccacaggcgggauuuuugcaaucgccuucagcgcuuauccgcugaccaagugcccacccccuacuauccucccaaaugcggaaguggucacagagaacgaagaguuuaauauuggagacaucgugcgguaccguuguuugcccgguuucacccugguuggcaacgagauauuaacgugcaagcuagggacuuaucugcaguucgaaggaccucccccaauuugugaggugcauugcccgacaaacgaacuccuuaccgauuccaccggcgucauccugucucaaucauacccugguagcuacccccaguuucagacuuguucgugguugguacgcguggagccagacuauaauauuucccugacaguugaauacuuccucagugagaaacaguaugaugaguuugaaaucuucgacgggccuucuggacaaagcccccugcuuaaggcccucucaggcaacuacuccgcaccacugauagugaccucuaguagcaauuccgucuauuugcgauggucaagcgaucacgcuuacaacagaaaaggcuuuaagauuagguauucugccccuuacugcagucugccccgggcaccguuacauggguucauccuaggacagacauccacucagccagguggcagcauccacuuuggguguaaugccggauaccgccuggugggccacucaauggcuauuugcacgagacauccucaggguuaucaccucuggucugaggccaucccccuuugucaagcgcuguccugcggguugccagaagcacccaaaaacggaauggucuucggcaaggaguacaccgugggcacaaaggccauguauucguguagcgaaggguaccaucugcaggcuggagccgaggcuacugcagagugccucgacaccggucuguggaguaauaggaacguuccuccgcagugugugccaguaacaugccccgaugugucuuccauuagcgucgaacacggccgguggcgacuuauauuugagacccaauaucaguuccaggcccaguuaaugcugaucugcgacccuggguacuauuacacuggacaaagaguuauucgcugucaggcuaauggcaaauggucacucggugauaguacgccaaccugcaggaucaucuccuguggggaauugccaauuccucccaacggacaucggauaggcacacugagcguguacggcgccacugcaaucuuuucuugcaauucaggguauacccuagucggaagccgugugagagaguguauggcgaacggucugugguccggcucugagguaaggugccucgccgggcacuguggaacaccagaaccuauugugaauggccacaucaacggugagaauuacaguuaucgcgggucgguuguguaccagugcaacgcuggauuccggcuuauuggcaugagcguccgaaucugucagcaagaccaucacugguccggcaagaccccguuuugcgugcccauaacuugugggcauccaggaaacccugucaauggucugacacagggcaaccaguucaauuugaacgacgugguuaaauucguaugcaaucccggguauauggccgaaggagcagcuagaucacagugccuggccucuggccaauggagcgauaugcucccaacguguaggaucauuaacugcaccgacccuggucaccaggagaauagugugcgccagguccaugcauccgggccccaccgguuuucauucggcacuacagugucuuacagauguaaccacggauuuuaucuguuaggcaccccgguucuuagcugccaaggggauggaaccugggaccguccaaggccucagugucugcucguguccugcggucaucccggcaguccaccccacagccagaugucuggggauucauacacagucggagccgugguacgguacuccuguaucggcaagcgcacucuaguggguaauagcacgcgaaugugcgggcuggacggccauuggaccggaaguuugccucacuguucuggcacauccguuggggucugcggagaucccgguauuccagcucacggcaucagacugggggacucguucgauccuggaacugugaugagguuuagcugugaagcgggccaugugcuccgggguucauccgagagaaccugccaggccaacggcucuuggagugggagccaaccggagugcggagucauaucauguggcaaucccgggacaccauccaacgcaagaguuguguucagcgacggacuuguauuuucuaguuccauuguguaugaaugcagggagggcuacuaugcuaccggucuguugagccgacacuguucagucaaugggacuuggacgggaucugauccugaaugccuggugaucaacuguggcgaccccgguauuccagccaauggccuccgguuagggaacgauuuccguuacaacaaaacaguuaccuaucagugcgugccuggauacaugauggagucgcauagagucagcgugcuguccuguacuaaggaccgcaccuggaauggcacaaagcccguaugcaaagcccuuauguguaagccgccuccacugauccccaacgggaaaguugugggaagugacuuuauguggggaucuucagucacuuaugcaugccuagaagguuaccagcucagccugccugcuguguucaccugugaggggaauggauccuggacaggcgaguugccacagugcuuucccguguucugcggugauccuggcgucccaaguagggggcggagagaagaccgcggauucucuuacaggagcuccguuucauuuagcugucaucccccgcuggugcucguaggcucuccucgacgguucugccaauccgaugggacguggaguggaacccagcccucauguauagacccaacucuuacaaccugcgccgaucccggcgugccucaguuugguauccagaacaauagccaaggguaucaggucggaucgacugugcuguucagaugucagaagggcuacuuacugcaaggcuccacaaccaggacgugcuugccaaaccucaccuggucugggacacccccugacuguguuccacaucacugccgccagccggagacucccacccacgcgaaugugggagcucuggaucuaccuaguauggguuauacacuuauuuacagcugucaggaaggcuuuucacugaaagggggauccgagcaucguacuugcaaggccgacggcucuuggaccgguaaaccacccaucugucucgcagaaguccggccuagcgggagaccaauuaacacagccagggagcccccgcugacccaggcuuugaucccuggagauguguucgcaaagaauagucuguggaagggcgccuaugaguaccaaggcaaaaagcagccagcgaugcuccgcguaacuggguuucagguugcuaacuccaaagugaaugccacgaugauagaccacagcggagucgaacuucaucuggcagguacauauaagaaagaggauuuccacuuacugcuacagguguaccaaauuaccggccccguugaaaucuuuaugaacaaguucaaggacgaccacugggcccucgaugggcaugugucuucagaguccagcggagcuacuuuuaucuaccagggcagugucaaaggucagggguucggacaguuuggcuuccaacgacuggaccuacggcuucuggagucugauccugaaucaauuggcagacacuucgccuccaauagcucgucuguggcagcugccauccucguacccuuuauagcgcugauuaucgccggguucguguuguauuuauacaagcauaggcgcagaccaaaagucccguuuaacggauaugcaggucacgagaauaccaacguucgggcuacauucgaaaacccuauguacgacaggaauauucagcccacggauaucauggccagugaggcagaauuuaccguguccacugucugcacagcuguguga

SEQ ID NO: 54872 - RNA, 10617 nt, Artificial Sequence
  derived and/or modified sequence opt3 from CSMD3__Homo_sapiens__NP_443132
augaagggcauccgcaaaggggaaagcagggccaaggaauccaaacccugggaaccuggaaagcggcgcugcgcuaaauguggucgacuggacuucauucucaugaagaagaugggcauaaaaucuggguuuaccuucuggaaccuuguguuucuguugacuguaucaugcguuaagggauucaucuacacuuguggcgguacguuaaaagggcugaauggaaccauugaaaguccaggcuuuccguauggcuaccccaacggggcaaauugcacaugggugaucauugccgaagaacguaacagaauccaaauaguauuccagagcuucgcgcuagaggaggaauaugauuaccucucccuguaugacggacacccucauccaacuaauuucaggacccggcuuaccgguuuucaucugccaccuccagugaccucuacuaagucggucuucucauugcgccucacaagcgauuuugcugugagugcccacggcuucaaaguuuacuaugaggaacugcaguccucuagcugugggaaccccggagugccuccaaagggcguccuguacgguaccagauuugacgugggggauaagaucagguacuccugcguaacgggauauauucucgacggccacccgcaguuaacuuguaucgcaaauucaguuaacaccgccaguugggauuuccccgugccuauuugccgggcugaggacgcauguggcgggacaaugcgcggaagcucugguaucauauccucacccagcuuccccaaugaguaccauaacaaugccgauugcacuuggaccauugucgcugaaccuggcgacacaaucagucugauuuuuaccgauuuccagauggaggaaaaauaugacuaccuugagaucgaagggucugagccacccacgaucugguuguccggaaugaacauuccgccucccauaaucagcaauaagaacuggcugcgacuacacuuugugacugauucgaaucacagauauaggggcuucucugccccauaccaagugaaaaaggcgauugacuuuaaaucccgggguuucaagcucuuuccugggaaagacaacucaaacaaguucaguauccugaaugagggcggaauaaagacagcaagcaaccuuugucccgauccaggcgaacccgagaaugggaaacguauuggauccgacuuuucucuggguagcaccguccaguucucaugcgaugaagacuauguuuugcagggcgccaagaguaucacuugccagcgcaucgcugagguguuugccgcaugguccgaucauagaccuguauguaaagugaagacaugcgggagcaaccuccaaggaccaucuggcaccuucacgucaccgaauuuucccuuccaguacgacaguaacgcucagugugucugggugauuaccgccguuaauacaaacaaagugauccagauuaauuucgaagaguuugaucuggagauagguuacgacacuuuaaccaucggggauggcggagaagucggcgacccuaggacagugcugcaaguacucacugggagcuucguuccagaucuuauuguguccaugucuucgcagauguggcugcacuugcagaccgacgagagcgucggauccguggguuuuaaggucaacuauaaggaaaucgagaaagaaucaugcggcgaccccgggacaccucuauacggaauccgggagggcgaugguuucaguaaucgagacgugcugcgcuuugagugucaauucggguuugaacucauuggcgagaagucuauaguuugccaggaaaacaaucaguggagcgcgaacaucccaauuuguaucuuccccugccuguccaauuuuaccgccccgaugggaacugugcuuucaccugauuauccagagggcuacgggaacaaccugaauuguauuuggacgaucauaagcgaccccggaucuagaauccauuuguccuucaacgauuuugaccucgagagucaguucgauuuucuggcaguaaaagacggcgauagcccugaaucucccauuuuagguacauucaccggggcugaggucccaucccaccugacuucaaauagucacauccuaaggcucgaguuccaagccgaccauagcaugucgggacggggcuuuaacauuaccuauaauacauucggucacaacgagugcccugaucccggcaucccaauaaaugcucgcagauuuggggacaacuuccagcugggauccucuauuagcgugaucugugaagagggcuuuauuaagacccaggggacugagacaaucacgugcauacuuauggauggaaaaguuauguggucaggcuugaucccgaagugcggugccccuugugggggacauuucagugcacccuccggcgugauucugucuccagguuggcccggcuacuauaaggacagccucaauugcgaaugggucaucgaggccgaaccugggcacuccauuaaaaucaccuuugagagguuccagacugaacugaacuacgacgugcuugagguacaugauggaccaaaucuguugucaccccuccugggcagcuacaacgggacacaagugccucaguuuuuauucaguucuuccaauuuuauauaucugcuauucaccacagacaacagccguucgaauaacggauucaagauucacuacgagucaguuacugucaacaccuauucuugucucgauccgggcaucccagugcacggucggcgauacgggcaugacuuuaguaucggauccacggugagcuucucuugcgauagcggcuauagacugucccacgaagaaccccuuuugugugagaaaaaucauugguggucacacccucugccaaccugcgacgcucucugugguggcgaugucagggggcccaguggaacaauucugagcccuggcuacccggaguuuuaucccaacucuuuaaauugcacuuggaccguugacgugacacacgggaagggagugcaguucaacuuucauacuuuccaccuggaagaucaucacgacuaccuuuugaucaccgagaauggcuccuuuacgcagccacucgcgcgccugacagguucagaucuaccucccaccauuaacgcagggcuguacggaaauuuccgggcccaacucagauuuauaagugacuucagcaucuccuaugagggcuuuaacauuacuuucucugaauacaaucuggagccaugugaagauccuggcaucccccaguaugggucgaggauuggauuuaacuucgguaucggcgacacacuuaccuucagcugcucauccggguaccgcuuggagggaacaagugagauaaucugucugggcggugggcgacggguauggucugcuccauuaccgcguugcgucgccgaaugcggagcaagcgccaccaauaacgagggcauucuccuguccccuaauuauccccuuaacuacgaaaauaaccaugaguguaucuauucaauucaggugcaggcuggcaaagggaucaacauaucugccagaacauuucaccuggcacaaggagacguuuugaagauuuacgaugguaaggacaaaacgacccaccuccugggcgcguucacuggggcuagcaugaggggacuaacacugaguuccaccagcaaucagcucuggcuggaauuuaacucugauacagagggcacugacgaggguuuccagcuuguguacaccucauuugaauugucccauugcgaggauccagggaucccccaauucggauauaagaucagugaccagggccacuuugccggcagcacgauuauauacggguguaauccuggauauacacugcaugguucgucuuuacucaaaugcaugaccggcgaacgccgggcaugggauuacccacugcccuccuguaucgccgagugcgggggaagauucaagggcgaaagcucagguaggauucuuaguccuggguauccguuuccauacgacaacaaucugcgauguauguggaugaucgaggucgaucccggaaacauugugucucuacaguuccucgcuuuugacacugaggccucccacgauauccugcgcguuugggacggcccucccgaaaaugacauguugcugaaagagauaagcggcucauuaaucccagaagggauucauaguacccucaacaucgugacaauucaguucgauacugacuuuuauaucagcaaguccggauucgcaauacaauucucuagcuccguagcuaccgccugccgggauccugguguccccaugaauggcacaagaaacggggacggaagggagccaggcgauacggugguguuucagugugacccugguuacgaacugcagggggaggagcguauuaccugcauccaggucgaaaaucgcuacuucuggcaaccgucacccccaguuuguaucgcgccuugcggaggcaaccuuacuggcucuaguggguuuauucugucgcccaauuucccacacccuuauccccacagccgggauugcgacuggacaaucaccgugaacgccgauuacguaauauccuuggcuuuuauuucuuucucaaucgagccgaauuaugacuuucucuacauuuaugauggaccagacagcaacuccccucugaucgguaguuuccaggauucuaaacuacccgaaagaauagagagcucauccaauacuaugcaucuggcauuuaggagugacggcagcgugucuuacacaggguuccaccuugaguauaaggccaagcuccgagaauccuguuuugacccaggaaacauuaugaacggcacccggcuggguauggauuacaaauuggggucaacggucacuuacuauugcgacgcuggcuacgugcugcagggauauagcaccuuaacauguaucaugggcgaugacgggcgccccggauggaauagagcccucccuucgugccaugcaccgugugguucuaggaguaccggcuccgaggggacuguucugagccccaacuacccaaagaauuauucagugggacacaacugcgucuacuccaucgcggugccuaaagaguucguuguguuuggccaguucgucuucuuucaaacaucucuucacgauguaguggagguuuaugacggucccacccagcagagcagucuguuguccagccucucugggucacauaguggcgaaucccugccucuaagcucuggaaaucaaauuacaauccgguucacuucggugggcccaauuaccgccaagggguuucacuucgucuaccaggcugugccccgaacgucaagcacacaguguuccaguguaccugagccaagauuuggacgcaggauagguaacgaguucgccgugggcucuagcguccuguuugauugcaaucccggguacauccuucauggauccauugcaauccguugugaaaccguuccgaacucacucgcucaguggaaugacagucugccuacuugcaucgugccauguggcgguauuuugaccaaacggaaggggacaauauuaucucccggcuauccugagccauacgauaacaaucugaacugcguguggaagaucacuguccccgaaggagccggcauucaagugcagguugucagcuucgcaaccgagcacaauugggacucccucgauuuuuaugacgggggagauaacaaugccccgagacugggcucauacagcgguacgacaaucccucaucuucugaacucuaccuccaacaauuuguaucuaaacuuccagagugacauuagcgugucggcugcgggguuucaccuggaauacacugccaucggacucgacuccugccccgagccacagacaccuucuucaggcauaaaaaucggugauagguauauggucggcgacgugguuagcuuccaaugugaucagggguacagucugcagggacacucccauauuaccugcaugcccggcccagugcgccgauggaauuaccccaucccuauuugucuugcacagugcgggggagcuaugucugacuuuagcggcgucaucuuaucaccagguuucccggggaacuaucccuccagucuggauuguacuuggacaauaaaucucccuauuggauucggcgugcacuugcaauuuguaaacuucagcaccgagacgauccaugacuaccuggaagucagaucugguucauccgagacuagcaccgugauuggccggcucucugggccacagauccccaguucgcuguuuuccacaacccacgaaacaagccuuuauuuccacucagauuacucucagaauaagcagggauuucauauaguuuaucaagccuaccagcugcagagcugcccugacccaaggcccuuccgcaacggcuuugugaucgggaaugauuucacugucggacaaaccauuuccuuugaguguuucccuggcuauacguugaucgguaacagugcccuaacaugccugcacggggugucacguaauuggaaccauccgcucccaagaugugaggcuuuaugcggaggcaauauuacugcaaugaacggcaccaucuacucucccggguacccugacgaguaucccaauuuucaggauuguuucuggcugguucgggugccaccuggaaacgguauauacauuaacuuuacaguccuucagaccgagcccaucuaugacuucaucacugugugggacggcccagaucagaauagcccgcaaauugggcaguucuccggaaacaccgcccuggaaaguguauacagcacauccaaucagauccucauaaaauuucacucugacuucacgacuucaggcuuuuucguguugagcuaucaugcguaccagcugaggguuugccaaccucccccacccgucccuaacgcugagauucucaccgaagaugacgaguuugagaucggugauauuauccgcuaucagugccugccaggguucacacuugugggaaaugccauacuaaccugucgacugggcgaaagauugcagauggacggcgcacccccugugugccaggucuuauguccggccaacgagcugcggcucgauucgacugggguaauccuguccccaggauaccccgacaguuacccuaaucuucaaaugugcgcuuggucuauuagcguggaaaaggguuauaacaucacaauguuuguugaguucuuucagaccgaaaaagaguucgaugugcugcaggucuacgacggcccaaauauucaaucacccgugcucaucuccuugucuggggauuauaguagcgcauuuaacauuacguccaauggacacgagguuuuccugcaguggucagccgaccacggcaacaauaagaaggguuuuaggauccgcuacauagcguucuauuguagcacuccugaaucucccccacauggguacauuaucagucagacaggaggccagcuaaacuccguggucagaugggcuugcgauaggggcuuccggcugguggggaaaagcucagccguaugucguaagucuuccuauggauaccacgcaugggacgccccggugccugcuugccaagccaucucgugugguauucccaaagcaccaaccaauggcgggauacucaccacugacuaccuuguuggaacacgcgucaccuauuuuugcaacgauggcuaccgacugagcaguaaggaguuaacaacugcugugugucagucugacgguacgugguccaaccauaauaaaaccccuagaugcguggucaucagcuguggggaauugcccacaccaccuaacggaaauaagauuggcacucagaccucauauggcaguacagccaucuuuaccugcgaucugggguuuaugcucguuggauccgcggugagggagugccugagcucuggucuuuggucagaaagcgagacucggugucuggccggccacugcgggauucccgagcucaucguaaacggacaggugauaggcgaaaauuacgguuaucgcgacacggucguguaccaauguaacccgggguucagauugaucggauccucuguuaggauuugccagcaggaucacaauuggaguggccagcugccaucgugugugccugucagcugcggccaucccggguccccaaucuauggacggaccucagguaacggcuuuaauuucaacgacguagugacauuuucuuguaauauuggguacuuaaugcaaggacccacuaaggcacagugccaggcuaaccgacaguggagccacccuccgccaauguguaaaguugugaauugcagugaucccggcaucccugccaacuccaagagagagucaaaaauagaacaugguaauuucaccuacgggacagucguguuuuaugacuguaaccccggauacuuccuauuuggcucuagcguccugauuugccaaccaaacggccagugggauaagccucuccccgagugcaucaugaucgacugugggcacccaggagugccuccgaaugcuguucuuuccggugaaaaauauaccuucggcaguacugugcauuacagcugcacagggaagcgcucucuguugggacagucauccaggacgugucaacugaacggccacuggagcgguagucagccccacugcucuggggaugcaaccggcacuuguggagacccaggcacaccugggcauggaucccggcaggagucgaauuuccguaccaaaagcaccguaagauaugccugcgacacagguuacauucuccacggcucagaggaaaggacuugucuggccaacggguccuggacgggacgccagcccgagugcaaggcugugcaauguggcaauccagguaccacagcgaacgggaaggucuuucggauagauggcacuaccuucucuaguagcguuaucuauucaugcauggaaggauacauucuuuccggcccuagcgugcgacaguguacagcaaaugggaccuggucuggaacucuccccaacugcacgaucauuaguugcggugacccgggcaucccagccaaugggcugagauacggagaugacuaugucgugggccagaacguauccuacaugugucagccugguuauacaauggaguugaauggcagcaggauaagaaccugcacuaucaacgggaccuggucaggagugaugcccacaugucgggcuguuacuugcccaacacccccucaaauuucuaauggcagacuggaggggacaaacuuugauuggggauucucgaucagcuacauuuguucccccggcuaugaauuaaguuuuccagccgugcuaacgugcgucgguaaugggaccuggucuggagaggugccucagugucugccgaaauucugcggcgaccccgguaucccagcacagggcaagcgugaagggaaaucauuuauuuaccagagcgaggucuccuucaguuguaacuuuccuuucauacucgugggaucuagcacuaggaucugccaagccgauggcacaugguccgggucaagcccccauuguauugaaccaacccagacuucuugcgagaacccuggaguuccccggcacggcucccagaauaacacauuugguuuccaaguagggagugugguccaguuucauugcaagaaaggacaccuucugcagggcucaaccacgcgcaccuguuugccggaccugacauggagcgguauccagccugagugcaucccacacucguguaagcaacccgaaacuccugcucaugcgaaugugguuggcauggaucucccaucccacggguacacccugauuuauacaugccagcccggauucuuccuugccggcgggacugagcaucgaguguguagaucugacaacaccuggacaggaaaggucccuauaugcgaagcaggcaguaaaaucuuagugaaggauccaaggcccgcucuggguaccccgagcccuaaacucucaguacccgacgauguguuugcccagaauuacauuuggaagggguccuauaacuucaaaggacggaagcagccaaugacuuugacgguuacaucuuuuaaugcaagcaccggccgcgucaacgccacucugaguaauuccaacauggagcuacugcucagcggcguguacaagucucaagaagcuagacuuaugcugaggaucuauuugauuaaagugcccgcccacgcgucagucaagaaaaugaaggaggagaauugggcaauggacggguucguuuccgccgaaccugacggagcuaccuacguguuucaggguuucauccagggcaaagauuaugggcaguuuggacugcaacgacucggccugaacaugagcgaggguaguaauucuucaaaccagccacacgggacaaauuccagcucgguagccauagcuaucuuagugcccuucuuugcacuuauuuucgccggauuuggcuucuaccuguacaagcagcggacggcuccuaagacccaauauacuggcuguucuguccaugaaaacaacaaugggcaggccgcauuugagaacccaauguacgacacaaaugcgaaaaguguggaaggaaaggccguucguuucgauccgaaccucaauaccgugugcacuauggucuga

SEQ ID NO: 54873 - RNA, 531 nt, Artificial Sequence
  derived and/or modified sequence opt3 from CSN1S1__Homo_sapiens__NP_001020275
augagacugcucauccuuaccugccugguggccgucgcuuuggcaaggcccaaguuaccucugcgguacccagagcgccuacagaacccgagcgaauccucugagcccauuccucucgaaucacgagaggaauauaugaauggcaugaaccguagaaauauacugagggagaaacaaacagacgagaucaaggauacucggaacgaaaguacgcagaauuguguuguggccgagccagagaaaauggaaagcuccauuucuucgucaagcgaggaacaguucugccgccuuaacgaguacaaucagcugcaauugcaggcggcucacgcccaggaacagaucagaaggaugaacgagaauagucauguacaagugcccuuucagcagcucaaccagcuggcagccuauccuuacgcugucugguauuacccacaaauuaugcaguaugugcccuucccuccauuuuccgacaucucuaauccgaccgcacacgaaaacuacgagaagaauaacguuaugcugcagugguga

SEQ ID NO: 54874 - RNA, 681 nt, Artificial Sequence
  derived and/or modified sequence opt3 from CSN2__Homo_sapiens__XP_011529920
augaaggugcugauccucgccugccuugucgcucuggcauuggccagagagaccauugaaagccuguccucuucagaggaaaguauaacagaguacaaacagaagguugaaaaagugaagcacgaggaccaacagcagggcgaggaugaacaucaggacaaaaucuaucccagcuuccaaccucagccacugauuuacccguuuguagagcccaucccuuauggguuccuaccacagaacauucucccccuggcgcagccugcugugguccuuccagugccccaaccugaaaucauggagguuccaaaggccaaggauacuguguacacgaaaggaagggucaugccggugcugaagucccccaccauaccauuuuucgacccucagauccccaaauugacagaucucgagaaucugcacuuaccucucccauuacugcagccccuuaugcagcaaguaccgcagccuauuccccagacuuuggcacugccaccucaaccccuauggucuguuccacagcccaaggugcucccuaucccacagcaggucgugccguauccccaacgggccgugccuguccaggcucugcuucugaaccaggaauugcuccugaauccaacccaucagauuuaccccguuacacaaccuuuagcaccagugcacaaccccaucucgguauga

SEQ ID NO: 54875 - RNA, 549 nt, Artificial Sequence
  derived and/or modified sequence opt3 from CSN3__Homo_sapiens__NP_005203
augaaguccuuccugcucguggucaacgcccuugcucugaccuugcccuuuuuagcaguugaggugcagaaucaaaaacagccugccugccacgaaaacgacgagagaccauucuaccagaagacagcgccguauguacccauguacuaugugccuaauagcuacccauauuacggcacuaaccuguaucagaggcggcccgcuaucgccauuaauaacccuuacgucccacgcacguacuaugcaaaucccgccgugguucgaccucaugcucaaauaccacagcgucaguaccuaccgaacucucacccaccuaccguggucagaaggccaaaucuccaucccucauuuaucgcaauuccucccaaaaagauccaggauaaaauuaucauacccacaaucaacacuauugccaccguggaaccgaccccugcucccgccacagagccaacuguagacaguguugugacaccugaagcguucagcgaguccaucauuaccucuacgcccgagacuaccacagucgcagugacuccacccaccgccuga

SEQ ID NO: 54876 - RNA, 1098 nt, Artificial Sequence
  derived and/or modified sequence opt3 from CSNK1A1__Homo_sapiens__NP_001020276
auggccagcuccucuggcucaaaggcugaguucaucgucgggggaaaauacaagcuggugagaaaaauugguaguggcagcuuuggggacauauaucucgcaaucaacauuaccaauggagaagagguugccgugaaacuugaaucccagaaggcgaggcacccccaacuguuguacgagucuaaguuauauaagauccugcagggcgguguagggauuccucauauccggugguacggacaggaaaaagauuauaacgugcuagucauggaccuccugggcccaucgcuugaggaucuguucaauuuuugcucacgccgauucacaaugaagacuguguugaugcucgcugaccagaugauaagccguaucgaguacguucacacgaaaaacuuuauucauagagauaucaagccggacaauuuccugaugggcauugggaggcacuguaacaaaugccuggaaagucccgugggaaagcggaagcgcuccaugaccgucucuacaagccaagauccuuccuuuucaggucucaaucaguuauuccugaucgacuuuggccuugccaaaaaguauagagauaacaggacucggcagcauauaccauaccgcgaggacaaaaauuugaccgggacagcacgauacgccaguauuaacgcucaccugggaaucgaacagagcagaagggaugacauggagucucuaggcuaugugcucauguacuucaaucggaccucccugcccuggcaaggucuuaaggcagccacuaaaaagcagaaauaugagaagauuucagaaaagaaaaugagcacaccuguagagguucuguguaagggguuuccagcugaguucgccauguacuugaacuauugccguggacuccgcuuugaagaagcgcccgauuacauguaucugagacaguuauucaggauccuguuccggacccucaaucaccaguacgacuacacguuugacuggacuaugcuuaaacaaaaggcagcccagcaggcugccaguucuuccggccaaggccagcaggcacagaccccuacagggaaacaaacugauaagaccaagagcaacaugaaaggauucuga

SEQ ID NO: 54877 - RNA, 1248 nt, Artificial Sequence
  derived and/or modified sequence opt3 from CSNK1D__Homo_sapiens__NP_001884
auggagcugagagugggcaacagguaccggcucgggcgcaagaucggaagcgguuccuucggcgacauuuaucuugggaccgauauagccgcuggagaagaggucgcaaucaaacuggaaugcguuaagacaaaacacccccaguugcauauugagucuaagaucuacaaaaugaugcaaggcgguguggggauuccuacuauccgaugguguggagccgaaggcgacuauaauguaauggugauggaguuacugggcccaucacuagaggaucucuuuaacuucugcagucguaaguuuagccugaagacgguccuucuguuggcggaccagaugauauccagaaucgaauacauucacucuaaaaauuucauccauagggaugugaagccggacaacuuucucauggggcuggguaaaaagggaaaucugguuuauauuaucgauuucggccucgcuaaaaaguaccgggacgcccgcacccaccagcauauacccuauagagagaacaagaauuuaacagggacugcaagguacgccucgauuaacacccaccugggaaucgaacagucacggcgcgaugaccuugagagcuugggcuacgugcugauguauuuuaaucuagguagucucccuuggcaagggcugaaagcugcaacaaagcgacagaaauacgagagaauuuccgaaaagaaaaugucuaccccaaucgagguccuuuguaagggauaucccagcgaguucgccacuuaccugaacuuuugcagguccuugcgguucgaugacaaaccugauuauucauaccuccgucagcuguuucgcaauuuauuccacagacagggcuuuaguuaugacuacguguucgacuggaacaugcugaaguucggcgcuagcagggccgcggaugacgcagaacgggaacgacgcgauagagaggagaggcuccggcauucucgcaauccagccacaagagggcuucccuccaccgcuucaggaaggcugcgugguacgcaagaaguagccccuccaacuccguugacccccacaagccacacugcaaacaccaguccucggccaguuucuggcauggagcgagaaagaaagguguccaugaggcuacaucgcggggcucccgucaauaucagcucgucugaccugacaggacggcaggauaccuccagaaugucaacgagucagauuccuggcaggguggccagcuccggucuccagucugugguccaccgcuga

SEQ ID NO: 54878 - RNA, 1272 nt, Artificial Sequence
  derived and/or modified sequence opt3 from CSNK1G3__Homo_sapiens__NP_001026982
auggagaacaagaaaaaggacaaagauaagagcgacgauagaauggccaggcccuccggccggucugggcacaauacccgcggaacagguucaaguagcuccggcgugcugauggucgggccuaacuuccgaguuggcaaaaagaucggaugugguaauuuuggggaacuccgucuuggaaagaaccuguacacuaaugaguauguggcuauuaaauuggaaccaaugaagucuagagcaccgcaguuacaucuggaguacagguucuauaaacaacuaggcucgggcgacgggauaccccagguauacuauuuuggaccuugugguaaguacaacgccauggugcucgaacugcuuggcccaucacuggaggauuuguucgaccucugcgaucggacguuuagccugaaaaccguccugaugaucgcgauucagcucaucagucgcauggaguaugugcacuccaagaauuuaauuuacagagacguuaagcccgaaaacuuccugaucgggaggccuggaaauaaaacacagcaagugauacauaucauugauuuuggccuugcuaaggaguacaucgacccagaaacuaaaaagcacauucccuaucgggagcauaaaucuuugaccgguacagcccgcuacaugagcaucaacacccaccuggggaaggagcagucccgaagagaugaccuagaagcacucggacacauguucauguauuuucugaggggcucacuuccuuggcagggccugaaagccgauacuuugaaggagcgguaccagaagauaggggacacaaaacgugcuaccccaauugaaguccucugugagaauuucccggaaauggcaacguaucugcgcuacgugagaagguuagacuuuuucgagaagcccgauuaugacuaccugcggaaacucuuuacugaucuuuucgaccgaaagggauacauguucgauuaugaguacgacuggaucgguaaacaacugccuaccccaguaggcgccguucagcaggaucccgcuuugaguagcaaccgcgaagcccaucagcacagagacaagaugcaacagucuaagaaucagguggucuccucaacaaacggggagcuaaauacugaugacccuaccgcgggaaggagcaacgcaccaauuacagcccccaccgaaguggaggugauggaugaaacgaacugccaaaaaguccugaauaugugguguugcugcuuuuucaagcggcgcaaaagaaagacuauccagaggcauaaauga

SEQ ID NO: 54879 - RNA, 1176 nt, Artificial Sequence
  derived and/or modified sequence opt3 from CSNK2A1__Homo_sapiens__XP_011527477
augagcggccccgugccuuccagagccagggucuacaccgacguuaacacacaccggccacgcgaguauugggauuacgaaucucaugugguagagugggggaaucaggacgauuaucaacuggugcgaaagcucggacgugguaaauacucagaagucuucgaggcuaucaacauuacuaauaacgaaaaggugguugugaaaauacuuaagccggucaaaaagaagaaaaucaagagagagauuaaaauccuggagaauuugaggggcgggcccaacauuaucacguuagcagacauagugaaggauccuguaagucggaccccagcccugguuuuugaacacgugaauaacacagacuucaaacagcuauaucagacucucaccgauuacgacauccgcuuuuauauguacgagauucugaaggcgcuugauuacugccauagcaugggaaucaugcacagagacgucaagccccauaaugugaugauugaucacgaacacaggaaacugcgguugaucgacuggggccucgcugaguucuaucauccuggucaggaguacaacgugcgcgucgccucccgauauuuuaaggggccagaacugcugguugauuaccaaauguaugacuacucucucgacauguggucguuaggauguaugcuggcaucaaugauauucagaaaagagcccuuuuuccacggccaugauaauuaugaccagcuugugaggauugccaagguauugggcacagaagaucuguacgacuacaucgauaaauauaacauugagcuagacccucgguuuaaugauauccucgggcgucacagccgcaagagaugggaaagguucgugcacagugagaaccagcaucuggucuccccagaggcucuugacuuucuggauaaauugcuccgguacgaccaccagucucgacugaccgcacgcgaagccauggagcauccguauuucuacacugugguuaaggaucaagcuagaaugggaagcuccucaaugcccgguggcaguacaccugugagcucugccaauaugauguccgggaucucaagcgucccaacccccaguccuuuaggaccacuggcgggcucucccgugauugcagccgcuaacccgcucgguaugccuguacccgccgcagcuggggcccagcaguga

SEQ ID NO: 54880 - RNA, 1053 nt, Artificial Sequence
  derived and/or modified sequence opt3 from CSNK2A2__Homo_sapiens__NP_001887
augcccggcccugccgcugggagcagagcaaggguguacgccgaggucaacucccugcggucucgcgaauauugggacuacgaggcgcacguuccaucauggggaaaucaggaugacuaucaacucgugcgaaaacuuggucguggcaaauacagugaaguauucgaggcuaucaacauuaccaauaacgaaagaguggucgugaagauacugaaaccgguuaagaaaaagaagaucaaaagggaggugaagauuuuggagaauuuacgcgggggaacaaacaucauuaaacugaucgauacugucaaggaccccgugagcaaaacgccugcccuaguauuugaauauauaaauaacaccgauuucaagcagcucuaccagauccugacagacuuugauauucgguucuauauguacgagcuucugaaggcauuggacuacugccauuccaaaggcaucaugcacagagauguuaagccacauaaugugaugauugaccaccagcaaaagaagcucaggcugaucgauuggggucuggccgaauuuuaucaucccgcucaggaguacaacguccggguggcaucucgcuauuucaaagggccugagcucuuaguggacuaccagauguaugauuacucgcuggacauguggucacuuggauguauguuggccagcaugauauuucgaagagaaccauucuuucacggccaggacaauuaugaucaacuggucaggauugcuaagguucuaggcacugaggaacucuacggguaccugaaaaaguaucacaucgaccuugauccccauuucaacgacauucugggacagcacagucggaagcguugggagaauuuuauccauuccgaaaaccgccacuuggugucuccugaggcccucgaucuguuagacaaacugcucagauacgaucaccagcagaggcuuaccgcgaaggaggcaauggaacauccauauuucuacccgguagugaaagagcaaagccagcccugcgccgacaaugcuguccuguccucagguuugacagccgcacgguga

SEQ ID NO: 54881 - RNA, 648 nt, Artificial Sequence
  derived and/or modified sequence opt3 from CSNK2B__Homo_sapiens__NP_001311
augagcuccucugaggaagugucauggaucaguugguucugcggccugagagggaacgaguuuuucugugaagucgacgaggauuacauucaggacaaguuuaaucucaccggacuuaacgaacaaguuccccacuauaggcaggcccuggauaugauauuggacuuagagccugaugaggaacuggaggacaauccaaaccagagcgaucuaaucgaacaggcugcagagaugcucuacggucugauucaugcccgguauauccuuacaaaucgcggcauugcgcaaaugcuggagaaauaccagcagggggacuucggauauugcccgcgaguguacugugaaaaccagcccauguugccuaucggccucuccgauauaccaggugaggcuaugguaaagcuguauugccccaaauguauggacguguacacuccuaagucuucgcgucaccaucacacggauggggccuacuuuggaaccggcuucccacauaugcuguuuaugguccaccccgaauauagaccuaaaaggccagcaaaucaauucgugccgcggcucuacggcuuuaagauccaccccauggccuaucaguuacagcugcaggcugcaucaaacuucaagagcccuguuaaaacaauucgcuga

SEQ ID NO: 54882 - RNA, 6969 nt, Artificial Sequence
  derived and/or modified sequence opt3 from CSPG4__Homo_sapiens__NP_001888
augcaguccggcccccggccuccacugccggcccccgggcucgcucuugcacugaccuugacaauguuagccaggcuggcguccgcugccucuuucuuuggagagaaccaccuagaagugccugucgcaacugcccucacggacaucgaucugcagcuucaguucucaaccagucagccagaggcucuguugcuccuggcagccggucccgcugaccaucugcucuuacagcuguacagcggccggcuucaaguucgcuuggugcuggggcaggaagaacuacgacuccagacuccugccgaaacucugcuuuccgauucuauuccacacaccguagugcugacagucguggagggaugggcgaccuugucgguugacggcuuucucaaugcaucaagcgccgugcccggugcuccucuggaggucccauauggguuauucgugggaggcacuggcacacuggggcucccguaccuucguggaaccaguagaccccugagggguugcuugcaugccgcaacgcuaaacggccggucccugcuccgcccucugacuccagauguacacgaagggugugcugaggaauuuucugccagcgacgauguugcgcuuggauucuccggcccccauucacuggccgcauuuccugcuugggguacccaggacgaggggacauuggaguucacucucaccacacaaaguagacaggccccacuggcuuuucaggccggaggcaggcggggcgauuucauauauguggacaucuuugaagggcacuuacgcgcagucguggagaagggacaggguaccgugcugcuacacaauagcguccccguugccgauggccaaccgcaugaagugucuguacacauuaacgcucaucgacucgagaucuccguggaccaguacccuacgcacacuucaaauagagggguccugagcuaucuugaacccaggggaaguuugcugcucggcggucuggaugcggaggcaucucggcaccuucaggagcaucgucugggguugacaccagaagccaccaacgcuucccuccugggcugcauggaggacuuaagcgugaauggacaacgcagaggccugagggaagcccuacucacucggaacauggcagccgggugucgacuggaggaagaggaguacgaagacgaugcuuauggacacuacgaggccuucucgacacuugcaccugaagcguggcccgcuauggaguugccagaacccugcguuccugagccaggucugccgcccguguuugccaauuucacccagcuccugacgauuucuccuuuagucguggcagagggcgggaccgccuggcuggaauggcgccauguacagccaacacuugacuugauggaggcugaacucagaaaaucccagguucuguucucagugacuaggggagcccggcacggcgagcuagagcuggauauccccggugcacaagcucgcaagauguuuacccuccuggacgucgugaacagaaaagccagguucauacaugaugggagugaagacacaagcgaucagcuugucuuggagguguccguuacugcgcgugugccuaugccaucuugucugcggcgaggccagaccuacuuacuccccauccagguaaauccggucaacgacccuccacacauuaucuuuccccacggaagccugauggugauucuugaacauacacaaaagccucugggccccgagguuuuccaggccuaugauccagacucagcuugcgaaggguugaccuuucaggugcucggaacaaguuccggucugccugucgagagaagggaucagcccggcgagccagcaacggaguucagcugucgcgagcuagaagccgggucucugguguacguacaccggggaggcccggcucaagaccucacauuuagagugucagacggucugcaggccaguccucccgcaacccuuaaaguugucgcgaucaggccagccauacagauucaucgcagcacuggguugcgacuggcucagggcuccgccaugcccaucuuaccugcaaaucucucuguggagaccaacgcugugggacaagaugucucgguucuguuccgggugacaggcgcccuucaguuuggggaacugcagaagcaaggagcaggcgguguggagggggccgaguggugggcuacccaggcguuccaccagcgugacguagaacagggaagagucagguaucuaagcacugauccacaacaccaugccuacgacacaguggagaaucucgcacuggaaguucaggugggccaggagauuuuguccaaccugucauuucccgucacgauccagcgcgcuaccguguggauguuacggcucgaaccucugcacacucaaaacacacagcaggagacccuuacaacugcccaucuggaggccaccuuggaagaggcugguccgaguccacccacguuccacuaugaaguugugcaggcaccuagaaagggcaaucuccaacugcaggggaccaggcuaucugauggacagggcuuuacacaagacgauauccaggccgggcgaguaacuuacggagcgaccgcucgcgccagcgaggcagucgaggacacauuccgguucagagugacugccccacccuauuuuuccccucuguacaccuucccgauucauauaggcggugaucccgacgcuccagugcuuacgaacguccuccugguugugccugaagggggagagggcguauugucagcagaucaccuguuugugaaaucuuuaaauagcgccuccuaccucuaugaagucauggagaggccccgucacggucgccuggcguggcggggcacacaggacaagaccacuauggugacaaguuucaccaacgaagaucuucugagagggagguugguuuaccagcaugacgacagcgagacuaccgaggaugacaucccauuuguggcuacacgacaaggagaaucuuccggcgauauggccugggaggaagucagagggguguuccgcguugcaauucagccugugaaugaccacgcccccguccagacgaucucaagaauauuucauguagcuaggggaggccggcgacuccugaccacugaugacguggccuucagugaugcagacagcgguuuugcugaugcccagcuaguucugacaagaaaagaccuucucuucgggucgauuguggcggucgaugagccaacccgcccgaucuauagguuuacacaagaagaccugcguaagcggagaguguuguucguacacuccggagccgauaggggcuggauccaguuacaggugucugacggucagcaucaagcaacugcucugcucgagguccaggccagcgagccuuaccugcgcguugcuaacggcucaagucuuguggugccccaagggggacagggcaccauugacacggcaguccugcacuuggauacaaaucuagacauccgauccggggaugaagugcacuaucauguuaccgccggaccaagauggggccaacugguacgggccggucagcccgcuacugcguuuucucagcaagaccuccuggauggggcagugcuuuacagccacaacggauccuuaucaccuagggacaccauggccuucagcgucgaggcuggcccagugcauacagaugccacucugcagguuaccauugcacucgaaggccccuuggccccucugaaacucgugcgccacaagaagauauaugucuuccagggggaggcugcggaaauccguagagaccagcuggaggccgcacaagaggcugugccgccagccgauauuguauuuagugucaaaucucccccuuccgcaggauaccuugugaugguuagccggggugcccuggcugacgaacccccaucguuggauccugugcagucauucucucaggaggccgucgacacaggcagggugcuauaccugcacagucgccccgaagcgugguccgacgcauuuagccucgauguugccucuggguuaggagcuccacuggagggcgugcuugucgagcuggaagugcucccugccgcuaucccguuggaggcacagaauuucagcguacccgaaggugggucccugacgcucgccccaccucugcuucgagugucaggacccuauuuuccaacccuacugggcuugaguuuacaaguucuggagccuccccagcauggcgcucuccagaaggaagacgggccgcaggccagaacucugagcgcauucucuuggcggauggucgaggagcaacuuaucagguacgugcacgauggauccgaaacacugaccgacucauuugugcucauggcgaacgccagugagauggaucgccagagccauccagucgcuuucacuguaacaguguugccuguuaaugaccagcccccaauucugaccacgaacacuggucuacaaaugugggaaggcgccaccgcacccauaccugcugaggcccugagauccacagauggggacucuggaucggaagaucucguguauaccaucgagcagccgagcaauggcagggucgugcuucggggugcacccgggacugagguucguucauuuacacaggcccagcuggacggaggcuuaguguuguucucccaccgcggcacccuggaugggggauuucgauucagacucagugacggugaacauacaucuccaggccacuucuuuagggucacugcucaaaaacaggugcugcuuagccugaaggggucccagacccucacgguaugcccuggaucagugcagcccuugucuagccaaacacugcgggcgaguuccagcgccggcaccgauccucaguuacuacuguaccgcguugucagagguccacagcucgggaggcuuuuccacgcacagcaagacucuacuggagaggcucuggugaacuuuacccaggccgaaguguaugccggcaauauuuuguacgagcaugaaaugcccccugagccauucugggaggcacacgacacacuggaacuccagcugucaagucccccggcucgggaugucgccgcgacucuugcuguugccgugagcuuugaggcagccuguccucagcgaccaagccaucucuggaaaaacaagggccuguggguacccgaagggcaaagagcucgcaucaccguggcagccuuggacgcgucgaaccuguuagcuucugucccuuccccacagaggagcgagcacgaugugcuauuccagguuacgcaauuucccucacggggacagcugcucgugagugaggaaccgcuucacgccggucagccucauuuccugcagucucaauuggcagccggccagcuggucuaugcucacgggggaggcgguacacagcaggacggguuucauuuccgugcccaccuccaaggacccgcaggcgcuuccguagccggcccacagaccagcgaggcguuugccauuacugugagagauguuaaugaaaggccuccccagccacaggcaucagugccccugcgccuuacacgggggagucgagcuccuaucagcagagcccaauuauccgucguggacccagauucugcaccgggagagauagaauacgagguccagagggcuccccauaacgguuuccugagccucgugggcgggggauugggcccuguuacccgcuuuacucaggccgacguggauuccggucggcuggccuucguagcgaaugggucaucuguggcuggcaucuuccaacuaaguaugucggacggagcaagcccaccccugccuaugucccucgccgucgauauucuuccaucugcuaucgagguucagcugagagcccccuuggaagugccucaggcacugggccguucaagccucucccagcaacagcugagggucgugagugaccgggaggaaccggaggccgcuuaccgcuuaauucaggggccacaguauggacaccuucugguagguggccgacccacaucugcguuuagccaauuccagaucgaucagggggaagugguuuuugccuucaccaacuuuucauccagucacgaccauuucagagugcucgcacuagcuaggggagucaaugccagcgcaguggucaacgugacgguucgggcccuguugcacguaugggcuggcgguccuuggccccagggggccacucugcgccucgacccaaccgugcuugaugcgggcgagcuggcaaauagaacaggaucugucccuagguuucgauugcuggagggcccccggcaugggcgugugguuagagugccacgcgccaggaccgaaccgggagguucccaacucgucgagcaguucacacagcaagacuuagaagauggccggcuggggcuugaggugggaagaccugaaggccgcgcucccgguccagccggggacucacugacucuagagcucugggcacagggcguacccccugcuguggccagccuggauuuugcuaccgagccauacaacgccgcaaggcccuauucgguugcguugcugucugucccugaagccgcucgaacggaggccggaaaaccggaaaguuccacaccaacuggcgagcccgggccuauggcaagcucaccagagcccgcuguggccaagggaggcuuccucuccuuucuugaagcaaauauguucucugugauaauuccuaugugccuggucuuacuguugcucgcccugauccuaccccuucuguuuuaccuccggaagagaaacaaaaccgguaagcacgacguucaggugcugacagcgaaaccaaggaauggguuggcuggagauaccgagacuuuccgcaagguagaaccgggccaggccauuccucugaccgcagugcccggucaaggcccaccucccgggggacagccagacccugagcuccuucaguucugucguacacccaacccggcccugaaaaauggccaguauugggucuga

SEQ ID NO: 54883 - RNA, 1206 nt, Artificial Sequence
  derived and/or modified sequence opt3 from CSPG5__Homo_sapiens__NP_001193871
augcccccugccaucccagaggcuaccgaagcaagcggcccgcccuccccuacaccaggggacaagcugucucccgccucagagcucccuaaagaaaguccacuugagguguggcugaacuugggagguagcacucccgauccucagggcccagaauuaacguacccguuccaagggacccuggagccccagccugcguccgacauuauagauaucgacuauuuugagggacuagauggcgaagguagaggggcugaccucggaucuuucccaggcucgcccggcacaucagagaaucacccugauacugaaggggagaccccaagcuggagucugcuugaccuguacgaugacuuuacacccuucgaugaguccgacuuuuauccgaccacuucuuucuacgaugacuuggacgaagaggaagaggaagaggaggaugacaaggaugccgucggagguggcgaccucgaagaugagaacgaacugcugguuccuacagggaaacccggacucggcccagguaccgggcagccuacguccagguggcaugcagugcccccacagcacacuuuaggaagcguacccggcucaaguauugcccugcggccucgcccaggcgagccggggcgagaccuugcuagcucugaaaauggaaccgagugccguuccgguuuugugagacauaacggcucauguaggagcgucugcgauuuguuccccaguuauugucacaaugggggacaaugcuaccugguggagaacaucggcgcauuuugucggugcaauacacaggacuauauuuggcauaaggguaugcgcugugaaucuaucauaacugauuuccagguuaugugcguggccgucggguccgcugcccuagugcuccugcuucuguuuaugaugaccguauucuuugcgaaaaaguuguaccuccugaagacagagaacaccaaauuaagaaggacgaauaaguuccggacuccuagcgaacugcacaacgacaauuucucgcucucuacaaucgcagagggcucccacccaaacgaugaccccucagccccucauaaaauucaggaaguucuuaagaguugucugaaagaggaggagagcuuuaauauccaaaacuccaugucuccaaaguuggaaggaggcaagggggaccaggcugaucuagacgugaauugccugcagaacaaccucaccuga

SEQ ID NO: 54884 - RNA, 2631 nt, Artificial Sequence
  derived and/or modified sequence opt3 from CSPP1__Homo_sapiens__NP_001278268
auggacgagagauucagguacgaaagcgauuuugaccggcgccugucccgaguguauaccaacgaucguaugcacagaaauaagaggggcaacaugcccccuauggagcaugacggggaugucaucgaacagucuaauauucggauaucaagugccgagaacaaaagcgcuccagacaaugaaacauccaagucugcaaaccaagauacuugcucgccguucgccggaaugcucuuugguggcgaggaccgcgagcuuauccagagaaggaaagaaaaguaccggcuggaguuguuagaacagauggcggagcagcaacgcaauaaacgaagagagaaggaucuggaacuaaggguugcugccucaggggcacaggaccccgaaaagagcccugaucggcucaaacaguucaguguggccccacgucacuuugaagagaugauucccccugaacgcccaagaaucgcuuuccagacgccccugccuccacuuuccgcaccgucuguacccccuauuccaagcgugcaucccgucccuucccaaaacgaggaccugaggucaggauugaguagcgcccucggcgagauggugucuccacggaucgcuccccugccgccucccccacugcucccucccuuagccaccaauuaucgaacaccauacgaugacgcguauuacuuuuaugguucccgcaacacuuucgaccccucacuggcauacuacgggagcggaaugaugggcguucagccugccgcuuaugugagugccccagucacccaccagcuugcacagccggugguaaauacaguuggccaaaacgaauugaagauaaccucugaucaggugaucaauuccgggcugauuuuugaggacaaacccaagccuagcaaacagucgcuacaaucuuaccaggaagcucuccagcagcaaaucagagagagggaagaacggcgcaagaaggagagagaagagaaagaagaguaugaagccaagcuggaggcggagaugaggacuuacaacccauggggaaaagguggcgggggagcaccccuucgugaugccaagggcaaucugauuucccauaugcagacacagucaaguccuuucgcucgggguaacgucuuuggggaaccacccaccgaguugcagaucaaacaacaggaacucuauaagaacuuccugcgauuucagauagaggagaaaaagcagagagaagaggccgaaagggagcgcuuacggauugcugaagagaaggaggaaagaaggcuggccgagcaacgcgcacgaauccagcaggaauacgaggaagaacaggagaaaaagcgggaaaaagaggaggagcaacgucucaagaaugaggagcacauuagacuugccgaggaaaggcagaaagaggcugaacgcaagaagaaagaggaggaagagaaguauaaccugcaguugcaacacuacugugaacgggacaaucuaaucggagaggaaacgaaacauaugagacagccgagcccuaucgugccagcgcugcagaacaagauugcauccaaacuccagaggcccccuucuguggauagcauaauccgaucauucauucacgagaguuccaugagccgcgcccaaucucccccagucccugcucggaagaaucagcugagagccgaggaagagaagaaaaacguuaucauggaacuuucagagaugaggaagcagcugcguagugaggagcgccgguugcaggagagacuccugcauauggacagcgaugacgaaauacccauuaggaaaaaggagcgaaauccaauggauaucuucgacauggcacggcaccgcuuacaagccccggugagaaggcaguccccuaaaggccuggaugcugccacuuuucagaacguacacgacuucaaugaacuaaaggaccgggauucugagacccgaguggaccucaaguuuauguaccuggaucccccaagagaccaucacacacuugaaauccagcaacaggcauugcugcgcgagcagcagaaaaggcucaaccguauuaagaugcaagagggcgcgaaagucgaucuggacgcuauccccucggccaaggugcgggaacagagaaugccuagggaugacacuagcgauuuccuuaaaaauucccuguuggagucagacagugcauuuauuggggccuauggagaaaccuacccagcuauagaggaugacguucugcccccuccgucucagcucccaagcgcccgcgagcgaagacggaacaaguggaaagguuuagauaucgacuccucaaggcccaauguggcaccugacggccugagccuaaagucuauuuccagugucaacguggaugaacuccgcguacguaaugaggaaagaaugcggaggcugaacgaguuccauaacaagccaaucaauacagacgaugaaagcucucuuguugaccccgaugacaucaugaaacacauuggggaugacggauccaacucaguggcuaccgagccuugguugcgcccgggcacgagugagacucugaagcgauuuauggccgaacaacucaaucaggagcagcagcaaauacccgguaaaccagggacauucaccuggcagggccugagcacugcgcauggauga

SEQ ID NO: 54885 - RNA, 1770 nt, Artificial Sequence
  derived and/or modified sequence opt3 from CSRNP1__Homo_sapiens__NP_149016
augaccggccugcucaagagaaaauucgaccagcuugaugaggacaacagcuccgugucuucaaguagcuccucuucggggugccaaucaaggagcuguagucccuccucuagcgucucccgggccugggauucagaagaggaaggaccuugggaccagaugccacugccggaucgcgacuuuugcgguccccgaaguuucacaccuuugagcaucuuaaagcgugcuagaagggagcggccaggccgcguugcauuugaugggauuacuguguucuacuuucccagaugucagggauucacgucuguaccuuccaggggcgguugcacccuggggauggcccuacggcacucagcgugucgccgauuuagccucgcugaguucgcccaggaacaagcaagagccaggcaugagaaacugcggcagcgucuuaaggaagagaaacuggaaauguugcaguggaagcucagugcugcaggagugccacaggccgaggcuggccugcccccugucguggacgccauagaugacgcgucuguugaggaagaucuggcaguggccgucgcuggcgggcgccucgaggaaguguccuuuuuacaaccauauccggccagaaggcggcgagcacugcuucgcgcuagcggaguaagaaggaucgaccgggaggaaaagcgcgaguugcaggcccugagacagucgagggaggauugcgguugucacugcgaccguauuugugaccccgaaacaugcucuuguucccuagcgggcaucaaaugccagauggaucauacugccuucccuugcggguguugccgggagggaugugaaaauccaaugggccgaguugaguuuaaccaagcaagagugcagacccacuucauucauacacucaccaggcugcagcuugaacaagaggcugagucauuucgcgaacuggaggcccccgcucaggguaguccuccaagccccggggaagaggccuuggucccgacuuucccucucgcaaagcccccaaugaauaacgaacugggagacaauuccugcucuagcgauaugacagacucaaguaccgccuccagcucugcuucaggcacgagugaggcgccugauugucccacucacccaggcuuacccgggccuggauuccagccagguguggacgaugacagccuggcacggauccucuccuuuucugauucggacuucggcggggaggaagaggaagaggaggaaggaagcgugggcaaccuugauaaucuguccugcuuucacccggccgacauauucgguaccucagaccccgggggcuuggcuaguuggacacauucuuacagcggauguuccuuuacuucaggcguccuagaugagaacgccaaucuggacgcaagcugcuuccucaacgggggacuggaagguucuagagagggcucccuuccugggaccaguguuccacccagcauggaugccggaaggucuuccucaguggaccugaguuugagcucgugugauuccuuugaacuccugcaggcuuuaccugacuauucucugggcccacacuacacaagccaaaaaguaucagauagucuagacaauaucgaggcaccccauuucccgcucccuggucuguccccacccggggaugccucuagcugcuuucuugaguccuugaugggcuucucagaaccugcggcugaggcccuggaccccuuuauugauagccaguucgaagacaccgugccagcaagucucauggagccuguccccguguga

SEQ ID NO: 54886 - RNA, 1758 nt, Artificial Sequence
  derived and/or modified sequence opt3 from CSRNP3__Homo_sapiens__NP_079245
augagcggcauccugaagagaaaauucgaggaaguggacggguccucucccugcucaagugucagggagagcgaugacgaaguuuccucuucggagucagccgauagcggagacagugugaacccuuccaccucuagccacuuuacaccauccucaauucucaagcgggaaaaacgccuucgaacuaagaauguacauuucaguugugugacggucuacuauuuuacccguagacaggguuucacaagcgugccgucucaaggcggguccacucugggaaugucaagcaggcacaacaguguucggcaguacaccuugggcgaguuugcucgcgagcaggaaagauuacauagggagaugcugcgggaacaccuacgcgaggagaaacucaauucucugaaacuuaagaugacaaagaacgguaccguggaauccgaggaagcaagcacucugacauuggaugacauaucggaugacgauaucgaccucgauaauaccgaggucgacgaauauuucuuucugcagccccugccuacgaagaaaagacgagcccucuuaagggcgucuggggugaagaaaauugauguagaggagaagcaugaacugcgggcuauccgucuuucccgcgaggacugcggaugugacugcagaguuuucugugauccagacacuugcaccuguucauuggccggcauuaagugccaaguggauaggaugaguuuucccuguggcugcacaaaagaaggguguagcaacacugcaggacggaucgaguucaauccuauacgaguccgcacccacuuucugcacacaaucaugaagcuagaacucgagaaaaacagagagcagcagauuccaacccugaaugguugccauuccgaaaucucugcccacagcucaaguaugggccccguggcucauuccguggaguacagcauugcagacucuuucgaaaucgagacggaaccucaggccgcuguccuucaucugcaaucagccgaggaguuggauugccagggggaagaggaagaggaggaagaggacggaaguagcuuuuguuccggcguuacugauucuucgacacagagccucgcgccauccgaaucagacgaggaagaggaggaagaggaagaggaagaggaggaagaggaugacgaugacgacaagggugauggguucguggaaggacugggcacccacgcagagguagugccguuacccaguguccugugcuauucugacggcacugccgugcacgaaagccacgcuaaaaacgccuccuucuacgcaaauucaagcacacucuauuaccagauagauucucauauuccugggaccccaaaccaaaucuccgagaauuacagugagagggacacgguuaagaacggaacccuuagccuggugcccuauacaaugacuccugaacaguuugucgauuacgcucggcaggccgaggaagcguauggugccucucacuacccagcagcuaaucccuccgugauuguauguugcucaaguagcgagaacgacucgggcguuccguguaacuccuuguauccugagcaucgcucuaaucacccccaaguggaguuccacagcuaccuaaaagggccaucacaggaaggauuugucagugcccugaacggcgauucccauaucucugaacacccugcugagaauagccucucccuggccgaaaagucaauccuucaugaggagugcauuaagagccccguggucgaaaccgugccaguuuga

SEQ ID NO: 54887 - RNA, 582 nt, Artificial Sequence
  derived and/or modified sequence opt3 from CSRP1__Homo_sapiens__NP_001180500
augcccaacuggggcgggggaaagaaaugcggugugugucagaagaccgucuacuucgccgaggaaguucaaugcgagggcaauagcuuucacaaauccuguuuccugugcaugguguguaagaaaaaccucgacucuacaacuguagcugugcauggggaagagaucuauugcaagucauguuacggaaagaaauauggcccuaaggguuacggguauggacagggcgcaggcacgcuuaguaccgauaaaggggaaagccugggaauuaagcacgaggaggccccaggucauagaccgacaacuaaucccaacgcguccaaauuugcucagaagauaggcgggucugaaaggugcccucgguguucgcaggccgucuacgcagccgagaaggugaucggagcuggcaaaucauggcacaaggcaugcuuccgcugugccaaaugcgguaagggguuggaaagcaccacauuagcugacaaagauggagagauuuauugcaagggcuguuacgccaaaaauuuuggcccaaagggguucggauuuggucaaggcgcgggggcacugguucauagugaguga

SEQ ID NO: 54888 - RNA, 2349 nt, Artificial Sequence
  derived and/or modified sequence opt3 from CSRP2BP__Homo_sapiens__NP_065397
auggacagcuccauccaccugucuucacucauuaguagacaugaugacgaggccaccaggacaagcacuuccgaaggccuugaggaaggggagguggaaggagagacgcuguugauagucgagucugaagaucaggcuucgguugacuuaucacacgaucaaagcggugacagucugaacuccgaugagggcgacgugucuuggauggaggaacagcuaagcuacuucugcgauaagugucagaaauggauccccgcaucccagcuccgggagcaacugucauaucuuaagggggacaacuuuuuccgcuuuaccugcagugauuguagcgccgacggaaaagaacaguacgagcgacugaaguugacauggcagcagguagugaugcucgcgauguauaaucugucucuggaaggcuccggucgucaaggguacuucagauggaaagaggauauuugcgcuuuuaucgaaaagcauuggacuuuccucuuaggaaauaggaagaaaaccucaacaugguggagcaccgucgccggcugucugagugugggcucuccuauguauuuucgguccggggcacaggaguucggagagccagguugguggaaacuuguucacaacaagccgcccacuaugaagccugaaggcgagaaauugagcgccucgacacugaagauuaaggcugcaucuaaaccaacccuagaccccaucauaacgguggaagggcuccgcaagagagccuccaggaauccugucgagucagcuauggaacugaaagagaagcggagucgcacucaggaggccaaagacaucagacgagcgcagaaggaagcagccggauuucuugauaggagcaccuccucuacaccagugaaauucauuagccggggccgucgccccgacguaauccuggagaagggugaaguuauugauuuuucaaguuuguccagcucugacagaacuccucucaccucaccaaguccgagccccucccuggauuucucugcuccugggacaccagccucgcauagcgcaacccccuccuuacugucagaggcugaccucaucccugaugugaugccaccccaagcccuuuuucacgacgaugacgaaauggagggagauggcgucauagacccgggcauggaguacgugccucccccagcggggaguguggccucuggaccugucguugguggcaggaagaaagugcgggggcccgaacagauuaagcaggagguagaaagcgaggaggaaaaaccagaccgaauggauaucgacuccgaggauacggacucaaacacuagccugcaaacacgcgcaagagaaaagaggaaaccccaguuggagaaggauaccaagccuaaagaaccacgguauacuccggugucuauuuacgaggagaagcuacugcucaaacgccuggaagccugccccggagccgucgcuaugacaccugaggccagaaggcuuaagcguaaacugaucgugcggcaggcaaagcgagacagaggcuugccacucuucgaucuggaccagguugugaaugccgcuuuacugcuagucgaugguaucuacggggcgaaggaaggcggaauuuccaggcuccccgcaggccaagccaccuaucgcacgaccugucaggacuuccggauacuggauagauaccagacaagucuuccuagcaggaaaggguuucgccaccagacuaccaaguucuuguaucgacuggugggaucugaggacauggcuguagaucaauccaucguuucaccauacacaagucggauucucaaacccuauauccguagagacuacgaaacuaagccgccuaaacugcagcuucugagccagauaaggucgcauuugcaccgcuccgacccacauuggacccccgagccugaugcuccccucgacuauugcuacgugcggccaaaccacauuccuacaaucaauucuaugugucaggaguuuuucuggcccgguaucgaucugagcgaaugcuuacaauacccagacuuuucagucgugguccuguauaagaaggugauuaucgcauucggcuuuaugguuccggaugugaaauacaacgaggccuauauuaguuuccuauuuguacacccugaauggagaagggcugggauagccaccuucaugaucuaccaucucauucagacuuguaugggaaaggacgucacgcugcacguguccgcaucuaaucccgcgaugcuuuuguaucagaaauuuggcuucaagacagaggaauacguucuggauuuuuaugacaaauacuacccacucgagagcaccgagugcaagcaugcuuucuuccugcgauuacgccgguga

SEQ ID NO: 54889 - RNA, 582 nt, Artificial Sequence
  derived and/or modified sequence opt3 from CSRP2__Homo_sapiens__NP_001287894
augcccguguggggcgggggaaacaagugcggugccuguggcagaaccgucuaccacgcugaggaaguucagugcgacgggaggagcuuccaucgguguugcuuucuguguauggugugccgcaaaaaucucgauuccacaacuguagcaauccacgacgaggaaauuuauuguaagucuugcuacggcaaaaaguauggaccuaaagguuacggguauggacaaggcgccggcacgcuuaacauggaucgaggggagcgucugggaauaaagccagaaucagugcagccgcauagacccaccacaaauccuaacacuagcaaguucgcgcagaaauacgguggcgcugagaaguguaguaggugcggggacuccgucuaugccgcagagaaaaucauuggagccggcaagccauggcacaaaaauuguuuucggugcgcuaagugcgguaagucuuuggaaucgaccacauuaaccgagaaagaaggggagaucuacuguaagggaugcuacgccaaaaacuucggccccaagggcuuuggguauggacagggugcaggcgcucuggugcaugcccaauga

SEQ ID NO: 54890 - RNA, 585 nt, Artificial Sequence
  derived and/or modified sequence opt3 from CSRP3__Homo_sapiens__NP_003467
augcccaacuggggcgggggagccaagugcggugcuugugagaaaaccguguaccacgcagaagagauccagugcaauggcaggagcuuccauaagacauguuuucacugcauggccuguagaaaagcgcuggacuccacuacggucgcugcccaugaaucugagauuuauugcaagguuuguuacgggcggcgcuauggaccuaaaggcauagguuacgggcaaggagcaggcugccucucaaccgauacaggcgaacaccuugggcugcaguuccagcagaguccaaagccggcccgaagcgugacuaccuccaaccccucuaaguuuacagcuaaauucggagagucggagaaguguccucguugcgguaaaucaguauaugcagccgaaaaggugaugggcgggggaaaaccauggcauaagaccuguuuuagaugcgcuaucugcggcaagagcuuggagaguacuaaugucacagacaaagauggugaauuauacuguaaggugugcuaugccaaaaacuucgggcccaccggaauuggcuuuggcgggcugacgcaacagguugagaagaaagaguga

SEQ ID NO: 54891 - RNA, 426 nt, Artificial Sequence
  derived and/or modified sequence opt3 from CST1__Homo_sapiens__NP_001889
auggcccaguaccugagcacccuccuucuguuguuagcuacacuggcaguggcccuagcguggucccccaaggaggaagacagaaucauuccuggcgggauauauaacgcugaucucaaugacgaguggguccaaagggcccugcacuucgcaaucucugaauacaacaaagccacuaaggaugacuauuaccggcgcccacuucgaguucugcgugcuagacagcagacggugggagguguaaauuacuuuuucgauguggaggucggcaggaccauuugcacaaaaucacagccgaacuuggacacuugugcauuucaugaacaacccgagcuccagaagaaacagcugugcaguuucgagaucuaugaagugccuugggagaaucggcgcagccugguuaaguccagaugucaggaaucuuga

SEQ ID NO: 54892 - RNA, 426 nt, Artificial Sequence
  derived and/or modified sequence opt3 from CST2__Homo_sapiens__NP_001313
auggccuggccccugugcacccuccuucuguuguuagcuacacaggcaguggcccuggcguggagcccucaagaggaagacagaaucauugagggcgggauauacgaugcugaccuaaacgaugaaaggguccagcgggcccuccacuucguuaucuccgaguauaauaaggcaacugaagacgaguacuaucgccgacugcuucgugugcugagagccagggagcagauuguaggaggugugaacuacuuuuucgauaucgaagucggccggacgauuuguaccaaaucucagccaaauuuggacacaugcgcuuuucaugagcaaccggaacuccagaagaaacagcuguguucauuccagaucuaugaggugcccugggaggaucgcaugagucugguuaacagcagaugccaagaagcauga

SEQ ID NO: 54893 - RNA, 441 nt, Artificial Sequence
  derived and/or modified sequence opt3 from CST3__Homo_sapiens__NP_001275543
auggccggcccccugagagcuccucuccuucuguuggcaaucuuagccguggcgcuggcugucagcccagccgcaggguccucuccgggaaagcccccuaggcuaguugguggcccaauggacgccucaguggaggaagaggggguacggcgcgcucucgauuucgcagugggagaauacaacaaagccaguaaugacauguaucacagccgagcucugcaggucgugcgugccagaaagcaaauuguugcgggcgugaacuacuuucuugaugucgagcuggguaggaccacaugcacuaaaacgcagcccaauuuggacaacuguccuuuccaugaucagccacaccucaagcggaaagcauuuugcuccuuccagauauaugccgugcccuggcaagggaccaugacacugucuaagucgacuugucaggacgcuuga

SEQ ID NO: 54894 - RNA, 426 nt, Artificial Sequence
  derived and/or modified sequence opt3 from CST4__Homo_sapiens__NP_001890
auggccagaccccugugcacccuccuucuguugauggcuacauuagcaggcgcccuggcgagcuccucuaaggaggaaaacaggaucauuccugggggaauauacgacgcugaucuaaaugacgagugggugcagcgggcccuccacuucgcaaucucagaauauaacaaagccacugaggaugaauacuaucgccgaccacugcaaguccuucgugcuagagagcagacguuugguggcguuaauuacuucuuugacguggagguagggaggaccauuuguacaaagagucagccgaaccuggauacuugcgcauuccaugaacagcccgaguugcagaaaaagcaacucuguagcuuugaaaucuaugaggugccuugggaggaccggaugucccuggucaauucucgcugccaggaagccuga

SEQ ID NO: 54895 - RNA, 429 nt, Artificial Sequence
  derived and/or modified sequence opt3 from CST5__Homo_sapiens__NP_001891
augauguggcccaugcacaccccucugcuccuucugacagccuugaugguggcugucgcaggcagcgccuccgcgcagucuagaacuuuagcugggggaauccaugccacggaccugaacgauaagucaguucaaugcgcacuagacuucgccauuagugaguacaauaaagugauaaacaaggaugaauauuacagcaggccacuccagguaauggcugcauaucagcagaucguggguggcgucaauuacuauuuuaacgugaaauucgggcggaccacauguacuaagucccaaccgaaucuggacaacugccccuuuaaugaucagccuaaacuuaaggaggaagaguucuguucuuuucagauuaacgaaguuccaugggaggacaagaucucgauucugaauuacaaaugccgcaagguguga

SEQ ID NO: 54896 - RNA, 450 nt, Artificial Sequence
  derived and/or modified sequence opt3 from CST6__Homo_sapiens__NP_001314
auggccagaagcaaccugccccucgcucuuggccuggcauugguggccuucugcuuacuggcgcuaccuagggacgcucgggcccgcccacaggagcgaauggucggggaacuccgugaucuguccccggacgauccccaaguucagaaggcagcccaggcugcaguggccucuuacaauaugggaucaaacaguaucuauuacuuuagagacacccacauuauaaaagcucagagccaacuuguagccgguaucaaguauuuccugacaauggagaugggcuccacugauuguaggaaaacgcgggugaccggggaccaugucgauuugacaacuugcccucucgcggcaggagcccagcaggaaaagcugcgcugugacuuugaggugcugguugugccauggcaaaauucuucgcagcucuuaaaacacaacugcguccagauguga

SEQ ID NO: 54897 - RNA, 438 nt, Artificial Sequence
  derived and/or modified sequence opt3 from CST7__Homo_sapiens__NP_003641
augagagccgcuggcacccugcucgcauucugcugucuugugcugagcacaacugggggacccuccccugacacgugcucucaggauuugaacucaagggucaagccagguuuuccgaaaaccaucaagacaaaugaccccggcguuuuacaagccgcgcgguacaguguggagaaauucaacaauuguacuaacgauauguuucuguucaaggaaagccgcauuacccgagcucuaguacagauagugaaagggcucaaguauaugcuggaggucgaaaucggacguacaaccugcaagaaaaaucagcaccuuagacuggacgauugugacuuucagacuaaccauacauugaagcaaacccucuccugcuacucugagguguggguugugccuuggcugcagcacuucgaagucccagugcugaggugucauuga

SEQ ID NO: 54898 - RNA, 429 nt, Artificial Sequence
  derived and/or modified sequence opt3 from CST8__Homo_sapiens__NP_005483
augcccagauguagguggcugagccucauccuucugaccauuccuuuggccuuaguggcucggaaggacccgaaaaagaacgagacaggcguccugcgcaaacuaaagccaguuaaugcauccaacgccaaugugaaacagugccucugguucgcgaugcaagaauacaacaaggagucugaagauaaguauguauuucugguggucaaaacucuucaggcucagcugcaagugacgaauuugcucgaguaccugauagacguugaaaucgcccgaucagauugccguaagccccugaguaccaacgagauuugugcaauccaggagaauagcaaacucaagagaaaauuauccugcucuuuccuggugggggcccuuccuuggaacggagaauuuacagucauggagaagaagugugaagacgcuuga

SEQ ID NO: 54899 - RNA, 480 nt, Artificial Sequence
  derived and/or modified sequence opt3 from CST9__Homo_sapiens__NP_001008693
augagcagcccccagagaaggaaggccaugccuugggcucugucucuccuucugaugggcuuccaauuguuagugaccuacgcauggugcucagaggaagagaugggagggaacaauaaaaucguccaggacccaauguuucuggccacaguugaguucgcgcuaaacacuuuuaaugugcagaguaaggaagaacacgcuuaucggcuccugcgcguacuuagcuccuggcgagaggauucuauggaccguaaauggagagguaagaugguguucucgaugaaccugcaguugaggcaaacggucugucggaaauuugaggaugacauugauaauugcccguuccaggaaucacucgagcugaacaaugugcgccagggcauauccuuuccccagguucauaguugugggugcuguaugggaugcggcguggguaccggggccgcagacaaggccaucccuagagauaagggaaaauga

SEQ ID NO: 54900 - RNA, 444 nt, Artificial Sequence
  derived and/or modified sequence opt3 from CST9L__Homo_sapiens__NP_542177
augcugggccuccccuggaaagggggacuuagcugggcccuguuguuacugcuacucgguucccagauccugcuuauuuacgcuuggcacuuccaugagcaaagagacugcgaugaacacaacgugauggcaagguaucugccugccaccgucgaguuugcgguucauacauucaaucagcagucuaaggacuacuaugcuuaccgguugggccacauacucaacucauggaaggaacagguggagaguaaaacuguauuuagcauggaacugcugcucgggcgcacgcgauguggaaaguucgaggaugacaucgauaauugccauuuucaagaguccaccgaauuaaacaauacauucacuugcuuuuucaccauuucuacacguccauggaugacccaguuuucgcugcuuaacaaaacuuguuuggagggcuuccacuga

SEQ ID NO: 54901 - RNA, 297 nt, Artificial Sequence
  derived and/or modified sequence opt3 from CSTA__Homo_sapiens__NP_005204
augauccccggcgggcugagcgaggccaagccugcuaccccagaaauucaggagauaguggacaaagucaagccgcaacucgaagagaaaacaaacgaaacuuacggaaaacuugaggcaguucaguauaagacccaggugguagccgguacgaauuacuauaucaaggugagagcgggcgauaacaaguacaugcaccugaaagucuucaaguccuugcccgggcagaaugaggacuuagugcugacaggauaucaaguugauaaaaacaaggacgaugaacuaacuggcuuuuga

SEQ ID NO: 54902 - RNA, 297 nt, Artificial Sequence
  derived and/or modified sequence opt3 from CSTB__Homo_sapiens__NP_000091
augaugugcggcgcccccagcgcuacccagccugcaacagccgagacucaacacaucgcggaccaggugagaucccagcuggaagagaaggaaaacaaaaaguucccagucuuuaaagcuguuucuuucaagucacaggugguagccgggacgaauuacuuuauuaaagugcaugucggagaugaggacuucgugcaccucaggguuuuucaaagucuuccgcaugaaaacaagccccugaccuugagcaauuaucagacaaacaaggcaaaacacgaugaguuaacuuacuucuga

SEQ ID NO: 54903 - RNA, 1296 nt, Artificial Sequence
  derived and/or modified sequence opt3 from CSTF1__Homo_sapiens__NP_001315
auguacagaaccaaggugggccugaaggacaggcagcaacucuauaaacuuaucauuagccagcuguuguacgauggguauauauccaucgccaacggauuaauuaaugagaucaagccccagucugucugcgcuccuucagaacagcugcuacaccucauuaagcuggguauggagaacgacgauacagcaguucaauacgccaucggccggagugacacuguggcgccagggacgggaauagaucuugaguucgacgcugauguacagaccaugagcccggaagccuccgaauaugagacauguuacgugacuucucauaaaggccccugccgcgucgcaaccuauucgcgagacggucagcugaucgccacagggucagcugaugcaagcauuaagaucuuggacaccgagcguaugcucgccaagagugcuaugccuauugaagugaugaugaaugagacugcccagcaaaacauggaaaaucacccaguuaucagaacacuguacgaucauguggacgaggucaccugucuggcguuucaccccacggagcagauacucgcauccggaucuagggauuacacuuuaaaacuguucgacuauagcaagccuuccgccaaacgggcuuuuaaguacauucaggaagccgagaugcuucgcucaaucaguuuccauccaagcggcgacuuuauuuuggugggcacccagcaccccacacugagacuauaugauaucaacacuuuccaaugcuuuguaucuuguaauccucaggaccagcacaccgaugcaaucugcuccguuaacuacaauucaagcgcuaacauguaugugacagggaguaaagacggauguauuaagcucugggauggugucucuaauaggugcauaaccacguucgaaaaggcccaugacggcgcggagguguguuccgccaucuuuagcaaaaacucgaaguacauucugucuuccgggaaagauucaguggcaaaacuuugggaaaucaguacuggacggacacugguccgcuauaccggcgcugguuugagcgggcgacaaguucacagaacucaggccguguucaaucauacagaggacuacguacuccugccagaugagaggaccauauccuuaugcuguugggacucucggacggcugaacgucgcaaccugcucagccuuggacacaauaacauugugagaugcaucguccacucaccgaccaaccccggcuuuaugacaugcagugaugacuucagggcccgguuuugguaccgacgcuccacuaccgacuga

SEQ ID NO: 54904 - RNA, 1734 nt, Artificial Sequence
  derived and/or modified sequence opt3 from CSTF2__Homo_sapiens__NP_001316
auggccggccugaccgugagagaccccgcugucgauaggagccuccgguccguuuucguggggaacaucccuuacgaggcaacagaagaacagcuuaaggacauauuuucugaaguaggaccaguggucucauuccgccugguguaugaucgagagacugguaaaccgaagggcuacggguuuugcgaauaucaagaccaggagacggccuugagugcgaugcguaauuuaaacggaagagaguucagcggcagggcucugcggguugauaaugccgcauccgagaaaaacaaggaggaacuaaaaucucucgguaccggggcccccgugauugagucgccuuacggagagacaaucucaccagaagacgcucccgagagcauuaguaaggcagucgccucccugccuccagaacagauguuugagcuuaugaagcagaugaaacugugugugcaaaauucuccccaggaagcucgcaacauguugcuccagaauccucagcuggccuaugcgcugcuccaagcacagguaguuaugagaaucguggauccagagauugccuuaaagauccugcacaggcagacuaacauaccgacccuuaucgcuggcaauccccagccuguccauggcgccgggccaggaagcgguuccaacgugucaaugaaucaacagaacccccaggcaccucaagcucagaguuugggcgggaugcacgugaauggagccccaccccugaugcaggcgagcaugcagggcggugucccggccccugggcaaaugcccgcagcuguuacaggaccaggcccuggcucucuagcccccgggggagguaugcaggcucaggugggcaugccaggguccggacccguaucaauggagcggggccaggugccuaugcaagacccacgcgccgcaaugcagcgagguagccucccggccaacguccccaccccuagagggcugcuuggcgaugcuccaaaugaccccaggggaggcacucuguugagugugacaggggaaguugagccucggggauaccucgguccaccccaucagggcccgccuaugcaccaugugccagggcacgaaucucguggacccccuccccacgagcugcgcggcgguccauuaccugaacccagaccacugauggcggagccgagggggccuaugcucgaucagcggggacccccacuugacggccgaggcgggcgcgaucccagaggaauugacgcaagggguauggaggcccgggcuauggaagcccgcggccuggacgcaagaggguuggaggccagggcuauggaagcccgugcaauggaggcgcgggcuauggaagcccgagcaauggaggccagagcuauggaggucaggggaauggaagcccgcggcauggauacccgggguccugugccagggcccagaggcccuaucccguccggaaugcaaggcccaagccccauuaacaugggggcaguaguuccucagggaucgcgccaggugccagucaugcagggcacggguaugcaaggggcuucuauccagggaggcucccagcccgguggcuucucaccugggcaaaaccaggugacuccgcaggaccaugagaaagccgcgcuaauaaugcagguccugcaacucaccgccgaucagauugcuaugcugcccccagaacagaggcagaguauccuuauucugaaggagcaaauccagaaaagcacaggagcaccuuga

SEQ ID NO: 54905 - RNA, 1851 nt, Artificial Sequence
  derived and/or modified sequence opt3 from CSTF2T__Homo_sapiens__NP_056050
augagcucccuggccgugagagaccccgcuauggauaggucucuccggucagucuucguuggcaacaucccuuacgaggcaaccgaggaacagcuuaaggacauuuuuagugaaguggggagcguaguguccuuccgccuggucuaugaucgagagacaggaaaaccaaaggguuacggcuuuugcgaauaucaagaccaggagacugccuugucugcgaugcguaauuuaaacgggagagaguucucgggaagggcucugcggguggauaaugccgcaucagagaaaaacaaggaagaacuaaaaagccucggcccggccgcucccauaaucgacaguccuuacggugauccaauugaccccgaggaugcaccugaguccaucacgcgcgccguugcuucucugccacccgaacagauguuugagcuuaugaagcagaugaagcugugugugcaaaauagccaccaggaagccagaaacauguugcuccagaauccucagcuggcguaugcacugcuccaagcccaggucgugaugaggauuauggacccagagaucgcuuuaaaaauacugcaucggaagauccacguaaccccgcuuauucccgggaaaucccagucaguuagugugagcggaccuggcccaggccccgggccuggauugugcccaggucccaacguccugcuaaaucagcaaaacccgccugcaccccagccacagcaucucgcccgccgaccugugaaggauauucccccacugaugcaaacacccauucagggcgggaucccugcuccaggaccgauacccgccgcggugccuggcgccgguccagggucucuuacucccggaggcgcaaugcagccucagcugggcaugccaggggucggacccguuccguuggaaagaggucaagugcagauguccgacccuagggcuccaauuccccggggcccuguaacccccgggggacucccaccucguggccuguuaggugaugcccccaaugacccacgcgggggcacacugcucucagugaccggagaggucgagccgagaggcuaccuugggccuccccaccagggaccacccaugcaucacgcuagcggucacgacacuaggggcccuaguucucaugaaaugcggggaggaccacugggcgauccccgauugcuaaucggugagccucgcgggccgaugauugaccagagaggccugccaauggauggaaggggcgggcgggacucccgcgccauggaaacaagagcaauggagaccgaagugcucgagacgaggguuauggagcgucggggaauggaaacuugugccauggagacccgagguauggaagcuagaggcauggaugcgagggggcuggagaugcgcggacccgugccuagcucgcggggcccaaugacaggugggauccaaggccccggaccuaucaacauuggcgcagggggaccgccccagggcccaagacaggucccugguauaucuggggugggaaaucccggcgccgguaugcagggcacugggauccaaggaaccggcaugcagggggcugggauucagggcggugggaugcagggagccggcauccaagguguauccauacagggcgggggaauccagggcgggggaauccaaggcgcaucaaaacagggugggagucagccaagcuccuucucuccuggacagagccaaguuacaccccaggaccaggaaaaggccgcucuuaucaugcaagugcugcaguugaccgccgaucagauugcaaugcucccaccggagcagaggcagucaauccugauuuuaaaggagcaaauacagaaaaguacgggcgcguccuga

SEQ ID NO: 54906 - RNA, 438 nt, Artificial Sequence
  derived and/or modified sequence opt3 from CSTL1__Homo_sapiens__NP_612140
augggcaucgggugcuggagaaacccccugcuccuucugauugccuugguguuaagcgcuaagcugggacacuuccagaggugggaggguuuucaacagaaacuaauguccaagaaaaauaugaacucuacccucaauuucuuuauacagucauacaacaaugcaaguaacgacacauaucuguaccggguccagcgccuuauccgaagccaaaugcagcugacuacgggcguugaauauauugugaccguaaagaucggguggacaaaauguaagcguaaugauacuuccaacucuucgugcccuuugcagucaaagaaacucagaaagagccugauuugugagagucugaucuacaccaugccauggauaaauuauuuccagcucuggaacaauuccugcuuagaagccgagcaugugggaaggaaccugcgguga

SEQ ID NO: 54907 - RNA, 570 nt, Artificial Sequence
  derived and/or modified sequence opt3 from CT45A1__Homo_sapiens__NP_001017417
augaccgacaagacagagaaaguggccgucgaucccgaaacuguuuucaagagaccuagggagugcgacagcccauccuaccagaaacggcaacgcauggcucugcucgcacgaaagcagggcgccggggauucucuuaucgcgggaucagcuaugaguaaagccaagaagcugaugacgggucacgcaauuccgcccagccaguuggacucccagauagaugacuuuaccggcuucucuaaagaucguaugaugcaaaagccugggucgaacgccccagugggaggcaauguaacaagcucauuuaguggugacgauuuagaauguagagagacugcuuccucucccaaaagccagagggaaaucaacgcagacauuaagcggaaacuggugaaggagcuacgcugcgucgggcagaaguaugagaaaaucuucgaaaugcucgagggagugcagggcccuaccgccguuagaaagagguuuuucgaauccauuaucaaagaggcugcccgguguaugcgccgagauuuugugaagcaucugaaaaagaaacuuaagagaaugauauga

SEQ ID NO: 54908 - RNA, 795 nt, Artificial Sequence
  derived and/or modified sequence opt3 from CT55__Homo_sapiens__NP_001026875
augcugagacuccuuaggcuggccuuggcuuucuacggccggaccgcagaccccgccgagcgccaggggccucaacagcagggauuaccacagggugauacacaacugacuacggugcagggcgucguuaccagcuuuugcggggacuauggaaugaucgaugaauccauuuacuucucuucagacgugguaacaggcaacgugccgcuaaaggucggucagaaagugaauguuguggucgaggaagauaagccccacuaugggcuccgagcgauaaaaguggacguaguuccucgucaucuguacggagcuggcccaagugauagcggcacuagagugcuuaucgggugugucaccuccauuaacgaggacaauaucuauauuucuaacucgaucuacuuuucaauagccaucgugagcgaagauuucgugcccuauaagggagaccuguuggaggucgaguacaguacagaaccugguauuuccaauaucaaagcaaccucuguuaagccaauuaggugcauccacacugaggaaguguguauaacaagcguacauggccggaacggggugauugauuacaccaucuuuuucacgcucgacuccgucaagcugcccgauggauaugugccucagguugacgacauugugaaugucgugaugguagagucaauccaauuuugcuucaucuggcgcgccauuaguauaacuccaguucacaaaucuagcuccggcuuucaggaugacggugggcugggaagaccgaagagggagcggcgcucacagagcaucuga

SEQ ID NO: 54909 - RNA, 342 nt, Artificial Sequence
  derived and/or modified sequence opt3 from CT83__Homo_sapiens__NP_001017978
augaacuucuaccugcuccuugccagcuccauccugugcgcuuugauuguguuuuggaaguauagaagguuccagcggaauaccggcgagaugucuucaaacaguacagcauuagcccugguccgccccagcuccucugggcuaauaaauucgaacacugacaauaaccucgcgguuuacgaucugucacgagacauccuuaauaacuuuccucacagcauugcucgucaaaaacggauccuggugaauuugaguaugguagaaaacaagcucguggagcuggaacauacgcugcucuccaaaggauucaggggugccucuccacacagaaagagcaccuga

SEQ ID NO: 54910 - RNA, 543 nt, Artificial Sequence
  derived and/or modified sequence opt3 from CTAG1A__Homo_sapiens__NP_640343
augcaggccgagggcagagggaccggagguagcacaggcgacgcugaugggcccggaggcccugguaucccagacgggccgggaggcaacgcaggcgggcccggagaagccggugcgacuggcgggaggggaccucggggcgcuggugccgcacgcgccuccgggccaggaggcggcgcuccccgagggccucacggaggugcagccucuggccugaaugggugcugucguugcggagcuagaggcccagagucaaggcuccuugaguucuaccuggccaugcccuuugcgacgccuauggaagcagaauuggcccggcgcaguuuagcucaagaugccccaccgcugcccgugccugguguccuacucaaggaguucaccguuagcgggaacauucugacaauaagacuuacugcagcugaccauaggcagcugcaguuguccaucucuucgugucuccagcaacugucacugcucauguggauuacccagugcuuuuuaccaguguuccuggcccagcccccuagcggccagcggcgcuga

SEQ ID NO: 54911 - RNA, 633 nt, Artificial Sequence
  derived and/or modified sequence opt3 from CTAG2__Homo_sapiens__NP_066274
augcaggccgagggcagagggaccggagguagcacaggcgacgcugaugggcccggaggcccugguaucccagacgggccgggaggcaacgcaggcgggcccggagaagccggugcgacuggcgggaggggaccucggggcgcuggugccgcacgcgccuccgggccacgaggaggcgcuccccguggcccucacgggggagcagccucugcucaagaugguagaugcccauguggcgccaggcggcccgacucacgccugcucgagcuucauauuacgaugccuuucaguagcccaauggaagcggagcuggugagaaggauauugucccgggaugcagccccguuaccccgcccuggggcuguccugaaggacuuuaccguuucuggaaaucuacucuucaugucggugcgagaucaggacagagaaggcgccgguaggaugcggguagugggguggggccugggaucagcaagcccagagggccagaaagcucgugaucuucgcacacccaagcacaaagucagugagcagagaccugggacuccaggacccccgccucccgaaggugcccaaggcgacgggugcaggggaguggcguuuaacguuauguucuccgccccacauaucuga

SEQ ID NO: 54912 - RNA, 2238 nt, Artificial Sequence
  derived and/or modified sequence opt3 from CTAGE1__Homo_sapiens__NP_758441
augagacccgacagccacccuuacggcuucccaugggagcuggugaucagggccgcugucgcaggguuuuucgccguucucuuucuuuggcgguccuuccgcucugugaccucacgacuguauguacguagagaaaagaaauuugcgguggcuuugaguggauuaauugaggaaaagugcaaacugcuagagaaguucagccucguccagaaagaauacgaggguuaugagguggaauccucucugaagaacgccucguuugagaaggaagcaacagaggcccaaucacuugaggcuacuugugaaaaacugaauagguucaacagcgaguugguucaugaaauacucugccuggagaaggaacugaaagaggagaagaguaaacacuccgaacagaaugagcucauggcagauaucucuaagcggauucagagcuuagaagacgaguccaagucacugaaaagucagguggccgaagcuaagaugacguuuaaacgcuuccaagccaacgaggagagacuugaaaucgagauucaggaugcguggaaggaaaauagcgaguugcaggaaucucagaaacaacugcuacaggaggcagaggucuggaaggaacagguguccgagcucaucaaacagaagaggaccuuugaagacucaaagguacaugccgagcaaguucugaacgauaaagagaaucacauaaagacacuuacugaacggcuguugaaaaugaaggacggcguggcuaugcucgaggaagaugucaccgacgaugacaaccuggaguuagaaaugaauagcgagagugaggauggggccuaccuggacaacccgcccaaaggagcacucaagaaacuuauccaugcugccaagcugaaugcgucuuugaagacacuagaaggcgagcgcaaccagauuuauauccagcuguccgaaguggauaaaaccaaggaggaacucacugagcacauuaaaaaucugcaaacagagcaggccagccuucagucggaaaacacccacuucgagucugaaaaucagaagcugcaacagaaguugaaagugaugacggagcucuaccaggaaaacgagaugaagcuguaucgaaaauuaaucgucgaggaaaaguguagacuggagaaagaagagaagcuauccaagguugacgagaugauaucacaugcaacugaagaacucgaaaccuacaggaaacgggcuaaggaccugaaagaguuugaaaagacaauucacuucuaccagaaaaagaucauucuucaugagaaaaaggcccacgauaacuggagugcugccuggacugcagagcguaauuugaacgaccugcgcaaggaaaaugcccacaacagacaaaaacucaccgagaucgaguucaagaucaaacugcuugagaaggauccuuauggucuggacgugccaaauacagcuuuugggaggcagcauagccccuacggaccuuccccauugggcuggcccucuagcgaaacccgggcgucacucuauccuccaacgcuguuagagggcccgcugcgacuaaguccccuccugccucgcgggggagguagaggcuccagggggccaggaaaucccccugaucaccagauuacuaaagagcggggcgaaagcucuugcgaccgccuuacagauccacauagagcacccucagacgccgguccguuggcuccucccugggagcaggauuacaggaugauguucccaccucccgggcaaaguuauccagacagcgcccugcccccucagcgucaggaucgguuuuacuccaacugugcacgacucucuggaccagccgaacugagaucguucaacaugccgagcuuagacaagauggacggcuccaugcccucagagauggaaaguucuaggaaugauaccaaggacaaccugggcaaucuuaaaguaccugauagcuccuugccagcugagaacgaggccacugggcccggauuugugccuccaccccucgcaccgauacgcggucugcuauucccugucgacacacggggcccauuuaucagaagggggcccccuuuucccccaccucccccaggaaccguguucggcgcgucaccggauuauuucagcccucgcgacguucccgguccaccccgagcuccuuuugccaugcggaauguguaccugccacguggguuccuccccuacagaccuccgaggccagcauuuuucccucccgccccaacguucuga

SEQ ID NO: 54913 - RNA, 2430 nt, Artificial Sequence
  derived and/or modified sequence opt3 from CTAGE5__Homo_sapiens__NP_001234918
auggaggaacccggcgugaccccucagccauaccuggggcuccuucuggaggaauugagaagggucguugccgcuuuaccggagggaaugcggcccgacagcaaccuguaugguuucccuugggagcuagugaucugcgcagccguagugggcuuuuucgcgguccucuuuuuccuguggcgcuccuuucgaucugugcguucaagacuuuacguugggagggaaaagaaacuggcuuugaugcucaguggacugauugaggaaaagagcaaacugcucgagaaguucuccuuagugcaaaaagaauaugagggcuacgaggucgaaucuucgcugaaggaugccucauuugagaaggaagcaacagaggcccagagccuugaaguggagaaucagauggcuacuugugagaaauugaaccggaguaauuccgaacuggaggacgaaauacuaugccucgagaaggaacugaaagaggagaagucuaaacacagcgaacaggaugagcuuauggcagacaucuccaagcgcauucaaucacuggaagaugagaguaagagcuugaaaucucagguagccgaagcuaagaugacguucaaaaucuuucagaugaacgaggagagacucaagauugccaucaaagacgcgcugaaugaaaacucccaguuacaagagucacagaagcagcugcuccaggaagcagagguuuggaaagagcaagugagcgaacuuaauaagcagaaggucaccuucgaggauaguaaagugcaugccgaacaggugcugaacgacaaggagucucacauaaaaacauugacugaaaggcuacugaagaugaaagauugggcugccaugcucggugaggacaucaccgaugacgauaaucuggagcuugaaaugaacuccgagagcgaaaauggggcauaucuggacaacccacccaagggagcuuugaagaaacucauucaugccgcgaagcugaaugccucguuaaaaacacuggagggcgaacggaaccaaaucuacauucagcuaucugaggucgacaagaccaaagaggaacucacugagcacaucaagaaucugcagacagaacaggcaucccuucaaucagagaacacccauuuugaaaacgagaaucagaaguugcagcagaaacugaagguuaugacggagcucuaucaagaaaacgagaugaaacugcaccgcaaacuuacuguggaagagaauuaccgacuggagaaagaagagaaguugaguaagguagaugaaaagauaagccacgcuaccgaggaacucgagacauacagaaagagggccaaagaccuggaggaagaguuagaacggacuauucauuccuaucagggccagaucauuucucacgagaagaaagcucaugauaacuggcuggccgcacguaaugccgaacgcaaccuaaaugaccucagaaaggagaacgcucacaauaggcagaaacugaccgagacagaacuuaaguucgaguugcuggaaaaggauccuuacgcgcucgacgugccaaacaccgcauuugggcgggagcacagccccuauggaccuucaccacuggguuggccgaguuccgaaacgcgagccuucuuaucucccccuacucugcuugagggcccauugcgccucagcccccugcuaccugggggaggcgguagagggucaaggggaccaggcaauccccuggaucaucaaaucacaaacgagcggggcgaaaguagcugugaccgccucaccgauccgcacagagcuccuuccgacacugggucucugucgcccccaugggaucaggacaggcguaugauguucccucccccaggacagagcuaccccgacuccgcccuuccuccacagcggcaagaucgauuuugcucaaauagugguagauugucuggcccggcagagcugaggagcuucaacaugcccuccuuagacaaaauggaugggucaaugccuagcgaaauggagucuucccgcaaugacacaaaggaugaccucggaaaccugaacgucccagauaguagccuucccgccgagaaugaagcuaccggcccugguuuugugccacccccgcuggccccuauccgggggccauuguuccccguugacgcaagaggcccuuuucucaggcgcggacccccauucccucccccaccgccuggcgcgauguuuggggcuucucgagauuauuuucccccaggagacuuccccgguccuccacccgccccuuucgcaaugcggaacguguacccgccacguggcuuucccccuuaucugccacccagaccuggguucuuuccgcccccaccucauuccgagggaaggucagaguuccccaguggccuaauuccaccuagcaaugaacccgccacggaacacccagagccgcagcaggagaccuga

SEQ ID NO: 54914 - RNA, 1290 nt, Artificial Sequence
  derived and/or modified sequence opt3 from CTBP1__Homo_sapiens__NP_001012632
augagcggcgugagacccccuaucaugaacgggccacugcacccgaggccccucgucgcccuucuggacggacgggauugcaccguugagaugccuauuuugaaggacguggcuacaguagcauucugugaugcccaguccacucaagaaauacaugagaaaguguuaaaugaagcggucggugcucugauguaccacacgaucacccuaacacgcgaggaccucgaaaaguuuaaagcccugcgaauuaucgugcguauuggcucuggguucgauaacaucgacauaaagucagcaggagaucuuggcaucgccguuugcaaugugccagcugcaagugucgaggagacugccgacagcacccugugucauauuuugaaccucuauagaagggcuacauggcugcaccaggcccugcgggaagguacccgcgugcaguccguagagcagaucagagaaguugcgucuggggcagccaggauucggggagagacucucggcaucauaggcuuagggcgcgugggacaagcugucgcccugcgagcaaaggcuuuugguuucaaugugcuauuuuacgaucccuauuugucggacggcguggagagagcccuggggcuacagagggucucaacacuccaggaucugcuuuuccauagcgacugcguuacccugcacuguggauugaacgaacacaaucaucaccucauuaacgauuuuacggugaaacagaugcggcaaggcgcguuccugguaaauacugcccgugguggguuaguggacgagaaggcacuggcucaggcccucaaagaaggacgcaucagaggcgcugcccuugacguccaugagagugaaccuuuuuccuucucucagggcccacugaaggaugcacccaacuugauuugcaccccucacgccgcuugguacagcgagcaggcguccaucgagaugagggaagaggcagcccgggaaauccgacgcgcuauuacagggagaauaccagacucacuuaaaaauugugugaacaaggaucaccugacugccgcaacccauugggccaguauggacccggcuguugugcaccccgagcucaauggagccgcauauagguacccuccaggugucgugggcguagcgcccacagggaucccugcugccguugaaggaauugugccaagcgcaaugucucugucccauggccuucccccggucgcccacccuccccaugcuccaucaccuggucaaaccgugaaacccgaggccgaucgggaccacgcaagcgaucagcuguga

SEQ ID NO: 54915 - RNA, 1338 nt, Artificial Sequence
  derived and/or modified sequence opt3 from CTBP2__Homo_sapiens__NP_001277143
auggcccugguggacaagcacaaagucaagagacagaggcucgaucggaucugcgagggcauucgcccccaaauaaugaacgggccucuucauccacgaccgcugguugcuuuguuagacggacgugauuguaccguggaaaugcccauccugaaagaccuagcaacaguagccuucugcgaugcgcagagcacucaggagauucacgaaaaggugcucaaugaggcugucggugccaugauguaccauacgaucacccugacaagagaagaccuugagaaauuuaaggcacugagggugauuguucggaucggcuccggguaugauaacguggacauaaaggccgcuggagaguugggcaucgcagucuguaauauuccuucugccgcuguggaagagacugccgauucaaccaucugccacauucucaaccuguaccgcagaaauacauggcuguaucaggcgcucagggaagguacccggguacaaaguguugagcagauccgcgagguggcaagcggggccgcucgaauaagaggagaaacuuuaggccugauuggcuucgggaggacaggacaggccgucgcagugcgggcuaaagccuuugguuucuccgugaucuuuuacgacccauaucuucaggauggcauugagcguucuuuggggguccaacgcguuuacacccugcaggaccuacucuaucagucggauugugugucacugcauugcaaccuuaaugaacacaaccaccaucugaucaaugacuucacgaucaagcagaugagacaaggagcguuuuugguaaacgccgcaaggggcggucucguggacgagaaagcucuggcccaggcuuuaaaggaagggcggauucgaggagccgcacuggauguccacgagagcgagcccuucaguuuugcccagggcccucucaaagacgcuccaaaucuuauauguacuccccauaccgcgugguacuccgaacaagcaucucuggagaugcgcgaagccgcugccacagagaucagaagggcaauuacuggccggaucccugaauccuugcgcaacugcgugaauaaggaguucuuuguuaccagcgccccauggucagugauagaucagcaggcuauucacccggagcuaaacggggccacauacagauaucccccuggaaucgucgguguggcaccaggcgggcugcccgcggcuauggaaggaaucauuccuggcgguaucccaguaacccacaaucuccccacgguugcccauccgagucaggcaccuagccccaaccaaccaacuaagcacggggacaacagggagcauccuaaugaacaguga

SEQ ID NO: 54916 - RNA, 3654 nt, Artificial Sequence
  derived and/or modified sequence opt3 from CTC1__Homo_sapiens__NP_079375
auggccgcuggcagagcacaggugcccagcuccgagcaagccuggcuggaagacgcgcaggucuucauccagaagacccucugcccugcuguuaaagagccaaacgugcagcuuacaccgcugguaauugauugugugaagacugucugguugucucaagggaggaaucagggaucaacguuaccccugaguuacagcuuuguguccguucaggaccuaaaaacccaccagcggcucccuugcuguucucaucugucguggucaagcagugccuaucaagcaugggcccaggaagcugguccaaacggcaauccccuuccucgcgagcagcuguugcuccuggggacacugacugaucucuccgcagacuuagaacaggagugccgaaacggaucucuguacgugcgugauaauaccggcguccuuagcugugaguugauagaccuggaucuauccuggcucggucaccuguuccuuuuuccaagauggucauaucugcccccugccagguggaacaguagcggggaaggacauuuggagcucugggacgcuccagugccgguauucccccugacaaucucuccuggcccaguuacccccauuccuguguuauacccagaauccgccucaugccugcuccggcuucgcaauaagcugagaggcguccaaaggaacuuggcggggagccuagugcggcugagugcacucgugaaaucuaagcagaaggccuauuuuauccugucccuuggacgcagccaccccgcugucacucauguuucgauuaucgugcagguaccggcccaacugguguggcaccgagcauugagaccugguacagcuuacguccucaccgagcugagggugucuaaaauacggggccagcgucagcacguuuggaugacgucccagucaagucgcuuacugcuacucaagcccgagugugugcaagaacuggagcuugaauuggaggggccacugcucgaagccgauccuaaaccccugccaaugcccagcaauuccgaggacaagaaagauccugagucucuugucagauauagcaggcuguugucauacaguggagcggugacuggcguacucaacgaaccagccggucuguacgaguuagacgggcagcugggacuaugccucgcauaucagcaguuccggggccugcgacgcguuaugagaccgggcgugugucuucaauugcaggauguccaucugcuccaguccgucgggggagguaccaggcggcccguccuggcuccuugcuuacgcggcgccgugcugcuucagagcuuuucuagacaaaagccaggggcucacucaaguaggcaggccuacggagcuagcuuguaugaacagcucguuugggagcgucagcugggccuaccccuguaccucugggccacaaaggcucuggaagaacuugcguguaaauugugcccucaugugcugcggcaccaccaauucuuacagcauuccucuccagguucgcccagccucgggcugcagcuucuggcaccgacuuuggaccuccuggccccuccaggcucccccguacgaaaugcucacaacgagauccuagaggagccucaucacugcccccugcaaaaguauaccagacuccagacaccaucaaguuuuccuacccuggccacgcuuaaagaagagggacagaggaaggcaugggccucuuucgaccccaaagcauugcugccauuaccggaagccagcuaccucccuuccugucagcugaaucgccggcuugcauggucauggcugugccuacuccccagcgcguuuuguccagcucaaguccuguugggcgugcugguugccucuucccauaaggggugcuuacagcucagagaucagaguggaagccugcccugucuucuguuggcaaaacacucucagccucucuccgacccaaggcugauugguugccuagugcgcgccgagcgauuccaacugaucgucgagcgggaugugcguucaaguuuucccagcuggaaggaacuuucgaugccuggcuucauucagaagcagcaggcuagaguauaugugcaauucuuucucgccgacgcacugaucuugccgguuccaaggcccugucugcacuccgcuacuccuucuacaccacagaccgaucccacugggccugagggaccgcauuuaggccagagccgccucuuccugcuuugccacaaagaagcccugaugaagcggaacuuuugugugcccccaggugcgucaccugaggugcccaaaccagccuugaguuucuacgugcucggguccuggcugggcggaacacaaagaaaggagggcaccggguggggacuaccugaaccccaggguaaugacgauaacgaccagaaaguccaucugauauuuuucggcucuagcguuaggugguuugaguuccuucacccaggacagguguaccgacucauugcuccggggccugcaacgcccaugcuguuugaaaaggauggcuccucaugcaucagccgccggccauuggaguuagccgguugugcuaguugccugaccgugcaagacaacuggacacucgaacuggagucuucccaggauauucaggacguacuugacgccaauaagagccugcccgagucgucauugacugaucuacugucugacaacuucaccgauagucucgucuccuuuagcgcagaaauccugucuagaacacuuugcgagccuuuaguggcgagccuguggaugaaacucgggaauacuggcgccaugaggcguuguguuaaguugaccguggcucuggaaacagccgagugcgaguucccaccccaccucgacgucuauaucgaagauccucaucugccgccaucccuuggacuguugcccggcgcacgcgugcacuuuucacagcuagagaaacggguuaguagaagccauaacguguacuguugcuucaggucuuccaccuauguacaaguccugucauucccucccgaaacuacgauuaguauaccacucccucacaucuacuuagcugagcugcuucaagggggacagagccccuuucaggccacagcauccugucauauugugucuguguucucgcugcagcucuuuugggucugcgccuauuguaccagcaucugccgacagggcaaguguacucgguuggguucaaccugcccaacacagaccgcuauaucccaggcgauuauccgccugcucguugaagacgggacugccgaggcagugguaacauguagaaaucaccacguggcugccgcccugggacuuugcccuagggaaugggcuagucuacuggauuucguccaagugccgggccggguuguguugcaguuugcaggucccggcgcccaguuagagucuagcgcgcgagucgacgagccaaugacgauguuccuguggacccucugcacuuccccuucagugcugagacccaucguucuuucuuuugaacuggagcgcaaaccaagcaagauugugccucucgaacccccgagguugcaacguuuccaguguggggagcugccauuucuaacacaugucaacccucggcugagacucaguugccuuuccaucagggagagcgaauacucuucaucccugggaauuuuagcuaguagcuguuga

SEQ ID NO: 54917 - RNA, 1200 nt, Artificial Sequence
  derived and/or modified sequence opt3 from CTCF__Homo_sapiens__NP_001177951
auggccuucgugaccagcggcgagcuggucagacacaggcgguacaagcauacacacgaaaaacccuuuaagugcuccaugugugacuaugcuucuguugaggugucaaaacucaagcgccauauccgaagucacacuggggaacguccuuuccagugcagccuuuguuccuacgcaucuagagauacguauaaacugaagaggcauaugcggacccacucgggagagaagccauacgaaugcuauauuugucacgcccgcuuuacacaaucagguacuaugaaaaugcauauauugcagaagcacaccgagaacguagcgaaauuccauugcccgcacugugacacagugaucgcuagaaagagcgauuuaggcguccaccugaggaaacagcauaguuacauugagcaggggaagaagugccgguauugugacgccguguuucacgaacgcuacgcacuaauccaacaucagaaaucccacaagaaugagaaacgauucaagugcgaucagugugacuacgccugcagacaggaaaggcauaugauuaugcacaaacggacccacacuggagagaagcccuaugcuugcucucauugugauaaaacauuucgucaaaagcagcuccuggacaugcacuucaagcgcuaccaugauccuaacuuuguuccagcagccuucgugugcagcaaauguggcaagaccuuuacgagaaggaauacuauggcucggcacgccgacaacugcgcgggucccgauggggucgagggagaaaauggcggcgagaccaaaaaguccaaacgagggcgcaagagaaagaugaggaguaaaaaggaagacucaagcgauucugagaacgcagaaccugaccuugacgauaaugaggacgaggaggaaccagccguggaaaucgagcccgaaccugagccacagccgguaacacccgcuccuccacccgccaaaaagcggcgcggaagaccuccagguaggacuaaccagcccaaacaaaaucagccgaccgcaauaauccagguugaggaucaaaacacaggcgcuauugaaaauaucauuguggaggucaagaaggaaccugacgccgagcccgcggaaggggaggaggaagaggcccagccagcagcuaccgaugccccuaacggagaccugacgcccgaaaugaucuuguccaugauggaucguuga

SEQ ID NO: 54918 - RNA, 1992 nt, Artificial Sequence
  derived and/or modified sequence opt3 from CTCFL__Homo_sapiens__NP_001255970
auggccgcuaccgagaucagcgugcuguccgaacaguucacaaagauuaaagagcucgaacuuaugcccgagaagggccugaaagaagaggagaaggacggggucugcagagaaaaagaucacaggucuccuucagaguuggaagcagagcggacgaguggagccuuucaagacagcguuuuagaggaagagguggaacugguacuagcgccauccgaggaaucugagaaguacauacucacucugcagaccgugcauuucacaucggaggcugucgaacuucaggauaugucacuguugagcauccagcaacaggagggugugcagguugugguccagcaaccgggccccgggcuccuguggcuggaagagggaccucgccagagucuccagcaguguguggccauuuccauccaacaggaauuauauucuccacaggagauggagguacugcaauuucacgcacuugaagagaacguuaugguggccagcgaagacuccaaguuggcugucucacuggcagagacuaccggccuaauuaaacucgaagaggagcaggaaaagaaucagcugcuugccgagcgaacaaaagaacagcuguucuuuguggagaccaugaguggugaugagcguagcgacgaaaucguguugacugucucuaacuccaauguugaggaacaagaggaucagcccacagcugggcaggccgacgcggaaaaggcaaaaucaaccaagaaccagagaaagacgaaaggagccaagggcacuuuccauugcgauguguguauguuuaccagcaguaggaugucuuccuucaaucggcacaugaaaacacauacuagcgagaagccucaccucugccaccuguguuuaaaaaccuuucgcacaguaacccugcucagaaaccaugugaauacgcacacuggcacaaggccauacaagugcaacgacuguaauauggcuuucgucaccucgggggagcuugugcggcaucgccgauauaaacacacucacgaaaagcccuuuaagugcucuauguguaaauacgccuccguugaggcaucaaagcugaaaagacaugugaggagucacacaggagaacggccuuuccaaugcugucagugcagcuaugcuucccgugauaccuacaaguugaaacgccauaugagaacgcacucuggugagaagccauaugaaugccauauaugucacaccagguuuacacagagcggcacuaugaagauccacauucuacagaaacauggggagaacgucccgaaguaccaaugcccccacugugccaccaucauugcgcggaaaucagaccugcgagugcauaugcgcaaucuccacgccuacagugcagcugagcugaagugcagauauuguuccgccguauuccacgaaagguacgcucuuauccagcaucagaaaacacacaagaacgagaagcgguucaaaugcaagcauuguagcuaugccugcaaacaggaacgccacaugacugcacauauaagaacccacacaggagagaagccuuuuaccugucugucuugcaauaaauguuucaggcaaaagcaguugcucaacgcccacuuucguaaguaccaugaugcuaauuucauuccaacuguuuauaaaugcucaaagugcggcaaagguuuuagucgguggaucaaccugcaccgacauagcgaaaaguguggguccggagaggcgaaaucugcagccucgggcaagggcagaaggacgcgcaaacggaagcagacaauuuuaaaggaggcuaccaaagggcaaaaggaagccgcaaaaggauggaaggaggccgcuaacggugacgaagccgcagcggaggaggcuagcacuaccaaaggcgaacaguuccccggggagauguuuccuguggccugcagagaaacaaccgcaagggucaaggaggaaguggacgagggagucacuugugagaugcugcuaaauacaauggauaaguga

SEQ ID NO: 54919 - RNA, 2886 nt, Artificial Sequence
  derived and/or modified sequence opt3 from CTDP1__Homo_sapiens__NP_004706
auggaggugcccgccgcuggcagagucccugcagaaggggccccaaccgcggcuguugccgaggugaggugcccgggacccgcaccucugcggcuccuugaauggcgcguagccgcuggugcagccgugcgaaucggcagcguccuggcuguguucgaggccgcggcauccgcccagucuucaggggcuagucaaagccguguugccuccggaggcugugugagaccagcaaggcccgaacggcgcuugagaucugagagggcuggugucgugcgggaguuaugcgcccagccugggcagguaguugcgccaggagccgugcugguccgccuagaaggcuguucgcaccccguggugaugaagggccucugcgcagagugugggcaggaccugacacaacuucagagcaaaaacggaaagcagcaggucccucugagcacugcuacgguuaguauggugcauuccguaccagaauugauggugucuagcgagcaagccgagcagcucggucgagaagaucagcagagacugcacaggaaucggaaacugguccucaugguggacuuagaucaaacccugauucauacaacugagcagcacugccagcaaauguccaacaagggcauauuucauuuccagcuugggcguggagaaccgauguugcacacccgccugagaccccacuguaaagacuuucuagagaagaucgcuaagcucuacgaacugcauguuuucacauuuggcucaaggcuuuaugcccacaccauugcagguuuccuggauccugagaaaaaguuguuuagucaucggauccucagccgagacgagugcauugauccauucucuaaaacugggaaucugcgcaacuuauuucccuguggagacuccauggugugcaucauagaugacagagaagaugucuggaaguucgccccuaaucugaucacagugaaaaaguacguauauuuucagggcaccggcgacaugaacgcuccacccgggucaagggagagccagacgcggaagaaaguuaaucacagucgcggaacugaagugucugagccguccccucccgucagagauccagaaggugugacccaagcgccuggcgucgagcccagcaacgggcucgagaagccagcaagggaacuuaauggaucggaggccgcuacaccccgugacucuccucggccaggcaaaccggacgaacgagauauuuggcccccugcccaggcaccaacuuccucacaggagcuggccggugcucccgaaccucaggggaguugugcccaaggcggaagaguggcaccaggccagaggcccgcgcagggggcuaccggaacagacuuggauuucgaccuaagcuccgauucugagagcucaagugaguccgaagguaccaagucaucuucaagugccagcgacggcgaguccgaagggaaacgcggacggcagaagccgaaagcagccccugagggcgcuggugcccuggcacaagggucuucgcucgagccaggcagacccgcugccccuagccugcccggagaagcggagccaggcgcccacgcuccugauaaggaacccgagcuugggggacaggaagagggugagagggacggccugugcggguugggaaacggcugcgcagaucgcaaggaagccgagacggaaucccaaaauucagagcucagugguguuacugcuggggaaucucuggaccagagcauggaggaggaagaggaagaggauacagacgaagacgaucauuuaaucuaccuggaggagauucuagugcgaguacacaccgacuauuacgccaaauaugaucgguaccucaacaaggaaaucgaggaagcaccagacauacguaaaauugucccggagcugaaguccaaagugcuugcggauguugccaucauuuuuagcggcuugcauccuacuaauuuccccaucgagaagacaagagaacacuaccaugcuaccgcccugggagcaaagauccucacgaggcuggugcuuagcccagacgcucccgaucgcgccacccaccugauugcagcccgggcuggcacagagaaagucuugcaggcgcaggaaugugggcaccuccaugugguaaacccugacuggcuguggucuugcuuagagagaugggauaagguggaggagcagcuguucccacuaagggacgaucacacuaaagcccaacgagaaaauucccccgcagcuuuuccugaccgcgaaggaguuccgccaaccgcccucuuccaucccaugccuguccugccaaaggcccagcccggcccugaggugcggauauaugauaguaacacagguaaacuuaucagaacuggggcuaggggaccgcccgcaccaucaucuuccuugccuauucgucaggaacccucaaguuuucgcgccgugccaccuccccagccacaaauguucggcgaggaacugccggacgcgcaggacggugagcagccuggccccagccggagaaagaggcagccaucgauguccgagaccaugccccucuacacacuguguaaggaagauuuagagucuauggacaaagaagucgaugacauccugggggagggaagcgaugacucagauagugaaaagcgacggccugaggagcaagaagaggaaccacagccccgcaaaccuggcaccagaagggagcggacucuuggggcuccggccuccucugagcgaagcgcagccggaggcagagguccacgcgggcacaagaggaaauugaacgaagaggacgcugcauccgaaucaagccgugagaguucuaaugaagaugagggauccagcucggaggccgacgaaauggcgaaggcucucgaggccgaacugaacgaucuaauguga

SEQ ID NO: 54920 - RNA, 783 nt, Artificial Sequence
  derived and/or modified sequence opt3 from CTDSP1__Homo_sapiens__NP_001193807
augguggccgcucccugggcaacccaggagcaagaagagggcagagggauccagccuggagacaggggugaucaaaagagcgccgcgucccagaaaccacggucucgcggcauucugcacucacucuucugcugugucugccgagacgauggggaagcccuuccggcucauaguggagcaccccuguugguugaggaaaacggcgccauaccuaagacaccagugcaguacuuacugcccgaggcuaaagcacaggacagcgauaagaucuguguagugauugaccuagaugagacucucguccacuccucuuuuaaaccugugaauaacgccgacuucaucauuccaguugaaaucgauggugugguccaucagguguauguacugaagcguccccacguugacgaguuucuucagagaaugggggaacuguucgagugcguguuguuuacggcuucgcucgccaaguacgcggauccugucgcagaccugcuggauaaauggggagccuucagggcucggcucuuucgcgagucauguguguuccauagaggcaauuaugugaaggacuuaagcaggcugggccgggaccuucgccgagucuugauacuggauaacaguccagccuccuacguuuuucacccggacaaugcagugcccguagcuucuugguucgauaacaugagcgacaccgaacuacacgaucuccugccauuuuucgagcaacuuuccagaguggacgaugucuauucagugcugaggcagccucggcccgggaguuga

SEQ ID NO: 54921 - RNA, 816 nt, Artificial Sequence
  derived and/or modified sequence opt3 from CTDSP2__Homo_sapiens__NP_005721
auggagcacggcagcaucauuacccaggccagaagggaagacgcucuggugcucacaaagcaagggcuugucuccaaaucuucacccaagaaaccucggggacgcaacauauucaaggcacuguuuugcuguuuccgagcccagcauguuggucagaguagcuccucuacugaguuggcggcuuacaaagaagaggccaauacgaucgcaaagucggauuuacugcagugccuacaauaucaguuuuaccagauuccaggcaccugucuccugccggaagugacagaggaggaccaggggcguaucugcguagugauugaucuugacgaaacucugguccacagcucauucaagcccaucaacaaugccgauuuuauagugccuaucgagauugaaggaaccacacaucaaguuuauguguugaaaagaccauacgucgacgaguuccucaggcggaugggcgagcuguuugaaugugugcuguucaccgcuagucucgcaaaguaugccgaucccguaacugacuuacuggaucgcugcgguguuuuuagagcuaggcuuuuccgggaguccuguguguuucaccaggggugcuacgucaaagacuugucucgccugggacgagaucuaagaaagacacucauccuggacaacagcccugccuccuauauuuuccauccagaaaaugcggugcccgugcagucaugguuugaugacauggcagacaccgagcuucugaacuugaucccuauauucgaggaacucaguggcgccgaggaugucuacacgagccugggccaguuaagggcuccauga

SEQ ID NO: 54922 - RNA, 831 nt, Artificial Sequence
  derived and/or modified sequence opt3 from CTDSPL__Homo_sapiens__NP_001008393
auggacggccccgccaucauuacccaggugacaaacccuaaggaggaugaagggagacugccaggagcuggugagaaagcaagccaaugcaaugucucccucaagaaacagaggucucggucaauacuuaguagcuucuuuuguugcuuccgcgacuacaacguugaagccccgcccccuuccucuccaucggugcugcccccuuugguagaggaaaauggcggguuacagaagggagaucagcgacaagugaucccaauucccucaccuccagcgaaauaucugcuaccggaggucacugugcucgacuacggcaagaaguguguugugaucgaucuggacgagacgcuuguccacagcaguuuuaaacccauuuccaacgcugauuucaucgugccuguagaaauagacgguaccauccaucagguuuaugugcugaagcguccacacgucgaugaguuuuugcagagaauggggcaacucuucgaaugcgugcuguuuacagccucucuggcaaaauacgccgaccccguggcugaucucuuagacagguggggagucuuccgggcacgccuguuuagagagagcuguguuuuccauaggggcaauuaugugaaggaucuuucccgguugggccgcgagcugucaaaaguaauuaucguggacaacaguccugccagcuacauuuuucacccagaaaaugcuguccccgugcagucuugguucgacgauaugacugacaccgagcuacucgaucugaucccguuuuucgaagggcuuucccgagaggacgauguuuauucaaugcugcauagauugugcaacagguga

SEQ ID NO: 54923 - RNA, 603 nt, Artificial Sequence
  derived and/or modified sequence opt3 from CTF1__Homo_sapiens__NP_001136016
augagcagaagggagggcucccuggacccccagaccgauucuucagugagucuccuuccucaccuggaagccaagauccggcaaacacauagcuuggcucacuuacugacuaaauacgcagagcagcuacuccaggaauauguccagcugcaaggggacccauucggacuuccguccuuuucucccccucgccugccaguugccgguuugucggcgcccgcuccuucacaugccggccucccagugcacgagcgacugcgucuggaugcagccgcucucgcagccuuacccccucugcuugacgcuguaugcagaaggcaggccgaauugaacccacgggcgccgcgccugcuaagaaggcucgaggaugcagcccggcaggcucgcgcccugggggcagcuguggaggcccuucuggcggccuugggagcagcuaaucgaggccccagagccgaaccuccagcugccacggcaagcgccgcuagugcgaccggugucuuccccgcaaaggugcucgggcugaggguuuguggauuauaccgggaguggcugucccguacagaaggcgaccucggccagcuucugccugggggaucugccuga

SEQ ID NO: 54924 - RNA, 1050 nt, Artificial Sequence
  derived and/or modified sequence opt3 from CTGF__Homo_sapiens__NP_001892
augaccgccgcuagcaugggccccgugagagucgcauucguugugcugcucgcccuuugcuccaggccugcgguagggcagaacuguucuggaccaugccgguguccggacgagcccgcuccucgcugcccagccggugugucacuggucuuggauggcugugggugcugucgagugugcgcaaagcaauuaggagaacuguguacagagcgugaccccugcgauccucacaaaggccuauuuugugacuucgguaguccagccaauagaaagaucgggguuugcacugcuaaagauggagcacccugcauuuuuggcggcacgguguacaggagcggggaauccuuccagucuucguguaaguaucagugcaccugucucgacggagccgucgguugcaugccucuguguucaauggaugugcggcuuccaagcccggacugccccuuuccucgcagaguaaaacugccaggcaaguguugcgaggaauggguuugugaugagcccaaggaccagacaguggucgggccugcuuuggccgcguacaggcucgaggauacuuucggaccagaccccaccaugauacgggcaaacugccuggugcaaacaaccgaauggagugccuguuccaaaacuugcggcauggguaucucuacacgcgugaccaaugauaacgcuagcugccgacuggagaagcaguccagacucuguauggucaggccgugcgaagccgacuuagaggagaauauuaaaaaggggaaaaaguguauccggacgccuaagauuucaaaacccaucaaguuugaacugaguggaugcacuagcaugaaaaccuaucgugcaaaguucuguggcguuugcacagacggccgcuguugcacuccacauagaaccacaacccuuccuguggaguuuaaaugucccgauggggaaguaaugaagaaaaacaugauguucauaaagacgugcgcuugucacuacaauugcccaggagacaacgauaucuuugagucuuuguauuacaggaagauguauggugacauggccuga

SEQ ID NO: 54925 - RNA, 690 nt, Artificial Sequence
  derived and/or modified sequence opt3 from CTHRC1__Homo_sapiens__NP_001243028
auguggcccccuggcagaagcaucaccgugaagcugagggagaaaacagucucccggaagcucgaaaugaacgggccaucugccuuccagggacuuauuugcgguaaauacaauggcaugugucugcaagggccggcuggaguucccggccgcgacgguucaccuggggcaaacggaauaccaggcacucccggcaucccugggcgagauggauuuaagggugagaaaggcgaaugcuugcgugagaguuucgaagagagcuggacgccaaauuauaagcaguguuccuggucuucguuaaacuacgggauugaccugggaaagaucgccgagugcaccuuuacaaaaaugagaucaaauagcgcgcuaaggguacucuucaguggcucccugcggcuuaagugucgcaacgcuugcugucagagaugguauuuuacuuucaauggugccgaaugcucugggccccugccuauugaggcaaucauauacuuggaucagggaagcccagaaaugaacuccaccaucaauauucacaggacaucaaguguggagggccucugugagggcaucggggccggacugguggacgucgcuauuuggguggguaccugcagcgauuauccgaaaggcgacgcaucuacuggguggaacuccguuucacggaucauaauugaggaacugcccaaguga

SEQ ID NO: 54926 - RNA, 1803 nt, Artificial Sequence
  derived and/or modified sequence opt3 from CTIF__Homo_sapiens__NP_001135869
auggagaacagcuccgccgcuucugcaucaagugaagccggcagcuccagaucucaggagaucgaggaacuggaaagguucauugacucguacgugcucgaguaucaaguccaggggcuucuggcggauaagaccgagggagacggugaaucagagcggacacagagccacauaagucaguggacugcugauugcuccgaacccuuggacucuagcuguuccuuuucacgcggccgagccccuccacaacagaaugggaguaaagauaacagcuuagacaugcugggaacggauaucugggcagccaauaccuucgacucuuuuuccggcgcuacaugggaucuacagccggagaagcucgacuucacucaguuucaucguaaaguuagacacacccccaagcaaccucugccacauauugauagggaggguugcgggaaaggaaaacuugaagacggcgauggcaucaaccugaaugacauugagaagguguugcccgcauggcagggguaccacccuaugccacaugaaguagagaucgcccacacaaagaaacucuuccggcgcagaaggaacgaccggcgccgacagcagagacccccuggagguaauaaaccacaacagcacggcgaucaucagccggggucagcuaagcacaacagggaccaucaaaagagcuaucagggaggcagugcgccccacccuucuggucggccaacccaccauggguacucccagaaucgucgcuggcaccauggaaacaugaagcaucccccuggcgauaagggcgaagccggggcacacagaaaugccaaagagacuaugacaauagagaacccaaagcuggaagacaccgcuggagauacgggucacagcucgcuggaggcccccaggucuccggacacucucgcaccuguggcuuccgaacgguuacccccacagcaaucaggcgggccugaggucgaaaccaaacgaaaggauaguauccugcccgagcgcauuggagagagaccaaaaaucacacuuuugcagagcuccaaggacaggcugcggcgcagacuaaaagaaaaggugcccgaugagguugccguggaaacuaccacaccucagcagaauaagauggacaaacucauugagauccugaacucuaugaggaauaacagcucagaugucgacaccaaacuuacgacuuuuauggaagaggcgcaaaacaguacaaauuccgaggaaaugcugggcgagauagugcguaccauuuaucagaaggccguaagcgaccggucuuucgcauuuacugcugccaaguugugugauaaaauggcucucuucaugguugaagguacaaaguuucgaucacuguuacugaacaugcuccagaaggacuucaccgugagagaggagcuucagcaacaggaugucgaaagguggcugggguuuaucacguucuugugcgagguguucggcaccaugcgcaguagcacaggagaaccauuucgggugcuagucuguccgauuuacacuugccugagagagcuccugcagucccaggacguuaaagaagaugccgugcuuuguugcucuauggagcugcaaucgaccggcagguugcucgaggaacagcugcccgagaugaugacagaauuacuggcaagcgcccgcgacaagaugcuauguccuuccgagucaaugcucacucgaagucugcuuuuggaaguaaucgagcugcacgcuaauucuuggaacccacucacacccccuaucacccaguauuacaaucggaccauucaaaaacugacugcguga

SEQ ID NO: 54927 - RNA, 525 nt, Artificial Sequence
  derived and/or modified sequence opt3 from CTLA4__Homo_sapiens__NP_001032720
auggccugccugggcuuccagagacacaaggcucaacucaaccuugcaaccaggacauggcccuguacucuguuguuuuucuuacuguuuaucccuguguucugcaaagccaugcaugucgcgcagccagcuguugugcuagccagcucccgggggauugcaucuuuuguaugugaguacgccucaccgggaaaggcuacggaagugcgcgucaccgugcuccgacaggcagacagucagguuacagaggugugcgccgcuacuuauaugauggguaaugaacugaccuuccuugaugacagcauauguacaggcaccuccucugggaaccaagucaaucugacuauccagggauugcgugccauggauacaggccucuacauuugcaaaguggagcugauguaucccccuccauacuaucuggguaucgggaacggaacccagauuuacguaaucgcgaaggagaaaaagcccucguauaauagaggccucugugaaaacgcaccuaauagggcccggauguga

SEQ ID NO: 54928 - RNA, 2526 nt, Artificial Sequence
  derived and/or modified sequence opt3 from CTNNA1__Homo_sapiens__NP_001277236
augaccgccgugcacgcuggcaacaucaauuucaagugggaccccaaaagccuggagauuagaacacucgcagucgaaaggcuucuggagccuuugguuacucaggugacgaccuuaguaaacacaaauuccaaggggccaucuaacaaaaagcggggacgcucaaagaaggcccaugugcuggcggcuagugucgaacaagccacugagaauuuucuagaaaagggugauaaaauagcaaaggagagccaguuccucaaagaggaacugguggccgcuguugaggacgugcgaaagcagggcgaucuuaugaaagcagccgcuggggaauuugccgacgauccgugcuccucugucaagcguggaaacauggugagagcggcaagggcccuguugucggcuguaacccggcuccugauccuggccgacauggcagauguuuacaagcucuuagugcagcugaaagucguggaggacggcauucuuaaguugcgcaaugcugguaacgagcaagaucuggggauccaguauaaagcccuaaagcccgaaguggacaaacucaauauuauggcggccaagagacagcaggagcugaaagaugucggacacagggaccaaauggcagcugcccggggcauccuucagaagaacguuccuauacuguacacagcuucacaggccuguuugcagcauccagauguggcagccuauaaggcuaaucgcgaccucaucuacaaacaacugcagcaggcgguaaccggcauuagcaacgcagcccaagcuacugccagugacgaugcaucccagcaccaagggggagguggcggggaauuagccuaugcucugaauaacuucgacaagcagaucauuguggauccccucucuuuuagcgaggaacgauucagaccuucccuugaggagaggcuggaaucaaucauaaguggagccgcauugauggcggacagcucuugcacacgggaugaccgucgcgagagaauugucgcugaauguaaugccgugaggcaggcacuacaggaucugcucuccgaguacaugggcaacgccggucggaaagaacgaucagacgcucugaacagcgccaucgauaagaugaccaaaaagacgcgcgaccuuagaaggcagcugcggaaggcaguuauggaucaugugagugacucuuuucuugagacuaaugucccacuccugguguuaauugaggcugccaaaaacgggaaugaaaaggagguaaaagaauaugcgcagguuuuccgcgagcacgccaacaagcugaucgaaguggcuaaucuagcaugcuccaucagcaacaaugaggagggagucaaacucgugagaaugucggccucucaacuggaagcucuuuguccccaggucauuaacgccgcauuggcgcuggccgcuaagccucaguccaagcucgcccaggagaauauggaccuguuuaaagaacaaugggagaaacaggugaggguucuuaccgaugcaguggacgauauaacaucaaucgacgauuuccuggcuguaagugagaaccacauuuuggaagacgucaauaaaugcgugaucgcccuccaggagaaggauguugacggccuggaucguacugcaggcgccauacgggggcgagcugcgagagugauucaugucgugaccagcgaaauggacaacuacgagccaggaguauacacagaaaaaguguuagaggccaccaagcugcuauccaauacgguuaugccgagguuuacugagcaggucgaagcagcuguggaggcccucucuagcgaucccgcccaaccuauggacgaaaacgaguucaucgaugcuucacgccugguguaugacgguauccgggacauuagaaaggcaguccuuaugaucaggacaccagaagaguuggaugacagugauuuugagaccgaagacuucgauguucgcucccgaacuagcgugcagacagaggacgaucagcugauugccggccaaucugcgcgggcuauaauggcccagcucccccaggaacagaaagcaaagaucgccgagcaaguggcuucauuccaggaagagaaaaguaagcuggacgcagagguaagcaaaugggaugacuccgggaaugauauuaucgucuuagccaagcagauguguaugaucaugauggaaaugaccgacuuuacgcguggaaaaggcccucugaagaacaccucugaugugauuucggcggcuaagaaaauagccgaggcagguagcagaauggacaaguuggggaggacaaucgccgaccacugcccagauuccgcuuguaaacaggacuugcucgccuaccugcaacgcauugcacuauauugccaucagcugaacaucuguucaaagguuaaagcugaagugcagaaucucggcggagagcuggucgugaguggcaacugcgauacuugcggggcccuucagggauugaaggguuggcccccgccucuguguuggcccuuaaccggcuggacagcgccaugcccuuga

SEQ ID NO: 54929 - RNA, 2583 nt, Artificial Sequence
  derived and/or modified sequence opt3 from CTNNA2__Homo_sapiens__NP_001158355
augaccagcgccacaucccccaucauucugaagugggacccuaaaucucucgagauaagaacucuuacgguggaaaggcuguuggagccauuagucacccagguuacaacucuggugaacaccucaaauaagggcccgagugggaaaaagaaaggacggagcaagaaggcucacguacuagcagccuccguggaacaagcgacacagaacuuccucgagaaaggugaacagaucgcuaaggagucucaggaucugaaagaggaacuugucgccgcaguggaggacguucgcaagcaaggcgaaaccaugcgaauugccucgucagaguuugcugaugaccccugcagcagugugaaacgugggacuauggucagagcagccagggcucuguuguccgccgugacacggcuccugauccuggcggauauggcagacguaaugcgccucuuaucucaucugaagauuguugaggaagcccuugaggcugugaagaaugccaccaacgaacaggauuuggcaaauagauucaaagaguuuggaaaggaaauggucaaacugaacuacguggcugccaggcggcagcaggagcuaaaggacccucacugucgcgaugagauggcggccgcacgaggcgcucucaaaaagaaugccacgaugcuguauacugcuagccaagccuuccuuagacauccagacguggcagccaccagggcuaaccgggauuacgucuuuaaacagguucaggaagcgaucgcagguauauccaaugccgcucaggccacaucacccacugacgaggcaaaggggcacaccggaaucggcgaacuggccgcugccuugaacgaguucgauaauaagauuauccucgacccuaugacauuuagugaagcacguuuccgcccaagccuggaggagagauuagaaucuauuaucuccggcgcggcucugauggccgacucaagcugcaccagggaugaccggcgagagcgcauaguggcagaauguaacgccguaagacaagcucuccaggaucuucugagugaguauaugaauaacacggggaggaaagaaaagggagaccccuugaauauugccaucgauaaaaugacuaagaaaacacgggaccuacgcagacagcugaggaaggcagugauggaucauauuucugacuccuuucucgagaccaacgucccucugcuugugcugaucgaggcugccaagagcgguaacgaaaaagagguuaaggaauacgcgcaaguguuccgugagcacgccaauaaauuggucgagguggcuaaccucgcaugcucgaucucuaauaacgaagagggcguaaagcugguucggauggccgcuacucagauugauuccuuauguccacaggugauaaaugccgcacugacacuagcggcccgaccgcagucaaaagucgcucaagacaacauggauguguuuaaggaccagugggaaaagcaggucagagugcucaccgaggccguugacgauaucacgaguguggacgauuuccugagcguauccgaaaaucacauucuugaggacgucaacaaaugcgugaucgcauugcaggagggggauguugacacccuggauaggacagcuggagccauacgcggccgggcagccagagugauucauaucaucaaugcugaaauggagaacuaugaagcgggugucuacacugagaaggugcucgaagccaccaaacugcuuucugagacaguaaugcccagguuugcagagcaaguggaaguugcuauugaggcccugagcgccaaugucccucagccauucgaagagaacgaauuuaucgacgcuucacgcuugguguaugauggggugcgagacauucggaaggcaguccucaugauacguacucccgaggagcuggaagaugacagugauuucgagcaggaagacuacgacguuagauccaggaccagcgugcagacagaggaugaccaauuaaucgccggacagucugcgcgcgcuauuauggcccagcugccucaggaggaaaaagcaaagaucgccgagcaaguggaaaucuuccaccaggagaagucaaaacuagaugcugaaguagcaaagugggacgauaguggcaaugacauuauaguccucgccaaacagauguguaugaucaugauggagaugaccgauuuuacucggggcaaggggccacugaaaaacacgagcgacgugauuaaugcggcuaagaaaaucgccgaggcaggauccagaauggauaaacuugccagggcuguugccgaccaauuggauucugcaacaucgcugauucaggcugccaagaaccucaugaacgcggugguccugaccgugaaagccagcuacguugcauccacuaaguaucagaaaguguacgguaccgcugccguaaauucacccgucgugaguuggaagaugaaagcuccggaaaagaagccuuuagugaaacgagagaagcccgaagaguuccagacacgcguccggagaggcucucaaaagaagcauaucagcccaguucaggcacuguccgaauuuaaagccauggacucauucuga

SEQ ID NO: 54930 - RNA, 1167 nt, Artificial Sequence
  derived and/or modified sequence opt3 from CTNNA3__Homo_sapiens__NP_001278062
augaaaagcacccagagaagggagaaacaaggcuccaugucugccgaaacacccaucacucugaacauugacccucaggaucuccaggugcagacguucaccgucgagaaacuucuggaaccauugauaauccaaguuacaacuuuagugaauugcccgcagaaccccucaagucggaagaaggggcgcagcaaacgagcuuccguacugcuagcaucuguggaggaagccaccuggaaucuccuggacaagggagagaagauugcgcaggaggcuacaguccuuaaagaugaacugaccgccucguuggaggaagugcguaaggagucagaggcacucaaaguuagcgccgaaagauuuacugacgauccuuguuuccugccaaagagggaggcugugguccaggcagcccgggcucugcucgccgcggugacacgcuuacugauccuugcagacaugauugauguaaugugcuugcugcaacacguuagugccuuucagagaaccuucgaaucccuaaagaacguggcuaauaagucugaccuccagaagacguaccagaaacuggguaaggagcuugaaaaccuggauuauuuggccuuuaaaaggcaacaggaccucaagagccccaaucagcgggaugagaucgcaggcgcucgcgccucccugaaagagaacucaccuuuacugcauaguauauguagcgcgugccucgaacacucugacgucgccucccuuaaggcaucaaaagauacugugugugaggaaauccaaaaugcucugaacgugauuagcaaugccagucaggggauccagaacaugaccacaccacccgagccucaggcugccacuuugggaucugcacuagacgaacuggagaaucucauuguccugaacccacuuaccguuacagaggaagagauccgaccgucccuggaaaagagauuggaggccauaauuagcggcgcugcgcuccuggcagacucgucuugcaccagggauuuacaucgggaacguaucauugccgaguguaaugcuauccgccaagcccugcaggaccuacucuccgaguacaugaacaaccugugcaaucagaagucagaucuugguuugacgggggugaaaaucaagcugcucgaagaguguauuauauucuggagucuguga

SEQ ID NO: 54931 - RNA, 2157 nt, Artificial Sequence
  derived and/or modified sequence opt3 from CTNNAL1__Homo_sapiens__NP_001273903
auggccgcuagccccggcccugcaggggugggaggugccggcgcggucuacggguccggaucuucaggcuucgcucuggacaguggucucgagaucaagaccagaagcguugaacagacacuucugccauuggugucccaaauuacuacguuaauaaaccacaaagauaauaccaagaaaucugacaagacacugcaggccauccagaggguagggcaggcagugaaccuagccgucggacgguuugugaaaguuggcgaggcuauugcaaaugaaaacugggaucucaaggaggaaaucaauauugccugcaucgaggcuaagcaagccggcgagacuauagcggcacugaccgacaucacaaaccuuaaucaucuggaaucggaugggcagauuaccaucuucacugacaaaacaggagugauuaaggccgcucgcuugcuccugucaagcgucaccaaagugcugcucuuagccgaucgaguaguuaucaagcagauaauuacgagucguaacaaagugcuggcaacuauggagagacuugaaaaggucaauuccuuucaggaguucgugcaaaucuuuucucaguucgguaacgagaugguggaauuugcucacuugagcggcgacaggcagaaugaucugaaggacgagaaaaagaaagccaagauggcggccgcacgggcuguccuagaaaaauguaccaugaugcuccugacagccuccaagacuugccuucgccauccgaacugugagucagcucacaaaaauaaggaagggguuuucgauagaaugaagguggcccuggacaaaguaauugagaucgugaccgauugcaagcccaacggagagacagacaucaguagcauuucuauauuuaccggcaucaaagaguucaagaugaauauugaggcauugagggaaaaccucuauuuucaguccaaagagaaccugucagucacguuagaagugauccuggagcggauggaggacuucacugauagcgccuacacaagucaugaacaccgcgagcgaauacucgaacuuucuacccaagcuagaauggagcugcagcaguugauuuccguuuggauccaagcgcagagcaagaagacuaaaucgaucgcagaagaacuagagcugucuauucucaagaucucccacucacugaaugaacuuaaaaaggagcugcauaguacagccacccaguuggcugccgaccuccugaaauaucacgcagaucauguggucuuaaaggcccugaagcuaacggguguggaagggaaccucgaggcucuggccgaguacgcauguaaacuuagcgaacagaaggagcaauugguagaaaccugcaggcugcuccggcacauuuccggaacagagccucuggaaauaacuuguauccacgcggaggagaccuuucagguuacaggccagcagauuaucucugcugccgaaacucuuacccugcauccaagcucaaaaaucgcaaaggagaauuuggacguguucugcgaagccugggagagucaaauuuccgauaugagcacacuccugcgugaaauaaacgacgucuucgagggccgcagaggggagaaauauggauacuuaucucugcccaagccuaugaagaauaacgcuaaucuaaaaucacucaagccagauaaacccgacagugaggaacaggccaagaucgcaaaacugggucuuaaguugggccugcucaccagcgaugcugacugugaaauugagaaaugggaagaucaggagaacgagaucgugcaguaugggaggaauauguccucuauggccuacucgcuguacuuauuuacucggggagaaggcccucugaagacgagccaagaccuuauucaccaguuggaggucuucgcggccgaaggucucaagcugacauccucagugcaggcuuuuaguaaacagcuaaaggacgaugacaaacugaugcuccugcuugagaucaacaaguugauaccacugugccaucaauuacagaccguuacuaaaaccucucuccagaauaagguguuccugaagguagauaaauguaucacaaagacccgaagcaugauggcacuucugguccaauugcucucccugugcuauaaacuacugaagaaaucagagacucgcuacuga

SEQ ID NO: 54932 - RNA, 2346 nt, Artificial Sequence
  derived and/or modified sequence opt3 from CTNNB1__Homo_sapiens__NP_001091679
auggccacccaggcugaccugauggagcucgauauggcaauggaacccgacagaaaggccgcggugagccacuggcaacagcaguccuaccuugauucuggcauccauucaggggcuacaacuacggccccuagucugagcggaaaagguaacccagaggaagaggacgucgauaccucccagguuuuguaugaaugggagcaaggcuucucucagucguuuacacaggaacagguggcagacauugaugggcaauacgccaugacuagggcucagcggguacgcgcagccauguucccggagaccuuagacgagggaaugcagauacccucaacacaguuugaugcugcccacccuaccaaugugcaacgacuggcggaaccaagccagaugcuaaagcaugcagucgugaaccucaucaauuaucaggacgaugccgagcuggcuacucgugccauucccgagcuuacaaaacuguugaacgacgaagaucaaguuguggucaauaaggcagcugugaugguacaccagcucaguaaaaaggaggccuccagacaugcgaucaugaggucuccucagaugguuagcgccauugugcggaccaugcagaacacgaaugacgucgaaacugcacgcugcaccgcuggcacacugcacaaccugucccaccauagagagggucucuuagccaucuucaagucagggggaauaccagcucuggugaaaaugcuuggcagucccguggacagcgucuuguuuuacgccaucacuacccugcacaaucuacuccugcaucaagaaggcgcaaagauggccguuaggcuugcugggggacugcagaaaaugguggcguugcucaacaagacaaauguaaaauuccuggcaauuaccacggauuguuuacagauccuggccuaugguaaccaggagucuaagcucauuauccuugcuuccggcgggccucaagcccuggugaauauaaugcggacuuacacauaugagaaguugcuauggaccacuucacgcguccugaaagugcucagcguuugcaguucuaacaagccagcaauuguggaagccggaggcaugcaggcucugggucuucaccugacagacccgucccagcgauugguccagaauugucucuggacccugagaaacuuaagcgaugccgcaacgaaacaagaggggauggaaggacugcuaggcacccucgugcagcugcuuggcucggacgauaucaacguaguuacaugcgcggcugggauuuugucuaaucugacuuguaacaauuacaagaacaaaaugauggugugccaggucggagguaucgaggcccucgugaggaccguccugcgggcaggcgaccgugaagauaucacagagcccgccauuugugcucuuagacaccugacuuccagacaucaggaggccgaaauggcacaaaaugcugugagguugcacuacgggcucccuguugugguaaagcuguuacauccacccucacacuggccucugauaaaagccaccgucggacuaauccggaaccucgcgcugugcccagccaaucaugcuccccuucgagagcagggcgcaauuccgcgcuuggugcagcugcucguuagagcccaccaagacacacagaggcggaccaguaugggugggacucagcagcaauuuguggaaggcguccgcauggaggaaaucguggagggauguacgggcgcucugcacauauuagccagagauguacauaacaggauugugauccgugggcugaauacaaucccucuuuucguucaguugcucuauagccccauugagaacauccagcgggucgcagcgggagugcugugcgaacuagcccaggacaaggaggcugccgaagcaauugaggcugagggugccaccgcaccacugacugaacuccugcacucccgaaaugagggcguggccaccuacgcugcggccguccuuuuuagaaugucugaagauaagccucaagacuauaaaaagagguugagcguugagcugacaucaaguuuauuccgcaccgaacccauggcauggaacgagacugcugaccucgggcuggauauaggagcccagggcgagccacuugguuaccggcaggacgaucccuccuaucgcagcuuucauucugggggcuacggacaggacgcccugggcauggauccuaugauggaacacgagaugggagggcaccauccaggugcugacuauccgguggauggcuugcccgaccucgggcacgcacaagaucugauggacggacuaccuccaggcgauucaaaucagcuggccugguucgacacagaucucuga

SEQ ID NO: 54933 - RNA, 1611 nt, Artificial Sequence
  derived and/or modified sequence opt3 from CTNNBL1__Homo_sapiens__NP_001268424
augagaaggaagcagaccggcacacgggagcgcgggcgauaccgugaagaggaaaugacuguggucgaggaagccgacgaugacaaaaagagacugcuccaaaucauugauagggacggagaggaggaagaggaagaggaggaaccccuugaugagagcuccguuaaaaagaugauacugacguucgaaaaacggucuuauaagaaccaggaguugcgcaucaaguuuccugacaauccagaaaaauucauggagucagaguuagaucugaacgacauuauccaggaaaugcacgugguagcuaccaugccggaucuauaccaucuccugguggagcuuaaugcaguccagagucuguugggucuccugggccacgacaacacagaugugagcauugccguuguggaccugcuccaagaauuaacugauaucgacacccugcaugaguccgaagagggggcggagguccuuauagacgcuuugguggauggacagguaguugcccugcuagugcagaaucucgaaagacuggacgagucugucaaggaagaggcagauggcgugcacaacacacuugccaucguggaaaauauggcugaguuuaggcccgagaugugcaccgaaggugcacagcaagggcuguugcaguggcuccugaaacgguuaaaggccaaaaugccuuucgacgcuaacaagcuguauuguucggagguccucgccauucuucugcaggauaaugacgaaaaccgcgaguugcuaggagagcuggauggcaucgacguucuccugcagcaacuuucaguguuuaagcgacauaauccaagcacugcggaggaacaggaaaugauggagaaccuguucgauaguuugugcuccugucucaugcugucuagcaauagagaaagguuuuuaaaaggcgaggggcugcagcuaaugaaccucaugcugcgggagaagaaaauuucccguucaagugcacuuaagguauuggaccacgccaugaucggacccgaagguacagauaauugccacaaauucguggacauacugggccuccgcaccauuuuuccucuguucaugaaaagcccaagaaagaucaagaaggucgggacgacugagaaagaacaugaggaacacguguguucuauucuugcuucccuguugaggaaccuccggggacaacagcgaacccgccuguuaaacaaguuuacagagaaugacucagagaaaguugauagacugauggaacuacauuucaaguaccucggcgccaugcaaguggcagacaaaaagaucgagggugaaaagcacgauauggucaggcgcggggagaucauugacaacgauacugaagaggaguuuuaucugcggagacuugacgcuggauuguucgugcugcagcacauaugcuacaucauggccgaaauuuguaaugcgaacguaccccagaucaggcagcguguucaucagauacucaauaugcggggcagcaguauuaaaaucgugcgacacaucauuaaggaguaugccgaaaacaucggcgaugggagaucuccugaguucagggagaaugaacagaaacgcauucugggauuacuggagaacuuuuga

SEQ ID NO: 54934 - RNA, 2907 nt, Artificial Sequence
  derived and/or modified sequence opt3 from CTNND1__Homo_sapiens__NP_001078927
auggacgauagcgagguggaauccaccgccucuauccuggcuucagucaaggagcaggaagcacaauucgagaaacucacaagagcccuugaagaggagaggcggcacguuagugcgcagcuggaacgcgugcgaguaagcccccaggacgcuaacccuuugauggccaauggcacuuuaacgcguagacaucagaacgggagguuugugggagaugcagaccuggagcggcaaaaguucuccgaucuaaaacucaaugguccacaggaccacucucaucugcuuuacucgaccauuccgcgcaugcaggaacccggccagauagucgagacauauacugaggaagauccugagggggccaugucagugguuagcguggaaaccagugacgauggaacaaccagaaggacugagacaaccgucaagaaagugguaaagacgguuacuacccggacagugcaaccagucgcuaugggccccgacggucugccuguggaugcauccucugugagcaacaauuacauccagacuuuggggcgcgacuuucgaaagaacggaaauggcggcccagggcccuaugucggacaggccgguaccgcuacacucccuagaaacuuccacuacccaccggauggcuauuccaggcauuacgaagacggguaucccggaggcucagacaauuacgguagucugagccggguuacccguauugaggagcgcuacagaccuucuauggaaggguauagggccccaucccggcaggauguguacggaccccaaccucagguacgagugggcggcucaagcgucgaccugcaccgcuuucacccagagcccuaugggcucgaagaugaccagagaaguaugggauacgaugacuuagauuaugguaugaugucugacuacggcacggcgaggcggacugggacaccguccgauccucgcagaaggcugcguagcuaugaggacaugaucggagaagaggugcccucggaucaauacuacugggcaccacuugcccagcaugagcggggcucuuuggcuucccuggacucacuacgaaaaggugggccucccccacccaacuggagacagccugaacucccagagguuauugccaugcugggcuucaggcuugacgcagugaagaguaaugcugccgcguaucugcagcacuugugcuaccgcaacgauaaagucaagaccgacgugcggaaacucaagggaaucccgguacugguuggcuuacuggaucaucccaagaaagaagugcaccucggggccuguggagcacuuaagaauauauccuuugguagagaccaagauaacaaaaucgcuauuaagaauugcgacggcgucccugcccuggugagguugcuacgcaaagcucgagauauggaccugacugaggucaucacagggacccucuggaaccuguccucucacgauagcauuaagauggaaaucguggaccaugcccuucacgcacugacggaugagguuauaauuccacauucaggaugggagcgggaacccaacgaggacuguaaaccucgucacaucgaaugggagaguguguugaccaauacagccggcugccucagaaacguauccagcgagaggucugaagcucgccggaagcugagagagugugaugguuuagucgacgcgcugauuuucaucgugcaggcagaaaucgggcagaaggacucagauaguaaacucguugagaauugcgugugucuacugaggaaccuuagcuaucagguccaucgagaaauuccacaagccgagcgcuaccaggaggcugcccccaauguggcaaacaauacuggcccgcacgccgcuuccugcuuuggagccaagaaaggcaaggacgaaugguucucucgggggaaaaagccuauagaggauccagcaaacgacaccguagauuuucccaagagaacaucgccugcgaggggauaugaauugcuguuccagcccgaggugguucguaucuacauuagccuccugaaagaauccaagacuccagcuauccuugaggccucagccggugcaauacagaaucugugugcuggccgcuggaccuaugggcgguacauuagaagugccuugaggcaagagaaagcacucucugcuaucgccgaccuguuaacaaacgaacacgagcgagucgugaaggcggccagcggagcucugcggaaucuagcaguggaugcccgcaacaaagaacucaucggcaagcaugcuauuccuaaucuggucaagaaccuucccggugggcagcagaauagcucauggaacuuuagcgaggacaccguuaucucuauuuugaacacuauaaaugaagugaucgccgagaaccuggaggcagcgaaaaagcucagagaaacgcagggcauugagaaacugguguuaaucaauaaguccggaaacaggagugaaaaagagguacgggccgcugcccugguccuucaaacaaucuggggcuacaaggaguugcgaaagccacucgaaaaagagggguggaagaaaagcgauuuccaggugaaucugaacaaugcaucuagaucccagucaagucacagcuaugacgauucgacccuaccgcugauugaccgcaaccaaaaguccgauaaaaagccugacagggaagagauacagaugucuaauaugggaagcaacacuaaaucacucgacaauaacuacaguacccccaaugaacguggcgaucauaaccggacacuggacagauccggugaucuuggggacauggagccauugaagggaaccacuccccugaugcaggaugagggccaggaaucuuuagaggaggaacucgacguucuggugcuugaugacgaagguggccaagucagcuauccuuccaugcagaagaucuga

SEQ ID NO: 54935 - RNA, 3405 nt, Artificial Sequence
  derived and/or modified sequence opt3 from CTNND2__Homo_sapiens__NP_001275644
augagcuccaugucuucagccgaggaacaguuccaauggcagagucaggacggccagaaggauaucgaggacgaacugaccacagggcucgagcuuguggauagcugcauuagaucccugcaagaaucuggaauauuggacccccaggauuacucgacuggugagaggccuucauuacugagccagagugcucuacagcucaacuccaaaccagagggcucuuuucaauauccggcaagcuaccacuccaaucagacgcuggcccuuggggaaaccacacccucacagcugccugcgcggggaacucaggcucgcgccaccggccaaaguuucagccaggguacaaccucucgagcagggcauuuggccggaccagagcccgcuccuccacccccuccaccgccccgugaaccuuuugcaccaucccucggcucagccuuccaucugcccgacgcuccuccagccgcggcagccgcugcccuguauuacagcaguucuacucuccccgcaccgccuagaggcgggucccccuuagcugccccacagggagguagcccuacaaagcugcaaaggggcgggucggcgcccgagggagccaccuaugcagcuccacggggcucgucccccaaacagucaccuagucgccuugccaagagcuacuccacgucuagcccaaucaacauugucguuucaagugcugguuuguccccgaucagagugacuagcccuccuaccguacagucuacaauuucaaguagcccaauccaccagcuguccucuacuauagggaccuaugccacacuaucgcccaccaaaaggcucgugcacgcaagcgagcaauacuccaagcauucacaggaacuguacgccacggcuacucuucagcggccuggaagucuggcggcaggcucucgcgccagcuauuccucacagcacggccacuuggggccagagcuccgagcucugcaaagccccgaacaucacaucgauccgauuuacgaggacagagucuaucagaagccuccaaugaggucuuuaucccagagucagggagauccccugccucccgcccauacagguaccuaccggacuagcacagcaccaucuuccccuggcguggacucaguuccccuccaacguaccgggagucagcacggaccacagaaugccgcugccgcaacguuucagcgcgcgagcuaugcugccggcccggcaucgaacuacgccgauccuuauagacaacuucaguacugucccuccguggaaucuccauacagcaaaucaggucccgcucugccuccagaggggaccuuggccaggagucccuccaucgacucuauucagaaggauccucgggaguucggcuggcgagacccggaacuaccagaggucauccaaaugcugcagcaccaguuucccagcgugcaguccaaugcagcugccuaucuccaacaucugugcuucggagacaacaaaauaaaggcggaaauucgcagacagggcgggauccagcuucugguagauuugcucgaccacaggaugacagagguucaucggucagccuguggagcucugcgcaauuuaguguacgguaaagcaaacgaugacaauaagauugcccugaagaacugcggcgggaucccugcucuagucagacuccugaggaaaacuaccgaucuugaaauccgugaguuggugacaggagugcuguggaaucucagcaguugugacgcccugaagaugccaauuauacaggaugcacuugcgguccugacuaacgccguuaucauuccccacucuggcugggaaaauuccccuuugcaagacgaucggaaaauccagcuccauagcucucaggugcugcgaaacgcuaccgguugcuuaagaaauguaucaucugccggggaggaggcaaggcgccggaugagagaaugugacggccugacagaugcucuacucuaugugauacagagugcccugggauccagcgagauugacucuaagaccgucgaaaacugcguguguauccuuaggaacuugagcuaccgccuggcagccgagacuucccaaggccagcacauggggacggacgagcucgauggacuguuaugcggugaagcuaauggcaaagacgcggagucaaguggguguuggggaaagaaaaagaagaaaaagaaaagccaggaucaaugggacggcguugguccgcugcccgauugcgccgaaccaccuaaggggauccagaugcuuuggcaccccucuauugugaaaccauauuugacacuccuguccgagugcucaaacccugacacccuagagggcgcagcuggagcccugcagaaucucgccgcuggcaguuggaaguggagcgucuacauccgagcagccgugcggaaggaaaaagggcugcccauucuuguagaguugcugcguauagauaacgacagaguugugugugcggucgcuacugccuuaaggaauauggcacucgaugugcgcaacaaggaacugaucggaaaauaugccaugcgggaccuuguccauagacugccaggcgguaauaacuccaauaacaccgcuucuaaggcaaugucggaugacacagugaccgccguuugcuguacuuugcacgaggugauuacgaaaaauauggaaaacgcgaaggcucucagggaugccgggggaaucgagaagcugguaggcaucagcaaaucaaagggugacaaacauuccccgaaggucgugaaagcagccagucagguucuaaauucuauguggcaauaccgagaccugcgcagccucuacaagaaggauggcuggucccaguaucacuuuguggcuucaucuagcacaauugagcgggacagacagaggccuuacaguuccagccguacccccucuauaucaccaguccgcgugucccccaacaaucggagugccagcgcacccgcuucgccaagagaaaugaucucucugaaagagaggaagacugauuaugaaugcacaggguccaacgccaccuaccacggagcgaaaggcgagcauacaagccgaaaggacgccaugacugcacagaacaccgggauuucaacgcuuuaucggaauaguuacggagcucccgccgaagauaucaaacacaaccaaguaucugcucagccugugccgcaggagccaucccgcaaggacuaugagaccuaccagcccuuccaaaauagcacaagaaacuacgaugaaucauuuuucgaggaccagguucaucacaggccucccgcaagugaauauacuaugcauuugggccugaaaagcaccgguaauuacgucgauuuuuauuccgccgcccggccauacucugaguuaaacuaugaaacaagccacuacccugcuucccccgacucauggguguga

SEQ ID NO: 54936 - RNA, 1203 nt, Artificial Sequence
  derived and/or modified sequence opt3 from CTNS__Homo_sapiens__NP_001026851
augaucagaaacuggcugaccauuuucauacucuuuccccuuaagcugguggagaaaugcgaaagcuccgucucuuugacaguuccuccagugguaaaguuagagaauggcucaaguacuaacgugagccugacgcuaaggccgccccucaaugccacccuggucaucacauucgaaauuacuuuucgguccaaaaacaucaccauucuugagcugccugacgaagugguugugccacccggggucacaaauucuucguuccaggugaccucacaaaacguaggacaguugacuguuuaccuccacgguaaucauagcaaccagacaggcccucgcauccgauuucuggugauacguaguuccgcuaucucuauuaucaaucaggucauuggguggaucuauuucguggcauggagcauauccuuuuacccacaagugauuaugaacuggagaaggaagucagucaucggacugaguuucgauuuuguugcccucaauuuaaccggcuucguggcguauagcguauuuaacauuggucugcuuugggugcccuacaucaaagagcaguucuugcugaaguauccuaauggggucaacccaguuaauucuaacgacguguuuuucucccuacacgcugugguccucacgcugaucauuauagugcaguguugccuuuacgagcggggaggccagcgcguaucauggccggccaucggcuuccugguuuuggcauggcucuuugccuucgugacuaugauugucgcugcagugggggucaccacauggcugcaauuuuuauucuguuuuagcuauaucaagcuggccgugacucucguuaaauacuucccccaggcuuacaugaacuuuuauuacaagaguaccgaaggauggucuauagguaaugugcuucuggauuucacaggcggguccuuuagcuugcuacagauguuccugcagucguauaacaaugaccaauggacccucauuuuuggagauccuacgaaauucggccuggguguauuuucuaucgucuucgacgugguuuucuuuauccagcauuucugccuuuacagaaagaggccagggcugcaggccgcgcggacuggauccggcucacgcuugcgacaagauugggcacccagucuccagccuaaagcccugccacagacaaccagcguguccgcuucuagcuuaaagggcuga

SEQ ID NO: 54937 - RNA, 1308 nt, Artificial Sequence
  derived and/or modified sequence opt3 from CTPS1__Homo_sapiens__NP_001288166
augcccuucaucgaggccuuuagacaguuccaauuuaaggugaaaagggaaaacuucugcaauauucacgucagccugguuccucagccauccucuaccggcgagcagaagacaaaaccgacucagaacucagugcgggaacuccgcgggcuuggacugagucccgacuugguagugugucgaugcagcaauccuuuagauacguccgucaaggagaaaauaucuauguuuugucauguggaaccagagcaaguuaucugcgugcacgacgucucgucaauuuaccgugugccccugcuacucgaggaacaggguguaguugauuauuuccugagaaggcuugaccugccuaucgagcggcagccacgcaagauguugaugaaguggaaagaaauggcugauagauacgacaggcuccuggagaccuguagcauugcacuggugggcaaguauacaaaauuuagugauuccuacgccucugucaucaaggcgcucgagcauagcgcuuuagccauaaaccacaaacuggaaaucaaguauauugacuccgcagaucuugagcccaucacuucacaggaggaaccugugcgguaccaugaagccuggcaaaaguugugcagugcucacggggugcuggucccaggaggcuucgguguucgcgggaccgagggaaaaauucaggcaaucgccugggcucgaaaucagaagaaaccguuucuaggcgugugucucggcaugcagcuggccguaguggaguucagcagaaacguccuuggguggcaagacgcaaauucuacagaauuugaucccaccacuucccacccugugguuguggacaugccagagcauaaccccggacagauggguggcacaaugaggcuggggaagcggcguaccuuguuccagacgaaaaauucagucaugcgcaagcucuauggagaugcggacuaccuggaagagagacacaggcaucgguuugaagugaacccuguauggaaaaagugcuuagaggagcaaggccugaaguucguuggucaggacguggaaggggagcgaauggaaauagucgagcucgaagaucacccauucuuugugggaguccaguaccaccccgaguuccuuagccgcccgauuaaaccuagucccccauauuuuggccuguugcuagccucugugggcagacugucccauuaccuccagaagggguguaggcugagcccucgggacacuuauucggaucgcucuggauccucaagucccgacagcgagaucaccgaacuuaaauucccauccauuaaucacgauuga

SEQ ID NO: 54938 - RNA, 3522 nt, Artificial Sequence
  derived and/or modified sequence opt3 from CTR9__Homo_sapiens__NP_055448
augagcagaggcuccaucgagauuccccugagggacaccgaugaagugauagagcucgacuucgaucagcuuccugaaggggacgaggucaucucuauucugaagcaagaacacacacaguugcauaucuggauugccuuagcucuggaguacuauaaacagggaaagacugaggaauuuguuaaacuacucgaggcagcccggaucgaugguaaccuggacuaccgcgaucacgaaaaggaccagaugacgugccuugauacccuggcggcuuauuacgugcaacaggcccgaaaagagaagaauaaggacaacaaaaaggauuugauaacacaggcaacucuccuguauaccauggccgacaaaaucauuauguacgaucagaaucaucugcucggccgugcuuguuucugcuuacuggagggggacaagauggaccaagcagaugcccaguuucacuucguacuuaaccagucaccaaauaacaucccggcuuugcugggaaaagccuguauuaguuuuaauaagaaggacuauagaggcgcgcuagcauacuacaaaaaggcccucaggacaaaccccgguugcccugcugaagugcggcuggggaugggacauuguuucgucaaacuuaauaagcuggagaaagcccgcuuggcauuuagcagagcucucgaacugaacuccaagugcgugggcgccuuaguuggccuggcggugcucgagcuuaauaacaaagaagccgauucuaucaagaaugggguccagcuguugucgagggcauauaccauagacccaucaaaccccauggugcuaaaucaccuggcuaaccacuucuuuuucaagaaagauuacagcaagguacaacaucucgcccugcacgcuuuucauaacacugagguugaggccaugcaggcagaaaguuguuaucagcuugcccgguccuuccacgugcaagaggacuacgaucaggcuuuucaguauuacuaucaggcgacacaauucgcaucuagcuccuucguccugcccuuuuucggauugggucagauguacauuuaccgcggcgacaaagaaaaugccucacagugcuuugagaaggugcucaaggcuuauccaaacaauuacgaaaccaugaaaauccuggggaguuuauaugccgcaagcgaggaucaggagaagcgagacauugccaaaggacaccugaagaaagugacggaacaauaccccgaugacgucgaggcuuggaucgaacuagcccagauccucgagcagacugacauucagggcgcacugucugcguaugguaccgcuacaagaauacuucaagaaaagguucaggccgaugugccuccagagaucuugaacaauguaggggcacugcauuucaggcucggaaaccugggcgaggccaaaaaguacuuucuugcuucccuggaccgggccaaggcagaagcugagcacgaugaacauuauuacaaugccauuucagugacuaccagcuacaacuuggcgcgucucuaugaggccaugugugaguuccacgaagcugagaaacuguacaagaauaucuuacgcgaacauccgaacuaugucgacugcuaccugagacuaggcgcaauggccagggauaaagggaauuuuuaugaggcuagugacugguucaaggaagcccuccagauaaaccaggaucaccccgacgcauggucucugauuggaaaucuucacuuggcgaaacaagagugggguccuggccagaagaaguuugagcggauccugaaacagccauccacacaaagcgauaccuacucgaugcucgcccuggggaacgugugguuacagacgcugcaucagcccacucgagaccgcgaaaaggagaaaagacaccaggauagggcucuugccaucuauaagcaaguuuugcggaaugacgcgaaaaaccucuacgcugccaacggaauuggcgcagugcuggcccauaaggguuacuuccgcgaagcuagagaugucuuugcacaggugagggaggccacagcagacaucucugacguauggcuaaaucuggcucacauuuauguugaacagaaacaguacauauccgccgugcaaauguaugagaacugucuccguaaguucuacaagcaccagaauaccgaggucgugcuguaucuugcccgggcuuuguuuaaaugcgggaagcugcaggaaugcaaacagacuuuacucaaggcacgacaugucgccccuucagauacagugcugauguucaacguugcgcuugugcugcaaagauuggcuaccaguguacucaaagacgaaaagagcaaucugaaggaaguccuaaacgccgugaaagagcuggaacucgcacacagguacuucuccuaucugucuaagguuggcgauaaaaugcgcuuugaccuugccuuggcugcaacggaggcccggcaguguagcgaucuguuaucacaggcgcaauaccauguggcuagagccaggaagcaggacgaggaggagcgcgaacuccgagcaaaacaggagcaggagaaggaacugcuucggcaaaagcugcuaaaagagcaggaagagaagcgucucagagaaaaagaggagcagaagaaacuguuggaacagagggcccaauacgucgagaagaccaagaauauccugauguucacaggagaaacugaggcuaccaaagaaaagaaacgcggcgggggagguggccggagaaguaagaaagggggagaguuugaugaguucgugaacgacgauacagacgaugacuuaccaauuuccaagaaaaagaagaggcgaaaaggcagcgguucugaacaggagggggaagaugaggaaggcggagagcgcaagaaaaagaaacggagaaggcaccccaagggcgaggaagggucagacgacgaugagacugaaaauggaccgaagccuaaaaagcgucgcccuccaaaagccgagaagaaaaaggcaccuaagcccgagcggcucccacccaguaugaaagguaagaucaaaagcaaggcuaucauuuccucuucggacgauagcuccgacgaagauaaacugaagauagccgacgagggccauccuagaaacucaaauaguaacucugauagcgacgaagaugagcagaggaagaaaugcgcguccucagaaagcgacucugaugagaaucagaacaaguccgggagugaggccggaagcccacgacggccgcgcagacaaaggucugaccaggacuccgauucagaccagcccagucggaaacgaagaccuagcggcucggaacaguccgauaaugagucuguacaaagcggucgcucacacagugggguguccgaaaacgacucuaggccagcaagccccuccgcugagucagaucacgaaagcgagcguggcagugacaacgagggaucuggccagggguccggaaaugaaagcgagccugaaggcucgaacaaugaggccucagaucgggguucugaacaugggagugacgauuccgacuga

SEQ ID NO: 54939 - RNA, 792 nt, Artificial Sequence
  derived and/or modified sequence opt3 from CTRB1__Homo_sapiens__NP_001897
auggccagccuguggcuccuuuccugcuucucucuggugggcgcugcauuuggguguggaguccccgccauccacccuguuuugucagguuuaaguagaauugugaacggcgaggacgcgguaccagggagcuggccguggcaagugucccugcaggauaagaccggauuccauuuuugcggcgguucucuaauaucggaagacugggucgugacagcugcccacugugggguuaggacuucagauguggucguggcaggagaguucgaccagggcagcgaugaagagaauauccagguacucaaaauugccaagguuuuuaaaaaccccaaguucaguauccugacggugaauaacgacauuacccuucugaaauuggcuacuccugcacgguuuucccagacagucucugccgugugccucccaagcgcugaugacgauuuccccgccggcacccugugugcgacaaccggguggggaaagacuaaguacaaugcaaacaaaacaccugacaagcugcaacaggccgcucucccauuacuguccaaugccgaaugcaaaaagucauggggucgccgaaucaccgaugugaugauaugugcaggcgcuaguggggucagcucuugcaugggagacuccggcgguccccuuguuugucagaaagauggggccuggacguuggugggaaucguaucauggggcagcgacacuugcaguaccucuuccccuggcguguaugcgcgugucacaaagcugauuccaugggugcagaagauccuagccgcaaacuga

SEQ ID NO: 54940 - RNA, 792 nt, Artificial Sequence
  derived and/or modified sequence opt3 from CTRB2__Homo_sapiens__NP_001020371
auggccuuccuguggcuccuuagcugcugggcucuguugggcacaacauuuggguguggagugcccgcaauccacccugucuuauccggucugucuagaauuguuaacggcgaggacgccgugccagggucauggccguggcagguaagucuacaagauaagacuggauuccauuuuugcggcgguagccucauauccgaagacuggguggucacggcggcucacuguggggugaggaccucugauguuguggucgccggagaguucgaccagggcucggaugaagagaauauccaggugcugaaaauugcaaagguauuuaaaaaccccaaguucucaauccuuacaguuaauaacgacauuacucuguugaaacucgccaccccugcucgguuuagccagacagugagugcagucugccugccauccgccgaugacgauuuccccgcuggcacccugugugccacuacaggguggggaaagaccaaguacaaugcgaacaaaacgccugacaagcuccaacaggcagccuuaccacugcuuucuaaugcugaaugcaaaaagagcuggggucgccgaaucacugaugugaugauaugugccggcgcauccggggugucaaguugcaugggagacagcggcggucccuuggucugucagaaagauggggcuuggacccugguuggaaucgugucuuggggcucccguacaugcucaacuaccaccccugccguauaugcgagaguggccaagcuaauuccauggguccagaagauccucgcagcuaacuga

SEQ ID NO: 54941 - RNA, 843 nt, Artificial Sequence
  derived and/or modified sequence opt3 from CTRC__Homo_sapiens__XP_011538852
augcugggcaucaccgugcucgccgcacuucuggcuugcgccagcuccugugggguccccucuuucccuccaaacuugucagcgagaguugugggaggugaggacgcuaggccgcacaguuggcccuggcagauuagcuuacaauaccugaagaaugauacauggcggcauacuugcggcgggacgcuaauagccuccaacuuuguacucaccgcagcccacuguaucucuaauacacgcacuuaucgaguggcugucggcaaaaacaaucuggaaguggaggacgaagagggaucgcuuuucguugguguggauaccauucauguccacaagcguuggaacgcacuguugcucagaaaugacaucgcccugauuaaacuggcugaacauguggagcucucagauacaauccagguagccugcuuaccugagaaggacagccugcuuccaaaagauuaccccuguuauguuaccggguggggaagguuguggcggggccugcgcuggccuacugaacuaccagugggcgagagauuucucgggggagucuggcacaggcagcuguggcuucccgcgggucugcagcacccucaagaagcaggcaguuugcauccaggggugcggcuccaccgccuggaccagcgagagaacgccgcugugauaugcuguugggagagaaggcagcgggucccggccacagcaaucaauuucuuacugcucggacccccuggcucccuuauuugcgcugccucuguugcgagccuguuguccggugccgcaccauuucauaccauggaacccaagcgugauccuacgcagccagugucacccacucuacacuga

SEQ ID NO: 54942 - RNA, 795 nt, Artificial Sequence
  derived and/or modified sequence opt3 from CTRL__Homo_sapiens__NP_001898
augcugcuccuuagccugaccuuguccuuagugcugcuagggucuucauggggcugcggaauccccgccauuaagccugcucucaguuucagccagagaauagucaacggugagaaugcaguucugggcuccuggccauggcaagugucucuucaggacucgucaggguuucacuucuguggaggcagccugaucagucaguccuggguagugacagccgcgcauugcaacgucucuccggguaggcacuuugugguuuugggggaauacgaucggagcuccaaugcugagccccuccaggugcugucagucagucgcgccauuacucauccuagcuggaacucuacgaccaugaauaacgacgugacacugcucaaauuagcauccccagcccaauauacuacccgaaucucacccguaugucuggcuagcaguaaugaagcacuuacagagggauugaccugcguuacuacaggcuggggccgucugucuggggugggaaacgucaccccugcccaccuacaacagguggcucucccacuggugacggucaaucaguguagacaguacugggguuccagcauuacugauucgaugaucugcgccggcggggcgggagcaucuuccugucagggcgacucaggugggccccuuguuugccagaagggaaacaccugggugcugauaggcaucguaaguuggggcacuaaaaauuguaacgugagggccccugcugucuauacacgggugagcaaguucuccaccuggauuaaucagguuaucgccuacaacuga

SEQ ID NO: 54943 - RNA, 1497 nt, Artificial Sequence
  derived and/or modified sequence opt3 from CTSA__Homo_sapiens__NP_000299
augaccagcucccccagagccccuccaggcgagcaggggaggggaggugcugaaaugauccgggcagccccgcccccucuguuccuccuucuguuguuacugcuacuccuggugucuugggcgucacgcggcgaggcugccccagaccaagaugaaauucagcgacuucccgggcuggcaaagcagccuaguuuucgucaguacagcggauauuugaaaggcuccgguucuaagcaccuccauuacugguucgucgagucgcaaaaagacccagaaaacucacccguugugcuguggcugaaugggggaccuggcugcagcagucucgauggcuuacugacagagcacgggccauuucuuguacagccggacggagugacuuuggaguauaaccccuacuccuggaaucugauagccaacguccuauaucucgaaucuccugcuggugugggcuucagcuacuccgaugacaaguuuuaugcaacgaaugauaccgagguugcccagucaaacuucgaagcucugcaggacuuuuucagacuuuuuccagaguacaaaaauaacaagcuguucuugacaggggagaguuacgccggaaucuauauucccacucucgcggugcuggucaugcaagauccuagcaugaauuuacagggccuggcaguggguaacgggcucucuuccuacgaacagaaugacaacucacuuguauauuuugccuacuaucauggacuguugggcaauaggcuauggagcagucugcagacccacuguugcucucaaaacaaguguaauuucuacgauaacaaagaccucgagugcguuacaaaccugcaggaaguggcucggaucgucggcaauuccgggcuuaacauuuauaaucuguacgccccaugugcaggaggugugcccagccauuuucgcuacgagaaggauaccguggucguucaggacuugggcaacaucuucacuagacucccgcugaaaaggauguggcaccaggcuuuacugcggucgggggacaaggugcgcauggauccucccugcacaaauaccacggccgcgucuacuuaucuaaacaauccauacguacgaaaagcccucaacauaccugaacaacugccccagugggacauguguaauuuccuugugaacuugcaguauagaaggcuguaccgguccaugaacucacaauaucucaagcugcuuaguagccagaaguaccagauccuguuguauaauggagaugucgacauggcaugcaauuuuaugggcgaugagugguucguggacucccucaaccagaaaauggagguucaacgucgcccauggcuggugaaguacggugauucuggggaacagauugcuggcuuugucaaagaguucagccacaucgccuuuuuaaccauuaagggagcuggccauauggugcccacagacaaaccucuggccgcauucacuauguuuucaagauuccuaaauaagcagccauacuga

SEQ ID NO: 54944 - RNA, 1020 nt, Artificial Sequence
  derived and/or modified sequence opt3 from CTSB__Homo_sapiens__NP_680093
auguggcagcugugggccagccucugcugucuucugguguuggcuaacgcaagauccaggcccucuuuccacccuuuaucagacgagcuggucaauuacguuaacaagcggaauaccacauggcaagccggccauaacuuuuauaauguggauaugaguuaccuaaaacgccucugcgggacuuuccugggagguccaaagccgccccagcgaguaauguuuacggaagaccuuaaacugccugcgagcuucgaugcucgugagcaguggccacagugucccaccaucaaggaaauuagagaccaaggcuccugcgggucuuguugggccuuuggagcaguggaggccauaucggauaggaucugcauucacacaaacgcucaugucucaguggaaguuagcgcagaggacuugcucacuuguugcggcaguauguguggugaugggugcaauggaggcuauccugccgaggcuuggaacuucuggacccggaaaggccugguguccgggggacuguacgaaucucacgucgguugucgcccauauagcauucccccuugcgagcaucacgugaauggcuccagaccaccgugcacaggggaaggagacacccccaaguguucaaagaucugcgagccuggcuacaguccaacuuauaaacaggauaagcacuacgguuacaacagcuauucuguauccaauucagagaaagacaucauggccgaaauauacaagaacgggcccguugagggagcguuuagcguguauagugauuuccucuuauacaaaucuggcgucuaucagcaugugacaggcgaaaugaugggagggcacgcaaucaggauucuggguuggggcguggagaaugggaccccuuacuggcuugucgccaacuccuggaauacggacuggggagauaacggcuuuuucaagaucuugcggggucaggaccauugugggauugaaagcgagguuguggcuggcaucccacgcacugaccaauauugggagaagauauga

SEQ ID NO: 54945 - RNA, 426 nt, Artificial Sequence
  derived and/or modified sequence opt3 from CTSC__Homo_sapiens__NP_001107645
augggcgccgggcccagccugcuccuugcugcacuguuguuacugcuauccggagacggugccgugagaugcgauaccccugcgaacuguacauaccucgaccugcuuggcacuugggucuuccagguugggucuucaggaagucaaagggaugugaauugcagcguaaugggcccacaggagaagaaaguggucguguaucugcagaaguuggacacggcuuacgaugaccucgguaacuccgggcacuuuaccaucauuuauaaucagggauucgaaauaguucugaacgauuacaaaugguuugccuucuuuaaggacgugacagauuucaucucucaccuguuuaugcaacucggcacugucggcauuuaugacuuaccgcaucugcggaauaaacuugcaaugaaccgccgauggggguga

SEQ ID NO: 54946 - RNA, 1239 nt, Artificial Sequence
  derived and/or modified sequence opt3 from CTSD__Homo_sapiens__NP_001900
augcagcccagcucccugcucccucuugcccugugcuuguuagcugcaccagccucugcgcuggugagaaucccgcuacacaaguucaccucaauuaggcggacaaugagugaggucggcgggagcguugaagaccucauagcuaaaggacccguguccaaguacucucaagccguaccugcagugacugaggguccaauccccgaaguccugaaaaacuauauggaugcccaguacuauggcgagauugggaucggaacgccuccacaguguuuuaccgugguuuucgacacaggcucgucaaaucuuugggugcccagcauucauugcaagcuguuggauaucgcuuguuggauacaccauaaauacaacagugacaaguccucuacuuaugucaagaaugguaccagcuuugauauccacuacggguccggaucacucaguggcuaucugagccaggacacagugucuguaccuugccaauccgcaucaagcgccagugcucugggcgggguuaaaguggaacgccaggucuucggagaggccaccaagcagccagguauuacuuuuaucgcggcaaaauucgauggcauucucgggauggccuacccgcgaaucucugugaacaauguguuacccgucuuugacaaccugaugcagcaaaaacuuguugaucagaauauauucuccuuuuacuugagccgugacccugaugcucagccaggaggcgagcugaugcuaggugggacagacucgaaguauuacaagggaucucucuccuaucugaacgugaccagaaaggccuacuggcagguacaucuugaucaaguggaagucgcaucaggccugacguuguguaaagagggcugcgaagcuauuguggacacugggaccagucucaugguuggacccguggacgaggucagggagcugcagaaggccaucggugcggugccuuuaauucagggcgaauauaugaucccaugugagaaaguaagcacacugcccgccaucacucucaaacuugggggaaagggcuacaagcuguccccggaagauuauaccuugaaaguuucucaagcagguaagacacuaugccugagcggguucaugggcauggacauuccucccccaucaggaccucucuggauacugggcgauguguuuaucgggcgguacuacaccgucuucgaccgcgauaauaacagagugggauuugcugaggccgcuaggcuuuga

SEQ ID NO: 54947 - RNA, 1191 nt, Artificial Sequence
  derived and/or modified sequence opt3 from CTSE__Homo_sapiens__NP_001901
augaagacccugcuccuucuguuguuagugcugcuagagcucggcgaagcccaggggagccugcacagagucccccuuaggcggcacccuucccugaaaaagaaauugcgcgcucgaucucaacucucagaguucuggaagagucacaaccuggacaugauccaguuuacagaaagcugcuccauggaucagucugcaaaagagccacugauuaauuaccucgacauggaauauuucggaacuauaucgaucgguucaccgccccagaacuuuacgguuauuuucgauaccggcagcaguaauuuaugggugccuuccguauacuguacaucuccagccugcaagacucauagccguuuucaacccucccagucaaguaccuauagccagccugggcagucuuucuccauccaauacggaacaggcucacugagcgguauuaucggggcggaccaggugagugucgagggacuuaccgugguuggccagcaguuuggcgagucugugacugaaccagggcaaacauucgucgaugcugaguuugacggaauauugggucugggcuaucccucccuagccguagggggagugaccccuguuuucgauaacaugauggcacagaaucucguggaccugccaauguuuagcgucuacaugucgucuaacccggaaggcggugccggguccgagcuuaucuucggaggcuaugaucacucacauuuuaguggcagccugaauugggugcccgugacgaagcaggcuuacuggcaaauugcauuggacaacauccaggucgggggaacuguuauguucuguuccgaggguugccaggccauuguggauaccggcacaucucucaucacugggccuagcgacaaaauaaagcagcugcaaaaugcuauuggagccgcgccaguagauggcgaauacgcaguggagugugccaacuuaaaugucaugcccgacgugaccuucacaaucaacgguguuccuuauacccugucaccaacggcuuacacucuccuugacuuuguggaugggaugcaguucugcaguuccggcuuucagggacuggacauucaucccccggccggcccuuuguggauccuaggggaugucuucaucagacaguuuuauagcguguucgacaggggaaauaaccggguaggucuggcacccgcuguuccauga

SEQ ID NO: 54948 - RNA, 1455 nt, Artificial Sequence
  derived and/or modified sequence opt3 from CTSF__Homo_sapiens__NP_003784
auggcccccuggcugcagcuccuuagccuguugggcuuacugccuggggcuguggcagccccagcgcaaccgagagcugccuccuuccaggcauggggacccccuucuccagagcuacucgcccccaccagguuugcucuggaaauguucaaccggggucgcgcagccggcacacgagcuguccuugggcugguucguggaagagugaggcgggccggccaggguucauuguacagucucgaggcgacucuggaggaaccuccaugcaaugaccccaugguaugucgccugccugugagcaagaaaacgcucuuaugcuccuuucagguccuggaugaacuugggagacacguguugcugaggaaggacuguggaccaguugauaccaaagugccgggcgcaggcgagcccaagucugccuucacacaagggucggcuaugaucucaagccuaagucagaaccauccugacaaucggaacgagacuuuuuccucugucauuagccuccugaaugaagauccacuuucccaggaccugcccgugaaaauggccucaauauucaagaacuuuguaaucaccuauaaucgcacauacgagaguaaggaagaggcacgauggagauugagcguuuucgugaacaauauggucagggcucagaaaauucaagcccucgaucggggaaccgcgcaguauggugugacuaaguuuucugaccugacagaggaagaguuccguaccaucuacuuaaacacgcugcuccgcaaagaaccuggcaauaagaugaaacaggccaaguccgugggggaucuugcaccacccgagugggacuggagaucaaagggagcugucacuaaaguuaaggaucagggcaugugcgguagcuguugggccuuuagugugaccgggaacguagaaggacaaugguuccugaaucagggcacauugcuaucucuguccgagcaggagcuccuggacugcgauaaaauggacaaggcuuguaugggcgggcuuccgagcaacgccuauucggcaauuaaaaaucugggagguuuggaaacugaggacgauuacucuuaucaaggccacaugcaguccugcaacuuuucagccgaaaaggcuaaaguguacaucaacgacagugucgagcucagccagaaugaacagaagcuggcggcaugguuagccaagagggggccuauauccguggcuaucaacgccuucggaaugcaauucuaccggcauggcauuucucgaccccugcgcccacuauguagcccuuggcucaucgaucacgcaguucugcuuguggguuaugggaauagaucagacguccccuuuugggccauuaaaaacaguuggggcaccgauuggggagagaagggcuacuauuacuugcauaggggguccggagcuugcggugugaauacaauggccagcucugcaguaguugacuga

SEQ ID NO: 54949 - RNA, 768 nt, Artificial Sequence
  derived and/or modified sequence opt3 from CTSG__Homo_sapiens__NP_001902
augcagccccugcuccuucuguuggccuucuuacugccuaccggcgcugaggcaggggaaaucauuggagguagagagagcaggccacacucccggccguacauggccuaucuacaaauacagucucccgcgggccagucacgcugcgggggauuucucgugcgagaagacuucguccugacagcugcccauuguuggggcaguaacaucaauguuacucuuggugcacacaacauucagcguagagagaauacgcaacagcauaucaccgccaggcgggcuauucgccacccucaguacaaccagagaacaauccaaaaugauauaaugcuguugcagcucagcaggcgggugcgccgaaacagaaauguaaacccaguggcacugcccagggcccaggaagggcugcggccuggaacucucugcaccgucgcuggcuggggccguguguccaugcgcagagggacagacaccuuaagggagguucagcugcgggugcaacgagaucgccagugucuuagaaucuuuggaucuuaugacccaaggcggcagauuugcgucggugaucgcagagagaggaaggccgcguucaaaggcgacagcgggggacccuugcuguguaauaacguggcacauggcaucguaucauacgguaagagcagugggguuccuccagaaguguuuacucgugucuccucuuuccuaccguggauucggacaaccaugcgaucguuuaaacuccuggaucaaauggagacgccccuuuga

SEQ ID NO: 54950 - RNA, 1008 nt, Artificial Sequence
  derived and/or modified sequence opt3 from CTSH__Homo_sapiens__NP_004381
augugggccacccugccccuccuuugcgcuggcgcauggcuguugggggugccugucuguggagccgcggaguuaugcguuaacagccuggaaaaguuccacuuuaaauccuggaugucuaagcauagaaaaacauacucaacugaggaauaucaccauaggcuacagacguucgcuaguaauuggcggaagaucaacgcccacaauaacgguaaucauaccuuuaaaauggcacucaaccaauucagcgacauguccuuugccgagauuaagcacaaguaccuguggucugaaccacagaauuguucggcuacaaaaucaaacuaucuucgcggcacugggccguaucccccuagcguggauuggcgaaagaaaggaaauuucguaaguccagugaagaaccagggcgcaugcgguuccuguuggaccuuuucuacaaccggggcccuggagagcgcuauagccaucgcgacuggaaaaauguugucccucgcagagcagcaacuggucgacugcgcccaggauuucaauaaccacggcugucagggcgggcugcccucacaggcuuuugaauacauucucuacaauaagggaaucaugggugaggacacauauccuuaccaaggcaaggauggguacugcaaauuccagccaggaaaggccauuggcuuugugaaagacguugcaaacaucaccauauaugaugaagaggcuaugguggaggccgucgcguuauacaaucccgugaguuucgccuuugaaguaacgcaggacuucaugauguaucguacugguaucuacagcucuaccuccugucauaagacaccugauaaaguuaaccacgcagugcuggcugucggguauggagagaagaacggcauuccauacuggaucgugaaaaauucauggggcccgcagugggggaugaacggauauuuccuuauugaaagagguaagaauaugugcggcuuggccgcuugugccagcuaccccaucccucugguguga

SEQ ID NO: 54951 - RNA, 1002 nt, Artificial Sequence
  derived and/or modified sequence opt3 from CTSL__Homo_sapiens__XP_005251773
augaaccccacccugauccucgccgcuuucugccuuggcauugcaagcgccacacugacuuuugaccacuccuuggaggcgcaguggacgaaguggaaagcuaugcauaauagauuauacgggaugaacgaagagggauggaggcgggccgugugggaaaagaauaugaaaaugauagagcugcacaaccaagaauaucgcgaggguaagcauucuuucaccauggcaaugaaugccuuuggcgauaugacaucagaggaguuccgacaggucaugaacggguuucagaaucguaaaccuagaaagggaaagguuuuccaggaaccacuauuuuacgaagcuccgaggaguguggacuggcgggagaaaggcuauguaacucccgugaagaaccaaggucagugugggagcugcugggcauucuccgccaccggagcucucgagggccagauguuucgcaaaacaggcagacugaucucucuuucggaacagaaucuggucgauuguucagggccucaaggaaacgaggguugcaauggcggguugauggacuacgccuuccaguaugugcaggauaacggaggccucgacagcgaagagaguuacccauaugaagcgaccgaggaguccuguaaguacaaucccaaauacucuguugcaaacgauacugguuuuguggacauuccuaagcaggaaaaggcccugaugaaagcugucgccacaguggggccaaucagcguagcaauugaugcuggacacgaguccuuccuguuuuauaaggaaggcaucuacuucgagcccgacugcucaagugaagauauggaccauggcguucucguggucggguauggauucgagagcaccgagucugauaauaacaaauacugguuagugaagaacuccuggggugaagaguggggcaugggaggguaugugaaaauggccaaggacaggcggaaucacuguggcauagcgucagccgcaagcuacccuacggucuga

SEQ ID NO: 54952 - RNA, 966 nt, Artificial Sequence
  derived and/or modified sequence opt3 from CTSO__Homo_sapiens__NP_001325
auggacgugagagcccugcccuggcucccuuggcuucugugguuguuaugcaggggcgggggagaugcugacagccgggcaccauucaccccgacauggccccgcucccgagagcgugaagccgcggcuuuuagagagucucugaacaggcaccgguaccuaaauucacucuucccuagugaaaacagcacugccuuuuaugguaucaaucaguucuccuaccuguuuccagaggaguucaaggcaauuuaucuucgcucuaaacccucgaaguuuccuagauacucagccgaaguccauaugagcauaccaaacguuagucugcccuugagguucgauuggcgggacaaacaagugguaacccaggugcgcaaucagcagauguguggcgggugcugggcuuuuuccgucgugggagcaguugagucugccuaugcuaucaagggcaaaccucucgaagaucugagcgugcaacaggucauugacuguuccuacaacaauuaugguugcaacgggggaucaacgcugaaugcccucaacugguuaaauaagaugcaagugaagcugguaaaagauagugaguacccauucaaggcgcagaacggccuuugucacuacuuuagcggcucucauuccggguucucaaucaaaggauauagcgcauacgacuuuagugaucaggaagacgagauggccaaggcuuugcugacauucgguccgcuaguugugauugucgaugccgugucuuggcaggacuaucucggcgggaucauacagcaccauugcuccagcggagaggcaaaucacgcugugcugaucacuggcuucgauaaaaccgguucgacacccuacuggauuguccgaaacucuuggggguccucauggggaguugacggcuaugcccacgugaagaugggcaguaauguaugugggaucgcggacagcguguccucuauuuuugucuga

SEQ ID NO: 54953 - RNA, 1005 nt, Artificial Sequence
  derived and/or modified sequence opt3 from CTSV__Homo_sapiens__NP_001188504
augaaccugagccucgugcuugccgcuuucugccugggcaucgcauccgccguccccaaguuugaccagaauuuggauaccaaaugguaccaauggaaggcgacacacagaagguuauauggggcuaacgaggaaggauggcggcgcgccguuugggagaaaaauaugaagaugauugaacugcauaacggugaguacucucagggcaaacacggguucacuauggcaaugaaugccuuuggagacaugacgaacgaagaguuccgacagaugaugggcuguuuucguaaucagaaguucagaaaggguaaaguguuuagggagccucuauuccucgaucugccaaagucaguagacuggcggaaaaagggguaugugaccccggucaaaaaccaaaagcagugcggaaguuguugggcuuuuagcgcaacaggcgcccuugaaggccagauguuccgcaagacugggaaacugguguccuugucugagcagaaucucguugauugcucgagaccccaaggaaaccaggguuguaauggcggguuuauggcuagggccuuccaguacgugaaggaaaacggaggccuggacucagaggagagcuauccuuacgucgcgguggaugaaauaugcaaauaucggccagagaauaguguagcaaacgacaccgguuuuacaguuguggcccccgggaaggaaaaagcucugaugaaggccgucgcaaccgugggaccuaucuccguggcuauggaugccggccauucuagcuuccaguucuacaaauccggcauuuacuuugagccagacuguucaaguaagaaucucgaucacggggucuuaguugugggauaugguuucgaaggcgcgaacagcaacaauucuaaguacuggcuggugaaaaacuccugggggcccgaguggggaucaaauggcuauguaaagaucgccaaagacaagaacaaucauugcgguauugcaacugcugccagcuacccuaacgucuga

SEQ ID NO: 54954 - RNA, 1131 nt, Artificial Sequence
  derived and/or modified sequence opt3 from CTSW__Homo_sapiens__NP_001326
auggcccugaccgcucaccccagcugccuccuugcacuguugguggccggcuuagcgcaggggaucagaggaccucugagggcucaagaccuagguccacagccgcucgagcugaaggaagccuucaaacuuuuucagauucaguucaaccgguccuaccugucucccgaggaacaugcacaccgcuuggauauauuugcccauaaucucgcucaagcacagcgacugcaggaggaagaccugggcacagccgaguucggggucacuccuuuuucagaucucacggaggaagaguucggacaguuauauggcuaccguagagcugccggugggguuccaaguaugggaagggaaauccggagcgaggagcccgaagaguccgugccuuuuucuugugacuggcgcaagguagcgggcgcaauuucgccaaucaaagaucaaaagaacugcaauuguugcugggccauggcugccgcaggcaacauugaaacccuguggagaaucucauucugggacuuuguggaugucagcgugcaggagcuuuuggacugugggaggugcggagaugguugucacggcggguucguuugggacgcuuuuauaacagugcugaauaacaguggacuagccuccgaaaaagauuaucccuuccagggcaagguccgggcgcaucgcugccacccuaagaaauaccagaagguggccuggauccaagacuuuauuaugcuccagaauaacgagcaccgaaucgcacaguaucuggcuacuuacgguccaauuaccguaacaaucaauaugaaaccgcuucaacuguauagaaaggggguuauaaaagccacccccacuacaugugauccucaguugguggaccauucuguccuccuggugggauucggcagcgugaaguccgaggaaggcauuugggcugagaccgucucaagucagagccagccacaacccccucacccaacgcccuacuggaucuuaaagaacucuuggggagcccaguggggugaaaaaggguacuucaggcugcaucggggcuccaauacuugcgggauuaccaaguuuccgcucacagcacguguucagaaaccugacaugaagccccgcgugucauguccaccuuga

SEQ ID NO: 54955 - RNA, 912 nt, Artificial Sequence
  derived and/or modified sequence opt3 from CTSZ__Homo_sapiens__NP_001327
auggccagaaggggccccggguggcggccucugcuccuucugguguuguuagcuggagcagcccaggguggccuguacuuccgccgagggcaaaccugcuaucguccacuaagaggagacggccucgcgccgcuggguaggagcacauacccccggccucacgaguaucuuuccccagcugaucugcccaagucuugggacuggcgcaacgucgaugggguuaauuacgccucaaucacuagaaaccagcauauuccucaguauuguggaaguugcugggcacacgccagcacguccgcuauggcagacaggauaaauaucaaacggaagggcgccuggccaucuaccuugcucucggugcagaacguaauugauuguggcaaugcugggucaugcgaaggagguaacgaccugagcgugugggauuacgcccaucaacacggcauccccgacgagacauguaauaacuaucaggcgaaagaucaggaaugcgacaaguuuaaucagugugggacuugcaacgaguucaaagaaugucaugcaauucgcaauuacacccuguggcgagucggagauuacggcagucucuccgguagagagaagaugauggccgagaucuaugcuaacgggccuauaucuugcggaaucauggccacagaaagguuagcaaauuacaccggcggcauuuaugcugaguaccaagacacuacauauaucaaccacgugguuagcguggccggguggggaauuuccgaugguaccgaauacuggaucguccguaauucauggggcgagccauggggagagcggggguggcugcgcauagugacgaguacuuauaaggacggcaaaggugcgagauacaaccuugccauugaggaacacuguaccuuuggggacccgaucguauga

SEQ ID NO: 54956 - RNA, 4992 nt, Artificial Sequence
  derived and/or modified sequence opt3 from CTTNBP2__Homo_sapiens__NP_219499
auggccaccgacggcgcuagcugcgagcccgaucuguccagagcaccugaagacgccgcgggggcugccgcagaggccgcuaagaaagaguucgauguggacacacucucuaagucagaacuuaggaugcuguugagugucauggaaggagaguuagaggcacgggaucugguuaucgaagcccuacgcgcucgacguaaagagguguuuauucaggaaagauacgguagguucaaccucaaugacccauuucuggcccuucaacgggauuaugaggcgggcgcaggggacaaggagaaaaagccgguauguacuaacccccugagcauauuggaagccgugauggcucacugcaagaaaaugcaggagcgcauguccgcccagcucgcagcugccgaaucuagacagaagaaacuggagauggaaaagcugcaacuccaggcguuagagcaggagcauaaaaagcuggccgcaaggcuugaagaggaacggggaaagaauaaacaggucguguugaugcugguuaaggaguguaaacaacuaucgggcaaggugaucgaagaggcucagaaacucgaggaugucauggccaagcuggaagaggagaaaaagaagacgaacgaacuugaagaggagcugucagcugaaaaacgccgaagcaccgagauggaagcccagauggagaagcaguugagugaguucgacacagaaagagagcaacucagggcaaaacugaaucgggaagaggcccacacuaccgauuuaaaggaagagauugacaaaaugcguaagaugaucgagcagcugaagcgcgguuccgauucuaaaccuagccucucccuuccaagaaagacaaaagacaggcggcuggugucaauuaguguagggaccgaaggaacuguuacacgaagcguggcuugccagaccgacuuggucacggagaacgcggaucauaugaagaaacuaccccugacuaugccugugaagccaucuaccggcagcccccucgugucagcaaaugccaagggcagcgucuguacaagugcuacuauggcccgcccugggaucgacagacaagcaucuuacggagaucugauaggugccuccguuccagcuuuuccgcccccuagcgccaacaaaaucgaagagaauggcccaucgaccgggucuacacccgacccuaccuccucaacgccaccccuuccgaguaacgcagcgccucccacugcucagacaccaggaauugccccucagaauagccaggcacccccaaugcacucccugcauucucccugcgccaacaccagcuugcacccuggccucaauccaaggauccaagcugcccgguuccgcuuucaggguaacgcaaaugauccggaccagaacgggaacacuacacagucacccccuaguagagauguguccccaaccagcagggacaaucugguagcuaagcaauuagcccguaacacggugacccaggcgcugucucgguucacaucaccccaggccggagcuccuagucgaccaggcgugcccccgacuggcgaugucgggacccacccuccaguuggaagaacaagccuaaaaacucaugguguggcaagggucgaccgcggcaaucccccucccauuccaccuaagaaacccgggcucucccagaccccaucuccgccucacccccaacugaaggugaucauagauucgagccgggccuccaacacaggagcuaagguagacaauaaaaccguugccucaacuccaaguucucuuccccagggcaacagagugauuaaugaagagaacuugccuaagagcuccucaccacagcugcccccuaaaccgagcaucgaccucacggucgcaccagcggguugugccgugucugcucuggccacaucccaggucggggcauggcccgcugccaccccuggccuuaaucaaccagcaugcagugauagcucucuggugauucccacuaccaucgccuuuuguuccucaaucaacccuguuagugcuagcucgugcaggccgggagcguccgacucuuugcucgugacagccagcggcuggucacccagucugaccccauuacugauguccgggggaccugcaccccuagcuggucgcccaacucuccugcagcaggccgccgcucaaggcaauguaacacuuuugucuaugcugcucaacgaggaagggcuggauauuaauuauagcugugaggacggacauuccgcauuauacucagccgcgaagaacggccacacggauugcguccgacugcuuuugagcgcugaagcccaggugaaugcagccgacaaaaacgguuucaccccucucugcgcugcagccgcgcaggggcacuuugaguguguugaacugcuaauaaguuaugaugcuaacaucaaucaugccgcagacggcggacagacuccccuguaccucgccugcaagaacggcaauaaagaguguauuaagcugcuuuuggaggcugggacaaaccggucugugaagaccacagauggauggacuccaguccacgccgcaguggacaccgguaauguagauucccugaaauuacucauguaucaucguaucccggcucacggcaacagcuucaaugaagaggaaucggagucaucuguguuugaccuggaugggggagaggaaaguccugagggcauauccaagcccguugucccagccgaccuuauuaaccaugcgaauagagaagguuggacggccgcacacaucgcugccagcaaaggguucaagaacugccuggagaucuuguguaggcacggcggacucgaacccgagcgccgggacaaaugcaauagaaccgugcaugauguggcuacagacgauuguaagcaucugcuagagaaccugaaugcacucaagauuccucugaggaucucugucggcgaaauugagccaagcaacuacggguccgacgaucuugaaugcgagaauacuauaugugccuugaacauccgaaaacaaaccucaugggacgauuucaguaaggccguuagccaggcucugacaaaccacuuucaggcgauuucuuccgacggaugguggucauuagaagaugugacuugcaauaacaccacggacaguaauaucggccucagcgcacgcuccauccggucuauuacacuggguaacgugcccuggucgguagggcagagcuucgcccaaucaccuugggauuuuaugaggaaaaauaaggcugagcacauaaccguccuucuguccggaccgcaggagggcugucuaaguucugugacuuacgccagcaugaucccacuccagaugaugcagaacuaucugagauugguugaacaauaccacaaugugauuuuccauggucccgagggcucccugcaggacuauaucguccaccaguuagcacucugccugaaacaucgucaaauggccgcuggguuuucaugcgaaauugugcgcgcggagguugaugccggauucucuaaggaacagcuucuggacuuguuuaucagcagugcaugucucauaccugugaagcagucccccagcaaaaagaaaaucauuaucauucuggagaaccuagagaagucuucacuguccgaacuucuccgggacuuccuggcuccauuggagaauagaaguacagaaagcccuugcaccuuucagaaaggcaacgggcugucggaguguuacuauuuccacgagaauugcuuuuuaaugggaacuaucgccaaggcaugucuccaaggcucugaucugcuuguacagcagcauuucagguggguccagcugcgaugggacggugaacccaugcaaggguugcuccagcgguuucugcgcagaaagguggugaacaaauucaagggacaggccccauccccuugcgauccggucuguaaaauaguugacugggcucuaagcguguggaggcagcuuaauucaugccuggcccggcucggcacccccgaggcgcuguuggguccaaaguacuucuuaaguuguccuguagugcccggccacgcacaagucacagugaaauggaugucuaagcuguggaacgggguuauugccccacgagugcaggaagcuauccucuccagagccagcgucaaacgccagccuggauuuggccagacgaccgcuaagaggcaccccucacaagggcagcaggcagugguuaaggccgcucugaguauucuucugaauaaagccguguugcauggaugcccgcuaccacgugcagagcuggaucaacacacugcggacuucaagggcgguagcuuuccucucuccaucgucucuagcuauaacacauguaacaaaaagaaaggggaauccggagccuggcggaagguaaauaccucacccagaaggaagucuggccgcuucagucugccaacauggaacaaacccgaucuuucgacugaggguaugaagaauaaaaccauaagccaguuaaacugcaaucgaaacgcuucccugucuaagcagaaaucacucgagaaugacuugagccugacgcucaaccuggaucagagacuuucccugggcagugacgaugaagccgacuuggugaaggagcuacaaucuaugugcagcucaaaguccgaaagugacaucagcaaaauugcagauucucgggacgaucugaggauguuugacuccucagggaauaacccuguucucagcgcuacaaucaauaacuuacgcaugccggugucgcagaaggaggucucuccccugaguucccaucagaccacugaauguagcaauucaaaauccaagaccgagcuuggagugucucguguaaagagcuuccugccagugccuagaaguaaagucacacagugcucccaaaacacuaagcgguccucuucaaguuccaauaccaggcagauugagaucaacaauaacagcaaagaaguuaacuggaaucuccacaagaacgagcauuuggaaaaacccaauaaguga

SEQ ID NO: 54957 - RNA, 1905 nt, Artificial Sequence
  derived and/or modified sequence opt3 from CTTN__Homo_sapiens__NP_001171669
auguggaaggccagcgcuggccacgcaguguccaucgcccaggacgaugcgggggcugacgauugggagaccgaccccgauuucgucaacgacguuucugaaaaagagcaaagauggggagccaagacagugcaggguucaggccaucaggaacacauuaauauacauaaacugagggagaacguauuucaggaacaccaaacucucaaggagaaagagcuugaaacggggccuaaggcaagucauggauacggcgguaaguucgggguggagcaggaucggauggacaaaagcgccgucggacacgaauaucaguccaagcugucuaaacacugcucacagguggauucgguucgcggcuuuggcgggaaguucggagugcaaauggaccgagucgaucagagcgcuguggguuuugaguaccagggcaaaaccgagaagcaugcaagucagaaggacuauuccucuggguucggaggcaaauacgguguacaagccgaucguguugacaagagcgcugugggguuugacuaucagggaaaaacagaaaagcacgagucccagagagauuacucaaaaggcuucggcgggaaguauggaaucgacaaagauaaggucgacaagagugccguggguuuugaauaccaaggcaaaacugagaagcaugaaagccagaaagauuacgugaagggguucggaggcaaauuugguguccagaccgacaggcaggauaagugugcguuggggugggaccaccaagagaaguuacagcugcacgagucucagaaagauuauuccaagggcuucggaggcaaauacgggguucagaaggaccggauggauaaaaaugcaucaacauuugaagacgugacccaaguaagcagugccuaucagaagacugugccagucgaggcugugacaucuaagaccuccaacauucgcgccaauuucgaaaaccuagcaaaagagaaggaacaggaggacagaaggaaagcugaggccgaacgggcgcagcgcauggccaaggagcgacaagaacaggaggaagcaagaaggaaacucgaggagcaggcucgggccaagacgcagacuccgcccguuagcccugcuccacaacccaccgaagagaggcugccuucgucuccaguguacgaagaugccgcauccuucaaggccgagcuuucauaucgcggacccgucagugguacagagccugaaccaguguacagcauggaggcugcggacuauagagaagcauccucucagcagggccuggccuacgcuacugaggccguauacgaaagcgcagaggccccggggcauuaucccgcugaggauucaaccuacgacgaauaugagaaugauuugggaaucacagccguugcacucuacgacuaucaagcggcuggcgaugacgaaauuaguuuugauccugacgauaucauaaccaacaucgagaugauugacgaugguugguggcguggggugugcaaaggccgguuccgagaacuggccuuuuccuguguccgcguggcacuggucccaaucaagugcagcagagaccuccccggacaggccaggggcuuacggucugcucuguggcgcguggggagaaaagacuguccuaggcguggagccucaagucggguuagccuuuugggucgaagaggccuggggcuaauggaggugaauccagagcucucccaccccgaacauaggucuugccacguacgcugggagauuugucugugccauacggucacugcacggagaaucaggaaacuuauaucguuccugcgcagccgagaagcuggaccggugccuuccuguucacagguuggcggugugaguuuucagaaggucacauggaagugcuuggggaccugggugcccgaguguccauga

SEQ ID NO: 54958 - RNA, 1047 nt, Artificial Sequence
  derived and/or modified sequence opt3 from CTU1__Homo_sapiens__NP_660275
augcccgccccuccaugcgcuagcugucacgcagccagagcggcucugaggcggccgcucuccggccaagcccuuugcggggcauguuucugcgccgcuuuugaggcagaagugcugcauaccgucuuggccggacgcuuacugcccccuggugcuguuguggccguaggcgcgucugggggaaaggacucaacagugcuagcacacguccuccgagcccuggcuccacgucuuggcaucagucugcaauugguggccguugaugaggguauugggggauacagagacgcagcucucgccgcggugaggcggcaggccgcacgcugggaacugccccugacugucguggcuuaugaggaucucuucggcggcuggacgauggacgccguagcuagaagcaccgccggguccggaaggucucggucguguugcacauuuugugguguuuuacgcagacgagcacuggaagagggcgccaggcgggugggggcuacucauauagucaccggacacaacgcggaugacauggcagagacagugcuuaugaauuucuugcguggcgaugccggucgccuggcuagagggggaggccuaggcucaccuggggaaggaggugcccucccaaggugccggccccugcaguuugcaagccagaaagaggugguccuuuacgcccauuuccgacgccuggacuauuuuagugaagaguguguuuacgcuccugaggccuucagaggccacgcaagggauuugcucaagcggcuggaagcggcucgcccauccgccguguuagaccugguacacucugcagagagacucgcccuugcuccggccgcaaggcccccucguccaggggcuugcagccgguguggagcccuggcgucccgagccuugugccaggcuugcgcacuacuggauggccucaacagagguaggccccgccuggccaucgggaaaggccggagaggacuugacgaagaggcuaccccuggcacuccaggggaucccgccaggccgccugcaucaaaggcggugcccacauuuuga

SEQ ID NO: 54959 - RNA, 246 nt, Artificial Sequence
  derived and/or modified sequence opt3 from CTXN3__Homo_sapiens__NP_001041717
auggacggcgggcagcccaucccuagcucccuggugccacucggaaacgagucugccgauucaaguaugagccuugaacaaaagaugaccuucgucuuuguuauucuguuguucauauuuuuagguauccugauugugagaugcuucaggauccuacucgacccguaccgguccaugcccacaucuacuugggcugauggccuggaggggcuugaaaaaggacaguuugaccacgcacuggccuga

SEQ ID NO: 54960 - RNA, 10872 nt, Artificial Sequence
  derived and/or modified sequence opt3 from CUBN__Homo_sapiens__NP_001072
augaugaacaugagccugcccuuccucuggucccuucugaccuuguuaaucuuugccgaggugaauggcgaggcuggggagcuggaacuacagagacaaaagagaucuauuaaccuccagcagccucggauggccacggagcgcggaaaucuggucuuccuuacugguucagcccagaacauugaauuucgaacgggcagucuggggaagaucaaguugaaugacgaggaucucagcgagugccugcaccaaauucagaaaaacaaggaagacaucauugagcugaaaggauccgcgaucggccucccacagaauauaucuucgcagaucuaccaauuaaacucaaagcugguugaucuugaacguaaguuccaggguuugcagcagaccguggacaaaaagguauguagcaguaauccgugccaaaacgggggaacaugucugaaucuacaugauuccuuuuucugcauuugucccccucaguggaaaggcccacucugcucugcugacgugaacgagugugagaucuauagcggcacuccccuguccugccagaaugggggaaccugugucaacacaauggguucauacaguugccacuguccuccagaaaccuauggcccccaaugcgccagcaaguacgaugacugcgaagggggcucuguggccagauguguucauggcauuugcgaggaucuuaugagggagcaggccggugaaccuaaauauuccugugugugcgacgcuggguggauguuuucaccaaauagcccggcauguacucuggaucgggacgagugcaguuuccagcccggaccuuguucuacauugguccagugcuuuaacacccaaggcuccuucuacuguggcgccugcccaacgggguggcagggaaacgguuauaucugugaggauauuaaugaaugcgagauuaacaauggcgggugcagcguggcucccccuguagaauguguuaacacuccaggaucgucucacugccaggccugucccccgggcuaccagggugacgggcgcgugugcacccucacagacaucuguuccgucucaaauggcggaugccauccugaugcgaguuguagcuccacucugggcucuuuaccccugugcaccugucucccaggguacacaggaaacgguuauggcccuaaugggugcgugcaacuuagcaacauuugucugucacaccccugcuugaauggacagugcaucgacaccgugaguggcuacuuuuguaagugcgauuccgguuggacgggggucaacuguacugagaauaucaacgaaugccuaagcaauccaugucugaacggcggaacaugcguugacggcguggauucuuucucaugugagugcaccagacucuggacuggggcacugugucagguaccccagcaagugugcggagagagucuuagcgguauuaauggcuccuuuucuuauaggucgccugacgucggguacgugcacgauguuaacuguuucugggugauaaagacagaaaugggaaaaguccugcggaucaccuucacguuuuuccgcuuggagagcauggacaacugcccacaugaauuucuccagguguaugauggcgacuccucaagugccuuccagcugggucgauuuugcgggucuagcuuaccgcacgagcugcuauccucagauaaugcucucuacuuccaucuguauagcgaacaccuuagaaacggcaggggauuuaccguacggugggagacacagcaacccgaguguggcgggauuuugacuggaccuuacggcucuaucaaguccccagguuaccccgggaauuauccuccaggacgugacugcguuuggauaguggucaccagucccgaccugcucgugacauucacuuuuggcacccugagccuugaacaccaugaugacuguaacaaagauuaccuggagauucgcgacgguccguuguaucaggauccucuccugggcaaguucugcacaaccuuuucugucccacccuuacagacuacggggccuuucgccagaauccacuuucauuccgacucacaaaucagugaucagggauuccacauuacauaccugaccagccccucggaccuaagguguggcgggaauuauacugauccagaaggagaacucuuccugccugagcuuuccggccccuuuacccauacacggcagugcguguacaugaugaaacagccacaaggugaacagauccagauuaacuucacccacguugaguugcagugucaaucugacagcucacagaauuauauagaagugcgagauggggagacucugcucggaaagguaugcggcaacgguacaaucagucacauuaaauccaucacaaauucugucuggauccgcuuuaagauugacgcaagcguggaaaaggcuuccuucagagccguuuaccagguggcguguggcgaugagcugaccggggagggagucauaaggucaccguuuuucccuaacguguaccccggcgaacggacuugccgcuggacaauccaucagccacaaagccagguaauuuuacugaauuuuaccguguucgagaucgggaguucugcccacugugaaacagacuauguugagauuggauccagcucgauccuuggcucacccgaaaacaaaaaguacugcgguacugacauaccuucuuuuaucaccagugucuauaauuucuuguacgugacguuugugaaauccagcucuaccgagaaccauggguucauggcaaaguuuagcgcugaggaucucgccugcggagaaauucugacagaguccacuggcaccauccagucaccaggucaccccaaugucuauccucacggcauuaacuguacauggcauauccuaguucaaccgaaccaccugauacaucucauguucgaaacuuuccaccuggaguuucauuacaauugcaccaacgacuaucuugaaguguacgauacggacagugagacuagcuuggggagauacuguggaaaaucuauuccacccucccugaccucaaguggcaauagcuuaaugcucguguucguaacugauuccgaccuggcuuaugagggguuucuuaucaacuacgaagccauuucugcagccacagcuugccugcaggauuauaccgacgauuugggaacuuucaccucgccuaauuuuccaaacaauuaccccaacaauugggaguguaucuauaggauaacaguccguacgggccagcucaucgcggugcacuucaccaacuuuagccuggaagaggcaauugguaauuacuauacugacuuccuagagauccgggaugggggauacgaaaagucaccucugcucggcauauuuuacggcuccaaccugccgcccacaaucauaagucacucuaauaaacuuugguugaaauucaagagcgaccagauugauacccgauccggguuuucagccuauugggacggaucuagcacagguugcggcgggaaccugacuaccaguuccggaacguucaucagcccaaauuacccuaugcccuauuaccauucuucagaguguuauuggugguuaaaauccagucacggcagcgcuuucgaacucgaguuuaaggacuuccaucuggaacaccauccaaacugcacacuugauuaccuggccguuuaugacgguccuucgucuaacucccaccuacucacccaacuguguggggaugagaaacccccauugaucagaagcucaggagacaguauguuuauuaagcugaggacugaugagggccagcagggccgcggguucaaggcagaauaccggcagaccugcgagaauguggucaucgugaaccaaacauacggaauuuuagaaucuauagguuauccgaauccuuacuccgagaaccagcacuguaauuggacuaucagagccaccacaggcaacacgguuaauuauaccuuucucgcuuucgaccuggaacaucacauuaacugcagcacugauuaccuugagcuguaugacgggcccaggcagaugggacgcuacugcggcguggauuugccacccccugguucaacaaccaguagcaaacuccagguacugcuacugacugacggggucggacgacgggagaagggcuuucaaaugcagugguucguguauggcugugggggagaacuuuccggugccacaggcucuuuuagcuccccaggguuccccaaucguuacccuccgaacaaagagugcaucugguacauuagaaccgauccaggaucaucuauccagcucacgauacaugacuuugacguggaauaucacaguagguguaauuucgauguccuggagaucuacggcggucccgacuuucacucgccucgcauugcacaguugugcacucaacggagccccgaaaacccaaugcagguuuccucuaccgggaaugagcuggcgaucagauucaagacagauuuaucaauuaacggaaggggcuucaaugcuagcuggcaggccgugaccggcggguguggagguaucuuucaagcaccuuccggcgagauacauagucccaacuauccaucuccuuaccgaagcaauacugacugcucauggguaauucgcguggaucggaaccacagaguccuccugaacuucacagacuuugaucuugaaccgcaggacuccuguaucauggccuaugaugggcugaguagcaccaugucuagguuggcucguacaugcggacgcgagcagcucgccaaucccaucguguccucaggcaacagccuguuccuacgguuucagucggguccaucuagacaaaauaggggguuccgagcacaguuucggcaggcuuguggaggccauauucugacaaguuccuucgacaccguuagcucaccucgcuuucccgccaacuacccaaauaaccagaauugcuccuggauaauccaagcgcagccuccccuuaaccacauuacgcucucuuucacacauuuugaacuggagagaagcaccacuugugccagggauuucguggagaucuuggacggcgggcacgaagaugcuccguuacggggacgauauugcgguaccgacaugccacacccuauuacaaguuuuuccagcgcacugacucucagauucgucucugacucaaguaucuccgccggcggguuccauaccacggugacagcuagcguuucugccuguggaggcaccuuuuacauggcagaggguauauucaauucgcccggguacccagauaucuaucccccuaacguggaaugcgucuggaauauuguaucaagcccgggcaaccgccugcagcuuuccuuuaucaguuuccagcuggaggacucucaagauugcagcagggacuuuguggaaauucgugagggaaaugcgacuggccacuugguugggcgguacuguggaaacuccuucccccuaaauuauucaaguaucgugggucauacacugugggucagauuuauaucugauggcagcggguccggaaccggcuuccaggccacuuuuaugaaaauuuucgguaacgacaacaucguggggacacacggcaagguagcuucaccauuuuggccugagaauuacccccacaacagcaauuaucaguggaccgugaacgucaaugccucucauguugugcacggaaggauccucgaaauggauauugaggaaauccaaaacugcuacuaugacaagcugcgcauauacgauggcccuuccauucaugcacgacuuaucggggcuuacuguggaacgcagacugagaguuucagcucgaccgguaauuccuuaacauuucacuucuauucugacucaagcauuaguggcaaaggguuccugcucgaaugguuugccguggaugcaccagacggagucuugcccaccaucgccccuggcgcuugcgguggguuccugagaacaggcgaugcgccaguguuucucuucucccccggauggccggacucuuacagcaaccggguugacuguacuuggcugauacaggccccugauucaaccguagagcuuaauauucuguccuuggacaucgagagucauaggacgugcgcauaugauagccuagugauccgcgacggcgauaacaaucuggcucagcaacucgccgucuuaugugggcgugaaauuccaggacccaucagaucuacaggcgaguacauguuuauucgguucacuucagacuccagcgugaccagggccgguuuuaacgcuucuuuccacaagaguugcgggggauaucugcacgcagaucgcggcauaaucacaucgccuaaauacccagaaaccuaucccuccaaucuuaacuguagcuggcauguucuggugcagucaggucucacuauugccguccacuuugagcagccguuccagaucccuaauggcgacucuagcugcaaccaaggggauuacuuggugcugcgaaacggacccgacaucuguuccccaccucucggacccccagggggaaauggccauuuuugcgguagucacgcgucaucuacccuguucacaagcgauaaccagauguuuguacaguucauuuccgaccacaguaaugaagggcagggauucaagauaaaauacgaggcuaagagccuugccugcggcgguaacgucuauauccaugacgcagauuccgccggcuacgugacgucucccaaucacccucauaacuauccaccgcacgcugacuguauuuggauccuagcagcacccccugagacuaggauucaacugcaguuugaagaucgguucgacaucgagguuaccccaaauugcacaucaaacuacuuggaauuaagggaugggguggacagcgaugcgcccauacugucgaaauuuuguggaaccucccucccuaguucucaguggagcucaggcgaggucauguaucugcgcuucagauccgacaauucuccaacucaugugggguuuaaggcuaaguacaguaucgcccagugcggaggcaggguucccggucaaagcgggguggucgaguccauuggacacccuacacuuccguaucgggauaaccuguucugugaauggcaccuccagggcuugucaggccauuaccugaccaucagcuuugaggacuucaaucuacagaacucuagugggugcgaaaaagauuuuguggagauuugggacaaucacacguccggaaacauccugggucguuacuguggcaauacuauaccagauagcauugacacaucaucuaacaccgcaguagugcgcuucguuaccgacggguccgucacugccucgggauuucgacucagauucgaaagcaguauggaggagugcggcggugaucuucaagggucuaucggaacauuuaccucccccaacuauccuaaucccaacccacauggcaggauuugugaauggcggaucacagcuccugagggccgcagaauaacucugauguucaauaacuuaagguuggccacgcaccccagcugcaauaacgaacaugugaucguguucaaugggauucggucaaacaguccacagcuggagaagcucuguuccagcgucaauguaucuaacgaaaucaaaucaagcggaaauaccaugaaggugauauuuuucacagacgguucccgaccguacggcggguuuacugcaucuuauaccaguucggaggaugcuguuugcggaggcagccugccuaacacacccgaggguaauuucaccuccccaggguacgacggagugagaaacuauucacgcaaucuuaacugcgaauggacucugucuaaccccaaucagggcaacagcaguaucuccauacacuuugaggauuucuaccucgaaucacaccaggacugucaauuugaugucuuggaguucagggugggcgacgccgaugggccucugauguggcgguuaugcggaccaucuaaacccacgcuaccucugguuauuccguauagccagguguggauccauuuugucaccaaugaacguguggagcacaucgguuuccaugcgaaguacuccuuuacagacuguggcgggauucagaucggagauaguggcguaauaacuagcccaaacuaccccaaugccuaugacucucucacccacugcucaucccuucuggaggcaccucagggucacacaauuaccuugacuuucagcgacuuugauaucgaaccacauacaacgugugcuugggacagugugaccguuagaaacgggggaucucccgaguccccuauuaucggccaauacugcggcaauucgaaccccaggacuauacagagcgggucaaaucagcuggucgugacauucaacuccgaucacucucuccagggagguggcuucuaugccaccuggaauacccaaacacugggguguggaggcaucuuucauagugacaacgguacuauucgcagcccacacuggccgcagaauuucccugaaaacucacggugcuccuggacggcuaucacccauaagagcaaacaccuugagauuucuuuugauaauaacuuccucauccccaguggggacggacagugucaaaacuccuuugugaaggucugggcaggcacagaggaaguugauaaagcccuguuggccacuggcugcgggaauguggcuccaggaccuguaauuacccccagcaacacauucaccgcgguguuucagucacaggaggcaccagcccaggguuucucugcuucguuugucagccgauguggcuccaauuucacugggccuaguggauacaucauaucucccaacuauccgaagcaauacgacaauaacaugaauugcacguaugugauugaagccaacccacugucaguuguguuacuaacauuugucagcuuccaccuggaggcaagauccgccguaaccggcaguugcgugaaugaugguguucauaucaucaggggguacucugugaugagcacuccuuucgcuaccgucuguggagacgaaaugcccgcgccacucacaauugccggccccgugcuucugaacuuuuacuccaaugagcagauaacugauuucggcuuuaaauucucauaucgcaucauuagcugcgggggagucuuuaacuucucuuccgguaucauuaccaguccugcauacucauaugcugacuacccgaaugauaugcacuguuuguauacaaucacggugagcgacgacaagguuauagagcugaaguuuucggauuucgacgugguaccauccaccucuugcagucaugauuaccucgccaucuaugacggcgcaaacacuagcgauccccugcuugggaaauuuuguggaucaaagcggccucccaaugugaaauccucuaacaacagcauguuacuggucuucaagacagacaguuuucagaccgccaaaggcuggaagauguccuucagacagacucucgguccacaacaggggugcggcggauacuugacaggcagcaauaacaccuuugcuucuccugauucagacuccaaugggauguacgauaagaaccugaauuguguuuggauuaucauugcccccgugaacaaagucauccaccuaacguucaauaccuucgcgcuggaagcagccagcacacgucagaggugccucuaugacuacgugaaacuuuaugauggagacagugagaacgcuaaucuggccgguacuuuuuguggcucuaccguaccagcuccuuucauaucauccgggaacuuuuugacagugcaguucauuagcgaucugacucucgaacgggagggauuuaaugcaaccuacacaaucauggacaugccgugcggcgguaccuauaacgccacuuggacgccccaaaauaucucgucuccaaacaguuccgacccugauguucccuucagcauuuguacaugggugauagacucaccaccucaccagcaggucaaaaucaccgugugggcucugcaauuaacuucucaggauugcacccagaauuaccuucagcugcaagacagcccccaggggcauggcaacucccgcuuucaguucugcggacgaaacgccagugcagucccgguguuuuacucaagcauguccacagcgaugguuauuuucaagucuggcguagugaauagaaacaguaggaugagcuuuacguaucagaucgccgauuguaaucgggacuaccacaaggcuuucgggaaccuccgcuccccaggauggccugauaauuaugacaacgauaaggacugcaccgucacucuaacagcaccccaaaaucauaccauuucacuguuuuuccacucuuuggguaucgaaaacucgguggaguguagaaaugauuuccuggagguuaggaacggcagcaauuccaacaguccacuccuugggaaauacugcggaacucuguugcccaauccuguguuuucucagaacaaugaacuguaucuccgauucaagagcgacucagucacauccgaccggggcuacgagauaaucuggaccagcucucccagugguuguggcgggacauuauauggagaucguggcuccuuuacuucaccaggguacccuggaaccuacccgaacaauacguauugcgaaugggugcugguagcacccgcuggcagacuugugaccauuaacuucuacuuuaucagcauugacgauccaggugacuguguucagaacuaucugacacuauacgaugggccuaaugccucuucgcccuccaguggaccauauugcggcggugacacuagcaucgcaccuuucgucgccucaucuaaccagguguuuauuaaguuccaugcugauuacgcgcgcaggcccuccgccuuucggcucaccugggacagcuga

SEQ ID NO: 54961 - RNA, 1161 nt, Artificial Sequence
  derived and/or modified sequence opt3 from CUEDC1__Homo_sapiens__NP_001278954
augaccagccuguucagaagguccucuucaggcagugggggagguggcacagccggggcucggggaggcggugggggaacugcagcgccccaggagcucaacaauagccgcccugcccgacaagugcguagacuugaauuuaaccaggcuauggacgauuucaagacgauguuuccaaauauggacuacgauaucauugagugcguccugagggccaacuccggcgcaguugacgccaccauagaucaguuguuacagaugaaucuggaaggcgggggaucuucggguggcguguaugaggacucaagcgauagugaagacuccaucccgcccgagauucuagagcggacacucgaaccugauucuagcgacgaggaaccacccccuguauacuccccacccgcuuaucacaugcauguguucgaucgcccuuacccacuggcaccgcccacuccuccacccagaaucgacgcccuugggucaggagcuccuaccagucaaaggcgguaucgcaacuggaauccaccccuguugggcaaccucccggaugacuuucugcgaauccugccucagcagcucgacagcauucaggguaaugccgggggacccaaaccaggcucuggcgagggguguccucccgcgauggcaggaccaggucccggcgaucaagaguccagauggaagcaguacuuagaagacgagaggauagcccuguuccuucagaacgaagaguuuaugaaagaauugcagcggaaucgugauuuccugcuagcucucgagcgcgacagacugaaguaugagucacagaaaagcaagaguucuuccgucgccguggggaacgauuuuggauucagcucgccuguuccaggcacaggugacgcaaauccggcugugucugaagaugcccuuuuuagggacaagcugaaacacauggggaaguccacccggcgaaaauuguucgagcucgcgcgcgccuuuucagaaaagacuaaaaugagaaagaguaagaggaaacaucuguuaaagcaccaaagccugggcgcagcugccuccacagcuaaccuccuugaugacgucgagggacaugccugcgaugaagacuuccggggccgcagacaggaggcacccaaaguggaggaagggcugagggagggacaauga

SEQ ID NO: 54962 - RNA, 864 nt, Artificial Sequence
  derived and/or modified sequence opt3 from CUEDC2__Homo_sapiens__NP_076945
auggagcuggaaagaaucgugagcgccgcucuccuugcauucguccagacccaccuucccgaggccgacuuguccggcuuagaugaaguuauauuuucuuacgugcuggggguacuagaggaccucggaccuucagguccaagugaagagaacuucgauauggaggcguuuacagaaaugauggaggcuuaugugccgggcuucgcccauauucccagggggacuaucggagacaugaugcaaaagcugagcggccagcuuuccgaugcacggaauaaagaaaaccugcagccucagucuucggguguccaaggacaggugccaauuucacccgagccuuugcagcgcccagagaugcucaaggaagagacgcgaagcagugccgcugcagccgcugacacccaggaugaagccacaggggcggaggaggaacugcugcccggcguugacgugcucuuagaggucuuuccuacuugcuccguggaacaagcacaguggguacuggccaaagcucguggcgaucuugaggaagccguucagauguugguggaggggaaggaagagggaccagcagcuugggaggguccgaaucaggaccugcccagaaggcuacggggcccucaaaaagaugaacucaagucuuucauccugcagaaguacaugauggucgacagcgccgaggaucagaaaauucaccgcccaauggcgcccaaggaagccccuaaaaagcugaucagauauauagacaaccaagugguguccaccaaaggggagagguuuaaggacguccggaauccagaagcagaggagaugaaggcuacauacaucaaccugaaacccgcccgcaaguaucgauuccauuga

SEQ ID NO: 54963 - RNA, 2331 nt, Artificial Sequence
  derived and/or modified sequence opt3 from CUL1__Homo_sapiens__XP_011514934
augagcuccaccagaucucagaacccccacggccugaagcaaaucgggcucgaccagauuugggaugaccuuagggccggaauacaacagguguacacacggcagucaauggcuaaaagucgcuauauggagcuguacacucaugucuauaauuacugcacgagcguucaccaguccaaccaggcacgaggugccggcgugccuccaucuaagucgaaaaaggggcagaccccgggaggcgcgcaauucguagguuuggaauuauauaaacgucugaaggaguuucuaaagaauuaccucacaaaccugcuuaaagauggggaagaccugauggaugagucaguguugaaguucuauacucagcagugggaagacuacagauuuagcaguaaaguccucaauggaaucugugcuuaccugaacaggcauugggugcggcgcgagugcgaugagggcagaaagggcauuuaugaaaucuacucccuggcccucguuaccuggagggacuguuuauuccggccccugaauaaacaggugacaaacgcaguccuuaaguugauugagaaggaacgcaauggggagaccaucaacacucgacugauaucuggagugguacaaagcuauguugagcuaggucucaaugaagaugacgccuuugcuaaaggcccuacacugaccguguacaaggaguccuucgaaucacaguuucuugcagauacggagagauucuauacuagggaaaguaccgaguuucugcagcaaaacccagucacagaguacaugaaaaaggccgaagcucgguugcucgaggaacagcgucgcguccagguguaucugcacgagagcacucaggacgaauuagccagaaaaugcgagcaagugcugaucgagaagcaucucgaaauuuuccacaccgaguuucagaaucuucuggaugcggacaaaaacgaagacuuggggaggauguacaaucuaguuucucggauccaggauggacugggcgagcucaagaagcugcuugaaacacacauucauaaccagggucuggcagccaucgagaaauguggggaggcugccuugaacgaccccaagauguacgugcaaaccguacucgaugugcacaaaaaguauaaugcacuggucauguccgcuuucaacaaugacgccggauuuguggcggccuuagauaaagcaugcggccgauucauaaacaauaacgcuguuacgaagauggcccagucaagcaguaagucuccugaacugcuagcucgcuacugugacucccuccugaaaaagagcucgaaaaauccagaggaagccgagcuugaggauacuuugaaccaggugauggucguguucaaguauauugaagacaaagauguauuucagaaguucuacgcaaagaugcuggccaaaagacucguucaucaaaauucugcuuccgacgaugcggaggcaucaaugaucaguaagcugaaacaggccugcggcuuugaauauacaagcaaacuucagaggauguuccaggacauugggguguccaaggaccugaacgagcaauuuaagaagcacuugaccaauucugaaccccucgaucuggacuucagcauccaggucuuaucaaguggauccuggccuuuucagcaaagcuguacuuucgcucugccaucugagcuagagcggucauaccagcgcuuuacagccuucuaugcaaguagacacagcgguaggaaacucaccuggcuguaccagcuuuccaagggcgaauuggugacgaacugcuuuaaaaaucguuacacccugcaggccucuacauuccaaauggcuauccuccugcaguauaacacugaggaugccuacaccguccagcaguuaacagacucgacucaaauuaagauggauauacuggcacaggugcuucagaucuugcucaaaagcaagcugcuaguucuggaagacgagaaugcgaacguggaugaaguagagcucaaaccggacacccugauuaaacuuuauuugggguacaagaacaagaagcugcgggucaauaucaacgugcccaugaaaacagagcagaagcaagaacaggagaccacucauaaaaauauagaagaggaucgaaaguuacucauucaggcugccaucguuagaaucaugaagaugaggaaagugcugaagcaccaacagcuucugggagaagucuugacgcagcucuccucacgcuuuaaaccucgggugccaguaauuaagaaauguaucgacauucugauagagaaggaguaucuagaaagaguggauggcgagaaggacacauacaguuaucuggcauga

SEQ ID NO: 54964 - RNA, 2295 nt, Artificial Sequence
  derived and/or modified sequence opt3 from CUL2__Homo_sapiens__NP_001185707
auguacagagugaccuggagcacauucuggcugagguuucagcacuauacuugcacgaugucccucaagccccgggucguugacuucgaugagaccuggaacaaacuucugacaacuaucaaggccgugguaauguuggaauacguggagcgcgcuaccuggaaugaccgauuuucugauauuuaugcauuaugugucgccuacccugaaccacugggcgagcgucuauauacagaaaccaaaauauuccucgagaaccaugugagacaccuucauaagaggguucuugagucagaagaacaagugcuggucauguaccaccgguauugggaagaguacaguaaaggggcggacuacauggauugcuuguaucgcuaccucaauacucaguuuaucaagaagaacaaacugacagaggcugaccugcaguauggauacgguggcguggauaugaaugaaccgcucauggagauuggggaauuagcccuggacauguggagaaagcugaugguagagcccuugcaggcaauccugauuaggaugcuacuccgggaaaucaaaaacgaucgcggaggcgaggacccuaaucaaaagguuauacauggugugaucaacagcuucguccacguggagcaguauaaaaagaaguuuccacugaaauucuaccaggaaauuuuugagucccccuuccuuaccgaaacgggggaguauuacaagcaggaagccucuaaucuguugcaagagucgaacuguucacaguacauggagaaagugcucggacgacugaaggaugaagagaucagaugcaggaaauauuuacacccuagcaguuacacuaaggucauucaugaaugucagcagcggaugguugcugaccaucugcaauuucuccacgcagagugccacaauaucauacgucaggagaaaaagaacgauauggccaauauguaugugcuucugcgcgcuguauccaccggcuugccacacaugauucaggagcuacaaaaccauauccacgacgagggccugagagccacaucuaaucucacucaggaaaacaugcccacccuguucguggagagcguccuugaagugcaugggaaguuuguucagcugauuaacacaguguugaauggagaccagcacuucauguccgcgcucgauaaagcacugaccucagucgugaacuacagggagccuaagaguguauguaaagccccagaguuacuggcuaaguauugcgacaaucuacucaaaaagagcgccaaggguaugacggaaaacgagguugaagaucggcugacuucuuucaucacaguguuuaaauacaucgacgauaaggacgucuuccaaaaauuuuaugcacgaaugcuugcuaagcgcuugauucauggccuguccaugucaauggauagcgaggaagccaugauaaauaaacucaagcaggcguguggguacgaguucaccaguaagcugcacagaauguacacugacaugucuguguccgccgaucuuaacaauaaauuuaacaauuucaucaagaaccaggacacagucauugaucugggaaucagcuuucagauauauguguugcaagcaggcgcuuggccgcucacccaggcccccucgucuacguucgcuauuccucaggagcuggaaaaauccguucagauguuugaguuauucuacucacaacacuuuagugguaggaagcugaccuggcuacauuaucucugcacaggggaagugaaaaugaauuaccugggaaagccauauguagccauggucacuaccuaccagauggcagugcuuuuggccuucaacaauagcgagacaguuuccuauaaggaacugcaggacucuacucagaugaacgagaaagagcucaccaagacaaucaaaagccuguuagacgugaagaugaucaaucacgauucagaaaaagaggacauugaugcugaaaguuccuuuagccugaacaugaacuucucuucaaagcggaccaaauucaagaucacuacgaguaugcaaaaggacacaccccaggagauggaacagacccgcagcgcggucgaugaggacagaaaaauguaccuucaagcagccauugugaggauaaugaaggcucguaaaguauugcggcauaaugcccucauccaggaggugauuucccagucucgagcaagauuuaacccuucgaucagcaugaucaagaaauguauugaaguucugauagauaagcaguacaucgagaggucccaagccucagcugacgaauauaguuacgucgccuga

SEQ ID NO: 54965 - RNA, 2109 nt, Artificial Sequence
  derived and/or modified sequence opt3 from CUL3__Homo_sapiens__NP_001244126
augagcaaccuguccaagggcaccgggucuagaaaagacacaaagaugaggauccgggccuuccccgugcgcgaggauguccucaauucacuuaacaauaacuuucugcagacuuugaaucaagcguggaacgaccaccagacggcaaugguuaugauucgagauauauuaauguacauggaccguguguauguacagcagaauaacguggaaaaugucuacaaccugggacuaaucauuuucagagaucaagugguuagguaugguugcauccgggaccaucuccgccagacccugcuugauaugauugccagagagaggaaaggcgaaguggucgaccgcggggcgauccggaaugcuugucagaugcugaugauauugggacucgagggccgaaguguguacgaagaggauuuugaggccccuuuccuggaaaugagcgcagaguuuuuccagauggaaucccaaaaguuucuggccgagaacucugcuucgguauauaucaaaaagguugaggcaagaauuaaugaagagaucgaaagggugaugcacugccucgacaagucaacagaggaaccaauugucaaagugguggagcgggaguuaaucagcaagcauaugaaaacuauagucgaaauggagaacaguggucugguucacaugcuuaagaaugggaaaaccgaagauuugggauguauguacaagcuguucucccgugugccgaacggccuaaagacaaugugcgaguguaugucuagcuaucuccgcgaacagggcaaagcccugguauccgaggagggggaaggaaagaaccccguggacuacauucagggucuucuggauuugaaaucaagauuugacagguuccuccuggagaguuuuaauaacgaccgguuauucaagcagaccaucgcuggcgauuuugaauacuuccugaaucucaacagccgaucuccugaguaucuuucccuguucauugacgauaaauugaagaaaggggucaagggacuaacugaacaagagguggagacaauccuggacaaggccaugguucucuuucgcuucaugcaggaaaaagauguguuugagagauacuauaagcagcaucuggcgaggcggcuucugaccaauaaaucagucagcgacgauagugaaaagaacaugaucucuaaauugaagacggagugcggcugucaauucacuuccaagcucgaggguauguuucgcgacaugagcauuucgaauaccacaauggaugaguucagacagcaucugcaggcaacuggggugucuuuaggaggcguagaccugaccguuagggugcuaacaaccggcuacuggccaacgcaguccgccacucccaaaugcaacauaccuccagcuccccgucacgccuuugaaaucuuccggcgauuuuaucucgcaaagcacucagggagacaacugacacuucagcaccauaugggaagugcugauuugaaugccaccuucuacgguccugucaaaaaggaagacggcagcgaggugggggucggaggcgcucaggugacugguuccaacacaaggaaacacauucugcagguuucuaccuuucaaaugacgauccucaugcuguucaauaaccgcgaaaaguauaccuuugaggagauacagcaggaaacagacauuccagagcgggaacuugugagagcccugcagagcuuggcaugugggaagccgacucaaaggguacucaccaaagagcccaagucaaaagaaaucgagaauggccacaucuucacagucaacgaucaguucaccaguaagcugcaucgcgugaaaauucagacuguugcugccaagcagggagaguccgacccugaacgaaaggagacacggcaaaaaguggaugacgaucguaagcacgaaaucgaggcugccauugucagaauaaugaaaagcaggaagaaaaugcagcauaauguguuaguagcagaagugacccagcaacugaaggcccgcuuucuaccaucucccguugucaucaaaaagcggauugagggccucaucgagagagaauaccuggcuaggacuccugaggaccgaaagguguacacguauguggcguga

SEQ ID NO: 54966 - RNA, 2280 nt, Artificial Sequence
  derived and/or modified sequence opt3 from CUL4A__Homo_sapiens__NP_001008895
auggccgacgaggcucccagaaagggcagcuucuccgcacugguggggaggaccaacggacucacaaaaccugccgcgcuugcugccgcaccagccaagccggguggcgcugggggaucuaaaaagcuggucaucaaaaauuuucgggaucgcccccgauugccugacaacuacacucaggauacguggcguaaguuacacgaagcaguuagagccgugcaaucaaguaccagcauuagguauaaucuggaggaacuauaccaggcuguagagaaccucugcucccauaaggugucuccaaugcuguauaaacagcuucggcaggccugugaagaccacguccaagcgcagauacugcccuuccgcgaggauucguuggacucagugcucuuucugaagaaaaucaauacaugcuggcaggaucauuguagacagaugauuaugaucaggagcauuuuccuguuucucgaccggacuuacguuuuacaaaacaguacccugccuuccaucugggauaugggccuugaguuguuccgcacacacauaaucucugacaagauggugcagagcaaaaccauugaugguauccugcuacucauugaacgagagagauccggggaagcagucgacaggucacugcuucggagucuguugggaaugcucagcgaucuucagguguauaaggacucuuuugaguuaaaguuccuggaggaaacuaauugccucuacgccgcugagggccagcgucuuaugcaagaacgcgagguaccagaauaucugaaccauguuuccaaaagauuggaggaggaaggcgacagggugaucacauaccuagaucacucaacccagaagccccugauagccugugucgagaaacagcuccugggggaacaccuuacggcaauucugcaaaagggauuggaccaucuccuggaugagaaucgggugccugacuuagcucagauguaccagcuguuuagccgagugcgcgguggccagcaagcccuacuccagcacuggagugaauauaucaaaacuuucgggaccgcgauugucaucaacccagagaaggauaaagacaugguucaggaucugcuugacuuuaaggauaagguggaccauguaaucgaggugugcuuccagaaaaaugaaagauuugucaacuugaugaaggagucuuucgaaacauucauuaauaaaaggccgaacaagcccgccgagcugauagcaaaacacguggauuccaagcuccgggcuggaaauaaggaagccacugacgaggagcuggaacgcacccuugacaaaaucaugauucuguuuagauucauccacggcaaggauguuuuugaggcuuucuacaaaaaggacuuggccaaaaggcuccugguggguaagagcgcaucggucgaugccgaaaagucuauguuauccaaacugaagcaugaguguggggcugcguuuacaucaaaacuagagggaauguucaaggacauggaacucaguaaagauauaauggugcacuuuaagcaacauaugcagaaccagagcgacuccggcccuauugaucugaccguaaacauccuuacgaugggcuauuggccaacuuacacacccauggagguucacuugaccccugaaaugaucaagcugcaggagguguucaaagcauuuuaucucgggaagcauucuggacguaaacugcaauggcagacuacauuaggucacgccguccugaaggcugaguucaaagagggcaagaaagaguuucaggugagccuuuuccagaccuugguccuccugauguuuaaugaaggggacggauucucauucgaggaaauuaagauggccacgggcaucgaggauagugaacuacggcgaacccugcaaucccucgcaugcgguaaggccagagugcugauuaaaagcccaaaggggaaagagguugaggacggcgauaaguuuauauucaacggagaauuuaaacacaagcuguucaggaucaagauuaaucagauccagaugaaagagacaguggaagaacaaguaucuacuaccgaacgcgucuuucaggaccggcaguaccagaucgaugcugccauugugagaauaaugaagaugaggaaaacauugggccauaaccuguuaguuucagagcucuauaaucaacugaaguuccccgugaaaccgggggaccuuaagaagcgcaucgagagucugauugaccgagauuacauggaacgggacaaagauaacccuaaucaguaccacuaugucgcauga

SEQ ID NO: 54967 - RNA, 2688 nt, Artificial Sequence
  derived and/or modified sequence opt3 from CUL4B__Homo_sapiens__NP_001073341
auguuccccaccggcuuuagcuccccuucuccaucagccgcugcagccgcgcaggaggugagaagugcuacagacgggaacacuagcacgaccccgcccacauccgccaagaaaaggaagcucaauucuucgucaagcaguuccucuaacagcuccaaugaacgggaggauuucgacucaacuagcaguucuuccucaaccccuccacugcaaccccgcgauagcgcaaguccuucuacauccagcuuuugccuuggagucucgguugccgcuucuucccacgugccaauccagaaaaagcugcgauucgaagacaccuuggaguuuguagguuucgaugcaaaaauggccgaagagucaaguagcuccucuagcucaaguucccccacugcugccacaagccagcagcaacaguuaaagaacaagucuauucugauaucaaguguggcgagcguccaucacgcaaauggccuagccaaauccucuaccacggugucgagcuuugcuaacuccaagccugggucagccaaaaagcucguuaucaaaaauuucaaggacaagccaaaacugccggagaacuacacugaugaaaccuggcagaaacuuaaagaggcaguggaagcuauucagaauaguacaucuaucaaguauaaccuggaggaguuguaccaagccgucgaaaaucucuguagcuauaaaauuuccgcgaaccuguacaagcagcugcgucagaucugcgaggaccauauaaaagcccagauccaccaauuuagagaagauucacucgacagcguguuauuccugaagaagauugauagguguuggcagaaucauugccggcagaugaucaugauucgcucuaucuuucuuuucuuggacagaacuuauguacugcaaaacuccaugcuacccaguauaugggauaugggacucgagcuguuuagggcacacauuaucagcgaccagaaaguucagaauaagaccauugacggcauccuucuguugaucgaacgggagcgcaacggugaggcuauugaucgaucucuccugagauccuuacugucaaugcucagugaccuucagauauaccaagauagcuucgaacagagguuccuggaggaaacaaaccgguuguaugccgcugaggggcagaaacuaaugcaggaacgugaggugccugaguaccugcaccaugucaauaagcgccucgaagaggaagccgacagacugaucaccuaccuugaucaaacgacucagaaaucgcugauugcaacaguggagaagcaguugcucggagaacaccugaccgccaucuuacagaagggccugaacaaucuacucgacgagaacaggauacaagaucugucccuuuuguaucagcuguuuucucgggugcgaggcgggguccagguucuccugcagcaauggauugaguacaucaaggcuuucggaagcacuaucgugauuaauccagaaaaggacaaaacaaugguacaggagcuucuggauuuuaaggacaaaguggaucauaucauugacauauguuucuugaagaacgaaaaguuuaucaaugcgaugaaagaggcauucgagaccuuuauuaacaagcgccccaauaaaccugccgaacucaucgcuaaguaugucgacucaaaacugagagccgguaacaaggaggcaacggaugaagaguuagaaaagaugcuggacaaaaucaugauuauauucagguuuaucuacggcaaggauguguucgaggccuuuuauaaaaaggaccuagcuaaacggcuccugguugggaagagugccuccguggaugcagagaaaucuaugcuuagcaaguugaagcacgaaugcggagcggcuuucaccuccaaacuggagggcauguuuaaggacauggaacucucaaaagauauuaugauccaguucaagcaauacaugcagaaucagaacgucccagguaauauugagcugacagugaacaucuuaacuaugggguauuggcccaccuacguaccgauggaaguucaucugccucccgagauggugaaacuucaggagauauucaagacauuuuacuugggaaagcacagcggccgcaaacuccaauggcagaguacucugggccacuguguccuaaaggccgaguucaaagaggggaagaaagaacuccaggugucucuguuucagacccugguccuuuugauguucaaugagggagaagaguuuucccuggaggaaaucaagcaagcaacagguauugaggacggcgaauuaagaaggacccuccagagccuggccugcgggaaggcucgugugcuugccaaaaacccaaagggaaaagauaucgaggacggcgauaaguucauuuguaacgacgauuuuaaacauaagcuguuccggaucaagauaaaucagauucagaugaaagagacuguugaagaacaagcaucgacgacagaacgaguguuucaggacagacaguaucaaaucgacgcugccauuguaaggaucaugaagaugcgcaaaaccuugucacacaaccuccuggucucugagguguacaaucagcuaaaguucccuguuaaacccgcggaucugaagaaacggauagaaagucucaucgacagagauuauauggagagggacaaggagaacccaaaucaguacaacuauauugccuga

SEQ ID NO: 54968 - RNA, 2343 nt, Artificial Sequence
  derived and/or modified sequence opt3 from CUL5__Homo_sapiens__NP_003469
auggccaccagcaaccugcucaagaauaaaggcucccuucaguucgaggacaagugggauuuuaugagacccaucgugcugaaauuguuaaggcaagaaucugucacaaagcagcagugguucgaccuguuuucagauguucacgcugugugccuaugggacgauaaagggccugcaaagauucaucaggcccucaaggaggacauacuggaguucaucaaacaagcgcaggcucggguacuuagucaccaggaugacacugcccuguugaaggcauacauuguggaauggcgcaaauuuuucacgcagugugauauccucccaaagccguuuugccaacuggaaauuacccugaugggaaaacaggguagcaacaagaaguccaaugucgaggacucuaucgugcgaaaacucauguuagauacauggaacgagucgauauucucaaauaucaagaaccgucugcaggacagcgccaugaaacuuguucaugcugaaagauugggcgaggcauuugauagucagcuggugauuggggucagggaauccuaugugaaucuauguucuaaccccgaggacaagcuccaaaucuaccgggacaauuucgagaaagccuaucuggauagcacugaacgcuuuuacagaacccaggcuccuuccuaucuucagcaaaacggaguacagaauuacaugaaguaugccgacgcgaaacugaaggaggaagagaagagggcauugcgguaccucgaaacacgccgagagugcaacucaguugaggcccugauggaauguugcgugaaugcuuuagucaccaguuucaaagagacuauucuggccgaaugucagggcaugaucaagagaaacgagacagaaaaacuccaccuuauguuuagccugauggauaaggugccaaaugguauagagcccauguugaaagaccuagaggaacauauuaucucugcagggcuggcugauaugguggccgcggccgagaccauuacgacugacuccgaaaaguacgucgagcagcuccugacccuuuucaacagguucucaaagcugguuaaagaagcauuucaagaugacccucgguucuugacagcucgugauaaggccuauaaagcugugguaaacgacgccacuaucuuuaagcucgagcugccauuaaaacagaagggagugggccugaagacccagcccgagagcaaaugcccugaacuacucgcaaauuacugugauaugcugcuucgcaagacaccauugaguaaaaagcugaccucugaggaaaucgaggccaaacucaaggagguccugcuugugcugaaguauguucagaacaaagacguguucaugagauaccacaaggcucacuugacgaggcggcucauucuggacauauccgcggauagcgaaaucgaggaaaauauggucgagugguuacgagaagugggcaugccggcagacuauguaaacaaacuggcccgcauguuucaagauauuaagguuucggaggaccuaaaucaggcuuucaaagagaugcauaagaacaauaaacucgcccugcccgcagauucugugaacaucaagauacuuaaugccggggcuugguccagaucaagugaaaaggucuuugugagcuugccuacugagcuggaagaccucauuccagaggucgaagaguucuacaaaaagaaccacuccggaaggaaacugcauuggcaccacuuaaugucuaaugguaucaucacauuuaagaacgaggugggccaguaugaucuggaaguuaccacuuuccagcuugccguguuguuugcauggaaucaacggccccgcgagaaaauuagcuucgaaaaccucaagcuggcgacagagcuaccugacgcugaacugagaaggacccucuggucacugguagccuuuccaaaacuuaaacgucaggucuugcuguacgagccccaggugaauaguccgaaggauuucacggaggggaccuuauucuccguuaaccaggaauuuagccucaucaaaaacgcaaaggugcaaaaacggggaaagauuaaucugauaggccgacuucagcugacaacugagagaaugagggaagaggagaacgaagguaucguccaguugcgcauucuccggacccaagaggccaucauccagauuaugaagaugagaaagaagauaucuaaugcucagcugcagacagagcuaguggaaauccugaaaaacauguuccucccucaaaagaaaaugauuaaggaacagaucgaguggcugauugagcauaaguacaucaggcgcgacgaaucagauauaaauacuuuuaucuauauggccuga

SEQ ID NO: 54969 - RNA, 5349 nt, Artificial Sequence
  derived and/or modified sequence opt3 from CUL7__Homo_sapiens__NP_001161842
augagcagaggcuucuggcuggccgagccccucgcugggaccggaccucacccagcaccgguggccgcggacuccagggguugcucuucagucccccggcgccaugcuccuagucgacuuagcguuuccacaccaucucguggccccggggccagaauggugggagaacugagguaccgggaguuucgcguaccuuugggcccagguuuacacgcauaucccgaugaacugaucagacagaggguggggcaugacggacacccugaguaccaaauucgguggcuaauacuccgccgaggcgaugaaggcgacgggggaucgggucaggucgauuguaaggccgagcauauccugcuuuggaugucaaaagacgagauuuaugcuaacugccacaagaugcugggcgaagaugggcaggugaucggaccaagccaggagagugcaggcgaaguuggugccuuggacaaauccgugcucgaggagauggaaacugaugucaagucucugauucaaagagcucugaggcagcucgaggaauguguggggacgaucccgcccgccccuuuacugcacaccguacauguucuuagcgcguacgcauccauagagccauugacaggaguguucaaagacccccggguccuggaucuacucaugcacaugcugucaaguccugacuaucagauccguuggagcgccggccgcaugauucaggcucuuucuucccaugaugccggcgaagggcaaugcggagaggaggguaaggcaggcgaagggcugggaagauugagggacucacaggacacuguggcuggcgccagcgaucucauccggacccgaacacagauucuguuaagucugucucagcaagaggcgaucgaaaagcaccucgacuuugauucccgcugugcccuucuggcauuguucgcucaggccacccuaagcgagcacccaaugucguuugaagguauacagcugccccaagugccggggagaguccucuucucucugguuaaaagguaccuucaugugacuucccuguuggaccagcucaaugauucagcugccgagccuggcgcacagaacacaagugcccccgaggaacugagcggagagcggggccaguuagaacuggaguuuuccauggcuauggggacccuaauuucugaacucguacaagcgaugcgcugggaccaggcaagcgauagaccaaggucaagugcccguuccccuggaagcaucuuccagccccagcuggcugacgugucuccaggucuucccgccgcacaagcccagccuucauuucggcgaaguagaagguuccgcccacggagcgaguuugcuuccggcaauacguaugccuuguacgucagagauacucugcagccggggaugagggugcgcaugcucgacgauuacgaggaaauuucugcaggagacgagggcgaauuccgacagucgaacaaugguguucccccugugcaagucuuuugggagagcaccgggcggacauauugggugcacuggcauaugcuggagauccuuggcuucgaagaggacaucgaagauaugguagaggcggacgaauaccagggagcuguugccucccgugugcugggcagagcauugccagccuggagguggcgccccaugacugagcucuaugcugucccuuacgugcugccagaggaugaagacaccgaggaaugcgagcacuuaacacuggccgaauggugggagcuacucuucuuuauuaagaaacuggaugggcccgaccaucaggagguccuucagauauugcaagaaaaccuggauggagagauccucgacgaugaaauucuggcagaguuagcugugccgaucgaacuggcccaggaccuuuugcucacccugccucagcggcuaaaugauucagcgcugagagaccucauaaacugucacguuuauaagaaauacgguccagaggcccuggcuggcaaucaagcauaucccagucuuuuggaggcccaggaagaugugcuguuacucgacgcucaggcccaggcaaaggacucugaggaugcggccaagguagaagcuaaagagccucccagccaauccccaaacacgccucugcagaggcuugucgagggguacggacccgccggcaagauucuguuggaccucgaacaggcacugucaagcgaggguacucaggaaaauaaagugaagccacuacugcuccaacugcagcgacagccgcagccuuuccuugcuuugaugcaaucucuggauacacccgagaccaaccgcacuuuacaccucacaguucugcggauccuuaaacagcugguggacuuuccagaagcccuacuccugcccuggcaugaggcagucgaugccugcauggcuuguuugagauccccuaauaccgacagggaggugcugcaggaauuaaucuucuuucuccaccgucugacgaguguaagccgcgauuacgcggugguucuuaaccaacugggggcccgggacgcaauuucuaaggcuuuggagaaacaucucggcaagcuggaacuagcccaggagcugagagauauggucuucaagugcgaaaaacacgcccaccuuuauaggaagcucaucaccaauauucugggaggcuguauacagaugguguuggggcagaucgaggaccaucgacggacacaccaaccaauuaacauccccuuuuucgauguguuucugcgcuacuuaugccagggauccucagucgagguuaaagaagacaagugcugggagaaaguggaagugaguagcaacccucauagagcuucgaagcucacugaucacaauccgaagaccuauugggaguccaacggcucugcagguagccauuacaucacacugcacaugaggcgggggauucuuauacgacagcugacuuugcucguagccucagaagacaguuccuauaugccagcgagagucgugguuuguggaggcgacucuaccagcucccugcacacagagcuaaauucagugaacgucaugcccagcgcuagucgcgugauccugcuugagaaucucaccagguucuggccuauuauccagauucguaucaaacggugccaacaggguggcauagauacuagaaucagggggcuggaaauuuugggaccaaagcccacguuuuggccuguuuuccgcgagcaguuaugucgacauacaagacuguuuuacauggugcgggcccaggcauggucucaagacauggccgaagauaggcgcucccuccugcaccuuagcucgcgucugaacggcgcuuugagacaggagcagaauuucgcagaccgguuccuaccggaugacgaggccgcgcaggcucuggggaaaaccugcugggaagcccucguaucacccgucgugcaaaacaucacuucuccagaugaggacggaauuaguccucugggcuggcuuuuagaucaguaucuggaaugucaggaggcaguguuuaauccccaauccagggguccagccuucuuuagccgcguccgaagacucacccauuugcugguucacguggaaccuugcgaggcucccccaccgguaguggccacaccucggcccaaggggaggaaccgcucucaugacuggagcucccucgcaaccagaggacugccaucaaguaucaugaggaaucuuacucgguguuggcgugcugucguggagaaacagguuaacaauuuccugacaagcucuuggcgcgaugacgacuuugugccccgauacugcgaacacuucaacauauugcagaauuccucaagugagcuauuuggcccuagagccgcguuccugcucgccuuacagaacgguugugcaggcgcucugcuuaagcugccauuucucaaggccgcucacgucagcgaacaauucgcaaggcauauugaucagcagauccaggggucccggauuggaggcgcccaagagauggaacgcuuggcccagcugcagcagugccuccaagcugugcugaucuuuucugggcuugagauagcgacgaccuucgagcacuacuaucagcauuacauggcagacagacuacugggaguugugucgagcugguuggaaggcgccgucuuagagcagaucggucccuguuuuccuaacaggcugccgcaacagaugcuccagucacuguccacuaguaaagaacuucagcggcaauuccacguauaucagcugcagcagcucgaucaagaguugcugaagcuagaagacacagagaaaaagauucagguggggcugggagcuucuggcaaagagcacaagagcgaaaaggaggaagaggccggugcagccgcuguuguggaugucgcggagggcgaagaggaagaggaagagaaugaggaccucuacuaugaaggggccaugccagagguguccguacuugugcugucacgacauucuuggcccgucgcaagcaucugccacaccuuaaacccuagaacaugcuugcccaguuaccugcgcggaacucucaauagguauuccaacuucuacaauaaaagccagucucauccagcucuggaacggggcucacagcguagacuucaauggaccuggcuggggugggccgagcuccaguuuggaaaccagacguugcacguuuccaccgugcagauguggcuguuacuauaccugaaugaucucaaggcagugagugucgaaagccuucuggccuucucgggcuugucugcugacaugcugaaccaagccauugguccucucacauccagcagggggccccuggaucuucaugagcagaaagacaucccaggaggcgugcucaagauacgcgauggcucaaaagagccucggagucgaugggacauuguuagacugaucccgccccagacuuauuugcaagcggaaggggaggauggacagaaucuggaaaagaggcgcaacuuacuaaauugucugaucguacggauucucaaagcacacggugacgagggccuucacaucgaccagcuggugugcuugguccuggaagccuggcagaaggggccauguccucccagaggacucgugucuucccugggcaaggguagcgcuugcucaaguaccgauguucuuagcuguauuuuacaucugcucgggaaaggaacauugcguaggcacgacgaucggccacaagugcuguccuacgccgucccugugacuguaauggagccccauaccgagucucuaaacccgggcagcuccggcccaaauccuccccugacguuucacacacuccagauacgcucacgaggggucccauaugcuucuugcaccgcaacucagaguuucucgacauuuagauga

SEQ ID NO: 54970 - RNA, 7554 nt, Artificial Sequence
  derived and/or modified sequence opt3 from CUL9__Homo_sapiens__NP_055904
auggugggcgagagacacgccggggaccugauggucccccucggaccuaggcuucaggcuuacccagaagagcugauccggcaacgcccgggucaugauggccaccccgaauauuugauucgauggagcguuuuaaagugcggggaggugggaaaaguaggcguggaagaggguaaggcagagcauauacugauguggcuauccgccccugaagucuacgcgaacuguccagggcuccugggagagcgugcucuuucuaaaggccugcagcacgaacccgccggcgugucagggaguuucccuagagacccaggagguuuggaugagguugcaaugggcgagauggaagccgacgugcaggcucucgucaggcgggcagcccgccagcuggcugagagcgggacccccucccugacagccgcggugcuccauacuauccacguauuaucugcauaugccucgauuggaccucugacgggcguuuuuagagaaaccggugcucuugauuugcugaugcacaugcuaugcaauccagagccgcaaaucaggcggucagccgggaagaugcuccaggcacuggcugcccaugacgcgggaagccgcgcccacgugcuucugaguuugucccagcaggauggcauugaacaacauauggacuucgauucucgauacacacuccuggaguuauuugcagagacuaccagcuccgaagagcacuguauggcuuucgaaggcauccaccugccccagauaccugggaaacuccuuuuuucacuggucaagagauauuugugcgugacaagucuacuggaccagcucaacagcucuccagagcugggagccggugaucaguccucacccugugcuaccagggaaaagagccggggccaacgugagcuugaguucaguauggccguggggaaucugaucucugaauugguccgcuccaugggaugggcaagaaaccucagcgagcagggcaugucgccuccaaggcccacucggucuauuuuucagccguacaucuccgguccuucacuguuacugcccacaauuguuaccacgccacgacgccaaggguggguguucagacagaggagugaauuuagcucccggucuggcuauggagaguacguacagcagacucuacaaccuggcaugcgcgugagaaugcucgacgauuacgaagagaucagcgccggggacgagggagaauucaggcagucaaauaacgguauacccccaguccagguguuuuggcagaguaccggccguacauauuggguucauuggcacaugcuggagauucuugggcccgaagaggcuacugaggacaaagcguccgcagccguggaaaagggagcuggcgccaccgucuuggguacagcauucccuagcugggauuggaauccaauggacgggcuguacccgcuccccuaucugcaaccugagccacagaaaaacgaacgggugggcuaccuuacccaggccgaguggugggaacuguuguuuuucaucaagaaacucgaucugugcgagcagcaacccauuuuccagaauuuauggaagaaccuggacgagacgcuaggagaaaaggcucucggcgagaucucuguaucaguugaaauggccgagagucugcuucagguguugagcucccgauuugaagggucuacucugaaugaucuccugaacucgcagaucuauacaaaauacggauuacugagcaaugagccuuccucaaguucuaccagcagaaaccauuccuguacuccagaccccgaggaagagucaaagagcgaagcaucuuucuccgaggaagagacagagagucuuaaagcgaaggcugaagccccgaaaaccgaggcagaaccuacgaagaccaggacagagacuccaauggcccaaagcgauucucaguuguuuaaucagcuccuggucaccgaggguaugacacuacccacugaaaugaaagaggcugccuccgaaauggcacgcgcucugcggggcccugggcccagaucaagucucgaccaacacguggccgcggucguggccaccguucagauuagcucgcuggauacaaaccuucaguuguccggacugucugcuuuaagccaggcaguggaggaaguaaccgagagggaccauccacucguccgcccugaucgaucacugcgggagaagcuugugaagaugcugguugaauugcucacuaaccaagugggcgagaaaauggucgugguacaggcccugcgucuacuguaucuccugaugacgaagcacgaauggagaccccuuuucgcuagggagggugggauauacgccguguugguuugcaugcaggaauacaaaacaaguguccuggugcagcaagcaggcuuagcggcccucaagaugcuggcuguggccuccucuagcgagaucccaaccuuugucacuggacgcgacuccauucacucacuuuucgacgcacagaugacccgggagaucuuugcuagcauagauagugccacaagaccgggcucugaaucccugcuacucaccguuccugcagccgugauucugauguugaauacugagggguguagcucggcugcgaggaacggacuguuacuccugaaucuucuguugugcaaccaucacacacucggcgaccagaucaucacgcaggaacugcgagauacccuauuccgccauucagguauugccccccggacugagccaaugcccacaaccagaacaauccugaugaugcuucucaauagguauucugaaccuccagggagucccgagcgugcagcucuggagacuccuauuauacaaggacaggacggcuccccggaauugcugauccgcagcuuaguggguggcccaucugccgagcuccugcuugaucuggaacggguauuguguagagaggggagccccggaggcgccgucaggccucuccugaaacgacuacagcaagagacccagccauuucugcuucuccugcggacguuggacgcucccgggccuaacaagaccuuacugcucuccgugcugcgcguuauuacaagacuucuggauuucccggaagcaaugguguugcccuggcacgagguccuagaaccaugccugaauugccucucaggaccuaguagcgacucugagaucgugcaggaacugacuuguuuucuucacagguuagccuccaugcauaaggauuacgcgguugugcugugcugucucggcgcuaaagagaucuugucaaagguacuggacaaacacagugcccagcuccugcuugguugcgagcugcgggauuuggucaccgaaugugagaaguaugcacaacuauacagcaaccugacauccucuauucucgccgggugcauacagaugguguuaggacagaucgaagaccaucgaagaacucaccagcccauuaauaucccauucuuugauguguuccugcgccaucuuugucaaggcucgagcgucgagguuaaagaagacaagugcugggagaagguggagguaucauccaacccucacagggcuaguaaacugaccgaccacaaucccaagacguauugggaaucuaacgguagcacaggcucccauuacauuacccuccacaugcaucgugggguguugguccggcagcugacucuccugguggcaucagaggauucuagcuauaugccagccagaguuguggucuucggaggcgacaguacauccuguaucgggaccgaacuuaauacugugaacguuaugccgagcgcgucuagggugauacuacuggagaauuugaaccgcuuuuggccuaucauucagauccgaauuaaaagaugccagcaaggaggcaucgauacccgggucagggguguagaaguguuagggcccaagccaacauucuggccccuguuucgcgagcagcucugucguagaacgugccuguucuacaccauacgggcucaggccuggucaagggacauugcagaggaucaccgccgacuucugcagcucugcccuagauugaaccggguucugaggcaugaacaaaauuuugccgaccgcuuccuaccagaugacgaggcugcccaggcacugggaaaaacuuguugggaagcucucguguccccccuuguccagaacaucacaaguccugaugccgagggcgugagcgcgcuggguugguuauuggaccaauaccuggagcagagagaaaccucgaggaauccgcucucucgggccgcauccuuugcuagccguguacgccgacugugccaccuucuggugcacgucgagccacccccuggccccucaccagaaccuaguacaagacccuucucuaagaacuccaaggggagggaucggagcccagccccuucaccgguucuccccaguagcuccuugcgcaauauuacucaguguuggcugucuguggugcaggagcaagucagcagauuuuuagcugcagccuggagggccccagacuucgugccucgguauugcaaacuauacgaacaucugcagcgagcuggauccgagcucuuuggccccagagcggcauucaugcuugcccugcgcucaggguuuucuggagcuuugcugcagcagaguuuccucaccgccgcacacaugucggagcaauucgccagguauaucgaucagcagauacagggcggucugaucgggggagcuccaggcguugaaaugcuuggccaacuccagcggcaucuggagccuauuaugguauugagcgggcuggaauuagcgacgacauuugagcacuucuaccagcacuauauggccgaccgucuacuguccuuuggaucuucauggcucgaaggugcagugcuugagcaaaucggccuguguuuccccaacagauugccgcagcugaugcuccagagccuguccaccagugaggaacuucagaggcaauuucauuuauuccagcugcagcgccucgacaaguuguuucuggagcaggaagaugaggaagagaaacggcuagaggaagaggaagaggaggaagaggaagaggaagcugagaaggagcuguucauugaagacccaucuccugccaucagcauacucguccuuucaccccgaugcuggccaguguccccccuguguuacuuguaucacccuagaaaaugccugccgacugaguuuugugaugcacucgacagguucaguagcuuuuacucucaaucccagaaucaucccguucuggauauggggccacaccgccgguuacaguggaccuggcuuggaagagccgaacugcaguucggcaagcaaauucuccaugugucaacaguccagauguggcuacuguugaaauucaaccagacugaggaagugagcguagagacccugcucaaggacucggaucuuucuccugagcuguugcugcaggcucucguccccuuaacaagugguaaugggccucugacgcuucacgaaggacaagacuuuccacacggcggcgugcugcgucuacaugagcccgggccucagagguccggagaagcccucuggcugaucccaccccaggcguacuugaacguugagaaggaugaaggucggacccuggagcaaaaacgcaaucuccuuagcugccuguuagugcgaauccugaaggcacacggcgagaaaggguugcauauugaccagcucgucugucuggugcuagaagccuggcagaagggaccgaacccuccaggcacucuuggucacacaguugcugggggaguggccugcaccucaacugauguccuguccugcauccuccaccuguugggccagggcuaugugaaaagaagggacgaccggccccaaauucugauguacgcugcaccugagccaauggggcccugucgcggacaggccgauguaccguucugcgguucucagagcgaaacaaguaagccuucccccgaggcuguggccacccucgcaagccuucagcugccagcgggcagaacgaugucuccucaagagguugaaggguuaaugaagcagacugucaggcaggugcaggagacccugaauuuggaacccgacguggcccaacaucuccuggcucacucacauuggggagccgagcagcuacuucagaguuauuccgaagauccagagccccugcuccuggcagcuggcuuguguguccaccaagcccaggcaguaccugugcgaccagaccauugcccgguuugugugagccccuuagguugcgaugacgaucugccuucucucuguugcaugcacuacuguugcaaaucguguuggaacgaguaucuuacaacccggauagaacagaaucugguccuaaacugcacuugcccaaucgccgacugucccgcucagccuacaggggcguuuauucgugccaucgugucaagcccagagguuauuuccaaguacgaaaaagcacugcucagaggauauguggagaguugcucuaacuugaccugguguacaaauccccaaggcugcgaucgcauccuguguaggcagggccuugggugcggaacuaccuguagcaagugcgguugggcuuccuguuucaacugcucauuuccugaagcccacuacccggccaguuguggccauaugucucagugggucgacgaugggggauacuaugacggcaugagcguggaggcacaguccaaacaccuggcuaagcucauaucaaagcggugcccaagcugccaagcccccaucgagaaaaaugaagguuguuuacauaugacgugcgcgaaguguaaccacggguucugcuggagaugucugaaaucuuggaagccuaaucacaaagauuacuauaacugcuccgcuaugguaaguaaggccgcacgccaggagaagagguuucaggacuacaaugaacgauguacauuccaucaccaggcccgggaguuugcugugaacuugagaaauaggguuagcgcaauucaugaaguccccccaccucgcucguucaccuuucugaacgacgccugccaaggacucgagcaggcgcguaaagugcuugcuuaugccuguguguacuccuucuauucucaggaugcagaguacauggacgucguugaacaacagacugagaaucuggaacuacacaccaacgcccugcagauccucuuggaggagacacugcuucggugcagagaucuggcuucaagcuuaaggcuccugcgcgccgacuguuugaguacuggcauggaacugcuccgacggauucaggagagacuucuggcaauccuacaacauuccgcucaggauuuuagggugggccugcagucucccagcguagaagccugggaggcgaaggggccaaauaugccgggaucacagccucaagccuccaguggucccgaagcagaggaggaagaggaagacgaugaggacgaugugccagaauggcagcaggacgaguucgaugaggaacucgacaacgauagcuucucuuacgacgagucagaaaauuuggaccaggagaccuuuuucuuuggcgaugaagaggaggacgaagaugaggcuuaugacuga

SEQ ID NO: 54971 - RNA, 597 nt, Artificial Sequence
  derived and/or modified sequence opt3 from CUTA__Homo_sapiens__NP_001014433
augaucggcagcgggcuggccggauccgguggcgcugggggacccucuucaaccgugacauggugcgcacucuucaguaaccacgucgccgcgacucaggcuagccuucuguuguccuuuguuuggaugccugccuuacugccaguggcaucuagacuacuccugcuuccgaggguacuguugacgauggccucgggcucacccccuacccaaccaagccccgcuagugacuccgguucuggguacgugccuggaagcgucuccgcagccuucgugacauguccaaaugagaagguugcuaaagaaauugcccgggcgguggucgagaagcgccucgcagccugcgugaaccugauaccccagaucacuucaauuuaugaauggaaaggcaagaucgaggaagauagugagguacugaugaugauuaaaacccagagcucucucguuccugcuuuaacagacuuugugcgauccguccauccauacgagguggccgaagugaucgcacugccggucgagcagggcaauuuccccuaucuucaauggguucgucaggugaccgaaucaguaagcgauaguauaacuguguugccuuga

SEQ ID NO: 54972 - RNA, 4551 nt, Artificial Sequence
  derived and/or modified sequence opt3 from CUX1__Homo_sapiens__NP_001189472
auggccgcuaacgugggcagcauguuccaguacuggaagagauuugaccugcaacagcuccagagggagcuugaugcaaccgccacaguccuggcgaaucggcaggacgaauccgagcaaucucgcaaacgauugaucgaacagucacgugaguucaagaaaaacacucccgaagauuuaagaaagcagguugcuccucugcuaaaaaguuuucagggggagauugacgcccucagcaagagguccaaggaggcagaagccgcuuuccugaauguguauaaacggcuuauagauguaccagacccggugcccgcacuggauuugggacaacagcuccagcugaagguccagcgccugcacgacaucgagacggaaaaccaaaaacucagagagaccuuagaggaauacaauaaggaguuugccgaagugaaaaaccaggagguuacaauuaaggcucugaaggagaaaaucagggaauaugagcagacucuuaagaaucaagccgaaaccauugcguuggagaaagaacagaagcugcagaacgauuucgcagagaaagaacggaagcuacaggagacacaaaugucuaccacuucgaaacucgaggaagccgagcauaaggugcagucacugcagacagcucuugaaaagacccgcacggagcuguuugacuugaaaacuaaguacgaugaagagaccacagccaaagcagacgagaucgaaaugauaaugacugaucucgagcgagcuaaucagagagccgaagucgcgcaaagggaggccgagacccugcgggaacaguuaagcagugcaaaccacucccugcagcucgcuucucagauccaaaaggccccugacguggagcaggcuauugaaguacuuacacguagcucccuggagguugaauuggccgcaaaagagcgcgagaucgcccagcuaguggaagacguccagagacugcaagcaucacucaccaagcugagggagaauagugcgagccagauuucucagcuugaacaacagcuguccgcaaagaacucaacguugaaacagcucgaggaaaagcugaaaggucaggccgauuaugaggaggugaagaaagaauuaaauauccuaaagagcauggaguucgcuccaagugaaggcgccgggacucaagacgcagccaagccccuggaggugcuccugcuugagaaaaaccggucuuugcaguccgaaaaugcugcccugcgaauaagcaacucggaucucucuggauccgcacgcagaaagggcaaagaccagccugagucaaggcggccagguagucugcccgcgccuccaccgagccagcuuccccgcaacccuggggaacaagccuccaauacaaacggaacccaucaguuuucuccagccggccugagccaggauuucuuuucaaguuccuuggcaagccccucucucccucuggccucaacuggcaaguucgcuuuaaauagucugcuacagagacaacucaugcagagcuuuuacuccaaagccaugcaggaggcagggucuacaucgaugauuuucagcaccggaccauauuccacgaacucaaucaguucucaaagcccccugcagcaguccccggacgucaaugguauggcuccuucacccagccagucugaauccgccggcaguguuagcgagggggaggaaauggauaccgcggagauugccaggcaagugaaggaacagcuuaucaagcacaacaucggacagcguauuuucggccauuacguauugggucugucucagggguccgugucagagauacucgcucggccaaaaccuuggaauaagcugacaguccgaggaaaagaacccuuucacaagaugaaacaauucuuaagugacgagcagaacauccuggcacuuagaagcauucagggcaggcagcgcgagaauccaggccaaucguugaaccggcucuuucaggaagugcccaagagaaggaauggguccgagggaaacaucacuacccgcauacgagccucugaaacagguagcgaugaggcuauuaaaucaauccuggaacaggccaagcgggagcuacagguucaaaagacugcagagccugcgcagccaaguuccgccucuggcagcggaaauuccgacgaugcuauccguucaauucugcagcaagccagaagggaaauggaggcacagcaggcugcccucgacccggcacugaaacaggcuccccuuagccaaagugacaucaccauuuugacaccuaagcuguuaucuaccuccccaaugcccacugugagcucguacccuccacucgcuauaucacugaaaaagcccucugcggccccggaagcaggggcuagugcccuuccuaacccacccgcccugaaaaaggaggcucaggaugcaccuggcuuggacccccagggugccgcggauugcgcucaggggguccuccgccaagugaagaaugaaguaggccgguccggagccuggaaagaccacugguggagcgcaguucagccagagagaaggaacgccgcuucuagcgaggaagcaaaggccgaggaaacgggcgggggaaaagagaaggguuccggcgggucaggaggcgguagucagccucgagcggagcgcagccagcugcaagggcccucuuccucagaauauuggaaagaguggccaagugcugaaagcccguacucccagucuucggagcuaagccugacaggcgccucacgguccgaaaccccucagaacaguccccucccaucuagccccaucgugccuauguccaagccaacuaagcccucagucccuccgcugaccccagagcaauaugagguguacauguaucaggaagucgauacaauugagcuuaccagacaggugaaagaaaaguuggcuaaaaauggaaucugucagaggaucuucggcgagaagguucugggguuaucucaaggaagcgugagugacaugcucucccgucccaaaccuuggagcaagcugacucagaagggucgcgaaccauuuauucggaugcagcuuuggcugaacggcgagcuagggcagggaguacuccccguccaaggccagcagcaggguccugugcugcauucuguuacaucauugcaagauccgcugcagcaggggugcguguccagugagagcacgcccaaaaccucggccucuuguuccccagcuccugaaagccccaugucaaguucugaguccgucaagagcuuaacugaacucgugcagcaaccaugcccucccauagaggccucaaaagacaguaagccaccggaaccuagcgaucccccagcauccgacucucagcccacaaccccucugccacuuagcggccacuccgcucugucaauccaggaguugguagccaugucucccgagcucgauacauacggaauuacuaaaagagugaaggaaguucugaccgacaauaaccuaggccaaaggcuguucggggagacgauccuuggacucacccagggcagugucucggaucuguuggcgcgaccuaaaccguggcauaagcugagcuuaaagggucgggaaccauuugugcgcaugcagcucuggcugaaugaccccaacaauguggagaaacuuauggacaugaagagaauggagaaaaaggccuauaugaaaaggcggcacuccucugucucagauagccagccuugugaacccccauccguugggacagaguacagucaaggagcaucuccucagccccagcaccagcugaagaagccacgagugguguuggcuccugaagagaaagaagcccucaagagagcuuaccaacagaaaccguaucccagcccaaagacuauugaggaccuggcaacccagcuaaaccugaaaacaucaacuguaaucaauugguuccauaacuaccgcuccaggauacgucgggagcuuuuuaucgaagagauucaggccggcagucaaggucaggccggcgcuagcgauucuccuuccgcgagaucagggagggcagcccccagcucggaaggagacucuugcgauggcgucgaggcuaccgaagggccaggaagugccgacacggaggagccuaagucccagggcgaagcagagcgcgaagaggugccccgaccggccgaacaaacagagccaccucccagcgguaccccagggcccgaugacgcuagagaugacgaucacgagggaggcccuguugaagguccgggcccccucccaagcccugcguccgccacugcaacagcugcccccgcagccccugaggacgcugccaccucugcggcagccgcuccaggggaaggacccgccgcuccuagcagugcaccacccccguccaauucaucuucaaguuccgccccucggaggccaagcucucugcagucguuguucggcuuacccgaggcugccggggcacgcgauucacgugacaacccucugagaaagaaaaaggcggccaaucucaacagcaucauucaucggcuggagaaagcugccuccagggaggaaccaaucgaaugggaguuuuga

SEQ ID NO: 54973 - RNA, 4461 nt, Artificial Sequence
  derived and/or modified sequence opt3 from CUX2__Homo_sapiens__NP_056082
auggccgcuaacgugggcagcauguuccaguacuggaagagauuugaccugaggcggcuccaaaaagagcuuaauuccgucgcaucugaacugucagcccgccaggaggaaagugagcacagccauaagcacuugaucgaauuacgacgugaguucaaaaagaacguucccgaggaaauuagagagaugguggcgccuguacugaaauccuuucaggcugaaguggucgcccuaucuaagaggucgcaggaggcagaggccgcuuuccucucaguguauaagcaacugauagaagcaccagauccgguucccguguuugaggccgcucggagccuugacgaucgccugcagccuccaaguuucgaccccuccgggcagccuagaagggauuugcauaccucuuggaaacggaauccagaacuccugagccccaaggagcagcgcgaaggaacauccccugccgguccaacucugacggagggcucacgacucccggggauccccggaaaagcguuacugaccgagacacuuuugcaaagaaacgaagcagagaagcagaaaggccugcaggaaguccagauuacucuagccgcuaggcucggugaggccgaagagaagaucaaggugcugcacagugcacuuaaagcuacccaagccgagcuguuggaacuccggcguaaguacgacgaggaagcggccagcaaagcagaugagguagggcugauuaugacaaauuuagaaaaggcuaaccagcgcgccgaggcugcccagagagagguugaaucucugagggagcaacucgcauccgugaauaguagcauccggcuugccugcuguaguccucagggaccaucuggcgacaaagucaacuuuacccugugcuccggcccccgauuggaagcugcgcuagcaagcaaggaucgcgagauacugagacuccugaaagacgugcagcaucuucagucgucucugcaagaguuggaagaggccuccgcuaaucagaucgccgaucucgaaaggcagcugacugcaaagucagaggccauugaaaaguuagaggagaaacugcaggcucaaagugacuaugaagagaucaagacagaacuaagcauucucaaagccaugaagcuggcauccucuaccuguagccuuccucaggggauggcgaaaccagaggauucauugcugaucgcuaaggaagccuucuuucccacgcagaaguuccuccuggagaaaccgagucuucuggcauccccugaggaagaccccagcgaggacgauucuauaaaggacucauugggaacugaacagaguuacccaagcccucaacagcuucccccacccccugguccagaggauccgcugucccccucuccuggccagccauuacuggggcccucgcuaggaccugacggcacccggacauuuagccucuccccauuccccucacuggccaguggugaacgccuuaugaugccgccugcugccuuuaaaggggaggcaggaggcuugcugguguucccacccgcuuucuauggcgccaagccucccacugcgccagccaccccugcucccgggccagagccgcucggagguccugaacccgcagauggcgggggaggcggugccgcugggccaggcgccgaggaggaacagcuggacacagcagagauugcguuucaagucaaagaacaguuacugaagcacaacaucggacagagaguuuucggccacuacgugcuuggguugucucaaggaagcguauccgagauucucgccaggcccaagccuuggcguaaacugaccgugaaggguaaagaaccauuuaucaagaugaaacaguuccuaucagaugagcagaauguccuggcucuccggacgauccaggugcgacaaagaggcagcauuacucccaggauacgcacaccugaaaccgggucugacgaugccaucaaguccauucuggagcaggcaaagaaagagaucgaaagucagaagggaggcgagccgaaaacuagcguugcuccacuuucuauagccaacgguacaacccccgcauccacgucagaagacgccauuaagaguaucuuggagcaggcucggagagaaaugcaagcgcagcagcaggcccuguuagagauggagguggcaccuagggggcgcagcgucccacccucgccuccggaacgacccucccucgcuaccgccucucaaaauggcgccccagcucuggugaaacaggaggaaggaagcggcgggccugcacaggcgccccuuccaguacuguccccugccgcuuuuguucaaaguaucauucggaaggugaaauccgagaucggagaugccgguuauuucgaccaucacugggcaucugaccguggcuugcucagcagacccuacgccuccgucucaccaagccugaguucuuccagcucgucaggguacucuggacagccgaacggcagggcuuggccucgcggugaugaagcacccgugccacccgaggacgaggccgcggcuggggccgaagaugagccuccacggacaggcgaacuaaaggcagagggagccacugcugaggccggcgcaagacugcccuauuacccugcuuaugucccgaggacccucaagccaacagugcccccucugacucccgaacaguacgagcuuuauauguaccgagaaguugacaccuuggagcugacacgccaggugaaagaaaaguuagccaaaaaugggauuugccaacggauauuuggagagaagguacucggccugagucaggguuccgucagcgauaugcuuucuagaccaaaaccuuggagcaagcugacccagaaggggagggagcccuucauccguaugcagcuauggcucuccgaccaacugggacaggcggugggccagcagccaggugccucacaagcaaguccuacugaaccgcgcagcucucccuccccaccucccucaccaacggagccugaaaaaucaagccaggagcccuugucccugucuuuagaaucgagcaaggagaaccagcagccggagggccggucauccaguucucucagcgggaaaauguauuccggaucacaagcuccaggcgggauucaggaaaucguugccaugucuccugagcuggauacauacagcaucaccaagagagugaaagaaguccuuacugacaacaaucugggacagagguuguuuggcgagaguauucucggucugacccaaggguccgugagcgaucuacugucucgacccaagccauggcauaagcucucacucaaaggacgggaacccuucguacgcaugcagcugugguugaacgacccucacaauguggagaagcugagagauaugaaaaaguuagagaaaaaggcuuaccucaagaggcgguauggccugauauccacagguagugacagcgaaucgccggcaacccgaucugagugucccuccccaugccuucagccucaggaucugagcuugcuccaaaucaaaaagcccagaguuguccuggccccugaagagaaagaggcccuacgcaaggcuuaccagcuggaaccauaucccucacagcagacuauugagcuucucaguuuucaacugaacuugaaaacaaauacggugaucaacugguuccacaauuacaggucucguaugcggagagaaauguuaguggagggcacccaggacgaaccugaccuggauccauccgggggacccggcauucucccgccugggcauagccacccagaccccacuccucagucaccagauagugagacagaggaccagaagcccaccgucaaagaacuggagcuucaagaaggaccggaggaaaacagcacaccucugacuacccaggauaaggcgcagguuaggaucaagcaagagcagauggaggaagacgcagaggaagaggccggcucccagccccaggauucuggugaauuggacaaagggcaaggaccaccuaaggaggagcaucccgauccacccggcaaugacggucuaccuaaaguggcuccaggcccgcugcuccccgggggaagcacgccugauuguccaucccugcacccccagcaggaaucagaggccggcgaacgccuucauccugacccauuaucuuuuaagagugcaucggagagcucccgaugcucucuggaggugucacucaacagccccuccgccgcuaguucuccuggguugaugaugagcguaucaccggucccauccaguagcgcgcccauaucuccuucacccccaggagccccucccgcaaaagugccaucagcuagcccgaccgccgauauggcaggcgcccugcacccuucggcuaagguuaaucccaaccuccagagacggcacgaaaagauggccaaucugaacaauaucauuuauaggguggagcgcgcggcaaaccgugaagaggcccuugaaugggaguucuga

SEQ ID NO: 54974 - RNA, 1824 nt, Artificial Sequence
  derived and/or modified sequence opt3 from CUZD1__Homo_sapiens__NP_071317
auggagcuggugagaaggcucaugccccuuacccuguugaucuuaagcugccuggccgaacuaacaauggcugaggcagaaggcaacgccuccuguacugucucucucgggggagcgaauauggcugagacgcacaaggccaugauucugcagcuuaacccuucagaaaauugcaccuggacaauagagcggccagagaacaaaaguauccgcauuaucuucagcuacguucaacuggacccggaugguuccugugaaucugagaauauuaagguguuugacggcacuucgucaaacgggcccuugcucggacagguaugcagcaaaaaugauuaugugccugucuucgaaaguuccucuagcacccugacauuucagaucgugaccgacuccgcacgaauacagcguacuguuuucguguuuuacuauuucuuuucaccaaacaucaguauucccaauuguggcgguuaccuggauacacucgaggggagcuucaccucuccuaacuauccaaagccccauccugaguuagccuacugcgucuggcacauccaaguggaaaaagacuauaagauuaagcugaauuuuaaagagaucuuccuugaaauagauaagcaguguaaauuugacuucuuggcuauuuacgauggaccauccacgaacucaggccugaucggccagguaugcgggagaguuacuccgaccuuugagagcaguucuaauucccuaacagugguccucagcacugacuacgcaaacucguauaggggauucucugccuccuacaccucaauuuaugcugaaaauaucaacacaaccagucugacguguagcuccgaucggaugcgcgugaucauuucuaagagcuaccuugaggccuucaacucaaaugguaacaaucugcaguugaaagaccccacuugcagaccuaagcucaguaacguggucgaguuuuccguuccacugaauggcugugggacaauaaggaagguggaagaucaaagcaucaccuauacuaacauuaucacauucucugcgucaaguaccagcgagguaauaacgcggcagaaacaguuacagauuaucgugaagugcgaaaugggacauaauuccaccgucgagaucauuuacaucacagaagacgacgugauucaaucucagaacgcacugggcaaauauaauacuucgauggcccucuuugagagcaacuccuucgagaagaccauacuugaaucacccuacuacguugaucugaaucagacauuguuugugcaagucagucuacacacuucugacccuaaccuggugguauuccucgauaccugccgcgcuagcccaacauccgacuuugccucacccaccuaugaucugaucaaaagcgguuguucucgagacgagacuugcaagguuuacccgcuuuucgggcauuauggaagauuucaguucaaugcauuuaaauuccugagguccaugaguagcguguacuugcaguguaagguccucauuugcgauucuuccgaccaccagucacgguguaaccaaggcugcgugagucguagcaagcgcgauaucucguccuauaaauggaagacggacucuaucauuggcccuauaagacugaaaagggaucggagcgcuucagggaauaguggauuucagcacgaaacacaugccgaggaaacccccaaccagccauucaacuccguccacuuauucucuuuuauggugcuggcgcuaaauguugugacuguagccaccaucacaguccgacauuucgugaaccagcgcgcagacuacaaguaucaaaaacuccagaauuacuga

SEQ ID NO: 54975 - RNA, 2727 nt, Artificial Sequence
  derived and/or modified sequence opt3 from CWC22__Homo_sapiens__NP_065994
augaaaagcuccguggcccagaucaagcccucuucaggccacgacagaagggagaaccugaauaguuaccaacggaacagcuccccugaagaucgcuaugaggaacaggagcgaucuccacgugacagagauuacuucgacuauucgaggucagauuacgaacauagccggcgcgggagaaguuaugacuccucuauggagagcaggaaucgggaucgcgagaagcgaagagaaagggagcgggacaccgaucguaaacgcuccagaaagucaccgagucccggaaggcggaacccugaaacaagcgucacucagucuuccucagcucaggacgagccagcaacgaaaaagaagaaagaugagcucgacccccuucugacccgaacagguggcgccuacauuccuccagcgaaguugcgcaugaugcaagaacagauaacugauaaaaauagcuuagcuuaucagagaaugaguugggaggcccugaagaaaucuaucaacgggcuaauuaauaagguuaacaucuccaauauuagcaucauaauccaggaacuccugcaagagaacauugugaggggacggggccuucugucgcgcucuguauugcaggcacaguccgccucacccaucuuuacccacguguacgcugcacucgucgccauuaucaauaguaaguucccucagauaggugaacugauucugaaaagacucaucuuaaacuuuaggaagggguaccgucggaaugacaaacaacugugccuuacagcuagcaaguucguggcccauuugauuaaccagaauguugcgcacgaggugcugugucuagagaugcucacccugcuucuggaacgaccaacugacgauuccgucgagguggcaaucggauuuuugaaagaaugcggccucaagcugacacagguaucuccgagaggcaucaacgccauuuucgagagguuacgcaacauacugcaugaaagcgagaucgacaaacggguucaauauaugauugaggugauguuugcugucagaaaggauggguucaaggaccaccccaucauacucgaaggacuugaucugguggaggaagacgaucaguuuacccacauguugccucuagaggacgauuacaauccagaagacgugcugaacgucuucaaaauggaucccaauuuuauggagaacgaggaaaaguauaaagccauuaagaaagagauccucgacgaaggugacacggauucaaauacugaccaggaugcaggcaguuccgaggaggacgaagaggaagaggaagaggagggggaagaggaugaagagggacagaagguuaccauccaugacaagacagaaauuaaccuggugagcuucaggcgcacuaucuaccuugcuauucaaucuucacuggauuuugaggagugugcccacaaauugcucaagauggaauuuccugagagucagaccaaagaacugugcaauaugauauuagacuguugcgcgcagcagcgaacauaugagaaguucuuuggccugcuagccggucgguucuguaugcucaaaaaggaauacauggagagcuuugaggggaucuucaaggaacaauaugauaccauucaucgucuggagacgaacaaacuuagaaauguagcaaagauguuugcucacuugcuguacacugacucccucccauggucugugcuggaaugcaucaaacuuucggaggagacaaccacuagcuccucaaggaucuucgucaagauuuucuuccaggaacugugugaguacaugggauugcccaaacucaacgcccgccugaaggaugaaacauuacagccguuuuucgagggccugcuaccucgggacaaucccagaaacaccagguuugcuauaaauuucuuuacgaguaucggccucgggggacugaccgaugaacuucgagagcacuugaagaacacaccaaaagugauuguugcccagaagccugacguggagcaaaauaaaucuagccccuccucaagcagcuccgcaaguucuucuuccgaaucagacaguagcgauucggacuccgauucuagcgacucaaguuccgagucuagcuccgaagagucagauagcaguucuaucuccagccauucgucagccucugcuaacgacguccgcaagaaaggucacggcaagacucggaguaaagaaguggauaagcugauuagaaaccagcagaccaaugacaggaagcagaaagagcgucgccaagagcaugggcaccaggaaacacggacugagagagaaaggcgauccgagaagcaucgggaucagaacagcucuggaagcaauuggcgcgacccaaucaccaaauauacauccgauaaggacguacccucagaaagaaacaauuacaguaggguugcgaacgaucgggaccaagagaugcacauagaccucgagaauaaacacggcgauccuaagaagaaacgaggugaaagacgcaacagcuucucugagaaugaaaagcauacccacaggaucaaagacuccgagaacuuccgucggaaggauagaucaaaaaguaaggagaugaauaggaagcauagcgggucccgcucugacgaagaucgauaucagaacggcgcagagagacggugggaaaaaucgagcagguacucagagcagucccgcgaaaguaagaaaaaucaggaccguagacgggagaagucuccagccaaacaaaaguga

SEQ ID NO: 54976 - RNA, 1176 nt, Artificial Sequence
  derived and/or modified sequence opt3 from CWC27__Homo_sapiens__NP_001284573
augagcaacaucuacauucaggagcccccuaccaauggcaaggugcugcucaaaacaacugccggggacauagauaucgaacuuugguccaaggaggcuccaaaagcaugcagaaacuucauucaacuguguuuggaagccuauuacgacaauacgaucuuucacagggucguuccgggauucauugugcaggguggcgaucccaccgggacaggaucuggcggugagucaaucuauggggcgccuuuuaaggacgaguuccauagucgguuacgcuuuaaccgacguggacugguagcuauggccaaugcaggcagccacgauaacggcucccaguucuuuuucacucuagggagagccgacgagcucaauaacaaacauaccauauuuggaaaggugacaggugauaccgucuacaauaugcugaggcuuucugagguggacaucgaugacgaugaacggccacacaacccccauaagauuaaaucgugcgagguucuguucaauccuuuugacgauaucauuccacgcgaaaucaagagauugaaaaaggagaaacccgaggaagaggugaagaagcucaaaccuaagggcacuaaaaacuucucacugcugagcuuuggggaagaggcugaagaggaggaagaggaagucaauagggugagucaguccaugaagggaaaaucuaagagcucccacgaccucuuaaaagacgauccacaccugucaaguguaccgguuguggagagcgaaaagggcgacgcacccgaucuugucgacgauggugaggacgagucugccgaacaugaugaguauauagacggggaugaaaagaacuugaugcgggagcgcauugcuaaaaagcugaaaaaggacacauccgccaaugugaaaucagcgggagaaggcgagguggagaaaaagagcgucagucgaucugaagaacuaagaaaggaagcaaggcaacucaagcgggagcugcuugccgcuaaacagaagaaaguugagaacgccgcaaagcaggcugaaaagcguuccgaggaagaggaagccccuccagauggcgcgguggccgaguaccgcagagagaaacagaaguaugaagcacugaggaaacaacagagcaagaaagggaccucgcgggaggaccaggacguaacguguacuucuguguga

SEQ ID NO: 54977 - RNA, 1497 nt, Artificial Sequence
  derived and/or modified sequence opt3 from CWF19L1__Homo_sapiens__NP_001290333
auggcccagaagccccugagacuccuugcuugcggcgacguggaggggaaauucgauauccuguuuaacaggguccaagcaauucagaagaaaagcggaaauuucgacuuguuacuguguguugguaacuuuuucggcuccacccaggaugccgaaugggaggaauacaagacagggaucaaaaaggcgccuauacagacuuaugugcuaggagcuaauaaccaagagacgguaaaguacuuucaggacgccgauggcugcgaacucgcagagaauauuaccuaucugggucggaaagggaucuucacaggaucuucaggccuucagauuguguaccugaguggcacugagagcuugaacgaaccagucccgggguauuccuuuucucccaaggacgugucgucacuccgcaugaugcuguguaccacaagccaguucaaaggaguugauauccugcucaccaguccuuggccaaagugcguggguaauuuuggcaacuccucuggggaggucgacacuaaaaaguguggaagcgccuuaguguccucacuggcuacaggccuuaagccccgauaccacuucgcagccuuggagaaaaccuauuacgaacgucugccuuacagaaaucauauaauccuacaagagaacgcucagcacgccacgagguuuauugcgcucgcaaauguagguaacccagaaaagaaaaaguaucuguacgccuucaguaucguucccaugaaacuuauggaugcugccgagcuggugaagcagccuccagacgucacugaaaauccguaucggaaaagcgggcaggaggcaucuauuggaaagcaaaucuuggcucccguggaagaguccgccugccaguuuuucuucgaucucaacgagaagcagggccgcaaaagaucaagcaccggcagggacaguaagucuuccccucauccaaaacaaccccggaagccuccacagcccccggggccuuguugguuuugccuggcgagccccgaaguggagaaacacuuagucguuaauauaggaacacauuguuaccuggcccucgcaaaggguggccuuucggaugaccacgugcugauuuugccaaucgggcacuaucagucuguaguggaacuauccgcugaggucguggaagagguugagaaguacaaagccacucugcgccgauucuuuaagucaagaggaaaauggugcguggucuucgaaaggaacuauaagagucaucaccuccagcugcaaauugcucagccuggcgccgcauacuuuuacguggagcuugacaccggugaaaaacuguuccaucggaucaagaagaacuuucccuugcaguucgggcgugagguacucgccagcgaagcuauccugaauguuccagauaaauccgacuggcgccagugucaaauuucuaaggaggaugaggaaacauuagcgagaagguuucggaaagacuucgagcccuaugauuuuacccuggacgauuga

SEQ ID NO: 54978 - RNA, 2685 nt, Artificial Sequence
  derived and/or modified sequence opt3 from CWF19L2__Homo_sapiens__NP_689647
auggccaccagcauggcugcagccuccggcagauucgagucugcgaagucaaucgaagagaggaaagaacagacacggaacgcucgcgccgaggugcugcgacaagcaaaggccaauuuugaaaaagaggagcguagaaaggaacucaaaaggcuucgcggggaggacacuuggaugcugcccgaugucaacgaacggauugagcaguucagucaggagcacagcguuaagaagaaaaagaaaaaggacaaacauuccaagaaggcuaaaaaggaaaagaagaaaaagucuaaaaagcagaaguacgagaaaaauaacgaaucgucagauagcaguuccucuagcgaggacgaauggguggaggcaguaccuucccaaacgccagauaaggagaaagccuggaaggugaaagacgaaaagucaggaaaggaugacacccagauaaucaaaagagaugaguggaugacagucgacuuuaugagugugaagacuguuucaucuuccucauugaaagcugaaaaggagaccaugaggaaaauugaacaggagaagaaucaggccuuagagcaaagcaagcugauggaacgggagcuaaacccguauuggaaagaugguggcacaggguuacccccugaagacugcagugugucuuccaucaccaaggucagcgugguagaggauggaggccugucguggcuucgcaaaucuuaccugcgaaugaaggaacaggcggagaaacaguccagaaauuucgaggacauuguugcagaaagguaugguucaauggagaucuuucagaguaaguuggaagacgccgagaaggcugccagcacuaaagaggauuaccggcgugaacgcuggagaaagccaacauauuccgacaaagcacaaaacugucaggagucuagggaaagcgaucucgugaaguacggaaauucaagucgggaccgauaugcuaccacggauacugccaaaaacuccaauaacgagaaguucauaggggacgaaaaagauaagcgccccggcagccuggagaccugcagaagggagucuaauccucggcagaaccaagaauuuucauucggcaaucugcgcgcgaaguuucucagaccaagugacgaugaggaacucagcuuccacuccaaagggaggaaguuugagccccugucuucgagcuccgcccuugucgcacagggaucauuguguagugguuuccguaaaccuacaaagaacucugaggaacggcugacuagcuggucccgaucagacggcagaggggauaaaaagcauagcaaccagaagccaucugagaccuccacagacgaacaccagcaugugccggaggaccccagggagaaaagucaagaugaagugcuacgcgacgauccuccaaagaaagaacaccuccgggacaccaagagcacguuugcuggaucucccgagagagaguccauccacauucugucagucgaugagaaaaauaaacuuggcgccaagaucauuaaagcugaaaugauggguaacauggaacuggccgagcaguugaagguucagcucgagaaagcaaauaaguucaaagaaacuaucacacagauaccuaagaagagugggguggagaacgaagaccaacaggagguaauucuggugaggaccgaucagagcggacgcgucuggccagugaauacucccggcaaaucguuagaaucccagggcgggcgacggaagcgucaaaugguuucuacacaugaggagagagaaagggugcgcuacuuccacgacgaugacaaccugagccucaaugaucuugucaaaaacgagaagaugggaaccgccgaaaaucagaacaaacuguuuaugcggauggcuucaaaguucauggguaaaacggacggcgauuacuauaccuuggacgacauguuugugaguaaggcggcagagagagaaaggcuaggggaggaggaagagaaucagcgaaagaaagccaucgcugaacaucgcucccuggccgcacagauggagaagugccucuacuguuucgauucuagccaauuuccgaaacaccugauuguagccaucggaguuaagguguaucuuugccugccuaacguccgguccuugacagaaggccacugucucaucgugccccugcagcaucacagagcugccacuuuacuggacgaggauauuugggaggaaauacagauguucaggaaaagccuagucaagauguuugaggacaagggucucgauugcaucuuccuggaaaccaauaugagcaugaaaaagcaauaccauaugguguaugaguguauuccacuuccuaaagagguuggggacauggcacccaucuacuuuaagaaagcgauaauggaaagugaugaggaauggucuaugaacaagaaguugauugaccuguccagcaaagauauccguaagucggugccacgcggccuccccuauuucucaguagacuuuggacugcacggcggguucgcucaugucaucgaggaucagcacaaauuuccucacuacuucggaaaggaaauuaucgguggcaugcuugacauugagccacggcuguggagaaaagggauaagggagucuuucgaagaucagcgaaagaaggccuugcaguuugcacaaugguggaaaccguacgacuucacaaagaguaaaaauuauuga

SEQ ID NO: 54979 - RNA, 2100 nt, Artificial Sequence
  derived and/or modified sequence opt3 from CWH43__Homo_sapiens__NP_079363
augcccagccuguggagagagauccuccuugaaucccuguugggcugcgugucuuggucauuauaccacgaccuggggccuaugauuuauuacuucccacuacagacccucgagcugacaggacuugaagguuuuaguauagccuuccugagcccgaucuuuuugacuauuacgcccuucuggaagcucgucaacaaaaaguggaugcugacccugcucaggaucauuacaaucggcuccauagcuucuuuucaagcaccuaaugccaaauuacggcugaugguucuugcguugggggugucgucaagccugaucguacaggcugugacuugguggaguggaucccaucuacagcgcuaucuccgaauuuggggcuucauccugggucagauuguccuugugguucugcguaucugguacaccucuuugaacccaauauggagcuaucaaauguccaauaaggugauucucacacugucagccaucgcaaccuuagauagaauugggacugacggagauuguaguaaacccgaggaaaagaagacaggcgaggucgccaccggcauggcuagcaggccuaacuggcugcucgcaggggccgcuuuuggaucucuuguguuccugacgcacuggguauuuggugagguuuccuuggugucacggugggccgucagcggccauccacaccccgggccugacccaaauccguucggaggcgcggugcuacugugccucgcaaguggucugaugcuucccucuugucugugguuucgcgggacuggauugaucuggugggugaccggcacagccuccgcugccggccuccuguacuuacauacuugggcagcugccgucagcgggugcguuuucgcgaucuuuaccgccucgauguggccucagacacugggacaccuaauuaacucugguaccaauccaggcaaaacgaugacuauagcaaugaucuucuaucuccuggaaauuuucuuuugugcuuggugcacagccuucaaguuugugcccgggggaguauacgcuagagagagguccgaugugcuuuugggcaccaugaugcugaucauaggucucaacaugcuguucgggccuaaaaagaaucuugaccuguugcuccagacuaaaaacucaaguaagguccuguuuagaaagagcgaaaaauacaugaaguuauuccuguggcuacucgugggcguuggacugcuuggcuuggggcugcgccacaaagccuaugagcgaaagcucggaaaaguggcaccaacaaaggaggucuccgccgcuauuuggcccuuuagauucgguuacgauaaugaaggcuggucuagccuggagaggucagcgcauuuacugaacgaaaccggggcagacuuuaucacgauccuugagagugaugccuccaaaccguauaugggaaauaacgacuugaccauguggcucggcgaaaagcuggguuucuacacagauuuugggccuagcacucgguaucacaccuggggcauuauggcucuaucucguuaccccaucgugaagucagagcaucaucugcucccaaguccugagggagaaauugcccccgcaauaacacugacuguaaauaucagcggcaaacuuguugacuucguggucacccacuuugggaaccacgaggaugacuuggaccgcaagcugcaggccauugcuguguccaaauuacucaagucuucgagcaaccaagucaucuuccugggauauaucacauccgccccagguucaagagauuaccuucagcugaccgaacacggcaaugugaaagacauugauaguacugaccaugauagguggugugaguacauaauguaucggggguugauccgacucggauacgcacgcauuucucacgcggaacugagcgacuccgagauccagauggcuaaguuccggauucccgaugacccuacgaacuauagggauaaucagaagguugugaucgaccaucgggagguaucagagaaaauacacuuuaacccacgcuucggcagcuacaaggaaggucacaauuaugaaaacaaucaucacuuucauaugaacacaccgaaauacuuccuauga

SEQ ID NO: 54980 - RNA, 1194 nt, Artificial Sequence
  derived and/or modified sequence opt3 from CX3CL1__Homo_sapiens__NP_002987
auggcccccaucagccuguccuggcuccuuagacuggcuaccuucugccacuugacaguguuacuggcaggccagcaucacggggucacuaaguguaacauuacgugcucuaaaaugaccucaaagauaccuguugcccuacucauccauuaccaacagaaucaggcgaguuguggaaaaagggcuauuauccuggagacacggcagcaccgccuguuuugcgccgacccaaaggaacaaugggugaaagaugcaaugcagcaucuugaccgacaggccgcugcauugacucguaacgguggcaccuucgagaagcagauuggggaaguaaagccgagaacaacccccgccgcuggaggcauggaugagagcgugguccucgaaccugaggccacuggugaguccucuucgcuggaaccaacacccucaagccaagaggcgcagagggcacuggggaccaguccugaacucccaacgggagugacuggcuccucuggcacccgguuacccccuacaccaaaagcccaggacgggggaccgguugguacugagcuguuucgcgugcccccugucagcaccgcugccacauggcaguccucagcaccacaccaacccggcccuagucuuugggcugaggccaagaccagcgaagcgccaucuacgcaggaucccuccacucaggccucaacagcaagcaguccggcuccugaggaaaaugcccccucugaggggcaaagaguguggggacagggccaguccccaaggccugaaaacagcuuggagcgggaggaaaugggucccguaccagcucacaccgacgccuuccaggauugggggcccggaucgauggcacauguuucuguggucccuguguccucagagggcacuccaagucgcgaaccgguggccagcggcuccuggacacccaaagcugaggaaccuauccacgcgaccauggacccacaacgacuggggguccuaauaacgcccguuccugaugcacaggccgcuaccagaaggcaggccgugggacuccuggcauuucuuggucuguuguucugucucggcguagccauguuuacauaucagucucugcaagggugcccacggaagauggcuggagagauggccgagggcuuacguuacaucccccgcagcugugguucaaauaguuaugugcuggucccgguguga

SEQ ID NO: 54981 - RNA, 1164 nt, Artificial Sequence
  derived and/or modified sequence opt3 from CX3CR1__Homo_sapiens__NP_001164645
augagagagccccuggaagccuucaagcucgcugaccuugauuuuaggaaaagcucccuggcaucuggcuggcggauggccucaggggcguucaccauggaccaguuuccugagagugugacagaaaacuucgaguacgaugacuuggcugaagccugcuauaucggagauauugucguuuuugguacuguguucuuaagcauauuuuacuccguaaucuucgcaauuggccugguggggaaucuacucgucguguuugcccugacgaacucuaagaaaccaaagucgguuaccgacaucuaucuucugaauuuggcucucucagaucugcuguucguggcaacacucccguuuuggacucacuacuuaauuaacgagaaaggacugcauaaugccauguguaaguucaccacagccuuuuucuucaucggcuuuuucgguagcauauuuuucaucaccgucauuaguaucgaccgcuaucuugcuauuguguuggcggcaaacuccaugaauaaccgaacuguacaacacgggguuacaaucucucugggagugugggccgcugccauucuagucgcagcuccccaguuuauguucaccaagcagaaagagaaugaaugccucggcgauuacccugaggugcugcaggaaauauggccagugcuucguaacgucgagacgaauuuucugggcuucuugcucccccuguuaaucaugagcuauuguuacuuuagaauuauccaaacucuguucuccugcaagaaccauaaaaaggccaaagcgaucaagcucauucuucugguugugauaguauuuuucuuguuuuggaccccuuacaaugugaugaucuuccuagagacacugaagcucuaugacuucuuuccaucaugugauaugaggaaagaccugcggcuugcccugagugucacugaaaccguggcauucagccacugcuguuugaacccccucauuuacgcuuuugccggggagaaguuccgcagauaucuguaccauuuauauggaaaaugccuggcuguucuaugugguaggucugugcacgucgauuuuuccucaagcgaaagucagcggucucgccacggcuccgugcucagcucgaauuucacauaccauaccucugacggggacgcccugcuuuugcuguga

SEQ ID NO: 54982 - RNA, 603 nt, Artificial Sequence
  derived and/or modified sequence opt3 from CXADR__Homo_sapiens__NP_001193993
auggcccugcuccuuugcuucgugcuguuguguggcgucguugacuuugcuaggagcuuauccaucaccacacccgaggaaaugauugagaaggcaaaaggggaaacugccuaccugccuugcaaguucacgcuaucuccagaggaucagggaccgcucgacauagaauggcugaucucacccgcggauaaccaaaaaguggaccagguaauuauccuuuauaguggugauaagauuuacgacgauuauuacccugaccugaaaggcagagugcacuuuaccagcaaugauuugaaguccggggacgcuucuaucaacgucacaaaucuccagcugucggauauaggaacuuaucaguguaaggugaaaaaggccccaggcguugcaaacaaaaagauccaucuggugguccucgguaaaaugugccacuuacaacgggccgugcgcccccugccugaggcuaccucagcaguaauuauccauccaugggggcccugucuuuugccuacauggaaggacauuccacgacugagcaucaccaaguaccagguuaaaacucuaaaugcccuccugcgugugagacuuagucaccuguugagguga

SEQ ID NO: 54983 - RNA, 297 nt, Artificial Sequence
  derived and/or modified sequence opt3 from CXCL10__Homo_sapiens__NP_001556
augaaccagaccgccauccugauuugcugucucauauuccuuacacugagcggcauccaaggggugcccuuguccagaacugucaggugcacguguauuucuaucucaaaucagccuguuaacccacggaguuuagagaagcuggaaauuaucccggcuagccaguuuugcccccgcguggagauaaucgcaaccaugaaaaagaaaggagaaaagcgaugucuaaauccugaguccaaagccauuaagaaccuccugaaggcgguaucuaaagaacguucgaagagaucaccauga

SEQ ID NO: 54984 - RNA, 285 nt, Artificial Sequence
  derived and/or modified sequence opt3 from CXCL11__Homo_sapiens__NP_005400
augagcgugaaaggcauggccaucgcucuggcagucauucucugcgccaccguugugcagggguuccccauguuuaaaagaggaaggugucuuugcauagguccuggcguaaaggcggugaaagucgcugacaucgagaaggccuccauuauguacccaucuaacaauugugauaaaaucgaagugauuaucacacugaaggagaacaaggggcaacggugcuugaauccgaaaucaaagcaggcacgcuuaauaaucaaaaagguugaacgaaagaacuucuga

SEQ ID NO: 54985 - RNA, 282 nt, Artificial Sequence
  derived and/or modified sequence opt3 from CXCL12__Homo_sapiens__NP_000600
augaacgccaagguggucguugugcugguacucgugcuuaccgcucugugcuugagcgacggcaaacccgucuccuuaucuuacagauguccuugcagguucuuugagucacacguggcacgggccaauguuaagcaucugaaaauccuaaacacaccaaauugugcgcuccagauuguggcucgccugaagaacaauaaccgacaagucugcauagauccgaaacuuaaguggauccaggaauaucuggagaaggccuugaauaaacguuucaagauguga

SEQ ID NO: 54986 - RNA, 330 nt, Artificial Sequence
  derived and/or modified sequence opt3 from CXCL13__Homo_sapiens__NP_006410
augaaguucaucagcaccucccugcuccuuaugcuguuggugucuucauuaagucccguccagggcguucuggagguguacuauacaagccuaagauguaggugcguacaagaauccucuguguuuauuccucggcgcuucauagaccgaauccagauucucccacgugggaacggaugcccgagaaaagagaucauugucuggaagaaaaauaagucgaucguguguguugauccccaggccgaauggauacagaggaugauggaggugcugcggaaacgcucaagcaguacucuuccugucccaguguuuaagagaaagauccccuga

SEQ ID NO: 54987 - RNA, 336 nt, Artificial Sequence
  derived and/or modified sequence opt3 from CXCL14__Homo_sapiens__NP_004878
augagccugcuccccagaagggccccuccaguguccaugcggcuucuggcugcagccuuguuacugcuacuccuggcgcuuuacaccgcucgcgucgacggcucuaagugcaaauguucacgaaaggggccgaaaauccguuauagugauguuaagaaacuggagaugaagcccaaguacccucacugcgaagagaaaauggugauuauaacaacuaagagcguauccagauauaggggacaggaacauuguuugcacccaaaacuccaaucuacgaagcgguucaucaaaugguacaacgccuggaaugagaagcgcagaguguaugaagaguga

SEQ ID NO: 54988 - RNA, 822 nt, Artificial Sequence
  derived and/or modified sequence opt3 from CXCL16__Homo_sapiens__NP_001094282
augagcggcucccagucugagguggcccccucaccucaaaguccaagaagcccggaaauggggagggaccugcggcccggaucccgcguccuccuucuguuguuacugcuacuccugguuuaccuuacccagccugguaacggcaaugaggggucugugacaggaucgugcuauuguggcaagcgaaucucaagcgauaguccacccuccguacaguucaugaaccgucugagaaaacacuugagggcuuaccaucggugccucuauuacacucgcuuucagcugcugucuuggagcguguguggugggaauaaggacccuuggguccaagaacucauguccugcuuagaucugaaagaguguggacacgcauauucaggcauuguggcccaucagaagcaccuuuugccaacgagucccccuauaagccaggcgucugaaggcgcuuccucagacauccauaccccagcccagaugcugcuaagcacacuccaaaguacucagagaccgacccugcccguugggucucuuuccagcgauaaagagcugacaaggccuaacgagaccacuauucacacagcaggacacucguuggccgcugguccagaagcaggcgagaaucagaagcagcccgaaaagaacgccgggccuaccgcucggacgucugccacugugccaguccucugccuguuagcgaucauuuucauccugaccgcagcccucuccuacgugcuuuguaaacgccgaagaggacaaucaccccagaguagcccggaccugccuguacauuauauacccguugcuccagauuccaauacauga

SEQ ID NO: 54989 - RNA, 360 nt, Artificial Sequence
  derived and/or modified sequence opt3 from CXCL17__Homo_sapiens__NP_940879
augaaggugcugaucagcucccuccuucuguuguuaccccugaugcuaaugucuauggucucaaguagccucaacccuggcguugccagagggcacagggaccggggacaggcuucccgccgauggcugcaagaggguggccaggaaugcgaguguaaagauugguuccuucgugcaccaagaaggaaguuuaugaccgugucugggcugccgaaaaagcagugccccugugaccauuucaaaggaaauguaaagaagacacggcaccagcgccaucacagaaaaccuaacaagcauucgagggccugccaacaguuuuugaaacagugucagcuccggucauucgcgcugccacuguga

SEQ ID NO: 54990 - RNA, 324 nt, Artificial Sequence
  derived and/or modified sequence opt3 from CXCL1__Homo_sapiens__NP_001502
auggccagagcugcacugagcgccgcgcccuccaacccuaggcugcuucggguggcucuguuguuacugcuacucgucgccgcaggccgccgagccgcuggggcaucuguugccaccgagcugcguugccagugucuucaaacacugcagggaauccacccaaagaauauucagucagugaacguaaaaaguccggguccccauugcgcucagacugaagugauagccacguugaagaauggcagaaaagcgugucucaacccugcaagcccaaucgucaagaaaauuaucgagaagaugcucaauuccgacaagucuaacuga

SEQ ID NO: 54991 - RNA, 324 nt, Artificial Sequence
  derived and/or modified sequence opt3 from CXCL2__Homo_sapiens__NP_002080
auggccagagcuacccugagcgcagcccccuccaacccuaggcuccuucggguggcgcuguuguuacugcuacucgucgcugccucucgccgagcagccggcgcuccacuggcaacagagcuucguugccagugucugcaaacuuugcaggggauccaccucaagaauauucagucaguuaaagugaagaguccgggaccccauugcgcccagacggaaguaauagcuacccugaaaaacggucaaaaggccugucugaauccugcgagcccaauggugaaaaagaucauugagaagaugcucaaaaacggcaaguccaauuga

SEQ ID NO: 54992 - RNA, 324 nt, Artificial Sequence
  derived and/or modified sequence opt3 from CXCL3__Homo_sapiens__NP_002081
auggcccacgcuacccugagcgcagcccccuccaacccuagacuccuuaggguggcgcuguuguuacugcuacucgucgcugccucucggcgcgcagccggcgcuucaguugugacagagcugcgaugccagugucuucaaacucugcaggggauccauuugaagaauauucagaguguaaacgugcguagcccaggaccgcacugcgcacagacggaagucauagccacccucaaaaaugguaagaaagccugucugaaccccgcuuccccuauggugcaaaagaucauugagaaaauccugaauaagggcucuacaaacuga

SEQ ID NO: 54993 - RNA, 345 nt, Artificial Sequence
  derived and/or modified sequence opt3 from CXCL5__Homo_sapiens__NP_002985
augagccugcucuccucuagagccgcuagggugcccggcccuucaaguagccuuugcgcacuguuggucuuacugcuacuccugacccagccagggccgaucgccuccgcgggacccgcugccgcaguucuucgggagcugcgcugugugugcuugcaaacaacucaggguguacacccuaagaugauuucuaaccuccagguguucgccauaggcccacaguguucgaaagucgaagugguugcuucacugaagaaugggaaagagaucugccuggaccccgaagcaccuuuucucaagaaagugauucaaaagaucuuagauggaggcaacaaggagaauuga

SEQ ID NO: 54994 - RNA, 345 nt, Artificial Sequence
  derived and/or modified sequence opt3 from CXCL6__Homo_sapiens__NP_002984
augagccugcccuccucuagagccgcuagggugccuggcccaucagggagucucugcgcacuucuggccuuguuacugcuacucaccccgcccggaccucuggcgagcgcugguccagucuccgccguucuuacagagcugcgguguacuugcuugcgcgugacgcuccgaguaaaccccaagaccaucggcaaauuacagguguucccugcagggccacaauguucuaaggucgaagugguugccucgcugaaaaauggaaaacaggugugccucgaccccgaggcuccuuuucugaagaaggucauucagaagauacuggauucaggcaacaaaaagaauuga

SEQ ID NO: 54995 - RNA, 300 nt, Artificial Sequence
  derived and/or modified sequence opt3 from CXCL8__Homo_sapiens__NP_000575
augaccagcaagcuggccguggcucuccuugcagccuuccugaucuccgcggcuuugugcgagggcgccgucuuacccagaucugcaaaagaacugaggugucagugcauuaagacauacucaaaaccuuuucacccaaaguucauaaaagagcuacggguuaucgaaagugggccgcauugugccaacacugagauuaucgugaagcucagcgacggacgcgaacugugccuugaucccaaggagaauuggguacaacgaguggucgagaaauuucugaagcgugcugaaaacuccuga

SEQ ID NO: 54996 - RNA, 378 nt, Artificial Sequence
  derived and/or modified sequence opt3 from CXCL9__Homo_sapiens__NP_002407
augaagaaaagcggcgugcuguuccuccuugggauaauucuguuggucuuaauaggaguucaggguacccccgugguaagaaaggggaggugcuccuguaucucuacaaaccaaggcacuauucaucugcagucacuaaaagaccucaagcaguuugccccuaguccaagcugcgagaaaaucgaaauuaucgcuacgcugaagaauggagugcagaccugucuuaacccggauuccgcagacgucaaggagcugaucaaaaagugggaaaaacaagugucucagaagaaaaagcagaagaauggcaaaaagcaccagaaaaagaaaguuuugaaggugcggaaaucgcaacgcucacgacagaagaagacaacuuga

SEQ ID NO: 54997 - RNA, 1053 nt, Artificial Sequence
  derived and/or modified sequence opt3 from CXCR1__Homo_sapiens__NP_000625
augagcaacaucaccgacccccagaugugggauuucgacgaucugaauuuuacaggcaugccuccagccgacgaagauuacuccccgugcaugcucgaaacugagacgcuuaacaaguauguggucauuauagcuuacgcacugguuuucuuguuaucucugcuaggaaauucacucgugaugcugguaauccuuuauaguagaguggggaggagcgucaccgacguguaccuguugaaccucgcccuggcggaucugcucuuugcuuuaacacugcccauuugggccgcauccaaaguuaaugguuggaucuucggcacuuuucuuuguaagguggucucuuugcugaaagaagugaacuucuauucggggauucuacuccuggccugcaucucaguagaccgguaccuugcuauaguucacgcaacccgcacacugacccaaaagcgacauuuggugaaauuugucugucucggaugcuggggccugagcaugaauuuaagucugccuuucuuucucuuccgucaggccuaucacccaaacaauuccucucccguguguuacgaggugcuugguaacgauacugcuaaguggagaaugguccugaggaucuugccucauacauuuggguucauuguuccacuauuugugaugcuguucugcuacggauucacccuccggacgcuguuuaaggcccacaugggccagaaacaucgcgcgaugagaguaaucuucgcagugguccuuauuuuucuguuguguuggcuccccuauaaucugguguuacuggccgacacucuaaugaggacccagguuauccaagaaagcugcgagcggcgcaacaauauaggccgagcucucgaugccacagagauucugggguuccuucacuccuguuugaacccuaucauuuacgcauuuaucggacagaauuucagacacgguuuucugaagauccucgcuaugcauggccuggugucaaaagaguuccuugccaggcaccgggucacuagcuauaccaguucuuccgugaacguaucaagcaaccuguga

SEQ ID NO: 54998 - RNA, 1083 nt, Artificial Sequence
  derived and/or modified sequence opt3 from CXCR2__Homo_sapiens__NP_001161770
auggaggacuucaacauggaaagcgauuccuuugaggacuucuggaagggcgaagaucugucuaauuacucauauaguagcacccuucccccuuuucuccuggacgccgcuccaugcgagccggaauccuuggagaucaacaaauacuucguggucauuauauaugcauuaguuuuucugcuaucucuccugggaaauucgcuugugaugcugguaaucuuguacucaagaguggggaggagcgucacagauguguaucuccugaaccuggcccucgcggacuuacuguucgcucuuacuuugcccauuugggccgcaaguaagguuaaugguuggaucuuuggcacguuccuguguaaaguggucucccuacucaaggaggugaacuuuuacucugggauucugcuucuggccugcaucagcguagaucgguauuuggcuauaguucacgcaacccgcacacucacucagaaacgauaccuggugaaguucaucuguuuauccauuuggggacugucacuccuucuggccuugccuguccuacuguuucguagaaccguguacaguagcaaugugucuccagcuugcuaugaagacaugggcaacaauacagccaacuggaggaugcuccugcggauccuuccccaauccuucgguuuuauugucccucuguugaucaugcuguucuguuacggguucacccuccgcacuuuauuuaaggcgcauaugggacagaaacacagagcaaugaggguuauauucgccgugguacugauuuuucuacucugcuggcugccauauaaucuuguguugcuggcugauacacucaugcggacccaggucauccaggagacgugugaacgccgaaaccauauugacagagcccuggaugcaacugagauccuuggcauccugcacucaugcuugaauccccucauuuacgcuuucauaggccaaaaguuuaggcaugggcuguuaaaaauccuggccauucacggacuaaucagcaaggacagucucccuaaagauucucggccauccuucguggguagcucgucuggccacaccuccacaacucuguga

SEQ ID NO: 54999 - RNA, 1248 nt, Artificial Sequence
  derived and/or modified sequence opt3 from CXCR3__Homo_sapiens__NP_001136269
auggagcugagaaaguacggccccgggaggcucgccggaaccgugaucgguggcgcugcacagagcaaaucccaaacaaagucugacucaauuacuaaagaguuccuuccugggcuguauacggccccaaguagcccguuucccccuucccaggucucugaucaccagguuuugaacgacgcggaaguggcugccuuacuggaaaauuucucgucaagcuacgauuauggagagaacgaaagugacuccugcuguaccucuccacccugcccucaggauuuuagccuaaauuucgaccgggcauuucucccagcccuguacucccuucuguucuugcucggccugcuggguaacggggcuguagcagccgugcucuuaucacgccgaacagcucugaguagcacugauaccuuucuuuugcaucuggccgucgcggacacacuacucgugcugacccuuccccugugggcaguugaugccgcugugcaaugggucuucggaucuggcuuguguaagguggccggcgcacucuuuaauauaaacuucuaugcuggggcccuguuacuggcgugcaucuccuuugaccguuaccucaauauuguacacgccacucagcuuuauagaaggggaccuccagcacggguuacacugaccuguuuggcuguguggggucuaugccuccuguucgcccugccggauuuuaucuuccuuucagcucaucacgacgagcgccugaacgccacgcauugucaguacaauuucccccaggucggcagaacugcauugagggugcuccaacugguggccggguuuuuacugccucuacucgucauggcuuacugcuaugcgcacauucuggcaguucuuuuggugagccggggacagcgccgacugagagccaugaggcucguaguggucgugguuguggcuuucgcccuguguuggaccccauaccaccuugucgugcugguagauaucuugauggaccucggcgcacuggcccggaacugcggucgugagagucgcguugacguggcuaaaucugucacauccggguuaggauauaugcauuguugccugaauccccuacucuacgccuuugugggcgucaaguucagagaaaggauguggaugcugcuuuugcggcugggcugcccuaaccagcgagggcuccagcgccaaccaagcucgucuagaagggauuccucauggagugagacuagcgaagcauccuauucuggacuguga

SEQ ID NO: 55000 - RNA, 1071 nt, Artificial Sequence
  derived and/or modified sequence opt3 from CXCR4__Homo_sapiens__NP_001008540
augagcaucccccugccucuccuucagauuuacaccuccgacaacuauacagaggaaaugggcucuggggauuacgacucaaugaaggagccaugcuucagagaagagaaugccaacuuuaauaaaauauuccugccgacuaucuauaguauuaucuuuuugacgggaauuguggguaacggcuuagucauccugguuaugggguaccaaaagaaacuaaggagcaugaccgauaaguaucggcuccaccuguccguggcugaccuucuguucguaauaacauugcccuuuugggcaguggaugccgucgcgaauugguacuucggaaacuuucucuguaaagcugugcauguuaucuauacugugaaucuguacucuucgguccugauucucgccuucaucucauuagaccgcuaccuggcaauugugcacgccaccaacagccagcgaccucguaaacuuuuggcugaaaagguaguuuaugugggcgucuggaucccagcacugcuacucacaauacccgauuuuauuuucgccaaugugagugaggcugacgauagauacaucugcgacagguuuuauccuaacgaucuguggguggucguuuuccaguuucagcauauuauggugggucuuauccugccagggaucguaauuuuguccuguuacugcauaaucauuucuaagcucagccacuccaagggacaucaaaaacggaaggcccugaaaaccacugugaucuuaauacuggcguucuucgcauguuggcuccccuauuacauuggcaucucaaucgacaguuuuauucuucuggagaucauuaagcagggcugcgaauuugagaauacaguccacaaguggauaagcaucaccgaagccuuggcuuucuuccacuguugccuaaacccuauucuguaugccuuucucggggcaaaauucaagacgucugcucagcaugcccugacuuccgugucacgcggaagcagucuuaaaauccugucuaaggguaaaagaggcgggcacuccagcguuucgaccgagucugaguccucaaguuuucauagcuccuga

SEQ ID NO: 55001 - RNA, 1119 nt, Artificial Sequence
  derived and/or modified sequence opt3 from CXCR5__Homo_sapiens__NP_001707
augaacuacccccugacccucgagauggaccuugaaaaucuggaggauuuguucugggaauuagacagacuggauaacuauaaugacacaagccuaguggagaaccaccucugcccugccacugaaggcccacugauggcuuccuuuaaggcagucuucguuccgguggccuacucucuuaucuuucuguuggggguaauuggaaaugugcucguccuggugauacuggagaggcaucggcagacgcgcucaaguaccgagacauuccucuuucacuuagcgguugcugaucugcuuuugguguucauccugcccuuugccgucgcagaagguagcgugggcuggguacuagggacuuuccucuguaaaaccguuauugcccugcauaaggugaacuuuuauugcuccucucuucuguuggcuuguaucgcagucgaccgauaccucgccauugugcacgcugugcaugccuaucgucacagaaggcuguuaucgauccacauaacaugcggaaccaucuggcuggucggcuuccuccuugcgcugccugagauuuuguuugcaaaaguuucacaaggucaucacaauaacagccuaccacgguguacuuucagucaggaaaaucaggccgagacacaugcuugguuuaccucccgcuuccuguaccacguggccggguuccuccugcccaugcuuguaaugggauggugcuaugugggcgucgugcacagacugaggcaggcacaacggcgcccucagcgacagaaggcuguuagaguggccaucuuggucacgucuaucuuuuuccucuguuggagcccauaccauauugugauauuucuggauacuuuagcgaggcugaaagccguagacaauaccugcaagcuaaacggcucccuccccguugcaauuacaaugugugaguuccuggggcuugcucacugcuguuugaacccuaugcuguacacuuuugccggagugaaguuccggucagaucucagucgucugcuuaccaaacuggguugcacaggcccagcuagcuugugccagcucuuuccgucuuggcgcagauccucacugagcgaaagugagaaugccaccucuuuaacgacuuucuga

SEQ ID NO: 55002 - RNA, 1029 nt, Artificial Sequence
  derived and/or modified sequence opt3 from CXCR6__Homo_sapiens__NP_006555
auggccgagcacgacuaccaugaagauuauggcuucagcuccuuuaacgacucuucacaggaggaacaccaagauuuccugcaguuuaguaagguguuccuccccugcauguaccuugucguuuuugugugugggcugguaggaaauagcuugguguuagucaucuccauuuucuaucauaaacugcagucucuaaccgacguguuucucguuaaccugccucuugcugaucugguguucgucugcacauugccauuuugggcauacgccgguauacacgaguggguguucggccagguaauguguaagucgcuccuggggaucuauacuauuaauuuuuacacgucaaugcugaucuuaaccugcauuacaguugacagauucaucguggucgugaaagcgacuaaggcuuauaaccaacaggccaaaaggaugaccuggggaaaggugacaagccuccugauaugggucaucagucuuuugguuucccugccgcagauuaucuacggcaauguguuuaaccuagauaagcucauuugugguuaccaugacgaagcaaucucuaccguagugcuggccacucagaugacacuuggguucuuccugcccuugcucaccaugauagucugcuauagcgugauuaucaaaacgcuguuacacgcuggaggcuuucaaaagcaccggucccugaaaauuaucuuccucguuauggcaguguuucuucugacucagaugccuuucaauuugaugaaguuuauccgcucaacccauugggaguacuaugccaugacaaguuuccacuacacuauuauggucaccgaggcuauagccuaucuacgagcgugucugaacccagugcucuacgcauuuguaagccugaaauuccguaagaauuuuuggaaacuuguuaaggauaucggcugccugcccuauuugggggugucucaucaguggaaguccucagaagacaacagcaaaacauucagugccucucacaaugucgaggcuaccuccauguuucagcucuga

SEQ ID NO: 55003 - RNA, 549 nt, Artificial Sequence
  derived and/or modified sequence opt3 from CXorf36__Homo_sapiens__NP_078965
auggagccccagcugggcccugaagccgcugcacucagaccaggguggcuugcccuguuguuaugggugagcgcgcuguccugcucuuucucacuaccggcuaguagccucuccucucuggucccccaaguuaggaccucguacaacuuuggacggacauuccuuggucuggacaaguguaaugccugcaucggcacuucaauuuguaaaaaguuuuucaaagaggaaauacgcagcgauaacugguuggcaagucaccucgggcugccuccagacucccugcucucuuaucccgccaauuacagcgaugacuccaagaucuggcgaccuguggagauuuuucguuuaguaucaaaauaucagaacgaaaucagugauagaaggauuugcgcuagcgcaucugccccaaagacguguuccaucgagcgggugcugcgcaagaccgagagauuccagaaauggcuucaggcuaagagguugacacccgaccugguccaagauugccaucagggacagcgggaacuaaaauuucucuguaugcugcgcuga

SEQ ID NO: 55004 - RNA, 1086 nt, Artificial Sequence
  derived and/or modified sequence opt3 from CXorf66__Homo_sapiens__NP_001013421
augaaccuggugaucugcguccuccuucugagcauuuggaagaauaacuguaugaccacaaaucagacuaacggcuccucuacgaccggggacaaacccguugagucaaugcaaacaaaguugaauuacuuaagaaggaaccugcuaauacucgugggaaucauuaucaugguauucguguuuauuugcuucuguuaucugcacuacaauugccuuagugaugacgccagcaaagcugguauggucaagaaaaagggcaucgcagccaaguccucuaaaacuucguuuucagaagcgaagaccgcuagccaguguaguccugagacacagccaaugcuguccaccgccgauaaaucuagcgacuccucaaguccggaacgggcaagcgcccagucuuccacugagaaguugauacgccccucaagccuccaaaaaccuaguaucccaaacucugcugggaagcugacacgacccuccuauccuaagcguagcucgaaaucuuccugcucaaagaaacugaguaagagcucccaucucgaaaaagcacacaagaaaggaucuuuagagaagcuguguaaacuugauuacgccugcaaguuggcuagcucagacaagccagugagacccccucagcuguucaaaccacuauauaguucccauccgcagaaugagauuagccccucuaagccuuuuggcccacaggaacucgccaaacccccuaagcacuucaacccaaagaggucaguuagucugggucgggcggcacuucugagcaauuccgaguuggccgaaaccugucaacccuacaaaaagaaacaucucguggcuaagacguaucgcccgcuggucaacgauaucucugaggccaaagagaagaauacucagaacuuacacgugucgagcaagguaaaauccucaaguagaucuuuuaggaagcuggacagccggaauaacgcauacggggaucacguuaacgacuccgauaccaugaaauacuauucagaaguggacagcgauaaggucauuaucauaacaugcgaccgcggauacaaucaggugacuucugaggugacccucaacgacuga

SEQ ID NO: 55005 - RNA, 1512 nt, Artificial Sequence
  derived and/or modified sequence opt3 from CXorf67__Homo_sapiens__NP_981952
auggccacccagagcgacauggagaaggaacaaaaacaccagcaggaugagggccaagggggacugaacaaugaaacagcucucgcauccggugacgccugcggcacugggaaccaggaucccgcggcuucugucacgaccgucucaagucaggccagcccuuccggaggcgcagcccuuucuucgucaacagcugguagcagugcagccgcugccacuuccgcggcaaucuucauuaccgacgaggccucugggcugccaauaaucgcugccguuuugacagaaagacauagcgauaggcaggacugucgguccccgcacgagguguuuggaugcguagugcccgagggcggcucacaggcagcugucgggccucaaaaggccaccggacaugcggaugaacacuuagcccagacuaaaaguccagguaauagccgccgacguaagcagcccuguagaaaccaggcagcuccugcccaaaaaccacccggcaggcggcuguucccugagccacuaccgcccucuuccccuggguuucgcccaucaagcuaccccugcaguggagcuucuacauccagccaggccacccagccuggcccagcacuccugucgcaugccucugaagcuagacccgcgacgaggucccggauuacucuuguggcaucagcccugcgcagacgagcuagugguccggggccuguuaucaggggauguaccgcccaacccggcccagcauucccucaccgggccacacacuuggaccccgcucgucucagcccagaguccgcccccggcccugcacgcagagggagggcgucugugccaggaccggcucggcgagguugcgauagcgcccccggcccugcacgcagagggagggacucagccccagucagugcuccccggggacgcgauuccgccccuggcagcgcaagaaggggucgugacucugcuccagggcccgcccugcgggugcgaacugcgagaucagaugccggccauaggaguaccagcacaaccccgggaacgggccugcgcucccggucuacucagcagagaucggcucucuuaagcaggcgcucccugucagggagugcagacgagaauccuucuuguggaacagguagcgaacgacuugccuuucagucccggucaggcagcccagaccccgagguaccuucucgugcuagucccccaguuuggcacgccgugagaaugagggcauccagcccuucucccccagggcgcuucuuuuugccgauuccucaacagugggaugaauccucaaguagcucguaugcguccaacucuagcucacccagucgguccccaggacugucucccagcuccccuucaccagaguuccuaggccucagaagcaucaguacccccucuccugaaucccugagguacgcccuuaugccggaguuuuaugcucugagcccagugcccccugaggaacaggccgagauagaaucgacugcacauccagcuacacccccugagccguga

SEQ ID NO: 55006 - RNA, 1983 nt, Artificial Sequence
  derived and/or modified sequence opt3 from CXXC1__Homo_sapiens__NP_001095124
auggagggcgacgggagcgaucccgaaccuccagacgccggagaggauuccaagucugaaaacggugagaaugcuccgaucuacugcauuuguagaaaacccgacauaaacugcuucaugaucggcugugauaauugcaacgaaugguuucacggggacuguauuaggaucaccgagaagauggcaaaagccauucgggagugguauugccgcgaaugucgagagaaggauccuaaacuggaaauccguuacagacauaagaagucaagggagcgggacggaaaugagcgcgauaguagcgaaccaagagacgagggcggugggaggaaacggcccgugccugauccagaccuccagcgccgagcgggauccggcacaggcgucggggcuaugcuugccagaggaucugcaucgccccacaagucaagcccucaaccacugguugccacuccgagucagcaucaccagcagcaacagcagcagauaaaaagguccgcucggaugugcggugaaugugaggcaugccgucgcacggaagauuguggccauugcgacuucugcagagacaugaagaaauuugggggacccaacaagaucaggcaaaagugucgguugcgacagugccaguuacgcgccagagagucuuauaaauacuucccuagcucccugucaccagugacccccagugagagccuaccuaggccacggcgcccccucccgacacagcaacagccucagcccucucaaaagcugggcagaauuagggaagaugagggugcuguagccuccucaacugugaaagaaccaccugaggcgaccgcaacacccgaaccacuuagcgacgaggaucugcccuuggacccugaucucuaucaggacuuuugugccggggcuuucgaugaccacggacugccauggaugagugauaccgaggaaucuccguuucuggaccccgcccuccguaagcgggcagucaaagugaagcacguuaaacgaagagagaagaaguccgagaaaaaggugauggagaggaaagaagaacgcuacaagcggcauagacagaaacagaagcacaaggauaaauggaagcauccugagagggcugacgccaaagacccagcgagcuuaccccaaugccugggcccuggcuguguccgcccagcccagcccucgucuaaguauugcuccgaugacugugggaugaaacuugcagcuaaucgaaucuacgaaauuuugccgcagcggauccagcaauggcagcagucaccuugcauagccgaggaacacggaaagaagcugcuagagcguauuagaagggagcagcaaagugcucgcacucggcuccaggaaauggagagaagguuccacgaacuggaggccaucauucuucgagcaaaacagcaggccgugcgcgaagaugaggagagcaacgaaggugacuccgaugacacagaucugcaaaucuuuuguguaucuugcggccauccaaucaauccccggguugcuuugagacacauggagagguguuacgcgaaguaugaaagccagaccucauucgggaguauguacccuacgcguauugagggagcaacucgccucuuuugcgacguguauaacccccaguccaaaaccuacugcaagcggcugcaagucuuauguccagaacauagcagagauccuaaagugcccgccgacgaggugugcggcuguccacuggucagggauguuuucgagcucacaggugacuuuugccgacuuccgaagcggcaguguaaucgccacuauugcugggaaaagcugagaagggcugagguggauuuggaacggguacgagugugguacaaacuagacgagcuguucgaacaggagagaaacguccgcacugccaugaccaauagggcagggcuccuggcccuuaugcugcaucagacaauacaacacgacccuuugaccacggaucuccguucuucagcugaccgguga

SEQ ID NO: 55007 - RNA, 1104 nt, Artificial Sequence
  derived and/or modified sequence opt3 from CXXC4__Homo_sapiens__NP_079488
augaacaccaaugugugcgucgagcccggcccuagcccagaagccccggggcugcccaaggagucccaccucccugaaggagcucuuaacucucugguugacuacaauucagagauggaaagauauaggaguuucgcaacuagcuuuuacaaaacaaacgguggcgccuucccacaggcggcuaagaucgcccggauuacgacccccauauuuccuuccucugcagccgcugcagccgcugccgcgcgcaucgggaugucgccauggaauugugauaacgcagccacagcugccgcagcuacugccauguuguggggaucaggcggugggggaggcggcgggggagguggcgggggaggcggugggggaggcggcgggggagguggcgggggaggcggugggcgaaaaagcaguuccgcggccgcaucuagcuccgcuucaaguagcucugccauuuuacccgcuggcggaggcgggggagguggcgggggaggcucccguaccucaaugcaucacagaaaugacagccaaaggcuggguaaggccgggugcccuccagagccgagucuacagauggcaaacacaaauuuccucucuacccugucccccgagcauugucggccucuugccggcgaaugcaugaacaaacugaaguguggagcugcggaggcagaaaucaugaauuugccagagcgcgugggcacuuuuagcgccauucccgcucucgggggaaucucgcugccuccagguguaauagugaugacagcccugcacucucccgcagccgcuuccgccgcagucaccgauucagcguuccagaucgcuaaccucgccgacugcccgcagaaucauaguagcuccucuagcucaaguuccggcggggcaggaggcgccaacccugcuaagaaaaagagaaaaagguguggugugugcguucccuguaagcgguuaauuaauugcgggguguguagcucuugccgcaaccgaaaaacgggccaccaaaucugcaaguuuagaaagugugaggaacugaaaaagaaaccaggaacuucacuugagaggaccccuguccccagugccgaagcauuccggugguuuuucuga

SEQ ID NO: 55008 - RNA, 669 nt, Artificial Sequence
  derived and/or modified sequence opt3 from CYB561D2__Homo_sapiens__NP_001278213
auggcccugagcgcugagaccgaaucccacaucuacagagcacucaggacagccucuggcgcggcugcccaucuuguggcacugggguucacuauuuuugucgccguuuuggcucggcccggaucaaguuuauucagcuggcacccugugcugaugucccuagcauuuucuuuccucaugacggaggcccugcuuguauuuucgccagaaucaagccuguugcauagucucucccgcaagggucgagcucguugccacugggugcugcagcugcucgccuuacugugugcgcuuuugggccuggggcuagucauacuccauaaagagcaacugggaaaggcacaccuugugaccagacacggccaggccggucuguuggcuguucucugggccgggcugcagugcucuggaggcgugggcuuacuguauccgaaacuccuucccagguggccucuggcaaaguugaaacuauaccaugcuacaagcgggcuggucggauaucuccuggguuccgccucacuucuguugggcauguguagucucugguucacugcgagcgugaccggggccgcaugguaccuggcuguauuaugcccaguucugacaucucuagugaucaugaaccaggucuccaaugccuaucucuaccggaagcgcauucaacccuga

SEQ ID NO: 55009 - RNA, 756 nt, Artificial Sequence
  derived and/or modified sequence opt3 from CYB561__Homo_sapiens__XP_005257148
auggagggcggggccgcugcagccacccccacagcgcugccuuacuauguggcuuucagccagcuccuuggacugacuuuggucgccaugacgggugcaugguuaggccuguacagagggggaaucgccugggaauccgaccuacaauuuaacgcucacccacucugcaugguuauuggccugauauuccuucaggguaaugcacuguugguguauaggguauuucggaacgaggccaagcgcaccacaaaagugcuccaugggcugcugcacaucuucgcucucgucauugccuuagugggacugguugcgguguuugauuaccaucgaaagaaaggcuaugcagaccuuuacucuuugcacucaugguguggcauccuggucuucgugcuauauuuuguacaguggcucguuggguucagcuuuuuccuguuuccgggagccaguuucucccuucguucuagauacaggccccagcauaucuuuuucggugcuacuauuuuccuguugucggugggcaccgcccuccugggguuaaaggaagcacugcucuuuaaucuuggaggcaaauacucagcuuucgagccugaagguguccuggccaacguguuggggcuacugcucgcgugcuuuggaggcgccgugcuguauauacuuacacgggcagauuggaagcgcccaagccaagcugaggagcaggcccugaguauggacuucaagaccuugacugaaggcgauucccccgggucucaguga

SEQ ID NO: 55010 - RNA, 375 nt, Artificial Sequence
  derived and/or modified sequence opt3 from CYB5A__Homo_sapiens__NP_001177736
auggccgagcagagcgacgaagcugugaaguacuauacccuggaggaaauccaaaaacacaaccauuccaagucuacauggcucauucuucaccauaaagucuacgaucugacuaaguucuuggaggaacaccccggcggggaggagguuuuaagagaacaggcaggaggugacgccacggagaauuuugaagaugugggccauucaaccgacgcgagggagaugaguaaaacauucauaaucggggagcugcacccugaaacucuaauuaccacaaucgauagcuccucuucgugguggaccaacuggguaauuccagcuaucucagccguggcagucgcccucauguaucggcuguacauggcugaggacuga

SEQ ID NO: 55011 - RNA, 453 nt, Artificial Sequence
  derived and/or modified sequence opt3 from CYB5B__Homo_sapiens__NP_085056
augagcggcuccauggccaccgcugaggcaucugggucagacggaaagggucaggaaguggagacaagugucacuuacuauagacuggaagagguugccaaaaggaacagccucaaggaacuuuggcuggugauccacggccggguauacgacgugacgcgcuucuugaaugagcaucccgggggagaggaagucuuacuggagcaagcgggcguggacgcuuccgaaucuuuugaggauguuggucacucgucagacgcccgagagaugcuaaaacaguauuacauuggggauauacauccuagcgaccucaagccagaaaguggauccaaagauccgucuaagaacgauaccugcaagagcuguugggcauauuggauccugcccauuaucggcgccgugcuucugggcuucuuguaccguuauuacacauccgagucaaaaaguagcuga

SEQ ID NO: 55012 - RNA, 906 nt, Artificial Sequence
  derived and/or modified sequence opt3 from CYB5R3__Homo_sapiens__NP_000389
augggcgcccagcugagcacccucgggcacauggugcuuuuccccgucugguuucuguacuccuuguuaaugaagcuguuccaaagaucuacuccugcuaucacacuagagucaccagacauuaaauauccgcucaggcugauagaucgggaaaucauuagucaugacacgcgccgauuucguuucgcacuucccagcccucagcacauccugggauugccaguuggucagcauauuuaccucuccgccagaaucgauggcaaccuggugguaaggcccuauaccccuauaucuucggacgaugacaagggguuuguggaucuggucaucaaaguguacuucaaggacacacacccaaaauuucccgcgggaggcaagaugucacaguaucucgagagcaugcaaauuggugauacuaucgaguuccgggggccuaguggauuacugguuuaccagggcaagggcaaauuugcuauucgcccagacaagaaauccaauccgaucauaagaaccgugaagucugucgggaugauugccggagguacaggcaucacccccaugcuucaggugauuagggcaaucaugaaagauccugacgaucauacuguaugccacuugcuguucgccaaccagacagaaaaggacauccuacuccggccagaacuggaggagcuucgcaauaagcacagcgcucgauuuaaacugugguauaccuuggacagagcacccgaagccugggauuacgggcaaggauucguuaacgaggaaaugauuagggaccaucucccuccacccgaggaggaaccgcugguguuaauguguggcccucccccaaugauacaguacgcuugccugccuaaucucgaucacgucggucaucccacggagcgguguuuuguguucuga

SEQ ID NO: 55013 - RNA, 1566 nt, Artificial Sequence
  derived and/or modified sequence opt3 from CYB5R4__Homo_sapiens__NP_057314
augcugaacgugcccagccaguccuucccugccccaagaucucaacagagggucgcuucaggcgggcggaguaagguuccgcucaaacagggacgcagccuuauggacuggauccgacugaccaaguccgguaaagauuugacaggcuuaaaggggcgucugauugaggugacugaagaggaacucaaaaagcacaauaagaaagacgauugcuggauauguaucagaggauuuguauacaacgugucucccuauauggaguaccauccuggcggugaagacgagcuaaugagggcagccgggucggauggaacggagcuguucgaccagguccaccggugggugaauuaugaaucaaugcuuaaggagugccugguuggccgcauggcgauuaaaccagcuguguugaaggauuacagagaagaggagaaaaagguccucaacggcaugcugcccaagagccaagugaccgacacacuggccaaagaagggccuaguuauccauccuacgauugguuucagacugacucucucguaaccaucgcaauuuauacaaagcagaaagauaucaauuuagacagcauaaucguugaucaucagaacgacuccuucagggccgagaccauuaucaaggacugucuguaccuuauucacaucggauugucacaugaagugcaagaggauuuuaguguccgggugguggaaagcgucgguaaaauagagauuguucugcagaagaaagagaauacuucuugggacuuccuaggccacccccucaagaaccacaauucccugaucccucgcaaggauacagggcuuuacuaucgaaaaugccagcugauuucaaaggaagacgugacccaugauacgagauuguuuugucucaugcugccaccgagcacucacuuacagguacccaucggacaacauguguaccugaaacucccuaucaccggcacagagauugucaagccauauacucccgugagugguucucuucuguccgaguucaaagaaccuguuuugccaaacaauaaguacauauauuuucuaaucaagauuuaccccaccgggcuguucacaccggaacucgacaggcugcagaucggagauuuugugagcgucucgucuccugagggcaacuucaaaauauccaaguuucaggagcuugaagaccuguucuugcucgcugcaggcaccggguucacgcccauggugaaaauucugaauuaugccuuaacugauaucccaucacugcggaagguaaaacuaauguuuuucaacaagacagaggacgauaucauuuggcguagucaacucgaaaagcuggcuuuuaaagacaagcgccuugacguugaguucguguugagcgccccuaucuccgaauggaauggaaaacagggucacauuucucccgcgcugcucagcgaguuucugaagagaaaccuugauaaaucaaagguccuggugugcauauguggcccaguccccuucaccgagcagggggugagguugcuccacgaccugaacuuuaguaagaaugaaauccauuccuucacugcauga

SEQ ID NO: 55014 - RNA, 588 nt, Artificial Sequence
  derived and/or modified sequence opt3 from CYBA__Homo_sapiens__NP_000092
augggccagaucgagugggcgaugugggcuaacgaacaagcacuggccagcgggcucauucuuauaaccggagguaucguggcgacagcuggcagauucacucagugguacuuuggggccuauuccauugucgcaggaguuuucgugugccuguuggaguaccccaggggcaagcggaaaaaggguucuacgauggaacgcugggggcagaaauauaugaccgccguagugaaguuauuuggaccuuucacacgaaauuacuauguccgugcugugcugcaccuacuccugucaguuccagcaggcuuucuucuggccacuaucuugggcaccgcuugucucgccauugcgagugggaucuaccugcuggcagccgugagaggagagcaguggacaccgauagaacccaaaccuagggagcggccacaaaucgguggcaccauuaagcagcccccuagcaacccacccccucgcccaccggcugaggccagaaagaaacccuccgaagaggaagcagcugucgccgccgggggaccuccaggcgguccccaggugaauccuaucccaguaacugacgagguuguguga

SEQ ID NO: 55015 - RNA, 1713 nt, Artificial Sequence
  derived and/or modified sequence opt3 from CYBB__Homo_sapiens__NP_000388
augggcaacugggccgugaaugaggggcugagcaucuucgucauucucguuuggcuuggacugaacguguuuuuguucguaugguacuauagaguguacgacauacccccuaaguuuuucuauaccaggaaauuacuggguuccgcucuagcacucgcccgggcgccagcugccugccugaauuuuaacuguaugcuuauccuguugccggucugccgcaaucuccugucuuuccugcgaggcucaagugcauguugcagcacacgugugagaaggcagcucgaucggaacuuaacuuuucacaagaugguugccuggaugauugcucugcauuccgcaauccacacgauugcccaucuuuucaauguggaauggugugucaacgcucgcgugaauaacucugaccccuacucgguagccuugucagagcugggggauagacaaaaugaaagcuaucuaaacuuugcgaggaaacggaucaagaauccugagggaggccucuaccuggcaguuacccuucuggccgguauaacagggguggucaucacuuugugccucauucugaucauuaccaguuccacaaaaaccauccgccgaucuuauuucgaaguguuuugguacacucaccauuuauucgugauauuuuucauuggacuggcuauccacggcgccgagagaauugucaggggccagacagcagagagccucgcuguucacaacaucaccgugugugaacagaagaucuccgagugggggaagauuaaagaaugcccaauaccccaguucgccggaaauccuccaaugacguggaaguggaucguaggucccauguuucuuuaccugugugagcgguuggugcguuucuggcgcucacaacagaaagucgugauuacuaagguugugacccauccuuuuaaaacaaucgagcuacagaugaagaagaaaggcuucaagauggaagucgggcaguauauauuugugaaaugcccaaagguaaguaaacuggaguggcacccguucacucucaccagcgcgcccgaagaggacuuuuucucuauucauaucagaaucguuggagauuggacagaaggccuguuuaacgccugugguugcgacaagcaagaguuccaggaugcauggaaacuuccuaagauugcuguggacgggccauuuggaaccgccuccgaggaugucuucucauacgaaguggucaugcuggugggcgcuggcaucgggguuacgcccuuugccagcauuuugaagagugugugguauaaauacugcaacaaugcaacuaaccucaagcugaaaaagauauauuucuacugguuauguagggacacacacgccuucgagugguuugcugaucugcuacagcuccuggaaucucagaugcaagagcggaauaacgcgggauuccuuuccuauaauaucuacuugaccgguugggacgaaagccaggcaaaccacuuugccguacaucacgaugaggagaaagacgucauuacuggccugaagcagaagacacucuacgggcgaccuaauugggacaacgaguucaaaaccaucgcuucgcaacauccaaauacgcgcaucggaguguuucugugcggccccgaagcccuugcagaaacccugucuaagcaguccauuucaaacagugagagcgguccgagagggguucacuucauauuuaauaaagaaaacuucuga

SEQ ID NO: 55016 - RNA, 474 nt, Artificial Sequence
  derived and/or modified sequence opt3 from CYBRD1__Homo_sapiens__NP_001120855
auggccauggagggcuacuggagauuccuggcucuccuugggagcgcacuguuggugggauuuuuauccgucaucuucgcccugguuugggugcuacacuauagggaaggucucggcugggacgggucugcgcuggaguuuaacuggcaucccguacuuauggugaccggauucgucuuuauucagggcauagcuucauuccgguuuuucagucugagcgccuccauggguucugcauuuucgccuucaaucagccacgcccauacaugcuuguucuggaauugucaccucuggaacagugauugcaauuccacuuacgggauugaccgcgaaacggacuuuuucccagagcgaucuuguauccaauauauuccggcucguagaugcuuuaggaaguacgcauggcccagcgauccuggagugcggggcccacauuuccuggauucccaccagaccgccauggaaacaucauga

SEQ ID NO: 55017 - RNA, 978 nt, Artificial Sequence
  derived and/or modified sequence opt3 from CYC1__Homo_sapiens__NP_001907
auggccgcugcagccgcgagccugagaggcgugguccucgggcccaggggagcuggucuuccuggcgcccgggcacgcgggcuguugugcuccgcccgaccaggacaguuaccgcugcguacaccccaagcuguugcacuaucuucaaagaguggccucagcagagguaggaaagugaugcuguccgcccuugggaugcuggcugccggaggcgcgggcuuggcaguagcccuccacucugcugugucggccucagaccuggagcugcauccuccaagcuaccccuggagucaccgggggcucuuauccucucuggaucauaccagcauccgcagaggauuccaggucuauaaacaggugugugcauccugccacucaauggacuuuguugcuuacaggcaucuugugggugucuguuauacugaagaugaggccaaggaauuggcggccgagguggaaguacaggacggcccuaacgaggauggggagauguucaugcggccaggaaagcuguuugacuacuuccccaaaccuuauccaaauagugaagcagcucgcgccgcuaacaauggcgcccuaccgcccgaucucagcuacauuguucgagcaagacacgguggggaggacuauguguuuucucugcuuacgggauacugcgaaccuccaaccggcgucucccugagggagggcuuguacuucaaccccuauuuuccugggcaagccauagcuauggcgccacccaucuacacagaugugcucgaguucgacgauggaacuccggcaaccaugucacagauugccaaggacguguguacauuucugcggugggcuagcgaaccugagcacgaucaucguaagcgcauggguuuaaaaaugcugaugaugauggcccuccuugucccccugguuuauaccaucaagagacacaaauggaguguguugaagucuaggaaacuagcauaccggccaccuaaguga

SEQ ID NO: 55018 - RNA, 318 nt, Artificial Sequence
  derived and/or modified sequence opt3 from CYCS__Homo_sapiens__NP_061820
augggcgacguggagaaggggaaaaagaucuucauuaugaaaugcagccagugucacaccgucgaaaagggagguaaacauaagacaggccccaaccugcacgggcucuuuggaagaaagacuggccaagccccugguuacuccuauacggcugcaaauaaaaacaaggggauaaucuggggagaggauacccuuauggaauaccuggagaauccgaaaaaguauauuccaggcacaaaaaugaucuucguuggcauuaagaagaaagaagagagggccgacuugaucgcguacuuaaagaaagcuacuaacgaguga

SEQ ID NO: 55019 - RNA, 3762 nt, Artificial Sequence
  derived and/or modified sequence opt3 from CYFIP1__Homo_sapiens__NP_001274739
auggccgcucaggugacccuggaggacgcacucagcaacgucgaucuucuggaagaguugcccuuaccugaccaacagccaugcaucgaaccgcccccuuccucucugcuauaccagccaaauuucaacacaaauuuugaggauagaaacgccuucguuacuggcauugcgagguauauagaacaggcuacggugcacucaaguaugaaugagaugcucgaggaagggcaagaguacgccguaaugcuguauaccuggcggagcuguucccgcgcaaucccccaggugaagugcaacgaacagccuaaucgagucgagauuuacgagaaaacaguggaaguucuugagccagaagugacuaagcugaugaacuuuauguauuuccagcguaaugccaucgagagauuuuguggagaagucaggcgguugugccaugcugagcgcagaaaagacuucgugucugaggcauaccucauuacccuggguaaguuuaucaacauguucgccguacuggaugaacucaaaaauaugaaguguucgguuaagaacgaccacucagcuuauaaaagggccgcgcaauuuuuacggaagauggcagauccccagagcauacaggagagucagaaucuguccauguuccuugccaaccauaauaaaaucacacaaucuuugcagcagcaacuggaagugauuagcggcuacgaggaacuacucgcugacaucgucaaccugugcguggauuacuaugagaaccgcauguaccuuaccccuuccgagaagcacaugcuguugaaagugaugggguuuggacucuaucugauggacggcucagucaguaauauuuacaaguuagaugccaagaaacgaaucaaccugagcaagauagacaaauauuucaagcagcuccagguugugccacuuuuuggugauaugcagauugaacuggcaagauacaucaaaacuucugcucauuaugaggaaaauaaguccagguggacauguaccucaagcgggaguucuccgcaauacaacauuugcgagcagaugauccagauccgggaagaccacaugcguuucauuuccgaguuggcccgcuacagcaauucggagguagugacgggaucuggcagacaggaagcgcagaaaacugacgccgaguauaggaagcuauucgaucuggcacuccaaggccugcagcuucugucccaguggucagcucacgucauggaaguguacaguuggaaguugguucaucccaccgacaaauauagcaacaaggauuguccugacuccgccgaggaguacgaacgggcuacacgauauaauuacacuucugaggaaaaauuugcccucguggaggucauagcaaugaucaaggggcugcaaguguuaaugggacgcauggaaagcguauucaaccacgccauuagacauaccguuuaugcugcgcugcaggauuuuucacaggugacacuaagggagccacuccggcaggcaaucaaaaagaagaaaaaugucauacaaagugugcugcaggccauucgcaagaccgucugcgacugggagacgggucacgaacccuucaacgauccugcucuuagaggcgagaaagacccaaaguccggguuugauaucaaagugcccaggcgugccguuggaccgagcucuacucaguuguacauggugcggacaaugcuggaaucacucaucgcagacaagaguggcagcaagaaaacccugcgauccucucuugaggguccuacuauucuggauaucgaaaaguuccacagagagucguuuuucuacacacauuugauuaauuuuagcgagacccuccaacaguguugcgaccugucccaguuaugguucagggaauuuuuccuggagcuaacgauggggcgccggauacaguuucccaucgaaaugucaaugccauggauucucaccgaccacauccuggagacaaaagaagccaguaugauggaguauguacuuuacucuuuggaucuguauaacgacagcgcucauuacgcccucacuagauucaauaagcaauuccuguaugaugagaucgaagcagaggucaacuuaugcuuugaccaguucguguacaaacuggcggaucagauuuuugcuuauuacaagguuauggccggaucccuuuugcucgacaagaggcugcgcucagaauguaaaaaucagggcgcaaccauacaccuaccucccagcaaccgauacgagacacugcucaagcaacggcaugugcagcugcuuggccguucuaucgauuugaacagacugauuacucagagggucuccgccgcuauguauaaaaguuuagagcucgccaucgggcgcuucgaaagcgaggaccugaccucuauuguggaacuugauggacuguuggagaucaaucggaugacacacaagcuccuguccagauaccuaacccuggacgguuuugaugcaauguucagggaagcuaaccacaauguaucagccccauauggccgaauaacucuccauguguuuugggagcugaacuacgacuuccuucccaauuauugcuacaacgggaguacgaaucgcuuuguucggacagucuugccuuucagccaggaguuucaaagagauaaacagccaaacgcgcagccgcaauaucugcacggaucgaaggccuuaaaucucgcuuacuccucuaucuacggcagcuauaggaacuucgugggucccccucauuuucaggugauuugucgucugcuuggguaccagggcaucgcagucguuauggaagaacugcuaaaaguggugaagucacuccugcagggaaccauuuugcaauauguaaagacucugauggaagucaugccaaaaaucugccgcuuaccccggcacgaguacggcaguccugggauacucgaauuuuuccaccaucagcugaaggacauuguggaguaugccgagcuuaaaaccguuuguuuccagaaucugagagaagugggaaacgcuaucuuguucugccuccugauugagcagucccuaucucuggaagaggucugugaccuucuccacgccgcaccauuucaaaauauccugcccagggugcauguuaaggaaggugagcgauuggaugcgaaaaugaagcggcuggagagcaaguacgccccguuacaccucgugccucugauagaacgccuuggcacaccacagcagaucgcuauugccagagagggggaccuguugaccaaagaaaggcucugcuguggacuguccauguucgagguaauccuaacucggauucgaucauuucuggaugaccccaucuggagaggcccucuucccagcaacggugucaugcauguggaugagugcguggaguuccaccgccucuggagugcaaugcaguuugucuauuguauaccaguugggacacacgaguucacgguggaacaaugcuuuggcgacggacugcauugggcuggcugcaugauuaucguauuguuagggcagcagaggcguuucgccgugcuggauuuuuguuaccaccuccugaagguccagaaacaugacggaaaggaugagaucauuaaaaaugugccucuuaagaagaugguugaacggaucagaaaauuccaaauucugaacgacgagauaaucaccauuuuggauaaguaccuaaaaucuggugacggcgaggggacucccguggaacacgucaggugcuuccagccaccgauccaucagucccuggcaagcucguga

SEQ ID NO: 55020 - RNA, 3684 nt, Artificial Sequence
  derived and/or modified sequence opt3 from CYFIP2__Homo_sapiens__NP_001278650
augaccacacacgugacucuggaggacgcccucagcaacgucgaucuucuggaagaguugcccuuaccugaccagcaaccaugcaucgaaccgcccccuuccucuauuauguaccaggcuaauuucgauacgaacuuugaggacagaaaugcauucguuaccggcauagccagguauaucgaacaggcgacagugcauucaaguaugguaaaguguaacgagcagccaaaucggguggagauuuacgaaaagacugucgaggugcuggaacccgagguuaccaagcuaaugaaauuuauguauuuccaacgcaaggcuaucgagcgauuuugcagcgaagugaaacgucucugucacgccgagagaaggaaggauuucgucuccgaagcauaccugcuuacacuggggaaguuuauuaacauguucgccguguuggacgagcucaaaaauaugaagugcucuguuaaaaacgaucauucggcuuauaagcgggcagcccaguuucugcgcaaaauggcugacccucagucaauccaggaaagccaaaaucugaguauguuccucgccaaccacaauagaauaacccaguguuuacaucagcagcuggagguaaucccaggauacgaggaacuuuuggcggauauugugaacaucugcgucgacuauuacgagaauaagauguaccugacucccuccgaaaagcacaugcuacucaaagugauggguuuuggccuguaucuuauggaugggaacgugucuaauauuuacaagcuggacgccaaaaagaggaucaacuugagcaaaauagauaaguucuuuaaacaacuccaggucguuccucuguucggagacaugcagauugaguuagcacgguauaucaagacauccgcucacuacgaagagaacaagucaaaauggaccuguacgcaaaguagcauuucuccacaguauaauaucugcgagcagauggugcagauccgcgacgaucauauucgauucauauccgaacuggccagauacucaaacagcgagguagugacuggcaguggucucgacucucaaaaguccgaugaagaguauagggaacuuuuugaccuggcauugcgggggcuacagcugcucagcaaauggucggcucacgucauggagguguacucuuggaagcugguucauccgaccgauaaauucuguaauaaggacugccccggaacagccgaggaauacgagcgugcgacucgcuauaacuacaccuccgaagagaaguuugccuucguggaggucaucgcaaugauuaaaggccuucaggugcugaugggcagaauggaaucaguauuuaaucaggcuaucaggaacacaauauaugccgcuuugcaagauuucgcccagguuacccuccgggagccucugcgacaggcagugcgcaagaaaaagaaugucuuaauuagugugcugcaggccaucagaaaaacgaucugugacugggaagggggaagggagccacccaacgauccuugccuacggggugaaaaggacccaaagggcggguuugauauuaaagucccccgcagagcugugggaccgagcuccacucaacucuacaugguuaggacaaugcuggagucucuuaucgcggacaagagcggcaguaaaaagaccuugcguucaucccuggacgguccuauugugcucgcaauagaggauuuccacaaacagagcuuuuucuuuacucaucugcuuaauaucucugaagcccugcagcagugcugugacuugucacaacucugguuccgggaguuuuuccuggaauuaacaauggggcgaaggauucaguuccccaucgagaugaguaugccauggauccugaccgaucacauucuagaaacgaaggagccuagcaugauggaguauguacucuacccccuggaccuuuauaacgauuccgcuuacuacgccuugaccaaguuuaaaaagcaguuccuguaugacgaaauagaggcagaagucaaucucugcuuugaucaauucguguacaaacuggccgaccagaucuuugcuuauuacaaggccauggcaggaucuguuuuacuggauaaaagauuccgcgcggaguguaagaacuauggcgugauuaucccauaucccccuucgaaucgguacgaaacacuuuugaaacagagacacguccagcuccugggcaggagcauugaccuaaaccgccugaucacucaacgaauauccgcugccauguacaagucacucgaucaggcaaucagucgguuugagucugaggaccugaccagcauuguggaacuugagugguugcuggaaaucaaucguuuaacacauagacuccugugcaagcacaugacucuugauuccuucgacgccauguuuagggaggcuaaccauaacguaucagccccauacgggcgcauuacccugcacguguucugggaguugaauuuugacuuccucccgaacuauuguuacaauggaagcacaaaccgguuuguuagaaccgcaauccccuucacucaggaaccucagagggauaaaccagcuaauguccaacccuauuaccuguaugguucuaagccucuaaacauagccuacucccacauuuauaguagcuaccgaaauuucgugggcccaccccauuuuaaaacgaucugccgccugcucggguaccagggaauugcgguggucauggaggaacugcuuaagaucguuaaaucuuugcugcagggcacaauauuacaguaugugaagacccucaucgaggugaugccgaagauuugucggcugccuagacacgaauacgguuccccagggauccuugaguucuuucaucaccaacugaaagacauuaucgaguaugccgaacuaaagacugauguauuccagucacucagggaggucggcaacgcuauacuguuuugcuugcugauugaacaggcauuaagucaagaggaagugugugaccuccugcacgccgcucccuuccagaauauccuuccucguguuuacaucaaagagggagagcgccuggaagugcggaugaagagauuggaggccaaauaugcaccccuccaucuggucccacuaauugaaaggcugggcaccccucagcagaucgcgauugcccgagagggggaucuucucacaaaggaacggcugugcuguggauugagcauguuugaggugauacugacccgcaucagaucguacuuacaagaccccauuuggagggguccaccgccuacuaacggcguuaugcacguggaugagugcguagaauuucaucggcucugguccgcuaugcaguucgucuauugcauccccguggggacaaaugaguucacggccgaacaguguuuuggagacggccugaacugggcagguugcucuauuaucgugcuucuggggcagcaacgaagauucgauuuguucgacuuuuguuaccaccuccugaagguccagcgccaggauggcaaagacgagauaaucaagaauguuccacugaaaaagauggcugauaggauucguaaauaccagauccuaaacaaugagguguucgccauucuuaacaaguauaugaaaagcguagaaaccgacucaaguacuguggagcauguccggugcuuucaacccccuauccaccagucccucgcaacaaccuguuga

SEQ ID NO: 55021 - RNA, 573 nt, Artificial Sequence
  derived and/or modified sequence opt3 from CYGB__Homo_sapiens__NP_599030
auggagaaggugcccggcgaaauggagaucgaaagaagggagcggagcgaagaacuguccgaggccgaacgcaaagcuguccaggcaaugugggcccgacucuacgcgaacugcgaggacguugggguggcuauucuuguacguuucuuugugaauuucccuucugccaagcaauauuuuucacaguucaaacacauggaagauccacuggagauggagagaaguccgcaguugaggaagcaugcaugucgggucaugggagccuuaaacaccgugguugaaaaucugcacgaccccgauaaagugagcuccguccuagcucucguggguaaggcacaugcccugaagcacaaaguagagccuguuuacuuuaagauacuuucuggcgugauccuggaagucguggcugaggaguucgccucggacuuuccacccgagacacagcgcgcgugggcaaaauugagagggcucauuuauucacaugugacugccgcuuacaaggaggucggauggguucaacaggugccuaacgccacgaccccacccgcaacacugccuagcaguggcccauga

SEQ ID NO: 55022 - RNA, 1956 nt, Artificial Sequence
  derived and/or modified sequence opt3 from CYLC1__Homo_sapiens__NP_066941
augagccugcccagacuccuuaaggugaacaucaggaccuacgacaauuccauuccuauaucugagucaagucggaaaagcuggaaccagaagcacuucgcccugacauuuccaaaaccguugcaacgcggcacuaaugauaagucccgacccuuaaaaucucagaucacggucacccgucaugacaagagaaagcuggaagaggggcagaaaccugcucacaaguggauuaggcauucguuccggaaaauccuacaguggccacccauuuauacagcagcccgcgaacaaacuccuuuuagacaccucuacaccucaaagacacaucugaaaaaggcggaguauaagaaaagcaaggaugaaaaaggagguaccccacuuaagaaagacaguaagaaaaagggcggguccuacgcuacuaaccccgagucuaagcagaucguugaggagaaaacaaagaggcagaaugaagccgauaaaaccccucuuaagagcucccacgaaaacgagcagagcaaaaagaguaagucaucuuccgagacgaauccagaaucacaaaacagcaaaacugugaguaagaauugcucucagaaagacaagaaagauuccaagaacagcaagaaaaccaauacagaguucuugcacacuaagaacaauccgaaaaaggaccucaaacggucgaagaccucuaacgaucccauauccgaaaucuguucagagaauagucugaacguagacuuucugaugcucgugggacagagcgaugacgaauccauuaacuucgaugcaugguuacgcaauuauucucagaacaauagcaagaacuacucacugaaauauacaaaguacaccaaaaaggacacgaaaaagaaugccaaaaagaguuccgacgcugagagcgaggauucuaaggacgccaaaaaggauaguaaaaaggucaaaaagaacgugaagaaagacgauaagaaaaaggacguuaaaaaggauacugaaucaacagacgcagagagcggcgauuccaaggacgaacgaaaagauaccaagaaagacaagaaaaagcugaagaaagacgauaagaaaaaggacacuaaaaaguacccugagucuacagauaccgaaucgggugacgcuaaagaugccagaaaugacagcaggaacuugaagaaggcguccaaaaaugaugacaagaaaaaggaugccaaaaagaucacguuuucaaccgacagugagucugagcuggaaagcaaggagucccaaaaagaugaaaagaaagacaagaaagauucaaagacagacaacaagaaaagcgugaagaaugacgaggaaucuacugaugcagacuccgagccaaaaggggauaguaagaaaggaaagaaggacgagaaaaagggcaaaaaggauagcaaaaaggacgauaagaaaaaggacgcuaaaaagaacgccgaaucuaccgagauggaauccgaucuagagcucaaaaaggacaaaaagcauucaaaggagaaaaagggcaguaaaaaggauauuaaaaaggacgcacggaaggauacagaaagcacugacgcugaguucgacgaaucguccaaaaccggguuuaagacaucuaccaaaaucaagggaagcgauacugagucagaagagagucuguauaaacccggugccaagaagaaaauagacgaguccgauggcacgucugcgaauagcaagauggaagggcuugaguccaaacguggauuccgcaugucaagcaagaaaacaaccuuuaacgaaaagggcgagaaggccaguacugguagagucccuccaucuagggaaaaacccccgcugccugcaugcgagcccuccuugccaagcccuaaggugcggcgacucuguuggugcaaaaugcccccacccccuccaaagccgcgcuacgcuccccugccugaggccccauggauucacaaauuacuguga

SEQ ID NO: 55023 - RNA, 1047 nt, Artificial Sequence
  derived and/or modified sequence opt3 from CYLC2__Homo_sapiens__NP_001331
augagccugcccagauuccagagggugaacuuuggcccuuacgacaauuauauaccagucuccgagcucucuaagaaaucauggaaccaacagcacuucgcccuucuguuuccgaagccccagcggccugggaccaaacgccgaaguaagccaagccagauucgugauaauacaguuuccauaaucgacgaggaacaauugagaggagauaggcggcagcccuuauggauguaccgcucucugaugagaauuucggaaaggccuucaguguaucuagcugcacggcgccagccacucaaacccacucgaacgguagagguggacagcaaggccgcggaaaucgguaagaaaggcgaggauaagaccacacagaaagacacuaccgauagugaguccgaacugaagcaagggaaaaaggacucuaagaaaggaaaggauauugagaaaggcaaggaagagaaacuugacgcuaagaaagauagcaagaaggguaaaaaggacgccgagaaagggaaggauuccgcaacagaaucagaggacgaaaaaggaggcgccaagaaggacaacaaaaaggauaaaaaggacaguaauaaaggcaaggauagcgcuaccgagucugaaggggagaagggagguacugagaaagacuccaagaaaggcaagaaagauucaaagaaggggaaagacagcgcaaucgaacugcaggccgucaaggcugaugagaaaaaggacgaagauggcaaaaaggacgccaacaaaggagaugagaguaaggacgcgaagaaagacgcaaaggaaaucaaaaaggguaaaaaggauaagaaaaagccuucuuccacagacagcgauucgaaagacgaugugaagaaagagucuaagaaggacgccaccaaagaugcuaagaaaguugccaagaaagacacggagaaggaauccgcagauucaaagaaagacgcuaagaaaaaugccaagaaagaugcgaagaaagacgccaagaagaacgcaaagaaagaugagaaaaaggacgcuaaaaagaaggggaaauga

SEQ ID NO: 55024 - RNA, 2862 nt, Artificial Sequence
  derived and/or modified sequence opt3 from CYLD__Homo_sapiens__NP_001035877
augagcuccggccuguggucucaggagaaggugaccucacccuacugggaagagagaaucuucuaucuccuucugcaagaaugcagugucacagacaaacagacucagaaguuguuaaaaguuccuaaggggagcauuggacaguacauacaagauagguccgugggucacucucggaucccaucggccaaaggcaagaagaaccagauugggcugaaaauccuagagcagccgcaugcuguacucuuuguggacgaaaaggaugucguggagauuaaugagaaauucacggaacugcuucuggcaaucaccaacugugaggaacgcuuuucauuguucaagaaucgaaaccgucucagcaaaggacugcagauagacguuggcugccccgugaagguccaacugagaaguggugaggagaaguuuccuggggugguaagguuccggggaccacucuuagccgaacgcacaguuuccggcaucuuuuucggcguggagcugcuugaagaggggagaggacaggguuuuacugauggcgucuaucaggggaaacaguuguuccaaugugacgaagauugcggaguguuuguggcgcuggacaagcuagagcucauugaggaugacgauaccgcucuggaaucugacuacgccggccccggugauacaaugcaggucgagcuuccuccacuggaaaucaauagcaggguuuccuugaaagugggggagaccauugaaucaggaacuguaaucuucugugacgugcuccccggcaaggagagucugggcuauuuugucgggguggacauggauaacccuauaggaaauugggacggucgguucgauggcguucaguuaugcagcuucgcauguguggagucuacaauucugcuccacaucaacgacauuaucccagaauccgucacccaagagcgccgaccgcccaaacuugccuuuaugucaagaggggugggagauaagggcagcaguucucauaauaaaccuaaggcuacggguuccacuagcgacccagggaacaggaaucggucggaacuguucuacaccuugaacggaucuuccguagauucacagccccagaguaagagcaaaaauacaugguauaucgacgagguugcagaagauccugccaagucccuaacugagauuucuaccgacuuugaucguagcucaccaccccugcagccgccucccgugaacagucucacaaccgagaaucgcuuccacucccugccauuuagccuuacgaaaaugccuaacacuaacggcucuauaggccauucaccccugaguuugagcgcucaauccgucauggaggaacucaauacagccccagugcaggaaucucccccucuggcgaugccaccggggaacucgcacggauuagaggucgguagccuggcagaggugaaggaaaaucccccuuucuacggcguuaucagauggauugggcagccacccggacuaaacgaggugcucgccggccuggaacuugaggacgaaugcgcugguuguaccgacgggacuuuuaggggcacacgguacuuuaccugcgccuugaaaaaggcacuguucguaaagcucaaauccugucgaccugauucacgcuucgcuagucugcagccagucucuaaucaaaucgagagaugcaacagccuugccuuuggaggcuaucuguccgaggugguugaagagaauacgcccccgaagauggaaaaagagggguuggaaauaaugauuggaaagaaaaaggguauccagggccacuacaacucaugcuaucucgacagcacccuguucuguuuauuugcguucucuuccgugcuggauacaguccuacucaggccuaaggagaaaaaugacguggaguacuauagugaaacucaggagcugcuucggaccgaaaucguaaacccauugcgcauuuacggguaugugugcgccacaaagaucaugaaacugagaaagauucucgagaaaguugaagcagcuagcggauucacuucugaggagaaggaucccgaagaguuucugaauauauuauuccaucacauccugagggucgaaccucuuuugaagauucguuccgccggccagaaagugcaagacuguuacuuuuaccagaucuucauggagaagaacgagaaaguggguguccccaccauccagcagcuccuggaauggucauuuauuaauaguaaccuaaaguucgcugaggccccaagcugccugauaauccaaaugccucgguuugggaaagauuucaagcucuuuaaaaagauuuuccccucgcuggaacuuaauaucacagacuugcuggaggauaccccacgacaguguagaauuugcggcggauuagcaauguaugaauguagggagugcuacgacgauccggacaucuccgccggcaagauaaaacaguuuuguaagacuugcaacacgcaaguucaucuccacccuaaacgccugaaccacaaguauaaucccgugucucuuccaaaagaucugcccgacugggacuggcggcauggguguaucccuugccagaacauggaguuguucgcugugcucugcauugaaacaagccacuacguagcguuugucaaguauggaaaggaugacucagcauggcuguucuucgauaguauggccgacagagauggcggucagaauggguuuaacaucccacaggugacccccuguccugagguuggagaauaccuaaaaaugucccuggaggaccuccauucucuggauagcaggcgcauucaaggcugcgcucgacggcuuuugugugacgccuauaugugcauguaccaguccccgacuaugucacuguacaaguga

SEQ ID NO: 55025 - RNA, 1566 nt, Artificial Sequence
  derived and/or modified sequence opt3 from CYP11A1__Homo_sapiens__NP_000772
augcuggccaagggccuucccccuagaagcgugcucgucaaagggugccagaccuuccuguccgcuccaagggagggauugggucgguuacgcguuccgacaggcgaaggggcaggaaucucuacucgaucaccccguccuuuuaacgagauuccaagucccggcgacaaugguuggcugaaccuauaccacuucuggagagaaacggggacccauaaggugcaccuccaucacguacaaaauuuucagaaauauggaccuauauacagggagaagcugggcaacguggaaagcgucuaugugaucgauccagaggacguugcccuucuguucaaauccgagggccccaauccugaacgguuuuugauuccaccguggguggcguaccaucaguauuaccagcgccccaucgggguccuccugaagaagucugcugccuggaaaaaggauagaguggcacugaaccaagagguaauggccccugaagcuacuaaaaauuuccucccauuacuggacgcaguuucgagggauuuugugucaguccuucaccggcgcauuaagaaagccggaagcgguaacuauaguggcgacaucuccgaugacuuguuccgauuugcuuucgagucuauaacaaaugugaucuuuggggagagacagggaaugcuggaagagguggucaaccccgaagcccagagguucauugaugcgaucuaccagauguuucacaccagcguuccuaugcuaaaucucccacccgaccuguuccggcuuuuccguacaaagaccuggaaggaucauguggcagccugggacguaaucuuuuccaaagcugauauuuacacucaaaacuucuauugggagcugcgccagaagggcucagugcaccaugacuacagagguauauuguauaggcuccugggggacaguaaaaugagcuuugaagauauuaaggccaaugucacagagauguuagcaggaggcguggacaccacgucuaugacucugcaguggcaccucuacgagauggcucggaaccuuaaaguucaggauaugcugcgagccgaaguguuggcggcccgccaccaagcacagggcgacauggcuaccaugcuacagcuggucccgcuccugaaggccuccaucaaagagacacuuagacugcauccuauuucagugacuuugcaaagguaucucguaaaugaucugguuuuacgggacuacaugauccccgcuaagacccuggugcaggucgccaucuaugcacuagggcgcgaaccaacauucuuuuucgauccugagaacuuugaccccaccagauggcucagcaaggauaaaaacauuacguacuucaggaaucugggauuugguuggggcgugcgucagugucuugggcggcgaauagccgaauuggagaugacuaucuuccugauuaacaugcucgagaauuuuagagucgaaauccagcaccugagugacgugggaacaaccuucaaccuuauacugaugccagagaagcccauuucuuuuacuuucuggccuuucaaucaagaagcuacacagcaguga

SEQ ID NO: 55026 - RNA, 1512 nt, Artificial Sequence
  derived and/or modified sequence opt3 from CYP11B1__Homo_sapiens__NP_000488
auggcccugagagcuaaggcagaggugugcauggccguccccuggcucagccuucagagggcgcaagcucugggcacccgggccgcacgcguuccucgaacaguguugccauucgaagccaugccgcguagacccgggaacaggugguuacggcugcuacagaucuggcgcgagcagggauacgaagaccuccaccuggagguacaucagacuuuucaagaacuugguccuauuuucagauaugaucugggcggggcuggaauggugugugucauguugccagaggacguggagaaacuccagcagguugauucccugcacccccauaggaugucucuggaaccuuggguggcauaccggcagcaccgcggccauaagugcggugucuuucucuuaaaugggccagaguggcgauucaacagacugaggcuuaaucccgaaguguugucaccuaacgccguacaacgguuucugccaaugguugacgcuguggcccgugauuucagucaggcgcucaaaaagaaaguccuacagaaugcacgcggaagccugacgcuugacgugcagccguccauauuucacuauaccaucgaggccucuaaccuggcuuuguucggcgagagacucggccugguggggcacucgcccucaagcgccaguuuaaauuuucugcaugcacucgaagucauguucaaguccacaguucaacuuauguuuaugccuaggucucugagccgguggacuuccccaaagguguggaaagagcacuucgaggcuugggauuguauuuuucaguacggagacaacugcauccagaagauuuaucaagaauuggccuucucacgaccccagcaguacaccaguaucguagcggaacuacugcucaaugccgagcugagcccugaugcaauaaaagcuaacucuauggagcuuacagccgguuccguggacaccacugucuucccacuguugaugacacucuuugaacuggcucgcaaucccaacgugcagcaagccuuaagacaggagucacuggcagccgcugcgagcaucagugaacauccgcagaaggcaaccacggagcuaccucuccugagggccgcucuuaaagaaacuuugcggcuguaucccguuggccucuuccuggagcgcguggccucuuccgaucuuguccugcagaauuaccacauuccagcagggaccuuggugagaguauuucucuacagccugggaaggaacccugccuuauucccccguccagagcgguauaauccccaacgauggcuggacaucagaggcucggguaggaacuuuuaccacguuccuuucggguuuggaaugcgccagugucuaggccggagacucgcugaagccgagaugcugcuuuugcugcaucacgugcucaagcaucugcaggucgaaacauuaacucaggaggauauuaagaugguguauucuuucauccugaggccauccauguuuccgcuuuugaccuuccgcgcaauaaacuga

SEQ ID NO: 55027 - RNA, 1512 nt, Artificial Sequence
  derived and/or modified sequence opt3 from CYP11B2__Homo_sapiens__NP_000489
auggcccugagagcuaaggcagaggugugcgucgccgcgcccuggcucagccuucagagggcucgggcccugggcacccgcgcagcccgagcuccucguacaguuuugccauucgaagcaaugccgcaacaccccgggaacagaugguuaaggcugcuacagaucuggcgggagcagggauacgaacaucuccaccuggagaugcaucagacuuuucaagaacuugguccuauuuuccgcuauaaucugggcgggccaagaaugguguguguaauguugcccgaggacguggagaaacuccagcaggucgauucccugcacccuugcaggaugauacuggaaccauggguggccuaccggcagcaucgcggacacaaguguggcguuuuucucuuaaacggucccgaguggcgauucaauagacugaggcuuaacccugacguguugucuccaaaagcuguccaacgguuucugccgaugguggaugccguagcgcgugacuucucacaggcacuaaagaaaaagguucuccagaaugcccgcgggagucugacgcuugaugugcagcccagcaucuuucacuauaccauugaagcauccaaccuggccuuguucggagagagacucggccuggucggccauucuccuucgucagcuagcuuaaauuuucugcacgcucucgaggugauguucaagaguacagugcaacuuauguuuaugccaaggucccugucucgguggaucagccccaaagucuggaaggaacauuucgaggccugggacugcauuuuucaguacggggauaacuguauccagaaaauauaucaagaauuggcguucaaucgaccucagcacuacacuggaaucguugccgagcuacugcucaaggcagaacugucccuugaggcuauuaaagccaacucaauggagcugaccgcugguaguguggacacaaccgccuucccauugcucaugacucuguuugaauuagcacgcaaucccgauguacagcagauccugagacaagagagccuagccgcugcggcaucuauuuccgaacacccgcagaaggccacaaccgagcucccucugcuuagggcugccuugaaggaaacgcugcggcucuaucccgugggccuguuccuugagcgcgucgugucaagcgaccugguuuugcagaacuaccauaucccagcagggacucucgugcaggucuuucuguacaguuuaggaagaaaugccgcucuguucccuaggcccgagcguuauaacccacaacgguggcuagauauacgaggcucugguagaaauuuucaccaugugcccuucggguuuggaaugaggcagugccucggccgccggcuggccgaagcagagaugcuuuugcugcuccaccauguacugaaacacuucuuaguugaaacccugacacaggaggacauuaagaugguguacuccuuuauccuuagaccuggcacuagcccauugcucaccuucagggcgauuaacuga

SEQ ID NO: 55028 - RNA, 1527 nt, Artificial Sequence
  derived and/or modified sequence opt3 from CYP17A1__Homo_sapiens__NP_000093
augugggagcugguggcccuccuucuguugaccuuagcuuaccuguucuggcccaagagaaggugcccuggcgcaaaauauccaaagagccuacucucccugccgcuugucgggucucugcccuuuuugccucggcacggacauaugcacaacaauuucuuuaaacuccagaagaaauacgguccaaucuauucaguucgcaugggcacaaagacuacggugauuguagggcaucaccaacuggccaaggaagugcugaucaaaaagggaaaagacuucaguggccgaccccagauggcgacccucgauauagcuagcaacaaucguaaggguauugccuuugcagacuccggggcccauuggcaguuacacagaaggcuggcuauggcaacauucgcccuuuuuaaagauggagaccagaaguuggagaagaucauuugucaagaaaucucuacucugugcgauaugcuagcuacccacaacggccagucgauagacaucucauucccugucuuuguggccguuacaaaugugauuagccucaucuguuucaacaccaguuacaaaaauggcgauccagagcugaacgucauucagaauuauaacgaagggaucauagacaaucuuuccaaggauucucugguggacuugguacccuggcucaaaauuuuuccuaacaagacucuggagaaauuaaagagccauguuaaaauccggaaugaucugcucaacaagauucuugagaauuacaaggaaaaauuccgcuccgacucaaucacaaacaugcuggauaccuugaugcaggcgaagaugaacagugacaauggaaacgcagguccagaccaagauagcgagcuacugucugacaaucacauccucacgacuauuggcgauauauuuggggccggaguggaaaccacaacuuccgucgugaaauggacccuggcuuuccuucugcauaacccccaggugaagaaaaaguuguaugaggagaucgaccagaaugucggcuucucaagaacaccgaccauuagcgauaggaaccggcuccuguuacuggaagccacgauccgcgagguucuacgacucagaccuguggcaccaaugcugauaccccacaaggcuaauguagacaguucuauuggugaauuugccguggauaaagggacugaggucaucaucaaccuuugggcguugcaccauaaugaaaaggaguggcaccagccugaccaauucaugccagagagguuucugaaccccgccggaacacagcucauuuccccgagcgugucguaccugccuuucggcgcaggcccccggucuugcaucggggaaauucuugcucgucaggagcuguuuuugauaauggccuggcuccugcaacgcuucgauuuagaaguuccagacgauggacagcugccuucccuagaggguauccccaaaguggucuuucucauugacucauucaaggugaaaaucaagguaagacaggcuuggagggaagcccaggcagagggcaguaccuga

SEQ ID NO: 55029 - RNA, 1512 nt, Artificial Sequence
  derived and/or modified sequence opt3 from CYP19A1__Homo_sapiens__NP_112503
auggugcuggagaugcucaaccccauccacuacaauauuaccagcauagucccugaagccaugccagcugcaacaaugccgguucuucuguugacuggcuuauuccugcuaguguggaacuaugaggggacguccucuauccccggaccugguuacugcaugggcauugggccacucaucucacauggaagauuucuguggaugggcauugguagugccuguaauuauuacaacaggguauauggggaguucaugcggguguggaucagcggagaagaaacccuuauaaucuccaagucuucgucaauguuucacauuaugaaacauaaucacuacagcagucgcuucggcuccaagcugggcuugcagugcaucgggaugcaugagaaaggaauuaucuuuaacaauaaccccgagcucuggaagacaacucgaccuuucuuuaugaaagcgcugucugguccaggccugguccguauggugaccguuugugcugaaagccucaagacacacuuagacagacuggaggaagugaccaaugaguccggguaugucgaugugcuuacuuugcugaggcggguaaugcuagacacaucaaacacccucuuccugcgcauaccccuugaugagagugccauuguugugaagauccaaggauacuuugacgcauggcaggcccuguugauuaaaccugauaucuucuuuaagaucagcuggcucuacaaaaaguaugaaaaaucugucaaggaccugaaggaugcuauugagguguuaauagcagagaaaagaaggcggaucuccacggaagaaaagcuggaggagugcauggacuucgccacugaacucauucuugcugagaaacgcggcgaucugacccgagaaaaugugaaccaguguaucuuggagaugcuaauagccgcgccagacacaaugucagucagccuguuuuucaugcuguuccucauugcaaagcacccgaauguugaagaggccaucaucaaagagauucagacugugaucggugaaagagauauuaagauagacgauauccaaaaacuuaagguaauggagaacuuuauuuacgaaaguaugagguaucagcccguggucgaccuggugaugcggaaggcuuuggaggacgauguuaucgacggguacccugugaaaaagggaaccaauaucauucucaacauaggccguaugcaucgccuggaauuuuucccaaaacccaacgaguucacauuagagaauuuugccaagaacgucccuuauagauacuuccagccauuuggcuucgggcccaggggaugcgcagguaaauauaucgcuauggugaugaugaaggccauucugguaacccuacuccggcgauuucacguuaagacgcugcagggccaauguguggaaucuauccagaaaauucaugaucuuuccuugcacccggacgagacuaagaauaugcuggaaaugaucuucacaccucgcaacagcgauagaugccucgagcacuga

SEQ ID NO: 55030 - RNA, 1539 nt, Artificial Sequence
  derived and/or modified sequence opt3 from CYP1A1__Homo_sapiens__NP_000490
augcuguuccccaucagcauguccgccaccgaguuucuccuugcuucugugauuuucugccuggucuuuuggguuauaagagcaucaaggccucaggugccaaagggcuugaaaaacccgcccgggccuuggggauggccauuaaucggucacaugcugacacuaggcaagaauccccaucucgcccugagucggaugagccaacaguacggggacguacuucagauucgcaucggauccacuccuguggucgugcugucuggcuuggauacgauucgacaggcgcucguucgucaaggugacgauuucaaagggagaccagaccuguauaccuuuacacugaucucgaacggacagucaaugagcuucagucccgauuccggcccugugugggcugccaggcggcgccucgcacagaauggcuuaaagucuuuuagcauagccuccgacccagcuucaaguacuagcuguuaccuggaagaacacgucucuaaagaagcagaggugcuuaucuccaccuugcaggaacugauggccgggccgggacauuucaaccccuauagauacguaguugugucagucacaaaugugauuugcgcuaucuguuuugguaggcgguaugaucacaaccaucaagagcuacucagccuggugaaucuuaacaauaacuucggcgaggucguugggaguggaaauccugccgacuuuauuccaauccugcgcuacuugcccaacccuucucucaaugcguucaaggaucugaacgaaaaguuuuauuccuucaugcagaaaauggugaaggagcacuacaaaaccuucgaaaagggccacauacgagacauuacugauagcuuaaucgagcauugccaggagaaacagcuggacgaaaaugcaaacguacaacucucggaugagaagauuaucaacaucgugcuugaccuguuuggugccggguucgacacagucaccacggcuauuucuugguccuugauguaccuagugaugaauccaagaguucagaggaagauacaggaggagcuggauacugugaucggacggucacgucgccccagacucagugacaggagccaucugccguauauggaagccuuuauucuugagaccuuccggcacuccucuuuugucccuuucacaaucccccacagcacuacccgagauacaucacugaaaggcuuuuacauaccaaagggccgcuguguguucguaaaccaauggcagauuaaucacgaccagaaauuguggguuaacccuagugaguuucuccccgaaagauuccugaccccagauggggcaaucgacaagguguuauccgagaaagucaucauuuuuggaauggguaagaggaaaugcaucggcgaaacgauugcucggugggagguguuccuguuucuagccauacuccugcagcgcgucgaguucagcgugccccuugggguuaagguggauaugacuccuaucuauggauugacaaugaagcaugcguguugcgaacacuuccaaaugcagcugagaucuuga

SEQ ID NO: 55031 - RNA, 1551 nt, Artificial Sequence
  derived and/or modified sequence opt3 from CYP1A2__Homo_sapiens__NP_000752
auggcccugagccaguccgugcccuucucugcuaccgagcuccuucuggcaucagccaucuuuugcuuggucuucuggguuuuaaagggccugagaccuagggugccaaaagggcuaaagaguccgcccgaaccuuggggauggccacuccugggucacguacuuacacugggcaaaaacccccauuuggcgcucagccggaugucccaacgcuacggggacgugcugcagauucgaauaggaucuacuccuguccuggugcucucgcguuuagauacgaucagacaggcucugguuaggcagggcgacgauuuuaagggucggccagaccuuuauaccucaacauugauuacugaugggcaaagccugaccuucaguacagacuccggacccgugugggccgcacgcagaaggcuagcccagaaugcucucaacaccuuuucuaucgcaagcgauccugccuccucaaguagcuguuaccuggaggaacacgucucuaaagaggcuaaggcccuuauuucccggcugcaggaauugauggcgggcccaggccauuucgacccguauaaucaggugguaguuucaguggcaaacgucaucggggccaugugcuuuggacaacacuuccccgagagcagugaugagaugcucucucuggugaagaauacucaugaauuuguggagacagcuuccagcgguaacccuuuagacuucuuuccaauacugcgcuaccuccccaauccugcccuucagcgauucaaagcauuuaaccagagauuccugugguucuugcagaagaccguccaagaacacuaucaggauuuugacaaaaauucgguuagggauaucacgggcgcucuauucaagcacucuaaaaaggggccacgggccuccggaaaccugauuccccaggagaagaucgugaaucucguaaacgacauuuuuggcgcggguuucgacacugugaccacagccaucucauggagucugauguaccuugucacuaaaccggagauacaacguaagauucagaaagaacuggauaccgugaucgggcgcgagagaaggccucgguugagcgaccgaccccagcucccauaucuggaagcauuuauuuuagagacauuccgccauuccucuuuucugccuuucaccaucccccacagcacgacuagagauacaacccuaaauggauuuuacaucccaaagaaauguugcguuuucgugaaccaguggcaagucaaucaugaccccgaacucugggaggauccuucagaguuuaggccagaacgguuccugacugcugacggcacagccauuaacaagccgcuuagugagaaaaugauguuguuuggcauggggaagcgcagauguauaggagaagugcuggcuaagugggagaucuuccucuuccuggccauucuucugcagcaguuggaauuuuccguacccccugguguuaaaguggaucucaccccaaucuacggccugacgaugaagcacgcaaggugcgagcacguccaggcccguuuacgguucagcauaaacuga

SEQ ID NO: 55032 - RNA, 1632 nt, Artificial Sequence
  derived and/or modified sequence opt3 from CYP1B1__Homo_sapiens__NP_000095
augggcaccagccugucccccaacgacccuuggccacucaauccgcuuucuauccagcaaacaacucuguuguuacugcuaucagugcucgccacgguccacguugggcagagacugcuuaggcagcggcgccgacagcugcguagugcucccccuggaccauucgcauggcccuugauugguaacgccgcggcugugggccaagccgcacaucucagcuuugccagacuggcuaggcgguacggggauguauuccagauacgccugggauccugcccuaucgugguccucaauggcgagagagcaauucaccaggccuuagugcagcaagguucugcuuuugccgacaggccagcguucgcaucguuucggguugugucagggggacgcagcauggccuucggccauuauagugaacacuggaagguccagagacgagcugcccauuccaugaugaggaacuuuuucacccggcagccccguucucgccaggugcuggagggccacguacuuagcgaagcaagagaguugguugcucugcuagugaggggguccgccgauggagcguuucucgacccucggccacugacagucguggccguggcaaaugucaugucagcuguuuguuucgguugccgauacagucacgaugacccggaauuucgcgagcuucugagccauaacgaggaguucggcagaacugugggggccggaucuuugguagaugugaugcccuggcuccaauauuuuccuaauccagucaggaccguguuccgggaguucgaacagcugaaccgcaauuuuuccaacuucaucuuagacaaauuucugagacacugugagucacucaggcccggcgcugccccucgugauaugauggacgcauucauucuuagcgccgagaagaaagcugcgggugauagucaugggggaggcgcacggcuggacuuggaaaauguuccagccacaaucaccgauauauuuggcgcuucucaggacacucuauccacagcccugcaauggcuccugcuucuguucacccgauaccccgacgugcagacgagaguccaggcagaguuggaucaggugguagggagggaccgccucccgugcaugggagaucaaccuaaccugcccuauguuuuagccuuucuguacgaagcuaugcgguucagcucguuugugccagucacuaucccucacgccaccacagcaaauacuucugugcuagguuaucacauucccaaggacaccgucguguucguuaaccagugguccgugaaucaugauccacucaaauggcccaacccugagaacuuugacccagcgagauuccuggauaaggacggccuuaucaauaaggauuugacaucaaggguaaugauuuuuagugucgggaaacgccgauguaucggagaagaacugagcaagaugcaacucuuccuguucauauccauucuugcucaccagugcgacuuucgggccaacccgaaugagcccgcaaaaaugaacuucucuuacggccugaccaucaagccuaagagcuuuaaagugaauguuacguugcgugaaucaauggagcuccuggauagugccgugcagaacuuacaggcuaaggaaacuugucaguga

SEQ ID NO: 55033 - RNA, 1488 nt, Artificial Sequence
  derived and/or modified sequence opt3 from CYP21A2__Homo_sapiens__NP_000491
augcugcuccuuggccuguuguuacugcuaccccuccuggccggggcuagacuucuguggaacugguggaaguugaggagccuccaucugccuccacuggcaccgggauuccuccacuuacugcagcccgaccuuccuaucuacuugcugggucuaacccaaaaauuuggcccaauuuaucggcuccaccuggggcuucaggauguggucguucugaacuccaagcgcacaauagaggaagccauggugaaaaagugggcggacuucgcuggacgacccgagccuuugacuuacaaacucguaucucguaauuauccagaucugucauuaggcgacuacagucugcucuggaaggcccauaagaaacuuacgagaagcgcacuguugcuagguaucagggauuccauggaacccguggucgagcagcugacccaggaauuuugcgagcggaugcgcgcccaaccugggacaccaguggcuauugaggaagaguucucucuccugacuuguucgaucauuugcuaucuuaccuuuggagacaagaucaaagaugacaaucugaugccggcauacuauaaguguauacaggaaguuuugaaaacauggucacacuggagcauccagauuguggaugucauccccuuccucagauuuuucccuaacccaggccugaggcgguuaaagcaggccauugagaagcgcgaccauaucguggagaugcaacugcgacagcacaaagaaagucuaguagcuggccaguggagagauaugauggacuacaugcuccaggggguugcccaacccuccauggaggaaggaucuggucagcugcuugagggccacgugcauauggcggcagucgauuugcugauagggggaaccgaaacuacagccaauacccucagcugggcugugguguuucugcuucaccauccugagauucagcaaaggcugcaggaggaauuggaccacgagcucggcccaggugccuccucaagucggguccccuacaaggaccgugcacgccugccguuacugaacgcuacgaucgccgaaguucuaagacucaggccugugguaccccuggcgcuuccacaccggacuacccgaccuagcucuauuuccggguaugauauccccgagggaacagugaucauuccaaauuugcagggcgcccaucuggacgaaacugucugggagcgcccccacgaguucuggccugauagauuucucgaaccaggcaaaaacucaagggcacuggcuuucgggugcggagcccggguguguuuaggugagccgcuggcucgccuugaauuguuuguugugcucaccagacugcuacaggccuucacacugcuccccagcggcgacgcacugccuagucuucaaccauugccccauugcucugucauacugaagaugcagccuuuccaggugagguuacagccacgugggaugggagcccacucccccggccaaagccaguga

SEQ ID NO: 55034 - RNA, 1545 nt, Artificial Sequence
  derived and/or modified sequence opt3 from CYP24A1__Homo_sapiens__NP_000773
augagcucccccaucucuaagucaagaagucuggccgcuuuccuccagcaacuuaggagcccucggcagccaccgcgccuggugaccuccacagcauacacuucuccccagccucgagaggucccaguuugccccuugacggccggcggggaaacccagaacgcggcugccuuaccuggaccaacaucguggccccugcuagguucacuccugcaaauucuuuggaaaggcgggcugaagaaacagcacgacacuuugguggaguaucauaagaaauacggaaagauauuucguaugaagcucggcagcuucgaaaguguacaccuggguuccccuugucugcucgaggcauuauauagaaccgaaucugccuacccacagaggcuggagaucaaaccguggaaggcuuaucgggauuaccgcaaagagggguauggacuuuugauucuggaaggcgaggacuggcagagagugaggagcgcauuucaaaagaaacuaaugaagcccggcgaagucaugaagcucgauaauaaaaucaacgaggugcuggccgacuucauggggcggauugaugagcuuugcgacgaacgcggacauguugaggaucuguacuccgaauugaauaaguggucauuugagaguaucugucucgugcuguacgaaaaacgauucgguuuacugcagaagaacgcuggcgacgaggccgucaauuuuauaauggcgaucaaaacaaugaugagcaccuucgggagaaugauggugacuccuguagagcuccacaagucucuuaacacaaaaguuuggcaggaucauacccuggcaugggacacgauuuuuaaguccgugaaggccugcaucgauaauagguuggaaaaauauucacagcaaccaagcgcugacuuccuaugugauauuuaccaccagaaccggcugaguaagaaagagcucuaugccgcagucacugaacugcagcuugcugccguggagaccacagccaauucucugauguggaucuuguacaaccucucccguaauccccaagugcagcagaagcuguuaaaagaaauacagagcguccugccugagaaccaaguuccacgcgcggaggaccuaagaaauaugcccuaucucaaggcaugccugaaggaaucgaugaggcuuacuccgucugugccuuuuaccacacggaccuuggacaaagcuacgguacugggagaguacgcccuccccaagggcacugugcugaugcuuaacacacagguccuggguuccucagaagauaauuucgaggacaguagccaguuucgaccagaacgcugguugcaggagaaagagaagauuaacccuuucgcucaccuccccuucggggugggaaaaagaauguguaucggcaggcggcuggccgaauuacaacugcaucuagcacucugcuggauuguucgcaaguaugauauccaggccaccgacaacgagccaguggaaaugcugcacuccggcacucuuguccccucuagagaguugccuaucgcuuuuugucagagguga

SEQ ID NO: 55035 - RNA, 1494 nt, Artificial Sequence
  derived and/or modified sequence opt3 from CYP26A1__Homo_sapiens__NP_000774
augggccugcccgcccuccuugcuagcgcacugugcaccuucguguugccuuuacugcuauuucucgccgcgaucaagcugugggaccuuuacugugucuccgggagagauaggucuugcgcucugccauugccgcccggaacaauggguuucccuuucuucggcgagacucuccagaugguucugcaacggcgcaaauuucugcagaugaagcgacguaaauauggguucauuuacaagacgcaccucuuuggaagaccaaccgugaggguaaugggcgccgacaacgugcggcgcauauuacugggugaacauagacuugucucagugcacuggcccgcaaguguuaggacaaucuuggggagcggaugucuguccaaucuacaugauucuucgcacaaacagcggaagaaggugauuaugcgcgccuucucacgagaggcucucgaaugcuaugucccugugaucacugaggaaguaggcagcagucuggagcaguggcuuuccuguggcgagagagggcuguugguuuacccagaagugaaaaggcucauguuucggauugcaaugcguauccuguuaggaugcgagccccaacuggccggugacggcgauucugaacagcagcucgucgaggcuuucgaggaaaugacccgcaaccuuuuuagccugccuauagacgugccauucuccggguuguauagaggaaugaaggccaggaaucuaauccaugcgcggauugagcagaacauccgagcaaaaauuuguggccugcgcgccucagaagcuggucaagggugcaaggaugcccuccagcugcuuaucgagcacaguugggaaagaggagagaggcuggacaugcaggcauugaaacagagcucuacagagcuccuguuuggcggccacgaaaccacugcuuccgccgcgacaucauuaauaaccuaccuggggcuauauccgcaugugcuccaaaagguccgggaggaacuuaagagcaaaggacuguuguguaagaguaaucaggauaacaaacuggacauggagauucucgaacagcugaaguacaucgguugcguuauuaaagagacgcuucgccugaaucccccugugccaggcggguucagaguagccuugaagacuuucgagcucaacggauaccaaauccccaaaggcuggaaugugaucuauucuauuugugauacccacgacgucgcagaaauauuuacaaacaaggaggaauuuaauccugauagguuuaugcugccacaucccgaggacgcuucccguuucagcuuuaucccguucggugggggcuuacggucgugcgugggaaaggaauuugccaaaauucugcuaaagaucuucacuguugagcucgcucgacacugcgacuggcagcugcuuaacggcccucccaccaugaaaacaucuccaaccguguacccugucgauaauuugcccgccagauuuacgcacuuccauggggagauauga

SEQ ID NO: 55036 - RNA, 1314 nt, Artificial Sequence
  derived and/or modified sequence opt3 from CYP26B1__Homo_sapiens__NP_001264671
augcuguucgagggccucgaccuugugagcgcccuggcuaccuuggcagccugcuuagucuccguuacacugcuacucgcggugucucagcaacuguggcagcuuagaugggcugccacuagggauaagucauguaaacugcccaucccuaaggggaguaugggauuuccauugauuggugaaacgggccacuggcuccugcagguauucagcaaaauauuuucccaugaggcacuggaaucuuaccucccgaagauccaguuagugauucaagacacccugcgggccuggucgucacaccccgaggcuaucaacgucuaucaggaagcacagaaacuuacauuccgcauggccauucgaguguugcugggguuuagcaucccugaggaggaucuaggacaucucuucgaaguuuaccagcaauuuguggacaaugucuucagucugccaguggaucuucccuuuuccggcuaucguagagguauacaggcuaggcagauccugcagaagggguuggagaaggccauucgggaaaaacuccaaugcacucagggaaaggacuaccuggaugcguuagaccugcucaucgagucuagcaaagagcacggcaaggaaaugaccaugcaggagcuuaaagauggcacacuggaauugauuuucgcagccuaugcuaccacugccuccgcaucaacaagucuaaucaugcaacugcucaagcauccuaccguacuggagaaacuucgcgacgaacugagagcucacgggauauugcacagcggagguuguccaugcgagggcacgcucaggcuggauacuuuaucugggcugcgguaccuagacuguguuauuaaggaggugaugcgccucuuuacccccaucuccggaggcuaucgaacaguccugcagacuuucgaacuugaugguuuucagauuccuaagggguggucagugauguacagcaucagagacacccaugacacagccccaguguucaaagaugucaacguuuucgacccggauagguuuagucaggcgcggucugaggacaaggauggacguuuccacuacuugcccuuuggcggcggggugagaaccugccugggaaaacaucucgccaagcuguuccuuaaaguacuggcaguggaauuggcuuccacgagccgcuuugagcucgccacuaggacauucccucggaucacccuggucccaguguuacaccccguugacggucugucggugaaguuuuucggccuagauucuaaucaaaacgaaauucucccugagacugaggcuaugcuguccgccacagucuga

SEQ ID NO: 55037 - RNA, 1569 nt, Artificial Sequence
  derived and/or modified sequence opt3 from CYP26C1__Homo_sapiens__NP_899230
auguuccccuggggccugagcugccucuccgugcuuggggccgcuggaaccgcacuguugugugccgguuuacugcuaucucucgcgcagcaccuguggacacuuagauggaugcugucaagggaccgggcuaguacuuugccucucccaaagggcagcaugggguggccguuuuucggagagacgcugcauuggcugguccaaggcucccgcuuucacucuucgcgacgugaaagauacgguaccguuuucaaaacacaucucuuagggaggcccgugauccggguaucaggagccgagaacgugcgcacuauucugcuuggcgaacacagauuggucaggagccaguggccucagagugcacauauacugcuaggcucccacacccuccugggggccgugggagagccacaccggcgccgaagaaagguucuugcuaggguguuuucucgggcagcccuggaacguuaugucccccgcuugcagggugcucucagacaugaggugaggagcuggugcgccgcgggcgggccuguauccguuuacgaugcaucaaaagcccugacauuccggauggcugcccgaaucuuacugggacuccgccuugacgaggcacaaugugcuacccuggccagaacuuuugaacaguugguggagaaucuauucagucugccacucgauguccccuuuagcggccugaggaaggguauucgggcgcgcgaccagcuucacagacaucuggaaggggccaucucugagaaauugcacgaggauaaggcagcugaaccuggagacgcccucgaucugauuauccacuccgcuagggaguuaggccaugaaccaucaaugcaggagcugaaggaaagcgccguggagcuacucuucgcagccuuuuucacaaccgcuagugcgucuacgucccuggugcuuuugcugcuccaacacccggcagccauagcuaaaauccgugaggaacuggucgcccagggccuugggcgggcaugcggaugugcccccggugcugccggcgggagcgagggaccuccacccgacugcggcugugaaccugaucugucguuggcagcgcucggucgacugagauauguugacugcgugguaaaggagguguuaaggcugcuaccacccgucucugggggcuaccgcacugcucuccggaccuuugaacuggauggauaucagauuccgaaaggcugguccgugauguacucaaucagagacacacaugagacugccgcaguuuauaggaguccucccgagggguucgauccagaacgcuucggagccgcucgagaggacagccggggugccuccucucguuuucacuacauuccuuucggcgggggagcaagaagcugucuuggccaggaauuggcucaagccgugcugcagcuccuggcggucgaguuagugaggaccgcccgcugggaacuggcuacacccgcauuuccagccaugcagaccguacccaucguucauccuguggacggucuucgguuguucuuucacccacucacgccgucagucgcugggaacggccugugccuauga

SEQ ID NO: 55038 - RNA, 1596 nt, Artificial Sequence
  derived and/or modified sequence opt3 from CYP27A1__Homo_sapiens__NP_000775
auggccgcucugggcugcgcaagacucaggugggcccuuagaggggcgggacgcggucuguguccccacggcgcucgagccaaggcagccaucccugcugcauugccaagcgacaaagccaccggggcuccgggagccggccccggugugcguagaaggcagcgguccuuagaggaaauuccucgccuggggcaacuaagauucuuuuuccagcucuuuguccagggauacgcgcugcagcuucaucaacugcagguuuuguauaaggcaaaauacggcccaauguggaugucuuaucucggcccccagaugcacgugaaccuggccucagcuccucugcucgagcagguaaugaggcaagaagggaaguacccagugcggaaugauauggaguuauggaaagaacaucgcgaccagcacgaucugacauauggacccuucacuacggagggucaucacugguaccagcuucgacaggccuugaaccaaagacugcuaaagccugcagaggcugcccucuauaccgacgcguuuaaugaagucauagaugacuucaugacaaggcuggaucagcuucgggccgagagugcaagcggcaaccagguguccgacauggcucaacuguuuuacuacuucgccuuggaagcuaucugcuauauucucuuugagaagcguaucgggugucugcagcgcucuauuccagaggauacuguuaccuucgugagaucgaucggauuaauguuucaaaauucacuguacgccacauuccucccgaaauggaccaggcccguccuuccuuuuuggaagcgguaucuggacggcuggaacgcaauauucagcuucgguaaaaaguugaucgaugaaaaacuagaggacauggaagcccagcugcaggcugcggggccagauggcauucaggugaguggauaccuccacuuucugcuugcauccggccagcugucuccccgagaggccauggggagcuugccugaacuccugauggcuggaguagacacuacauccaauaccuuaacgugggcccuguaucaucuaucaaaggacccagagauccaggaggcacuccacgaagagguugugggugucgugcccgccggccaagugccgcagcauaaggauuucgcucacaugccucugcuuaaagccgucuugaaggaaacucugcgccucuaccccguugugccaaccaacaguagaauuaucgagaaagaaauagagguagacggguuucuguucccuaagaauacacaguuuguguucugccacuaugucgugagcagggaucccacugcauuuucugagccagaauccuuccagccccaucgguggcuucgcaacucacaaccugcgaccccacggauucagcacccguuuggaagcguucccuucggcuacggugugagggcuugucuggggcgucggaucgccgaguuggaaaugcagcuccuguuagcacgacugauucagaaauacaaggucgugcuagccccugagacaggcgaacucaaaaguguagcuagaaucguucuggugccaaauaagaaggucggacuucaauuuuugcagaggcagugcuga

SEQ ID NO: 55039 - RNA, 1527 nt, Artificial Sequence
  derived and/or modified sequence opt3 from CYP27B1__Homo_sapiens__NP_000776
augacccagacacugaaguacgccagcagaguguuccacaggguccggugggcucccgagcucggcgcaucccuuggguaucgcgaauaccauucugcccgacguucacuggcggacaucccuggaccaaguacuccgagcuuuuuggcugaguuauucugcaaagguggccuguccagacuacacgaacuccaaguucagggggccgcacauuuuggacccguguggcuggccucuuucggcacgguaaggaccguguaugucgcugccccugcacuuguggaggaacuguugcggcaggaggguccacgccccgagagauguucguuuucaccuuggacagaacacaggcggugccgccagcgagcuugugggcuccugacugccgagggagaagaguggcaaagacugaggagccucuuagcgccacugcuuuugcggccccaggcagccgcucguuacgccggcacccugaacaauguugugugcgaucuaguccgcagacucaggcggcagcgaggccgcgggacaggaccuccagcacuggugagagacguagcuggugaguucuauaaguuuggccuugaagggauugccgcgguucuguugggaaguaggcucggcugucuggaggcccaggugccgcccgauaccgaaacuuucauacgggcagucgguuccguguuugugucuacauuacugaccauggcuaugccucauuggcuccgccaccuugucccagggcccuggggaagacugugcagggacugggaucaaauguucgccuuugcucagcgucacguugagcggcgagaagccgaggcagccaugagaaacggcggccagccugagaaagacuuggaaagcggggcucaucuaacgcacuuccuguuuagggaggaacucccagcgcaguccauccugggaaaugugacugagcuucuguuggcagggguagauaccgugucaaacacacucaguugggcccuguacgaauuaagccgccaucccgagguccaaacugcucugcacucugagauuaccgccgcacuauccccgggcucaagcgccuauccuagugcuacagugcucucucagcugccccuuuugaaggccguugugaaagaaguccugcggcucuacccagugguaccugguaauuccagaguucccgacaaggauauccacgugggagacuacauuaucccaaagaacacccuggucacgcuuugucauuaugcaacuagcagggaucccgcgcaguucccugagccaaauucguuccgcccggcucgauggcugggcgaaggucccacaccucacccauuugccucuuugcccuucggguuuggcaaacgguccugcaugggacguagacucgcagagcuggaauuacaaauggcccuggcucagauacuaacccauuucgaggugcagccugagccaggcgccgcacccgucaggccgaagacucgcacagugcucguuccugaacggucaaucaaccugcaguuucuugacagauga

SEQ ID NO: 55040 - RNA, 1119 nt, Artificial Sequence
  derived and/or modified sequence opt3 from CYP27C1__Homo_sapiens__NP_001001665
augagaagcgugcugaggcagcggauccucaagcccaaagacgucgccauuuacuccggcgagguuaaccaagugauagcugaucuuaucaagcgcauuuaucuguugcgaucucaggcagaagacggggagaccguaacaaaugugaacgauuuauucuuuaaauacucaauggaaggagucgccacuauccuguaugagagucgucuagguugccucgaaaauagcauuccucagcugacgguggaguacaucgaggcgcuugaacugauguucuccauguuuaagaccucuauguaugcuggcgccauaccaagaugguugaggccguucauccccaaaccuuggcgggaguuuugucgcucgugggacggacucuucaaguuuucacagauucacguugauaacaagcugagagacauccaauaccagauggauagggggcggcgcgugagcggcggucugcucacauauuuauuccugagucaggcacuuacuuugcaggaaauuuacgccaaugucaccgagaugcugcuagcugggguggacacaaccuccuuuacucucucuuggacaguauaccugcuugcacgacauccagagguucaacagaccguguauagagaaaucgucaaaaaccugggagagaggcacgugcccacggccgcugaugugccuaaggucccauugguucgggcccuccugaaagaaacuuuacgucuguuccccgugcucccuggcaauggccgcguaacccaggaggaccuugugauagggggauaccugauuccaaaggguacacaguuggcgcuaugccauuaugcaacuagcuaccaagaugaaaacuuuccgagagccaaagaguucaggcccgagcgguggcugcgaaagggcgaccucgaucgcgucgacaauuuuggguccaucccuuucggacacggcgugagaucauguauugguaggcggaucgcugaacuggagauccaucuuguugugauucagcuguugcagcacuucgaaauaaagaccaguagccaaacaaacgccguccacgcaaaaacccaugggcuccugacgccaggaggccccauccacgugcgcuuuguaaauagaaaguga

SEQ ID NO: 55041 - RNA, 1485 nt, Artificial Sequence
  derived and/or modified sequence opt3 from CYP2A13__Homo_sapiens__NP_000757
augcuggccagcggccuccuucuggugaccuuguuagcuugccugacagucaugguucuaauguccguguggagacagaggaagucucgggggaaacugcccccuggaccaacuccgcuccccuucaucgguaacuaccuucaacugaauacggagcagauguauaacucauugaugaagauuagugaacgcuacggcccuguauuuaccauacaccucgggccacgacguguggucgugcuguguggacaugacgcaguuaaagaggcccugguggaucaggcggaagaguucagcggcagaggugaacaggcuacauuugacugguuauucaagggguauggagucgccuuuuccaauggcgagagggcaaaacaacuccggcgcuucucuaucgccacucugagaggcuuuggggugggaaagagggguauugaggaacggauccaggaggaagcuggcuuccuuauugaugcauugcgcgggacccacggagccaacaucgaccccacauuuuuccugucgcgaaccguaucaaauguuauaagcaguaucguguuuggcgauagauucgacuacgaggauaaggaguuucuaucccuccugaggaugaugcuugguucuuuccaguucacugcuacaagcaccgggcagcuguaugaaauguuuuccucagucaugaaacauuugccuggaccacaacagcaggccuucaaggagcuccagggccuggaagacuuuauugcgaaaaagguggagcacaaccaacggacguuagaucccaauaguccucgugacuucaucgauagcuuucugauucgcaugcaggaagaggagaaaaacccaaauacugaauuuuaccucaagaaccuugugaugaccacacugaauuuguuuuucgcaggcacugagaccgucucuacaacccuaagauauggguuucugcuccugaugaagcauccggaaguugaggccaaagugcacgaagagaucgacaggguaauaggaaagaaccggcagcccaaauucgaggaucgagcuaagaugccuuacacggaagccgugauucacgagauccaacgcuuuggugacaugcuuccaaugggccuggcacauagagucaauaaagacacuaaguucagggauuucuucuugcccaaagggacagaaguguucccuaugcucggauccguucugcgggacccacgcuuuuucucaaaccccagagauuuuaauccgcagcacuucuuagacaagaagggccaguuuaaaaagagcgaugcuuucgugccuuuuaguauugguaaaagguacugcuucggggagggccuggcccguauggaacuauuucucuucuuuaccacuaucaugcagaacuuccgguuuaagucuccccaauccccaaaagacaucgaugucagcccuaagcaugugggauucgcgacaauuccccgaaacuauaccaugucguuccugccaagauga

SEQ ID NO: 55042 - RNA, 1485 nt, Artificial Sequence
  derived and/or modified sequence opt3 from CYP2A6__Homo_sapiens__NP_000753
augcuggccagcggcaugcuccuuguggcucuguuggucugcuuaaccguuauggugcugauguccguauggcagcaaagaaagucuaaagggaagcuacccccuggaccaacaccgcuccccuucaucgguaacuaccugcagcuuaauacugagcagauguauaacucacugaugaaaauuagugaaagguacggcccuguguuuacgauacacuuggggccacggcgcgucgugguucucuguggacaugacgcagugcgagaggcccuggucgaucaggcggaagaguucagcggccguggugaacaagcuaccuuugacuggguguucaagggguauggaguaguuuuuagcaauggcgagagagccaaacagcugaggcgguucucuaucgcaacacuccgcgauuuuggcguggggaagagaggaauugaggaaaggauccaggaggaagccgguuucuuaauugacgcucugcggggcacugggggagcaaacaucgaucccaccuuuuuccuuucgcgcacagucucaaaugugauaagcaguaucguguuuggcgaccgauucgauuacaaggacaaagaguuuuugucccugcuaagaaugaugcucgguauuuuccaguucaccucuacuagcacagggcaacuguaugagauguuuuccucagucaugaagcaccuuccuggaccacagcagcaggccuuccaacuguugcagggccucgaagauuuuaucgcuaaaaagguugagcauaaccagaggacccuggaccccaauaguccucgggauuucauugacagcuuuuuaauccguaugcaagaagaggaaaagaacccaaauacggaguucuaccugaaaaaccucgugaugacuacccuuaaucuguuuauaggcgggacagagacuguaucuaccacauugcgcuauggauuccuacugcucaugaagcacccggaaguggaggccaaaguccaugaagagauugauagagugaucgguaagaacaggcagcccaaauuugaagaccgggcgaagaugccuuacauggaggcaguuauucacgagauccagcgauucggcgacgugaucccaaugucccuggcccgcagagucaaaaaggauaccaaauuuagggacuucuuucuucccaaggggacggaaguguacccuaugcugggaucaguauugcgggauccauccuucuucaguaauccccaggacuuuaacccgcaacacuuccucaaugagaagggccaguuuaaaaagucugaugcuuucguuccuuuuuccauugguaaacgcaacugcuucggggaaggccuggccagaauggaguuauuucuguucuuuacuacagugaugcagaacuucaggcuaaagagcucgcagucucccaaagacauagaugucuccccaaagcaugugggauuugcaaccaucccucguaauuauacuaugucauuccucccccgguga

SEQ ID NO: 55043 - RNA, 1485 nt, Artificial Sequence
  derived and/or modified sequence opt3 from CYP2A7__Homo_sapiens__NP_000755
augcuggccagcggccuccuucugguggcuuuguuagcaugccugaccgucaugguucuaauguccguguggcagcaaagaaagucuagggggaaacugcccccuggaccaacaccgcuccccuucaucgguaacuaccuucagcugaauacugagcacauuugugacucaauaaugaaguuuagugaaugcuauggcccuguauucacgauccauuuggggccacggcgcguggucgugcucuguggacacgaugccguucgagaggcgcugguggaccaggcugaagaguuuagcggccguggugaacaggccaccuucgauugggucuuuaaaggguacggaguggcauucuccaacggcgagagagccaagcaacugcucagguuugcuauugcaacauuacgggacuucggcguagggaaacgcggaaucgaggaaaggauucaggaggaaucugguuuucugaucgaggccauaagaucgacucauggcgcuaauaucgaucccaccuucuuucuuucacggacaguuagcaacgugauuaguuccaucgucuucggggaccgcuuugauuaugaggacaaggaguucuugucucugcuaagcaugaugcucggaauuuuccaguuuaccuccacuucaacaggccagcuguacgaaauguucaguagcgugaugaagcaccuuccugguccacaacagcaggccuuuaaacuguugcaggggcucgaagauuucaucgcgaagaaaguggagcauaaucaacgaacccuggaccccaacucuccucaggauuuuauagacuccuucuuaauucacaugcaggaagaggagaagaauccaaacacggaauuuuaucugaaaaaucucaugaugucaacucuuaaccuguucaucgcaggaaccgagacagucagcacuaccuugagauacggcuuucuacugcucaugaagcacccggaaguugaggccaaggugcaugaagagauugauaggguaaucggcaaaaaucggcaacccaaguucgaggaccguacaaaaaugccuuauauggaagcugugauccacgagauucagcgcuuuggggacgucauaccaaugagucuggccagaagggugaagaaagauaccaaguuccgggacuuuuuccuucccaaaggaacggaaguuuucccuaugcuggguucuguguugcgagauccauccuuuuucagcaacccccaggacuuuaauccgcagcauuuccucgaugacaagggccaauuuaagaaaucggaugcauucgucccuuuuucuaucgggaagcgcaacugcuucggagagggccuggcuagaauggaauuauuucuguucuuuacuacagugaugcagaauuucaggcuaaaauccucacagagucccaaggacauugauguaagcccaaaacacguuguguuugccaccaucccucggaacuacacuauguccuuccucccccgcuga

SEQ ID NO: 55044 - RNA, 1476 nt, Artificial Sequence
  derived and/or modified sequence opt3 from CYP2B6__Homo_sapiens__NP_000758
auggagcugagcgugcuccuuuuccuggccuuguuaaccggccugcuacuccugcuuguccagagacaccccaacacacaugacaggcugccuccagggccgcggcccuugccucuccugggaaaucugcuccaaauggaucgccgagguuuacugaaguccuuucuucguuucagagaaaaauacggcgacguuuuuacugugcacuuggggccaaggcccguagugaugcugugcggagucgaggcuauccgggaagcacucguggauaaggccgaggcguucucuggccgcgguaaaauugcuaugguugacccauuuuucagaggguauggagugauauuugccaacggcaauagguggaagguccuccggcgcuucucagugacgaccaugcgagauuuuggcauggggaaaagaaguguagaagagaggauccaggaggaagcacagugucugauugaggaacuucggaaaagcaagggagcccugauggacccuacauucuuguuucaguccaucacugcuaacauuaucugcucuauaguuuucgguaaacguuuucauuaccaagaucaggaguuccucaagaugcugaauuuauucuaucagaccuuuucgcugaucucaagcguguucggccagcucuuugagcuuuucaguggguuucugaaauacuuccccggagcacaccgccaagucuauaagaacuugcaggaaauuaaugccuacaucggccauuccguggagaaacacagagaaacacuagacccuucugcuccaaaggaucugauugacaccuaucuccugcacauggagaaggaaaagagcaacgcccauuccgaguuuucacaccagaaucuuaaccugaauacuuugagucucuucuuugcggguacagagaccacgagcacuacccugagguacggguucuuacugaugcuaaaguacccgcauguggcagaacgggucuaucgagagaucgaacagguuauaggaccccaccgcccuccagagcuccacgauagagccaaaaugcccuacacagaagcugugauuuaugagauccaaagguuuucugaccugcuuccuaugggcguaccacauauugugacucagcacaccuccuuccggggcuacaucauccccaaggauacagaggucuuuuugauucugucaaccgcccuccaugacccgcacuauuucgaaaaaccugacgcauucaaccccgaucauuuucuggacgcuaauggggcccuuaagaaaacggaggcguucauaccauuuagccugggaaagcgcaucuguuugggugaaggcauugccagagcagagcuauuccuguuuuucacuacaaucuuacagaacuuuaguauggcuucuccuguggcccccgaagauauagaccugaccccacaagagugcgggguuggaaagauucccccuacuuaccagaucagguuccuaccacguuga

SEQ ID NO: 55045 - RNA, 1473 nt, Artificial Sequence
  derived and/or modified sequence opt3 from CYP2C18__Homo_sapiens__NP_000763
auggaccccgccguggcucugguccucugccuuagcugucuguucuuguuaucccuguggagacagucuucaggcagggggcggcuaccuaguggaccaaccccgcuccccaucauugguaacauacugcaacuugauguuaaggacaugagcaaaucccugacaaauuuuucuaagguguacggcccuguauucacuguguauuuuggguugaaaccaaucgucgugcuccacggauacgaggcaguuaaggaagcccugauugaucauggcgaggaguucucgggucgcgggucauuucccguggcggaaaaagucaacaagggacugggcauccucuucagcaauggcaagcgauggaaagaaauucguagauuuugcuuaaugacgcugaggaacuucgggaugggaaagcggaguaucgaggaccgcgugcaggaggaagcuagaugucuuguagaggaauugaggaaaaccaaugccuccccuugcgauccaacauuuauacuggguugugcacccugcaacguuaucuguucugugauuuuccacgaccgguuugauuauaaggaccagcgcuuccuaaaucucauggagaaauuuaacgagaaucugcgaauccuuagcuccccuuggauucaggucugcaacaauuucccagcccugaucgauuacuugccgggcucacauaacaagauagcugaaaauuucgcauauauuaagaguuacgugcucgagagaaucaaagaacaccaagagagccuggacaugaacucugccagggauuuuauugacuguuucuuaaucaagauggaacaggagaaacauaaucagcaguccgaguuuacuguggaaucacugaucgcuaccgucacagauauguucggggccggaaccgagacuacaagcaccacgcuccgguauggccuucuguugcuacugaaguaccccgaaguuacugcgaaagugcaagaggaaauugagugcguagugggucguaaccgcaguccuuguaugcaggacagaucucacaugccauacaccgacgcagucgugcacgagauacagagguauaucgaucuccugcccacaaaccuuccucaugccguuacuugcgacgugaaguuuaaaaauuaccugauuccaaaggggaccacaaucauaaccuccuugacgagcguccuccacaacgauaaggaguuccccaauccggaaauguuugacccuggacauuuccuggauaaaucgggcaacuuuaagaaaucugacuauuucaugcccuuuuccgcuggcaagcggaugugcaugggggaaggauuagcccgaauggagcuguuccuauuucucacuacaauucugcagaauuucaaccuuaaaucacaaguggauccaaaggacaucgauaucaccccuauugcaaaugcuuucggucgcguacccccauuguaccagcuguguuuuauccccguuuga

SEQ ID NO: 55046 - RNA, 1473 nt, Artificial Sequence
  derived and/or modified sequence opt3 from CYP2C19__Homo_sapiens__NP_000760
auggaccccuucgugguccugguucucugccuuagcugucuguuguuacuguccaucuggagacagucuucaggcagggggaagcuaccuccaggaccgacaccccucccugugauugguaacauacugcaaaucgauauuaaagacguaaguaagagccuuaccaaucuguccaaaaucuacggcccaguguuuacuuuguauuucgggcucgagcggauggucgugcugcacggauacgaaguugugaaggaggcccugauugaucucggcgaagaguuuucuggucgcgggcauuuccccuuagcugaacgagcaaaccguggauuuggcaucgucuucucgaauggcaaaagauggaaggagauaaggcgguuuucacugaugacgcuucgcaacuucgggaugggaaagagaagcaucgaggacagggugcaggaagaggcccggugcuugguagaggaacugcgcaaaaccaaggcgaguccuugugauccaacauuuauucuagguugcgcucccuguaauguuaucugcuccauuaucuuccagaaacgauuugacuauaaggaucagcaauuccucaaccugauggagaaacuuaaugaaaacauaagaauugugucuacuccuuggauccagauuuguaauaacuuuccaaccaucaucgacuacuucccgggcacacacaauaagcuguugaagaaccucgccuucauggagagcgauauucuggaaaaagucaaggagcaucaggaauccauggacauaaauaaccccagggauuuuaucgacugcuucuuaauuaaaauggagaaggagaaacagaaucaacagucagaauuuaccaucgagaaccuggugauaacugcagccgaucuccuuggggcuggaacagaaaccacgaguacuacccugcgguaugcauugcuacugcuccugaagcacccugaggugacagccaaaguccaggaagagauugagcguguuaucggccgcaacagaagcccauguaugcaggacaggggucauaugcccuacacugacgcugugguacacgaagugcaacgguauaucgaucuuauuccuaccucucugccacacgccgucacaugcgacgugaaguuccgaaauuacuugauccccaaggggaccacgauucucacuucccugacaucaguuuuacaugauaacaaagaguuuccgaauccugaaauguucgacccccgccacuuucuggaugagggaggcaacuucaagaaaagcaauuacuuuaugccauucagugcgggcaagagaauaugugugggggaaggacuagcaaggauggagcucuuucuguuccuuaccuuuaucuugcagaacuucaaucugaaaucucucauugacccuaaggaucuggacacuacacccgucgugaacgguuucgccuccguaccacccuuuuaucagcuuugcuucaucccuguuuga

SEQ ID NO: 55047 - RNA, 1473 nt, Artificial Sequence
  derived and/or modified sequence opt3 from CYP2C8__Homo_sapiens__NP_000761
auggagcccuucgugguccugguucucugccuuagcuuuaugcuguuguucuccuuauggagacagucuuguaggcggcgcaagcugccuccaggcccgacaccccuaccuaucauugggaacaugcuccaaauagacgugaaagauaucugcaagucauuuaccaauuucaguaaaguauacggaccaguguuuacugucuauuucgguaugaaccccauugugguuuuucacggcuacgaagccgugaaggaggcucugaucgacaauggggaagaguucagcggacgaggcaacuccccuauuucucagcguaucacgaaaggucuugggauaaucucgucaaauggaaagagauggaaggaaauuaggcgguuuagccugaccacauugcgcaacuucggcaugggcaaaagaaguaucgaggauaggguccaggaggaagcacauugucucguggaggaacugcggaagacuaaagccuccccaugcgaccccaccuuuauucuggggugugcgccuugcaauguaaucuguucuguuguguuccagaagcgcuuugauuauaaagaccaaaacuuccucacauuaaugaagcgauucaaugagaacuuuagaauacugaauagcccauggauucaggucugcaacaauuucccgcuuuugaucgauuguuuucccggaacccacaacaaggugcugaaaaauguggcucuaacuagguccuacauucgggagaaggucaaagaacaucaggccucacucgacguuaacaacccucgugauuucaucgacugcuuucugaucaagauggagcaggaaaaagauaaucaaaagagugaguucaacauugaaaaucuuguggguacaguagcagaccuguuuguggccggcaccgagacgacuagcaccacauugcgcuaugggcuccuguuacugcucaaacacccagaggucacugcuaaggugcaggaagagauagaucauguuaucggaagacacaggucucccuguaugcaggaccggucccacaugccuuacaccgacgcagugguccaugaaauucagcgauauucagaucuugugccaacaggcguaccccacgccguuaccacggacacuaaguuccgcaacuaccugaucccgaaagguacaaccauaauggcuuugcuaacuagcgugcugcaugaugacaaggaguuuccuaaucccaacauuuucgauccagggcacuuucucgacaaaaauggaaacuucaagaaaagugauuacuuuaugccuuucucugccggcaagagaaucugcgcgggcgaagggcuggcaaggauggagcuuuuccuguuuuugacaaccauccuccaaaauuucaaccugaaguccgucgacgaucugaaaaauuuaaacacgaccgccgugacaaagggaauugucagccuacccccaucguaucagaucugcuuuauucccguguga

SEQ ID NO: 55048 - RNA, 1473 nt, Artificial Sequence
  derived and/or modified sequence opt3 from CYP2C9__Homo_sapiens__NP_000762
auggacagccuggugguccucguucuuugccuguccuguuuguuacugcuaucucucuggagacagucaaguggcagggggaagcugcccccuggaccaaccccgcuucccgugaucgguaacauucugcaaauaggcaucaaagauauuagcaaguccuugacaaaucucucuaaaguauacgggccuguguucacucuguauuuuggacugaagccaaucgucgugcuccacggcuacgaggccguuaaagaggcuuuaauugaccugggugaagaguucucggggcggggaaucuuuccccuugcagaacgcgccaaccgaggcuucggcauaguguuuucaaaugggaagaaguggaaagaaauccguagauucagcuugaugacgcugaggaacuuuggaauggguaagcggaguauugaggaucgcguccaggaggaagcgagaugccuaguggaggaacucaggaaaaccaaggcuuccccuugugacccaacauucauccugggcugcgcccccuguaauguaauuugcucuaucauauuucauaaacgguucgauuauaaggaccagcaguuucuuaaccugauggagaaguugaaugagaacauuaaaauccucagcuccccuuggauucaaaucuguaauaacuucucaccaaucauugauuacuuuccggggacucacaauaagcugcuuaaaaacguugcauucaugaagaguuauauacuggaaaaagugaaggagcaucaggaaagcauggacaugaauaacccccaggauuucaucgacugcuuucucaugaaaauggagaaggaaaagcacaaucagccuucugaguucaccauugagucccuugaaaacacagccgucgaucuguuuggagcuggcaccgagacuacaucaaccacguugcgcuacgcacuacugcuccugcuuaaacauccagaagugacugccaaggugcaagaggaaaucgagcgagucauagguagaaacaggagccccuguaugcaggaccggagucacaugccuuauaccgaugcuguugugcacgagguacagcguuacauugaccuguugccaacaucucucccccaugccgugacuugcgacaucaaauuccgcaauuaccugaucccgaaggggaccacaauuuuaaucucccugaccagcguccuacacgauaacaaagaauuuccuaaucccgagauguucgacccacaucacuuucucgaugaaggaggcaacuucaagaagucgaaauauuuuaugccuuucucugcgggcaagagaauuugugugggggaggcacuggccggaauggaauuauuuuuguuccugacguccauacuccagaauuuuaaccugaaaucacuuguugaccccaagaaucuggauacuacaccaguggucaacgguuucgcuagugugcccccuuucuaccaauugugcuuuaucccaguauga

SEQ ID NO: 55049 - RNA, 1494 nt, Artificial Sequence
  derived and/or modified sequence opt3 from CYP2D6__Homo_sapiens__NP_000097
augggccuggaggcccucgugccccuugcugucaucguugcaauuuuccuguuguuaguggaccugaugcacagaaggcagcggugggccgcgcgcuacccuccagggccgcuaccccucccuggacuggguaaccuucugcauguagauuuucaaaauaccccauauugcuucgaccaguugcgacguagauuuggcgauguguucagccuccagcuggcuuggacacccgucgugguucugaacgggcucgccgcagugagggaagccuuagucacucacggagaggacacggcugaucggccuccagugcccauaacccagauccugggcuuugguccucgcucccaagggguauuccuugcaagauacggaccagccuggagggaacagcggcgcuuuucuguuucaacauugcgaaaucugggccuaggcaagaaaagucucgagcagugggugacugaagaggcugccugucugugcgcggcauucgccaaccauagcgggagaccguuuaggcccaauggacuucuggacaaggcugucuccaacgugauugccucuuugaccuguggucggcguuucgaguaugaugacccucgcuuucucagacuguuagaucuggcacaggaaggccucaaagaggaaucgggguuccuuagggaggugcugaaugcugucccaguuuugcuacacauccccgcccuggcgggaaaggugcuccgguuucaaaaagccuuccugacacagcuugacgagcuguugaccgaacaucgaaugacuugggauccugcacagccaccccgcgaccucacagaggcuuuccuggccgaaauggagaaggcuaagggcaacccggaaagcucauuuaaugaugagaacuuaagaauuguaguggccgaccuguucagugcagguauggucaccacguccacuacccuagccugggggcuccugcuuaugaucuugcacccugacgugcagaggcggguucaacaggagauagaugacgugaucggacagguccgcagacccgaaaugggcgaucaagcucacaugccauacacaacugcggugauucaugagguacagagguuuggcgacaucguuccucugggggugacccacaugacaucucgugauauugaaguccagggauuccggauccccaaagguaccacgcucauaacuaaucugagcuccgugcuuaaggacgaggcagucugggaaaaaccauuucgauuccaucccgagcacuuucuggaugcccagggccacuucgugaagccugaggccuuuuugccauucucagcugggagaagggcaugccucggagaaccgcuggcccgcauggaguuauuucuguucuuuacaagucuacuccaacauuucagcuucucuguucccaccggccagccucggccaucccaccaugguguguuugcuuuccugguaucacccagcccuuaugaacuuugugccgucccaagauga

SEQ ID NO: 55050 - RNA, 1482 nt, Artificial Sequence
  derived and/or modified sequence opt3 from CYP2E1__Homo_sapiens__NP_000764
augagcgcccugggcgugaccgucgcucuccuuguuugggcagccuuccuguuguuaguguccauguggagacagguacacucuucauggaaccugcccccugggccauuuccgcuacccaucauuggaaaucucuuccaacuggagcuuaagaacauaccuaaaaguuuuacaaggcuggcgcagcgguucgguccaguguuuacuuuguacgucggcagccagcgcauggugguuaugcauggguauaaggcugugaaagaagcccuccuggacuacaaggaugaguucuccggacgaggcgaccugcccgcauuucacgcccaucgugauagagguaucauuuucaauaacgggccuacguggaaagacaucaggcgguuuucucucaccacauuacgcaauuauggaaugggcaagcagggcaacgaaucgaggauucaaagagaggcucacuuccugcuugaagcauugcggaagacucaggggcagccauuugaucccaccuuccugaucggaugcgccccuuguaaugucauagcugacauccuauuucgcaaacauuucgauuacaacgacgagaaguuccuccgacugauguaucuuuuuaaugagaacuuccaccuguugucaacaccauggcuccagcuguacaauaacuuuccgagcuucuuacacuaucugcccgguagucauagaaaagugauuaagaauguagccgaaguuaaagaguacguguccgaaagggucaaggagcaccaucaaucucucgauccuaacugcccacgggaccuuaccgauugucuguugguggagauggaaaaggagaaacacagcgcggaacgucuauacacuauggacggcaucacagugaccgucgcagaucuguuuuucgccgggacggagacuaccuccacaacucuccgcuauggacugcuuauucugaugaaguaccccgaaaucgaggagaaauugcacgaagagauagacagaguuauuggcccuucaaggaucccagcuauuaaggaccggcaggaaaugcccuauauggaugccgugguacaugagauccagcgauuuaucacccucgugccgaguaaucugccucacgaagcaacacgcgacaccauuuucagagguuacuuaauacccaaagggacggucgugguuccaacucuggauagcgugcuauaugacaaccaggaguuuccugaucccgagaaguucaaaccagaacauuuucucaacgagaauggaaaguucaaguacucugacuauuuuaaacccuucuccacaggcaagagggucugcgcuggcgaagggcuggcccggauggagcuuuucuugcugcucugugcgauccugcaacacuuuaaccuuaaaccucugguggauccaaaggacauugauuugucaccgauccauauaggauucgguugcauucccccucgcuacaaacucuguguaaucccaagaagcuga

SEQ ID NO: 55051 - RNA, 1476 nt, Artificial Sequence
  derived and/or modified sequence opt3 from CYP2F1__Homo_sapiens__NP_000765
auggacagcaucuccaccgccauucugcuccuucuguuggcuuuagugugccugcuacucacacugucuucaagagauaagggcaaacuucccccugggccaaggccgcugaguauauugggaaaccuccugcugcucuguagccaggacauguuaacuucccugacgaaguugucuaaagaguacgguucgauguauaccguccacuugggcccccggcgcguugugguacugucaggguaccaagcagugaaggaagcccuagucgaucagggagaggaguucagcggccgaggugacuauccugcguuuuucaauuuuacaaaagggaacggaaucgcuuucaguuccggcgaucguuggaaggugcucagacaguuuucuauucagauccugaggaauuucggcauggggaagcggagcauugaagaacgcauccuugaggagggauccuuucuguuggccgaacucagaaaaacugagggugaaccauucgaccccaccuuuguucugucaaggagugugagcaacauaaucugcucugucuuauucggcucccgguuugauuacgacgaugagcgccugcucacaauuauccgacuuauuaaugacaacuuccaaaucaugucaagcccuuggggagagcuguaugauauauuuccaaguuugcuagacugggugcccgggccucaucagagaauuuuccagaauuucaagugucugagggaucucaucgcacacucuguacaugaccaccaggccucccuggacccacggagcccgcgugauuuuauucaaugcuuccuuaccaaaauggcugaagagaaggaagacccccugucgcauuuucacauggauacuuugcucaugacaacccacaaccuguuauucggcgguacgaaaacuguuucuaccacacugcaucacgcauuucuagcccucaugaaguacccuaaggugcaggcucgcguccaggaggaaaucgaccuggugguggggagagccaggcuuccagcguugaaagaucgggcagccaugcccuauacugacgcugucauccaugagguucagcgauucgccgauauuauaccuaugaaucugccacaccgcgugaccagagacacagcauuuaggggauuccucauccccaagggcaccgauguaauuacgcugcuuaacacugugcacuacgacccgucccaauuucugacaccucaggaguucaaucccgaacauuuucuugaugcuaaccagucauucaaaaagaguccagccuuuaugccuuucagcgcgggccggcgccucugucugggggaguccuuagccagaauggaacuguuccuauaccucaccgcaauccugcaaucuuuuagccuucagcccuugggagcuccagaggacauagaccugacuccccucucaaguggucugggcaauuuaccuaggccauuccagcugugccuucguccgcgguga

SEQ ID NO: 55052 - RNA, 1506 nt, Artificial Sequence
  derived and/or modified sequence opt3 from CYP2R1__Homo_sapiens__NP_078790
auguggaagcuguggagagccgaggaaggcgcugcagcccucgggggagcgcuuuuccuguuguuauuugcucugggugugaggcagcuacucaaacaacggcgccccaugggcuucccuccagggccgcccggacugccuuuuaucggcaacauuuacagccuugccgcauccucugagcugccacacgucuauaugcgaaagcagucacagguuuacggugaaauauucaguuuggaccucgggggaaucagcaccgugguacugaauggcuaugauguggucaaagagugccuggugcaucaguccgaaauuuuugccgaccgucccugucucccuuuauucaugaagaugacaaaaaugggcgggcugcuuaacucuagauacggaagggguuggguugaucaccggcgcuuggcugucaauucguuuagauauuucggcuacgggcaaaagucauuugagagcaagauccuggaggaaacuaaauucuuuaacgacgcaauugagacguauaagggaaggccauucgauuuuaaacagcuaaucaccaaugccgugaguaacauaacaaaucucaucauuuucggcgaacgguucacuuacgaggacaccgauuuucagcauaugaucgagcuguucuccgaaaacguggagcuugcugccucugcgagcguauuucuguacaaugcauuccccuggauugguaucuugccuuuugggaagcaccagcaacucuuccgcaacgccgcuguuguguaugacuuucugucccgauuaauagaaaaagccucagucaauagaaagccacagcugccgcagcauuucguggaugcauaccucgacgagauggaucagggaaagaacgaccccaguagcacauuuucuaaagaaaaucuuauuuucuccgugggcgagcugaucauugcuggcaccgagacuacaaccaacgucuugaggugggccauccuauuuauggcgcuguauccuaauauccaagggcagguucagaaggaaauugaucucauaaugggaccaaacgguaaacccucaugggacgacaagugcaaaaugccuuacacggaggccgugcugcacgaaguacuucgguucuguaacaucgugccacugggcauuuuucacgcaacuagcgaggaugcugucgugcguggguauaguauccccaagggaaccacaguuauaacuaauuuguacucugugcauuucgacgaaaaauauuggcgcgauccggaggucuuccacccugagagauuucucgacuccagcggcuacuucgccaagaaggaagcucuggugcccuuuucguuagguaggcggcauugccugggggagcaccuagcccgaauggaaauguuccucuuuuucaccgcacugcuucaacgcuuucacuugcauuucccacacgagcugguaccugaucucaaacccagacugggcaugacacuucagccacagcccuaccugauuugugccgaaaggcgguga

SEQ ID NO: 55053 - RNA, 1515 nt, Artificial Sequence
  derived and/or modified sequence opt3 from CYP2S1__Homo_sapiens__NP_085125
auggaggccaccggcacaugggcucugcuccuugcacuggccuuguuacugcuacucacucuggcgcuuagcgggacgagagcuaggggacaucugcccccugguccaaccccguugccccuccugggcaaccugcuccaguuacggccuggggcccuguacuccggacuuaugcgcuugucuaagaaauauggcccaguguucacaaucuaccugggucccuggcgaccugucguugugcuaguagggcaagaagcagugcgugaggcccucggaggccaggcugaagaguuuucaggcagagggacugucgcaaugcuggaaggaaccuucgacggucacggcguguuuuucaguaauggggagagguggcggcagcuucgcaaguuuacaaugcuggccuugagagaucucggaaugggcaaaagggagggugaggaacugauucaggcugaagcccggugcuuaguugagaccuuccaagggacugagggacgcccauuugaccccagccugcuccuugcgcaggcaacauccaacguggucuguucucuguuguucggccuacgauuuucguaugaagauaaggaguuccaggccgugguaagagcugccggcgggacccugcucggaguuucaagccaggguggccaaacguacgaaauguuuaguugguuccugaggccucuuccagggccgcacaaacagcuguugcaucacguguccacucucgcagcuuuuaccguccgucaggugcagcaacaucagggaaaucuggacgccucuggccccgcgcgggauuuaguggacgccuuccugcuaaagauggcacaggaggaacaaaacccugguacagaguucacuaauaagaacaugcucaugaccgucauauaucugcuuuuugcugggacaaugaccguuagcacgacugugggcuacacauugcugcuccugaugaaauauccacacguacagaagugggugcgcgaggaacuuaauagagagcugggagccggccaggcucccuccuugggggauaggacccggcucccuuacacugacgccguccugcacgaagcacagcgauuacuggcccuagugccaaugggaaucccccgcacacucaugagaaccacgagguuccgggguuacacccugccgcaaggcacagagguuuuuccucuuuuggggucaauucugcaugaucccaacaucuucaaacacccagaagaguuuaauccugaccgcuuccucgaugcugacggaagauuuaggaagcaugaggcguuccugcccuuuaguuuaggcaaacgugugugccugggugaagggcuugcaaaggccgaguuguuccucuuuuucacuaccauucugcaggcuuuuagccuagaaucuccaugucccccugauacacugucccucaagccaacugucucaggccuguucaacaucccgcccgccuuccagcuucaggugcggccuaccgacuugcacagcacaacccaaacucgauga

SEQ ID NO: 55054 - RNA, 1635 nt, Artificial Sequence
  derived and/or modified sequence opt3 from CYP2U1__Homo_sapiens__NP_898898
augagcucccccggcccuucucagccaccggccgaggaucccccuuggccagcuagacugcucagggcaccccuugggcuguugcgguuagacccuucaggaggugcccugcuacucugcggccugguggcgcuucugggguggaguugguugcgccgacguagagcuaggggaaucccacccggcccuaccccauggccgcucgucgguaacuucgggcacguucugcugcccccuuuucuccggcgcagaagcugguuauccucuaggacacgggccgcaggaauugacccaucggugauaggcccccaaguacugcuugcccauuuggcucgcguguacggcucaaucuucagcuuuuucauugggcacuaucuggucgugguucuaagugauuuucauuccgugcgagaagcacucguccagcaggccgagguguucucugacagaccuaggguaccacugaucagcauuguuacuaaggaaaaaggaguggucuuugcucacuacggucccguguggcggcagcaacguaaguucucccauucaacgcuucgccacuuuggccuggggaaauugagucucgagccgaagaucauagaagaguucaaauaugugaaggccgagaugcagaagcacggagaagauccuuuuugucccuucagcaucauuucuaaugcggucuccaacaucauuugcucacuguguuuuggccagagauucgacuacaccaauagcgaguucaaaaagauguuagguuuuaugaguagggggcuggaaaucugccucaacucucagguucuucuggugaauauauguccaugguuguauuaccuaccuuucggacccuuuaaagagcugcggcaaauugagaaggauaucacauccuuccucaaaaagauuaucaaggaccaucaggaaagccuggaucgagagaacccacaggacuuuaucgauauguaucuucugcacauggaagaggaacgcaaaaauaacucuaauucguccuucgacgaggaguacuuguuuuacauuauaggcgaucucuucaucgcaggcacugacaccacaaccaacucacuguuauggugccugcuauauaugagucucaaucccgacguacaggaaaaggugcaugaggaaauugagagagucaucggggccaacagggcuccuagccugacugauaaagcccaaaugccauacacagaagcaaccauaauggaggugcagcggcuuacgguuguggucccguuggcuauuccccacaugacuuccgagaauaccgugcugcagggauauacaaucccuaaggguacucucauccugccaaaccuuuggucuguacaccgcgaccccgccauuugggaaaaaccugaggauuuuuacccaaauagauuccuggacgaucaaggccaguugaucaagaaagaaaccuuuauucccuucgggauaggaaagaggguuuguaugggcgagcagcucgcgaagauggaacuguuuuuaauguucgugagccugaugcagucauucgccuuugcacuaccggaggacaguaaaaagccucuccugacaggucguuucgggcuuaccuuggcuccacaucccuuuaacaucacgauuucccggcgauga

SEQ ID NO: 55055 - RNA, 1473 nt, Artificial Sequence
  derived and/or modified sequence opt3 from CYP2W1__Homo_sapiens__NP_060251
auggcccugcuccuucuguuguucuuaggccugcuagggcucuggggacugcuuugcgcuugugcacaggaccccagcccugccgcgagauggccaccgggucccaggccucugccauuggugggcaaccuccaccuucugcggcucucccaacaggaucgcucuuuaauggagcugucagaacgauacgggcccgucuuuaccguucaucuuggacgucagaagacagugguauugacuggcuucgaggcugugaaagaagcccuggcagguccugggcaggagcuagccgacagaccacccaucgcuauuuuucaacucauacagaggggaggcggcaucuucuuuaguagcggggcacgguggcgcgccgcuagacaguucacggucagggcccugcacucccuuggagugggucgggaaccuguugcggauaagauucugcaggaguugaaaugccucucuggccaacuggacggguaucgcggacgaccauuuccguuagcacugcucggcugggcccccucgaauaucaccuucgcucugcuguuugguagaagguucgauuaccgggacccuguguuugucucauugcuagggcugauugaugaggugaugguacuccugggaagcccaggccuucagcuguucaacguuuaucccugguugggcgcccuccugcaguuacaucguccugugcugcgcaagaucgaagaggucagagcaauacuaaggacacuccuggaagcucggcgaccacacgugugucccggggacccggugugcaguuacgucgaugcccuuauccagcaaggacagggugacgauccugagggcuuguuugcggaggccaaugcaguugcuuguacucuggacauggugauggccgggaccgaaacaaccuccgcuacucuccagugggccgcacugcuuaugggacgccaucccgauguacaaggcagagugcaggaggaacuggacagggucuuggguccagggcggacaccucgccucgaggaccagcaggcccugcccuauaccucugcuguguuacacgaaguucaaagauucauuacgcugcuaccacacgugcccaggugcacugcggcagauacccagcucggcggauuccugcuuccuaaaggcacaccagucaucccguugcugacuagcgugcuccuggacgagacccaguggcagacacccgggcaauuuaacccuggacauuucuuagaugccaauggucacuuuguaaagcgugaggcuuuccugccauuuuccgccggccggcgaguuugugugggggaaagacuugcaaggaccgaguuguuccuccuguuugccggacuacugcagcgcuaccggcuccugcccccuccaggcgucucacccgcuagucuugacacgacuccggccagagcauucacaaugaggccucgcgcgcaggcuuugugcgccgugccacgacccuga

SEQ ID NO: 55056 - RNA, 1410 nt, Artificial Sequence
  derived and/or modified sequence opt3 from CYP39A1__Homo_sapiens__NP_057677
auggagcugaucagccccaccgugauuauaauccucggcugccuugcucuguucuuguuacugcagagaaagaaccuaaggcggccuccauguauuaaaggguggaucccguggauuggagucgguuuugaguucggcaaggcuccccucgaauuuaucgaaaaagcacgcauaaaguacgggccuaucuucacaguuuuugccaugggaaaucgaaugacuuucgugacggaggaagagggcauuaacguauuucugaaauccaagaagguggacuucgagcuugcgguccaaaauaucguguaucguaccgcuucuauucccaaaaacguuuuucuggccuugcacgaaaagcucuacaucaugcugaaagguaagauggggacagugaaucugcaucaguucacuggacagcucaccgaggaauuacacgagcagcuggagaaccuuggcacacauggcaccauggauuugaauaaccuggucagacaccuacucuauccagugacuguaaauaugcuguuuaacaaaucacuuuucaguacaaauaagaagaaaauaaaggaauuucaucaauacuuccagguuuaugacgaggauuucgaauacgggagccagcugccugagugcuugcucaggaacugguccaaaucuaagaaaugguuucuggaauuauucgagaagaauauuccagacaucaaagcauguaagucggccaaggauaacucaaugacccugcuccaggcuacgcuugacauuguggagacugaaaccagcaaagagaauagucccaacuauggacuguugcuacugugggcaucccucucuaacgccgucccuguggcuuuuuggacacuggccuacgugcuuagccacccagauauccacaaggcgaucauggaagguauuuccucagucuucggcaaagcagggaaggacaaaauaaagguuagugaggaugaccuggaaaauuugcuccugaucaaguggugcguguuagagacuauucggcugaaagccccgggaguaaucacccgcaagguggucaaacccguggagauacuaaacuacauuaucccuagcggcgaucuccugaugcuuucuccauuuugguugcauagaaaucccaaguauuucccugaaccagagcuguuuaaacccgaaagguggaagaaggcuaaccucgagaaacacuccuuccuggacuguuuuauggccuucgguucagggaaguuucaaugcccggcacggugguucgcccuucuggaaguucagauguguaucauuuugauccucuacaaauaugauugcagccuguuagacccucugcccaagcagaguuaccuacaucucgugggagucccacagccugagggccaaugucgcauugaguauaaacagcgaauauga

SEQ ID NO: 55057 - RNA, 1182 nt, Artificial Sequence
  derived and/or modified sequence opt3 from CYP3A43__Homo_sapiens__NP_001265850
auggaccugauccccaacuucgccauggagaccugggugcucgucgcuacaagccuuguucuguuguacauuuauggcacucacucccauaaguuauuuaaaaagcuggggauaccuggaccaacgccgcuacccuuccucgguaccauccuguuuuaccuuagaaggucucugaauaaaauuccuucaugggcauggugguugacaccagugauccccgcccucugggaagcggaggcuggcgggaguccuaagguacggagcucccgcccagcccugcccacuuggguguucggcauucugaccgaaaacgucaugaaaaauacagagaagugcggagcacucuuuccuuucuuaaccccaguguuugaagcccugaacaucggucuuuucccgaaggauguuacucacuuuuugaaaaauucuauagagcgaaugaaggagucgcgucugaaagacaagcagaaacauagaguggauuucuuucaacagaugaucgacucacagaacagcaaggaaacaaagagucacaaagcucuauccgaucucgagcuggucgcacagucuauuaucauuaucuucgccgcuuaugacaccacgagcacuacccuucccuuuauaauguacgaacuggccacacauccugaugugcaacagaaguugcaggaggagauugacgcgguacucccaaauaaagcacccguuacuuaugaugcccuggugcagauggaauacuuagacauggucgugaacgagacccugaggcuuuucccuguggucucccggguuacacgcguguguaagaaagauaucgaaauuaaugggguauucaucccaaagggacuugcugugaugguccccaucuaugcccugcaccacgacccgaaauacuggaccgagccugaaaaguuuugccccgagagauucucaaagaaaaacaaggauaguauugacuuguacagguauauaccauuuggcgcaggcccucggaauuguaucgggaugcgcuucgcucuaacgaacauuaaacuggccgugauccgagcgcuccaaaauuuuagcuucaagcccugcaaagagacucagauaccacugaagcucgacaaccugcccauuuugcagccugaaaagccaaucguucucaaagugcaucugagagauggaaucacaucugguccguga

SEQ ID NO: 55058 - RNA, 1509 nt, Artificial Sequence
  derived and/or modified sequence opt3 from CYP3A4__Homo_sapiens__NP_001189784
auggcccugauccccgaccucgcuauggagaccuggcuucuguuggcagugagcuuaguccugcuauaccucuauggcacacacucccaugggcuguucaagaaacuugguauuccuggaccaacuccgcugcccuuuuugggcaacauacucucuuaccacaagggguucugcauguuugauauggaaugucauaaaaaguauggaaaaguuuggggcuucuacgacggucagcaaccugugcuggccaucacggauccagacaugauuaagaccguacuggugaaggagugcuauucagucuuuacaaauagaaggcccuucgggccugugggauuuaugaaaagugcgaucagcauugcugaagaugaggaauggaagcggcuccgcuccuuacugucuccaacuuucaccucgggcaaacuuaaggagaugguucccaucauagcccaguacggcgacguguugguccgaaaccugcguagagaggcagaaacagggaaaccugugacccuaaaggauguauuuggagccuauucaauggacguuaucacuagcacaaguuucggugugaauauugauucccucaacaauccacaggacccguuugucgagaacaccaagaaacugcuuagguucgauuuucuggaccccuucuucuugucuaucauuuuuccuuuccucaucccaauacuggaaguguuaaauauuuguguguuuccccgggaggucacgaacuuccugcgcaagagcguuaaaagaaugaaggaguccaggcucgaagauacucagaaacaccggguggacuuucuucaacugaugaucgacucacagaauaguaaggagaccgaaagccauaaggcuuugucugaucuagagcugguagcacaguccauuaucuucaucuuugccggcuacgaaacaacuucaagcgugcucaguuucauuauguacgagcuggcuacccacccugacguccagcaaaaacuucaggaggaaauagaugccgugcugccaaacaaggcgcccccgacauaugacaccguuuugcagauggaguaccucgauaugguggucaaugaaacgcugcgcuuauuuccuaucgcaaugcgacuggagagagugugcaaaaaggacguagaaauuaacgggauguucauccccaaaggaguuguggucaugauaccaucuuaugcccuacacagggauccuaaguacuggacugagcccgagaaauuucucccagaacgguucuccaagaagaauaaagacaacauugaucccuauaucuacacaccuuuuggcagcgguccacguaauuguaucgggaugcgcuucgcucugaugaacaugaaacuugccuugauuagagugcugcagaacuucucguuuaagccgugcaaggagacccaaaucccccucaaacugucucuuggaggccuguugcagccugaaaagccagucgugcucaagguugaguccagggacggcacugugucaggggcauga

SEQ ID NO: 55059 - RNA, 1509 nt, Artificial Sequence
  derived and/or modified sequence opt3 from CYP3A5__Homo_sapiens__NP_000768
auggaccugauccccaaccucgccguggagaccuggcuucuguuggcugucagcuuaguucugcuauaccucuauggcacaagaacucacgggcuguucaagaggcuugguauuccuggaccaacgccgcugcccuugcucggcaaugugcuguccuaccggcaggggcuguggaaauuugauaccgaaugcuauaagaaauacggaaagauguggggcacauaugagggucaacucccuguauuagcaauaacugacccagaugugauccgcaccguccuggugaaagaauguuacucuguuuucacaaaccgacguucacuugggcccgugggauuuaugaagagugccauuagcuuggcggaggacgaagaguggaagagaaucaggucccugcuaucuccuaccuucacuucgggcaaacucaaggagauguuuccaauuaucgcucaguauggcgauguccuggugcggaaucuucgcagagaagccgagaaagggaagcccguaacacugaaagacauauucggagcauacucaauggauguuaucaccgguacgagcuuuggcgugaacauugacaguuugaauaacccucaggauccauucgucgaauccacuaagaaguuucucaaauucggguuucuggacccguuauuccugucuaucauucucuuucccuuccuuaccccuguguucgaggcccugaaugugagcuuguuuccaaaggauacaaucaacuuccuauccaaaucagucaauaggaugaagaaaagucggcugaacgacaagcagaaacaucgccucgauuuucugcaacuuaugauagacagccaaaauucuaaggagacugaaucccacaaggcucugucagacuuggagcucgcagcccagagcauuaucuucauuuuugcuggauacgaaaccacaaguucuguucuguccuucaccuuauaugagcuggccacgcaucccgaugugcagcagaaacuacagaaggaaaucgacgcgguacucccuaacaaagcaccacccacuuacgaugccgugguccagauggaguaucuggacauggugguuaaugagacacuucgauuguuuccgguggcuaucagacuggaaaggaccugcaagaaagaugucgagauuaacggcguguucauaccuaaggguagcaugguaguuauccccacuuacgcccuccaccaugacccaaaguauuggacagaaccugaggaauuucggcccgagcguuucucgaaaaagaaagauucuauugacccauacaucuauacccccuuugggacgggaccucgcaauuguauaggcaugagauucgcacugaugaacaugaaacuugcucugauuaggguguugcagaacuuuuccuucaagccaugcaaggagacccaaaucccgcucaagcuggauacacagggcuuacugcagcccgaaaaaccuaucguccuaaagguggacucacgggaugggacucucaguggagaguga

SEQ ID NO: 55060 - RNA, 1608 nt, Artificial Sequence
  derived and/or modified sequence opt3 from CYP3A7-CYP3A51P__Homo_sapiens__NP_001243426
auggaccugauccccaaccucgccguggagaccuggcuucuguuggcugucagcuuaauucugcuauaccucuauggcacaagaacucacgggcuguucaagaaacuuggaauaccugguccaacgccgcugcccuuuuugggcaaugcacucuccuucaggaagggguacuggaccuuugauauggaaugcuauaaaaaguaccggaaaguuuggggaaucuaugacugucagcaaccuaugcuggccauuacagauccagacaugaucaagacugugcugguaaaggagugcuacucuguguucaccaaccgccgacccuuuggcccugucgguuucaugaaaaaugcgauuucaaucgcugaagaugaggaauggaagcguauaagaagucucuuaagcccaacauuuaccuccgggaaacugaaggagauggugcccaucauugcccaguauggagacguucuugugaggaacuugcggcgcgaggcagaaacuggcaaaccugucacacugaagcauguguucggcgccuacucuauggauguaaucaccucgacgucauuugggguuagcauugacagucuaaauaacccacaggauccguucguggagaauacuaagaaacuccugagauuuaacccccuugacccuuucguccuguccaucaagguguuuccauucuugacccccauacucgaagcucugaauauuacaguguucccuaggaaagucaucagcuuuuuaacuaagucuguuaaacagauuaaggagggacggcugaaagagacccaaaagcaccgcguggauuuccuccagcuuaugaucgacucccagaacucaaaggauagugaaacacauaaagcacugagcgacuuggagcuaauggcccagucuaucauuuuuauauucgcugguuacgaaaccacguccucaguacugagcuuuaucauuuaugagcucgccacucacccagacgugcaacagaagguccagaaagaaaucgauacagugcugcccaauaaggcgccgccuaccuacgacacuguucuucagcuggaguauuuggauaugguggucaacgagacacuccgacuguuccccguggcaaugagauuagaaaggguauguaaaaaggacguugagauaaauggcauguuuauuccaaaggggguggucgugaugaucccuaguuacguccugcaucacgaucccaaauauuggaccgaaccagagaaguuccuacccgaacgguuuucuaaaaagaacaaagacaauaucgauccuuacauuuauacgccauucggauccggcccgcguaacugcaucgguaugcgcuuugcccucgugaacaugaagcuggcucuuguuagaguguugcaaaauuucagcuuuaagcccuguaaagagacccagauuccucugaagcucagguucgggggacugcuucugacagagaaaccaauaguauugaaggccgaaucgcgggacgagacuuucgucgauauggaacccauccacauggacuuucuccgaucucuggcauuccagggcccucauuuaugcuuuuucugggagcugcuauguccaaccauucgcuccagauga

SEQ ID NO: 55061 - RNA, 1512 nt, Artificial Sequence
  derived and/or modified sequence opt3 from CYP3A7__Homo_sapiens__NP_000756
auggaccugauccccaaccucgccguggagaccuggcuucuguuggcugucagcuuaauucugcuauaccucuauggcacaagaacucacgggcuguucaagaaacuuggaauaccugguccaacgccgcugcccuuuuugggcaaugcacucuccuucaggaagggguacuggaccuuugauauggaaugcuauaaaaaguaccggaaaguuuggggaaucuaugacugucagcaaccuaugcuggccauuacagauccagacaugaucaagacugugcugguaaaggagugcuacucuguguucaccaaccgccgacccuuuggcccugucgguuucaugaaaaaugcgauuucaaucgcugaagaugaggaauggaagcguauaagaagucucuuaagcccaacauuuaccuccgggaaacugaaggagauggugcccaucauugcccaguauggagacguucuugugaggaacuugcggcgcgaggcagaaacuggcaaaccugucacacugaagcauguguucggcgccuacucuauggauguaaucaccucgacgucauuugggguuagcauugacagucuaaauaacccacaggauccguucguggagaauacuaagaaacuccugagauuuaacccccuugacccuuucguccuguccaucaagguguuuccauucuugacccccauacucgaagcucugaauauuacaguguucccuaggaaagucaucagcuuuuuaacuaagucuguuaaacagauuaaggagggacggcugaaagagacccaaaagcaccgcguggauuuccuccagcuuaugaucgacucccagaacucaaaggauagugaaacacauaaagcacugagcgacuuggagcuaauggcccagucuaucauuuuuauauucgcugguuacgaaaccacguccucaguacugagcuuuaucauuuaugagcucgccacucacccagacgugcaacagaagguccagaaagaaaucgauacagugcugcccaauaaggcgccgccuaccuacgacacuguucuucagcuggaguauuuggauaugguggucaacgagacacuccgacuguuccccguggcaaugagauuagaaaggguauguaaaaaggacguugagauaaauggcauguuuauuccaaaggggguggucgugaugaucccuaguuacguccugcaucacgaucccaaauauuggaccgaaccagagaaguuccuacccgaacgguuuucuaaaaagaacaaagacaauaucgauccuuacauuuauacgccauucggauccggcccgcguaacugcaucgguaugcgcuuugcccucgugaacaugaagcuggcucuuguuagaguguugcaaaauuucagcuuuaagcccuguaaagagacccagauuccucugaagcucagguucgggggacugcuucugacagagaaaccaauaguauugaaggccgaaucgcgggacgagacugucucuggcgcauga

SEQ ID NO: 55062 - RNA, 1503 nt, Artificial Sequence
  derived and/or modified sequence opt3 from CYP46A1__Homo_sapiens__NP_006659
augagccccggccugcuccuucugggguccgccguguuguuagcuuucggacugugcuguaccuuuguccacagagcaaggucucgguacgagcauaucccugguccaccgcgccccucauuccuacucggccaucugccuugcuuuuggaagaaagacgaaguugggggacgagugcuucaggauguauuccuggacugggccaagaaauauggcccagugguccgugugaacguuuuucacaagacaagugugauugucacuagccccgaguccgugaaaaaguucuugaugucuacgaaguacaauaaagauucgaagauguauagagcgcuccaaaccguauuuggugaaaggcuguucgggcagggacugguuucagaguguaacuacgaacgguggcacaaacagcgcagagugauagaccucgcuuuuagcaggaguuccuuagucucucugauggagacauucaaugagaaggccgaacagcuuguggagaucuuggaagcaaaagccgauggccaaacuccugugagcaugcaggacaugcugaccuauacagcuauggauauucuagcaaaggccgcuuuuggcauggagaccuccaugcuccugggggcccagaagccacuuucacaggcggucaaacugauguuggagggaaucacugcaagucggaacacacucgccaaguuccugcccgguaaacgcaagcaauuacgagaaguuagagagagcauuagguuucugcgucaggugggccgggacuggguacagcgcagaagggaagcucucaaacgaggggaggaagugccugccgauauccuuacccagauacugaaggcagaggagggagcucaagacgaugaaggcuugcuagacaauuucgucacguucuuuaucgccggucaugagacuucugcgaaccaccuggccuucaccgugauggaacucucccggcagccagagauuguugcacgccugcaggcugaaguggaugaggucaucgggucaaaaagauaccuugacuuugaggaccugggaagguugcaauaucucagccaggugcugaaggaaaguuuacggcuguacccgcccgccuggggcacauuccgccuacucgaggaagagacucugauugauggcguaagaguuccugggaauaccccacuuuuguuuucuacauacgugaugggaaggauggacaccuauuucgaagauccccugacguuuaacccugaccguuucgguccaggcgcucccaagccgcgguuuacuuacuucccuuuuucccucgggcaccgaagcugcaucggacagcaguucgcccaaauggaggucaaaguggucauggcaaagcugcuucagagacuggaguuuagguuggugcccggccagcgcuucggucuccaggaacaagccacacugaaaccauuagauccuguucuguguacccuacggcccagaggguggcagccagcucccccuccaccgcccugcuga

SEQ ID NO: 55063 - RNA, 804 nt, Artificial Sequence
  derived and/or modified sequence opt3 from CYP4A11__Homo_sapiens__XP_011539132
augagcguguccguccugucucccucaagacuccuuggcgacguuagugggauccugcaggccgcuagcuuguuaauucugcuacuccugcuuauaaaggcagugcaacuguacuugcacaggcaguggcuccugaaagcccugcagcaguucccuugcccaccgucccauuggcucuuuggacacauccaagaguuacagcaggaucaggaacugcaacggauucagaaguggguagagaccuuccccucugcguguccucauuggcuuugggguggcaaagugcgcguccaguuguaugacccagauuacaugaaggugauccuggggcgaucggcucuaucaugccucagcgaccccaaaagucacggauccuaucguuuucuggccccuuggauuggcuacggucuucuguugcucaacgggcagacaugguuccaacauagaaggaugcugacuccagcauuucacuaugauaucuuaaagcccuacguuggacugauggccgacucugugcgggucaugcucgauaagugggaggaacuucugggccaggacagcccuuuggaaguguuccagcacguaucccuaaugacgcuggauaccauaaugaaaugugcuuuuucacaucaaggcaguauccagguugaccgcccaagcgauccgacagaggaggggucuacuaccgaaggagguggcgcaggggaggaccaggaagaggaggccuucggauuuuccggcuaucccccucucggucagaauggggaaugggagcaccuggugagacaaggaccacccugcuga

SEQ ID NO: 55064 - RNA, 1494 nt, Artificial Sequence
  derived and/or modified sequence opt3 from CYP4B1__Homo_sapiens__NP_001306090
auggugcccagcuuccugucccucucuuuuucaagucuuggccugugggccagcggguugaucuuaguccugggauuccuaaagcucauucaucugcuucugagaaggcagaccuuggcuaaagcaauggacaaguuuccugguccaccgacacacugguuguucggccacgcccuggagauacaagaaacugggucccuggauaaaguugugucuugggcgcaucaguuucccuacgcucacccucucugguucggacaguuuaucggcuucuuaaacauuuaugagccagacuacgccaaggcaguauauucgcggggugggcgcggacugcuuguguuggaaggccccaaauggcugcagcaucgaaagcuacucacgccuggcuuucacuacgauguccugaagccauauguggccguuuucaccgagucaacacguaucaugcuugacaaaugggaagagaaggcuagagaggggaaaaguuuugauauuuucugcgacgugggacacauggcacugaauacuuugaugaaguguaccuuugguaggggcgauacagggcucggacauagccgggacuccucuuacuaucuggccgucagcgauuuaacccugcucaugcaacagcgccuuguguccuuccaguaccacaacgacuucaucuacuggcugacuccccauggcagaagguuuuugcgggcuugccagguagcccacgaucacacagaccaaguuauacgcgaacgaaaagcggcacuacaggaugagaaggugagaaagaaaauccagaauaggcggcaucuggacuuccucgacauucugcuuggugcccgugaugaagacgauaucaagcugucagacgcugauuugcgcgccgaggucgacaccuuuauguucgaggggcacgauacgacuaccaguggaauuagcugguuucucuauuguauggcacuguacccugaacaucagcacagaugcagggaggaagugcgggagaucuuaggcgaccaagauuucuuucagugggacgaucugggcaaaaugacauaucuaacuauguguauaaaggaaucuuuccgacucuacccaccggugccccaggucuaucgccaacuguccaaaccuguuaccuuuguggacgggagaucacuuccagcuggaagccucauuaguaugcauaucuacgcccugcacaggaacucugcgguauggcccgacccugagguguucgauucccuccgguuuagcacagagaaugccucgaagcgccacccauucgcauuuaugcccuucucugcugguccgagaaacugcauuggccagcaguucgccauguccgaaaugaaagucgugaccgcuaugugucugcuuagguuugaguucucacuggacccuagucguuugcccaucaagaugccacagcucguucugcggagcaagaauggguuucauuuacaccugaaaccucuaggacccggcuccgguaaguga

SEQ ID NO: 55065 - RNA, 1575 nt, Artificial Sequence
  derived and/or modified sequence opt3 from CYP4F11__Homo_sapiens__NP_067010
augccccagcugagccucuccuggcuuggccuggggccuguggccgcuucuccaugguuguuacugcuacucgucggagguucauggcugcuugcaagaguucuggccuggaccuacacauucuaugacaacugcaggcgguugcaauguuuuccgcagcccccuaagcagaauugguucuggggccaccaggggcucgugacuccaacggaggaaggaaugaaaacccugacacaacugguaacuaccuacccccagggcuuuaagcucugguuagguccuacauucccacugcuuaucuugugccaucccgauauuauacgcccuaucaccagugcgagcgcugccguggcaccaaaagacaugaucuuuuauggguuccugaagccguggcuaggagauggccuccugcuuuccggcggggacaaauggucucgacaccguagaaugcugacucccgccuuucauuucaacauuuugaagccuuacaugaagauuuuuaauaaaucggucaacaucaugcacgauaaguggcagaggcucgcuucagagggaagcgcacggcuggacauguucgaacauauaaguuuaaugacacuggauucccuccagaaauguguguuuucuuucgagagcaauugccaagaaaagccauccgaguauaucgccgcuauucuugagcugucagccuuuguugaaaaacgcaaccagcagaucuugcuacacaccgacuuccuguacuaucucacgcccgauggucagagauucaggcgggcgugucaccuggugcaugacuuuacugaugcagucauucaagagcgccgaugcacccuuccuacacagggcaucgacgauuuccugaagaauaaggccaaaaguaagacuuuggacuuuauagacgugcuccuguuaagcaaagaugaagacgggaaggagcugucugaugaggacauuagagcugaagccgauaccuucauguuugagggacacgacacaaccgcauccggccuaucauggguacucuaccaucuggcuaaacacccagaauaccaggagcaauguaggcaggaaguucaggagcuuuugaaggaucgggagcccaucgaaauugagugggacgaucuggcccagcucccguuccugacgaugugcaucaaagaaagccuucgucugcacccucccgugccagucaucagucgcuguugcacucaagacuuuguguugccugaugguagagugauucccaaggggauagucugucucaucaacauuaucggaauacauuauaauccaacaguuuggcccgacccugagguguacgacccauucagguuugaucaggaaaacauuaaggagcggucuccgcuggcguucauccccuuuuccgccggcccucgaaauugcaucggccaggcauucgcuauggccgagaugaaaguaguguuagcucugacccuacuccacuuucgcauucugccaacucauacagaacccagaaggaagccugagcuuaucuugcgggccgaagggggacuguggcuccgcgucgagccacugggugcaaacagccaguga

SEQ ID NO: 55066 - RNA, 1575 nt, Artificial Sequence
  derived and/or modified sequence opt3 from CYP4F12__Homo_sapiens__NP_076433
augagccugcucucccuucccuggcugggcuugagaccuguggccaccucuccaugguuacugcuacuccuggucguugggucauggcuucuggcuaggaucuuggcauggacauacgccuucuauaacaauugccggcgccuccaguguuuuccgcaacccccuaagcgaaacugguucuggggacaccugggucugauuacuccaacggaggaaggccucaaaaauaguacccagaugagcgcgacauacucccagggguuuacugugugguuaggacccauaaucccuuucauuguacugugccauccagacaccauccguucuauuacaaacgcuucggccgcaaucgcccccaaggauaaucuuuuuauaagauucuugaaaccuuggcugggcgaggguauccuacucucagggggagacaaguggagcaggcaccggcgcaugcugaccccagcuuuucauuucaacauucuuaaaaguuauaucacuauuuuuaauaaguccgcaaacaucaugcuggauaaguggcagcacuuggccucugaaggcagcuccagacucgacauguucgagcauauaucacugaugacauuagauagucugcaaaaauguauuuuuagcuucgacucucacugccaggaaaggccguccgaguacaucgcuaccauucucgagcuuucagcccugguggaaaagcggagccagcacaucuugcagcauauggauuuucuauauuaccugagucacgacggccgccgauuccauagagcguguaggcucguccacgauuucacggacgcagugauccgggagcgucgcagaacucugcccacccaagggauugaugacuuuuucaaagauaaggccaaaucuaagacacuugacuuuauagacguucuguugcucuccaaggaugaagacggaaaagcucugagcgaugaggacaucagggccgaggcagauacuuucauguuugguggccacgacaccacagcuucgggguuaucuugggugcuguauaaucuagcccggcauccugaauaccaggagcgaugccgccaggaaguccaggagcuccugaaggauagagacccaaaagaaauugagugggaugaccuugcgcaauugcccuuccugaccaugugugugaaggagucccucaggcugcacccuccagcccccuuuaucucacggugcuguacgcaggauauaguacuuccggacggacgcguuauuccuaaaggcaucacuugccugaucgacauuaucggugugcaucacaaccccacagucuggccagauccugaaguguacgaccccuucagauuugauccagagaauaguaaggggaggagccccuuggcauucauuccuuuuuccgcuggaccacguaacuguauaggccaggccuucgcuauggccgaaaugaaagugguccucgcacugauguuacugcauuuucgguuccuaccggaccacaccgagccccgaagaaagcucgaacugaucaugagggccgagggcgggcuuugguugcgcguugagccucugaaugugucucuccaauga

SEQ ID NO: 55067 - RNA, 1596 nt, Artificial Sequence
  derived and/or modified sequence opt3 from CYP4F22__Homo_sapiens__NP_775754
augcugcccaucaccgacagacuccuucaccuguugggcuuagagaagacagccuucaggauuuacgcugugagcacucugcuacucuuucugcuuuucuuucuguuccgguugcuccugcgcuuucugcgacucugccguuccuucuauauaacguguagaagguuacggugcuuuccucagccaccgcgcagaaacuggcugcuugggcauuugggaauguaccugcccaaugaagcaggucuacaagaugagaaaaagguccucgacaacaugcaccauguucugcuuguguggaugggcccuguacugccauugcucgugcugguccaccccgauuauaucaaaccuuuacugggggccucugcggcuauugccccaaaggacgaucucuucuacggauuucuuaaacccuggcugggcgacgguuugcuacugucaaagggggauaaguggaguaggcaucggcgccuccugaccccugcauuccacuuugacauccuuaaaccauauaugaagauuuucaaucagagcgccgauaucaugcacgcuaaauggcgacaucuggcagaaggauccgccgugucuuuggacauguuugagcacauaucgcucaugacacuggauucauuacagaaguguguuuucagcuacaacaguaauugccaggagaaaauguccgacuauaucucugcuauuaucgaacugagcgcccuauccgugagaaggcaauaccggcuccaucacuaccuggauuucauuuauuaccguucagcggacggccgcagauuuaggcaggcaugugacaugguccaccauuucacuaccgaggugauccaggaacggcgacgcgcccuuagacagcaaggcgcugaggccugguugaaggcaaagcaggggaaaacacuggauuuuauagacguacuccugcuugcuagggaugaagacggaaaggagcugagugaugaggacauucgggccgaagcggauaccuucauguuugagggucacgacacuacaagcucuggcaucuccuggauguuguucaaccucgccaaauauccggaauaccaggagaagugccgcgaagagauucaggagguuaugaaagggagagaacuggaggaauuagagugggaugaccugacccaacuacccuuuacgacuauguguaucaaggaaucacucaggcaguauccuccagugacccuggucagccgucagugcacagaggauaucaaacuucccgacggacggauuauaccuaagggcaucauuuguuuggugaguaucuacgguacucaucacaauccaaccguguggcccgacucuaaggucuauaacccguaccgauucgauccugacaauccccaacagagauccccacuggcauacguuccuuuuagcgcugggcccaggaacugcauaggacagucguucgccauggcugagcuccgcgugguaguggcccugacauuacugcgguuuagacuuucugucgauaggacccgcaaagugcgacggaagccagaauugauucuccguacggagaauggccuguggcuaaaaguugaaccccugccuccaagagcauga

SEQ ID NO: 55068 - RNA, 1563 nt, Artificial Sequence
  derived and/or modified sequence opt3 from CYP4F2__Homo_sapiens__NP_001073
augagccagcugucccucucuuggcuuggccuguggcccguggccgcuucaccuugguuguuacugcuacucgucggggcaaguuggcugcuugcccacguucuggcguggaccuacgcuuucuaugacaacugcagaagguugcgguguuuuccacaaccgccccgccgaaauugguucuggggacaucaggguauggugaacccuacagaggaaggcaugcguguacucacucagcugguggccacguacccacagggguuuaaggucuggaugggacccaucagcccucugcucuccuuaugccacccagauauuauaagaucugugaucaaugcaucggccgcuauugcacccaaagacaaguucuuuuauucauuccuggagccuuggcuuggcgaugguuugcugcuaagcgccggggacaaauggaguaggcaucggcgcaugcucaccccagcuuuucacuucaacauccugaagccguacaugaaaauuuuuaaugaauccguuaacaucaugcaugccaaguggcaacuucuggcgucugagggaagcgcauguuuggauauguucgaacacauaucccucaugacacuggacucauuacagaagugcguguuuaguuucgauagccacugucaggagaaacccucugaguauaucgccgcuauucuggaacucuccgcccuugucucaaagagacaucacgagauccuguugcauauugacuuucuauacuaucugacuccugauggccagagguuccggcgcgcaugccgacucgugcacgacuucaccgaugcuguaauccaagaaagaaggcggacacugccaagccagggcguugacgauuuucuucaggccaaagcgaagaguaaaacccuggacuucauagacguguugcuccugucuaaggaugaggacgggaagaaauuauccgaugaggacauucgugccgaagcagauacuuuuauguucgagggacacgacacaaccgcuagcggucugucguggguccuauaccaucucgccaagcaccccgaauaccaggagcgcuguagacaagaagugcaggagcugcuuaaagauagggagccuaaggaaaucgagugggacgauuuggcucaucugccauuucucacgaugugcaugaaagaaucucugcggcuucaucccccggugccugucauuucccgacacguuacucaggacaucgugcugcccgauggccgcguaaucccaaaggggauuauauguuugaucucaguguucggaacccaccacaauccugccgucuggcccgacccagagguguaugaccccuuuagauucgauccugaaaacauuaaagagaggaguccacucgcauuuaucccguucagcgccggcccccggaauugcauaggucaaacauuugcuauggcggagaugaagguugugcuggcauuaacucugcuacgcuucagaguccucccugaccauaccgaaccaaggcguaagcccgagcuggugcuucgggccgaagggggauuguggcugcgaguagagccucucuccuga

SEQ ID NO: 55069 - RNA, 1563 nt, Artificial Sequence
  derived and/or modified sequence opt3 from CYP4F3__Homo_sapiens__NP_000887
augccccagcugagccucuccucucuuggccuguggccuauggccgcuucaccaugguuguuacugcuacucgugggggcaaguuggcugcuugccagaauccuggcguggaccuacacauucuaugacaacugcuguagguugcggugcuuuccgcaacccccuaagcgcaauugguuccucggacaccugggucugauucauagcuccgaggaaggccucuuauacacucagucucuggcuuguacguuuggggauaugugcuguuggugggucggaccauggcacgccauaguucgaaucuuccaucccaccuauauuaaaccugugcuuuuugcaccagccgcuaucguacccaaggacaaaguguucuacucguuuuugaagccuuggcugggcgauggucuacuccugucagcaggggagaaauggagccgucacagaaggaugcuuacaccagccuuccauuuuaacauucugaagccguauaugaagaucuucaaugaaagugucaacauaaugcacgcuaaauggcaguugcucgccuccgagggaucugcgcggcuggacauguuugaacacaucagcuuaaugacucuggauucccuccagaagugcguguucucauuugacagucauugucaagagaaacccagcgaguacauugcagccauccuugaacugucugcuuugguuaccaagcgccaccagcagauucuacuguauaucgauuuccucuacuaccugacaccugacggccagagauucaggcgggccugccgccuugugcaugauuuuaccgacgcagucauacaagagcgaagaaggacucugccaucccagggcguggaugacuucuugcaggcuaaagccaagucaaagacacucgauuuuauugacguacuguuacugagcaaagacgaagaugggaagaaacuaagugacgaggauauccgggcggaggccgacaccuucauguuugaaggacacgauacgacugcaucuggucucuccuggguucuguaucaccuugcuaagcaucccgaguaccaggaacguugucgccaagaggugcaggaauugcugaaagacagagagccuaaggagauugaaugggaugaccucgcccagcugccauuccuuaccaugugcaucaaagagagccugagguugcaucccccggucccugcugugucgcgguguugcacacaagauaucgugcuccccgacggccgagucauuccaaaggggauaaucugccugauuucuguuuuuggaacucaccacaauccugccguguggcccgauccagaaguauaugaccccuuccgcuuugacccuaagaacaucaaagagagauccccauuagcauucauaccguuuucagccggccccaggaauuguauuggucaggcuuucgcgauggcagaaaugaaggugguccuggggcuaacccuccugcgguuucgcgugcuuccugaucauacagagccaagaaggaaacccgaguugguucugcgugccgaaggaggccucuggcugcggguggagccuuuaaguuga

SEQ ID NO: 55070 - RNA, 1563 nt, Artificial Sequence
  derived and/or modified sequence opt3 from CYP4F8__Homo_sapiens__NP_009184
augagccugcucucccuuucuuggcugggcuugagacccguggccgcuucaccuugguuacugcuacucgucguuggggcaaguuggcugcuugccaggauccuggcguggaccuacgcuuucuaucacaacggacggcgcuugcgaugcuuuccacagccgcguaagcaaaauugguuccucggucaucugggccuggugacacccacugaggaagggcucagaguauuaacgcagcugguggccaccuacccucagggauuugucagguggcuuggcccaauuacacccauaaucaacuugugucacccugacauugugcggagcguuaucaauacuuccgaugcaauuaccgacaaagauaucguguucuauaagacacugaaaccauggcuaggugacgggcuccugcuuucugucggagauaaguggcgccaucacagaaggcuguugacccccgccuuucauuucaacauacucaaaccuuacaucaagaucuuuucgaagucagcuaauauuaugcacgcaaaauggcagcggcuggccauggagggcagcacuugcuuagacguguucgaacacauuagucugaugacacucgauucccuucaaaaguguaucuuuucuuucgacagcaacugccaggagaaaccauccgaauauauaaccgcuauuauggagcugucagccuugguaguuaagcgcaauaaccaguuuuuccgauacaaagauuuucuauauuuccugacgccguguggcagaagguuccaucgggcgugccgucucgugcacgacuuuacugaugcagucauccaggagcgcagaaggacccugacaagucaagggguggacgauuuccuucaggccaaggcuaagagcaaaacucuggacuuuauugacguguugcuccugucugaagauaagaauggaaaagaguuauccgacgaagauauccgggccgaggcagacaccuucauguuugguggccaugauacaaccgcuucagggcugagcuggguccuauacaaccucgcccgacaccccgaguaccaggaacgcuguagacaggagguucaagaacugcuuaaggacagggagccuaaagaaaucgagugggaugacuuggcgcagcugccauuccucacgaugugccugaaggagagucuucggcugcaucccccuauuccaacuuuugcccgcggauguacacaggaugugguauugcccgacucuagagugauaccgaaaggcaaugucugcaacaucaauauuuucgcaauccaccacaacccuuccguguggcccgauccagaaguuuaugacccuuuuagguucgaccccgagaaugcucaaaagcguagcccaauggccuuuauacccuucucggcugguccucggaacuguauugggcagaaguuugccauggcagaaaugaaagugguccucgcccugaccuuacugcgauucagaauccuaccagaucauagggagccgcgccggacucccgaaaucgugcucagagcugaggacggacuguggcuuaggguagagccuuugggcuga

SEQ ID NO: 55071 - RNA, 1578 nt, Artificial Sequence
  derived and/or modified sequence opt3 from CYP4V2__Homo_sapiens__NP_997235
auggccggccuguggcucgggcuuguguggcagaagcuguuguuauggggagcugcaagcgcccugucccuagcgggugcuucucucguccugucacuucugcaaagaguugccaguuacgcaaggaaauggcagcagaugcggcccaucccuaccguggcccgcgcuuauccauugguaggccacgcacuccugaugaagccggacgggcgagaguucuuucagcaaauuauagaauacacagaggaauaucgucauaugccccugcucaaauuaugggugggaccugucccaaugguggcccuguacaacgcugagaauguugaagugauccuuacuagcuccaagcagauugauaaaucuucgauguauaaguucuuggagcccuggcugggccuaggucuccugacgucaaccgggaacaaguggagaagcaggcggaaaaugcuuacaccuacuuuucacuucaccauccuggaggacuuuuuggauauuaugaaugaacaggccaacauccucgucaagaaacuggagaagcauauaaaucaggaagcguucaacugcuuuuucuacaucacauuaugugcacuggacauuaucugcgagaccgccaugggcaaaaauauuggagcucaaaguaacgaugacuccgaguaugugcgcgccguauacagaaugucugaaaugaucuuuaggcggauaaagaugccauggcucuggcuugaucugugguacuugauguucaaggagggcugggaacacaaaaagagccuacagauucugcauacuuuuacaaauuccguuaucgcagagcgcgcuaacgaaaugaaugccaacgaggacugucgaggggauggaagagguucagcgcccaguaaaaauaagaggcgggccuuccucgaccugcuucugagcgugaccgaugacgagggcaaccguuugucucacgaagauauucgcgaggaagucgacacguuuauguucgaggggcacgacacuaccgcagcugccaucaauuggucccucuaucuguuaggaucaaacccugaagugcagaaaaagguggaucaugagcuggacgaugucuucggcaaaagcgacagaccagcuacaguugaggaucuaaagaagcucagguaccuggaaugcgugaucaaagagacucuucgguuguuuccgaguguaccccuguucgcccgaucuguguccgaagacugugaggucgcagguuaucgcgugcucaaggggaccgaagccguuauuauaccuuacgcucugcacagagauccaagguauuuucccaacccugaggaguuccagccagaacgguuuuuccccgagaaugcgcaaggacgccauccguacgcauaugugccuuuuagcgccggccccagaaacugcaucggccagaaauucgcugucauggaagagaagacaauucuuucguguauccugaggcacuuuuggauagagucuaaucagaaacgugaagaguuggggcucgaaggacaacugauuuuacggccauccaacgguaucuggaucaagcugaagcgaagaaaugccgacgagagguga

SEQ ID NO: 55072 - RNA, 1530 nt, Artificial Sequence
  derived and/or modified sequence opt3 from CYP51A1__Homo_sapiens__NP_000777
auggccgcugcagccggcaugcugcuccuugggcuguugcaggcgggagguagcguguuaggccaagcuauggagaaggucaccgggggaaaccugcuauccaugcuccugaucgccugcgcauucacacuuucucugguuuacuugauuagacucgccgcuggccaccuggugcagcugcccgcugguguaaaaucaccuccauauauauuuaguccgauccccuuccucgggcaugccauugcuuuuggaaagagcccuaucgaguucuuagaaaaugccuacgaaaaauauggcccaguguuuuccuucacuauggucggcaagacguuuaccuaccugcuugggucugacgcggcagccuugcuguucaacucgaaaaaugaggaucuaaacgcugaagacguguauucaaggcucacaacucccguuuuuggaaaggguguggccuacgaugucccuaauccaguguuccuggagcagaagaaaaugcuuaagagcggccugaacauugcacacuuuaaacagcauguaaguaucauagagaaggaaaccaaagaguauuucgaauccuggggagagucuggggagaagaauguuuuugaagcauugagcgagcucaucauucugacagccucccacuguuuacauggcaaggaaauccggucacaacugaacgagaaaguggcgcagcucuacgccgaccuugaugguggguucagucacgcagcuuggcuguugcccggauggcuaccucugccgagcuuccgccgacgugacagagcccacagggaaauuaaggauaucuuuuacaaagcuauacagaagcggcgccagucucaagagaaaauugacgauauccuccagacccugcuugacgccacuuauaaggauggcagaccacugacagacgaugaggucgcaggcauguugauugggcuccuguuagccggacagcauaccuccucaacgacuagcgcuuggauggguuucuuucuggcgagggacaaaacccuacagaagaagugcuaccucgaacagaaaacaguguguggcgagaaucugcccccucuuacuuaugaccaauugaaggaucugaaccuccuggaccggugcaucaaagaaacccuucgccugcgaccacccaucaugauuaugaugagaauggcaaggacaccucagaccguggccggguacacgauaccacccggacaccaagucuguguuaguccgacugugaaucagcgguugaaggauucuuggguagagcgucucgacuucaacccugaucgcuaucugcaggacaaucccgcuuccggcgaaaaauuugccuacgugccauucggugcagggagacauaggugcaucggcgagaacuuugccuauguccagauuaagacaaucuggagcaccauguuacggcuguacgaguucgaucuaauagacggauacuuuccuacugugaauuauacaaccaugauucacacgcccgaaaacccaguuauccgauacaagcgcagaucgaaauga

SEQ ID NO: 55073 - RNA, 1515 nt, Artificial Sequence
  derived and/or modified sequence opt3 from CYP7A1__Homo_sapiens__NP_000771
augaugaccacaagccugaucuggggcauugccauagcugcaugcugcugccucuggcuuauccuggggauuagaaggcggcagacuggagaacccccuuuggaaaacgguuuaaucccauaccugggcugugcccuacaauucggggcgaauccgcucgaguuucugcgcgcuaaccagcgaaagcacggacauguguucacgugcaaacuuaugggcaaguauguccacuuuauuaccaauccccuguccuaccauaaaguuuugugucacgguaaguauuucgacuggaaaaaguuucauuucgccacaucugcaaaggccuuugggcaccguucaaucgauccuauggacggaaacacuaccgaaaauauaaacgauacauucaucaaaacccuccagggccacgcucugaauagucugacugagagcaugauggaaaaccuccagagaauuaugaggccacccguguccucuaauucgaagacagcagccuggguaaccgagggcauguacucauuuugcuaucgggugauguucgaggcuggguacuuaacgaucuuuggacgcgaccugacuagaagggauacccaaaaagcccauauucuuaacaauuuggacaacuucaagcaguuugauaaagucuucccugcgcugguggcaggucuaccaauccacauguuccggacagcccauaaugcucgcgaaaagcucgccgagagccugcgacacgaaaaccuucagaagagagagaguauauccgagcugauuucuuugaggauguuucucaaugacacucugagcaccuucgaugacuuagaaaaagcaaagacacaccugguugugcucugggcuucccaggccaacaccauccccgcgacguuuuggucacuuuuccaaaugauucggaacccugaggccaugaaagcagcuacugaagaggucaagcguacacuggaaaaugccggccagaaagugaguuuggaggggaacccaaucugucuaagccaggcugagcugaaugaucucccgguacuggacucuaucauuaaggaaucccuucgccugucaagcgccaguuugaacauaagaaccgcaaaagaggauuuuacucuccaucuggaagacggaucuuauaauaucaggaaggacgauauuaucgccuuauacccccagcugaugcaccuagacccugagauauacccagauccccucacauucaaguaugaccgguaccuggaugaaaacggcaaaaccaagacgaccuuuuauugcaauggucuuaaauugaaguacuauuacaugccuuucggguccggagcuacaauuuguccaggccgacuguuugcgauccaugagaucaaacaauuccucauucugaugcuuagcuauuuugagcuggaauugaucgagggccaggcaaagugucccccgcucgaccagucgcgcgccgggcugggaauuuuaccuccccugaacgauauagaguucaaguacaaauuuaagcaccuauga

SEQ ID NO: 55074 - RNA, 1521 nt, Artificial Sequence
  derived and/or modified sequence opt3 from CYP7B1__Homo_sapiens__NP_004811
auggccggcgaggugagcgcugcaaccgggagauucucccuggaaaggcucggacuucccggucuggccuuggcggcugccuuacugcuacucgcacugugccuucugguccggcgcacacgacguccuggcgagccaccguugaucaagggguggcuccccuaccugggaguugugcugaaccucagaaaagacccuuuaagguuuaugaagacucugcagaaacaacacggcgauacguucaccguacuuuugggugggaaguauauuacauuuauacuggacccauuccaguaccagcuagugaucaaaaaucauaagcagcucucuuuucgggucuucucaaacaagcugcuugaaaaagccuuuaguauuagccaacugcagaagaaucacgauaugaacgacgaguugcaucucuguuaucaguuccugcagggaaaauccuuagauauccugcucgaaucuaugaugcaaaaucuuaaacagguguuugagccccagcuguugaaaacuaccucgugggacacagcugagcuauacccuuucugcucaagcauuaucuuugaaauaaccuucacuacaaucuauggcaagguuauugugugugauaacaauaaguuuaucagugagcugcgcgacgauuuccucaaauucgacgauaaguuugcauaccuggucuccaacauuccaaucgaacuucugggcaaugugaaaucuauaagagagaagauuaucaaaugcuucagcuccgagaaguuggccaaaaugcagggguggucagaaguauuucaaaguaggcaggacguucucgagaaguauuacgugcacgaagaucuggagauuggagcucaucacuuagguuuccugugggccagcgucgcgaacaccauccccacgauguuuugggcaauguacuaucuacuccggcacccugaagccauggcugccgugcgcgacgagaucgaccgacugcuucagucuacuggccaaaagaaaggguccggauucccaauucauuugaccagagagcagcuggauucacucauaugucuggaaagcaguaucuuugaggcacuuaggcugucuuccuacagcacaacuauucgguucguggaagaggacuugacccucucgucugaaacaggcgauuauugcguccguaagggugaccugguugcuaucuuuccgcccguguuacacggggauccugagauauucgaggccccagaagaguuucgcuacgacagauucauugaagauggaaagaagaaaaccacguuuuucaagaggggcaagaaacugaaguguuaucuaaugcccuucggcacugggacauccaaaugcccuggacgguuuuucgcgcucauggagaucaagcagcugcuuguaaucuugcugaccuacuuugaccucgaaauuaucgaugacaaaccaauuggucugaauuauucacgauuacuguucggcauacaguaccccgauagugacgugcuuuuucgcuacaaggucaagagcuga

SEQ ID NO: 55075 - RNA, 1506 nt, Artificial Sequence
  derived and/or modified sequence opt3 from CYP8B1__Homo_sapiens__NP_004382
auggugcuguggggccccguccucggggcccuucugguugugaucgcuggauacuugugcuuaccugguaugcugagacagaggcggccaugggagccgccccuagacaagggcaccguaccuuggcucgggcacgcaauggccuuccgcaagaacauguuugaguuccugaagcgaaugcguacaaaacauggagauguguuuacuguccaacuuggcggucaguauuucacguuugugauggacccacugagcuucggguccauuuugaaggauacccagagaaaacucgacuuuggacaguacgcgaagaagcugguucugaaaguguucggcuauaggucuguccaaggcgaucacgaaaugauacauucagcuaguacaaagcaccuccgcggggacggauuaaaagaucugaaugaaacuaugcuugacagcuuguccuuugugaugcugaccucuaaggguuggucgcuagaugccucauguuggcaugaggacagccucuuccgguuuugcuacuauauccuguucacagcaggcuaccuuagucuguuuggguauaccaaagauaaggaacaggacuugcuccaggccggagagcuguucauggaguucagaaaguuugauuuacuguuccccagguuuguauacucccuccuuuggccucgggaauggcuggagguuggccgcuugcagcgacuauuccacaaaaugcugucugugagccacucccaagaaaaggaggguauuucaaacuggcucgggaauaugcugcaguuucuuagagagcagggagucccaagugcuaugcaggacaaauucaacuuuaugaugcugugggcaagccaaggcaauacuggccccacaucuuucugggccuugcucuaccuguuaaagcauccugaagcuaucagggccgugcgggaggaagcgacccaggugcugggggaggcacgucuagaaacgaaacaguccuuugccuucaagcucggagcucugcaacacacuccaguccuugacucaguuguggaggagaccuugcgccugagagccgcaccgacacuccugaggcuuguacaugaagauuauacucugaaaaugagcaguggucaggaguacuuguuucggcacggcgacauucucgcucuguuccccuauuuaucugugcacauggauccugacauccauccagaacccaccgucuuuaaguacgaucgauuccugaacccuaaugggucccgcaagguggacuucuuuaaaacaggaaagaaaauacaccauuauaccaugccauggggcagcgguguuucgaucugucccgggagauucuuugcccuaucugaggugaaacucuucauucugcuuauggucacgcacuuugauuuggaacugguggacccggauacuccucucccccauguagacccacagagguggggcuucggaacaaugcagccuucccacgauguucgguuucgcuacagacugcaccccaccgaguga

SEQ ID NO: 55076 - RNA, 477 nt, Artificial Sequence
  derived and/or modified sequence opt3 from CYS1__Homo_sapiens__NP_001032237
augggcagcggguccucuagaucaaguaggacccugcggcgccgacguagccccgagucccucccugccggaccaggugcugcagcccuugaaggcgggacaagaaggcgggugccggucgcggcugccgagguucccggagcagccgcugaagaggcaccuggccgcgacccaucucccguggccccuccagaugguagagacgaaacucugagguuguuagaugagcugcuagcugagucggccgcgugggggcccccugaaccagcaccgcggcgccccgcccgacucagaccuacggcuguagccggaucagcagugugcgcugagcagagcaccgaaggccacccaggcagugggaacgucuccgaggcccccggaucugguaggaagaaaccugagcggccagcggccaucagcuacgaccauuccgaagagggccugauggcaucaauugaacgugaguauugucgcuga

SEQ ID NO: 55077 - RNA, 1014 nt, Artificial Sequence
  derived and/or modified sequence opt3 from CYSLTR1__Homo_sapiens__NP_001269117
auggacgagaccggcaaccugacagugagcuccgccacuugccacgauacgaucgacgauuucagaaaucaggucuacucuacccucuauucaaugauuaguguugugggguuuuucggaaacgguuuuguacuuuacgugcugauaaagacauaucauaaaaagagcgcuuuccaagucuacaugaucaauuuggcaguggccgacuuacuguguguuugcacucuaccccucagaguggucuauuacgugcacaaaggcauuuggcuguuuggggauuuccuuugucggcuguccaccuaugcguuguacguaaaccucuacugcucuaucuuuuucaugacagcuaugucguuuuuccgcuguauugccaucguuuuuccugugcagaauauaaaccuggucacccagaagaaagcacgauucgugugcgugggaaucuggauuuuugucauccugacuucaagcccauuccucauggccaagccgcagaaggacgagaaaaauaacacaaaguguuucgaacccccucaagauaaucagaccaaaaaccauguuuuagugcugcacuauguaagucuuuuugugggcuucauuaucccauuugucauaauuaucgugugcuacacgaugauuaucuugacucugcuaaagaaauccaugaagaagaaucucucuagccauaaaaaggcuaucgguaugauuaugguugugaccgcagccuuccuggucuccuuuaugcccuaucacauacagcguacaauccaccuucauuuccugcacaacgaaacuaaaccuugugacucaguguugagaaugcagaagaguguaguuauuacccucagccuggcugccucuaauugcuguuuugauccauuacuguacuucuuuuccgggggaaacuucaggaaacggcucucaacauuucgcaagcauagccuuaguucugugaccuauguccccaggaaaaaggcgucccugccugagaagggcgaagagaucugcaaaguguga

SEQ ID NO: 55078 - RNA, 1197 nt, Artificial Sequence
  derived and/or modified sequence opt3 from CYTH1__Homo_sapiens__NP_004753
auggaggaagacgauagcuacgugcccuccgaccugaccgccgaggaaagacaggagcucgaaaacaucaggcggcgcaagcaagagcuucuggcugauauucagcgauugaaagacgagauagcagaagucgccaaugagaucgaaaacuuaggcucuacagaggagcguaagaauaugcagagaaacaaacagguugcgauggggaggaagaaauucaauauggauccuaagaaggguauucaauuucugaucgaaaacgaccuacucaaaaauacuugcgaggauauugcucaguuccuguauaagggagaaggccuuaacaaaacggccaucggggacuaccugggagagcgggaugaauuuaauauacagguguugcacgcauucguagagcuccaugaguuuaccgaccugaaccuggugcaggcccuccgccaauucuuauggucauuuagacugccaggcgaagcucagaagaucgauaggaugauggaggcauucgcccagcgguauugucagugcaauaacggugucuuucaaaguacagacacuuguuacgugcuuagcuucgcuauuaucauguugaauaccucccugcacaacccgaauguuaaagauaagcccacaguggaacgcuuuauugccaugaaccgagggaucaacgacggaggcgaccuaccugaggaacuccugagaaaucuuuaugagucuauaaagaacgagccauucaaaauucccgaagaugacggcaaugaucugacccauacauuuuucaacccugacagggaggggugguugcucaagcugggagguggccgggucaaaacuuggaagcgucgcugguucaucuuaaccgauaauugccuguacuauuuugaauacacgacugacaaagagccaagagggauuaucccccucgaaaaccuuucgaucagggagguggaggauucaaagaaaccuaauuguuucgaacuguacauuccagacaacaaggaucagguaauaaaggcgugcaaaaccgaggcagacggacggguuguggaaggcaaucacacagucuaucgaaucagcgccccgacucccgaggagaaggaagaguggauuaaauguaucaaggcugccauaagucgcgauccuuuuuacgaaauguuggcagcuaggaaaaagaagguguccucuaccaaaagacauuga

SEQ ID NO: 55079 - RNA, 1200 nt, Artificial Sequence
  derived and/or modified sequence opt3 from CYTH3__Homo_sapiens__NP_004218
auggacgaggauggcgggggagaagguggcggggugcccgaggaccugagccucgaagagagagaggaacuucuggauaucaggcggcgcaagaaagaguugauugacgauauagaacgauuaaaguacgagaucgccgaagucaugaccgagauugacaaccugacauccguugaggaaucuaaaacuacgcagcguaauaagcaaaucgcuaugggaaggaaaaaguucaacauggauccuaagaaaggcauucaguuucuaaucgagaaugaccuccugcagucaaguccagaagauguggcacaguuccuuuauaagggugaggggcugaacaaaaccguaauaggagacuacuugggcgaaagagaugaguuuaauaucaaggugcuccaagccuucgucgagcugcacgaauuugcggaccugaaccucgugcaggcuuuacggcaguuccuguggagcuuucgccuuccgggcgaggcccagaaaauugauagaaugauggaagcauucgccuccagguauugcuuguguaaucccgggguuuuucaaucuacagacacuugcuacgugcugucguucgcuaucauuaugcuaaacaccucacuccauaaucacaacguccgggacaagccuacagcagagcgcuuuaucgccaugaaucgaggaauaaacgaagguggcgaucugccagaggagcuucugagaaauuuguaugaaagcauuaagaacgagcccuucaaaaucccugaagacgaugggaaugaccucacccauacauuuuucaacccagauagggagggauggcuguuaaagcugggcggucgggugaaaacuuggaagcgucgcugguucauucucaccgacaacugucuuuacuauuuugaauacacgacugauaaagagcccagagggaucaucccucuggagaauuugaguauuagggaaguagaggacccacggaagccgaacugcuucgaacuauacaaucccucccacaaaggacagguuauaaaggcuuguaagaccgaggccgauggccgaguggucgagggcaaccaugugguguaucgcaucucugcgccuagcccagaagagaaagaagaguggaugaaguccauuaaagcaucaaucaguagagaccccuuuuacgauaugcuggccacaaggaagcggcgcauagcuaauaaaaaguga

SEQ ID NO: 55080 - RNA, 1080 nt, Artificial Sequence
  derived and/or modified sequence opt3 from CYTIP__Homo_sapiens__NP_004279
augagccugcagagacuccuucaacacuccucuaacggcaaucuggccgacuucugcgcugggcccgcauacucaaguuauagcaccuugacaggauccuuaacuauggaugacaacaggcggauccagaugcuggccgauacgguggcgacccuaccucgcggucgaaagcagcucgcucugacacguucuucgucacuuagcgacuuuaguuggucccagagaaaacuggucacuguugagaagcaagauaaugaaaccuucggcuuugagauucagucuuacaggccacagaaccagaaugccuguagcuccgaaauguucacauugauaugcaaaauccaagaggacucaccggcacauugugccgggcuccaggcuggagaugugcuggcaaacauuaauggcguaaguaccgaagguuuuacuuauaaacagguggucgaccugauccggagcucugggaaccucuuaacaauugagacccugaauggaacgaugauccuuaagcgcacugaguuggaagccaagcuacaggugcugaagcaaacccucaaacagaaguggguugaguacagaucccugcagcuucaagaacacaggcuguugcauggcgaugcugccaacugccccucacucgagaauauggaccuggaugaguuaagccuguucggcccucucccagggcccggaccugcgcuuguggaccggaaccgccugaguucugaauccagcuguaaaucgugguugucuuccaugacaauggauucagaggacgguuaucagacuugcgucagugaagacagcucccgaggcgcauuuucuagacagaccagcacagaugacgaguguuucauaccaaaggaaggggaugacuuucuaaggcggucaaguucccgucgcaauagaagcaucucuaacaccucaaguggaagcaugucuccccugugggagggcaaucucuccucgauguucgguacgcugccuaggaaaagccggaagggguccgugcgaaagcagcuucugaaauuuauuccaggauugcaccgcgccguagaggaagaggaaucaagauucuga

SEQ ID NO: 55081 - RNA, 411 nt, Artificial Sequence
  derived and/or modified sequence opt3 from CYTL1__Homo_sapiens__NP_061129
augagaacccccggcccucugccagugcuccuucuguuguuagccggggcuccggcagccaggcccacaccuccaacuugcuacagccggaugcgcgcgcugucccaggagaucacgcgagacuucaaccuacuccaagucucugaacccucagagccuuguguucguuaucugccaagacuuuaccuggauauucacaauuauugcguguuggacaagcucagggauuuuguagcuagucccccuuguuggaaaguggcccaggucgacagccugaaggauaaagcacggaagcuguacaccauaaugaacuccuucugccgcagagaccucguguuuuuacuggaugacuguaaugcccuugaauauccaaucccgguuacaacuguguugcccgauaggcagcgguga

SEQ ID NO: 55082 - RNA, 789 nt, Artificial Sequence
  derived and/or modified sequence opt3 from CYYR1__Homo_sapiens__NP_443186
augaagugcgagcccggcuggccuagaaccccagaauggccgcccagcccuaggcuguccgccguggggcgggacaaagagacaugggcuccaucugcagcccgccucggaccccgagcgccucagcuucguggugucccacaaucacuggcuagagaugcccccggcccugggaguuugggaagguuaccacggcaguggccgggccuguguagcacucgccuauccggugcacuccugucucccucggacagaccuccaucaagccccuucccuccaguucccgggaguccguuugccccuucccuuaggcccccagcuuggauggaugcaccucggcugcccgugcgcccaggaguauugcuccccaagcuggugcuccuguucgucuacgccgacgauugcuuagcucaguguggcaaagacugcaagucuuauuguugcgauggcacgaccccuuacuguugcagcuauuacgccuauaucgggaacauucuguccggaacagcgauagcagguaucguguuuggcauuguuuucaucaugggggugauugccggaaucgcuauauguaucugcauguguaugaaaaaucaccgagccacuagagucggcauucuuaggaccacacauaucaacaccgugucaaguuacccagguccgcccccuuaugggcacgaccaugaaauggaguacugcgcagauuugccacccccuuacagcccaacuccccagggaccggcucaacggucuccuccacccccuuaucccggcaaugcccguaaguga

SEQ ID NO: 55083 - RNA, 1164 nt, Artificial Sequence
  derived and/or modified sequence opt3 from D2HGDH__Homo_sapiens__NP_001274178
auggugggcgggagcguccccguuuucgacgagaucauucuguccaccgccagaaugaacagggugcucucuuuucacucaguaaguggaauacuugugugccaggcugguuguguccuggaagaguugagccgguacguggaggaacgcgauuucaucaugccuuuagaccugggcgcaaagggguccugccauauuggaggcaauguugccacaaacgcgggugggcuacgauuucuccguuauggaucucugcacggcacugugcuuggccuggaagucguguuggcugaugggacgguacucgacugucugaccucgcugagaaaagauaauacaggauacgaccucaagcaauuauucaucgguucagagggcacucuggggauuaucaccacaguuagcauacuuugcccaccgaaacccagggccgugaacgucgcauuuuugggauguccuggcuucgccgaggugcugcagaccuuuaguacuugcaaggguaugcuaggggaaauccucuccgcuuucgaguuuauggaugcaguguguaugcagcuggucggacggcaucuucaccuggccucuccaguucaggaaagccccuucuauguguugauugagacauccggcucaaaugcuggccaugacgccgagaaacucgggcacuuucuggaacacgcguuaggaaguggucugguaaccgauggcacgauggcaacugaccaacgcaaggugaagaugcucugggcccuuagagagaggaucaccgaagcucugagccgggauggguacgucuauaaauacgacuugucucuaccuguggagcgccuguaugauauuguuacagaccuccgagccagacugggaccacaugcaaagcacguggucggcuacggucaucuuggggacggcaaccugcacuugaaugugacugcugaagccuucucccccucacuccuggcggccuuagagccucacguauacgaguggaccgcaggacagcagggcagcguuagugcugaacauggggugggauuuaggaaacgggauguccuggguuauucuaagccaccgggcgcccuacagcucaugcaacagcugaaagcucuuuuggaccccaaggggauccugaacccuuacaagacacucccaucccaggccuga

SEQ ID NO: 55084 - RNA, 3207 nt, Artificial Sequence
  derived and/or modified sequence opt3 from DAAM1__Homo_sapiens__NP_001257449
auggcccccagaaagaggggcgggcggggaaucagcuucauuuucugcuguuuccgcaacaaugaccacccugagauaaccuaccgacugcguaacgauuccaauuuugcucuccagacaauggaaccagcacuuccgaugcccccuguggaggaacuggacgucauguucucugaguugguugaugaauuagaccugacugauaaacauagagaggccauguuugcgcuaccagcugagaagaaauggcaaaucuauugcucaaagaaaaaggaccaggaagagaacaagggugccacgaguuggcccgaauuuuacauugaucagcucaauagcauggcagccaggaaaucccugcuugcucuggagaaggaggaagaggaggagcggucuaaaaccaucgaaucguugaagacagcacuccgcacuaaaccuaugagauuugugaccagguucauugaccuggauggccugucauguauccucaacuuuuuaaagacaauggacuaugagaccagcgagagucggauacacacuucccugaucgggugcauuaaggcccuuaugaauaacucucagggacgcgcucauguauuggcccacagcgaauccaucaaugugauugcgcaaucacugaguacagagaacaucaaaaccaaggucgcagugcuagaaauacucggcgccguuugucuggugccaggugggcauaaaaagguccuucaggcuaugcugcacuaccagaaauaugccagcgagcgaacgagauuccagacuuugauuaaugaucucgacaagucuaccggaagguaccgggaugaagugucccugaaaacagcaaucaugucauuuauuaacgcuguauuaagccaaggcgccggcguugagagucuggacuuccgucuccaccuucgcuaugaguuucugauguuggggauccagcccgugaucgacaagcuaagagaacaugaaaauucuacucuggauaggcaccucgacuucuucgaaaugcugcggaacgaggaugaacuugaguuugcgaagcgauucgagcugguccauauugacaccaaauccgccacacagauguuugaauugacccgcaagagacucacgcacagcgaggcauacccucacuucaugucgauacugcaucacugcuuacagaugccauacaaaaggucuggaaauacugugcaauauuggcugcuacucgaucggaucauucagcagaucgugauacaaaacgacaagggucaggauccggacuccacaccccuggaaaacuuuaauauuaaaaacgucguucgcaugcuugugaaugagaacgagguaaagcaguggaaggaacaggcugagaaaaugagaaaggaacauaaugaguugcaacagaaacuggaaaagaaagagagggagugugaugccaagacccaggaaaaggaggaaaugaugcagacucucaacaaaaugaaggagaaacuggaaaaggagacaaccgagcacaaacaagugaagcagcaggucgcugaccuuacggcccagcugcaugaauugucacgucgggcagugugcgccaguaucccuggcgggccaagccccggagcuccuggcgguccauuccccuccucuguuccggggagccuccugccucccccaccucccccacccuuaccuggaggcaugcugccaccgcccccuccaccccuaccuccaggcgggcccccgccuccacccggaccucccccacucggugcgaucaugccucccccaggcgcaccgauggggcuggcccuuaagaaaaagucaauuccucaacccaccaaugcuuugaaaaguuuuaacugguccaagcugccagagaauaaacucgaaggaacaguguggacugagaucgaugacaccaaggucuucaaaauucuggacuuagaagaucuggagcgaacauuuagcgccuaccagagacagcagaaggaggcagacgccauagaugacacucuuucuucaaaguugaaagugaaggaacucaguguaaucgauggcaggcgcgcucaaaacuguaauauucugcuaagccggcugaaacucuccaacgacgagaucaagagagccauccugaccauggaugaacaggaggaccuucccaaagauauguuggagcagcuguuaaaguucguuccugaaaagucugacauugaucuccuggaggaacacaaacacgagcuugacaggauggcaaaggcggaucgcuuucuguucgaaaugucgcgaauaaaucauuaucaacagcgguugcagagccucuacuuuaaaaagaaauucgcugagcguguggccgaggucaagccaaagguggaagcaaucagauccgguucagaggaagucuucaggaguggggcccugaaacagcuacuggaggugguucucgcuuuuggcaacuauaugaauaagggacaacgcggcaacgccuacggguucaaaauuucuagccugaacaagaucgcagacacaaaauccucaauugacaagaauaucacccuuuugcacuaucugauaacuaucguggaaaacaaguaccccagcguauuaaaucucaacgaggagcugcgggauauuccucaggcugccaaagucaauaugacggaacuugacaaggagaucucuacacugagauccggacuaaaagcgguggaaaccgagcucgaauaccagaagagucagccgccacaacccggugauaaauuuguuagcguggucucucaguucauuacuguggccuccuuuucauucagugacguagaggaucuguuggcugaggcaaaggaccuguuuaccaaagccgugaagcauuucggcgaagaggcugggaagauccagccugaugaauuuuucggaauauuugaccaguucuuacaagccguuagcgaggcaaaacaggagaacgaaaauaugaggaagaaaaaggaggaagaggaacgacgcgcgcggauggaggcccagcucaaagagcaaagagaaagggagcguaagaugcgcaaggcuaaagaaaacucggaggaauccggcgaguuugaugaccuggucucugcccuucggagcggugagguguucgauaaggaccugucaaaauugaagagaaauaggaaacgaauuacaaaccagaugaccgauaguucccgggaacgcccaaucacuaagcucaauuucuga

SEQ ID NO: 55085 - RNA, 3207 nt, Artificial Sequence
  derived and/or modified sequence opt3 from DAAM2__Homo_sapiens__NP_001188356
auggcccccagaaagaggagccaccauggccugggguuccucugcuguuuuggagguuccgacaucccugagauuaaccuucgggauaaucacccacugcaguucauggaauuuucuucaccgauacccaacgcugaggaauugaauauccgcuucgcagaguuaguggacgaacuggaucuaaccgacaaaaaccgagaggccauguuugcgcucccuccagagaagaaauggcaaauuuacugcaguaagaaaaaggaacaggaggaucccaauaagcuggcuacaagcuggccugacuauuacaucgaucguauuaacuccauggccgcaaugcagucucuuuaugccuucgacgaagaggagacugaaaugagaaaucaggucguugaggaucugaaaacggcuuugaggacccaaccaaugcgguuugugacacgcuucaucgaacucgagggccugacuugucugcucaacuuuuuaagaucgauggaccaugcaaccugcgaaucaaggauacacacaagccugaucggguguauuaaggcccuuaugaauaacagucagggacgggcucauguauuggcccagcccgaggcgaucuccaccauugcacagucucugcgcacugagaauagcaaaacaaagguggccguccuagaaauccucggcgcugugugccugguuccuggugggcacaaaaaggugcuucaagccaugcugcacuaccaggucuaugcagcugagcgaaccagauuccagacguugcucaacgaacuggauagguccuuaggacgguaccgugacgaggugaaucugaagacugccauaaugucauuuauuaacgcgguacucaaugccggcgcaggcgaagauaaccuugaguuccgccugcauuugagauaugaguuucuaaugcuggggauccagccaguuauugacaaacucaggcaacacgaaaacgcuauccuggacaagcaucuugauuucuucgagauggugcggaaugaagacgaucuggaguuggcccgacgcuuugacaugguccacaucgauaccaaaagugcuagccagauguucgaacucauucacaagaaacugaaguacacagaggccuacccguguuuacugucugugcuacaucacugccuccagaugcccuauaaaagaaacggagguuacuuucaacaguggcagcugcuugacaggauauugcagcaaaucgugcugcaggaugagcggggcgucgacccugaucucgcaccacuggaaaauuucaacguuaagaauauugugaacaugcuuaucaaugagaacgaaguaaagcaguggcgcgaccaggccgagaaauuuagaaaggagcauauggaacugguguccagguuggagcguaaagaacgggagugugaaacuaagacccucgagaaagaggaaaugaugcgaacacugaauaagaugaaggauaaauuagcuagagagucacaagaacugaggcaggcgcgcgggcaggucgcagagcuaguggcccagcucagcgaacugaguaccggacccguuucuuccccuccacccccgggcgguccucuuacguugagcucgucuaugacuacaaacgaccugcccccaccucccccaccccucccuuucgcuugcuguccaccgcccccuccacccccucugccacccgggggaccgccuaccccacccggcgccccucccugcuuaggcauggggcugccacuuccucaagaccccuauccauccucagaugugccguugcggaagaaaagagucccucagcccagucacccacucaagagcuuuaauugggugaaacugaacgaggagaggguacccggaacuguuuggaaugaaauagacgauaugcaaguguuccgcauucuagaccuggaggauuuugaaaagauguucuccgcauaccagcgacaucagaaggagcucgguucuacagaagacaucuaucuggccagccggaaagucaaggagcuuucagugaucgauggccguagagcucagaacugcauuaucuugcugaguaaauuaaagcucuccaaugaggaaauuaggcaggccauacugaaaauggacgagcaagaagaucuugcaaaggacaugcuggagcaguugcucaaguuuaucccugagaaaagcgauauugaccugcuagaagaacacaagcacgaaaucgagcgcauggcgcgggcugauagauuccuguacgaaaugucuaggaucgaccauuaucagcagcgacuccaagcccuguuuuucaaaaagaaauuccaggagcgccuugcagaggccaagccaaaagucgaagcuauuuugcuggccucacgggaguuagugagaaguaagaggcuccgucagaugcuggaaguuauacuugcaaucgggaacuuuaugaacaagggacagcgcggcggugcuuacggguuccggguggccagccugaauaaaauugcggacaccaaguccucuaucgauagaaacauuucgcuacuccacuaccugaucaugauauuggagaaacauuuucccgacauccugaauaugccuagcgaauuacaacaccucccggaggccgcuaagguaaaccuggcagagcuugaaaaagaggucggcaaucugaggcgaggauugcgggccguggaaguugagcucgaauaucagcgcagacaggugagggagccauccgauaaguucguccccgugaugucagacuuuauuacgguaaguucuuucagcuuuuccgagcuggaagaucagcuaaacgaggcucgggacaaguucgccaaagcacugaugcacuuuggcgaacaugauucaaagaugcaaccugacgaguucuuugggaucuucgauaccuuucuucaggcguucagcgaggcccgacaggaccucgaagcuaugagacgcaggaaagaggaagaggaacgucgggccagaauggaggcaaugcugaaggagcaaagggaacgcgagcgauggcagagacagcggaaaguguuggcugccggaucuucccuggaagaggguggcgaguucgaugacuuaguuagugcacucaggagcggggaggucuuugauaaggaccuguguaaacuuaagcgcucucguaagagauccggaucacaggcccuggaggugacacgggaaagggcuauuaaucgcuugaacuacuga

SEQ ID NO: 55086 - RNA, 2250 nt, Artificial Sequence
  derived and/or modified sequence opt3 from DAB2__Homo_sapiens__NP_001231800
augagcaacgagguggaaaccuccgccacaaauggccagcccgaccaacaggcugcaccuaaggccccaucuaaaaaggagaaaaagaaagggccggaaaagacugaugaguaccugcucgcgagauucaagggagacggugucaaauauaaggcuaaacuuaucggcauugaugacguucccgaugccaggggagacaagaugucacaggauaguaugaugaaacugaaggggauggcagccgcuggccggagccagggucaacacaagcagcgcauaugggugaacaucuccuugucugggauuaaaaucauugacgaaaagacgggaguaaucgagcaugagcacccugugaauaaaauaucguuuaucgcacgagaugucaccgacaaccgugccuucggcuacgugugcggcggggaaggacagcaucaguuuuucgcuauuaagacaggucaacaggccgagccauuaguuguggaucugaaagaccuauuucaggucaucuauaaugugaagaaaaaggaagaggagaagaaaaagauugaagaggcgucaaaagcaguagaaaacggcagcgaggcccucaugauccuggaugaccagacuaauaaguuaaaaagugaauccaaggacauacuguugguugaucucaacucugagauugacaccaaucaaaacagccugagagagaaucccuuccugacaaacgggaucaccuccuguucacucccuaggccaacuccccaggcuaguuuucuuccugaaaaugccuucagcgcaaaccugaacuuuuucccaacaccgaaucccgauccuuuucgggacgauccauucacccagcccgaccaaucuacgccuuccucauuugauagccuuaagaguccagaccagaaaaaggagaacucuuccagcucgucuacucccuuguccaauggaccgcugaacggcgauguggacuacuucggucagcaguucgaucaaauuucaaaucgcaccgggaaacaggaagcucaggccggaccuuggcccuuuaguagcucccagacacaaccagcggucagaacucagaacggcgugucugagagggaacagaauggcuucagcgugaagucaaguccuaaccccuuugucggguccccacccaaaggacuaagcauccagaaugguguuaagcaagaccucgagucuucagugcagaguagcccucacgacuccaucgccauuauaccaccgccccagucuaccaagccuggccgggggcgccgaacagcaaaaucgagcgcuaacgaucugcuugccuccgacaucuucgcuccacccguaucagagccuaguggacaggccucuccaaccggccaacccacggcacugcagccgaauccuuuggaucucuuuaagacuagcgccccagcucccguggguccucuggucggguuaggcggagugacaguuacccugccccaggcgggcccauggaacacugcaucccucguguucaaucaaucaccuagcauggcccccggggcuaugaugggaggucagccaucuggcuuuucccagccggucauuuucgggacaaguccugccgugagcggauggaaccagcccucuccauuugcagccuccacgcccccuccaguacccguuguguggggcccuucagcuagugucgccccgaaugcauggagcaccaccucgccacuugguaaccccuuccaauccaauaucuuuccugcgccagcugugucuacacagcccccuagcaugcauucaagucuguuggucacuccgccccagccaccucccagagccgggccaccuaaagacauauccucugaugcauucaccgcccuagacccccugggcgauaaggaaauuaaagacgugaaggagauguuuaaggauuuccagcucaggcaaccaccggcuguuccugcccggaaaggagaacagacaagcuccggcacucugucagcauucgcuagcuauuuuaacaguaagguggggaucccccaggagaacgccgaccacgaugacuucgaugcgaaucagcuucugaacaaaaucaaugaaccacccaagccugccccacgucaaguaucuuugcccgucaccaaauccacagacaacgcuuuugagaauccuuucuuuaaggacagcuucggaucgucacaggcaucuguggccaguucccagccgguuagcucugagauguaccgcgauccauuugguaaccccuucgcuuga

SEQ ID NO: 55087 - RNA, 3399 nt, Artificial Sequence
  derived and/or modified sequence opt3 from DAB2IP__Homo_sapiens__NP_115941
auggagcccgacagccugcucgaucaggacgauuccuacgaaucuccucaagagagaccaggcucaaggcggagucuuccggggagccuguccgaaaagucucccucgauggagccuucagccgcuaccccauuccgcgugacaggauuuuugagccgacguuuaaaagguaguaucaagagaacuaaaucccagcccaagcuggacaggaaccacucuuuccggcauauucuaccuggcuuucgcagcgcagccgcggcugccgcagauaaugaaagaucccaccucaugccaaggcugaaagagucacggagucaugagagccuucugucucccuccucagccgucgaggcuuuggaccucagcauggaggaagagguugugauaaagccuguacacaguucuauccuggggcaggauuauugcuucgaggugacgaccuccagcggaucgaaguguuuuucuugccgcuccgcagccgaacgagacaaauggauggagaaccugagaagggcuguccauccaaauaaggauaacucacggcguguggaacacauucucaaauuauggguuaucgaggccaaggaccugccggcgaaaaagaaguaccuuugugaauugugccuggaugacgugcuauaugcacgcacaacuggcaaacucaagaccgauaaugucuucuggggugagcacuuugaguuccauaaccugcccccucuuagaacagugaccguacaccuguacagggaaacugacaaaaagaaaaagaaagagcggaauaguuauuuggggcucguuagccugccagccgcuuccguggccggacgacaguuugucgaaaagugguaccccguggugacaccuaacccaaagggcggcaaagggcccggaccgaugauucgcaucaaggcaagauaucaaaccauaacgaucuuaccuauggagauguacaaagaguucgcugaacauauuacuaaucacuaccugggucucugugccgcgcuugagcccauccugucugccaagaccaaagaagagauggcaagcgcuuugguccacauucuacagucaacaggcaagguuaaggacuuucugacugaucucaugaugagugaaguggacaggugcggggauaacgagcaucugaucuuccgggaaaauacccuugccacaaaagcuauagaggaguaucugaaguugguaggacagaaauaccuccaggacgcccugggcgaauuuauuaaggcauuauaugaguccgaugaaaacugugagguggacccaagcaaaugcucugccgcugaucugccugagcaccaagguaaucuaaagauguguugcgaacucgcguucuguaagaucauuaacucauacugcgucuucccccgcgagcugaaagaaguguuugcaaguuggagacaggagugcagcuccagggggcguccagacaucucugaacggcuuaucucggccagcuuguuccugcgauuucucugucccgcuauuauguccccuucacuguucaaucuucugcaggaguauccagaugacagaaccgccaggacguugacucucauagcaaagguuacacagaaccuggccaacuuugcuaaauucggaaguaaggaggaauacaugucuuuuaugaaucaauucuuagagcaugaauggaccaacaugcagcgcuuucugcuagagaucagcaauccggaaacucucuccaacacagccggcuucgagggcuauauugaucuggggcgggagcuuagcucauugcacucucugcucugggaagcagugucccagcuggagcaaaguaucgucagcaaauuaggaccccugccuagaauacuuagggacgugcauaccgcguugucuacgccagguuccggccagcuccccgggaccaaugaccuggcuucaacaccuggaaguggcagcucguccauuucugccggucuacagaagaugguaaucgaaaacgaucugagcgggcucaucgacuuuacucgccugccaucacccaccccggagaauaaggaucuuuucuuuguuacacgaaguuccggcgugcagccuucuccagcacggagcuccucauacagcgaagccaacgagcccgacuugcaaauggcuaauggaggcaaaagucugucuauggucgauuuacaggacgcccguacucucgauggggaggcaggauccccugcuggucccgacgugcugccaaccgauggccaggccgcggccgcucagcuugucgcaggguggccugccagagcuacacccgugaaccuggccggauuggcaaccguuaggcgcgcgggccaaacuccaacgacaccggguaccagcgaaggggccccuggccggccccagcuccuggcuccacuaucguuccagaaucccguguaccagauggccgcaggacugccucucucaccaagaggccugggggacucuggaagugagggucacuccagccuuucuagccacuccaacucagaagaguuggcugccgcagccaagcugggcaguuucagcacugcugcggaggaauuagccaggcgacccggggagcucgcacgccggcaaaugucucugaccgaaaaaggaggccagccuacaguaccgagacaaaauuccgcugguccacagaggcguauugaucaacccccuccacccccuccgcccccaccucccgccccacgcgggcggaccccucccaaccuucugucaacucuacaguauccaagaccgaguagcggcacacucgccuccgcuucuccugacugggucggacccucgacgaggcugcgacagcaaagcucauccaguaagggcgauucuccagaguugaaaccccgggcagugcauaagcaggggccuagcccaguuucccccaaugcccuggaccgcaccgcggcuugguuacucacuaugaacgcccagcugcuugaagacgagggacugggcccugauccgccacacagagacagguugcggucaaaagaugagcucucucaggcagaaaaggaccuggccgugcuacaagauaagcugcgaaucagcacaaagaaacuugaggaauacgagacccucuuuaaaugccaggaagagacaacucagaagcuggucuuggaguaucaggcuagacuggaagagggugaagaacgcuuaaggcgucaacaggaagacaaagauauucagaugaaggggauaaucagucggcucauguccguggaggaggaacugaagaaagaccaugcagagaugcaggccgcgguagauagcaagcagaaaauuaucgacgcucaggaaaagagaaucgccucucuugaugcagccaacgcuaggcugaugucagccuugacccagcucaaagaguccaugcacuga

SEQ ID NO: 55088 - RNA, 1515 nt, Artificial Sequence
  derived and/or modified sequence opt3 from DACH1__Homo_sapiens__NP_004383
auggccgugcccgcugcacugaucccuccaacccagcucgucccgccccaaccuccaauuagcacauccgccucuucaaguggcacuacgaccagcacauccucugcgacuucgucacccgcuccuagcauagggccacccgccaguuccggaccuacccuuuucagaccagagccgaucgcaucugccgcugcagccgcugccacaguuaccagcacugguggcgggggaggcggugggggauccggcggcgggggagguucaaguggcaacgggggaggcggugggggaggcggcgggggaagcaauugcaaccccaaucuggcggcagccucuaacgguuccggcgggggaggcggugggauuucagcuggcggaggcguggccagcaguacaccuaucaaugcaucuaccggguccagcucgucuuccucaaguagcuccucuagcucaaguuccucuagcucaaguagcuccucuucgagcuccuguggaccauugcccgguaagccuguauacucaacgccaagucccguggaaaacacuccgcagaauaacgagugcaaaauggucgacuuaaggggcgcuaagguggccucuuuuaccguugaagggugugagcugauuugccuaccucaggcguucgaucucuuucugaaacaccuugugggaggccugcauacagucuauacuaaguugaaacggcucgaaaucacccccgugguauguaauguugagcaagugcgcauacugcgaggucugggggccauccaaccaggcgucaaccguugcaagcucauuagcagaaaggacuucgagacauuauacaaugauuguaccaacgcauccucaaggccuggacggcccccaaaacgcacgcagagcgugacuucucccgaaaauucccacaucaugccucauagugugccaggccugaugagcccggggauuauacccccuacagacgagaccccacuuucuacucccacagcuagagauuccuuggacaagcugucacuaaccggacacggucagccucucccacccggcuuuccgaguccuuuccuguuuccagaugggcuuagcucgaucgaaacgcuguugaccaacauucagggacuccugaaagucgccaucgacaaugcuagggcccaagagaagcagguucaguuagagaaaacagaacugaagauggauuuccuccgggagcgcgaacuucgagagacucuggaaaagcaguuggcaauggagcagaaaaacagagccauugugcagaagaggcugaaaaaggagaaaaaggcuaaacggaagcuacaggaagcgcucgaguuugaaaccaagcgucgcgagcaagcagaacagacacugaaacaggccgcuuccacugacucucuuagaguacugaacgauagcuugacccccgagaucgaggccgacaggucaggcggucggacagaugcagaacgaaccauccaggacgggcgccucuaucugaagacuacggugauguacuga

SEQ ID NO: 55089 - RNA, 1716 nt, Artificial Sequence
  derived and/or modified sequence opt3 from DACH2__Homo_sapiens__NP_001132986
auggccgugagcgcuucccccgucaucucugcaaccucaaguggcgccgggguuccuggaggucuguucagagcggagccacucuacagcacaccgagggaacccccucggcuuacuccaaacaugauuaauuccuuugugguaaacaaucacucuaacucggcuggcgggggaggccgcgguaauacgaacaccaaugagugccgaaugguggacaugcaugggaugaaggucgccucauuccugauggauggacaggaauugauauguuuaccccaaguguuugaccuguuccuaaaacaccucguuggcggccugcauacaguguauacuaaacuuaaacgucuggauaucagcccugucgugugcaccguagagcagguuagaauuuugagggggcucggagcaauccagccaggugugaaccgguguaagcugauuacacgcaaagacuuugaaacccuguucacugauugcacaaaugccaguuccagacccggcaggccuccaaagcggucucucggggucuuacaggagaacgcucgccugcuuacccacgcagugccgggauugcugagccccggccuaaucacgccuacugguauaaccgccgcugccauggcggaggcaaugaagcuccaaaagaugaagcugauggccaugaauacacuucaggggaacggaucccagaauggcacugaaucagagccagacgaucugaacaguaauaccggcgggagcgaaucuuccugggacaaagauaagaugcagucacccuuugcugccccuggaccacaacaugguaucgcacacgcugccuuggcgggccagcccgggauuggaggcgccccgacacucaacccucugcagcagaaccacuuacugaccaaucgacucgaccuucccuucaugaugaugccacauccucuguugcccgugagccuaccacccgcaagugucgcuauggccaugaaccaaaugaaucaccugaacacgaucgcuaauauggccgcagccgcucagauucauucuccucucuccagagcggguacuagcguuaucaaagagaggauaccagagucgccgucucccgcaccuucccuggaagagaaccaccggccagggucacagacaaguagccacaccuccucuagcgugucaaguucccccagccaaauggaucaucaccuugaacguauggaggaaguaccugugcagauuccaaucaugaagucuccccuggacaagauucaguugacuccgggccaggcccucccugcuggauuuccaggccccuucaucuuugccgauucacugaguagcgucgagacauuacugaccaauauccaagggcuacucaaaguggcacuggacaacgcccgcauucaggagaagcagauacagcaagagaaaaaggagcuuagauuggaacuguacagggagcgggaaauccgagagaaucucgagcgccagcuggcuguugaacuucaguccagaacgaccaugcagaaaaggcugaagaaagagaagaagacaaaacggaaguugcaagaagcccucgaguucgaaucuaaacgcagagaacagguggagcaggcacugaagcaggcgacuaccucggacagcggauuaaggaugcugaaagauacagguauuccugacaucgaaauagagaacaauggcacuccccaugauuccgcugccaugcaagcauga

SEQ ID NO: 55090 - RNA, 2400 nt, Artificial Sequence
  derived and/or modified sequence opt3 from DACT1__Homo_sapiens__NP_001072988
augaagcccagcccugccggcaccgcuaaagagcuggaaccaccggcacccgccagaggggagcagaggacagcggaaccugagggacgguggcgcgaaaagggugaggcugacacugagcgacaacguacgagagaaaggcaggaggccacccucgcaggccuugccgaacuggaguacuugcggcagcgccaggaguuacuggugagaggggcucuaaggggagcaggcggugccggggcugccgcgccacgggcaggagaacuccugggcgaggccgcucaacgcucccgacuugaagagaaauuccuggaagagaacaucuugcuccugagaaagcagcugaauugccucaggcggcgugaugccggcuuacugaaccagcuucaggaguuggacaaacaaauuucugaucugcgccuagacgucgaaaagacaucagaggaacaccucgagacugauaguagacccagcuccggguuuuaugaacugucugacggagcaucggguucacuuagcaauaguuccaacucuguuuucagcgagugucuguccucaugccauaguagcaccuguuuuugcucuccuuuggaggcuacacucucccugucagauggcuguccaaagagcgccgacgugaaucccaaauaccagugcgauuuaguaaguaagaacgggaaugacguguauagguacccuucuccacugcacgcggucgccgugcaguccccgauguuccuccuuugucugaccggaaaccccuugcgggaagaggaucgacuaggcaaucaugcaagcgacauaugcggugggucggaacuggaugcuguuaaaacugacucuucccucccuucaccaaguagccugugguccgccucucaccccagcucaaguaagaaaauggacggauauauccuuucccuggugcagaagaagacacauccuguccgcaccaacaaaccaagaacgagcgugaaugcugaucccacuaagggcuugcucaggaacggcucuguauguguucgggcccccgggggagugucacaagguaauagugucaaccugaaaaauagcaagcaggcaugcuuaccuuccggcgggauucccucucugaacaacggaaccuuuucgccaccuaaacaguggagcaaggaguccaaagccgaacaagcugagucaaagcgcgugccccuaccagagggcugucccaguggugcggcaucugaccuccagagcaagcaucugccuaaaacagccaagccagcuucccaggaacacgccagaugcucagcaaucgggacuggcgagagcccgaaagaaucugcccagcuuuccggagcuagucccaaggagagcccuucuaggggcccagccccgccucaagagaauaaagugguccagccauugaagaagaugucccagaaaaacucacugcaggggguucccccggcaaccccuccacuccugaguacagcguuccccguggaggaacguccugcucuugauuuuaagagcgaaggaucgucccaaucucuggaggaagcccacuugguaaaagcacaguucauucccggucagcagccaagcgugcggcuccaccgaggccauagaaauaugggggucgugaagaacucaagucugaaacacaggggaccugccuuacaaggccuggagaauggucuacccaccguucgcgagaagacgcgggcuggguccaagaaaugcagauuuccagacgaucucgacacuaacaagaaacugaagaaagccucuagcaagggcaggaaguccggaggcgggccggaagcaggagugccuggucgccccgcuggcgggggacaccgagccggcucacgggcgcauggucacgggcgugaggccgucguggcuaaaccaaagcauaaaagaacagauuacaggcgcuggaaaagcagugcagaaaucucuuaugaggaagcccuucggagagcuaggcgaggccgccgggagaauguaggauuguaccccgccccuguuccacugcccuacgcauccccuuaugcguacguggccagcgacucggaguauucagcugaaugugagucucucuuccacaguaccgucguggauacuuccgaagacgagcagagcaacuacacaaccaauugcuuuggcgauucugaaagcuccgucucagagggggaguucgugggagaaaguacgaccacaagcgacucugaggaauccggcggucugauauggucacaguuuguucagacuuuaccgauccaaaccgugacagccccagaccugcauaaccaccccgcaaagacuuucguaaagauuaaagcuagucacaaucuuaagaagaaaaucuugagauucaggagcgggucccucaagcugaugaccacagucuga

SEQ ID NO: 55091 - RNA, 843 nt, Artificial Sequence
  derived and/or modified sequence opt3 from DACT2__Homo_sapiens__NP_001273280
auguggacccccggcgggccuccaggaagcgccgguugggacagaaggcggcugggcgcucgccuccgagcagccuucgcggggcuucaggagcugcaaggauugcgugcuacacagcaggaaagagugaggggcgccuuagcacugcagccgcccccugccccagcugcacccugcgguccucacgggcuacauggaccagagcaacagcucgaagccgcucuggccgcgcuucaggagcagcugucccgguugcgccaacaggauaucggccucaagacucaccuggaccagcuggaucuccagauuucuaaauuacaacuggacgucggcacggcaucaggggaagcccuugauagugacagcagacccuccucuggauuuuacgagaugucggaugguggcucauguagcuugaguaccuccugcgcuucuguuuguagcgaccauauauccccuucacuggggagucuacucccaguggcccaggcacacaaggcuaggccgagcaugggagauuggcggccccgcucuguagacgagacaacugugccugccuggcgaccacaggcgaccgaagagggcgccagacccccugguuccgucgaagaugcagggcaaccauggggaacauucuggcccaggccggugucaaccgagcugugcaacgcuccuggcgagcuugacaugcaugcucccccagccggcuguacuagcaguucucugacagggguuggauccgguuugcggggcaaaugcgggcucuguggaugccagcugccuuuuuguagcgugaauaccucgucuaagacgaaauccucaggcaucagucgucagcaguga

SEQ ID NO: 55092 - RNA, 1890 nt, Artificial Sequence
  derived and/or modified sequence opt3 from DACT3__Homo_sapiens__NP_659493
augaucagagccuucagcuuucccguguccccugagaggggccggcugcgcggguggcucgaaggaucucuugcuggucugugcgaguugcacugguuacgagaacgucaggaguacagaguccaacaggcacugaggcuagcccagccaggcaugggaggggcggaagcugaggacgaggaagaugccgacgaggaugaagacgcagccgcugcacggcgcgccgcugccgcgcucgaggagcagcuggaagcacuuccgggccugguuugggauuugggucaacagcucggggaccugucacuggagaguggaggccucgaacaggagagcggcagauccucuggguucuaugaagaucccucgucaaccggagguccugacagcccacccaguacauuuuguggcgauuccggguucucuggaagcuccucauacggcagguuagguccuagugagccacgggggauuuaugccagcgagcgccccaagucucugggagacgcuuccccuucagccccagaagugguaggcgcacgagcugccgugccgagaaguuuuagugcgcccuacccuacugccggcgggucugcaggaccagaggcuugcuccagcgccgaaaggcgggcucgugccggucccuuccuuacgccuucgccauugcaugcagucgccaugcgcucucccagaccguguggcaggccucccaccgauuccccagacgcugggggagcgggccggccucuggaugguuauauaucagcacuacuccgacgcagaaggcggcgcggggccggccagcccagaacaaguccaggaggcgcugacgggggacccaggcgucaaaacagcgugcggcagcgaccuccagacgccuccccgucucccgguagcgcaagaccugccagggagccaucacuggaacgcguuggcgggcaccccacuagcccugcugcccuuucccgggcaugggcgagcucuugggagucagaggcugccccagaacccgcagccccgccugcugccccaagucccccugauagccccgcagagggaagacuggugaaagcucaguacaucccaggcgcccaggcggccaccagggguuugccugggcgcgcugcacgacggaagcccccaccgcucacacguggcagauccgucgaacaaucuccucccagggagcgcccacgggccgcuggaagaaggggccgaauggccgaagcaucggggcgccggggaagccccagagcgaggaaagccucccguucacagagugagaccucucuguuaggucgcgcuagcgccgugccuuccggcccacccaaguauccuacugcagagcgggaggaaccgagaccacccaggccucgacgggggccagcucccacacuggccgcacaggccgcuggaucaugccgcagauggaggagcaccgcggaaauugacgccgcagauggccggcgaguaagaccucgcgcuccggccgccaggguucccgguccagggccuucucccuccgcuccacaacgucggcuccuuuacggcugugcaggaagugacagcgagugcucugccggcagacuggggccuuugggaaggcgcggccccgcggguggggugggaggcgguuacggcgaguccgaaucaagugcuagcgagggggaaucgccagccuuuuccucugcaagcucagauagugacggauccggcgggcuagucuggccgcagcagcugguggccgcuacggcagccucuggaggcggugcgggggcuggagccccugcaggccccgccaaaguguucgucaagaucaaggcuagccaugcccucaaaaagaaaauucugcgauuuagauccgguucacuuaagguuaugacuaccguguga

SEQ ID NO: 55093 - RNA, 342 nt, Artificial Sequence
  derived and/or modified sequence opt3 from DAD1__Homo_sapiens__NP_001335
augagcgccuccguggucucuguuaucucaagauuccuggaggaauaccucaguagcacaccccagaggcuuaagcuguuggacgcuuauuuacuguacauucuacucaccggcgcacugcaauuuggguauugccuucuggugggaacuuucccuuuuaacuccuucuugucugguuuuauaucguguguaggcucauucauccucgccgugugccugcggauucagaucaauccacagaacaaagcggauuuucaggggauuagcccggagcgcgcuuucgccgacuuucuguucgcaaguacgauccuccacuuagucgugaugaauuuuguuggauga

SEQ ID NO: 55094 - RNA, 2688 nt, Artificial Sequence
  derived and/or modified sequence opt3 from DAG1__Homo_sapiens__NP_001171113
augagaaugagcgugggccugucccuccuucugcccuugugggggaggaccuucuuacugcuacucucugucguuauggcccagucacacuggccuagugagccaagcgaagcugugcgggacugggagaaccaacuggaagcauccaugcauucuguacuuucggaucugcacgaggccgugccgacagucgugggaauccccgacgguacugcgguugugggccgcucauuucgagucacgauuccuaccgauuugauagcuagcaguggggacaucauuaagguguccgccgcaggaaaagaagcccucccaucuuggcugcauugggauagccagucccacacacuggagggccuccccuuagacacugauaaggguguacauuacaucucaguuagugcuacccgucugggggcaaauggaagccacauuccucagacaucuuccguguucucaaucgaggucuauccagaagaccacagcgagcuucagagugugagaaccgccucucccgauccuggcgaaguggucuccagcgcuugcgccgcggacgagccaguuacuguguugacaguaauacuggaugcagaccuaaccaaaaugacgccgaagcaaaggaucgaucuccugcaucggaugcgcucguuuucugagguggaacuucacaacaugaaacugguccccgugguuaauaacagauuguucgacauguccgccuuuauggcuggcccugggaaugccaagaagguggucgagaacggagcacuccugucauggaaauuagguuguagucugaaucagaacagcgugccagacauucauggcguagaagcucccgccagggagggggcgauguccgcccagcucggauacccuguugugggcuggcacaucgcaaauaagaaaccaccccuuccgaagcggguccgccgacagauucacgcuacuccuacccccgugacagccaucgguccaccuacuaccgcuauacaagaacccccaucuagaauuguccccacaccuaccagcccagccaucgcaccgcccacggagacuauggccccuccagugagggaucccguuccugggaaaccaacagugaccauucggacucguggagcuaucauccagacacccacccugggcccgauucagccuacgcgcguaucagaggcgggcaccacagucccagggcagauaagacccacuaugaccaucccuggauauguggaacccacagcaguugccacuccaccuaccacaaccacuaagaagcccagggugaguacgccaaaaccggcuacaccuuccaccgacagcacuaccacaaccacucggcgacccacaaagaaaccacgcacgcccagaccugucccaagggugaccacuaagguaucuauuacacgguuggagaccgccucacccccuacacgcaucagaacuaccacgaguggugugccgaggggcggggaaccaaaccaacgucccgagcuaaagaaucauauagaucggguugacgcaugggucggaaccuacuucgaagugaagauuccuagcgauacauuuuaugaccacgaggauacuaccacagacaaacugaagcucacucugaaacuucgagagcagcagcuggugggcgaaaaauccuggguccaauucaacucuaauucgcaguugauguacggucucccagauagcucccauguugggaagcacgaguauuuuaugcaugccaccgacaaaggcggacugucagcuguggaugccuucgaaauccacgugcacagaaggccccagggcgaccgcgcacccgcgcgguuuaaggcuaaauucguaggggacccggccuuaguccugaacgauauccauaagaagauugcccuagugaaaaagcucgccuuugcuuucggagacagaaauugcaguacgaucacacugcagaacauuaccagggguucuauaguuguggaguggacuaacaauacacuucccuuggaaccauguccuaaagagcaaaucgccggccugagccgccgaauugcagaggaugacgggaagccccggccagcuuucuccaacgcccucgaaccugauuuuaaagcgaccucaaucacugucaccggaagcggcucuugccgucaccuccaguucauccccgugguuccaccgagaagggugccuuccgaggcacccccaacagaaguacccgaccgcgauccugagaagaguagcgaggacgaugucuaccuucauacggugauuccagcuguggucguugcagccauacuguugaucgcugguauuaucgccaugauuuguuaccggaagaaaagaaaggggaaacucacccuggaagaccaggcaacuuuuaucaagaaaggcgugcccauaaucuucgcggaugaguuagacgauucuaagccuccgccauccucaaguaugccccugauucuacaggaagagaaggccccucugcccccaccugaauaucccaaucaaagcguaccagagacaaccccucugaaccaggacacaaugggagaguacacuccgcuuagggacgaagaucccaaugcuccaccuuaucagcccccaccucccuuuaccgccccgauggagggcaaagggucgcgaccaaagaacaugacgccuuaccgcuccccuccacccuaugugccuccguga

SEQ ID NO: 55095 - RNA, 570 nt, Artificial Sequence
  derived and/or modified sequence opt3 from DAND5__Homo_sapiens__NP_689867
augcugcucggccagcuuagcacccuguugugcuuacuguccggggcccuacccacaggaucugguagaccugagccacaaucaccgaggccccagaguugggcugcagccaaccagacuugggcgcucggcccuggggcucugccaccccuugugccugccagcgcacugggauccuggaaagccuucuugggccuccagaaagcucggcaacuggguauggggcgccugcagcgaggacaggacgaagucgcagccguuacgcucccauuaaauccccaggaggugauccaaggcauguguaaggcuguaccuuuugugcaggucuucucucguccaggcugcucggccauuagacugaggaaccaccuuuguuuugggcauugcagcucauuguacauaccgggaagugaucccaccccucuggugcuauguaauuccugcaugccagcgcggaaacgcugggcacccguugugcucuggugucugacagguucuagcgccuccagaaggcgggucaagaucucaacuaugcuuauugaaggcugccacuguaguccuaaggcuuga

SEQ ID NO: 55096 - RNA, 378 nt, Artificial Sequence
  derived and/or modified sequence opt3 from DAOA__Homo_sapiens__NP_001155284
augagaaccgccaucuggaaguggcacaggggcauuuaccgggaccauuaugugcuggggagccucacauuccuuucccccaugcagcgcgcuggaacuucuaaccaauggaauauggguaaagucaugacgcuggauucaggcgacgagguuaccuuucacaagacauggccuacugaaaccgggaguccauaccgauuggaggaagugagcucccauguaggaaaaguguucauggcacguaacuaugaguuuuuagccuacgaagcgucuaaggauagaaggcagccgcuggagcggauguggacaugcaauuauaaccagcagaaagaccaaucguguaaucacaaggagauaaccucaacuaaggcugaauga

SEQ ID NO: 55097 - RNA, 1044 nt, Artificial Sequence
  derived and/or modified sequence opt3 from DAO__Homo_sapiens__XP_011536307
augagaguggucguuaucggcgccggggugauuggacugagcaccgcucucugcauacacgaaagguaccauuccguacuucagccccuggacaucaagguguaugcagaucgguucacaccuuugacuacgaccgacgucgccgcggguuuauggcaaccauaccugucugauccgaacaauccccaggaagcugacuggucacagcagacauuugauuaucuacucagucacgugcauagcccuaacgccgagaaucugggccuuuuccugauuuccggguacaacuuguuucacgaagcaaucccagaccccucuuggaaagauacuguucucggauuccgcaagcugaccccucgagagcuggacauguuuccagauuauggcuacgguugguuccauacaucgcucauuuuagaagggaaaaauuaucugcaauggcuuaccgagcguuugacugagagaggagugaaguuuuuccagaggaaagucgaaucauuugaggaaguggcccgggagggcgcugacguaaucguuaacuguacaggcgugugggcaggggcccugcagcgcgauccccuacuccagccuggaagaggucaaauaaugaaggucgacgcuccauggaugaagcacuucauccugacccacgauccggagaggggcauuuacaauagccccuacaucauuccugggacgcagacugugacccuuggaggcaucuuucagcuggguaacuggagugaauugaauaacauacaggaccauaauacaauuugggaggggugcugucggcucgaaccaacucugaaaaacgcccgcaucauuggagagcgaaccggcuucagacccgugaggccucaaauccgguuagaacgugagcagcugcgcacaggcccauccaauaccgaggucauccacaacuaugggcauggagguuacggccucacgauucacugggggugcgcgcuugaagcagccaagcuguuuggaagaauauuggaggagaaaaagcuaucuaggaugcccccgagccaccuguga

SEQ ID NO: 55098 - RNA, 1197 nt, Artificial Sequence
  derived and/or modified sequence opt3 from DAP3__Homo_sapiens__NP_001186778
augaugcugaagggcaucaccagacucauuagcaggauacacaaacuugaccccgggcgguuccugcauaugggaacacaggcccgccaauccaucgcugcacacuuggauaaccaggugccugucgagucuccacgagccauuucacguacuaaugaaaacgacccggcgaagcauggugaucagcacgagggccagcauuacaauaucaguccccaagacuuagaaacgguuuuuccucacgggcugccacccagauucgugaugcagguaaaaaccuuuagcgaggcuugccuaauggugaggaagccugcccucgaacugcuucacuaucugaaaaacacauccuucgcauacccagccauucgguauuugcucuacggagagaagggcacugguaagacccugucucugugucaugucauccacuuuugcgcuaaacaggauuggcucauauuacauauccccgacgcacaccugugggugaagaauugucgcgaucuuuugcagucgucauauaacaaacaaagauucgaccagccucuggaggccagcacauggcuaaagaauuuuaaaaccacuaacgaaagguuccucaaucagauuaagguucaggagaaguacguguggaacaaacgggaaaguacagagaagggguccccacugggagaggucguggaacaaggcaucacccgcguacgaaaugcuacggaugccguuggcauugugcuuaaagagcugaagagacagucuagcuuggggauguuucaccuccuggucgcgguggacggaaucaacgcauuaugggguaggacuacccugaaacgggaagauaaguccccgauagcccccgaggaacucgcucuugugcauaaucugcguaaaaugaugaagaacgacuggcacggcggggccauugucucagcauugagucagacaggaagccuauucaagccucgcaaggcuuaucugccacaagagcuccugggcaaagaggguuuugaugcccuugaccccuucaucccuauucugguuucuaauuacaacccaaaagaauuugaguccugcauccaguacuauuuggaaaacaauuggcuccagcaugagaaggcgcccacugaagaggggaaaaaggagcuguuauuccugucaaacgccaauccgagccuacucgaaagacacugugcauaccuguga

SEQ ID NO: 55099 - RNA, 615 nt, Artificial Sequence
  derived and/or modified sequence opt3 from DAP__Homo_sapiens__NP_001278892
augagcucucccccugagggcaagcuggaaaccaaagccgggcacccaccggcugugaaggcaggagguaugagaaucguccagaaacauccccacacaggcgacacuaaggaggaaaaagauaaggacgaucaagagugggaauccccuaggguuacgaagauuucaccacggcgccuccgacguuggcuuaccagaaguaggaugcccccuuggacaagcauacugccacaggagcccuccacuucuucgucacaugccagcgagccuggggugcaccagccagcgccguggccccgguugugcuguaccugguacuucccugaccgcgaaaaccagcaauuuagaccaaaucccacauuacugggaaaccuaaggcagaaucagguacucugcccucugccauauaucaguauuuucaaaacccggaacuccucuagccccaaucuuguguacggcgaguccgguuggaugucauuugaagaucauugugcuccgcgcggggccaucagucgaauuugccaggacccuagaaagauccuggcauugguccucuuccaacagagccccgaugugcugguuuauggacugaaaaacaagaaagcccacauauga

SEQ ID NO: 55100 - RNA, 4293 nt, Artificial Sequence
  derived and/or modified sequence opt3 from DAPK1__Homo_sapiens__NP_004929
augaccguguucagacaggagaacgucgacgauuacuaugacacaggcgaagaacuggggagcggacaauuugccguugugaagaaaugcagggaaaaguccacuggucuccaguacgcugcaaaauucaucaagaaacggcgcacgaagucuucacgacguggcguaaguagagaggauauugaaagggaggugagcauacuuaaggagauccagcaccccaaugucauuacccugcaugaaguguaugagaacaaaacagacguuaucuugauuuuagaacugguggccgggggagagcuauuugauuuccucgcggagaaggaaucccugacugaggaagaggcuaccgaauuucuuaaacagauccugaauggcgucuacuauuugcacucucuccaaauagcccauuucgaccugaagccugagaacaucaugcugcucgaucggaaugugccaaaaccgcgcauuaagaucauugacuuugguuuagcacacaagaucgauuucgggaacgaguuuaaaaauauauucggaacacccgaauuuguagccccugagauuguuaacuacgaaccacugggccuugaggcugacauguggucgaucggcgugauuaccuauaucuugcugucaggggcaagccccuuccuaggagauacuaagcaggaaacacucgccaaugucagugcugugaacuacgaguuugaggacgaauacuucuccaauaccucugcccuggcgaaagauuucaucagaaggcuucuggugaaggacccuaaaaagcggaugacgauucaggacagcuugcagcauccauggauaaaacccaaggauacucaacaggcacucucccgcaaggccucagcugucaacauggagaaauuuaagaaauucgccgcacgaaagaaauggaagcagaguguuagacugaucagcuuaugucagaggcugucucgguccuuucucucacguagcaauaugaguguggcucgcucugacgauacccuugacgaagaggauuccuucguaaugaaggccauuauccacgcgauaaacgacgauaaugugccuggucugcaacacuugcuaggcagccugucgaacuaugacgucaaccagccaaauaaacaugggacaccgccccuccugauugccgcaggaugcggcaacauccagauccuucaacuguugauuaagagagguucuaggaucgaugugcaggacaaagggggauccaaugcuguuuacugggccgcucggcacggccauguggauacucucaaguuucugucagaaaacaaauguccuuuagacgucaaggacaagaguggcgagauggcccugcacguggcagcccgauaugggcacgcugauguagcgcagcuacucugcagcuucggauccaauccaaacauucaggacaaagaggaagagacuccccugcauugugcagccuggcacgguuacuauucuguugcuaaggcccuuugcgaagcaggcuguaaugugaacauuaaaaaucgcgagggggagacaccuuugcugaccgccagcgcuagaggauaccaugauaucgucgaaugccucgccgagcacggcgcagaccugaacgcgugugauaaggacggucauauugcucuacaccuggccgugaggcggugccaaauggaagucaucaaaacguugcucucacagggguguuuuguggauuaucaggaccgccacggcaauacuccacugcauguugcaugcaaggauggaaacaugcccaucgugguagccuuaugcgaggcuaauuguaaccuggacauuaguaauaaguacggcagaacaccgcuacaccucgccgcaaacaacgggauacuggaugucgugagguaccuuugcuugaugggagcuuccguugaagcccugaccacugacgguaaaacagcggaggaucucgcccguagcgagcagcaugaacacguggcuggccuguuagcacggcugcgaaaggacacccacagagggcuuuucauccaacaguugaggccuacgcagaaucuccagccccgcauuaaacugaagcuauuuggacauucuggcucagguaaaaccacacuggucgagagucucaagugugggcugcuucggagcuucuuuagaaggcgccgaccacgguuguccucuacuaacucgagccguuucccucccuccccacuggccucaaaacccaccgugaguguaucuaucaauaacuuauauccuggcugcgaaaaugugagcguuagauccaggucaaugauguuugagccaggacucacaaagggcaugcuggaagucuucguggcuccgacucaccauccccacuguagcgccgacgaucaaucuaccaaggcaauugacauccagaacgcguaccuuaauggggugggagauuucuccgucugggaguuuagugguaacccuguuuauuucugcuguuacgacuauuuugccgcuaaugauccaacaagcauacauguggugguauucucucuggaggaacccuacgagauccaguugaaccaggucauauuuuggcucuccuuccugaaaucacuugugccuguugaggagccaaucgccuuuggcgggaagcugaaaaauccccuccaagugguccugguggcaacccacgcugacauuaugaacguuccgcgcccugccggaggcgaguucgguuaugauaaggacaccagucuuuugaaagaaauccggaauagauuugggaacgaucugcacauaagcaauaaguuauucgugcucgacgcaggcgccucgggauccaaggauaugaaaguacugaggaaccaucuucaggagauucgaucucagaucgucagcgugugcccacccaugacgcaccugugugaaaagauuaucucaacacuaccuaguuggcgcaaacucaacggccccaaucaacugauguccuugcagcaguuuguguacgacguccaggaucaacugaacccauuagcuucugaggaagaccuccggagaauagcgcagcagcugcauagcaccggggagaucaauauuaugcaguccgagacuguucaagacgugcuucuguuggauccuagguggcucugcaccaacguacugggaaagcuacugucaguggaaacaccccgugcccuucaccauuaccgcggccgguauaccgucgaggacauccagagacucgugccagauagcgacguugaggaacuguugcagauucuggaugcaauggacaucugugcuagggauuuaaguucugguacuaugguggacgucccggcccucauaaaaacagauaaucugcaccgauccugggccgacgaagaggaugaggugaugguuuacgggggagugcggauugucccuguagaacaccuuacgcccuucccaugcggcaucuuucauaaggugcagguuaaccugugccgcuggauccaccaacagagcaccgagggugacgcugacauuagauugugggugaauggcuguaagcucgcaaacaggggagccgaacugcuaguccugcuugugaaucaugggcagggcaucgagguacaagugcgggggcucgaaacugagaaaauuaagugcugucuguuguuagauucggucugcucaacaauagagaacguuauggcgaccacacugcccggacuccugacugugaaacacuaucuuucuccucagcagcugcgagaacaccaugagccagugaugaucuaccagcccagagacuucuuccgcgcucaaaccuugaaggaaacgagucuaaccaauacaaugggcgguuauaaagaguccuuuagcucuauuauguguuucgggugccacgaugucuacagccaggccucccugggaauggacauccaugcaucagaucucaaccugcuuacuaggcguaaguuaagucggcugcucgacccuccggauccauugggcaaggacuggugucugcucgccaugaaucugggucuucccgaucugguggcuaaauauaacaccagcaauggcgcaccuaaggacuuuuugccaucuccccuacacgcccugcucagagaauggacaacuuacccugaguccaccguugggacguuaaugucaaaacugagggagcuuggacgccgagaugcggcugacuuccugcucaaggccaguagcguauuuaaaauuaacuuggauggcaacgggcaggaagcauacgccuccucuugcaauucgggaacaagcuauaacucaaucuccaguguggucucuagauga

SEQ ID NO: 55101 - RNA, 1113 nt, Artificial Sequence
  derived and/or modified sequence opt3 from DAPK2__Homo_sapiens__NP_055141
auguuccaggccagcaugagaucccccaacauggagccuuuuaagcaacagaaaguggaagacuucuacgauaucggcgaggaacuggggucuggacaguuugcuauugucaagaaaugcagggagaagucaaccggucucgaauaugcagccaaauucauaaagaagcggcagagucgcgcgagccgacguggcguuuccagagaggagaucgaaagggaggugucuauucuucggcaaguacugcaccauaaugugaucacauugcacgacgucuacgaaaaccgcacugaugugguuuuaauucuggagcuagugagugggggagagcucuuugacuuccuggcucagaaagaaucacuuagcgaggaagaggccacgaguuuuaucaagcagauacuggauggcgucaauuauuugcauaccaaaaagaucgcacacuucgaccucaaaccagaaaacauuaugcugcuggauaagaauaucccgauuccccauaucaagcucauagacuuugguuuagcccacgagauugaggaugggguggaauuuaaaaacaucuucggaacaccugaguucguagcuccagaaauuguuaauuacgagccccugggccuugaagcagacaugugguccaucggcgugaucacuuauauuuugcugucuggggccagcccuuuucuaggagauaccaagcaggagacacucgcuaacauaaccgccgucuccuacgacuucgaugaggaguucuuuucacaaacuucggaacuggcgaaagacuucaucagaaaacuucuggugaaggaaacaaggaagcgguugaccauucaggaggcacuccgccacccauggaucacgcccguggacaaucagcaggccaugguccgaagagaaagcguugugaaccuggagaauuuuaggaaacaauauguacggcgucgcuggaaguuaucuuucuccauagugucacuguguaaccaucucacuagaagccuuaugaagaaaguccaccugaggccugaugaggacuugcggaauugcgaaagugauaccgaggaagacauugcucgacgcaaggcccuacauccaagaaggcggucuuccacaagcuga

SEQ ID NO: 55102 - RNA, 1365 nt, Artificial Sequence
  derived and/or modified sequence opt3 from DAPK3__Homo_sapiens__XP_005259565
augagcaccuucagacaggaggacguggaagaucacuacgagaugggcgaggaacugggguccggacaauuugccaucgucaggaagugccggcagaaagguacaggcaaggaauaugcugcaaaauucauuaagaaacgccgacucucuucaagucguagagggguuagcagggaggagauagaacgggaggugaacauccuucgcgaaauuagacaucccaauaucauuacucugcacgacaucuuugagaacaagacggauguaguguugauauuagagcuggucuccggaggcgaacuauucgacuuucucgccgagaaggaaucucugaccgaggaugaagcgacacaguuccuuaaacagauccuggacggugugcauuacuugcacucgaagaggauugcucauuuugaucucaaaccugagaauaucaugcugcuggacaagaacguuccaaauccgcggauuaaacucaucgauuucgggauagcccacaagauugaggcaggaaacgaauuuaagaauaucuucggcacucccgaguuuguggccccugaaauugucaacuaugagccauuaggccuggaagcugacauguggucaaucggggugaucaccuacauucuuuugagcggagcaagucccuuccugggugagacaaaacaagagacccuaacuaauauauccgccguaaacuaugauuuugacgaagaguacuucucuaauacaagcgaacucgcuaaggauuucauccgccgacugcuuguuaaagacccuaagagaaggaugaccauugcccagucccuggagcacucauggaucaaagcgauacggcgucgcaacgugagaggcgaagacagugggaggaagccagagcggcgacgcuugaaaacgacuagacucaaggaguauaccauuaagagccauucuucccugcccccuaauaacucauacgcagauuuugaaagguucagcaaagucuuagaggaagccgcugccgcagaggagggacugcgggaacuccagcgcaguagaaggcuuugucacgaggacguggaagcucuggccgcgaucuacgaggaaaaggaggccugguaucgugaggaaucugauuccuugggccaggaccuacggcgacugagacaagagcuccugaaaacagaagcacuuaagaggcaggcucaggaggaagccaaaggugcucuguuggggacuagcggacucaagcgccgguuuucgagacuggagaauagguacgaggccuuagcaaaacagguggccucugaaaugcgcuucguccaagaucugguucgagcucuagagcaggaaaagcuccagggcguggagugcggccugcgguga

SEQ ID NO: 55103 - RNA, 1938 nt, Artificial Sequence
  derived and/or modified sequence opt3 from DARS2__Homo_sapiens__NP_060592
auguacuuccccagcuggcugucccagcucuauagaggccuuucuaggccuauccggcgcaccacacaaccaauuugggggucacuguaccgaaguuuguuacagagcucccagcguagaauaccggaguuuucuucguucguggucaggacuaacacgugcggagaacugcggucaagccaccuaggucaggagguuacccucuguggcuggauccaauaucgcagacagaauacauuucuggugcuuagggacuucgaugggcugguacaggugauuaucccccaggacgaaagugccgcuuccgucaagaaaauuuugugcgaggcaccuguggaaucuguugugcaagucagcggaacugugaucucccggccagccggccaggagaaccccaagaugccuaccggugagauagaaaucaaaguaaagacagcggagcuccugaaugcuuguaaaaagcugccauuugaaauuaagaacuucguuaaaaagaccgaggcccuccgcuuacaguaccgauaucuggaucuuagaucauuucagaugcaauacaauuugaggcugcggagucagauggugaugaaaaugcgugaguaucuaugcaaccuccauggguucgucgacaucgaaacucccacacuguuuaagcgcaccccuggaggcgcaaaagaguuccuugugccaagcagagaaccgggcaaguuuuacucucugccccaguccccucaacaguucaagcaguugcucauggucgggggacuggauagguacuuucagguggcccgguguuaucgagacgaggguucacgcccagauagacaacccgaguucacgcagauugacaucgaaaugagcuucguugaucagacuggcauacagaguuuaauugaggggcugcuccaauacucuuggccuaaugacaaagauccagugguagugcccuuuccgaccaugacauucgcugaaguccuugcaacuuauggaaccgacaagccugauacaagguuuggcaugaaaaucauugacaucuccgacguguuccggaacaccgagaucgguuuucugcaggaugccuugagcaagccccacgggacgguuaaagcuauuugcauaccagaaggagccaaguaccuaaaacgcaaggacaucgagucgauuagaaauuucgcggcagaucauuuuaaccaggaaauccugccuguguuccucaaugccaacaggaauuggaacucucccgucgcuaauuuuauaauggagucccagcgucuggagcuuauucggcugauggaaacucaagaggaagacgugguauugcucacagccggcgagcacaacaaggcauguucacuguuaggcaaacugcgacuagaaugcgcugaucuccuggagaccagagggguugugcuuagggacccaacuuuguucaguuuucugugggucguggauuucccccucuuucugccuaaggaggaaaacccacgcgagcuugaaagcgcccaucacccguucacagcgccccacccuuccgacauccaucuguuguauaccgagcccaaaaaggcccggucucagcacuacgaucucguccugaauggaaacgagaucgguggcgggagcauuagaauccauaaugcagaauuacagagguauauucuggcuacgcuacucaaagaggacgugaagaugcugucacaccuuuugcaggcccuggauuacggagcuccaccucacggcgguauagcccucgggcuggaccgcuuaaucugucugguuaccggcaguccauccauucgagacgugaucgcauuccccaagagcuuucggggacaugaucuuaugucuaacacaccggacucaguaccuccagaagaguugaaacccuaccacauccgugucaguaagccuacugauagcaaagccgaaagagcucauuga

SEQ ID NO: 55104 - RNA, 1206 nt, Artificial Sequence
  derived and/or modified sequence opt3 from DARS__Homo_sapiens__NP_001280241
auggugaaguucgccgcuaacaucaauaaagagagcauugucgacguugaaggcgugguaagaaaggugaaccagaaaauaggguccugcacccaacaggaugucgagcugcacgugcagaagaucuacguuauuucucucgcagaacccaggcuuccucugcaguuggacgaugccgugcggccagaggcggaaggagaggaggaaggucgcgcuacagucaaucaagacacucgauuagauaaccgugugaucgaccugagaacgucaaccagucaggccguauuuaggcuacagagcggcauuugucaucucuuccgggagacacugaucaauaaaggguuuguugaaauacagacuccgaagaucauuuccgcagccucugagggaggcgcuaacguguucaccgucucguauuuuaagaauaacgcauaccuugcccaaucaccccagcuguauaaacagaugugcaucugugcugauuucgagaagguguuuagcauugguccuguguuccgcgccgaagacaguaauacacacagacauuugaccgaguuugucgggcucgauaucgaaauggcguucaacuaccacuaucaugagguuauggaagagauagcagacacuauggugcagauuuuuaaaggacugcaagagagguuccagacagaaauccagaccguaaauaagcaauuuccaugcgagcccuucaaauuccuggaaccuacgcuccgguuagaguacugugaagcccuggcuaugcuucgcgaggccggcguggagaugggcgaugaagacgauuuguccacuccaaacgagaagcugcuagggcaccucgucaaggaaaaauaugacaccgacuuuuacauucuggauaaguacccccuugcagugcgaccuuucuauacaaugccagacccgagaaaucccaaacagucuaacagcuacgauauguuuaugaggggagaggaaauccuguccggugcucagcggauccacgacccucaguugcucacugagcgugcccugcaucacggcauugauuuagagaagauaaaagcguauaucgacucauuccgcuuuggggccccaccccaugcaggaggcgguauugggcuggaaagaguuaccaugcuuuuccucggacugcacaaugugaggcaaacaaguauguuuccucgggauccaaagcgauugacccccuga

SEQ ID NO: 55105 - RNA, 1248 nt, Artificial Sequence
  derived and/or modified sequence opt3 from DAW1__Homo_sapiens__NP_849143
augaagcugaaaagccuccuucugagauacuaucccccuggcaucauguuggaguacgaaaagcacggggaguuaaaaaccaaguccauugaccugcuagaucucggaccaucuacagacgugucagcccuggucgaagagauacagaaagcugaaccgcuucugacugcaaguaggacggagcaaguuaaguugcucauccagcggcugcaggagaagcugggucagaacagcaaucauaccuucuaucucuuuaaaguguuaaaggcccacauucugccccuuacaaacguagcguugaauaaauccggcucuugcuucaucacugggucguacgaucgcaccuguaagcugugggacacagcuucaggagaggaacuaaacacccucgaaggccaucgaaauguggucuaugccauugcauuuaacaauccuuacggugauaaaaucgccacugggagcuucgacaagacaugcaagcuguggaguguggagaccggaaaauguuaucacacguuucguggccauacugcugagauaguuugccuuuccuucaacccacaaucuacccugguggcaacaggcagcauggauacuaccgccaaguugugggacauccagaauggggaagaggucuacacacucagaggacacuccgcugaaauuaucucacugaguuuuaacaccagcggugauaggauuaucacgggcucuuucgaccacacugugguaguuugggaugccgacacagggcggaaagugaauauauuaauuggacauugugcggagaucuccucagcaucguuuaacugggauugcagucugauucucaccggcucuauggacaagacuuguaaacuuugggacgccacaaaugguaagugcgucgcuacccugacggggcacgaugacgaaaucuuggauuccuguuucgacuacaccggaaaacuaaucgccacagcaagcgcugauggcacugcccgcauuuuuagcgcggccaccagaaagugcauagcaaagcuggagggccaugagggggaaaucucuaaaauuuccuucaacccccagggaaaucaccuccugacagguucaagugacaagacugcuaggaucugggaugcccagaccggccaaugucuucaggugcuggaggggcacacagacgaaauauuuagcugcgcuuucaacuauaaaggaaacauugugaucaccggcuccaaggauaauacuugccggaucuggcgcuga

SEQ ID NO: 55106 - RNA, 2259 nt, Artificial Sequence
  derived and/or modified sequence opt3 from DAXX__Homo_sapiens__NP_001135442
augagaggcagcgagaacugcggggaaggaaggcuggagcggcgcuuccucuccaucauugugcuugacgaugacgaugaagacgaggccgcugcacagcccgguccuucucacccacugccgaaugccgcgucacccggcgcugaagccccuaguagcuccgagccacauggggcacgaggaucuucgucaagcggcgguaagaaauguuacaaguuggagaacgaaaaauuauuugaggaguuccuggagcuaugcaagaugcaaaccgccgaucaccccgaggucguuccuuuucucuauaaucgucagcagagagcucauagucuguuccuugcauccgccgaauuuuguaacauacugucuaggguguugagccgggcucgcuccagaccagccaaacucuacguauauaucaaugagcugugcacagugcugaaggcgcacucagcaaagaaaaagcucaacuuagcccccgcugccacuacgaguaaugaaccuagcgggaacaauccaccgacccaucugucucuugaccccacaaacgcagagaauacugcuucccagucaccuaggacccggggaagccgccgacaaauucagagauuggaacagcugcuagcccucuacgucgcggagaucaggcggcugcaggagaaagaacuugaucugagugaguuggacgauccagacucugccuaucuccaagaagcacgucugaagcgcaaauuaauuagacuguucggcaggcucugugagcuuaaggauugcuccagccugacaggccgggugaucgaacagcgaauacccuaccgcgggaccagauauccugagguuaacaggcggaucgagcgcuugauuaauaagccaggacccgacacuuuuccggauuacggugacgugcuaagagcugucgaaaaagccgcugccaggcacucgcugggccucccucgucagcagcugcaacuuauggcacaggacgccuuccgggauguggggauccgacugcaggagagaaggcacuuggaccucauuuacaacuuuggaugucaucugacagaugacuaucgccccggcguagauccagcuuuaucugacccuguucuggcgcggagacuaagggaaaaucgcucccucgcaaugucacgacuggaugaggugaucaguaaguacgccaugcuucaagacaaaagcgaagagggugagcggaagaaacguagagcuagguugcaggggaccuccucucacagcgccgauacgcccgaagcaucacuggacaguggagagggcccauccggcauggccagccaggggugccccucugcuucacgcgccgaaacugaugacgaggacgaugaggaaagugacgaggaagaggaagaggaggaagaggaagaggaagaggaggcaaccgauagcgaagaggaagaggaccucgaacagaugcaagagggacaggaggaugacgaagaggaagaugaggaggaagaggcggcugccgguaaggacggcgauaaauccccuaugucuucgcugcagauaagcaacgaaaagaaccuugagccagggaagcagauuucccggucaaguggagaacaacagaauaaaggcagaaucgucucuccgagccuguuguccgaggagccccucgcaccuucaagcauugacgccgaaucuaacggugagcagccagaagaacugacauuagaagaggagucccccgugagucagcuguucgaacuagagaucgaagcucucccucuggauacuccaagcucuguggagaccgacaucuccucaaguaggaagcaaagcgaagaacccuuuacaaccguccuugagaauggggccggcaugguuucguccacgucuuucaacggaggcgugagcccgcauaauuggggagauucagggccuccauguaaaaagagucgaaaagaaaagaagcagacugguuccggccccuuggggaacucuuauguagagcgccagcggagcgugcacgagaaaaauggaaagaaaauuugcacacugccuucacccccauccccucucgcaagccuggcucccgucgccgacaguucuaccagaguggacuccccaagccacggcuuaguuacuucgucacuguguauaccgucuccugcgaggcuuagucagacaccccauucccaaccaccccguccugguaccugcaagacgagcguggccacccagugcgauccagaggagaucauugucuugucugacagcgauuga

SEQ ID NO: 55107 - RNA, 2235 nt, Artificial Sequence
  derived and/or modified sequence opt3 from DAZ1__Homo_sapiens__NP_004072
augagcgccgcuaaccccgagaccccuaauuccacaaucucuagagaagcaucaacucagaguagcuccgccgcggcuucucaaggcugggugcugccagaggggaagauugucccgaacacgguuuucgugggagguauagacgccaggauggaugaaaccgagaucggcucgugcuuugggcgguacggaucaguaaaagaagugaagauuaucacaaaucgcacuggcgucagcaaagguuauggguucgugaguuuuguuaacgacguggauguccagaagauugugggaucccagauccacuuccauggcaaaaagcucaaacuuggccccgcaauacgaaagcagaagcugugugcccgucacguacaaccuagaccauugguugugaaucccccuccacccccucaguuucagaacgucuggaggaauccaaacaccgagacauacuuacagccgcaaaucacccccaauccugugacucagcaugugcagucugcugcaaacccagagacacccaauagcaccauuucccgggaagccucaacgcagaguagcucugcugccgcgucccaaggguggguccugccugagggaaaaaucguuccaaacacuguguucguagguggcauugacgcacgcauggaugaaaccgagaucgggucaugcuuuggaagauauggcagcgugaaggaggucaaaauaauuacaaauaggacuggugugaguaagggguacggauucguuucuuuugugaacgacgucgaugugcagaagaucguaggcucccagauucacuuccauggcaaaaagcuaaaacucgggcccgccauccggaagcaaaaacugugugcucgccacguucagccgcgaccucuuguggucaaucccccaccucccccacaguuucagaacguguggagaaaccccaauaccgaaacauaucugcaaccucagaucaccccaaacccggucacgcagcacgugcagagcgccgcaaaucccgagacuccuaacucgacaauuucuagggaggcuuccacccaaucaaguagcgccgcggccucccagggauggguuuugccagaagguaagauagugcccaauacuguauucgucggcgggaucgacgcacggauggaugaaacagagauuggaucuugcuuuggccguuacgguagcgugaaagagguuaagaucauaaccaaccgcacgggggugucaaagggcuauggauucgucaguuucgugaaugacguagaugugcagaaaauuguuggcucccagauccauuuucacgggaagaaacucaagcugggaccugcuaucagaaaacaaaagcugugugccaggcauguccagccacggccccucguggugaacccgccuccacccccucaguuccagaaugucuggcgaaaccccaauaccgaaacauacuuacaaccacagauuacuccuaaccccguuacccagcacgugcaggcuuacagcgccuauccacacucuccgggucaagugaucacaggcugccagcugcuuguauacaauuaucaggaguacccuacuuaucccgacucagcauuucaagucaccacaggguaccaguugccaguguauaacuaccagcccuucccugccuacccacgcagucccuuucagguuaccgcuggauaucaacugccuguguacaauuaucaggcguucccggcauacccaaacagccccuuucaggucgccacuggcuaucaguucccuguguacaacuaucaaccauuucccgcuuacccuuccucuccguuccagguuacggccgguuaccagcuacccguguauaauuaccaagcauuuccagccuauccuaacucgcccuuccagguagcuacaggguaccaguuuccagucuauaauuaccaggccuucccugcauaucccaacagcccagugcaagugaccacuggcuaccagcucccggucuacaauuaucaggcguucccugcuuaccccuccucaccauuucagguuaccacaggauaucaacugcccguguacaacuaucaggccuucccugcauacccaaauagugccguacaggugaccacuggcuaucaguuucaugucuacaacuaccaaaugcccccucaguguccggugggggaacagagaaggaaucuuuggacagaggcuuauaaguggugguaccugguuugcuugauucagcggcgcgauuga

SEQ ID NO: 55108 - RNA, 1605 nt, Artificial Sequence
  derived and/or modified sequence opt3 from DAZ2__Homo_sapiens__NP_001005785
augagcgccgcuaaccccgagaccccuaauuccacaaucucuagagaagcaucaacucagaguagcuccgccgcggcuucucaaggcugggugcugccagaggggaagauugucccgaacacgguuuucgugggagguauagacgccaggauggaugaaaccgagaucggcucgugcuuugggcgguacggaucaguaaaagaagugaagauuaucacaaaucgcacuggcgucagcaaagguuauggguucgugaguuuuguuaacgacguggauguccagaagauugugggaucccagauccacuuccauggcaaaaagcucaaacuuggccccgcaauacgaaagcagaagcugugugcccgucacguacaaccuagaccauugguugugaaucccccuccacccccucaguuucagaacgucuggaggaauccaaacaccgagacauacuuacagccgcaaaucacccccaauccugugacucagcaugugcaggcuuauucugcauacccacacagccccgggcaggucauuacaggaugccaacugcuaguuuauaacuaccaggaguauccuaccuacccagacuccgccuuccaggugacgacugguuaccaacuccccguauauaauuaccagccguuuccugcuuauccccggucaccauuccaggugaccgccggcuaccagcugccugucuauaacuaccaagcguuucccgcauauccaaauagucccuuccagguggccacaggguaccaguuuccuguuuacaacuaucagccauucccggcuuaccccagcucuccuuuucaagugacugccggauaucagcuuccagucuacaauuaucaggcauuccccgcuuacccuaacuccccauuccagguggccaccggcuaucaauuucccguauacaacuaccaggcguucccggccuauccuaauucaccaguucaggugacaaccgguuaccagcugcccgucuauaacuaccaagcauuuccugcuuaucccagcaguccauuccaggugacgacuggguaccaguugccugucuauaauuaccaagccuuucccgcuuacccaucuuccccguuccaggugacaaccggauaucagcucccuguuuacaacuaucaggccuuucccgcauacccaagcucgcccuuccaagugacuacaggcuaucagcugccuguauacaauuaucaggccuuuccagcuuaccccucuuccccuuuccaggucaccacgggcuaccaacugccgguguauaacuaccaggcguuuccagcauaucccucaaguccuuuccagguuaccacaggguaccagcucccaguguauaauuaccaagccuuucccgcuuauccuagcuccccguuccaggucacuaccggauaccaguuacccguguacaacuaucaagccuucccagcauacccuaauucugccguacaggugacaacugguuaucaguuucauguuuacaacuaucagaugcccccacaauguccugucggcgaacagcgcagaaaucuguggaccgaggcuuacaaauggugguaucuugugugcuugauccagaggcgggauuga

SEQ ID NO: 55109 - RNA, 1317 nt, Artificial Sequence
  derived and/or modified sequence opt3 from DAZ3__Homo_sapiens__NP_065097
augagcgccgcuaaccccgagaccccuaauuccacaaucucuagagaagcaucaacucagaguagcuccgccgcggcuucucaaggcugggugcugccagaggggaagauugucccgaacacgguuuucgugggagguauagacgccaggauggaugaaaccgagaucggcucgugcuuugggcgguacggaucaguaaaagaagugaagauuaucacaaaucgcacuggcgucagcaaagguuauggguucgugaguuuuguuaacgacguggauguccagaagauugugggaucccagauccacuuccauggcaaaaagcucaaacuuggccccgcaauacgaaagcagaagcugugugcccgucacguacaaccuagaccauugguugugaaucccccuccacccccucaguuucagaacgucuggaggaauccaaacaccgagacauacuuacagccgcaaaucacccccaauccugugacucagcaugugcaggcuuauucugcauacccacacagccccgggcaggucauuacaggaugccaacugcuaguuuauaacuaccaggaguauccuaccuacccagacuccgccuuccaggugacgacugguuaccaacuccccguauauaauuaccagccguuuccugcuuauccccggucaccauuccaggugaccgccggcuaccagcugccugucuauaacuaccaagcguuucccgcauauccaaauagucccuuccagguggccacaggguaccaguuuccuguuuacaacuaucaggcuuucccagccuacccgaauagccccgugcaagucacuaccggauaucagcuuccuguguacaacuaucaggcauuuccagcuuaccccaacucuccuuuccagguagccacaggcuaucaauucccaguuuacaauuaccaggcguuucccgccuauccgaacuccccugugcaggucaccacggguuaccagcugccaguguauaauuaccaagcauuccccgcuuauccuaacucacccuuucaggucgccacuggguaccaguucccaguguauaauuaccaggcuuuuccugccuaccccaacagcccaguucaagugacaaccggauaucaguugccgguauacaauuaucaggcauucccugccuaccccaacagugcuguccaagugacuacaggcuaucaguuucauguuuacaauuaucagaugccaccccaguguccugugggcgaacaacgcagaaaccucuggaccgaggcguacaaauggugguaccuggucugccugauccagaggcgggauuga

SEQ ID NO: 55110 - RNA, 1740 nt, Artificial Sequence
  derived and/or modified sequence opt3 from DAZ4__Homo_sapiens__NP_001005375
augagcgccgcuaaccccgagaccccuaauuccacaaucucuagagaagcaucaacucagaguagcuccgccgcggcuucucaaggcugggugcugccagaggggaagauugucccgaacacgguuuucgugggagguauagacgccaggauggaugaaaccgagaucggcucgugcuuugggcgguacggaucaguaaaagaagugaagauuaucacaaaucgcacuggcgucagcaaagguuauggguucgugaguuuuguuaacgacguggauguccagaagauugugggaucccagauccacuuccauggcaaaaagcucaaacuuggccccgcaauacgaaagcagaagcugugugcccgucacguacaaccuagaccauugguugugaaucccccuccacccccucaguuucagaacgucuggaggaauccaaacaccgagacauacuuacagccgcaaaucacccccaauccugugacucagcaugugcagucugcugcaaacccagagacacccaauagcaccauuucccgggaagccucaacgcagaguagcucugcugccgcgucccaaggguggguccugccugagggaaaaaucguuccaaacacuguguucguagguggcauugacgcacgcauggaugaaaccgagaucgggucaugcuuuggaagauauggcagcgugaaggaggucaaaauaauuacaaauaggacuggugugaguaagggguacggauucguuucuuuugugaacgacgucgaugugcagaagaucguaggcucccagauucacuuccauggcaaaaagcuaaaacucgggcccgccauccggaagcaaaaacugugugcucgccacguucagccgcgaccucuuguggucaaucccccaccucccccacaguuucagaacguguggagaaaccccaauaccgaaacauaucugcaaccucagaucaccccaaacccggucacgcagcacgugcaggccuacagcgcauauccccauucgccuggacaaguuauuacugguugccaguugcucguguacaauuaccaggaguauccaacauaccccgacucugcuuuccagguaaccacuggcuaucaacugccugucuacaacuaucagccauuucccgccuacccgagguccccuuuccaggugacagcgggguaucagcugccaguuuacaauuaccaagccuuccccgcauauccuaacucacccuuucagguggcuaccggauaccaguucccagucuauaauuaccaaccuuuucccgccuauccaaguagcccguuccaggugacggcuggcuaccagcucccuguauauaacuaccaggccuuucccgcauacccaaauucccccuuccaaguggccaccgguuaucaguuuccuguuuacaacuaucaggcuuucccagcguaccccaauucuccuguccaggugacaacuggguaucaauuaccgguguacaacuaucaggcauuuccagccuaccccagcucaccuuuccaggucaccacaggcuaccagcugccaguuuauaauuaccaggcuuuucccgccuauccuaacagugcagugcaagugacuaccggauaccaguuccacguauauaauuaccaaaugccgccccaguguccagucggcgaacagcggcguaaccuuuggacagaggccuauaaguggugguacuuggugugccugauacagcgcagagauuga

SEQ ID NO: 55111 - RNA, 1224 nt, Artificial Sequence
  derived and/or modified sequence opt3 from DAZAP1__Homo_sapiens__NP_061832
augaacaauagcggcgccgacgagaucgggaagcuguucgugggaggucucgauugguccaccacacaggaaacucuuagaucuuacuuuucacaauauggcgaggucguugacugcgugauuaugaaagauaagacgaccaaccagaguaggggguucggauuuguaaaauucaaggaccccaauugugugggcacaguccuggcuagccggccucacacuuuggauggucgcaacauagacccaaaaccgugcacaccccgagggaugcagccugaacguaccagaccaaaggagggauggcagaagggccccagguccgauaauucuaaaucgaacaagaucuuugugggcgggauuccucauaauuguggagaaaccgaguuacgggaguacuucaaaaaguuugguguugugacugaagucgugaugaucuaugacgcagagaaacaacgcccaagaggcuucggguuuauuacauucgaagaugagcagucaguagaccaggccguuaacaugcacuuucaugauaucaugggaaagaagguggaggucaaaagggcggaaccccgggacagcaagagucaggcuccuggccaaccaggugccucccagugggggucucgcguggugccgaaugcagccaacggaugggcuggccagcccccuccaaccuggcagcaaggcuacgggccccagggaaugugggucccugcaggucaggccauaggcggguauggaccacccccggcuggccgaggugccccucccccaccucccccauucacgagcuacaucguuuccacucccccugggggcuuuccaccgccccaaggauucccucagggcuauggggcgccaccccaguucucauuuggauacgguccuccacccccgccuccagaucaguucgcacccccuggcgugcccccaccucccgccaccccaggggcugccccgcuggcauuuccucccccacccagucaagcugccccugacaugagcaaaccacccacagcgcagccugacuucccguacggacaguaugccggcuacggucaggaucuaucuggguuuggccaaggauucuccgacccaucacagcagcccccuagcuauggcgggccaaguguacccggaucugguggcccuccggcagggggauccggcuuugguagagggcagaaucacaacgugcaaggcuuccaucccuacaggcgguga

SEQ ID NO: 55112 - RNA, 441 nt, Artificial Sequence
  derived and/or modified sequence opt3 from DAZAP2__Homo_sapiens__NP_001129736
augaacagcaagggccaguaccccacccaaccuacauauccagugcagccgcccgggaauccugucuacccacagacucugcaccucccccaggccccuccauauacggacgcucccccugcauacuccgagcuuuauagaccaucuuucguucauccgggagccgcgaccgugcccacaaugucagcugccaucccuauggcauacuauccaguaggucccauuuacccuccaggcaguacugugcuggucgaagggggauacgaugccggcgcuagguuuggugcaggggccaccgcuggaaacauacccccgccucccccaggcugcccucccaaugccgcgcaauuggcagugaugcagggcgccaacguuuuagugacacagcggaaagggaauuucuuuaugggagguagcgacggcggguauaccaucugguga

SEQ ID NO: 55113 - RNA, 948 nt, Artificial Sequence
  derived and/or modified sequence opt3 from DAZL__Homo_sapiens__NP_001177740
auggccgcucccagcugcggcggggacagaaaggcaaggcugaccccuucccucccacacgagucuacagccaacccggaaacucccaauucaacgaucagucgggaggcgagcacccaguccucuucggcugccacaucacaaggauacauucuuccugaagguaaaauaaugccaaacacuguguucgucggcgggaucgauguucgcauggacgagaccgaaauucguagcuuuuucgcacgauauggaagugugaaggagguaaaaaucauuacagauagaaccggcguguccaaggguuacggguuugucucuuucuuuaaugacguggauguucagaaaaucguggagagccagauaaacuuccauggaaagaagcugaaauugggccccgccaucaggaagcagaauuuaugugcuuaucacguccaaccucggccacugguguuuaaccaucccccuccaccgcaguuccagaauguauggacuaaccccaauacagaaaccuacaugcagccuacgacuaccaugaacccaauuacacaauauguucaggcauaccccacuuauccuaauuccccagugcaggucaucaccggcuaccagcuacccguguacaacuaucaaaugccgccucaguggcccgugggggagcagcgcucauacgucguuccuccagccuauagugcugugaauuaccacugcaacgaaguagaccccggagccgagguggucccaaaugaguguagcgugcaugaagcgacacccccuucugguaacggcccacagaaaaaguccguugauagaucaauucaaaccguggucagcugccucuuuaacccggagaauaggcugcggaacagugugguaacgcaggacgauuauuucaaagacaagcgcguucaccacuuucgaagaucuagggcaaugcuuaaguccguguga

SEQ ID NO: 55114 - RNA, 2025 nt, Artificial Sequence
  derived and/or modified sequence opt3 from DBF4__Homo_sapiens__NP_006707
augaacagcggcgccaugagaauccacuccaaggggcauuuccagggagguauucaagugaaaaaugagaagaacaggcccucucugaaaucacucaagaccgacaaucggccugagaaaaguaagugcaagccacuuuggggcaaagucuuuuaccuggauuugccgagcguuacaauauccgaaaaguuacagaaagacaucaaggaucuagggggacgcguggaagaguuccugucuaaagacauuucguaucucaucucaaacaagaaggaagcuaaauuugcacagacucugggccgaauuagccccguaccuaguccagaguccgccuacacggcggagaccacaucuccccacccuagccaugaugguuccucauucaagaguccagacacugugugucuuagccgugggaaacuguuggucgaaaaggcuaucaaagaucacgacuuuauacccucuaauuccauccucucaaacgcccugagcuggggagugaagauucugcauaucgaugacauuagauauuacaucgagcagaaaaagaaggaacucuauuuacugaaaaagaguucuaccuccguuagggauggcggcaaacggguggggagcggagcacaaaagacacgcaccgguagacuuaaaaagccuuucgucaagguggaggacaugucgcaguuguacaggccauuuuaucugcagcuaacuaauaugccguucauaaacuacucuauucagaaacccugcuccccuuuugauguagacaagccaucaaguaugcaaaaacagacacagguuaagcuccggauccagaccgacggcgauaaauacgggggaacgagcauucaacugcagcuuaaggagaagaaaaagaaaggcuauugugaaugcugucugcagaaguacgaggacuuggaaacucaccuccuguccgagcaacaccgcaauuucgcccagucuaaccaguaucagguggucgaugacaucgugagcaaauuaguguuugauuucgucgaauacgagaaggacacccccaagaaaaagcgaaucaaauauucaguugguagucuguccccugugagcgcuucuguacucaagaaaacagagcaaaaggaaaaaguggagcuucagcauauuucacagaaggauugccaggaagacgauacuaccgucaaggagcaaaauuuucuguacaaagaaacacaggagaccgagaagaaauugcuauucauaagugaaccaaucccccacccgagcaacgagcugagagggcucaaugaaaagauguccaacaaauguucuaugcugucgacggcagaggacgauauuaggcagaauuucacucagcuuccucugcauaagaacaagcaagaaugcaucuuggacauaagcgagcacacacucuccgagaacgaccuggaagaguuacggguggaucacuauaaauguaauauucaggccucaguucaugugagugacuuuucuaccgauaacagcggaucccagcccaagcagaaaucagacacuguccuguucccagcuaaggaucuaaaagaaaaggaccuccacagcaucuuuacacaugauucuggccugaucaccauuaauuccagucaagagcaccuuacggugcaggccaaggcgccuuuccauacacccccagaggaacccaacgagugcgacuuuaaaaauauggauagcuugccuucuggcaagauccaccguaaaguaaagauuauacuggggcgcaacagaaaagaaaaucucgagccaaacgcagaguucgacaagaggaccgaauuuaucacucaggaggaaaaucggauuuguuccucaccgguucaaagucugcuugaucuguuccagaccagcgaggaaaagucggaguuuuugggauucacauccuacacugaaaaaucugguaucugcaacgugcucgacaucugggaggaggaaaauagcgauaaccuguuaaccgccuuuuucucaagucccuccacaucuaccuuuacuggcuucuga

SEQ ID NO: 55115 - RNA, 1854 nt, Artificial Sequence
  derived and/or modified sequence opt3 from DBH__Homo_sapiens__NP_000778
augcccgcccugagcagaugggcuucccucccuggcccaucuaugagggaggcagccuucauguacucaaccgcgguggcuaucuuucuugucauucugguugccgcauugcaggggagugccccgcgggaaagccccuuaccuuaucacauaccacuggaccccgagggaucccuagaacucucuuggaacgugucguacacacaagaggcuauccauuuccagcugcuuguacgccgacugaaggccgguguguuguuuggcaugucagaucguggggaacucgagaaugcagaccuggucgugcuguggacugauggagacacggcuuauuucgccgaugcguggagcgaccagaaaggccagauucaccucgauccucaacaggacuaccaguuacugcagguucaaagaaccccagagggucuuacauugcuguuuaagaggcccuucgggacuugcgauccuaaagacuaucuaaucgaagauggaaccgugcaucucgucuacggcauucuggaggaaccauuucggagucuugaggcaaucaacggcuccgggcugcagaugggauugcagcgcgugcagcuccugaagccgaauauacccgagccugaauuaccaucugacgccuguacaauggagguacaagcucccaacauccagauuccuagccaggaaaccacuuauuggugcuacaucaaagagcugccaaaggguuucuccagacaccauauuaucaaguacgaacccauaguuacaaaaggcaaugaggcccucgugcaccacauggaggucuuucaaugugcaccggaaauggauucagugccucauuucagugggcccugcgacagcaagaugaaaccagacaggcuuaacuauugucggcacgugcuggcugccugggcguugggagccaaggcauuuuacuauccugaggaagcuggccuagccuucggugggcccggaucuucccgcuaccugcgacucgagguccauuaucacaauccacugguuauugaaggcagaaacgauucaagcggcaucaggcuuuacuauaccgcuaaacugcggcguuuuaaugccgggauuauggaguugggacucguguacacgcccguaauggcaaucccuccacgcgagacugccuucauccugaccgguuacugcacagacaaguguacucaguuagcucugccgcccaguggcauucacauauucgcgucucagcuacauacccaccucacagggagaaagguggucaccgugcugguuagggauggacgggaaugggagaucgugaaccaggacaaucauuauuccccucacuuucaagaaauucgaaugcuuaaaaaggucgugagcguacauccaggcgauguuuugaucacgucgugcacuuacaacacagaggaccgcgaacuggcaaccguggguggguucggcauacucgaggagaugugugucaauuaugugcacuacuauccccagacucagcuggaacuuugcaaaucugccgucgaugcuggauuucugcagaaguacuuccacuugauuaacagauuuaauaacgaggacguguguacaugcccucaagccuccguuucacagcaguucaccagugugccauggaacagcuuuaauagggauguacucaaagcacuguauuccuucgcccccaucucuaugcauugcaacaagagcucagcuguccgguuucagggcgaauggaauuuacaaccgcugccuaaagugaucaguacgcuagaggagccaacaccccaguguccuaccucccaggggcgcagccccgccggaccaacuguugugucuauugguggcgggaagggauga

SEQ ID NO: 55116 - RNA, 264 nt, Artificial Sequence
  derived and/or modified sequence opt3 from DBI__Homo_sapiens__NP_001073331
augagccaggccgaguucgaaaaggcugcagaggaagugagacaccugaaaaccaagcccuccgacgaggaaaugcucuuuaucuacggccauuauaaacaagccacagucggggauauuaacacugagaggccuggaaugcuugacuucacggguaaggcgaaaugggaugcuuggaaugagcugaagggcaccucuaaggaagacgccaugaaagcauacauaaacaagguugaggaauugaaaaagaaauaugggaucuga

SEQ ID NO: 55117 - RNA, 1950 nt, Artificial Sequence
  derived and/or modified sequence opt3 from DBN1__Homo_sapiens__NP_004386
auggccggcgugagcuucuccgggcacagacuggagcuccuugcugcauacgaagaggucaucagggaagagucugccgcggacugggcucuguauaccuacgaagauggaucagacgauuugaaguuagccgcaaguggugagggcgggcugcaggagcuaagcggacauuuugaaaaccaaaaaguuauguauggcuucugcuccgugaaggacucucaggccgcucuccccaaauacguacugauuaauugggugggugaggaugucccugacgcacggaagugugccugcgcuucgcacguggccaaaguugcggaauuuuuccaggggguggaugucauagugaacgcaucaagcguagaggacaucgaugccggagcuauuggccagcgccuuaguaauggccuggcccgauuguccucuccaguucuccaucgucugagacugagggaggacgaaaacgcagagccgguggggacaacuuaucaaaagacggaugcugccgucgaaaugaagcggaucaaucgcgagcaguuuugggaacaggcgaaaaaggaggaggaacucagaaaagaggaagagaggaagaaagccuuagacgaacggcugcgcuucgagcaggagcgaauggaacaagagagacaggaacaggaggaaagggagcggcguuaccgcgagagagaacagcaaauugaggaacacaggcggaagcagcagacccuugaggcagaggaagcuaagcgacgcuugaaagagcaaagcaucuuuggagaucauagagacgaagaggaagagacacacaugaagaaauccgagucagaaguggaggaagccgcugccauaaucgcacagaggcccgacaacccucgggaguucuuuaagcagcaggaacgcguggccagugcuagcgcggguucuugugaugucccaucccccuucaaucacagaccuggcucacaucuggacagccacaggcguauggcaccaacucccauuccuacccggaguccaucugauuccagcacagccucgaccccgguugcugagcaaaucgagcgagcccuagacgaagugacuucuucccagcccccuccacugcccccuccacccccgccugcacaggagacacaggaacccucaccaauucucgauagugaggaaaccagagccgcugccccucaagcaugggcggggcccauggaggagccaccccaggcucaggccccuccaaggggaccgggcagccccgcagaagaccuuauguuuauggaguccgccgaacaggcuguacuggccgcaccuguggagccagcuacggccgaugcgacugagauccaugacgccgcugauaccauagaaacagacacugcaaccgccgauacaaccgucgcuaacaaugugcccccugccgcaacgucuuugauugaccucuggccagguaacggggagggagcgagcacucugcaaggcgaaccccgcgccccgacaccuccaucaggcaccgagguuacuuuagcugaagugccccugcucgacgaggucgccccugagccccuucugccagcaggggaaggaugcgcuacauugcuaaauuucgaugagcugccugaacccccagccaccuuuugugacccggaggaaguggagggugagccucucgcagcuccccagacgccaacccugcccagugcccuugaagaacuggaacaggagcaggaaccugagccacacuugcucacaaacggcgagacuacccaaaaagaagggacacaggcguccgagggauauuucagccagucucaagaagaggaguucgcccagucagaggagcugugcgcaaaggcucccccuccgguauuuuacaauaaaccacccgaaaucgauauuacuuguugggacgccgauccuguuccagaggaagaggagggcuucgaagguggggacuga

SEQ ID NO: 55118 - RNA, 1293 nt, Artificial Sequence
  derived and/or modified sequence opt3 from DBNL__Homo_sapiens__NP_001014436
auggccgcuaaccugagcagaaauggccccgcacuccaggaggccuacgugagggucguuaccgaaaaguccccuacagacugggcgcuuuucacuuaugaggggaacucuaaugauauccggguggcuggaacgggugaaggcgggcuggaggaaaugguagaggaguugaacucaggaaaagugauguacgccuuuugccgcgucaaggacccaaauaguggcuuaccgaaauucgugcugauuaacuggaccggugaagggguuaaugaugugcgaaagggagcaugugccagccacgucuccacaauggcuucuuuucuaaaaggcgcacaugugacuauaaacgcccgugcugaggaagacguagagcccgagugcaucauggaaaagguugccaaggcgucgggcgcaaauuauucauuccacaaagagagcgggagauuucaagaugugggaccucaggccccagucgguaguguguaccagaagaccaacgcuguguccgaaauuaaaagggucggcaaggacucuuucugggccaaagcagagaaggaagaggagaaucggcgccucgaagagaagagaagggcugaagaggcccagcggcaacuggaacaggagcgccgagagagagaacuuagggaggcggcccggcgugaacagcgcuaucaggagcaagggggagaagcaagcccccagagaacaugggagcagcagcaagagguuguguccaggaaccggaaugaacaggagucagcuguacauccucgagaaaucuuuaaacagaaggagcgcgccaugaguaccacuagcauuucuuccccacaacccggcaaacugagaucaccuuucuugcagaagcagcucacacagccagagacccacuuugguagggaaccggcugccgcaaucagccggccccgcgccgaucugccugcugaggaaccagcgcccaguacgccuccaugucuggugcaagcagaggaagaggccgucuacgaggaacccccggagcaggaaacuuucuaugagcagccuccccucgugcagcaacagggggcuggaucugaacauauagaccaccacauccagggccagggcuuauccgggcaaggacugugcgccagagcacuuuacgauuaccaggccgcugacgauaccgagauuagcuuugacccagagaacuugaucacagguauugaaguuaucgaugagggcugguggaggggguauggaccugacggccauuucgguauguuucccgccaauuacguggaacugauagaguga

SEQ ID NO: 55119 - RNA, 978 nt, Artificial Sequence
  derived and/or modified sequence opt3 from DBP__Homo_sapiens__NP_001343
auggccagacccgugagcgacaggaccccugcuccacugcuccuuggcgggccggcaggaacacccccugguggcggggcccuguugggauuacggucccugcuacagggcacuucuaagccaaaagagcccgcgucaugccuccugaaggaaaaagagcgcaaggcugcccuuccugcagccacgaccccaggucccgggcuggaaacagcuggaccugcagaugccccagcuggcgccgucguuggcgggggaaguccgcgaggucgucccggcccugugccagcgcccggguugcucgcaccucugcugugggagagaacucucccauucggagacguagaauacguggauuuagacgccuuucugcuugagcacggcuugcccccgagcccucccccaccuggugggcccuccccagagcccucuccugcuaggaccccagccccgucgcccggaccuggcucauguggcagcgcaaguccacgguccucucccgggcaugcuccugcccgcgcggcccugggaacagcaagcggucacagagcuggccuaaccuccagggauacuccaucacccgucgacccggauacaguggaaguucucaugaccuucgagccugacccagccgaucuggcucuuaguagcauccccgggcaugaaacguuugacccucggcgccaccgauucucugaggaggaacugaaaccccaaccaauuaugaagaaggccagaaaaauacaggugccugaggaacagaaggaugagaaauauugguccaggcgguacaagaacaaugaagcagccaaacguucacgcgacgcuagaagguugaaggagaaccagaucagcguccgggcggcauuucucgagaaggaaaaugcccuguuacgacaagaggugguagcuguucgccaggaacugagucauuauagagccgugcucucuagguaccaggcacagcacggagcccuuuga

SEQ ID NO: 55120 - RNA, 1635 nt, Artificial Sequence
  derived and/or modified sequence opt3 from DBR1__Homo_sapiens__NP_057300
augagaguggccgucgcuggcugcugucacggggagcuggacaagaucuacgaaacccucgcacuugccgagaggcggggacccgguccuguugaucuguuguuaugcuguggcgacuuccaggcggugcgcaacgaagcugaucugcgaugcauggccguaccaccgaaauaucgucauaugcaaacauuuuacagauauuacagcggggagaagaaagcacccgugcuaacucucuucauuggaggcaaucacgaagccuccaaccaucugcaggagcuuccuuauggugggugggucgcuccaaauauauacuaucugggauuggcaggcgugguuaaguacaggggcgugcggaucgggggaauuucugguaucuuuaaaucacacgacuaccgcaagggccauuucgagugucccccuuauaacaguagcacgauuagauccaucuaccacgucaggaauauagaaguguauaagcucaaacagcugaagcagccaaucgauauuuuucugucucacgacuggccccggucgaucuaccauuaugggaacaaaaagcaacucuuaaaaaccaagucauucuuucgccaggagguagaaaauaacacacugggaagcccugccgcuagugagcuuuuggagcaccugaagccaacuuacugguucuccgcccaucuacacguuaaauuugcggcacucaugcagcaccaggccaaggauaaaggccaaaccgcucgagccacaaaguuccuggcacuugacaaaugccugccgcauagagacuuuuugcagauucucgaaaucgagcacgaucccucugcuccugauuaucuggaauacgacauagagugguuaaccauucugagggccacugaugaccucaucaaugugacaggucggcuuuggaacaugccagaaaauaacgggcugcaugcgcguugggacuacagcgccaccgaggagggaaugaaggaagucuuggagaaacuaaaucacgaucugaaggugcccuguaacuucuccgugacggcagcuugcuaugacccuucaaagccacagacucagaugcaacucauucaucgcaucaauccccagaccacagaauuuugugcccagcugggcaucauugauauaaacgucagacuucagaaaaguaaggaggaacaccacguuugcggcgaguacgaggaacaagacgauguggagagcaacgacucuggggaagaucaguccgaguauaauacugacaccucagcucugagcaguaucaacccggaugaaauuauguuggacgaggaggaagaugaggacucuaucguauccgcccauagcggaaugaauacaccuucgguggaacccucugaccaggcauccgaguucucagccaguuucagcgaugucaggauacucccagguuccaugauugugucuagcgacgauaccguugacucaacgaucgaucgggagggcaaaccugggggaacuguggaaaguggcaacggugaggaccugacaaagguccccuuaaaacgacuguccgaugaacacgagccagaacaacgcaagaagaucaaaagaaggaaucaggcuauuuacgcggcaguggacgaugacgaugacgaugccgcuuga

SEQ ID NO: 55121 - RNA, 1032 nt, Artificial Sequence
  derived and/or modified sequence opt3 from DBX1__Homo_sapiens__NP_001025036
augauguuccccggccugcucgccccuccagcuggguacccgagccuucugagacccaccccuacauugacuuuaccacagucccugcaaucugcauuuucaggacacaguagcuuccuaguggaggaccucaucaggauuucccggcccccugccuaucugccacgcucuguccccacggcgucgaugucaccuccacgacagggugcuccgaccgcccuuacagauacuggcgcaagcgaccuggggagucccggaccuggcucccguagaggugggucuccacccaccgccuuuagcccugcuuccgaaacaaccuucuugaaguuuggaguuaacgcaauacucucaaguggcccaaggacugagacaagccccgcccugcugcagucugugccgccuaaaaccuucgcuuuucccuacuucgaaggcuccuuucagccauucauccggucaagcuauuuuccugccaguucuuccguagugcccauuccagggacguucagcuggccccucgcggcacgcggaaagccuagaagggguauguuacggcgcgccgucuuuucggaugugcaacgaaaagcucuggagaagauguuccagaaacagaaguacaucucuaagccagacagaaagaaacuugccgcaaaauugggccugaaggauucccagguuaaaauuugguuccaaaauaggcggaugaaguggcguaacucaaaggaacgcgagcuacucaguagcgggggaugcagagagcagacucugccgaccaaacuuaauccccauccugaccuguccgaugugggccagaaggguccagggaacgaagaggaagaggagggacccggcucuccuagccacagguuggcuuaucaugccucaagugacccacagcaccuccgggauccccgacugccgggcccuuuaccacccuccccugcgcauucuagcucacccgggaaaccaagugacuuuagcgauuccgaagaggaagaggaaggagaggagcaagaagagaucacagucucuuga

SEQ ID NO: 55122 - RNA, 1362 nt, Artificial Sequence
  derived and/or modified sequence opt3 from DCAF12__Homo_sapiens__NP_056212
auggccagaaagguggucagcaggaaacggaaggcucccgcauccccuggcgccgggucugacgcgcagggaccacaauucgguugggaucacucacugcauaaacgcaagcgacucccgcccguuaaacguagucuuguguacuaucugaagaacagagagguaagguugcagaaugaaaccagcuacucccggguguuacacggcuaugcugcccagcagcugccuucucuacucaaggagcgcgaauuucaucuggggacacuuaacaaagucuucgcaucgcaauggcugaaucacagacaggugguuugcggaacuaaguguaacacguuguuuguggucgacgugcagaccucacagaucacaaaaauuccaauacucaaggauagggagcccggcgguguaacucaacaggggugcggaauccaugccauugaacugaauccuagccggacccugcucgcuacaggcggcgacaacccaaauaguuuagcaaucuaccgccugcccacccuugauccuguuugugugggggacgauggacacaaagacuggauuuucuccaucgccuggauaucugauacuauggcugucagcgguucccgagacggcucaaugggguugugggaggugacagaugacgugcugaccaagagugaugccagacacaacgucagcaggguuccaguguaugcgcauaucacgcacaaggcacuaaaagacauuccgaaggaggacacuaaucccgauaacugcaaaguacgggcccucgcuuuuaauaacaagaauaaagaacugggagccgugucucuugacggcuacuuccaucuguggaaggcagagaacaccuuguccaaacuccugucaacaaaguuaccuuauugucgugaaaaugucugccuggcuuacgguagcgaguggaguguguacgccguugggucucaggcgcacguguccuuucucgauccacgccagcccagcuauaacgucaagucgguguguucuagagagaggggauccggcauccggucaguaaguuucuacgaacacauuaucacuguuggcaccgggcaaggaagccuucuguuuuaugacauacgagcccagcgcuucuuggaggaaagacuauccgcaugcuacgguucuaaaccuaggcuggcuggcgagaaccucaagcugacaaccgggaaaggauggcuuaaucaugaugaaacguggcggaacuauuuuagcgacauugauuucuuuccaaaugccguguacacucacuguuaugacucaaguggcacaaagcuguucgucgcuggugggcccuugccguccggccuccauggaaacuacgccggccuguggagcuga

SEQ ID NO: 55123 - RNA, 1794 nt, Artificial Sequence
  derived and/or modified sequence opt3 from DCAF13__Homo_sapiens__NP_056235
augcaguggcccccuccauggagaaggagcccgcugguguccgccacacccccuccaggccccacccgggggcuccuuugcccucgccgagucucugaggcuggagacucaaguacugaaggugcacguacgggccacagacauuacguuaccccagccgagagcgcgauggaagggaggucccaaccccugccuucuuugcggccagcuucgccgacaaacgcccccgcacacggacgcggcucagauuguacugccaaggagccuccauuagcuaaugugugcagacagaacuauggugcagcccaggaccccguagaaccugcugggaggcggagcgccagucaugugaccggauccucucugggcaaagcggaggucgcauguggccgccgauggagaugggccgagcuacucgcugauacaagcugguccccagccgggagggcaaccgaaaugaaggugaaaaugcugucacggaaucccgacaacuacguucgugagacuaaacuugaucugcagcgcgugccgagaaauuaugacccugcuuugcaccccuucgaagucccaagggaguacauccgggcccucaacgcgacaaagcuggagcgaguguuugccaagccuuuccuggcaagucucgauggacaucgcgacgguguaaauugcuuagcuaagcaccccgaaaaacuggccaccguucuuagcggcgcuugugauggggaggugagaauuuggaacuugacgcaaaggaauugcauacggacuauccaggcccacgaaggauuuguccgcggcauuuguaccagauucugcgguacaucuuucuucacugugggggacgauaagaccgugaaacaguggaagauggacggaccaggcuauggcgaugaggaggaaccccugcauacaauccuagggaaaaccgucuacacgggaauugaccaccauuggaaggaggcaguuuuugccacuuguggucagcaaguggacaucugggaugaacagaggacaaacccuauaugcuccaugaccuggggcuucgacucaaucagcaguguaaaguuuaauccaauugagacuuuccuccuggggucuugugcuuccgaucguaacaucgugcuuuaugacaugcggcaggcgacaccgcugaaaaaggucauuuuggauaugcgaaccaauacgaucugcuggaaccccauggaagcauuuauauucaccgccgcuaaugaggacuacaaccucuacacauuugauaugagagcccuggacacuccugugaugguucacauggaucacgugagcgcagucuuagacguggauuauucgccaaccggaaaagaauuuguaucugccuccuucgacaagucaauuaggaucuuucccguugacaaaagucgcagccgggagguguaccauacaaagagaaugcagcacgucauuugcgugaaauggacuuccgauucuaaguauaucauguguggcagcgacgagaugaacaucaggcuguggaaggcuaaugccucagaaaaacucgguguccuuaccagucgcgagaaggcagcgaaagauuacaaccaaaagcugaaagaaaaguuccagcauuauccucacauuaagcgaauagcucggcaucgucacuugccaaaauccaucuacagccagauucaagagcagagaaucaugaaggaagccaggcgccggaaagaggugaauagaauaaagcacucuaaacccgggucaguuccgcuagugagugagaagaagaaacauguagucgcagugguuaaguga

SEQ ID NO: 55124 - RNA, 1362 nt, Artificial Sequence
  derived and/or modified sequence opt3 from DCAF17__Homo_sapiens__NP_001158293
augggccccaccagaaagccuaacgugugcagcaggcugucccggcgcgcccucggguguuucucucgagacgcuggagucguucagcguacaaaucuugguauccugagagcauuggugugccaagagucaacuaaauuuaagaacguauggacgacccacaguaggagcccaauugccuacgaacggggccgcauauauuucgauaauuacagaagguguguguccucugucgcgucggagccgcggaaauuauaugaaaugcccaagugcucaaaaagcgagaagaucgaagacgcucugcuaugggaguguccugugggggauauucucccaaacaguuccgacuacaagucuagccugaucgcccuuacagcacauaauuggcuguugcgcauuuccgccacuaccggaaaaauccucgagaagauauaucuggcucccuacugcaaauuucgauaucugucaugggauacaccucaggaaguuaucgcagugaagagugcccagaacagaggcagcgcugucgccaggcaggcggguauucaacagcacgugcucuuauaccuggcaguauuccggguucuuccauuuucuuugguggggauccuggagauuaauaaaaagaucuucggaaacgucaccgacgccacucuaucccauggcauacucauugugauguacucaagcggccuggugcgucuuuauaguuuucagacaaucgcugaacaguucaugcaacagaagcuggauuuggggugugccugccgcuggggagguaccacgggcacugucggggaggcacccuuuggcauuccuuguaauaucaaaaucaccgacaugccaccgcuccuguucgagguuucuuccuuagaaaacgcuuuucagauuggaggucaccccuggcauuacauagugacaccuaauaagaaaaagcagaaagggguauuccacaucugcgcccugaaggauaacagccucaaugagaacgugcuuacugucaccgcgucgggaagagugguuaaaaagucuuuuaaucuguuggacgaugacccagaacaagagacauucaagauuguggauuaugaagacgagcuagaccugcucuccgucguggccguaacccagaucgaugcagagggcaaagcucaccuggacuuccauuguaacgaauacggcacgcuucugaagucaauacccuugguugagaguugggaugugacuuauagccacgaagucuacuuugacagggaucucgugcugcauauugagcagaaaccuaaccgggucuucuccugcuauguguaccaaaugaucugcgacacaggggaagaggaggaaaccaucaaucgaucuuguuga

SEQ ID NO: 55125 - RNA, 1470 nt, Artificial Sequence
  derived and/or modified sequence opt3 from DCAF4__Homo_sapiens__NP_001156980
augaacaagagcagauggcaguccaggcggcgccacggccgacguucucaucaacagaaucccugguucagacugagggacucagaggaucggagugacagccgcgccgcucagccugcacacgauuccgggcauggagacgaugaaucuccaucgaccucaagcgguacagccggcacgaguuccgugccggagcuccccggguuuuacuucgacccugagaaaaagagauauuuuaggcuucugccaggacacaacaauugcaaccccuugacuaaagaaucuauccggcagaaggaaauggagagcaaacgcuuacgacugcuacaagaggaagauagaaggaagaagauugcgcggaugggcuucaaugcuuccucaaugcuccguaaaagucagcuggguuuucuuaacgucaccaauuacugucaucuggcccacgaguugcgccucagcugcauggaaagaaagaaaguucagauaaggucuauggacccuuccgcacuggccucagaucgguucaaccugauccucgcugacacaaauagcgaucgauuauuuacugugaacgacguaaaggucgggggaaguaaauauggcauuaucaaucugcagucucuuaagaccccaacauugaagguguucaugcacgagaaccuguacuuuaccaaucgcaaagugaacuccguuuguugggcaagccuaaaucaucucgauucgcacauucugcuuugccugaugggcuuggccgagacucccgggugugcuacacuccugccugccucuuuauucgugaacucccauccagcgggaaucgacagaccggguaugcugugcucauuuaggauacccggcgcauggaguugugccuggagccucaacauccaagcuaauaacugcuucuccaccgggcuuucucggcgcguccuguugacgaaugugguaacuggacacagacagagcuuuggcaccaacucagacguucuagccccucuguuguucaaugguuguaggaguggggaaauuuucgcaaucgaucugcguugcggaaaccagggcaagggcuggaaagcuacacggcuuuuucacgacuccgccgugacuagcguccgaauacugcaggaugagcaauauuugauggcgucugacauggccgggaagaucaaacucugggaucugagaaccacaaagugugugaggcaguacgaaggacaugugaaugaguaugcauacuuaccacugcacguccaugaagaggaggguauucuaguugcugugggccaggacugcuacacccgcauuuggucacuccacgaugcccggcugcuuagaacgauccccaguccuuauccagcuagcaaagccgacauucccuccguagcauucucuucgaggcucgggggaagccgcggcgccccgggucugcucauggcuguggggcaagaucuguacugcuauuccuacucauga

SEQ ID NO: 55126 - RNA, 2583 nt, Artificial Sequence
  derived and/or modified sequence opt3 from DCAF5__Homo_sapiens__NP_001271136
auggagcaggccauccacagcagagugaagcccauucaacugaaaggcgaacaucacuccaacauauucugccucgcuuuuaauucugggaacaccaaggucuucucaggagguaaugacgagcagguuauccuucaugauguggaaaguagcgagacacuggacguauuugcacacgaagaugccguguacggcuuguccgucucuccugugaacgacaauauuuucgcgucgucaagcgaugacgggaggguuuuaaucugggauauucgggagaguccacauggagagccguuuugucuggcuaacuaucccuccgccuuccacucugugauguuuaauccugucgaaccacgccuacucgcaacugccaacagcaaagagggcgugggucugugggacauccgaaagccccaguccucacuucugcguuacgggggaaauuugagucuccagagcgcuaugucuguaagauucaacuccaauggcacgcaacugcuggcacucaggcggcgcuuaccuccaguucuguaugauauacacucaagacuucccguguuucaguucgacaaccagggcuacuuuaauagcugcaccaugaaaaguuguugcuucgccggggauagggaccaguauaucuugucuggauccgaugacuuuaaccuguacauguggcggauuccugcugacccagaagccgguggcaucgggcgcgucgugaauggagcguucauggugcuaaagggccaucgaagcauugucaaccaaguuagauucaacccgcacacauauaugaucuguucgucugguguggagaagauaauuaaaaucuggucccccuacaagcagccugggugcacuggagaucucgacggcaggauugaggaugacucacggugucuguacacccaugaagaguauaucagucuuguacugaauagcggcuccggguugucucacgauuacgcaaaccagagcgugcaggaagacccacguaugauggccuuuuucgauucacucguccgcagagagaucgaaggauggaguuccgacagcgauucugaccugucagagaguacaauuuuacaacugcacgcuggugugagcgagagguccggcuauaccgauucugaaucgagcgccucccucccccggucaccuccacccacuguugacgagagugcagacaaugcuuuucaucuugggccgcugcgagugacaaccacgaacacugucgccucuaccccucccacaccaacuugcgaagaugcggccagccgccagcagagauuguccgcacuaaggcgguaccaagacaaacgccugcucgcucugucaaaugagagcgauucugaagagaacgugugugagguagaacuugacaccgaucuguucccuagacccagguccccaagucccgaggacgaaaguucuuccucaaguagcucguccucuagcgaggaugaagaggaguugaaugaacgucgggccucaacauggcagcgaaacgcuaugagaaggcgccagaagaccacgcgggaggacaaaccuagugccccaauaaagccgacuaauacauauaucggagaagauaacuacgacuauccccagauuaagguugaugaccucuccucuagcccuaccuccucaccagagagaagcacuagcacacuggagauccaacccucuagggcauccccuaccagcgauauagaaucgguggagcgcaaaauuuacaaggccuacaaaugguuacgauauucauacaucucuuauaguaauaacaaggacggcgaaacgucccuggucaccggugaggcugacgaagggcgggcgggcacaagccacaaagauaauccagcacccucuagcuccaaggaggccugccuaaacaucgcuauggcccagcguaaucaggaccucccgccugagggauguucaaaagauacuuuuaaggaagagaccccaagaacacccaguaacggcccugggcaugaacacagcucucaugcaugggccgaggugcccgaaggaacuucccaggacaccgguaacucaggcagugucgagcacccauucgagacaaagaaacugaaugggaaggcucuuagcuccagggccgaagaaccucccucuccaccggugccuaaagcaucgggaagcaccuugaacucaggcuccgguaauugcccccgcacucaaagugaugacucugaggagcggagccuggaaacgauuugcgcgaaccacaauaacgggagacuccauccaaggcccccucacccacauaauaacggccagaaucugggagagcuugagguuguggcuuacuccucacccggccacucugauacagaccgagauaacagcagucugaccgggacuuugcuccacaaggacuguugcggauccgaaauggccugugagaccccuaaugcagguacacgcgaagauccgaccgacacuccagccacagauagcucucgggcuguacauggccacucagggcugaaaagacagaggaucgaguuagaggacacggacuccgaaaacaguagcucggagaagaagcugaaaaccuga

SEQ ID NO: 55127 - RNA, 2583 nt, Artificial Sequence
  derived and/or modified sequence opt3 from DCAF6__Homo_sapiens__NP_001017977
augagcagaggcggguccuacccccaucugcucugggacgugaggaagcggucucuuggacuggaggauccuucacgcuugcgaagucguuauuuagguagaagggaguucauccagcggcugaagcuagaggccacccucaacguccacgacggcugcguuaauacaauuuguuggaacgauacuggggaauacauacugagcggauccgacgauacgaaacuugugaucucuaauccauauucgcgcaagguacugaccacaauuagaucaggccacagggcuaacaucuuuagcgcaaaguucuugccgugcacuaaugacaaacaaauugugaguuguuccggugauggggucaucuuuuacaccaacguggagcaggacgccgaaacaaaucggcagugccaguucaccugucauuauggaacuacauacgagauaaugaccguucccaacgauccuuauacguuucucucuugcggcgaggacggcacugugcgcugguucgauacccgaaucaagacaagcuguacuaaggaagacugcaaagaugacauucugaucaauuguagaagggcggcuaccuccgucgccauuugcccacccaucccuuacuaccuggcagugggguguucagacaguagcguacggauauaugaucgucgcaugcucggaacaagagccaccgguaacuacgcuggcagggggacgacuggaaugguugcacgguuuauuccaucucacuuaaauaacaaguccugccgagugacaucacugugcuauagcgaggacggccaagaaauccuugucaguuacucuuccgauuauauuuacuuguucgaccccaaagaugacaccgcccgcgagcugaagacuccuagcgcugaggaaagaagggaggaacuacggcagccaccggugaaacgccucagacugaggggugauuggucggacacagggccccgugcccggccugagucugaacgagagagagauggagagcaguccccaaaugugucacuuaugcagaggaugagugacaugcugagccgcugguuugaagaggcguccgaagucgcacaaucuaaccggggcagaggcaggagccgcccccgagggggaaccucacagagugauaucuccacguugccuaccguuccaagcucucccgaccucgaggugucagaaacagccauggagguagacacuccggcugagcaguuccugcagccuaguaccagcuccacaaugucugcccaagcacauucgacuagcucccccaccgaaucaccacacaguacaccuuuacugucuagccccgauuccgagcagcggcagucaguggaagcuagcggucaccauacccaccaucaaucugacaauaacaacgagaagcucuccccaaagcccggcacuggggaaccuguccuuagucugcacuauagcacggagggaacaaccacuucuaccaucaaauugaauuuuacagaugagugguccucaauugccaguagcucgcguggcauagguucccacuguaagucugaagggcaggaggagagcuucgugccacagucaaguguucagccgcccgaaggcgacuccgagaccaaagcgccugaagagucuagcgaagaugugacuaaguaccaagagggagucuccgccgaaaacccaguggagaaucauaucaacauuacacagucagacaaauuuacggcaaagccccuagauagcaauaguggcgagagaaacgaccugaaucucgauaggucuugcgggguaccugaagaguccgcuagcucggaaaaagccaaggagccagaaaccucagaccagacuucuacagagagugcuaccaacgagaauaacacaaaucccgaaccgcaguuccaaacugaggccaccggaccuuccgcacacgaagagacgagcacccgcgauucugcccugcaggacacagaugacagcgacgaugacccaguucuuauccccggugcucgguacagagcgggcccuggggauaggcgauccgcaguggcccgcauacaggaguucuuucggagaaggaaggaacguaaagagauggaagaacuggacacuuugaacauucgccggccccucgucaagaugguguauaaaggacauagaaauucaaggaccaugaucaaggaagcuaacuucuggggcgccaauuuugucaugagugguagcgauugugggcacaucuucauuugggaccgacauacagcagagcaccugauguuacuggaggccgauaaccacgugguuaacugccuacagccacauccuuuugaccccauccucgcuucuuccggcauugauuacgacauaaaaaucuggucaccacuggaagagagucggauuuucaaucgcaaacuugccgaugaagugaucacuagaaacgaguugaugcuggaagagaccaggaauacgaucacaguaccggcgagcuuuaugcuccggaugcuggcaucccuuaaccacauucgagcugacagacuggagggagaucgcucugaaggcucggggcaagagaaugaaaacgaggacgaagaguga

SEQ ID NO: 55128 - RNA, 1029 nt, Artificial Sequence
  derived and/or modified sequence opt3 from DCAF7__Homo_sapiens__NP_005819
augagccugcacggcaagagaaaagagaucuacaaguaugaagcccccuggaccguguacgcuaugaacugguccgucaggccugacaaacgguuccgccucgcacuugggucuuuuguugaggaauauaauaacaaggugcagcugguaggauuggaugaggaaucaagugaguucauuugccgaaauacauuugaccauccauacccgacuacgaaauuaauguggauacccgauaccaaggguguguauccugaccugcuagccacaagcggcgauuaccuccgugucuggagagugggggagacugaaaccaggcuggagugucuucugaacaauaacaaaaauuccgacuucugcgcgccauugacaucuuuugauuggaacgaaguugaccccuaucuccugggaaccucgucaaucgauacuacauguaccauuuggggccuggagacgggucaagugcucgggcgggucaauuuagugagcggacacguaaagacucagcugaucgcucaugacaaggagguuuacgauauugccuucagucgcgcaggcggcgggagagacauguuugccuccgugggagcugaugguucugucaggauguucgaccuucggcacuuggaacauagcaccaucauauacgaggacccucagcaccacccacugcuacgccucugcuggaacaaacaggaucccaauuaucuggcaacaauggccauggacggcauggaaguggugauccuugauguccgaguuccuuguacuccaguggcuagacugaacaaucauagggccugcguaaacgggauugcgugggcaccgcacuccucaugucauaucugcaccgccgcugacgaucaccaagccuugauuugggacauccagcagaugccccgggcaauagaggauccuauucucgcuuacacagccgaaggagagaucaauaacgugcagugggcgaguacccaaccagacuggauugccaucuguuauaacaauugccuggagaucuuacgugucuga

SEQ ID NO: 55129 - RNA, 1794 nt, Artificial Sequence
  derived and/or modified sequence opt3 from DCAF8__Homo_sapiens__NP_056541
augagcuccaaggggucuucaaccgacggcagaacagaucuggccaacggaagucucagcuccucucccgaggaaaugucgggugcugaggaaggcagggagacuucaagcgggaucgaaguggaggcaagugaccuuucccugucuuugacgggagaugacggcgguccuaaucggaccagcacagagucccgcgggacugauaccgaaucaaguggagaggacaaagauagcgacucuauggaagauacaggccacuacuccauuaacgacgagaaucgaguccaugaucguucagaggaagaggaagaggaagaggaggaagaggaagaggaacagccaagaaggcggguucaacgcaagagagccaacagggaccaggauagcagugacgacgagcgggcguuagaggauugggugucuuccgaaaccagcgcucugccgcgcccccgauggcaggcccuaccugcacucagagagagggaacugggcucgucugcccgguucguauaugaggcuugcggggcacguguguuuguccagcgcuucagacuucaacacggacuggaaggucauacuggcugugugaauacauugcacuuuaaccagagggggaccuggcucgccuccggaucagacgaucugaaaguuguggucugggacugggugcggcgacagccaguacuggauuucgagaguggccauaagagcaauguuuuucaggcuaaauuccuccccaacuccggugacucuacguuagccaugugcgcgcgcgaugggcaagugagagucgcagagcugagcgccacucaguguugcaagaauaccaagaggguggcucagcacaaaggagccucacacaaacuugcauuggaaccugacaguccauguacauuucuguccgcuggcgaggaugccguggucuucacuauagaccuacggcaggaucgccccgcgagcaagcucguugugaccaaggaaaaagagaagaagguaggccuguacacaaucuaugugaacccugccaauacccaucaauuugcagucgggggaagagaccaguucgugaggauuuacgaccagcguaaaaucgaugagaacgaaaauaacgguguucuuaagaaauuuugcccacaccaucuggugaauagcgagucaaaggcuaacauuacguguuuggucuauagucacgacggcacugaacuccuggccagcuacaacgaugaggacaucuauuuauucaauuccucucacucggauggggcucaauacgugaaacgguacaagggacaucgaaacaaugccacaguaaaaggcguuaacuuuuaugguccgaagucugaguucguggucuccgggucagacugcggccacauauuccugugggaaaagaguucuugucagaucauucaguuuauggagggagauaaaggcgggguggucaauugccucgaaccccauccucaccuuccagugcuggcaaccagcggauuggaccaugauguuaagaucugggcccccacugcugaggcguccacagaacuaaccggucugaaagacgugauuaagaaaaacaagagagagagggaugaagacucacuccaccagacggaucuguucgacagccacaugcuuugguuucugaugcaucacuugcgccaacggagacaucacaggcgcuggcgagagccuggcguaggggcaaccgacgccgauucugacgaguccccaaguagcucugauacauccgacgaagaggaaggacccgaucggguccaguguaugccgucauga

SEQ ID NO: 55130 - RNA, 735 nt, Artificial Sequence
  derived and/or modified sequence opt3 from DCANP1__Homo_sapiens__NP_570900
augcacuacggcgccgcuacccauauccagaacagcagaucccacgggcuggagacagugcccggacaucaaaggcucgaacggggugcaggcggggagacuccugaguucccaggaugccacucuccggcgcccccugaaaauuuuggcaacgaacuucugccauugucagcccccuuacagggucugagugaggggcuauauccuccaggacgcaauaagacgcuccccgcuggcguccugcgagagggcgccguucaguuccuucaucgugggcuguguaacagcaauuuguccucugaagcaucggccagaccuucaggaacccaggacgagcuccacagcaguaggcggaaaacaggucaaacucgcagagaaggcgcuaggaagcaccuggugugcuccuuucggcuguacccauucaccguacauacagugucuccggggaacagccaccucgcauuauaucaggucuuuaaagccgugaagcugugucccuccgagaccucauucuuucuuagucgcaagagcuugaaaucuuccgauccuuggcauccacccucacugagcccuaauaguuggaaccgacaggcuggauucagagccuggucuucccaccuaauuagccucucgcugacuugcucugacucccagucaaggcggguuaguagcucccaacagccaccccuucacucucugagcucacaucgucgcgcggcacacgugccggaguga

SEQ ID NO: 55131 - RNA, 1620 nt, Artificial Sequence
  derived and/or modified sequence opt3 from DCBLD1__Homo_sapiens__NP_775945
auggugcccggcgccagagggggaggugcucuggcaagggccgcgggccgggggcuccuugcucuguuguuagccgucagcgcaccucugcgccuacaggccgaggaacucggagacggcugcggucaccugguuaccuaccaagauuccgggacaaugacuucuaagaacuauccaggaacguacccgaaucauaccgugugugagaaaacaaucacuguacccaagggcaaacgacuuauucugcguuugggcgaccucgauauagaaucacagaccugcgcuagugacuaucugcuguucacaagcuccucugaucaguacgggccuuauuguggaucgaugaccgugccaaaggagcucuuacugaacacuucagaagucacagugagauuugagagcgguagucacaucuccggcaggggguuccuuuugaccuacgcaucuagcgaccaucccgaucugauuacgugccuagagcgggccucccacuaucucaaaacugaauacucaaaguuuuguccugcuggaugccgcgacguugccggcgauaucagugguaauaugguggacggguacagagauaccagccugcuuuguaaggcggcaauucaugccggaaucauagcugacgagcugggcggccagaucucugucuugcaaaggaaagggauuucccgguaugaaggaauccucgccaacggugugcugucacgcgauggcagcuuaagugacaagcgauuccuguuuacaucuaaugggugcuccagaagccucucguucgagccagacggacagauuagggcaucuuccucauggcagaguguaaacgagagcggcgaucagguucacuggucccccggucaagcucggcuucaggaccaggggccuucuugggccagcggcgauucaaguaauaaccacaaaccacgugaauggcuggagaucgacuugggagaaaagaaaaagauaacuggcauucgcaccacaggguccacccagagcaauuuuaacuucuacgugaagucuuuugucaugaauuucaaaaacaauaacucaaaguggaaaacguauaagggaaucgugaauaacgaggaaaaaguguuucaagguaacaguaauuucagagauccgguccagaacaauuuuauucccccuaucguugcgagguacgugcggguagugccacagacuuggcaucaacgaaucgcccuaaaggucgagcugauuggcugucagauaacacaggggaacgacagccucguguggcgcaaaaccucccagucuacuucgguuagcacaaagaaggaggaugaaaccaucacgagacccauuccuuccgaggaaaccucaacaggaaucaauauaacuaccguggcaauuccacugguccuucuggugguauugguuuucgcuggcauggguaucuucgccgcuuuuaggaaaaagaaaaagaaagggagucccuauggcucugccgaggcacaaaagacagacugcuggaagcagaucaaauacccguucgcccggcaccagagcgcugaauuuacuauuuccuaugauaacgagaaggagaugacccagaaacucgaccugaucacaucagauauggcgggauga

SEQ ID NO: 55132 - RNA, 2328 nt, Artificial Sequence
  derived and/or modified sequence opt3 from DCBLD2__Homo_sapiens__NP_563615
auggccagcagagcuguggucagggcacggcgcugcccccaguguccucaaguucgagccgcggcugccgcaccagccugggcugcacugccgcucucccguucucuucccccuugcucaaacaguagcuccuucucuaugccacuguuuuuguuacugcuacucgugcugcuucuguugcucgaggacgccggcgcucagcagggggauggauguggucacaccguacugggccccgaaucggggacacugacuucaaucaauuacccucagacguauccaaacagcaccgugugcgagugggaaauuagagucaagaugggagagagggugcggauaaaauucggcgacuuugauaucgaagacagugauuccugucauuucaauuaccuccgcauuuauaacgguaucgggguuucuagaacagagauuggaaaguacugcggcuuaggccugcaaaugaaucacagcaucgaguccaaagggaacgaaauaacucuuuuguuuaugucaggaauccaugugagugguaggggcuuccuggccagcuauucugucauugacaagcaggaucuaaucaccugucucgacacagcguccaauuuucuggagcccgaguucucaaaauacugcccugcagggugucuucugccauuugccgaaauuagcggaaccaucccgcacggcuaucgggauaguucucccuugugcauggcuggugugcaugccgggguaguuuccaacacucucggaggccagauaagcguggucauuucgaagggcaucccuuacuacgagucuucccuggcaaauaacgugacaucaguggucgggcacuuaaguaccagccuguucacguuuaagacuuccggauguuaugguacccucggcauggaaucugggguuauugcugacccacagaucacagccagcucagugcuugaguggacugaucacaccggacaagaaaauaguuggaaacccaagaaagcgcgccugaagaaaccuggcccacccugggccgcauucgcuacagacgaguaccagugguugcagaucgaucuaaacaaggaaaagaaaauuaccgguauaaucacgacuggguccacaaugguagagcauaauuauuacgugagcgccuaucgcauucuguacucugacgacggccagaaguggaccgucuauagagagccgggaguggaacaagauaaaaucuuucagggcaacaaggacuaccaccaggauguuaggaauaacuuccucccucccauaauugcucgguucauccgugugaacccaacucaauggcagcagaaaaucgccaugaagauggagcugcuugggugccaguuuauuccuaaaggacgacccccaaagcugacacaacccccuccaccgagaaauucaaacgacuugaagaauaccacggcacccccuaaaaucgccaaggguagggcuccaaaauucacccagccccuccagccucggaguagcaacgaauuuccagcgcagacagagcaaacuaccgcaucccccgauauucgaaauacaacugucaccccgaacgugacaaaggacguagcccuggcugccguuuuagugccuguccuggugaugguccuaaccacucucauacugauccuugugugcgcauggcauuggcgcaauagaaagaaaaagacggaaggcacauacgauuugccauauugggacagggccgggugguggaaaggaaugaagcaguuccugcccgcuaaagccguugaucacgaggagaccccugugcgguacucuucgagcgaaguaaaccaccucucaccccgcgaggucacuaccgugcugcaggcagacuccgcggaauaugcucagccacuuguuggcgguauuguggggacacugcaucaaagaaguaccuuuaagccugaggaaggcaaagaggccggauacgcagauuuggaccccuauaauucuccaggccaggaggucuaccacgccuaugcugaaccgcucccuaucacugggcccgaguacgccacaccaaucauuauggacaugagcggacaucccacgaccuccgugggucagccuucaacuagcacauucaaggcaaccggcaaccagccacccccucugguagggacauacaauacuuuacugucuaggaccgauuccuguaguagcgcucaagcccaguaugacacgccgaaggcgggaaaaccaggccuacccgccccugaugaacucguguaccagguuccacaaucuacccaggaggucuccggugcugggcgugacggcgagugcgauguguuuaaggaaauacuguga

SEQ ID NO: 55133 - RNA, 4344 nt, Artificial Sequence
  derived and/or modified sequence opt3 from DCC__Homo_sapiens__NP_005206
auggagaacagccugagaugcguguggguccccaagcucgccuucguucuuuuuggcgcuucccuguucucugcacaccuucaggugaccggguuucaaaucaaagccuucacagcguuaagguuucugucagaaccuagugacgcuguaacuaugcggggagguaaugugcuacucgauuguagcgccgaguccgaccgcggcgucccagugauuaaguggaaaaaggaugggauacaucuggcacuuggaauggacgaacgaaaacagcagcugucuaacggcucguugcucauccagaauauucugcacucacgucaucacaagccggaugagggucuguaccaaugcgaagccagccucggggacaguggauccaucauuucuagaacggcuaagguugcaguggccggccccuuaagguuccugagccagaccgaguccgucacagcuuuuaugggcgauacugugcuuuugaaaugugagguaaucggggaaccuaugccaaccauacauuggcagaagaaccagcaagaccugacacccaucccuggagauucacggguugugguccuaccaaguggugcccuccagauuagccgccugcagcccggcgacaucgggauuuauagaugcucugcgaggaauccugcauccucacggaccggaaacgaggccgaagugcgcauccuuagcgauccaggccugcaccgacaguuguacuuccuccaaagaccgaguaauguggucgcuauagaggguaaagacgccguucuggaguguugcgugucuggguaucccccuccauccuuuacuugguuaaggggagaagagguaauucagcugcggagcaagaaauacucgcuccuuggcggcucuaaccuguugaucuccaaugugacagaugacgacucagggauguauaccugugucgugacguacaagaacgaaaauauuagugcaagcgcugagcuaacuguucuggugcccccuugguuccucaaccacccauccaaucuguaugccuacgaaucuauggauaucgaguuugagugcaccgucagcggaaagcccgugccgacaguaaacuggaugaaaaauggugacguugugaucccuucagauuacuuccagauugucggcgggaguaaccuucguauacugggaguggucaaguccgacgaaggcuuuuaucaauguguggcggagaacgaagccgguaaugcacagacuagcgcucaguugaucguucccaaaccagccauuccuucuucaagugugcuccccagcgcuccacgcgauguaguccccgugcugguuuccucuagauucgugagguuaucguggcggccuccagccgaggcaaaggggaacauccagaccuucacagucuuuuucagccgagaaggcgacaaucgcgagagagcccugaacaccacgcaaccgggaucccuacagcucacugugggcaaucugaaacccgaggcuauguacacauuuaggguaguggcguauaacgaaugggggccuggagagucaagucagccaauaaagguugcaacccagcccgaacuucaagucccugguccaguggagaauuugcaggccgugucuacuagccccacauccauucugaucaccugggaaccgccugcuuacgccaacggcccaguccagggguaucgccucuucugcacggagguuucaaccggaaaagagcagaauaucgaaguggauggccugagcuacaaguuggagggucugaagaaauuuacagaauauucuuugcgguuccucgcauacaacagauacgggcccggcguguccacugacgauauuaccguagucacacugagugacgugccuagcgcucccccacaaaauguuucuuuagagguggucaacuccaggucaaucaaggugaguuggcugccucccccaagcggaacucagaauggcuuuauuaccggguauaaaauacgucaucggaagacaacccgaagaggagagauggaaacucuagagccgaacaaucucugguaccuguucacgggucuugaaaaaggcucgcaguauuccuuucagguuucugccaugacagugaacgggaccggaccucccagcaacugguacacugccgagaccccagaaaaugauuuggacgagucacaaguacccgaccagccuaguucccugcacgucaggccacagacaaacuguaucauuaugucuuggacucccccucucaauccgaacaucguggugcgcggcuauaucauugguuacggggucggcagcccauaugcagagaccguucggguggauuccaagcaaagauacuacucaauagaaaggcuggagagcaguucucauuauguaaucuccuuaaaggcguucaauaacgcuggagaaggcgugccccuguacgagagcgccacaacgcgcucgauuaccgacccuacugauccagucgacuauuacccccuuuuggaugacuuuccuacaucagugccggaucucucuacccccaugcugccaccuguuggggugcaggcagucgcccuaacacacgacgcugugcgaguuaguugggccgauaauuccgugcccaaaaaccagaagacuagcgaaguccggcuguauaccguacguuggagaacgucuuucagcgcauccgcuaaauacaagucagaggacaccacaagucucagcuauacugccaccggacugaaaccaaauacaauguacgaguuuucugugaugguuacuaagaacaggcgcuccucaaccuggaguaugacggcgcacgccacaaccuacgaagcugcaccuacuagcgcccccaaggaucuuacagugaucacccgggagggcaaaccaagagcugucauuguguccuggcagccgccuuuggaagccaaugguaagaucacugcauauauacuguucuacaccuuagacaaaaacauccccauugaugacuggaucauggagacaauuucuggggacaggcucacgcaucaaaucauggaucugaaucuugacaccauguauuacuuccgaauacaggcgcgcaacucgaagggaguaggcccacugagcgaucccauuuuguuucggacucucaaaguggaacacccugacaagauggccaaugaucaggguagacauggcgacgggggauauuggccagucgauacaaaccugaucgacaggucaacccuaaacgagcccccuauuggccagaugcacccgccacauggguccguuacaccccaaaagaauaguaaccugcucgugaucauaguggucacugugggaguuaucaccguacugguggucgugauuguugcugugaucugcacgcgucgcucuagcgcccagcagcggaaaaagagagcaacacacuccgcuggcaaaaggaaggguucacagaaagaucuucgaccucccgacuuguggauucaccaugaggaaauggagaugaagaauaucgaaaaaccaucugggaccgauccugccggacgggacagccccauacaaaguugccaggaucugacuccagucucccacagccagucugagacccaauuaggcucaaaguccacaagucauagcggucaggacacugaggaagcaggcucgucuauguccacccucgagcgcagccuggccgcuagaagggcgccucgggccaaacuuaugauuccgauggacgcacagucaaacaaucccgcugugguaagugccaucccagucccuacacuggaaucugcccaguaccccgggauccuaccauccccuacguguggauauccccacccgcaauucacccuccgaccagugccuuuucccacucugagcguugauagaggcuucggggcuggacgcucacagagugugagcgagggcccaacaacccagcagcccccuauguugccgcccucccaaccagaacacucuagcuccgaggaggcaccuucaaggacuauucccacagccugcguccguccuacccauccacugcggucuuuugcgaaccccuuacucccuccacccaugagugcuaucgaaccgaaggugccuuacacgccacugcuuucgcagcccgguccuacucugccaaagacccacguuaaaacagccagcuuggggcucgcaggaaaggccagaucuccccugcuaccgguguccgucccuaccgcucccgaggugucagaagagagccauaaaccaacugaagacuccgcaaauguauacgagcaggaugaccugagugagcagauggccucucuugaaggccucaugaagcaacugaacgcgauuacagguagcgcuuucuga

SEQ ID NO: 55134 - RNA, 1095 nt, Artificial Sequence
  derived and/or modified sequence opt3 from DCDC2C__Homo_sapiens__NP_001274373
augggcaccagagggcccagcgccccuguggacacaacuccagcuaagacgaucgucguuuacaggaacggagauccguucuauguggguaaaaaguuuguacugucccggcgccgagcagccaccuucgaggcgcuccuugaacagcugacagagcaaguggacguccccuuuggcgugcguagauuguucacuccuaccagggggcaccggguuuuaggacuggaugcucuacaggccggcgguaaauacguggcagccgggcgcgaaagauuuaaggagcucgacuauauucauauagucccaaggaaacccgcuaagauccggaagcugaaagaaauuaagccugugguacacugcgauaucaauguuccaucuaaauggcagacauaccaucgcauuucacgacacaucaacguguucaccaauggaagacuuuuuauacccccugcaaagaucauuaucccaaaauucagucugagcgacugggauauugucuuggccacuaucggcgagaagguguuuccgcucggcggggugaggaagcuguucacaaugaacggacaucugcucggugacuccaaagauuuacaggacaaucacuuuuaugucgcuguuggccuggagaccuucaaguacuuucccuauuggaaaucuccucgggugccaucggaaguacaacagcguuacgccaacguggagaaaaauucacagcgcaagaagaaagucgauagcaaggggaaggaacccuguaaauacgacggaauaccuccaaagacgcaggauaguguguauuacgcgaaagaggagaagaaaaagacucuugcagaacccuugguucaaagaggcgccgagggugacguguauaaggcuccgaccccuuccaaagaaacacagggggcccuggacgucaaggaggaacacaacgugcagcuagagguacccguugaucagaggcaagcagagauugugaaagaagacgaggaaauccaugagaauacuccagauuucgaaggaaacaaggacaaagaggaugcucggcucugcgaggacgucgaacgaaagauggcccgcgaguggaagccuguggauuga

SEQ ID NO: 55135 - RNA, 1431 nt, Artificial Sequence
  derived and/or modified sequence opt3 from DCDC2__Homo_sapiens__NP_057440
augagcggcuccucugccagaucaagucaccugagccagcccguggucaaguccguucucguguacaggaacggggacccuuucuaugcuggacggcgcguagugauccaugagaaaaaggucucuucguuugaaguguuccuuaaagagguuaccgguggcgugcaagcaccauuuggggccguccgaaauauuuacacaccgcguacuggacacagaauaaggaagcuggaucagauccagucaggcgguaacuauguggcugggggacaggaagcguucaaaaaguugaauuacuuagacauuggcgagaucaagaaacggcccauggaaguaguuaacacggaggugaagccugucauucauagccgcaucaaugugagugccagauuuaggaaaccacugcaagagcccugcaccauauuccuaaucgcaaacggcgaucucauuaauccugccucccggcugcuuaucccacgcaagacacugaaccagugggaccacguguugcagauggucacugaaaagauuacccuccgaucuggggcuguucauagacuguauacacuggagggaaagcucguggaaagcggugcagaguuagagaauggccaguuuuacguagccguggggagggauaaguucaaaaagcugcccuauuccgaacuuuuguuugacaaaucaaccaugcggcguccuuucggacaaaaggcuaguagccugccaccgaucgucggcucucgcaaauccaaggguucagggaacgauagacacagcaaaaguacugugggaucuuccgacaauagcucgccccagccucuaaagaggaagggcaaaaaggaggauguuaacucugaaaaacucacaaagcugaaacagaaugugaaacuuaagaacucccaggagaccauaccaaauucagacgaaggcauuuuuaaagccggggcggagcggagugagacgcgaggagcagccgaaguccaagaggaugaagacacucagguggagguacccguugaucagcgcccugcugaaaucguggacgaggaggaagacggugagaaggccaacaaagaugcagaacaaaaggaggacuucagcggcaugaacggggaucuggaagaggagggaggcagagaagcuaccgacgccccagagcaggucgaagagauuuuggaucacuccgagcagcaggcgaggcccgcccgggugaauggugggacagacgaagagaacggcgaggaacuccaacaggucaauaacgaacugcaguuagugcuggauaaagagcgcaagucucagggagcaggcagcgggcaagacgaggcugauguugacccgcagagaccucccaggccagaagugaagaucacuucaccugaggaaaaugagaacaaucagcagaacaaagauuacgccgcuguagccuga

SEQ ID NO: 55136 - RNA, 333 nt, Artificial Sequence
  derived and/or modified sequence opt3 from DCD__Homo_sapiens__NP_444513
augagauucaugacccugcucuuucuuacagcccuggcuggcgcauuggugugcgccuacgaccccgaggcggcuagcgccccuggguccggaaacccaugucacgaagcaucugccgcucagaaggagaaugccggugaagauccgggcuuagcaaggcaagcucccaaaccucggaagcagcgcucaagucugcuagagaaagggcucgacggagccaagaaagcggucggcggucuggggaaacuuggaaaggaugcaguugaagaccuggagagcgugggcaagggcgccguacaugaugugaaggacgucuuggauuccgugcucuga

SEQ ID NO: 55137 - RNA, 9897 nt, Artificial Sequence
  derived and/or modified sequence opt3 from DCHS1__Homo_sapiens__NP_003728
augcagaaggagcugggcaucgugcccagcugcccugggaugaaauccccaagaccgcaccuccuucugcccuuguuacugcuacuccugcuucuguugggagccggugucccuggcgcuugggggcaagcaggaucucucgaccugcagauugaugaggaacagccagccggcacccugauaggugacaucucagcggggcuccccgcuggaacugccgcaccuuuaauguacuucauuagugcccaggaaggcuccggcguugggacugaucuggcuaucgacgagcauuccggagugguaaggacggcacgggugcuugaucgcgaacaacgagaccguuauagauuuaccgccgucacaccagauggugcuacuguggagguuaccgugagggucgccgacauuaacgaucacgcgcccgcauucccucaggcccgggcugccuugcaagugccagagcauacagcauuuggcacccgcuacccgcuggaacccgcuagagacgccgaugcggggaggcuaggaacucagggcuaugcccucucuggugacggggcaggagagacauuccggcuggaaacccgcccuggcccagauggcacgcccguaccugagcuuguugugacuggggagcuggaccgagaaaacagaucgcacuacauguugcagcucgaggcuuaugacggagguucaccacccaggcgggcccaggcucuguuagaugucacccugcucgacaucaacgaucaugccccggcauuuaaucagucccguuaccacgccguggugagugaaucccuugcuccuggcucucccguccugcagguuuucgcguccgacgcagaugccggggugaacggagcuguaacauaugagauaaaucgcagacaauccgaaggcgacgguccauuuucaaucgaugcccacacuggguugcuacagcuggagaggccucucgacuucgagcagcggcgagugcaugaacuggucgugcaagcacgcgauggcggagcccaccccgagcuuggcagugcuuuuguuaccgugcaugucagagacgccaacgauaaucagccaagcaugacagugauuuuccugucugcagacgggagcccacagguaucagaagcggcuccuccaggacaguugguugccaggaucagcgugagugacccggaugacggugauuuugcacacgucaacgugucucucgagggcggggaaggacacuucgcccuguccacccaagacagcgucauuuacuuagugugcguugcucggcgccuggauagagaggagagggacgccuacaaucuacgugugacggcaacugauucgggcucucccccucuccgggcugaagccgcguuuguacugcaugucacagacgugaacgauaaugccccagcuuucgaccgacagcuuuauagacccgagccuuugccagaaguugcacugcccgguuccuucguggucagggugaccgcccgcgauccggaccaggggacuaacggccagguaacauacucacucgcuccuggagcccacacccauugguuuaguaucgauccaacgagcggcauaauuaccacagcagcgucccuggacuaugagcuugaaccccaaccucagcugaucgugguugccacugacgggggauugcccccacucgcuucuagcgccaccgucucaguggcacugcaggaugugaaugacaacgagccucaguuccaacggacauuuuacaaugcuaguuuacccgaggguacucagccaggcacaugcuuccugcaggucacagccaccgaugcagacuccgggccguuuggacuacucagcuauucucugggcgccggucuugggucaaguggcagcccucccuucagaauugaugcucacuccggagacguuuguacuacgaggacauuggaucgcgaccagggcccaucuucguuugauuucaccgugacugcgguggacgggggaggccugaaguccaugguauacgucaaaguguuucucuccgaugaaaacgacaaucccccucaauucuauccacgagaguacgccgcaucaaucagugcucagucucccccugguaccgccguucugcgguuacgugcccaugauccggaccaggggagccacggaagacuguccuaccacauccuugcuggcaauucaccacccuuguuuacacucgacgaacaaagcggucugcuaaccguggcauggccucuggccaggcgcgcgaacucugucgugcagcucgagauuggcgcugaggaugggggaggccugcaggccgaaccauccgcacggguugacauaaguaucgugcccgggacuccuacaccgcccauuuucgagcagcuucaauauguauuuagcgucccagaagauguggccccuggaacgucugugggcaucguccaggcucauaaucccccagguagauuggcaccuguuacccuguccuuaucagggggagaccccaggggccucuucagucuggaugccgugagcggucuucugcagacuuugcgaccacucgaccgcgagcugcuaggcccgguacuggaacucgaggugcgggcggggucgggagucccucccgcuuucgccguggcaagaguuagggugcugcuugaugacgucaacgauaauuccccagccuuucccgcuccugaggacacaguguugcugccacccaacaccgccccuggcacaccgauauacacuuuacgugcacucgauccagacucugggguuaauagccgcgugaccuucacgcugcuugcuggaggcgguggggccuuuaccgucgaccccacaacuggacacguacggcugaugagaccucuaggccccucagguggcccagcgcaugaacucgagcuggaagccagggaugggggaaguccuccccgaaccucccacuuccgguugcgcgugguugugcaggacgucggcacaagagggcuggcaccaagguuuaacucuccuacuuaucggguggauuuaccgagcggaaccacggcuggcacacaaguacuccaggugcaggcccaggcucccgacggugggccaauuaccuaccaccuggcagccgagggagccuccucaccuuucggccuugaaccccaaagcggcuggcuguggguccgagcugcguuggauagagaggcacaggagcucuauauccugaagguuauggccgugagugggucuaaagcugaacuaggacagcaaacugguacagccaccgugcgcgucuccauccugaaucagaacgagcauagcccaaggcuuucggaagacccuacuuuucucgcaguggccgagaaucagcccccgggcaccucaguugggcguguauucgcuacagaucgggacucuggaccaaacggcagacugacguacaguuugcagcaacuguccgaagauagcaaggcguuuaggauucacccucagaccggugaggugacuacauuacagacccucgaccgcgagcagcaaucuagcuaucagcugcuuguccaggugcaggaugggggaucacccccacgaagcacaacuggcaccguucauguggccguccuggacuugaaugauaacagucccacguuccuccaagcaagcggcgcugccgggggaggucugccuauccaggugccggacagaguacccccaggcacccuggucaccacucugcaggcaaaggacccugaugaaggggagaauggaaccauucuuuacacacucacuggccccgguucugaacuguuuuccuugcacccucauucaggggaguuacugaccgccgcuccacucauacgggccgagaggccccacuacgugcugacacuuagugcgcacgaccagggaagcccuccacgcuccgcaucucugcaauugcuaguucaggugcugcccucggcccgucucgcugaaccgccuccagaucuggccgagagagaccccgcugcaccugucccagugguucuuacggugaccgccgcugaaggcuuacggcccggcagccugcucgggucagucgccgcaccggagccugcgggagugggugccuugacuuauacacugguaggcggggcugaucccgaaggaaccuucgcccucgacgcagcuuccggcaggcuguaccuugcccgcccacuggauuuugaggcagguccucccuggcgagccuugacugugagagcugaggggccaggaggcgcgggcgcccggcuacugaggguucagguccaagugcaggacgaaaacgagcaugcacccgcuuucgcccgcgauccucucgccuuagcacugccagaaaacccggagcccggggcugcccuuuauacauucagagcgagugacgcugauggaccugguccaaauucugacgugagguaccggcugcuccgucaggaacccccugucccagccuugcgccuggaugcacgaaccggcgcccucagcgcucccagagggcuggacagggagacgacuccugcacuucuacuguugguagaggccaccgaccggccggcgaacgcuucccgcagaagggccgcacgggugucagcccgaguuuuugugacagaugaaaaugacaacgcuccagucuucgccucucccagcagagugcgcuuaccugaggaucagcccccaggaccugcagcucugcacguuguggccagggaccccgaucucggcgaagcggcccgggucaguuaucgucuggcauccgguggggacggacauuuuagacuucacagcucuaccggcgcucugucagugguaaggccacucgaucgcgagcaacgggccgaacauguguugacuguugucgcauccgaccacggcaguccgccucgaagcgcuacacaggugcugaccgugucggucgccgauguuaaugacgaggcccccacauuccagcagcaagaguacucugugcuacugagagaaaacaauccacccgggacuucccuccuuacccugagggcgacggauccugacguaggagcuaacggucaggugacauauggcggggucagcucagagaguuuuucuuuagacccagauaccggaguguugacuacccugcgcgcacucgaccgggaggaacaggaggaaaucaaucugacaguuuacgcccaggauagaggcucacccccucaacuuacucacgugaccguccguguagcuguggaggacgaaaacgaucaugccccgacguucgguagcgcacaccugagccucgagguuccagaagggcaggacccccagacauugaccaugcugagggccagugauccugacgugggcgcuaauggacaauuacaguaccggauucuagauggcgacccaagcggggcguuuguccuggaucucgccuccggagaguucgguacuaugcgcccccuugaccgagagguggaaccugcauuucagcugagaaucgaggcuagggauggcgggcagcccgccuugucugcaacacugcuccugaccgucacugugcuugacgccaacgaccaugcuccagccuucccgguuccugcguauagcguggaaguacccgaggaugugccagcaggaacacuccuguugcaacugcaggcccacgacccugaugcuggcgccaauggucacgucaccuacuauuuaggggcaggcacggcuggagccuuucuacuggaacccuccucaggcgagcuccggacugcugccgcacuugaccgcgagcagugcccaucuuacaccuucaguguuucggcgguggauggggccgcugccggaccucugagcacaaccgucuccgugacaaucacuguaagagacgugaacgaucaugcacccaccuucccgacgucuccauugaggcugcgacucccucggcccgguccaucauuuagcacacccacucuggcucuugccaccuuacgugcagaagacagagaugccggcgcgaaugcuuccauucuguaucgccucgccgggacaccuccgccaggaaccacuguugacaguuacaccggcgagauaaggguggcacggucucccgucgccuuggguccuagagaucgcgugcuguucaucgucgcuacagaccuagggaggcccgcccgaagcgcaacgggcgugauuaucguuggacugcagggcgaagcugagcgggggccaagauuuccuagggccucauccgaagcgacuauucgcgagaacgcucccccaggaaccccuaucguaaguccgcgugccgugcacgcaggcgguacaaacgggcccauaaccuauagcauccucucuggaaaugagaaaggcacuuucuccauucaaccaucaacaggugccaucaccguccggagcgcugaaggccuugacuuugaggugucgccuagacugagguugguucugcaggcagaaucugggggagccuucgcguuuacggugcucacucugacauuacaggaugccaacgacaaugcuccccgcuuccuucgaccacauuacgucgcauuucugccugagagucggccccucgagggcccgcuacuacagguggaagccgaugacuuggaucaaggguccggaggccagauuagcuacucacuggcugccucccagccagcaagaggucucuuccacguagacccuaccaccgggacuaucacaaccacagcuauacuugauagggagauuugggccgaaacucgccugguguugauggcgacggacagaggaucucccgcccugguuggcagcgcaacccucacagucauggugaucgauacuaacgacaaucggccaaccauuccccagccuugggaguuaagggugagugaagaugcucugcuugguuccgagaucgcccaagucacaggcaacgacguugauagcgggcccgugcugugguauguacuaucuccaucaggaccucaggacccguuuagugugggccguuacgggggacgagucucccucaccggcccccuggacuucgagcagugugaucgcuaucaauugcagcugcucgcacaugacgguccacacgaagggagagccaaucuuacugugcugguugaggaugugaacgacaaugcuccugccuuuagccagucuuuauaccaggucaugcuguuggaacacacgcccccaggaucggcgauacucucagugagcgcuaccgaucgggacuccggcgcaaacggccauaucaguuaucaccuggccucuccugcugauggguucagcguagaccccaauaacggaacacuauucacuauuguugguaccguggcccuuggccaugauggguccggagcagucgacguggugcuggaggccagggaucacggcgcuccgggucgcgcggccagagcaacaguccacguucaacuccaggaccagaaugaucaugccccuucauuuacccugagucacuaccggguggcuguaacugaagacuugccacccgggucuacacugcucacgcuugaggcaaccgacgccgauggaagcaggucccaugcugccguggacuauucaaucauuagcggcaacuggggccgagucuuccagcuggagccucguuuagcggaagcaggggagucugccggaccaggucccagagcucugggcugcuuggugcuccuggaaccucuagauuuugagucccuuacucaauacaaucugacaguugccgcagcugaccgcgggcagccaccccagaguagcguggucccggugaccguaaccguucucgaugugaacgacaacccucccgucuucacacgggccucguacagggugacuguuccagaagauacgcccgugggagcggagcuguugcacgucgaggccuccgacgcugauccuggcccacaugguuuagugagauuuaccguaucuucaggggaccccagcggacuguucgaacucgaugagaguuccggcacacuucgccuggcacacgcccuagacugugaaacucaggcucggcaccaacuggugguccaggcagccgacccugcuggcgcccauuuugcacucgccccaguuaccaucgaggugcaggaugucaaugaccacgggccggcguuccccuugaaccugcuuucuacaagcguggcugagaaucaaccuccaggaacccugguaacuacgcuccaugccauagauggugacgcaggcgccuuugggagguuacgauauucacuguuggaagcuggacccggcccugaggguagagaagccuucgcacugaacuccaguacaggggagcuccgggcuagggugccauuugauuacgaacacaccgagagcuuccgccuucugguuggagccgcggacgcaggcaaucuaucugccucagugacugucuccgugcugguuaccggcgaggaugaauaugaccccgucuuucucgcuccggccuuccacuuccaggugccugagggggcucguagaggacauagcuugggucacgugcaggcaacagaugaagacggcggggccgauggacugguacuuuacucucuggcgacaaguucgccauauuuuggcauuaaccagaccacaggugccuuauaccuccgagucgacuccagggcucccgggagcggaacggcaaccucaggcggcgggggacggacucgcagagaggccccuagggaacugcgguuggaggugaucgcucgcgguccccugccaggcucuagaagcgccacaguuccggugaccgucgauaucacucauacagcacucgggcuugccccugaccugaaucuacugcucgugggagcuguugcggccuccuugggcgugguagucgugcuggcauuagcugcccuugugcugggucucguucgagcaaggagucggaaggccgaggcugcgcccgggccaaugucacaagccgcaccccuggcuucugacagcuugcagaaacugggacgugaaccuccaagucccccuccaagcgagcaccucuaucaucagacccuuccgagcuacggcggccccggggccggagguccuuacccacgcggcgggucccuggaucccucucacucaagcggaagaggcucggccgaagcugcagaggacgaugaaauuaggaugaucaacgaguucccucgggucgccuccguggcuaguucucuagcggccagagguccagacagcgggauucagcaagaugcagacggccugucagauacguccugcgagcccccugccccggacaccugguauaagggacgcaaagcuggcuuacuccugcccggggcaggagccacauuguaccgagaagagggucccccugcuacugccaccgcauuucuuggcggguguggacugucucccgcgccaacaggcgauuaugguuucccugccgacgggaagcccugcguagcuggcgcccucacugcaauaguggcuggagaagaggagcugaggggcaguuacaauugggauuauuugcugagcugguguccacaguuucagccgcuagccuccgucuucaccgaaaucgcgcggcucaaggacgaggccagaccuugucccccagcuccccguauugauccuccaccccuuaucacagcaguggcccacccuggggcuaaaucaguuccgcccaagccagcaaacaccgccgccgcucgcgcaauuuuuccucccgccagccauaggucuccaaucagucacgaaggaucccugagcucagcggcuaugucuccuuccuucucgcccagcuuaaguccacuggccgcacggucuccgguggucuccccuuuugguguggcccagggccccagcgcuucagcccucagugcagaguccgggcuggaaccaccugacgacacugaguugcauauauga

SEQ ID NO: 55138 - RNA, 4110 nt, Artificial Sequence
  derived and/or modified sequence opt3 from DCHS2__Homo_sapiens__NP_001136024
augagccccugcggcagaaagaugggggagggaaggcagcaacggcgcgccccuguggguaaacugcuccuucugccaggccgacgugacaccccgcacgggagauccggaucuucaggcgcuaggacacagcggaguuuguuauggcugcuaguccauguuuggcucugggcagccagcgguuccucugcgcagcuguucaaccuuacucugucgguggaugaaggguugcccccugacacgcucguaggagauauccgcgcuggccugccagccgcacagcaacaggagggcucaggguuuuuccugagcgaagacagugaugacuccccucucuuagaugacuuucacgugcauccugauaccggaauuauaagaacagccaggcggcuggaccgcgagcgaagagaucacuacucuuucgucgcugcaacucuuuugggugccgugguucagguggaaaucagggucaaugacgugaacgaucauagcccacgguuuccccuggacucccuacagcucgacguaucagagcugaguccuccaggcaccgcuuuccgucuuccgguugcccacgaucccgacgcggggcuguuuagcacacaaggauauaccuuggugcagccuucugaucucccaaaggaccccgcaggcccuuucuuucagcugcgcuacagaacuccaggucccuuaccguccccucugcuccccgggucaagcaguccacuugagccucuggauuugguccuacugaggcggcucgaccgagaagaggccgcugcccaccgccugcagauugaagcaugggauggaggcagacccaggcggacaggccuucugucuguggaguugcgcgugcucgacgagaaugauaacccacccgucuucgaacaagacgaguauagagcugccguuagggaagaugcgcagccuggggccgaggugugucguguacgggcaaccgaccgagaccugggaccaaaugguuuugugagauacuccgucagggcucgccaggugccgggcgccgggagcggaggcggugcuuuaggggaugccgcauauuucgccguugaggagcugucgggcgugguccggguguggagaccccuagacagggaggcucaagcguggcaucagcucguaguugaagcacgcgauggaggcgccgagccugaaguggcuacgguccgagugucuaucgccguccuggacgugaacgauaaucggccagcaauucacguucuguuuuugacugaagggggaguggcccguguauccgaaggugcuagacccggcgacuacgucgccagggugucaguuagugaugcagacggggauugggagaaagaggacgaagcgaccggagagcugggcgugggucucggggauggcagcaucucccugucucuugaaggaggcgagggggacuucgcucuguugccuggagguccacccggcgucuucuuucucugcguggaagggccgcuggaucgcgagagccgggacuuauaugagcugcuacucguagccacagacgcaggaucaccuccacugaguacugaagagacccuuuugcugagaguggccgaucucaacgaccagcccccucuguucucccagcaacauuacaaggcuagcguuucugaagccgcagcucccggcacagucgugaugugggugucagccagugaugcggacgaggccgguagcgaucacgcuugguuaagguacaccgucguucagcuguccgcaccauguaaucuugggucuuugcagucgaaaauggugcacacggccgagugcggcccuagcuuugcuauagacuccgaaucaggagccaucaguacuauucgaacacucgaucgcgaggugcaggaagcaguagagcugaaggucguggcgcaagaccuaggcgaacccccacugucugccaccugucucguuagcaucacuguggaugacgucaacgauaaugagccgauuuucuggagacagguguauaacgcuacaaucgccgagcaugcaccuguugggcacugcuuucuucaggugaccgcuuccgacgccgauucaggacuuuacggcuucauagaauauagcuuguacgacgguuuucugucuuaugaggcaccccaggccuuccggauugacccacaugaugggcaaaucuguguaucccaggacauugauagggaacgugaccccgcuacguacgauuuacucgucgaggcgaaggacggaggcggucugagugcccaggcauuugugcgcguggaucuugaagacgucaaugauaaccacccuguuuucaauccaagcaccuaugugacaucuaucuccgacgagacucagcccggcaccgagaucauuaacguacuggcuacagaucaagacucagggauauacggaacuguggccuacgaauugaucccuggcaacgucaguagccucuuuaccauugacucgacaaccgggaucauauaucugacucuaccgcugucccaucucgagucuacgacacugagccuuauggugucagcccaggauggaggcgguuugaccgcuguuauuaaugcagacgugacuauccacaucuuccagaccacacuggccccagcggaauuugagcggcccaaauacaccuucuuagucuaugaagaugugccugaggacaguccaauugggacuguuaaggcuagagagccccucaacuccucugaaccuaucuucuacaggauuagcuccggagaucugggcgguaaauuuucaauacacccgcgacuuggcacaauccggacgcgcaagccccuggaccaugagacccaaccaguggucguacuaacugugcaggcccagcucgggagcgccccugcaugcaguucuacagaaguuaauauuaccgugauggaugucaacgacaaucaccccgcuuuccugagaacauccgaugagaucaggaucagccagacuaccccaccuggaacggcauuguaucuggcccgggcggaggaccgagauucgggcagaaacggguuaauucgcuacucaauagcuucuccccaaccaggaguguuugccaucgacagggcacucggcguacuguuccuuaaugguagucugggggccggagaacagcgugaguugacccucacacugcgggcugaagaucagggcgugcauccgcaggccgcacuacugguccuuacuguugugauugagaaaagagaacacuccccuagcuggaccuuugagcaccucguguaucaagucgaggugucugaaagccugucccccaugacacagauguugcagacucaggcucauccacuggguccccaaagggccgcgucaccuuuacgcuacagucucgagccaagcguugacucugccauguucggcauccgacccuacaccggguggauuuaucugagacggcaguuugacuacgaauccacgcagacauauaacuucaggguauuugcauggaucccugaggauggauuccuucaaaaugugucaaccacugucauagugcgcguuugggacgaaaacgauaauaguccgacauuucugcacgacguguuguuccucaaggucgaggagagcccagugccccagggcguaaucgggaagauuaccgcuaucgauauggacuccggcaaaaacggacagcugcuauacuuucugcuuucugaugguaaguucuucaaaaugaauccuaacacuggggaacucauuaauugggucgcccuggaccgugagcauagaggacaccaugaaaugaccguguugguuacagaucggggcucgcccccaaggaacgcuacgauggcaguguaugucagcgugaccgacaucaacgauaaucgccccuuuuucccccaguguuuaccaggcaaggagcugcacguuaaagugcucgaagggcaaccugucaacaugcuggugacuacaguauuugccaaggacccggaugagggaaauaacgccgaggugaccuacucaguuuccagugcucgacccaugccacuuaaagguaagacagcguucggcaagcagucuugcaaaaagcagacuaauaaacagaccaacaagauacugacguga

SEQ ID NO: 55139 - RNA, 783 nt, Artificial Sequence
  derived and/or modified sequence opt3 from DCK__Homo_sapiens__NP_000779
auggccacacccccuaagagaagcugcccauccuucucugcuucaagugagggcaccaggaucaaaaagauuagcauagaagggaacaucgcagccggaaaauccacuuuugugaauauucugaagcagcucugugaggacugggaagucguuccggagcccguggcgcgguggugcaacguacaaucuacgcaggaugaauuugaggagcuuaccaugucgcagaaaaaugguggcaacgugcugcagaugauguacgaaaagccugagcgcuggucauucacauuccaaacuuaugcuuguuugagccgaauccgugcccaguuagcaagucugaaugggaagcuaaaagacgccgaaaagccaguccucuuuuucgagagauccguguacucugauagguauauuuuugcuagcaaccuguacgaguccgaaugcaugaaugagaccgaauggacaaucuaucaggacuggcacgauuggaugaacaaucaguucggacaaucacuugagcuggacggcauaaucuacuugcaggcaacccccgaaacuugucuccaucggauuuaucugcgcgguagaaacgaggagcaggggaucccucuggaauaccucgagaaauuacacuacaagcaugaaaguuggcugcuucacaggacauugaaaaccaauuuugauuaucugcaggagguuccaauucuaacgcucgacgugaacgaagauuucaaggacaaguacgagagccuggucgagaaagugaaggaauuucuuucuacucuguga

SEQ ID NO: 55140 - RNA, 1269 nt, Artificial Sequence
  derived and/or modified sequence opt3 from DCLK1__Homo_sapiens__NP_001182344
augcuggagcucaucgaagugaacggcacccccgggagccagcuuuccacaccuagaucuggaaagucaccaaguccgagccccacuuccccugguucucugaggaaacaacggucgucacagcacggcgggagcaguacguccuuggccucuaccaaggucugcagcuccauggacgagaaugauggaccaggcgaagagguuucagaagaggguuuccagauucccgcuacaauaacugagcgcuacaaaguggggcgaaccaucggagacggcaacuuugcaguagugaaggaaugugucgagcguaguacagccagagaauaugcguuaaaaauuaucaaaaagagcaagugcaggggcaaggagcauaugauucagaaugaggugucuauccugcggcgcguuaaacacccuaacauagugcuacucaucgaagagauggaugucccaaccgaacuguaccuugugauggagcugguaaaagggggagacuuguucgaugcuauuacuuccacaaauaaguauaccgaaagagacgccucagguaugcucuacaaccuggcaagcgccaucaaguaucugcauagucucaauauuguucacagggauaucaagcccgagaacuuacugguguacgagcaucaagacggcucuaaaucccuuaaguugggggauuuuggacuggcuacgauagucgacggcccucuauauacugugugugguaccccaacauacguggcaccggaaauuaucgccgagacuggguacggacucaaagucgauauuugggcugccggcguuaucaccuauauccugcuuugcggcuuucccccuuuccgggggagcggagacgaucaggaagugcuguucgaccagauuuugaugggucagguagacuuuccaucgcccuacugggauaaugugucugacuccgcgaaggagcucauaacaaugaugcuguuagucgauguggaccaacgcuucucagcaguucaggugcuggaacacccuugggucaacgaugacggccucccagagaaugagcaccagcuuaguguggccgggaaaaucaagaaacauuuuaacaccggacccaagccgaauagcacggcugccggcguauccguuauugcacuggaucacgguuucacuaucaagcgaucugggagcuuggacuauuaccagcaaccuggcauguauuggauaagacccccacuacugauuaggcggggacguuuuucagaugaagacgcuacacgcauguga

SEQ ID NO: 55141 - RNA, 2301 nt, Artificial Sequence
  derived and/or modified sequence opt3 from DCLK2__Homo_sapiens__NP_001035350
auggccagcaccagauccaucgagcuggaacacuucgaggaaagggacaagcggccccgcccuggcucucgacguggggcuccaucaaguagcggagguuccucuucgucaggcccgaaagggaacggacucauucccagcccugcacauagugcccacugcuccuuuuacagaacaaggacucuucaggcgcugucuagcgagaagaaagcuaagaaagcccgguucuaucgcaauggcgauagauacuuuaaggguuugguguucgcaauauccucagacagguuucggaguuucgaugccuuacugaucgaacuaacgcgcagccucucugacaacgucaaucugccacaagggguucgaaccauuuauacaaucgauggauccagaaaggugacuucacuugacgagcuguuggagggcgaaagcuacguaugugcuaguaacgagcccuuuaggaaaguggauuauaccaagaauauuaacccuaauuggucugucaacaucaaaggcgggacaucccgggcacucgccgcugccagcucggugaagucugaaguuaaagaguccaaggacuucauaaagccaaaacuggugaccgucauccguucaggagugaagccccgcaaagcgguaaggauucugcucaauaagaaaacugcacauaguuuugagcagguuuuaacagauaucaccgaagccauuaagcuggacagcgguguggucaaaagacuuugcacguuggauggcaaacaggugacuugucugcaggacuucuuuggggaugacgacguguucaucgcuugcggaccugagaaguuucgguacgcccaagaugacuucguccuagaucacuccgaaugucgaguucucaagucuagcuauucacgcaguuccgcagugaaguacagcggcucuaaaucaccagguccgaguagaaggagcaagucccccgcuucuguaaacgggaccccuucgagccagcuguccacaccaaaaucaacuaagaguucuagcuccucacccaccagcccuggaucuuuccggggccuuaagcagauauccgcccauggccgcaguagcucuaaugugaacgggggaccagagcuggacagaugcauuucccccgaaggugucaauggcaacagguguucagagaguagcacauugcucgagaaauacaagaucgggaaagugauuggagauggcaauuuugcgguugugaaggaaugcaucgaccguucgaccgguaaagaguucgcccugaagaucauugauaaggcaaaauguugcgggaaggaacacuuaauagagaacgaagucuccauccugcggcgagugaaacacccgaacauuaucaugcucguagaggagauggaaacggcuacugagcuuuuucugguuauggaauuggugaagggcggagaccuauucgaugccauaacaucuagcaccaaauauacugagagagacggcucagcuauggucuacaaucuggccaacgcacucagguaucugcaugggcuuaguauugugcaccgcgauaucaagccugaaaaucuguuggucugugaguaccccgacggaacaaagucccucaaacugggugacuuuggcuuagccaccgugguugaggggccacuguauacggugugcggaaccccuacauacguagcucccgaaaucauugcggagacuggcuauggucuaaaggucgauaucugggcagccggggugauuaccuacauacuccugugcggcuucccacccuuucggucugaaaacaaucuucaggaggacuuguucgaucaaauccuggcuggaaaacucgaguuuccugccccauacugggacaacauuacagauagcgcaaaggaacugaucucccagaugcuucagguuaauguggaggccagauguacugcuggccagauccugucacauccgugggucagcgacgaugccagucaagaaaacaauaugcaggcagaggugaccgggaaauugaagcagcacuucaacaaugcgcuccccaaacaaaacucuacaaccacuggaguauccgugauuaugaauacggcucuggacaaggaaggucagauauuuugcagcaagcacugucaggauucgggcaggccugggauggagccaaucucacccguuccuccaucugucgaggaaauucccgugccgggagaggccgugccugcaccaacacccccugaaagucccaccccacauccucccccagccgcuccgggcggugagcgcgccgggacuuggcgacggcaccgugacuga

SEQ ID NO: 55142 - RNA, 1947 nt, Artificial Sequence
  derived and/or modified sequence opt3 from DCLK3__Homo_sapiens__NP_208382
augggcaaggagccccugacccucaaaagcauccagguggccgucgaagaacuuuacccuaacaaggcuagagcacugacauuggcccaacacuccagggcgccaucuccgcgguuacgcucacgacuguucaguaaagcucuaaagggggaccaucguugcggagaaacugagacgcccaaaagcuguuccgaaguugccgguugcaaggcagccaugagacaccagggcaagauuccugaggagcucucucuggaugacagggcucggacccagaaaaagugggggcgcggaaaaugggaaccagagcccucgucaaagccuccaagagaagcaacacuugaggagaggcaugcccggggcgaaaaacaccuggguguggagauagaaaagacuagcggggagaucauucgcugugaaaagugcaaacgagagagagaguugcagcaaagucucgaaagggagcggcugucccugggaaccucugaacucgauaugggcaagggccccauguaugacguagagaaauuagugcguacacgcagcuguagaagguccccugaagcuaauccagccucaggggaggagggauggaagggugauagucaucggagcucuccgcgaaaccccacccaggaacugcgcagaccuuccaaaucaauggacaagaaagaggauaggggcccagaagaccaggagagccacgcgcagggggcagccaaggcuaagaaagaucuugucgaaguguugcccguuacugaggagggacugcgggaagugaagaaagacacacgcccuaugaguagaucuaagcacggcgguuggcuacucagggagcaucaagccggguuugaaaaacugcgucggacccgaggagaggagaaggaagcagagaaggagaaaaagccaugcauguccggcggcagaaggaugacgcuucgcgaugaccagcccgcuaaacuggagaaggaaccgaaaacucggccugaggagaauaagcccgaaagaccaagcgggaggaagccucgccccaugggaaucauugccgcgaacgucgagaaacacuacgaaaccggucgagugaucggcgaugggaauuucgccguaguuaaggagugucggcaucgugaaacaagacaggcauaugcuaugaaaauaaucgacaagucgagguugaaaggaaaggaggacaugguggauucugagauucucaucauucagucccugucacacccaaacaucgucaaguuacacgaaguguacgagacugacauggaaauauaucugauucucgaguacgugcaaggcggugaucuuuuugacgccaucauugaaagugucaaauuccccgagccugaugcugcccugaugaucauggacuugugcaaggcccuaguucauaugcacgauaaaagcaucgugcaucgcgaccugaagccagagaaucuccugguacagcggaacgaagauaaauccaccacacuuaagcuggcagacuuuggguuggcuaaacacguggucagaccgauuuucaccguguguggcacgcccacuuauguugcgccugagauacucucugaaaagggauacggccuggagguggauaugugggcagccggggucaucuuauacauucugcuaugcggauuuccacccuucaggagcccugagcgagaccaggacgaacucuuuaauaucauacaacugggucauuucgaguuucuuccacccuauugggauaacauuucagacgcugccaaggauuuggugagucgccugcucguaguugacccgaaaaagcgguacacagcacaccaggugcugcagcacccuuggaucgaaaccgccggcaaaacuaauacagucaagagacagaaacaaguguccccaagcucugaggggcauuucaggucacagcacaagcgugucguggaacagguuaguuga

SEQ ID NO: 55143 - RNA, 3123 nt, Artificial Sequence
  derived and/or modified sequence opt3 from DCLRE1A__Homo_sapiens__NP_055696
augcuggaggacaucagcgaagaggauauuugggaauacaaguccaaaagaaagcccaaaaggguggacccuaacaauggcucuaagaacauacucaaaucagucgagaaggccaccgaugggaaguaucagaguaaacggagccgcaaucgaaagcgugcugcagaagccaaagagguuaaggaccacgaggugccacuuggaaacgcggguugccaaacauccguagcuucuucgcaaaauucaagcuguggcgaugggauccagcagacucaggacaaagaaacgaccccgggaaagcugugcagaacacagaagagucagcaugugucccccaaaauuaggccugucuacgauggcuauuguccaaacugccagaugcccuucucuagcuugaucggucaaacuccucgguggcacguguuugaguguuuagacuccccaccccgcucagaaaccgagugcccugaugggcugcuauguacaaguaccauuccauuccauuacaagagauauacucacuuucuccuggcccagagcagggcaggagaccauccguucucuucccccagcccugccagcggcggcaguuuuucugagacaaaauccgggguucuuugcagccuggaggaacgguggucgucuuaccagaaucagaccgauaacuccgugucaaaugacccauugcucaugacgcaauauuucaagaaaagucccagccugacugaggcuuccgaaaagaucucuacccacauacagacaagccagcaagcacugcaguuuacugauuucgucgaaaacgacaaacucgugggaguagccuuacgccuggcuaauaacucagagcacaucaaucuuccuuugccagagaacgacuuuagugauugugaaauuuccuacagcccccugcagucugacgaggauacccaugacaucgaugaaaagccggacgauucacaggagcaacuauucuuuacagaaaguagcaaggacgguucccucgaggaggaugacgauucuugcggcuucuuuaaaaagcgacacgggccucugcuuaaagaccaggacgaaucgugucccaagguuaauagcuuccugaccagagauaaauacgacgagggauuguauagguucaacucccucaacgaucugucacagccaauuagucagaauaacgaaucuacguuaccuuacgaccuggccugcacuggcggugauuuuguccucuucccaccagcgcuugcagggaagcuggccgcuagcgugcaucaagccacaaaggcaaaacccgacgagccugaauuucacuccgcucagucaaauaagcagaaacaggugaucgaggagagcucuguguauaaccaagucuccuugccccuaguuaagagucugaugcucaaaccguucgaaagccagguggagggauaccugucuucccagcccacccagaauacuauacggaaacuuucaagugaaaaccugaaugccaagaacaauacaaacagcgcgugcuuuugucguaaagccuuggagggcguaccugugggcaaggcaaccauucucaauacggagaaccugucguccaccccagcucccaaauauuuaaagauccugccuucugggcuaaaauacaaugcccgccacccaagcacaaaggucaugaagcaaauggauauuggaguguauuucggucugcccccgaaaagaaaggaagagaaacuccuuggcgaaucagcuuuggaggggaucaaccugaauccuguuccaagucccaaccagaagagguccucucagugcaaacggaaggccgaaaaaucacucuccgaccuggaguuugaugcaucaacucuucaugagagccaacugaguguggaauugucuuccgagcgaagccagcgccagaagaagagauguaggaaaucgaacucacuccaggaaggagccugccaaaagcggucugaccaccugaucaauaccgagagugaagcugucaacuuauccaaagugaagguauucacaaaaagcgcgcauggcggucugcagcgcgggaauaagaagauuccugagucuagcaacguuggcggauccagaaagaagacuugucccuuuuacaaaaagauaccaggcaccggguucacaguggaugcauuucaguacggagucguggaggguugcaccgccuauuuccuaacucacuuucauucagaccacuacgcuggccucaguaaacacuucacguucccugucuauuguagcgaaaucacagggaaucugcuuaagaacaaguugcaugugcaggagcaauacauucacccccugccacucgauaccgaaugcaucguuaauggagugaaaguaguccuguuagacgccaaccauuguccgggcgcagugaugauacuguuuuaucuuccuaaugguacuguuauuuugcacaccggggacuucagggccgaucccucuauggagcguucccuccuggcugaccagaaggugcacaugcuauaccuggauacaaccuauugcucaccagaauacacuuuucccagucagcaggaggucauccgguucgccaucaacacagcauuugaggcggugacgcucaauccucaugcucugguaguguguggcaccuacagcauuggaaaagaaaagguuuuccuugccaucgcagacgucuugggcuccaaaguggggaugucucaagagaaguauaagacucugcagugcuuaaacauuccagaaauaaauucgcucaucacaaccgauaugugcagcucacuggugcaccuucugcccaugaugcagauuaacuuuaaaggauugcaaucccaucucaagaaaugugguggcaaguacaaucagauccuggccuuccgaccuacaggguggacucacaguaacaaauuuaccagaaucgcugacgucauuccgcagacgaagggaaacauaucuaucuauggcauuccauacagcgagcauuccucauaucuagagaugaaaagguucguucaguggcugaagccccaaaagaucauuccuaccgugaauguggguacauggaaaucucgcagcacuauggaaaaguacuuucgggaguggaaacucgaagccggguauuga

SEQ ID NO: 55144 - RNA, 2079 nt, Artificial Sequence
  derived and/or modified sequence opt3 from DCLRE1C__Homo_sapiens__NP_001029027
augagcuccuucgagggccagauggccgaauaccccaccaucucuauugacagauuugauagggagaaccugcgggcucgcgcauauuuccucucacacugccauaaggaccacaugaaagggcuucgagccccuacacugaagcguagauuggaauguaguuuaaaaguguaccuguauugcagcccagucacuaaggagcuacuccugacguccccgaaauacagguuuuggaagaagcggauaaucucuauugaaaucgagacccccacacaaauuucgcuuguugaugaggcgucaggagaaaaagaggaaaucgugguaacucuguugccugcuggucauuguccaggcagcgugauguuccucuuucaggggaauaacggaaccguccuguauacaggcgacuuccgccuggcccagggugaggcagccagaauggagcucuuacacagugggggaagggugaaggauauacaguccguuuaccuggacaccacuuuuugcgauccccgguucuaucaaaucccuucucgcgaagagugucuuagcggcguguuggaacugguccgauccuggauuacaagaucaccauaccaugugguauggcuaaauugcaaagcugcauacggcuaugaguaccucuuuaccaaccugagugaggaacuugggguucaggugcacgucaauaagcuggacauguucaggaacaugcccgagaucuugcaccaucucacgacugaucggaauacccagauucacgccugucgucauccuaaagcugaagaguauuuucaguggagcaagcugccaugcggaaucacaucucgcaacagaauaccguuacacauuaucuccauuaagcccucaacuaugugguucggugaaaggagccggaaaaccaaugugaucgugcgaacaggcgagaguucuuaccgcgccuguuuuuccuuccacagcucguauucugaaaucaaggacuuccuguccuaccucugcccugucaacgcguauccaaauguuauucccguggggaccacgauggauaaaguaguggagauacuuaagccucuguguagaucaagucaaagcacugagccaaaauacaagcccuugggaaaacuaaagagggcacggacaguccaucgcgacuccgaagaggaagaugacuaccuguuugacgauccgcucccuaucccccugagacacaaggugccauauccugagaccuuccaucccgaaguuuuuagcaugacugccgugagcgagaaacagccagagaagcugaggcagacacccggcugcugccgugcugaauguaugcagucaagucgguucaccaacuuugucgacugcgaggaauccaauagcgagucugaggaagagguggguauuccugccucacugcaaggggauuugggaaguguacuccaccuucagaaagcagacggcgauguuccacagugggaaguguucuuuaagcgaaacgacgagaucacggaugaaucuuuagagaauuucccguccucuaccgucgcuggcgggucgcaaagccccaaacuguuuuccgacucagauggagagaguacacauauaucuagccagaacuccucacagagcacucacauuaccgaacaggguucucaaggcugggacucccagagugauacagugcuacucagcucucaggagagaaacuccggggacaucacuucacuggacaaggccgauuacaggccuaccaucaaggaaaauauuccagcgagucuuauggagcagaacgucaucugucccaaagacacauauagcgauuugaagucgcgcgacaaagaugugaccauuguuccuuccacuggagaaccaacgacacugucuagcgagacccacauacccgaggaaaagucacuccugaaucuuaguacuaacgccgacucccaaucuagcuccgauuucgaggugccgucaaccccugaagcagagcugccaaaacgggaacauuugcaguaccucuaugagaagcuggcuacaggcgagagcaucgccguaaagaaaagaaagugcaguuuacuggacaccuga

SEQ ID NO: 55145 - RNA, 1080 nt, Artificial Sequence
  derived and/or modified sequence opt3 from DCN__Homo_sapiens__NP_598010
augaaggccaccaucauucugcuccuucuggcucaggugagcugggcaggccccuuccaacagagaggguuguuugacuucauguuagaggaugaagccuccggaauagguccugaggucccagacgauagggacuuugaaccgucucugggccccguuugcccuuuccggugucagugccaccuacgcgugguacaguguucagaucucgggcuggacaaagugccaaaggaucuucccccugacacaacucuguuggaucuccaaaacaauaaaaucacggagauuaaggacggagauuuuaaaaaccugaagaaucugcaugcgcucaucuuagucaacaauaagauuaguaaagugagcccaggcgcuuucacaccccugguuaaacuugaacgauuguaccuguccaagaaccagcuaaaggagcucccugagaaaaugccaaagacccugcaggaacuucgugcccacgagaaugaaaucacuaaggugagaaaagucaccuuuaacggucugaaucagaugauagugaucgaguuggggacaaacccgcucaagucuucgggaauugagaauggcgcauuccaaggcaugaaaaagcugucauauaucaggauugccgacaccaacaucacuagcauaccccagggguuaccuccaagucugacagaacuccaucuugauggaaauaaaauuucccggguagacgcugcaucucugaaggguuugaacaaucuagccaaacugggccucagcuuuaacuccaucucagcuguugacaacgggagucuggccaauacgccccaccuucgcgagcugcauuuggauaacaauaagcucaccagagugccuggaggccuggcggaacacaaguacauucaggucguguauuuacacaacaauaacaucagcguggucgguucuuccgacuucugcccacccgggcauaauacuaaaaaggcaucauacagcggaguuagucuguuuucuaacccggugcaguauugggagauccaaccuuccaccuucagguguguauacgugcggagcgccauucagcuaggcaauuauaaauga

SEQ ID NO: 55146 - RNA, 1272 nt, Artificial Sequence
  derived and/or modified sequence opt3 from DCP1A__Homo_sapiens__NP_001277136
auggccgacguggucgaggaagagaccagaaggagccagcaagcugcacgggauaagcagucccccucucaggccaacggcugcucagaccaccgcccuaucgauauucuggaaaugcucagucgagcgaaagacgaguacgaacguagcgcuccauccgggcauaagcaccuuacaguugaggagcuguucggaacuucuuugccgaaagaacagcccgccgugguagguuuagauucggaggaaauggagagacugccuggcgacgcaucacaaaaggagccaaauagcuuucuacccuucccuuuugaacagcucgggggagccccacagagugagacgcugggcgugcccuccgcugcacaucacucuguccagccugaaauaaccacaccagugcuuaucacuccggccagcauuacccaauccaacgagaaacaugcucccacauauaccaucccucugucaccaguuuugagucccacucucccugccgaagcgccaacagcacaggugcccccgagccugccuaggaauagcaccaugaugcaggccgucaagacgacuccccggcagcgcuccccacugcucaaccaaccugugcccgaguuaucacacgcuagccugauugccaaucagaguccauucagagcaccccuuaacguaaccaauacagcugguacuucuuugccuuccguugaucugcuacagaagcucaggcugaccccacaacacgaccagauccagacacagccgcuugggaaaggagccaugguggcgagcuuuucgcccgccgcaggccaacuggcuaccccugagucuuucauagaaccacccuccaagacggccgcugcccgggucgcagccucagcuaguuugagcaacauggugcucgcgccucugcaguccaugcagcagaaucaagauccagagguguuuguccagcccaaaguuuuaucuagcgcaaucccgguggccggcgcuccucugguaacugccacaaccacugcagugucaaguguccuccuugccccauccguguuccagcagacaguuacccgcagcucugaccuggaacgaaaggcuucaagucccagcccuuugacgauugggacccccgagucccaaagaaaaccaucuaucauucuaucgaagucucagcugcaggauacacucauccaucugauaaagaacgacuccucauuucuuaguacucugcacgaaguguacuugcagguccucaccaaaaauaaggauaaccauaaucuguga

SEQ ID NO: 55147 - RNA, 1854 nt, Artificial Sequence
  derived and/or modified sequence opt3 from DCP1B__Homo_sapiens__NP_689853
auggccgcuguggcagccggcgggcuggucggaaaggguagagacaucagccucgcggcccuucagaggcacgaucccuacauuaaccggauaguugacguggcuucccaaguagcacuguauaccuucggccaucgcgccaaugagugggagaaaacagauguggaagggacuuuguuugucuacacgcgaucugcuucaccuaagcacggauucaccaucaugaaccguuuaaguauggaaaauagaacagagccaauuacuaaagaccuggauuuucagcuacaggacccguuccuccuguauaggaacgcacggcuuagcaucuacggcauuugguuuuaugauaaggaagagugccagcgcaucgccgagcugaugaaaaauuugacccaauacgaacagcucaaggcucaucaggguacaggggccggaauaucccccgugauccugaacucuggcgagggcaaggaaguugacauucugagaaugcucaucaaagcgaaggaugaguauaccaaauguaagacuugcucggagccuaaaaagauuacaucaagcagugcaaucuacgacaauccaaacuuaauaaagcccauuccugugaaaccauccgaaaaucagcaacagaggaucccccagccuaaccagacccuggauccagagccgcaacaccuuucuuugacggcccuguucgggaagcaggacaaagcuacuugucaggaaaccgucgagcccccucaaacacuacaucagcagcagcaacagcagcagcaacagcaggaaaagcucccaauucggcagggagugguacgcagccuguccuacgaggagccccgaagacacucaccuccaaucgaaaaacaacuuugccccgccauccagaagcugaugguuaggagugcagauuugcacccgcucagcgagcugccugaaaaucggcccugugagaacgguucuacucauuccgcuggcgaauuuuucaccgggccagugcagccuggaucaccccacaauauuggcacaagccgugguguccagaacgccagucgcacccaaaauuuauuugagaaacugcagucuacgccaggggcggccaacaagugcgaccccuccacuccugcaccagcuagcucggccgcucucaacagaucuagggccccgacauccgugacccccguggcaccuggaaagggccuugcccagccaccccaggcuuauuucaauggcucacugccuccacaaacugucgggcaucaggcgcacggacgggagcagaguacauugccccgacaaacccuaccgauaagcgguucccagacgggcucuagcgggguuaucucaccucaggaacugcucaaaaagcugcagauugugcaacaggagcagcagcuucacgcaaguaaccgcccagcccuggcugccaaauuucccguauuggcacaauccagcggaaccggcaagccucucgaaucuuggaucaauaaaacacccaacacugagcagcagaccccacuguuccaagugauaucaccucagaggauucccgccacagcugccccaaguuuacugaugagcccgauggucuuugcacagccuacuuccgugcccccaaaggaaagagagucuggucuacuccccguugggggccaggagccuccagcggcugccaccucgcugcuuuugcccauccaaagcccugaaccguccgugaucacaucaaguccacugaccaagcuccagcugcaggaggcacuucuguacuugauucagaaugacgauaacuuccucaauaucauuuaugaagccuaccuguucucuaugacucaagcugccaugaaaaagacgauguga

SEQ ID NO: 55148 - RNA, 1014 nt, Artificial Sequence
  derived and/or modified sequence opt3 from DCPS__Homo_sapiens__NP_054745
auggccgacgcugcaccccagcugggcaagagaaaaagggagcucgauguggaagaggcccacgcggcuagcaccgaagagaaggaagccggggucggaaacgguacaugcgcaccuguucggcuuccauucuccggcuuucgccugcaaaaaguguugcgagagucugcccgugacaagaucauuuucuuacaugggaaaguaaaugaggcuucaggagauggcgacggugaagaugcaguggucauacuggagaagacuccguuucagguggaacagguugcccagcuacucacggggagucccgagcugcaacuucaguucagcaacgacaucuacuccaccuaucaccuguuuccuccaagacaguugaaugaugugaagacaacugucguguaccccgcuaccgagaaacaucuccagaaguaucugaggcaagaccugcggcucauucgcgaaacaggagaugacuacagaaacaucaccuuaccucaccuggagucucagucgcuuucaauucaguggguauauaauaucuuggauaaaaaggccgaagcggacaggauaguuuucgagaacccagaucccagcgacggcuuugugcugaucccugaccuaaaauggaaucagcaacagcucgaugaccuguaccuuauugcaaucugucaucggcgcggcauucgaagucugagagauuugacuccagaacaccucccgcuguuaaggaacauccugcaccaggggcaagaggccauacuccagcgguaucguaugaagggagaccaucuucgcgucuaccugcacuacuugcccuccuauuaccaucuacacgugcacuucacagcucuggguuuugaggccccuggcucugggguggaaagagcacaucuccuggcugaggucauugaaaaucuugagugcgauccaaggcacuaucagcagcggacccugacguucgccuugcgagcggacgauccccuccugaaguuacugcaagaagcccagcagagcuga

SEQ ID NO: 55149 - RNA, 2046 nt, Artificial Sequence
  derived and/or modified sequence opt3 from DCST1__Homo_sapiens__NP_001137159
auggacaucaagcaccaucagaacggcaccagagggcaaaggcggaaacagccccacacaacugugcagcgccugcucacguggggacuuccugucagcugcuccugguuccuguggcgacagccaggugaguuuccgguuaccgccuuguuacugggcgcuggggcaggaggccuacucgccauuggucugggggcgaugggauggggcacaucuccccauauacguugugcuucacuucuguuggugccuaagaugcucggcaaagaagggagacuguucguacugggauacgcccucgcagccaucuauguggguccagucgcuaauuuaaggcacaaccugaauaacgugauugcaagucuuggcugcacuguugaguugcaaaucaauaacacccgggccgcuuggcgcauuagcacagcgccccugagagccauguuuaaggaucuacucuccucuaaagaacugcuuagggcagagacccggaauaucucggccacuuucgaagaccuggaugcucaggugaacucagagacaggguacaccccugaggacacgauggauagcggagaaacugcccagggccgcgaggcacgacaggcuccagccaguagauugcaucucuccacccaaaagauguaugaacugaagacaaaauuaagguguucuuacgucgugaaucaggcgauacugagcugccggcguugguuugaccgcaagcacgagcaguguaugaaacacaucuggguaccccuccuuacucaucuguugugccuaccuaugaaguucaaauuuuucugugguauugccaagguuauggagguguggugcagaaacaggaucccagucgaagggaauuuuggacagaccuaugauucccugaaccaaucaauucggggccucgacggcgaguucagugcaaauaucgauuuuaaggaagagaaacaggcuggggugcugggacuuaacacaagcugggaacgagugucuaccgagguccgcgacuacguuuauagacaggaggccaggcuggaaugggcuuugggucuccugcacguguuacuguccuguacguuccuacucguacugcaugccucauuuagcuacauggauaguuacaaucacgacauacgguucgauaacauuuauaucucuacuuacuucugccaaauugacgaccgcagaaagaaacuuggcaagaggacauugcugccgcuccguaaagcagaggaaaagaccgugaucuuucccuguaaaccuacuauccaggccuccgagaugagcaacgucgugcgggaacugcuugagacacugccaauuuugcuccuguuaguugugcugugcgggcuagauugggcucucuauucgauauucgacaccauccgacaccauucuuuucugcaguacuccuucagaucaagucacaaacuugaggucaaggugggaggcgauagcauguuggcgaggcugcuccgcaaaacgauuggugcacugaauaccuccucugaaacaguaauggagagcaacaauaugcccugcuuaccucagccaguugggcuggacgcccgggcuuauuggagagccgcagugcccaucggccuuuuggucugucucugccugcuacaagccuuuggauacaggcugcgccgagugauagcugccuucuauuuuccgaagcgggaaaagaagcguauucucuuccuguacaacgaucuuuugaaaaagagagcagcguuuacuaagcugaggcgcgcugccaucuuacggagagagaggcagcagaaagcaccucgacauccccucgccgacauccugcaccgcggcuguccacuucugcggagaugguugugcaggcguugugucgugugccaggcuccugaaacccccgagucauacguuugucgcacacucgauugcgaggccguguauuguuggaguugcugggacgauaugcggcaaagauguccaguaugcacucccagggaggaacuguccagcucugcauucucagacaguaaugaugacaccgcuuacgccggguga

SEQ ID NO: 55150 - RNA, 2322 nt, Artificial Sequence
  derived and/or modified sequence opt3 from DCST2__Homo_sapiens__NP_653223
augcccaaggugaugaaagacgucguucacccucugggcggggaggaaccaagcauggccagagcugugguaagguccgugggagguuucacccucggccuuucucuggcaacagccuacggguuguuagagcugcuagucgaaggacauucaccguggggcugccucguggguacucugacgcuugcggcuuuucugaguuuggggaugggauucagccggcagguucgcgccaccgugcuccugcugcucccccaagcauuuucccgacagggccguacauuacugcuugucgccgcuuucggcuuggugcugcaggggccuugugcaaacacucuaagaaauuuuaccagggccucugaggcuguagccugcggagcggaacucgcacugaaccagacagccgagguucuucaacgggcuaagcagccacuggugucggccuugaauaaaaucaaggcaauugcucgcaaaaccaaggaggucgccgauagagugaggaaguucuuucggucaauaauggacggugugaaacacaucgcgcgcgcccuccgaaacgucuggcaguggcuguuacauauuggcgauguuuguaauagcgaacuggggaaccccuaucucaagugcgcaagaguguucgacgaugcuaaagacaguuguaugaugguaaucccucaggccuaccaccuuugcuaugugcugaugccauuuaaguuggcucuauguggacuggccucccucguccaaguguucugcguuauucccaaauacauccagccuuuucugaggcagacuauaggcacaccagugauccagcuucugaaucggguccgucaagaguucgaauuuaacaugaccgcaacgcaucacuucucuguggauuugaaugccagccgcucccucucacagguagcuauggaccugcacgaggcgguuaguaugaaguuacauagagugagggaggcacuggcccuaauggguuucacuaccccgcuccugcuugucuugcuguaucuccaggcucuguuuuaccgguauuguuaccuuaacugggaucacuacgacaauauuuauaucacaagccgauuccugcgcauggaagccgugagaucuacugcaggguugcccaccguccucccucuguccgcccaugaggcuaggcgguacauuccacccggaucaaucuuuuuaagccaaugggaaaaguucuuuuauauacuggagacauucaaccuaauucgccaccuccugcuuguguuguuucugguuuuccucgauuacgccguguuuuggguacuggacuuagcaagacaccagcugcagggcgaaaucgucgcgaggaguccugugcuuguuucuuugaccguggagggcacgggguaugcuggaaauauuuaccgugaucucgucuccgccuucgacgugcugcagcaagguaacaucagcauccuaucgcggcgaugccugcucagaccaucugagcccgacuccacuggcuauauuguaauaggggugauguacggacugugcuuuuucaucacacuuuuuggcucauacguuaguagguugcgccgggucauuugugcaagcuauuacccguccagagaacaggagaggaucucuuaucuguacaauguguuacucagccgccgaaccaaccugcuugccgcucugcaucggucagugcguagaagggccgcagaucagggucaccgcagugcuuucuugguccucgccucccggugcccuugucuggggcccuucguuagccauuuuuggcuacaccaggcguauugccugggcuguggacaaccacaggacgaaggcgauauggagaacacugugucuugcucaacaccugggugucagggacucuacugccugaccuguuucagacuuuuggacaauacgugcagugugugugccagcccccuguccuaucagggugauuuagaccucgaacuggauucuucggacgaggagggcccacaacuuuggcuggcugcagcccagaggaaagaucccgaacaggcuuggcuacuccagcaacagcugcaggagguauuggggcgaagccuguccauggaaucaaccagugagucuagcgacuuagaugaagagaagggaccucaacagcgcaaacauggccagcagccacucccggaggcccaccaacccgucuccauacugacaucaccugaaccacaccggcccccugagacuagcucugcaaccaagggugcgccaacacccgccuccgaaccgagugugccucuuagcccacccucucugccugaccccucccauccaccucccaaauga

SEQ ID NO: 55151 - RNA, 1413 nt, Artificial Sequence
  derived and/or modified sequence opt3 from DCSTAMP__Homo_sapiens__XP_005251132
augggcaucuggaccagcgggacagacauuuuccugucccucugggagauauacgugucucccagaucaccuggauggauggauuuuauccagcaccuuggugucugcugucugguugccuugauuagugugggcuuacugagcguagcugcaugcugguuccuaccauccaucauugccgcggcugccucuuggaucauaacuugugugcuccugugcuguucgaagcaugcaaggugcuuuauccuucuggucuucuugucaugugggcuccgggaaggacgcaacgcccugauugcugcaggcacggguaucgugauucuggggcacguugagaauaucuuucauaacuucaaaggacucuuagacggcaugaccugcaaucugcgagccaagagcuuuaguauacacuucccgcuuuugaaaaaguauauugaagcuauccaauggauuuacggccuggccacaccccuauccguguuugaugaccucgucucuuggaaccagacucuggcggugagccuuuucuccccuucacauguacuggaggcacaguugaaugauaguaaaggggaaguucucagcgugcuguaucagauggccaccacaaccgaggucuuaucuucccugggacaaaagcuccuugcuuuugccggucugucauuggugcuacugggcacuggacucuucaugaagcguuuucuggggccauguggcuggaaauacgagaacaucuauaucacaagacaguucgugcaguucgacgaaagggagcggcaccagcaacgccccugcguccuuccucugaauaaggaagagagaaggaaauacguuauuauaccaaccuuuuggcccacgccuaaggagcggaaaaacuugggucucuucuuucugccaaucuuaauucaccuguguaucugggugcuauucgcagcuguagauuaucuccuguaccgccuuauauuuagcgugaguaagcaguuccagucuuugccgggguuugaaguccaucugaagcuccacggagagaaacagggcacucaagacauuauccaugauuccagcuucaauaucucgguguuugaacccaacugcauuccuaagccaaaauuccugcuuucugagaccuggguuccccuguccgugaucuugcucauucuggucauguuaggccugcuaucaaguauacucaugcagcugaagauccuugugagcgccuccuuuuacccuucuguagaacgaaaaaggauucaguauuugcacgcgaagcugcucaaaaagagaagcaagcaaccacugggggagguuaaacggcguuuaucacuguaccuuacaaagauccacuucugguugcccgugcucaaaaugauccgcaagaaacagauggacauggccagugcagauaaguccuga

SEQ ID NO: 55152 - RNA, 570 nt, Artificial Sequence
  derived and/or modified sequence opt3 from DCTD__Homo_sapiens__NP_001012750
auggugggcgggggacagcccugcgguccuaacaugagcgaggucuccuguaagaaaagagacgauuaccuggaauggccagaguauuucauggccguugcuuuucucucugcacaaaggucaaaggacccgaauagucaggugggcgccugcaucguaaacagcgaaaauaaaauuguggggauaggauacaacggcaugcccaaugguuguuccgaugacguccuuccuuggcggcgcaccgcggagaacaagcuggauacaaaauauccauacgugugccacgcugaauugaaugccaucaugaacaaaaauucuacugacguuaagggguguucgauguauguggcauuauuccccugcaacgagugugccaagcugauuauccaggcuggaauuaaggaggucaucuuuaugucagauaaauaccaugacagcgaugaagcaacggccgcucgacuacucuucaauauggccggcgugaccuuucguaaguucauaccuaaaugcaguaagaucguaauugacuuugauuccaucaacucuagaccaagccagaagcugcaauga

SEQ ID NO: 55153 - RNA, 1659 nt, Artificial Sequence
  derived and/or modified sequence opt3 from DCT__Homo_sapiens__NP_001123361
augagcccccugugguggggcuuccuccuuuccugccugggguguaagaucuugccuggagcccagggucaauuuccaagagugugcaugaccgucgacucuuuaguuaacaaagaguguugcccgaggcugggcgcugaaucagcaaaugugugugggagucagcagggacggggccagugcacagagguacgcgccgauacucgacccuggagcgguccuuacauucuacguaaccaagacgauagagaacucuggccaaggaaguucuuucaccggacguguaaaugcaccgggaauuucgcgggauauaacuguggcgacugcaaguuuggcuggacagggcccaauugugagcgcaaaaagccuccagugauaagacagaacauccauucccugucuccccaggaaagggagcaguuccuuggagcucuggauuuggccaagaaacggguccacccugacuacgugauuacuacccaacauuggcucggucugcugggcccaaaugggacacagccgcaguuugcaaacugcucgguuuaugauuucuuuguguggcuccacuacuauucaguccgcgacaccuuacugggacccggccgaccuuacagagccaucgauuucagccaucaggguccagcuuuugugacuuggcacagguaucaccuuuugugccuggagcgggaccuacaacgucucauugggaaugaaaguuucgcacugcccuacuggaacuuugccacaggacgcaaugagugugauguaugcaccgaccagcuuuucggcgcugccagaccugaugacccaacgcugaucuccaggaacucucgguucagcuccugggaaacuguuugugacucauuggaugacuacaaucaucucgugacccugugcaacggcacauaugagggguuacugcgacgcaaucagaugggaagaaacaguaugaagcuccccacucuuaaagauauaagggacugucugagcuugcaaaaguuugauaacccgccuuucuuucagaacucuaccuucuccuuucggaacgcgcuagaggguuucgacaaagcagauggcacacuggacucacaggucaugagccuccacaaucuggugcauaguuuucuuaacgggaccaaugcccugccccacucugcugccaacgauccaaucuucguggucauuuccaaucgcuugcucuacaacgcaacgacuaauauccuggaacacguuagaaaggagaaggcuacaaaagaauuaccuagccugcaugugcuaguacuccacucguuuaccgacgccauuuucgaugaguggaugaagagguuuaaucccccagcggacgccuggccccaggaacuggcaccuaucggacauaaucguauguauaacauggugccauucuuuccgcccgucacuaaugaggagcuuuucuugacaucugaccaacugggcuacuccuaugcuauagaucucccugugucaguugaagagaccccagguuggcccacgacccugcuuguggucauggggacacugguggccuugguaggccucuucguucuguuagcuuuucugcaguaccggcgacuaagaaaaggauauacuccucucauggaaacccaccugaguagcaagagguacacagaggaagccuga

SEQ ID NO: 55154 - RNA, 3762 nt, Artificial Sequence
  derived and/or modified sequence opt3 from DCTN1__Homo_sapiens__NP_001128512
auggcccagagcaagagacacguguacuccaggacccccucuggcucacggaugagugcugaggcaagcgcccgcccucugcgagucgggucccguguugaagugaucggaaaaggucauagaggcacaguagcguaugugggggcuacucucuucgccacgggaaagugggucggcgugauucuugacgaggcaaaagguaagaacgaugggaccguucaaggaaggaaauacuuuacaugcgacgaaggccacggcauauucgugcggcagucucagauccaggucuuugaggauggggccgacacuaccucgccagaaacaccggauucaagcgcuaguaaggugcugaagcgcgagggaaccgacacuacagcaaaaaccuccaaguugcccacgagaccugccucuacugguguagcuggcgccagcuccucauuagggccaaguggaagcgcgucugcaggcgagcuguccucaagcgaacccaguaccccugcccaaacaccacuagcugcccccauuaucccuacuccaguucucaccucuccgggugcagugcccccucugccaucccccagcaaagaggaagaggggcuuagggcucagguccgggaucuggaggaaaaguuggagacacuccgccugaaacgagccgaagacaaggcgaagcugaaagagcucgaaaagcauaaaauucaguuagaacaggugcaagaguggaagucgaaaaugcaggaacagcaggccgaucugcaaagaaggcuuaaggaggcacggaaagaagcuaaggaggccuuggaagcuaaggagcguuauauggaggaaauggccgacaccgcagaugccaucgagauggcuacgcuggacaaagaaauggcggaggaacgcgcagagucucuacagcaggagguggaagcccucaaggagagagucgaugaacugacuacagaccuugagauacugaaagcugagaucgaagagaagggauccgacggcgccgcaucaaguuaccaauugaaacagcucgaggagcagaaugccaggcugaaggaugcuuuaguucggaugcgagaccugagcuccucugaaaagcaggagcacgugaaacuccaaaaacuuauggagaaaaagaaccaggaacuggagguagugcgccagcagagagaaagguugcaagaggaacuaagccaggccgagucaaccauugaugagcugaaagaacaggucgacgcagcgcucggcgcugaggaaaugguggagaugcugacugaucggaaucuuaaccuggaagagaagguucgcgaguugagagaaacagugggggaccucgaggccaugaaugaaaugaacgaugagcugcaggagaaugcaagggaaaccgaguuagaacugcgugagcaacuagacauggccggagcucggguccgagaagcccagaagagaguggaggcagcucaggagacgguagccgauuaucagcaaaccaucaaaaaguacaggcagcucacagcgcaucugcaggacguuaaccgcgaacuuacuaaucaacaggaggccaguguggaacggcagcagcaaccuccacccgagaccuucgauuuuaaaauuaaguucgcugaaacaaaagcacacgccaaggcuaucgagauggaguugagacagauggaagucgcccaggcaaacaggcacaugucccugcucacugcguuuaugccggacagcuuccugcgcccugguggcgaccaugauugugugcuuguccuguugcucaugccccgacugauaugcaaggccgaguuaauucggaaacaggcucaagaaaaguuugagcugucugaaaauuguucagagcguccagggcuaagaggagccgcaggcgagcagcucaguuucgcugccggucugguguauagccuuuccuugcugcaggcaacccuccacagguacgaacaugcccugucucagugcucgguugacguguacaaaaagguagggagcuuauauccugagauguccgcucacgaacgcucacuggauuuucuuaucgaguugcuccacaaagaccaacuggaugagacagucaacguggaaccccuaaccaaggcgauuaaauacuaucagcaucuguacaguauccaccucgccgagcagccagaagacuguacuaugcaacuggcagaucauaucaaguucacgcagucugcucuugacugcaugagcguugaggugggccgguugagagccuuucugcagggaggccaggaagccacagauauugcuuuacuccugagggaccuugagaccuccuguucagauauacgacaauucugcaagaaaauccgccggagaaugcccgggacugacgcaccugguauuccagccgcgcuggcuuucggaccgcaggucagcgauaccuugcucgacuguaggaagcaccugacaugggugguagccgugcuacaggagguugcagccgcugcagcccagcugaucgcgccccucgcugaaaaugagggccugcuugucgccgcauuggaggagcuggccuuuaaggcuucugaacaaauauaugggaccccuuccaguagcccauacgagugcuuacgucagucuuguaacauucucaucuccacuaugaauaagcuggccacagcaaugcaggagggagaauaugacgcugagcggcccccuucaaaaccacccccgguggaacuucgcgccgcggcccugagagcagagaucacggaugcugaaggccuaggucucaagcuggaggacagggagaccgugauuaaggaauugaaaaagagucugaaaaucaagggggaggaauuaagcgaggccaacguccgacucucgcugcuugagaaaaagcuggauuccgcugcaaaggacgccgaugaacggauugagaaaguucagacucgcuuggaagagacacaagcccuccugagaaagaaagaaaaggaguucgaggaaaccauggacgcucuacaggcggauauagaccagcuggaggcagaaaaagccgagcuuaagcagaggcucaacucucaaagcaagcggacaaucgaaggccugcgaggaccuccacccucaggcauugcuacuuuggugagugggaucgccggaggugcaaucccuggccaggcccccggguccgugccaggaccuggccugguaaaagauucucccuuacuccugcagcaaauuagcgcuaugagacuucauauaucccagcugcagcacgaaaauucaaucuugaagggugcgcagaugaaagccagccucgcaagucugccaccgcuacacgucgcuaagcugucucaugaggggccuggcuccgaacuucccgccggagcacucuaccgcaaaaccagccaacuguuggagacguuaaaccagcugucgacccacacacaugugguugacauuacuaggaccucaccagccgcuaagucucccagugcccagcucauggaacagguggcgcaacugaaaucccuuagcgauacagucgagaagcugaaggacgaaguguugaaagagacuguuucucagcguccuggcgcaaccgugccaacggauuuugccacauuccccagcuccgcuuuucuacgggccaaggaggaacagcaggacgacaccguauacauggggaaagucacuuucucaugcgcugcaggauuuggccaaagacacaggcuggugcucacacaggagcagcugcaccaacuucauagucgcuuaaucagcuga

SEQ ID NO: 55155 - RNA, 1212 nt, Artificial Sequence
  derived and/or modified sequence opt3 from DCTN2__Homo_sapiens__NP_001248341
auggccgaccccaaguacgcugaucugccuggcaucgcaagaaacgagccagacguguaugaaaccagcgaucucccggaggacgaucaggccgaguucgacgcggagcuugaagaacugacauccacuucugucgagcacauuauaguuaaucccaacgcugccuacgauaaauuuaaggacaaaaggguggggacgaagggauuggauuucucagaccggaucgguaaaaccaagcgcacaggcuaugaaaguggggaguacgaaauguuaggagagggccuggguguaaaggagacuccucaacagaaauaucagcgacuacuccaugaagugcaggagcugaccacagaagucgagaagauuaaaaccacugugaaggaaagcgcaacagaggagaaacuuaccccaguucuguuggccaagcaacucgcugcacugaagcagcagcugguggccucccaccucgaaaaauuacuggggcccgaugcugccaucaaucuuacggacccugauggagcguuggcaaagcgucugcuacuccagcuggaggccacuaaaaacucuaagggcggcucagggggaaaaaccacagguacuccacccgacucgagccuugucaccuacgaacugcauaguagaccugagcaagacaaguuuucccaggcugccaaaguggcagaauuggagaagaggcucacagagcuggaaaccgcuguacggugcgaucaggacgcccagaauccauuaucugcgggccugcaaggggccugucucauggagacgguugaacuucugcaggcaaaggugagcgcuuuggaucuagccguccuggaccagguggaggcucgccuccaauccgugcugggaaaagucaacgaaauugccaagcacaaagcaucaguugaggaugccgacacucagaguaaggugcaucagcuuuaugagacaauccagagauggagcccgauagcuucuacccugcccgaauugguacaaaggcucgugacuaucaaacagcugcacgagcaggcgaugcaguucggccaauuacugacacaccuagauaccacgcagcagaugauugcaaauucccucaaggacaacaccacacugcuuacucagguccaaaccacaaugcgggaaaauuuggccacuguggaggguaacuuugcuucaaucgaugagcgcaugaagaaacuggggaaguga

SEQ ID NO: 55156 - RNA, 477 nt, Artificial Sequence
  derived and/or modified sequence opt3 from DCTN3__Homo_sapiens__NP_001268354
auggccggccugaccgaccuccagagacuucaagcuaggguggaggaacuggagcggugggucuacgggcccggaggugcacgcggcagccgaaagguugccgauggguuggugaaaguacagguggcguuaggaaacaucuccucuaagcgugaaagagucaaaauucuguauaagaaaauagaggaccuaaucaaguaccucgauccugaauauauugacaggaucgcuauuccagaugccucaaagcugcaguucauccuugcagccgugccggagcacgcugcacggcugcagcgcuuggcccaaauacauauccagcagcaggaccaaugcguugagauuacagaagagaguaaagcucuccuggaagaguacaauaagacuacgaugcugcucagcaaacaguuugugcagugggaugaguuacugugucagcuugaagccgcgacccaagucaagcccgcagaggaauga

SEQ ID NO: 55157 - RNA, 1404 nt, Artificial Sequence
  derived and/or modified sequence opt3 from DCTN4__Homo_sapiens__NP_001129115
auggccagccugcuccaguccgacagagugcuuuaccugguccaaggcgagaagaaaguuagggcucccuugucucaguuauauuucugccgguacuguucagaacugcgcagucuagagugcgugagccacgaaguagauucccauuauuguccuucuugccucgagaacaugccaucggcagaagccaagcugaaaaagaaucgaugugcgaacugcuuugacuguccggggugcaugcacacccuuucaacacgugcuacuagcaucaguacgcagcugcccgaugacccugccaaaaccacaaugaagaaggcauacuauuuggccuguggauucugcagauggacuuccagggauguggguauggcugacaaaucugucgcaagcggcggguggcaggagccagagaauccccauacccaacggaugaacaagcucauugaauacuaucagcagcuggcccagaaagagaagguggaacgcgauaggaaaaagcuggcuagacggcgcaauuacaugccucucgccuuuucccaacacacaauacauguuguggacaaguacggauuaggcacccgacugcagagaccaagggcgggugcaucaaucaguacucuugccggguugagccugaaagagggagaggaucagaaggaaauuaaaaucgagcccgcucaggccgucgacgaaguggagccucuaccagaagauuauuacacacggccgguaaaccucaccgagguuacgacucugcaacagcgucuucugcagcccgacuuccaaccugugugugcaucucaguuguauccacgccacaagcaccuccugauuaaaagauccuuaaggugccggaagugcgagcauaaucugucaaaacccgaauuuaacccuaccagcaucaaguucaagauacagcucgucgcugugaauuacaucccagaggugcgaauuaugaguauccccaaccuucgcuauaugaaagaaucucagguccuguugacacuaacuaauccgguugagaaccugacccacgugacacucuuugaaugugaggagggcgauccugacgacauuaauuccaccgccaagguaguggugcccccaaaagaacugguccuugcgggcaaggaugccgcagcugaguacgacgaacuggccgagccucaagauuuccaggacgaucccgacaucauagcuuuuagaaaagccaacaagguugggauuuucaucaaggugacgccacagagggaagagggagaggucacugugugcuuuaaaaugaagcaugauuucaaaaauuuggcagcccccauucggccuaucgaagagagcgaccaggguacagaaguaaucuggcucacccaacacguugagcugucguuaggcccacugcuaccguga

SEQ ID NO: 55158 - RNA, 255 nt, Artificial Sequence
  derived and/or modified sequence opt3 from DCTN5__Homo_sapiens__NP_001185940
auggagcugggcgaacuccuuuacaacaagagcgaguauaucgaaaccgccuccgggaauaaagugucuagacagucaguccugugcggaagucaaaacauuguuuugaaugguaagaacuucgugauaagcguauuuuuaucccccuacaucaggugucacucugcuugccgggaccgcaaacgaucggaugagucagugcgucugagcgucaauaacagagaaugguggggccuagugaauuggaggauguga

SEQ ID NO: 55159 - RNA, 573 nt, Artificial Sequence
  derived and/or modified sequence opt3 from DCTN6__Homo_sapiens__NP_006562
auggccgagaagacccagaaaagcgugaagaucgcucccggcgcagucguuugcguggaauccgagauuagaggggacguaacaauaggaccuaggacugugauccacccaaaagcccggauuaucgcggaagcugguccgauugucaucggcgaggggaaccugauagaggaacaagcccucaucauuaaugcauaccccgauaacaucacgccugacaccgaggauccagaacccaagccuaugauuaucggaacaaauaacguguucgagguuggcuguuauucucaggccaugaaaaugggugacaauaacgugauagaaucaaaggcuuacgucgggcgcaaugugauucuuaccaguggaugcaucauuggcgcauguugcaaccugaauacuuuugagguaaucccagagaacacaguuaucuauggcgccgauuguuugcgacgugugcagaccgaaagaccccagccucaaacuuuacagcuggacuuccuaaugaagauucucccaaauuaccaucaccugaaaaagacaaugaaagggagcuccaccccggucaagaacuga

SEQ ID NO: 55160 - RNA, 780 nt, Artificial Sequence
  derived and/or modified sequence opt3 from DCUN1D1__Homo_sapiens__NP_065691
augaacaagcugaaaagcucccagaaggacaaagugagacaauucaugaucuuuacccagucuucagagaagacagccgucaguugccucagccagaaugauuggaaacuugacguugcuacugauaacuucuuucagaaucccgaacuguacauuagggaguccgugaagggcucuuuggaccggaagaaauuagaacaacuguauaaccgcuacaaggauccucaggacgagaauaaaauagggaucgaugguauucagcaguucugugacgaucuagcacucgacccagccucgaucucaguacugauuaucgcguggaaguuucgagcugccacgcaaugcgaguucagcaaacaggaauuuauggauggaaugaccgagcuuggcugugacaguauagaaaagcugaaggcacagaucccgaaaauggagcaggaauugaaggagcccgggcguuucaaagauuuuuaucaauucacauuuaacuucgccaagaauccuggacagaaaggccucgaccuggagauggcuauugcauacuggaaccuggugcucaaugguagauuuaaguucuuagaccuguggaacaaauuccuuuuggaacaccauaagagguccaucccaaaggauacuuggaaucugcuacucgacuuuucuaccaugauugccgaugacaugagcaacuaugaugaggaaggggcuuggcccguccugaucgacgauuucguggaguuugcccggccucagauagcgggaacaaaauccaccacuguuuga

SEQ ID NO: 55161 - RNA, 1326 nt, Artificial Sequence
  derived and/or modified sequence opt3 from DCX__Homo_sapiens__NP_000546
augaagacccugccccuccacagccauugcacagagaugcagagacuucugccuaaauuggaaauguuaacucugggcuccucuuucuguucacuacaaggggaguuuugccaggccauggacaguuucacgaccgugagccacgucggaaugugugaagagacagaugcuuccuuuaacguuuucucuccaaaguuucaguucgacaggucgcauugccagucacuccgguuucaccaaaauauggaacuggauuucggucauuuugacgagcgcgauaaaacuagccgaaacaugcguggcaguagaaugaaugggcuuccgucccccacccacucugcacacuguagcuucuacaggacacggacccugcaggccuuguccaacgagaagaaagcgaagaaggugcgcuuuuauagaaauggagacagguacuucaaaggcaucguauaugcugugucaagugaucgguuucgcagcuucgacgcccuccuggcagaucugacucgaucucucuccgacaacauuaauuuaccucagggugucagauacauauauacaaucgaugggucaaggaagauuggaagcauggacgaacuggaggaaggcgagaguuacguguguucuuccgauaacuucuuuaaaaagguugaguauaccaaaaaugugaacccaaauuggagcgucaacgugaagacgucggccaauaugaaggcuccccagucucuugcauccucaaacagugcccaagcucgggaaaauaaagacuucguacguccuaaguugguuacuaucauucgcagcggcgugaaaccaagaaaggccgucagggugcugcuaaacaaaaagaccgcgcauuccuuugaacaggugcucacagacaucacugaggcaauaaaacuggagaccggggucguuaagaaacuuuacacacuggauggaaaacaggugaccugcuugcacgacuucuuuggugaugacgauguauucaucgccugcggccccgaaaaguuucgguacgcucaggacgauuucucucucgacgagaacgagugucgagugaugaaagggaauccuagcgccacggcaggaccaaaggcuucaccgacuccccaaaagacaagugccaaguccccuggcccaaugcgcagaagcaagucucccgcggauucagccaacgguaccaguagcucccagcugucuacuccuaaaucgaagcagagcccaauuuccacacccaccucaccggggaguuuaaggaaacauaaggaccuguaucucccucuuucucuggaugacagcgacuccuugggagauucaauguga

SEQ ID NO: 55162 - RNA, 735 nt, Artificial Sequence
  derived and/or modified sequence opt3 from DCXR__Homo_sapiens__NP_057370
auggagcuguuccucgccggcagaagggugcuugucaccggggcuggaaaggguaucggccgggggacaguucaggcacugcacgccacuggagcgcgcgugguagcugugagccgaacgcaagccgacuuggauuccuuaguccgugaaugccccggcauugagccuguguguguugaccugggugauugggaagcaaccgagagagcccuagggucugugggaccagucgaccuccuggugaacaaugcugcaguagcccuucugcagccguuuuuggaaguuacaaaagaggcuuucgauaggucauuugaggugaaccuccgggccgucauacaggugagucagaucguggcgcgcggccugauugcaagaggcguccccggggccaucguuaaugugagcucccaaugcucucagagggcuguaacuaaccauucgguguacuguucaaccaagggagcccuggacaugcucacaaaagucauggcauuagaacuggguccucacaagauucgggugaaugcuguuaacccaaccguggucaugacuagcaugggccaggccacauggagugauccccauaaagcgaagaccaugcuuaaucgcaucccuuuggggaaguucgccgagguggaacacguaguuaacgcaauacuguuucuacucuccgaccgaucuggaaugacgacuggcagcacccugccaguggaggguggguucugggcuugcuga

SEQ ID NO: 55163 - RNA, 558 nt, Artificial Sequence
  derived and/or modified sequence opt3 from DDAH1__Homo_sapiens__XP_011539460
augguggacaugaugaaggaggcccuggaaaaacuccagcuuaacaucgucgagaugaaggaugaaaaugcuacccuggacggcggggauguuuuguucacaggaagagaguuuuucguggguuuaagcaaaaggacuaaccaacggggcgcagaaauucuggccgacacguuuaaggauuacgcgguauccaccgugcccgucgcugacgggcuacaccucaaaucuuucugcucaauggccggaccuaaucugauagcaaucggcaguagcgaguccgcccagaaggcucuuaagauuaugcagcagaugucugaucaucgcuaugacaaacugacagugccagaugacaucgcagccaacuguauuuacuugaauaucccgaacaagggucacguucuccugcaucgaacucccgaggaauauccugagucggcuaaaguguacgaaaagcugaaagaucacaugcucauaccagucucaaugagcgaguuagagaagguggacgggcugcuuaccugcuguaguguauugaucaauaagaaaguugauuccuga

SEQ ID NO: 55164 - RNA, 858 nt, Artificial Sequence
  derived and/or modified sequence opt3 from DDAH2__Homo_sapiens__NP_001289937
augggcacccccggggagggacuggguagaugcagccacgcccucaucaggggcgugccugaaucccuugcuucuggggagggagcaggcgccggucugccagcguuggacuuagcuaaggcccagcgggaacaugggguccugggaggcaaacuacgccaacgacucggccugcagcuucuggaguugccgcccgaagagucacucccucuggggccacugcucggagauacagcaguuauucagggugacacugccuuaauaacgcgucccuggaguccugcuagaaggccagagguggauggcguacggaaggcacugcaggaccuuggguugcgcaucguggaaauuggagaugagaacgccacccuggacggcacagauguccuauucacugguagagaauuuuucguggggcucagcaaauggaccaaucacaggggagcugagaucguugccgacacauuucgggauuucgcgguguccaccguccccgugucuggcccuucgcaucugcgcggccuuugugggaugggagguccacgaacuguaguugcaggcucaagcgacgccgcucaaaaggccgugagagcaauggcuguccugacagaucacccguacgccaguuugacccuccccgacgaugcggccgcagacugccuguuuuuaaggccugggcugccaggagugcccccuuuccuccuucaucggggcgguggggaccugccaaacucccaggaggcuuugcagaaacuaucugaugugacgcugguccccguuagcuguuccgaacucgagaaggccggcgcuggacugucaagucuuugccugguguugagcacucguccgcacucuuga

SEQ ID NO: 55165 - RNA, 3423 nt, Artificial Sequence
  derived and/or modified sequence opt3 from DDB1__Homo_sapiens__NP_001914
augagcuacaacuauguggucaccgcccagaagcccacagcuguuaauggcugcgugacugggcacuucacguccgcagaggaccugaaccuccuuaucgccaaaaauaccagacuggaaauuuacguagugacagcggagggauugaggccugucaaggaaguggguauguauggcaaaauagcuguuauggaguuauuucggccaaagggggaaucuaaagaucugcuauucauccucacugccaaguacaacgcauguauucuggaguauaagcaaucaggagagaguaucgacauuaucacccgcgcccauggcaaugugcaggaucgaauaggucguccgagcgaaacagggaucauuggaaucauugaccccgagugcagaaugaucggccuuaggcuguacgauggcuuguuuaaagucauaccucucgaccgggauaacaaggaacugaaggcuuucaauauucgccuggaggagcuccacgugaucgacguaaaguuuuuauaugggugucaggcaccaaccauuugcuucguuuaccaggauccccaaggaagacaugugaaaacuuacgaagucucccugagggagaaggaauuuaacaaggguccuuggaaacaggagaauguggaagccgaggcuucuauggugaucgccgucccagagcccuucggcggggcgaucauuauaggacaggaaucgaucacauaucacaacggcgacaaguaccuugcaauugccccuccaaucauaaaacagucaaccauuguuugucauaaucggguggauccgaacgguagccgcuauuugcugggggacauggagggacgacuauuuaugcuccugcuugaaaaggaggaacaaauggauggcacgguaacucugaaagacuugagaguggagcuccugggcgagaccaguaucgcugaaugcuuaacauaccuggacaauggggucguguucguuggauccaggcucggugauucucagcuugugaagcugaacgucgacagcaaugagcagggcuccuaugugguagccauggaaacuuuuaccaacuuggggcccaucguugauauguguguggucgaccuagagcggcagggacaaggccagcuggugacaugcucaggugcauucaaagaagggagucuccguauuauccgcaacggcauuggaauacacgagcacgcuagcaucgaucugccuggcauuaaggggcuuuggccacugagaucugaccccaauagggagaccgaugacacguugguccucuccuuugugggacagacucggguucugauguuaaacggugaagagguggaagagacagagcugaugggcuucguagaugaccaacagaccuucuuuugugggaaugucgcccaucagcagcuaauccaaaucacuucagcgagcgugcgacucguuagucaggaaccuaaggcccuggugucugaguggaaagaaccacaggcaaagaacauuuccgucgcuagcugcaauucgucucaggugguaguggccguuggacgcgcucuuuacuauuugcaaauacacccccaggagcugagacagaucucccauacagaaauggagcacgaggucgccugucucgauauuaccccgcugggcgacucaaacggucuuaguccucugugcgcaaucggguuguggacggacauuagcgccaggauccucaaacugcccuccuucgaauuacugcacaaggagaugcuaggcggagaaauaaucccacggucuauucucaugaccacauuugagagcucacauuaccugcuuugcgcuuugggcgauggggcgcuguucuacuuuggacucaauaucgaaacuggucuguuaagugaccgcaaaaaggugacccugggcacacagccuacugugcuuagaaccuucagguccuugagcacaaccaacgucuuugcauguucugaucgucccacuguuauuuauucaaguaaucacaagcucguguucagcaacgugaaucugaaagagguaaacuacaugugcccacuaaauuccgacggguaucccgauucucuggcccucgcuaacaauucgacgcugacaaucggaaccauagacgagauucaaaaacuucauauccggacugucccuuuguacgaaagcccacgaaaaauuuguuaucaggaggugucccagugcuuuggcguucugucaaguagaaucgaagugcaggauaccucuggugggacaaccgccuuaaggccgagcgcauccacucaagcccucucaagcucugucuccaguagcaagcuguucucuuccucaacagcuccccacgagacgaguuuuggcgaagagguggagguucauaaccuucugauaaucgaccagcacaccuucgaaguguugcacgcccaucaguuucuccaaaacgaguacgcacugagccuaguaucguguaaacugggaaaggauccuaauacuuauuucauugucggcacagcgaugguguacccagaagaggcugagcccaagcaggggcgcaucguggucuuccaguacuccgacggaaaacuccagaccguugccgaaaaggaggugaaaggcgcaguauauucuaugguggaauuuaacgguaagcugcuugccagcauuaauucaacaguccgguuguacgaguggacuaccgaaaaagagcugagaacggagugcaaccacuauaauaacaucauggcuuuauaccucaagaccaagggggauuucauacuggugggagaccuuaugaggaguguucugcuacucgccuauaaaccuauggaaggcaauuuugaggaaauugcacgcgauuucaacccaaauuggauguccgcuguggagauccuggacgacgauaacuuuuugggugccgaaaaugcguucaaccuguuugucugucaaaaggacucugccgcuacaacugaugaggagcgacagcauuuacaggaagugggccucuuccaccugggggaguuuguuaauguguucugccacggaagccuugucaugcagaaccugggcgaaaccuccacacccacucaagggucaguauuguuuggaaccgugaauggcaugaucggucucguuacgagccugagugagucuugguacaaccuacugcuugacaugcagaaccggcucaauaaagugauuaaguccgucgggaaaaucgaacauagcuucuggcguucguuucacacagagagaaagaccgagccggcaacuggauucauugauggcgaccugauagaaucauucuuggauaucucuaggccuaaaaugcaggaggugguagccaaccugcaguaugacgaugguaguggcaugaagcgcgaagcuacagccgacgauuuaauuaagguggucgaggagcucacccggauccauuga

SEQ ID NO: 55166 - RNA, 1284 nt, Artificial Sequence
  derived and/or modified sequence opt3 from DDB2__Homo_sapiens__NP_000098
auggcccccaagaaaagaccugagacccagaagacaagcgaaaucgugcugaggccacggaacaaacgcucccgaucuccgcucgagcuugaacccgaggcuaagaaacugugcgcaaagggcucagggccuagucguagaugugacagcgauugcuugugggucggauuagccgguccacaaauucugcccccuuguagguccauaguucggacucuacaccagcauaagcucggccgcgcgucuuggccaucggugcagcaggggcugcaacagucauuccuucacacgcuggacagcuacagaaucuugcagaaagcugcccccuuugauaggcgggcaaccagucucgccuggcauccuacacacccauccacuguagcugugggaucuaagggcggugacauuaugcuguggaauuucgggaucaaagauaagccgaccuuuauuaaaggaaucggcgcaggcgggagcauaacaggacugaaguucaacccccucaauaccaaccaguuuuaugccuccucaauggaagguacuacacgcuuacaagacuucaagggcaauauccugcgagucuuugcuaguagcgauaccauuaacaucugguucugcucucuugacguguccgccucaagcagaaugguugugacgggggauaaugucggaaacgugauuuugcugaauauggacggcaaagagcuauggaaccucaggaugcauaagaaaaagguaacucacguugcgcugaauccuuguugcgauugguuucuugcaaccgccaguguggaccagacagucaaaaucugggaucugcgucaggugcgggguaaggcuucuuucuuguacucccucccacaccgccaucccgugaacgccgcauguuuuagcccugacggggcuagacuguuaacuaccgaccagaaaucggagauaagggucuauucugccucccaaugggauugcccacugggacucauuccccacccgcaucggcacuuccagcaccuuacaccuaucaaggcggccuggcauccccgauacaaucugauuguugugggccgcuauccagacccuaacuuuaagucauguacccccuacgaauugagaacgaucgauguauucgacggcaauagugggaaaaugaugugccagcuauaugauccagagagcuccggaaucucuagccugaacgaguucaaccccaugggugacacucucgcaucagcuaugggcuaccacauucugauauggagucaagaagaggccaggacacggaaguga

SEQ ID NO: 55167 - RNA, 1443 nt, Artificial Sequence
  derived and/or modified sequence opt3 from DDC__Homo_sapiens__NP_000781
augaacgccagcgaguucagaaggcggggcaaggaaaugguggacuacgucgcuaauuauauggaggggaucgaaggacgccagguuuaccccgauguggagccugguuaucugcgaccacucauuccggcagccgcgccccaagaaccugacaccuuugaggauauaaucaacgacguagagaaaauuaucaugccaggcgugacacacuggcauucccccuacuucuuugcuuauuucccuacugccucuucauacccagcaaugcuugccgauaugcugugcggggcuauuggauguaucggcuuuaguugggcagccagccccgcuugcacggaauuggagaccgucaugauggacugguuagguaagaugcuggaacuaccuaaagccuuccucaaugagaaggcgggggagggaggcggcgugauacagggguccgcaucugaagccacacugguugcccuucuggcugcacguacuaaagugauccacagauugcaggcugccucgccagagcucacccaggcggccauuauggaaaagcuggucgcauauucaagcgaucaagcucauaguuccguggagagggccggacugaucgguggcguaaagcucaaagcuauuccgucugacgggaacuuugccaugcgggcaagcgccuuacaggaagcucuggagcgcgauaaggcggcaggacuuauccccuucuuuaugguugccacauugggcaccacuacauguugcuccuucgacaaucugcuagagguggguccuauauguaacaaagaagauauuuggcuccacgucgacgcugccuacgcagggucagccuuuaucugcccagaguucagacaucugcuuaauggaguggaauuugcugauaguuucaacuucaauccccacaaguggcuguuggugaacuuugacuguagcgccaugugggucaaaaagaggaccgaccucacgggcgcauuccggcuggauccuacuuacuuaaagcacucucaucaggacuccggccugauuaccgauuaucgccacuggcagaucccacucgggcgaagauuuaggucacuuaaaaugugguucguuuuucggauguacggagugaagggucugcaagcguauauccguaaacauguacaguugagccacgaguucgaaagucuagugcgccaggaccccagauuugagauuugcgucgaggugauacugggccucguuuguuucaggcugaaggggucuaauaaagugaacgaagcccuucugcagcggaucaauuccgcuaagaaaauucacuuggucccgugccaucuccgagauaaguuugugcugcgcuucgcaaucuguagcagaacaguagagucggcccacguucaaagggcuugggaacauauaaaggaguuagccgcagacgugcugcgggcugaacgcgaguga

SEQ ID NO: 55168 - RNA, 2640 nt, Artificial Sequence
  derived and/or modified sequence opt3 from DDHD1__Homo_sapiens__NP_001153619
augaacuaccccggcagagggagcccuagguccccagagcacaauggacgggguggcgggggaggcgccugggaacuggguucugacgcucgcccggcauucgggggaggcgugugcuguuuugagcaucuccccggcggggauccugacgauggagacgucccacuugcccuguugcgaggugaacccggcuuacaccuggcgccugggaccgaugaccauaaccaccaucuagcucucgauccaugccugucagacgagaauuaugauuucaguagcgccgaauccggaucuucgcuucguuacuauucagagggcgagagcggugggggaggcaguucccugucuuugcaucccccucagcaaccaccgcucguucccacaaacagcggcgggggaggugcaacuggcggguccccuggagaaagaaagaggacgcggcugggcgguccagccgcucgccacagauacgaggugguaaccgaacuggggcccgaggaggugaggugguuuuauaaagaagacaagaaaacauggaagccuuucaucggcuacgauucacuccggauugaguuagcauuucgcacucugcuucagaccacaggagcccgaccacagggcggggacagagauggagaccacgucuguagucccaccgguccggcuucaucuuccggcgaagacgaugacgaggauagggccugcggguucugucagucaacuacaggacacgaaccugagaugguggaguugguuaauauagaacccgugugcguccggggcggucuguaugagguggacguaacccaaggggaauguuacccaguuuacuggaaccaggcggauaaaaucccugugaugcguggccagugguuuauugacggaacguggcagccccuagaggaagaggagagcaaucucaucgaacaagagcaucugaacugcuuccgcggccagcagaugcaggaaaauuuugauauugaggucaguaagucuaucgacgggaaggauggauccgguauaaacuauagcgcagugcacucguucaaacuuucuagaaaucacguggacuggcauuccgucgaugaaguuuaccuguauucagacgccacuaccaguaagaucgcuaggacagugacucaaaaauugggcuuuagcaaggccuccucuagcgggacccggcuccaccgaggauacguagaggaggcaacacuggaagacaaaccaucacagaccacgcauauuguguucgucgugcacggcaucggucagaagauggaucaagggcgcauuaucaagaacacugcuaugaugagagaggccgcgaggaaaauagaagaacggcauuuuaguaaucacgccacacacguugaguucuuacccguggaauggcgcuccaagcugacccucgacggcgauacugucgacagcauuacaccugauaaagugagaggacuuagggacaugcugaacucuucagcaauggauaucauguauuacaccaguccauuguaucgugacgagcuaguaaagggccugcagcaggaacucaaucggcuguacagccuuuucuguucccgaaacccggauuuugaggaaaaagggggaaagguuucuauugugucgcauagccugggcugcgucaucacguacgacaucaugaccgguuggaaccccgugagauuguaugagcagcuccugcaaaaagaggaagaguuaccugaugaaagguggauguccuacgaggaacgccaucugcuagacgagcucuauauuacaaagcggagacugaaggagauagaagagaggcuucacggguugaaagcuagcaguaugacucagaccccagcccugaaguucaaagucgaaaacuuuuucuguaugggaucuccccucgcuguguuucuggcccuucgcggcauccgaccugguaauacaggcagccaggaucacauucugccacgggagaucugcaaucguuugcucaacauauuccaccccacugacccgguugcauacagacuggaaccuuuaauucugaagcauuauuccaauaucucaccagugcagauccacugguacaacaccagcaauccccuaccuuaugagcauaugaaacccucuuuucucaacccagccaaggagccuacauccguaagugaaaaugaggggauuagcaccauccccucuccagucacuuccccggugcugucaaggcgccacuacggagaaaguauuacgaacauaggcaaggcuagcauccuuggggcggcaucgauuggaaaaggcuugggugggaugcuguucucccgguuuggaagaucuagcacaacccaaucaagugagacuuccaaggacucuauggaggaugagaaaaagccuguugccagccccuccgcuaccacagugggcacccagacucucccacauucaagcagugguuuccuggacucugccuuagagcuggaucacaggaucgacuuugaacuucgagagggcuuggucgaaucccgcuacuggagcgcagugacaucgcacacggccuauuggucaucucucgauguagcucuguuccuacugaccuuuauguacaaacaugagcacgacgaugacgccaagcccaaucucgauccuaucuga

SEQ ID NO: 55169 - RNA, 684 nt, Artificial Sequence
  derived and/or modified sequence opt3 from DDHD2__Homo_sapiens__NP_001157706
augagcuccgugcagucucaacaggagcagcugucacagagugaccccagcccuuccccaaacucuugcucgucauucgaacucaucgauauggacgccggcagccuuuacgagccggucaguccccacugguuuuauuguaagauuauagauuccaaagaaaccuggaucccuuucaauucugaggacagccaacagcuggaagaggcuuacuccucagggaagggaugcaacgguagaguugugccaacagauggcgggagguaugacguacauuugggagagcggaugcgcuacgcaguguauugggaugaauuagccagugagguccgacguuguacuugguuuuacaaaggcgacaaggauaauaaauaugugcccuacagcgaaucuuucucccagguucuggaggagacguacaugcuagcggugacccucgacgaauggaagaagaaacuggagucaccuaacagagaaauuaucauucuucacaauccaaagcugaugguccauuaucagcccguggcugguagcgaugacugggggaguacaccuacugagcaaggaaggccacggaccguaaaacgcggcguugaaaacaucucuguggauauacacugcggcaaugucaacagauuguuuuuccucacauuuggguguaucugccugcugcucaaguuauga

SEQ ID NO: 55170 - RNA, 1191 nt, Artificial Sequence
  derived and/or modified sequence opt3 from DDI1__Homo_sapiens__NP_001001711
augcugaucaccguguacugcgucagaagggaccucagcgagguuacauucucccuucaggugucucccgauuuugaacugcggaacuucaagguauugugugaggccgaaucacgcgugccugucgaggaaauucaaauaauccacauggagcgauuacugauugaggaccauugcagucuaggcagcuaugggcucaaagauggagacaucgugguucugcuucagaaggauaauguggguccacgugcuccgggcagagcacccaaccagccuagggucgacuuuuccgggauugccgugccaggaacuucuucgucacggccccagcacccuggccaacagcagcagcgcacgccagcggcucaaagaagccagggucuggccaguggggaaaaaguagcaggauugcagggccucggcucccccgcccugaucaggucuaugcugcucagcaauccucaugauuuaucccugcuuaaggagcggaacccaccguuggcugaagcacugcuaucagggagucucgagaccuucagccagguucugauggagcaacagcgcgaaaaagcccuucgagagcaggaaagacugagguuguacacagcugacccccucgaucgggaggcccaagcgaagauagaagaggagauccgucagcagaauauugaagagaacaugaauaucgcaauugaagaggccccugaaucuuuuggacaggugacuaugcuguauaucaacuguaaggucaauggucacccauuaaaggcuuucguggacuccggcgcccaaaugaccauaaugucacaggcaugcgcugagcgcuguaacauuaugagacugguggauaggcggugggccggggucgcgaaaggaguuggcacacagcgaaucauuggucgcgugcaucucgcccagauccaaaucgagggggacuuucuucagugcagcuucaguauucuggaagaucagcccauggacauguugcuaggacuggacaugcucagaaggcaccaguguucuauagaucugaaaaagaauguacuugugaucggcaccacuggcacacaaaccuacuuucugccugagggggaauugccacucugcucccggauggucagcggacaggacgagucgucugauaaagaaauuacgcacuccgugauggacucaggucgcaaggagcauuga

SEQ ID NO: 55171 - RNA, 2997 nt, Artificial Sequence
  derived and/or modified sequence opt3 from DDIAS__Homo_sapiens__NP_659455
augaacagaaggcggaaguuccugcucgccagcgugcuugcucugcaaaauuccucuuuuaucuaccccucaugccaaaaauguuucagucgcauuauauuggucagcaagcgauccaacugcccuaaauguggcucuaccggggagucgggaaaugcaaacuaucguuacaaguuaucacugaaaguugccgaaagcaauaagcuauuugugaucacaguauucgguaguugccucgacacguuuuucggccugacugcgaccgggcuucacagauauauucaggauccaaacaagaucccggagacacuggacaaugauacuacccagaacuugcucacaaaagcuguggaaaccuguuuugucggacaguccuucauuuuuggcgugacuaauuucgagaaccaacccggucaggggucugacgccagcaauuuucugcagcagugcuccgaucauaagaggaaagcaaaggcccugguugcuugucaaaucgugcucccugacccaggaauagcaggcuucacagucaucgauuacuuucaccaguuacugcagaccuucaacuuccggaaacuucagugcgacucacaagcccccaauaaccauuugcuggcucuagaucacaguaauagcgaccucucuuccauuuauacgucagauagcaccagugacuuuuucaagucuuguuccaaggauacuuuuagcaaauucuggcagccuucgcuggaauuuacaugcaucgugucucagcuuacugacaacgacgauuucuccgccucagagcaaaguaaggcguuuggcacccugcagcagaaccgcaaaagcauuuccaucgcagaggccacagggucuagcucaugucaugacccaauacaggauaguugguccuugguaagcuacauggacaagaaaucuaccgcugaaaagcucggaaaagagcuggguuuacaagccaaggaacugucagcaguucacaguagccaccaugagauuggcgugaaugauuccaaccucuucucucuugagaugagagaaccccuggagucgagcaauacgaaguccuuucacucagcugucgaaaucaaaaacaggagucagcaugaguugccuugcuuccagcaccacgggauugacacuccaacaucucuacagaagcggagcgccugcuguccgcccucccugcuccgccuggaagagaccgcgucaagcucucaagauggagacccucagaucugggaugaccuuccauuuuccgagagucugaauaaauucuuggccgugcucgaaagcgagaucgcagugacucaggcugaugucucuucccgaaagcaucacguugacaacgacauugauaaauuucaugccgaccacucaagacugagugugacaccccagaggaccacgggcgcuuuacauaccccuccaauagcccugcggagcucgcaaguaaucgugaaggcaaauugcuccaaggaugacuuccuauucaacuguaaagguaaucucucucccagcgucgaaaaggagucacagccggauaacaaaguggaagccguuagugugaaucacaacgggcgugacauguccgaguauuuucugccuaaucccuaccuuucugcuuugagcuccucaagcaaggaucuggagacaauugucacucucaaaaagaccauccgcauaaguccacacagagaaucugaccauuccagccugaacaauaaguaccuuaacggaugcggcgagauuucggugucagaaaugaacgagaaacugacaacuuuguguuauaggaaguacaaugauguaucugaccucugcaaacuggaaaacaagcaguauugucgguggaguaaaaaucaggaugacuccuucaccaucugccgaaaguuaacauacccucuggagacccuauguaacagccccaaucgcucuacuaacacgcucaaggagaugccauggggccacaucaauaacaauguuacacaaagcuauuccauuggguacgaaggaucauaugaugcgagugcagaccuguuugacgauaucgccaaagagauggacauugcuaccgaaauaacuaagaaaagccaggauauccuuuugaagugggguaccucucuggccgagucccaucccucagagagugacuucagccucagaucccugucugaagauuuuauucagccuucgcaaaaauuaagccugcagucacuuuccgacaguaggcacucucggacaugcagcccaaccccgcacuuccaguccgauucagaguacaacuuugaaaauucucaggacuucgugcccuguagccaaaguacuccuaucuccggcuuucaucagacacgcauccacgggauuaacagagcauucaagaaaccagucuuuuacagcgauuuggacggaaauuaugagaagauaaggaucuuccccgaaaacgauaagcagcaggccucuccuucaugccccaaaaauauuaagacgccaucccagaaaauccguaguccgauugugagcggcgucucgcagccugacguguuuaaccauuacccauucgcugagugccacgagaccgauucugacgaauggguucccccuacuacacagaagaucuuccccuccgacaugcucgguuuucaggggauaggccugggaaaaugucuagccgcauaucauuucccagaucaacaggagcugccucggaagaagcucaaacacauccgacagggcaccaacaaggggcugauuaaaaagaaacuuaagaauauguuggcggcugugguaacaaagaaaaagacucacaaauacaacugcaagagcucaggauggaucaguaaaugucccgacauucaaguccuggccgcaccacaguuacauccgauccucgguccugauucuugcuccgaagugaaguguugccugcccuuuagcgagaagggcccacccucaguuugugaaaccagaagugccuggagcccugagcuuuucuccuga

SEQ ID NO: 55172 - RNA, 579 nt, Artificial Sequence
  derived and/or modified sequence opt3 from DDIT3__Homo_sapiens__NP_001181983
auggagcuggugcccgccaccccucacuacccagcugacguccucuuccagacagauccgacugcagaaauggccgcggagagccuucccuuuuccuucggcacgcugucuucaugggaauuggaggcuugguaugaagacuuacaagagguucugaguagcgaugagaacgggggaaccuacguguccccuccagguaaugaagaggaagagucuaagaucuuuacaacucuagaccccgccucgcucgcauggcugaccgaggaggaaccugaaccagccgagguaacaucaaccagccagaguccccauuccccugauucuagccaguccucacuugcucaggaagaggaggaagaggaccaaggcagaacuaggaaacggaagcagagugggcacagcccagcacgcgccggaaaacagcgaaugaaggaaaaagagcaggaaaacgagcguaagguggcucaacuggccgaggaaaaugagagauugaagcaggaaauugagaggcucacacgggaagucgaggcgacccgcagagcacugauagauaggauggugaaccugcaucaggccuga

SEQ ID NO: 55173 - RNA, 699 nt, Artificial Sequence
  derived and/or modified sequence opt3 from DDIT4__Homo_sapiens__NP_061931
augcccagccugugggacagauucuccucuucaaguaccagcuccucuccuucgucacucccaaggacaccgacucccgaucggccuccacgcagcgccuggggcagugcuacgcgagaggaaggguuugaccguuccaccucucuugagagcuccgauugcgaaucacuggacaguagcaacucuggauucggucccgaggaagauacagcauacuuggacggcguguccuuaccugauuuugagcugcuaucagacccagaggaugaacaccucugugccaaucugaugcagcuucugcaagagagcuuggcgcaggcuagacucgggaguaggcggcccgcccgccugcugaugccuucucagcucgucucccagguuggaaaggaauuacugagacuugcauauagcgagccaugcggcuugaggggugcccugcuagacguguguguagagcaagggaaaucgugccauucugugggacagcucgcucuggauccgucccuuguccccacuuuccagcugaccuuggugcuccggcuggacucacgcuuauggccuaagauccagggccuguuuaguagcgcaaacuccccauuccuccccggcuuuucucaaagccuuacacugucaaccggguuccgaguuauuaaaaagaaauuguacaguuccgaacagcuacugauagaggaauguuga

SEQ ID NO: 55174 - RNA, 582 nt, Artificial Sequence
  derived and/or modified sequence opt3 from DDIT4L__Homo_sapiens__NP_660287
augguggccaccggcagccuguccucuaagaaccccgcuucaaucagugagcuccuugauugcggguaccacccugaaagccuguuguccgauuucgacuauugggauuacgucguuccagagccgaauuuaaacgaagugauuuuugaggaaucuacaugucagaaucugguaaaaaugcuagagaacugccucucgaagucaaaacaaacuaagcugggauguagcaaagugcuuguccccgagaagcugacgcagagaauagcacaggacguguugaggcucaguuccaccgaaccuugcggucugcggggcuguguuaugcaugugaaucuggagaucgaaaacgucugcaagaaacucgaucgcauugugugugacucuagcguaguuccaacauucgaguuaacucugguguuuaagcaggagaauugcuccuggaccucauuccgagacuuuuucuuuagucgugggagauucagcucuggauuuaggcggacacuuaucuuguccucaggcuuccgccuggucaaaaagaaacuauauagccucauugguaccacugugaucgaagggaguuga

SEQ ID NO: 55175 - RNA, 2136 nt, Artificial Sequence
  derived and/or modified sequence opt3 from DDN__Homo_sapiens__NP_055901
augcuggacggcccccucuucagcgaggggccugauuccccaagagaacuucaggacgaggaaucuggaucaugccugugggugcaaaagaguaaauuguuagucaucgagguuaagaccauuagcugucacuacuccaggcgggccccgucucgccagcccauggauuuucaggcuucgcauugggcacgagguuuccagaaccguacaugcggcccuagaccagggucaccccaaccuccacccaggcggccuugggccagccgcgugcugcaggaagcgacuaauuggagagcuggaccacuagccgagguaagggcacgggagcaggaaaaacgcaaggccgcuagucaggagcgagaagcaaaagagacggagagaaagaggcggaaggccggcggugcucgucgcuccccgcccgggagaccuaggccagaaccccggaacgccccucgaguggcgcaacucgcaggacugccagcccccuugcgcccggagagacuggcuccugucggcagggcaccccggccaucugcacagccucagagcgaccccggcuccgcuugggccgggccauggggaggucgcagacccggcccuccaucauaugaagcgcacuugcuccugagggggagugccggaaccgcaccgcgucggcgaugggauagacccccuccauacguggcucccccuagcuaugagggcccacauaggacacuggguacuaaacgcgggcccggaaauucucagguuccgaccuccucagccccugcugccacaccagcacggaccgacggcggcagaacuaagaaaaggcucgauccccgcauauaccgagacguguuaggggccuggggacugcggcaaggucagggccuucuugggggaagcccuggcuguggugcugcgcgugcaagacccgaaccagggaagggcgucguggagaaaagucugggacuagccgcugccgaucucaacucuggcuccgacagccacccucaggcaaaggccacagggucggcuggaaccgagaucgcccccgcagguucugcgacggcugccccaugcgcaccgcauccugcccccaggucccgccaccaccugaagggcucacgggaagggaaagagggagaacaaauuugguuuccaaaguguuggauccccaguccuaaaaagcagccacccagacauagccagacucuuccuaggccgugggcuccaggcgguaccggguggcgagagucccugggcuugggagaaggcgccgggcccgagacacucgagggauggaaagcaacucgccgggcucacacccugccuagaucuagccaggguuuaucaaggggcgaagggguauucguuauugaugccacaugcguggucauccguagucaauaugugccaacccccagaacgcaacaggugcagcugcucccuuccggagucacucggguugugggcgacagcccgucucagucaaagcccgguaaagaggaaggggagggcgcgacaguauuuccaaguccuugucagaagagacuuagcuccucuaggcuguugcaucagcccggaggcgggcgaggaggcgaagccgagggugggcggccaggagauucgacccuagaggaacgcacuuucagaauacugggccucccugcucccgaggugaaucugagggacgcaccaacacagccggguagcccugaacaccaagcccuuggccccgcugccuccggggcacagggacgggcggagggcucagaggucgccgugguucagcgacgcgcugggcgcggaugggccaggaccccaggccccuacgccggugcucugcgugaagccgugagucggaucagaaggcacacggcaccugacucugauaccgacgaggccgaagaguugagcguccauuccgggucaagcgauggaucugacacagaagcuccaggcgcguccuggcgcaacgagcgaacucuccccgagguggguaauaguagcccugaagaggauggcaagaccgccgaacugucugacuccguaggggagauuuuagauguuaucucacagacagaagaggugcuguuuggagucagagacauucggggcacucaacaggggaacaggaaacgccaguga

SEQ ID NO: 55176 - RNA, 1110 nt, Artificial Sequence
  derived and/or modified sequence opt3 from DDO__Homo_sapiens__NP_003640
augagacccgccaggcacugggagacccgguucggcgcucgcgacuuugggggauuccaggauugcuuuuuccgagaccgucugauggauacagcaagaaucgccguggucggugcgggcguuguggggcucagcacugcuguauguauuuccaaacuugugccuaggugcucugucacgauaaucucagacaaguuuaccccagauacaacuucggacguggccgcaggaaugcugauuccgcauaccuaccccgauacaccuauccacacccaaaagcagugguuccgggaaacuuuuaaccauuuguucgccauugcuaauagcgcagaggccggcgacgcugguguucacuuaguguccggguggcagaucuuucagucuacaccaaccgaagagguccccuucugggccgaugugguacugggauuucgcaaaaugacggaagcggagcuaaagaaauucccucaauauguuuuuggccaggcauucacuacccucaagugugagugcccagccuaccugcccuggcuugaaaagagaauaaaaggcagugggggauggacacugacuaggcggaucgaggacuugugggaacuccauccuucauucgauauuguggucaacuguagcggucugggcagucgccagcuggcuggggacuccaagaucuuuccagugcgaggacaggugcuccaaguccaggccccguggguugagcacuucauuagagauggcucugguuuaaccuauaucuaccccgggacaagccacgugacccugggaggcacgaggcagaaaggcgacuggaaucuuuccccugacgcagagaacucacgggaaauauugagucguugcugugcucuggagccaagccuacauggggccugcaauauucgcgaaaagguaggacucagacccuauaggccuggugugcggcugcagacugagcuucuggcgcgagauggccaacgcuugccagucgugcaccauuacgggcacggaucuggcgguaucuccguucacugggggacagcccucgaagcagcuagacuggugucagaguguguccaugccuuaaggacccccauuccgaaaagcaaccuguga

SEQ ID NO: 55177 - RNA, 1527 nt, Artificial Sequence
  derived and/or modified sequence opt3 from DDR1__Homo_sapiens__NP_001189450
augggccccgaggcccugagcucccuccuucuguuguuacugguggcuucuggggacgcagauaugaagggacacuucgacccugccaaaugcagauacgcgcuagguaugcaggauaggaccaucccagacucagauauuagugcuagcuccucuuggucggacucaacagccgcacggcauagccgccucgaaaguuccgauggcgacggggccugguguccggcuggaucugucuuucccaaggaggaagaguaucugcaaguugaucuucagcgacugcacuugguggcacucguaggcacucagggucgucaugccgggggacugggcaaagaguucagcagauccuacaggcugcgguauucacgcgacggcagaagguggaugggguggaaggaucgguggggacaggaagugauaagugguaacgaggacccugaaggcgucgugcucaaagauuuagggccacccaugguugcucgccuggugcgauuuuacccuagagccgacagggucaugagcgugugccuucggguagaguuguauggaugucuguggcgugacggccuacucucuuacacggcgccaguuggucaaaccauguaucuguccgaagcaguguaccuuaaugauucaacauacgacgggcacacugucggaggccugcaguauggcggguugggacagcucgccgaugguguggugggccuggacgauuuccgcaagagccaggaguuaagagucuggcccggguacgacuauguuggauggaguaaccauucuuuuuccagcggcuacguggagauggaguucgaauuugauaggcugcgggcuuuccaagccaugcagguacacugcaauaacaugcacacccucggugcacgacuuccugggggcguggaaugucgcuuuagaaggggaccagcuauggccugggagggcgaaccgaugcggcauaaucuugggggaaacuugggugacccccgcgcgagagccgucucggugccucuaggcgggaggguugcacguuuccugcagugccgguuucucuucgcuggaccauggcugcuguuuucugagaucuccuucauuucagauguggucaauaacaguagccccgcccugggcgguacauucccuccagcucccugguggccgccugggcccccaccuaccaauuuuuccucuuuggagcucgaaccccgaggccagcaaccaguggccaaggcagagggaagccccacugccauccugauuggcuguuuaguagcuaucauacugcuacuccugcuuaucauugcguugaugcuguggagacuccacuggaggcgccugcuuucaaaagcagaacggagaguucuggaggaagaguugacagugcaucucagugucccuggggacaccauccugauuaacaauaggccaggaccgcgcgagcccccuccauaucaggaaccccgaccucgggguaacccaccccacuccgccccgugcgugccuaauggcagcggggcuccagucuga

SEQ ID NO: 55178 - RNA, 2568 nt, Artificial Sequence
  derived and/or modified sequence opt3 from DDR2__Homo_sapiens__XP_011507889
augauccugauucccagaaugcuccuugugcuguucuuguuacugccuauacuaagcuccgccaaggcucaggucaacccagcaaucugcagguacccgcucggcaugucugggggacaaauucccgacgaggauaucaccgccucaagucaguggagcgaauccacagcggcuaaauauggucggcuggacucugaggaaggcgauggggccugguguccugagauuccaguugaacccgacgaucuuaaggaguuucugcagaucgacuugcacacucuccauuucauaacgcuggugggaacccagggccgccacgccggugggcauggaaucgaguuugcaccuauguacaaaauuaauuauucgcgagauggcacacguuggaucucauggagaaacaggcacggcaagcaaguacuggacgggaauagcaacccauacgauauuuuccucaaagacuuagaacccccuaucguggcucgguuuguccgcuucauaccagugacugaucauaguaugaauguuugcaugagaguggagcuguauggaugugucuggcuugacgguuugguguccuacaacgcaccggccggccagcaguuuguacugcccgggggaucuauuaucuaucuaaaugauagcguuuacgacggcgcuguggguuacuccaugaccgaagggcucggacagcugacagacggcgucucaggccuugaugacuucacccaaacucacgaguaucacguguggccuggguacgauuaugugggauggaggaacgagagugccacaaaugguuacauugaaaucauguuugaguucgaccggauccgcaacuuuaccacgaugaagguccauugcaauaacauguucgcgaagggcguuaaaauuuuuaaggaagugcaguguuauuuccgaagcgaggcaucugaaugggagccaaaugccauauccuucccccugguauuggaugacgugaacccuucagcuagauuugucacugugccacuccaccauaggauggccagcgcaaucaaaugccaguaccacuucgcugauaccuggaugauguuuagugagauuacauuccagucugacgccgcgauguauaauaacuccgaagcccugcccacuagcccgauggcaccuaccacauacgaucccauguuaaagguugacgauucgaacacccggauccugauagggugucucguggcuauuaucuuuauccuucuggccauuaucgucauuauauuguggcgucaauucuggcagaaaaugcuagagaaggcuucucgcagaaugcuggacgacgaaaugacggugucccucucacugccaagugauagcuccauguuuaauaacaauaggucuagcucaccuagugagcagggauccaacagcacuuacgaccggaucuucccccuucgaccagauuaucaagaacccucucgccugauuagaaaguugccugaguuugccccaggcgaggaagagucagguugcagugggguaguuaaaccggugcagcccagcggcccugaaggagucccacacuacgcagaggccgacaucgugaaucuccagggcgucacagggggaaacaccuauuccgugcccgcuguuacuauggaucuguuaucugguaaggacguggcgguagaagaguucccuaggaaacugcuaacauuuaaggagaaacucggcgaagggcaguucggagagguccaucugugugaaguggagggcauggagaaguuuaaagauaaggacuucgcacuugauguuucggccaaucaaccaguguuggucgcugugaagaugcugcgggccgacgcaaacaaaaaugcccgcaacgauuuccucaaggaaaucaaaauuaugagcagacugaaggaccccaauauaauccaccuucuggcuguaugcauuaccgaugacccguuguguaugaucacggaguacauggaaaacggugaccucaaucaguuucuguccaggcaugagccuccaaacucaaguucuagcgaugugcguaccguuuccuauacaaauuuaaaauucauggccacucagauugcaucagggaugaaguaccugagcucucuaaacuuuguccaccgggaccucgcgacccgaaacugccuggugggcaagaauuauacaaucaaaauagcugauuucggaauguccagaaaccuuuacaguggcgacuacuauaggauccaggggcgcgccguguugcccauucgguggaugagcugggaaucuauccugcucggaaaguuuacuaccgcauccgaugucugggccuucgguguuacacugugggagaccuuuacuuucugccaagagcagccuuacucacaguuaagugacgaacaggugauugagaauacgggcgaauuuuucagagaucaagggaggcagacauaucugccccagccagcuaucuguccugacagcguguacaaacuuauguugucgugcuggcgccgagauaccaagaaccggcccuccuuucaggagauacaucuccugcuacugcaacagggagacgaauga

SEQ ID NO: 55179 - RNA, 945 nt, Artificial Sequence
  derived and/or modified sequence opt3 from DDRGK1__Homo_sapiens__NP_076424
augguggcccccgucugguaccugguugcugcagcccuccuugugggcuucauccuguuuuugaccagaagcagggggcgggcggcuuccgccggacaggagccuuuacacaacgaagaacuggccggugcaggccgcguagcucaaccagggccgcuagaacccgaggaaccucgagcaggaggccguccaagaaggcggcgcgaccucgguucuagacugcaggcccagaggcgggcucagcgcguggccugggcggaggcagaugagaaugaagaggaagccgucauucuugcucaagaggaggaagggguggagaagcccgccgaaacacaucugucaggaaaaauaggcgcaaagaaauugcgaaagcucgaggaaaaacaggcuagaaaggcccagagggaggcggaggaagccgagcgggaggagcguaagcgccuggaaagucagagagaggcagaguggaaaaaggaagaggaaaggcugcggcucgaggaggaacaaaaagaggaagaggaacgaaaggcucgcgaggagcaggcccagagagaacacgaggaauauuuaaaacugaaggaggcuuucguuguggaagaggagggcgucggggaaacuaugacggaggaacagagccaauccuuucuuaccgaguucaucaacuacauuaagcagucuaaagugguauugcuggaagaccuagccucgcagguuggacucaggacacaagauacuaucaaucggauucaggaccugcuugcagaggguaccaucacaggcgugauagaugaccgcgggaaguuuaucuauauuaccccugaggaacuggccgcugucgcgaacuucaucagacagaggggacgugugucaauugcagaguuggcccaggcuagcaauagucucaucgccuggggccgggaauccccagcacaagcccccgcuuga

SEQ ID NO: 55180 - RNA, 357 nt, Artificial Sequence
  derived and/or modified sequence opt3 from DDT__Homo_sapiens__NP_001077861
augcccuuccuggagcucgacaccaaccuuccugccaauagagugccagcuggccuggaaaagagguugugcgcagccgcggcuagcaucuuagggaaaccggccgaucgggucaacguuacagugcgccccggacuggcaauggcccuauccgguucuacugagccuugugcucagcucucaauuaguagcauaggcguaguggggacggcagaagacaaucgaucccauucugcccacuuuuucgaguuucugaccaaggaacuugcucugggacaagaucguaucuugauuagauucuuuccacucgagucguggcagaucggcaaaauugguacagucaugacuuuccuguga

SEQ ID NO: 55181 - RNA, 405 nt, Artificial Sequence
  derived and/or modified sequence opt3 from DDTL__Homo_sapiens__NP_001077862
augcccuuccuggagcucgacaccaaccuuccugccaauagagugccagcuggacuggaaaagagguugugcgcagccgcggcuagcaucuuagggaaaccggccgaucgggucaacguuacagugcgccccggacuggcaauggcccuauccgguucuacugagccuugugcucagcucucaauuaguagcauaggcguaguggggacggcagaagacaaucgaucccacucugcccacuuuuucgaguuucugaccaaggaacuugcucugggacaagaucguuucccaacagucuugucgacuucacccgccgcgcauggcgguccuagaugcccaggggagaucauugagggcaaaaagagcugucucaacgaagaggcacuguuuaucuacuucauuuga

SEQ ID NO: 55182 - RNA, 2628 nt, Artificial Sequence
  derived and/or modified sequence opt3 from DDX10__Homo_sapiens__NP_004389
augggcaagaccgccaacagccccggguccggagcuagaccugacccagugaggucuuucaaucgguggaaaaagaaacacucacaucgccagaacaagaaaaagcaacugcgaaagcagcucaaaaagccggaguggcaggucgaacgugagaguaucagcagacuuaugcagaauuacgagaaaauuaacguuaaugaaauaacaagguuuuccgauuucccccugucuaagaaaacuuugaaggguuuacaagaagcacaguaucggcuggugacggagauccagaagcagaccauuggccuagcccuccaagggaaagacguacugggagcggcuaagacaggcucggguaaaacucuugccuuucuggugccugucuuggaggcacucuaccgccugcaguggaccucaacagaugggcugggagugcucaucauuagcccaaccagagaauuagccuaucagacuuucgagguucugaggaaggugggcaaaaaccacgacuuuagugcuggccuuaucauagggggaaaggauuugaaacaugaagcagagcggaucaauaacauuaauauccuggucugcacacccggucgccuacuccagcacauggacgagaccguguccuuccaugccacggaucugcaaaugcuuguacuggacgaagcugaucgaauuuuggacaugggcuuugccgauacuaugaacgcgguuaucgagaaucucccuaagaagagacagacccuguuauucucugcaacacagacuaaaagcgugaaggaccuggccaggcucucccuuaaaaacccagaauacgucugggugcacgagaaggcuaaauauucaacccccgccacacuggaacaaaauuacauagugugugaguugcagcagaagauuaguguccuauauagcuuucugcggucucaccucaagaaaaaguccaucguuuucuuuucaagcugcaaagaggugcaguaccuguaccguguauucugucgccuuagaccuggggugaguauucuggcauugcauggaaggcaacagcagaugcggcgaauggaagucuauaacgaguuugugcgcaagagagcugccguucucuucgcgaccgauaucgccgcaaggggccuggacuucccagcugugaauugggucuuacaguuugacugcccggaagaugccaacacguacauccaccgggcuggucgcacugccagauauaaagaggacggggaagcacugcuaauucuccugcccucugagaaggccauggugcaacagcuuuugcagaagaaaguaccuguuaaggagauaaaaaucaacccagaaaagcugauugaugugcagaaaaagcucgaguccauccuggcucaagaccaggaucuuaaggaaagggcgcagcguuguuucgucagcuacgugcggucggucuaucugaugaaagacaaggagguguuugauguuucuaaauugcccauaccugaauacgcacucucccugggauuagccguggcuccacgaguaagauuccugcagaagaugcaaaaacagcccacaaaggagcuagucaggucacaggccgacaaagugauugagccgcgcgcaccuagucucaccaaugaugaaguugaggaauuucgggccuauuucaacgagaagaugagcauccugcaaaagggcggcaaaagacuugaggggacugaacauaggcaggacaaugauacaggaaacgaggaacaggaggaagaggaggacgacgaagaggaaauggaggaaaaguuggcuaaagccaaggguucccaggcacccucucugccaaauaccagcgaggcgcagaaaaucaaggaggugccuacgcaauuucucgaucgcgacgaagaggaagaggaugcugacuuccugaaggucaaacgacacaacguguuuggcuuagaucugaaggacgagaaaacccuucagaagaaagaacccucaaagaguuccauuaagaaaaagaugacaaaaguagccgaggcaaagaaagugaugaagcggaauuucaagguuaacaaaaagaucacuuuuaccgaugaaggggaguugguccagcaauggccacagaugcagaaaagcgccauuaaggacgcugaagaggaugacgauacaggaggcauaaaucuccacaaagccaaggagcgucugcaggaagaggacaaauucgauaaggaagaguacagaaagaaaaucaaggcaaaacauagggaaaagcgccuaaaagagcgggaggcuagaagggaagccaacaagcgacaagcgaaggccaaagacgaggaagaggcuuuucuggacuggucugaugacgaugacgaugacgaugacgguuucgaucccucaacucucccugacccagauaaguaccgcaguagcgaagacuccgauucugaggacauggagaauaaaauuucggacaccaagaaaaagcaggggaugaagaaacggagcaacuccgaaguggaggaugugggcccgacaucacacaauagaaagaaagcaaggugggacacccuggaaccccuugauacuggauugagucuggccgaggacgaagaguuaguccuccaucugcuucguucucagagcuga

SEQ ID NO: 55183 - RNA, 2643 nt, Artificial Sequence
  derived and/or modified sequence opt3 from DDX11__Homo_sapiens__NP_001244074
auggccgagcuguacagagugcucgaagcuggcaagaucgggauuuucgagagccccaccggaacagguaaaucccuuucucugauaugcggcgcauugucaugguuaagggacuuugaacagaagaaacgggaggaagaggcccgccugcuagagacugggacgggaccucuccacgaugaaaaggacgagagucugugucuuagcuccucuugcgaaggcgcggcugguaccccacgaccggccggggagcccgcaugggucacacaauucguucagaaaaaggaggaacgugaucugguggacagauugaaggccgagcaggcuaggcggaaacagcgcgaagagagacuccaacagcugcagcauaggguacagcugaaguaugcagccaaacggcuccgccaagaagaggaggaacgagagaacuuacugagacuuucgagggaaauguuggagacuggaccugaagcugagcggcuggagcagcuagaaucaggcgaggaagaacucgugcuggccgaauacgagagcgaugaggaaaagaaagucgcgagucguguggacgaggaugaagacgaucuugaggaggaacacaucaccaagauuuauuacuguucccgcacacauucucagcuggcacaguuuguucacgaggugaagaaaagcccauucggcaaggacgucagauuggugucccucgggucaaggcaaaaucugugcguaaacgaagauguuaaaaguuuaggaagcgugcagcugaucaaugaccggugugucgauaugcagcgaucucgccaugagaagaaaaagggugccgaagaggagaaacccaagagaaggcggcaagaaaagcaggcugccugcccuuuuuauaaccacgagcagaugggccuccuucgcgacgaagcacuggcugaggugaaagacauggaacaguugcuagcccuggggaaggaggcgagagccuguccauacuauggauccaggcucgcaauucccgcugcccaacuggugguccuuccuuaccagaugcuguugcacgcugccacccgucaggcagccggcauccggcuccaggaucaaguugugauaaucgacgaggcucauaaucugauugauacuaucacagguaugcacucaguagaagugagcgggagucaguuaugccaggcgcauucucagcugcuacaauacgucgagcgauauggaaaaagacucaaggccaaaaaccugauguaccuuaagcagauuuuguaucugcucgaaaaguucguggccguucugggcggcaauaucaaacagaacccaaauacccagucccuuagccaaacggggacugagcugaagaccauaaacgacuuuuuguuccagucgcagauugauaauaucaaccucuuuaaagugcaaagguacugugaaaagucuaugauuucccgcaaacuguucggauuuacagagcgguauggugcugucuucucaaguagagagcagccgaaguuagccggcuuucagcaguuccugcaaagccuacagcccaggacuaccgaagcacucgccgcuccugccgacgagucccaggcaucuacacugcgcccagcgagcccccuuaugcacauccagggguucuuggcugcccugaccacggcaaaucaagauggacgagugauccucucacggcagggcagucugucccagagcacuuuaaaguuucugcuuuugaacccugccguacacuucgcucagguugugaaagaaugccgugccgucgugauugcuggugggacaaugcaaccagucucugacuuuagacagcagcuccuggcaugugccggcguggaggcggagaggguuguggaauuuucaugcggacauguaauacccccggauaauauccuaccucuggucauuugcaguggcaucagcaaccaaccccucgaguuuaccuuccagaagcgcgaacugccacagaugauggacgagguggggcggauacuuuguaacuugugcggaguugugccugguggcgucguguguuucuuccccuccuacgaauaucugagacagguacacgcccauugggagaaagggggauuacucggcaggcuggcugcacgaaagaaaauuuuucaagagccaaagucugcccaccagguggaacagguucuucuggcuuacucgcgcugcauccaggccuguggucaagagcgggggcaggucacuggcgcauugcuccugagcguggugggaggcaagauguccgaagggaucaauuucucagauaaccuaggaagaugcgucguuaugguggguaugcccuuuccuaauauuaggagugcggagcugcaggagaaaauggccuaccucgaccagacacugccacgugcuccgggccaagcacccccugggaaggcacuuguggagaacuuguguaugaaagcuguaaaucagucuaucggacgcgccauucggcaucagaaggacuucgcaagcgucgugcuguuagaucagagauaugccaggccacccguucucgcuaaacugccugcguggauacgagcccggguggaggucaaggcaaccuuuggcccagcuaucgccgccgugcaaaaauuccaccgcgaaaaguccgcuucaagcuga

SEQ ID NO: 55184 - RNA, 2196 nt, Artificial Sequence
  derived and/or modified sequence opt3 from DDX17__Homo_sapiens__NP_001091974
augcccaccggcuucguggccccuauccugugcguccuccuuccaagcccgacaagagaggcugcaacuguugccuccgcgacgggggacucugcuucagaaagggagagugccgcacccgccgcugcaccuaccgccgaagcuccacccccuagcgugguaacacggccagagccccaggcccugccuuccccagcgauucgcgcaccguugcccgauuuauacccuuuuggaacuaugcgagguggcggguucggagaccgugauagagacagggaucggggcgguuuuggggcccgcggaggcggcgggcugccacccaagaaauucggaaacccuggugaaagacuaaggaagaaaaagugggaccucucugagcugccaaaauuugagaagaauuucuauguggaacaccccgaggucgcucggcuuaccccguacgaaguggaugagcugcgccgaaagaaagagauaacaguuagaggcggggacguguguccuaagcccgucuuugccuuccaucacgcaaacuuuccacaauaugugauggauguauugauggaccagcauuucaccgaaccuacucccauccagugccagggauuuccacucgcucugucgggcagggauaugguugguauugcccaaacagggucaggaaaaacccuggcguaccucuuacccgccaucgugcacauuaaucaucagccuuaucuggagcggggcgacggcccaaucugucuugucuuggcaccgacgcgugaacuggcucagcagguccaacagguggccgaugacuacgggaagugcagccgccuaaaaaguacuuguauauauggaggugcucccaagggcccucagaucagagaccucgagaggggaguggaaauuugcaucgccaccccagggcggcugauugauuuccuugaguccggcaagacaaaccugcgacgcuguacuuacuugguucucgacgaggcagauagaaugcuggacauggguuuugaaccccagaucaggaaaauaguggaucaaauucggccugaccgccagaccuuaauguggucugccacauggccaaaggagguaagacagcuggcugaagauuuccucagggacuacacccaaaucaauguggggaaccuugagcugagcgcgaaucacaacauuuugcagaucgucgaugugugcauggaauccgagaaagaccacaagcuaauccagcugauggaggaaauuauggcagagaaagaaaauaagacgauaaucuucguugagacuaaacgucggugugaugaccucacacgaagaaugaggcgcgacggcuggcccgccaugugcauucauggagauaagucacagccggaacgggacugggugcugaacgaguuuagaaguggcaaggcuccuauccuuauagccaccgaugucgcaagcagggggcuggacguggaggauguaaaauucguuauuaauuaugacuacccaaacucuuccgaagauuaugugcaccgcaucggacgaacugcccggucaacaaauaaggguaccgcuuacacguuuuucacccccggcaacuugaaacaagcccgugagcucaucaagguccuggaagaggcaaaucaggcgauuaacccuaaauuaaugcagcugguggaccauagagggggaggcggugggggcggaaagggcgggaggagccgcuaucggacaaccaguucugcuaacaaucccaaccuaauguaccaggaugagugugacagaaggcuccgaggagucaaggaugguggccgccgggacuccgccagcuauagagauaggucggaaacugaccgugcaggguacgccaauggaucuggcuacgguuccccaaacucagcuuuuggggcccaagcaggccaguauacauacggacagggcacuuauggggcugccgcguacggaaccaguagcuauacagcccaggaguacggcgcugguaccuauggggcauccucuacuacgagcacaggacgcucaagucaauccagcucucagcaguucucaggcaucggucggaguggccagcaaccucagccccugaugagccagcaauuugcccagccaccgggggcuaccaauaugauuggauacaugggccagacugccuaccaguauccucccccacccccuccacccccuccguccagaaaauga

SEQ ID NO: 55185 - RNA, 2013 nt, Artificial Sequence
  derived and/or modified sequence opt3 from DDX18__Homo_sapiens__NP_006764
augagccaccuacccaugaagcuccuuaggaaaaagaucgagaaaagaaaccugaaguugcggcagcgcaauuuaaaauuccaaggcgccuccaaccugacccuaucugaaacacagaauggggacgugucagaggaaacuaugggaagucgaaaggucaagaaaagcaagcagaaaccuaugaacguuggucucuccgagacgcagaauggcgggaugucucaagaagcugugggaaacauuaagguaaccaaaucgccacagaagucaacagugcugacuaauggcgaggcagccaugcagagcaguaacuccgagucuaagaaaaagaaaaagaaaaagcguaaaauggucaaugaugcggaaccggacaccaagaaggcuaaaacagagaacaaggguaaaagcgaagaggaguccgccgaaaccacuaaggagacagaaaauaacguggagaaacccgauaaugacgaagaugagucagagguuccuagucuuccacugggguugaccggagcauuugaagacacgagcuucgccucucucugcaaccuggugaaugagaacacucugaaggcuauaaaggaaaugggcuuuaccaacaugacagagauccagcauaaauccauuagaccccucuuagaaggcagggaucugcuugcagccgcuaagacugggucaggaaaaaccuuggccuuccugaucccugcggucgagcuaauugugaagcuccgguuuaugccacgcaaugguacaggcguacugauccuuagccccaccagagagcuggcaaugcaaacguucgggguuuugaaagaacucaugacucaccaugugcacacauacggacugauaaugggcgguaguaacaggucugccgaggcucagaaguuagggaauggaaucaacauuaucgucgccaccccuggccggcugcucgaccauaugcagaauacuccaggcuuuauguauaagaaccuucagugucuggugauugaugaagcagaccgcaucuuggaugugggguucgaggaggaacuaaaacaaauaauuaagcugcucccgacacgaagacagaccaugcuguuuuccgcuacgcagaccaggaaagucgaggaccuugcccggaucagccugaagaaagaacccuuguacguuggaguggaugacgacaaggcgaaugccacaguagauggucucgagcaaggcuauguggucugcccuucggaaaagcguuuccuguuacuguuuacuuuccugaaaaagaaccgcaaaaagaaacucaugguguuuuucucuuccuguaugucaguuaaguaccacuaugagcugcuuaauuacauugacuugccagugcuggcaauccacgggaaacagaagcagaacaagagaaccacaacuuucuuucaguucugcaaugcugauaguggaacccuccuguguacagacgucgccgcuaggggccuugauauccccgagguggacuggauuguacaauaugauccuccagacgaucccaaagaauacauacaucggguuggucgaaccgcccgcgggcugaacggcagaggacacgcauugcucauccugaggccggaggaauuaggcuuucugcgguaccuaaagcagagcaaagugccucucuccgaguucgacuuuucuuggagcaagauuucagauauccagagucagcuggaaaaacuuauagagaagaauuauuucuugcauaaguccgcccaagaggcuuacaaaagcuauauucgcgcguacgacucucacucacugaagcagaucuuuaacgucaauaaccucaaccugccccagguggcauuaaguuucggguuuaaagucccaccuuucguggaccugaauguuaacagcaaugaaggaaagcagaaaaagagagguggcgggggaggcuuugguuaucaaaagacuaaaaagguggagaaauccaagaucuucaaacacauuucuaagaagucgagcgauuccaggcaguuuucacauuga

SEQ ID NO: 55186 - RNA, 1437 nt, Artificial Sequence
  derived and/or modified sequence opt3 from DDX19A__Homo_sapiens__NP_060802
auggccaccgacagcugggcucuggcaguggaugagcaggaagccgcggucaaguccaugacaaaccuccaaaucaaagaggaaaagguuaaagcugacacuaauggcauuauaaagacgucuaccacagccgagaaaacugaugaagaggagaaggaagacagagcagcccagucacuucugaacaaguugaucaggaguaauuuaguggauaacaccaaucagguagaggugcugcagcgggaccccaacagcccucuauacuccgucaaaucuuucgaggaacuccgccugaagccacaacuucugcaggggguguaugcuaugggauuuaaucgaccgucgaaaauucaggagaacgcauugcccaugaugcucgccgaaccuccacagaaucugaucgcucaaucacagagcgguacaggcaagaccgccgcguucguucuggcaaugcucagucguguggagcccuccgauagauacccucagugcuuaugucugucuccaacuuaugaacuugccuugcagacagggaaagucauugagcaaaugggaaaguuuuaccccgaacugaagcuagcuuaugccgugaggggcaacaaacucgagcggggucagaagaucagcgagcagauaguaaucgggaccccuggaacgguucuggacuggugcuccaaacuuaaguucauugauccgaaaaagaucaaaguguuuguccuggacgaagcagaugugaugauugcuacucaaggccaccaggaccagucaauccgcauacagagaauguugccaaggaauugucaaaugcuccuguucagugccaccuuugaggauagcguguggaaguucgcgcagaaggucguucccgacccuaacgugauuaaauuaaagcgggaagaggaaacacuggacacuaucaaacaguacuauguacucuguucuucccgcgaugagaaguuucaggcccuuugcaaucuguacggcgcaauuaccaucgcucaagccaugaucuucugccauacacgaaaaaccgcuucaugguuggccgcagagcuaagcaaggaagggcaccagguggcccugcucaguggagagaugauggucgaacagagagcugcggugauugagagguuucgggaagguaaggagaaaguucuggugacgacuaacgucugugcacguggcauagacguggagcagguaucuguugugaucaauuucgaucuuccagucgacaaggaugggaaccccgacaacgaaacauaccugcaucgcauuggaagaaccggcagguuugguaaacggggguuggccgugaauauggucgauuccaagcacagcaugaacauccucaaucgaauacaagagcauuucaacaaaaagauugaacgccuggacacugaugacuuagaugagaucgagaagaucgcuaauuga

SEQ ID NO: 55187 - RNA, 2223 nt, Artificial Sequence
  derived and/or modified sequence opt3 from DDX1__Homo_sapiens__NP_004930
auggccgcuuucagugagaugggcgugaugcccgaaaucgcacaggccgucgaggaaauggacuggcugcucccuaccgauauucaagcggaguccauaccacuuauccugggagggggugacguuuugauggcugccgaaacaggcucugggaagacuggagcauuuucaauuccggugauccagauuguauacgagacguuaaaagaucagcaggagggcaagaaagguaagaccacaaucaaaacuggggccagugugcugaacaaguggcaaaugaaucccuaugacagaggaagcgcuuucgcaauaggcuccgauggccuaugcugucagucuagggaagucaaggaguggcacgggugccgggccaccaaaggacucaugaaggguaaacauuacuaugaagugucgugucacgaccagggccugugccgcguuggguggucaacaaugcaggcuagccuugaucugggaaccgacaaguuuggcuucgguuuugggggaacuggcaaaaagagucauaacaagcaauucgauaauuacggcgaggaguuuacaaugcacgacaccaucggguguuauuuggauauugacaaaggacaugugaaguucuccaaaaacgguaaggaucucggccuggccuuugaaaucccuccacacaugaaaaaucaggcgcuguuccccgcaugcguccucaagaacgccgaguuaaaauuuaauuucggggaagaggaauuuaaguucccuccaaaggacggauucguggcucugucuaaagcccccgacggcuacauuguaaagagccagcacuccgguaacgcacagguuacgcaaacuaaauuucuuccuaaugcuccaaaggccuugaucguggagccgucacgagagcuggcggaacagacccuaaacaauauaaaacaguucaagaaguauauugauaaccccaaacuccgugagcugcuuaucauugggggcgucgccgcaagagaccaacugaguguguuggaaaauggaguggauaucgucguuggcacaccugggaggcucgacgaucuggugagcacuggaaaguuaaaccugucucagguacgguuucucgugcuugacgaggcugauggucuguugucccagggcuacucagacuucaucaaucgcaugcauaaccagauuccacaagucaccagcgaugggaaaagacuacaggugauaguuuguagugccacacugcacucuuuugacgugaagaaacucuccgaaaagaucaugcauuuccccaccugggucgaucugaagggagaggacagcgugccugacacgguacaccacguuguggucccagugaaccccaaaacugauaggcuuugggagcggcugggcaagucgcauauucgcacagacgauguccacgcuaaagacaauacccgaccgggugccaacucuccugaaaugugguccgaggcaaucaagauauugaaaggggaauacgccgugagagcuauuaaggagcauaagauggaucaggcgaucaucuuuugcaggacuaaaauugacugugauaaucucgaacaguauuucauccaacagggcggaggccccgacaagaaagggcaccaguuuucaugcguuugucugcauggagaucggaagccacacgagcguaaacagaacuuagagcgcuucaagaaaggugacgugagauuucugauuugcacagauguagcagccaggggcauagacauccacggggucccuuacgugauuaauguuacccuacccgaugaaaagcaaaacuaugugcaucggaucggacgagucggccgcgcugagagaaugggucucgccaucagucugguggcaacggaaaaggagaaaguaugguaccacgugugcagcuccagggggaagggcuguuauaauacccggcuuaaagaggacggaggcugcacaauuugguacaacgaaaugcaguugcugucugagauagaggaacaucucaauuguacuaucagccagguugaaccagacauuaagguccccguggaugaguucgacgggaaagugaccuauggacagaagcgcgccgcuggcggugggucauacaagggacacgucgauauccuggccccuacaguucaagagcuugcagcgcuggaaaaagaggcucagacuagcuuuuugcaccucggcuaccugccaaaccaguuauucagaaccuucuga

SEQ ID NO: 55188 - RNA, 2352 nt, Artificial Sequence
  derived and/or modified sequence opt3 from DDX21__Homo_sapiens__NP_004719
augcccggcaagcugagaagcgacgccgggcucgaguccgauaccgcuaugaaaaagggagaaacacuuaggaaacagacugaggaaaaggagaaaaaggaaaagccuaaaucugacaagacggaggagaucgcagaagaggaagagaccguguucccaaaagccaagcaagucaaaaagaaggcggagccgucagaaguugauaugaacagucccaaaagcaagaaagcuaagaaaaaggaggaaccuucccagaaugacauuucuccaaaaacaaagucgcugcggaagaaaaaggagcccauagaaaagaaagugguaucaagcaaaacuaagaaggugaccaaaaacgaggagccuagugaagaggaaaucgaugccccaaagcccaaaaagaugaaaaaggagaaggaaaugaauggugagacacgcgagaaauccccuaaguugaaaaacggcuuuccacacccggaacccgacugcaauccuucugaggcagccagcgaagaguccaacucagaaauugagcaggagaucccagucgaacagaaggagggggcuuucaguaauuuucccauuagcgaagagaccaucaaauuacugaagggacgaggcgugacuuuccuauuuccuauacaagcaaagacauuccaucacguuuacucugguaaagaucucaucgcccaggcucguaccgggacgggaaagacuuuuuccuucgccauuccacugaucgagaaacuucauggcgaacugcaggacagaaagaggggccgggcgccccagguguugguccucgcaccgacccgcgagcuggccaaccaagugucaaaagauuuuagcgacauuacaaagaaacugaguguagcuuguuucuaugggggaacuccuuacgguggccaguuugaaagaaugaggaaugggaucgauauacucguuggaacccccggccggauuaaggaccacauccagaacgguaaguuagaucugacaaaacuuaagcauguggucuuggacgagguggaccagaugcuggauaugggguucgccgaccaaguggaagagauucuaucugucgcauauaaaaaggauuccgaggacaauccacagacccuccuguuuagcgcuacgugcccucacuggguuuucaacguggccaaaaaguacaugaagucgacuuaugaacagguagaucuuaucggcaaaaagacacagaaaaccgcgaucacuguggagcaccuggccauuaagugucauuggacacaacgcgcagcugucauaggagacgugauccgaguuuacucuggccaccaggggagaaccauuaucuucugcgaaacgaaaaaggaggcccaggaauugucccaaaauucagcuauaaagcaggaugcccagagucuccauggagacauuccccagaaacaaagggagaucacccugaaggguuuucggaacggcagcuucgggguguuagucgcaacaaauguggccgcucguggacuggauaucccagagguagaccucguuauucaguccucucccccuaaagauguggaaagcuauauccaccgcucaggcagaacugguagggcggggcggaccggcgucuguauuugcuuuuaccagcacaaggaggaauaccagcuugugcaagucgagcagaaagcaggaauaaaguucaagcgaaucggcgugccaagugccacagaaauuaucaaggcuuccagcaaagacgccauccgccuguuggacucuguuccgcccacugcaauuucacauuuuaaacagagugccgagaagcuaauagaggaaaaaggggcuguggaggcccuggcagcggcucucgcccacaucagcggagcaaccuccguagaucagagaucucugauuaacucgaacgucgguuucgugacaaugauccuucaauguagcauugaaaugccuaauaucuccuaugccuggaaggagcugaaagagcaguugggcgaagagauagacucaaagguuaaggggaugguguuucucaaaggaaagcugggcgucugcuucgaugugccaaccgcuaguguaacugaaauccaggagaaauggcaugacucuaggcgguggcaauuaagcguggccacggaacagcccgagcuggaggguccucgcgaaggguacggcggauuuagaggccagagggaggggucccguggauuccggggucagcgagauggcaacagaagguuucgcgggcaacgggaaggaucaagaggcccaaggggucagcgcagcgggggcggaaauaagucuaaccgaucccagaauaaaggccagaagcggaguuucagcaaggcauuugggcaauga

SEQ ID NO: 55189 - RNA, 1452 nt, Artificial Sequence
  derived and/or modified sequence opt3 from DDX25__Homo_sapiens__NP_037396
auggccagccugcucuggggcggggacgcuggagcagccgaguccgaaagacuuaacucucacuucucaaaucugagucagcccaggaagaacuugugggguaucaaaagcaccgcggugcggaauauugauggcuccauaaacaauaucaacgaggacgaugaagaggacgucguugauuuagcugccaauucucugcuaaacaagcucauucaucaaucgcugguggaaucaagccaccgcguagaggugcuucagaaagacccuaguuccccacuguacucugucaagacauuugaggaauugcgacucaaagaggaacugcugaaggggaucuaugcaaugggauucaaucguccgagcaagauucaggagauggcccuccccaugauguuagcucauccuccacagaaccugaucgcacaaucccagucaggcacugguaaaacggccgcuuuugugcuugccauguugaguagaguuaaugcgcuggagcuauucccccagugccucugucuggcaccuaccuacgaacuugcccugcagacagggaggguggucgagcaaaugggaaaguuuugcguggauguacagguuauguaugcuauacggggcaaccgcaucccaagaggcacugacauuaccaaacagaucauuaucgggacacccggaaccguguuggauugguguuucaagcucaaacugauagacuuaacuaagauuagggucuuugugcuggaugaagccgacgugaugaucgauacacaggguuucagcgaccacucuauucggauccaacgcgcacucccuuccgagugccagaugcuucuguuuucagcuaccuucgaagacagcgucuggcauuuugccgagcgaaucauuccagauccgaauguuauaaaguugagaaaagaggaacuaacgcugaacaauaucaggcaguacuaugugcucugugagcaccggaaggacaaauaccaagcgcugugcaacauuuauggcaguaucacuauagggcaggccauuaucuucugucagacccgucgcaacgcaaaguggcuuacaguagaaaugauccaggauggacaccaagugucucuguuguccggcgagcucacugucgaacagagagcuagcauuauccagagguuucgggacgguaaagagaaggugcugauuaccacaaauguuugcgcccgagggauagaugugaaacaggucaccaucgugguaaacuucgacuuacccguuaagcaaggagaggaaccugauuacgagacguaccugcaucgcauuggcagaacuggcagguucgggaagaaaggacuagcuuuuaauaugaucgaaguggacgagcucccaucgcugaugaagauccaggaucacuucaacucuuccauuaaacagcuuaaugccgaagacauggaugagauagagaagaucgacuauuga

SEQ ID NO: 55190 - RNA, 2391 nt, Artificial Sequence
  derived and/or modified sequence opt3 from DDX27__Homo_sapiens__NP_060365
auggugcuggcccagagaaggcggggcgggugcgagaagcuccgcgcuggaccccaagcaguccuugccagcgguuccggcuucugugacaacaugcuggcggauuugggguuaaucggaaccauuggcgaagacgaugagguuccuguggaaccagagucugacucaggugaugaagaggaggaagggccgauaguacugggacgacgucagaaagcucuaggcaagaauagaagugccgacuuuaaccccgauuucguguuuacagagaaagaaggcacuuacgacgggagcugggcacucgccgaugucaugucccagcugaagaaaaagagggcugcaacgacccuugacgagaagaucgagaaagugcggaagaaacgcaagacagaagauaaagaggccaagucuggaaagcuggaaaaagagaaggaagcuaaagaggguucggagccuaaggaacaggaggacuugcaagaaaaugaugaggaaggcucagaggacgaggccagcgaaacugacuauaguuccgcggaugagaacauucucaccaaagcagacacacugaagguuaaagauagaaagaagaaaaagaaaaaggggcaggaagccggaggcuucuuugaggacgcuucucaguacgaugaaaaucugagcuuccaggacaugaaccucuccaggccauuacugaaagccaucaccgcaauggguuuuaagcaacccacuccuauucagaaggcuugcaucccaguggggcuuuugggaaaagauauaugugccugcgcggccacaggcaccggcaagacggcagcuuucgcccugcccguccuagagcggcucaucuauaaaccucgccaggcuccagugacucgaguacugguucuugugccgaccagagagcuggggauucagguccacucagugacaaggcaauuggcccaguuuuguaauaucacuaccugccucgcagugggaggucuggacgucaagagucaggaagccgcuuuacgggcggcacccgauauucugaucgccacaccuggccgucucauagaccaucuucacaacugucccagcuuccaucugucuuccauugagguuuugauccuagaugaagcugaccgcaugcuggacgaguacuuugaggaacaaaugaaagagauuaucagaaugugcucacaccauaggcagaccaugcuguucagcgccacgaugacugaugaagugaaggaccucgcaaguguaucucuuaagaauccagugcggaucuuugucaacuccaauacagauguggccccuuuccugcgacaggaguucauucgcauaagaccaaacagggaaggggaccgggaggcuaucguugccgcauugcucacccgcacuuuuacagaucacgugaugcuguucacccagacgaaaaagcaagcgcacagaaugcauauuuuacugggacuaaugggccuccaggucggugagcugcacgggaaucuuagccagacccagagguuggaagcucugcgucgguuuaaagacgagcaaaucgauauacucguggccacagacguagcagcccgaggccuggauauugaaggaguuaagacugugaucaacuucaccaugcccaauacaaucaaacauuauguccacagagugggcaggacugcucgcgccgggcgggcaggaagaucggucucucuugugggugaggacgaaaggaagaugcugaaggagauuguuaaagcugccaaggcgccggugaaagcccgcaucuugccucaggauguaauucucaaguuucgagacaaaauagagaagauggaaaaagaugucuacgcugugcugcaguuagaggcagaagagaaggaaaugcagcaauccgaggcccagaucaacaccgcuaagcggcugcuagagaaaggcaaggaagccguugugcaggagcccgaacguucaugguuccagacaaaagaggagagaaagaaagaaaagauugcaaaggcgcuccaagaguuugaccuggcccuuagggggaaaaagaaacgcaagaaauucaugaaggacgcuaagaaaaagggagaaaugaccgccgaggaacggagucaguuugagaucuugaaagcacagauguucgcugagagacuggccaagaggaaccgacgcgcaaaacgggccagagcuaugccagaagaggaaccugucaggggccccgcgaagaagcaaaaacaggguaagaaaagcguguuugaugaggaacucacuaauacguccaagaaagcccugaagcaguaucgugcagggccaucuuucgaggagcgcaaacaguuaggccugccccaccaacggagaggaggcaacuuuaagagcaagucaagguacaaacgacggaaguga

SEQ ID NO: 55191 - RNA, 1623 nt, Artificial Sequence
  derived and/or modified sequence opt3 from DDX28__Homo_sapiens__NP_060850
auggcccugaccagacccgugaggcuuuucagccucgucacacggcuguuguuagcuccucgccgaggccugacuguucguuccccagacgagccgcuacccgugguaagaaucccuguggcacuccagaggcaacuggaacagcggcagucucgcagaaggaaccuuccacggcccguccuggugcgcccugggccauugcucguuucagcccgaagacccgagcugaaucagccugcgaggcugacgcucggacggugggaacgugcuccauuagccagucaagguuggaaaagccgcagagcaaggcgggaucacuuuuccauugagcgagcccagcaggaagcuccggcagugcgcaagcugucuucgaagggcucauucgccgaccuuggguuggagcccagaguccugcaugcucuacaggaggccgcgccugaagugguacaaccaaccacaguucagagcaguacuauacccucccuccugaggggacggcacguggucugcgcagccgagaccggcucugguaaaacacuuagcuaccuguugccucuccugcagcgcuuacuggggcagccaucccucgauucacuucccaucccggcuccuagaggacugguguuggugcccaguagggaacuagcccaacagguccgugcaguugcucagccacugggccggagccucggccugcuugugcgagaccuggaagggggacaugguaugagaaggauucgcuugcaacucucucggcagccuuccgccgauguacugguggcgacccccggcgccuuauggaaggcacugaaaucaagacuaaucagccucgagcagcugaguuuucuugucuuggacgaagcugauacucugcucgacgagucuuuccuggaacuuguggauuauauucuggagaagucccacaucgccgaagggccagcugacuuggaggaucccuuuaacccuaaggcccagcucguucuggugggagcaacauucccagagggcgucggucaauuacugaauaaaguggccagcccggacgcuguaaccacgauaacuucgucuaagcuacauuguaucaugccccacguuaaacagaccuuucucaggcugaagggggcggauaaaguggcagaacuuguccacauuuugaagcaucgcgaccgagccgagcggacaggaccuuccggcacugugcuggucuucugcaacucaaguagcaccgugaauuggcucggcuacauccuggacgaucacaagauucagcauuuacgucugcaggggcaaaugccagcucuuaugagaguuggaaucuuucaguccuuccagaaaucuagcagggacauauugcucuguacagauauugccucacgcggucuggacaguaccggcguggagcuaguagucaacuaugauuuucccccuacgcugcaggacuacauccaccgggcagggagagugggaaggguuggcuccgaggugccagguacugucauuagcuucgugacacaccccugggauguaucucucgugcaaaagaucgaacuggccgcucgacgccggagaucacuuccgggguuggccaguagcguuaaagagccucugccacaggcaaccuga

SEQ ID NO: 55192 - RNA, 2556 nt, Artificial Sequence
  derived and/or modified sequence opt3 from DDX31__Homo_sapiens__NP_073616
auggcccccgaccuggcuagccagagacacuccgagucuuucccuucagugaacaguaggccaaaugucauccucccgggccgggaagggcgccgagagggacuucccccugguggcgggacccguggaagccugguuccaacaagacccgugccuccaucccccgcaccuuugggcacuucuccauacucguggucaaggagcgguccggggcggggaggcggcgccgggaguucccgcguacccagaggagugccugguccagcggucugcgcucccggcucuuuacugcaucacgccagcccuacgcaaaccauggcagccgcugaugggucccuauuugacaacccaaggacauucucacggcgacccccggcacaggccagucgccaggcuaaggccacuaaaagaaaguaucaggcgagcucugaagcaccucccgccaaaaggcggaaugagaccuccuuucucccagcuaagaaaacaucagugaaggaaacccaacguacuuucaagggaaacgcccagaaaauguuuagcccuaagaaacauaguguuucuacauccgaucgcaaucaggaggagagacaguguauuaagaccagcucgcuguucaaaaacaaucccgacauaccagaacuucacaggcccguggucaagcaagugcaggagaagguauuuacgucugcagcuuuccaugaacugggcuugcacccucaccucaucuccacuauuaacaccguucugaaaaugucaaguaugacaagcgugcagaagcaguccaucccaguccugcucgagggucgggaugccuuagugcgaucucaaacugggagcggaaaaacccuggcguacugcauuccggugguccagucacuucaggccauggagaguaagauccaacgcuccgacggccccuaugcauugguucuggugccuacaagagaacuagcucuccagagcuuugauaccguacagaaacugcuuaagccauucacguggauagugcccggcguccugaugggaggggagaaaaggaagucugaaaaggcccgguugcgcaaagguaucaauauucucaucucaacuccuggcagacugguggaccauauuaagaguaccaaaaacauccacuuuagcagguuacguuggcugguuuucgaugaggcugaccggauacucgaucuuggguuugaaaaggacauuacagugauccugaaugccgucaacgcagagugucagaaacgacaaaauguguugcuauccgccacucugacagagggaguaaccagacucgcugauauuucucugcaugacccaguuucgaucagcgugcuugacaagucccacgaucagcugaaccccaaggacaaagcgguccaggaagugugcccgccuccagcaggcgauaaguuggacucauucgccauccccgagagucucaaacagcacgucacggugguuccuucuaagcugagguuagugugucuggcugccuucauucuacaaaaaugcaaguuugaagaggaucagaagaugguagucuucuuuagcuccugugaacucguggaguuccauuacucacuguuucuucagaccuugcugucuagcuccggugcacccgccagugggcagcucccaagcgcuucuaugcgccugaaauuccuucggcugcacggcggaauggagcaagaagagagaacagccguuuuucaggaguucucccauucaaggcgcggcguguugcucugcacugacgucgcagcgcgagggcuggauuuaccucaggugaccuggauaguacaguauaaugcucccaguagcccagccgaauacauccaccggauuggacguacagcaagaaucgguugucauggcucgucccugcuaauacucgccccgucugaagcugaguaugugaacagccuggccucacacaagauuaacguuagugagaucaaaauggaagacauccuuugcgucuugacuagggaugacuguuuuaaggggaaacgcuggggagcacaaaagucccacgcugugggcccucaggagauucgggaaagagccaccgugcugcagacagucuucgaggauuacguucauucuagcgagaggcgaguguccugggcgaagaaagcccuccaaucauuuauccaggcuuacgcaaccuauccccgcgaacugaagcacauuuuccaugugcggagcuuacaccugggucacguagccaaaaguuuugggcuuagagacgcuccaaggaauuugucugcccucacucguaagaaacgcaaggcacaugucaaacggcccgaccugcacaagaagacgcaguccaaacauagccuagcggagauacugagaucggaauacucaucuggcauggaggccgauaucgcuaaggugaaaaagcagaacgccccuggagaaccaggcgggaggccccuccaacacagucugcagccuacaccgugcuucggacgagguaaaacccuuaaguggcggaagacucagaaaggcguucagcgcgacuccaagaccagccaaaaaguguga

SEQ ID NO: 55193 - RNA, 1284 nt, Artificial Sequence
  derived and/or modified sequence opt3 from DDX39A__Homo_sapiens__NP_005795
auggccgagcaggacguggaaaacgaucugcucgacuacgaugaggaagaggaaccccaagcuccucaggagagcaccccagcaccgcccaagaaagacaucaagggcuccuaugucucuauucacucaaguggguucagagauuuucuucugaaaccugaguuguuaagggccauaguugacugcggauucgaacauccaagcgaggugcagcacgaauguaucccccaggcgauucuggguauggauguacuaugccaagcuaaguccggcauggggaaaacagccguguuuguccucgcaacucugcagcagaucgagccugugaauggacagguuacggugcuugucaugugucauacccgggagcuggccuuccaaauuucuaaggaauacgagcgcuuuucgaaguauaugccaucagugaaaguaagcguuuucuuuggcgguuugaguaucaagaaagacgaagaggugcucaagaaaaacugcccccacgucgugguggggacaccuggacgaauacuggcucugguccguaauagauccuucucucucaagaacguuaagcauuuuguguuagaugaaugugacaaaaugcuggagcagcuugauaugaggcgggacguacaggagaucuuccgcuugacuccacacgaaaagcagugcaugauguuuagcgcaacccuguccaaagauauuagaccgguguguaggaaguucaugcaagaccccauggaggucuuuguggacgaugaaacaaaacuaacccuccacggccugcagcaguacuauguuaaacuuaaggacucagagaagaaucggaagcuguucgauuugcucgacgugcuggaguucaaccaagucaucauuuuugugaaaaguguacagcgcugcauggccuuagcucagcugcucguugaacagaauuucccugccaucgcgauacaucgaggcauggcacaagaggaaagacuuagcagguaccagcaguuuaaggauuuccagcggcguauucugguggccacuaacuuguuugggcgcggaauggacaucgagagagucaauauuguguucaacuaugauaugccagaagacucugauacauaccuacacagggucgcucgggccggucgauuuggcaccaaagggcuggcaaucacguucguguccgacgagaaugaugcuaagauccucaacgacguucaagaccgcuuugaagugaauguagccgagcugcccgaggaaauugauauaucaacuuacaucgagcagagcagauga

SEQ ID NO: 55194 - RNA, 1287 nt, Artificial Sequence
  derived and/or modified sequence opt3 from DDX39B__Homo_sapiens__NP_542165
auggccgagaacgacguggauaaugaacugcucgacuacgaggaugacgaagucgagaccgcugcaggcggggauggagccgaagcgcccgcuaagaaagacguuaaggguagcuauguguccauccacucuucaggcuucagagauuuucuucugaaaccugaguuguuaagggccauuguagacugcggguucgagcauccaagugaagugcagcacgaguguauaccgcaagcaauccugggaauggauguccuaugccaggccaagagcggcauggguaaaacagcuguguuuguucucgcaacucugcagcagcuugaacccgugacggggcaagucuccgugcugguaaugugucauacccgggaguuggccuuccagauuucuaaggaguacgaacgcuuuucgaaguauaugccuaacguuaaaguggcugucuucuuuggaggccucucaaucaagaaagacgaggaagugcugaagaaaaauugcccacacauuguggucggcacacccgggcgaauccuggcccucgcgcguaacaagagcuuaaaucugaagcauauaaaacacuucauccuugaugagugugacaagauguuggaacagcuggauaugagaagggacguucaggagauuuuucggaugacuccucacgagaaacaagugaugauguucagugcaacccuauccaaggaaauccgcccaguaugcagaaaauuuaugcaggaccccauggagauuuucguggaugacgaaacaaagcucacccugcauggacuucagcaguacuaugucaaacugaaggauaacgagaagaauaggaaauuguuugaccuccuggauguguuagaguucaaccaaguugugaucuucgucaagucugugcagcgguguauagcccuggcucagcuccuuguagaacaaaauuuuccugccauugcaauccaccgcgguaugccacaggaggaacgacugagcagauaccagcaguucaaagacuuucaaaggcggauuuugguugcuacuaaccuauucggccgugggauggauaucgagcgcgugaauaucgccuuuaacuaugacaugccggaagauuccgacacauaccugcauagagucgcgagggccggacgguucggcaccaagggucucgcaauuacguuugugucagaugagaaugacgcuaaaauacugaacgacguccaggaucgauucgaagugaauaucagugagcuucccgacgagauugauaucagcucuuacauagaacagacucgcuga

SEQ ID NO: 55195 - RNA, 1986 nt, Artificial Sequence
  derived and/or modified sequence opt3 from DDX3X__Homo_sapiens__NP_001180345
augagccacguggccgucgagaacgcucugggccucgaccagcaauucgcagggcuugaucugaauaguucugacaaccagucaggagguaguaccgccagcaagggcagauacauucccccucauuugaggaaucgggaagcgacaaaaggguuuuaugauaaggacuccucuggauggucgucaagcaaagauaaggacgcuuacaguuccuucggcucucgcagcgauucccgagguaaaucauccuuuuucagcgaccgugggucuggauccagaggcagguuugaugaccggggccgcucagauuaugacgggaucggaagcagaggugauaggaguggcuucgggaaguuugagcggggaggcaacucucgcuggugcgacaaguccgacgaagaugacuggagcaaaccauuaccgcccucggagcgacuggaacaggagcuauucucuggugggaauacuggaauaaacuuugagaaguacgaugacaucccuguugaagccacgggcaauaacuguccaccccacauugaguccuucucagauguggaaaugggcgagaucauuauggggaauaucgagcucaccagauauacaaggccuacuccaguacagaaacaugcaauacccaucauuaaggaaaaacgggaccugauggccugcgcucaaaccggaagugguaagacagcagccuuucuucugccuaucuugagccagauuuacuccgauggcccaggggaggcucuccgugccaugaaggaaaacggacgcuauggcagaaggaaacaguacccgaucucucuggugcuggcgcccacccgggagcucgcaguccagauauacgaagaggcccgaaaguucagcuaucgcucaagagugaggccuuguguuguguacgguggggcugacauuggccaacagauccgggauuuagagcgcggaugccaucugcuugucgccacuccaggcagauugguggacaugauggaaagggggaaaauuggacuggauuuuuguaaguaucuaguacucgacgaggcagaccguaugcuggauauggguuucgaaccccagauccggcgaaucguugagcaggacacaaugccuccaaaaggcgugagacacaccaugauguucagugcuacguuucccaaggaaauucaaaugcuugccagggauuuccuggacgaguacauauuuuuggcggucgggcgcgugggauccacuagcgagaauaucacccagaaaguggucuggguugaagagucugauaagcggucauuccuccuggacuuacugaacgccacaggcaaggauagucucacucuuguguuuguagaaaccaaaaagggugcagacagccuggaggauuucuuguaucacgaaggguacgcuugcacauccauucacggcgacagaucucagagggaucgcgaggaggcccuacaucaauuucgaucgggaaaaagcccgauccugguggcuaccgccgucgcagcccggggccucgacauauccaaugugaagcacguuauuaacuucgaucugccuucagacaucgaagaguaugugcaucguaucgggagaacgggaagggucgguaaucuuggccuggcuacuuccuuuuucaacgaacgcaacauuaauaucacaaaagacuugcucgaucuguuaguggaggcgaagcaggagguacccucuuggcuggaaaacauggcauacgagcaccacuacaaggggagcucccggggaagaucaaaaagcagguuuucuggcgguuucggggcccgagacuaucgccaguccaguggcgcuagcucuaguucauuuaguagcucgcgggccuccucuagcagaucaggaggcgggggacauggcaguuccagggguuucgggggaggcgguuacggcggguucuauaauucugauggauacggcgggaacuauaauagccagggaguugacugguggggcaacuga

SEQ ID NO: 55196 - RNA, 1974 nt, Artificial Sequence
  derived and/or modified sequence opt3 from DDX3Y__Homo_sapiens__NP_001289481
auggagaucggcagacccaggaaggacaccuggaaacuggccaaccucgaucuuaauagcgaaaagcaguccgggggagcuucuacagcaucaaaaggucgguacauuccuccacaccugaggaaccgagaggccaguaagggcuuccaugacaaagauagcuccggguggucuugcucgaaggacaaggaugcguauagcagcuuuggaagucgugacuccagaggcaaaccggguuacuucucugaaagggggagcggaucccggggccgcuuugaugacagaggcaggucagauuaugacgggauaggaaaucgggagcgccccgguuucggccgauuugaaagaagugggcacagccgcuggugugauaagucuguggaggacgauugguccaaaccuuugccacccucagagcgguuagaacaagagcuguucagcggaggcaacacugguaucaauuuugaaaaguacgacgacauuccugucgaggcuacggggaguaacugcccaccccauaucgagaauuucucugauauugacaugggagaaaucauaaugggcaacaucgagcuaacccguuauacacgcccuacuccaguucagaaacacgccauuccgaucauuaagggcaagagagaucucauggcaugugcccagaccggguccggaaaaacagcugcauuucugcuucccauccugagccagauauacaccgacgguccuggcgaagccuugaaggcugugaaagagaaugggagguauggacggcgaaagcaauacccaauuucgcucguacuggcccccacucgcgaacuggcggugcagaucuacgaggaggcaagaaaauucucuuauaggucccggguccgcccuugcgugguuuacggcggugccgauauugggcagcagaucagagaccucgaaaggggcugucauuuacugguggcuacaccaggacgucuugucgauaugauggagcggggcaagaucggguuggacuuuugcaaauaucuggugcuagaugaagccgaccgaaugcucgauaugggauucgagccccaaauuagaaggauaguagaacaggacaccaugccgccuaaggguguucgccacacgaugauguuuucagcaacuuuccccaaggagauccagaugcuggcucgggacuuccuugaugaguacauuuuucuggccgugggcagagucgggaguaccagcgaaaacaucacacagaaaguggugugggucgaggacuuggauaagagguccuuccuccuggacauauuaggagcgacuggcucugauagccugacccucguuuuuguggaaacaaagaagggugccgacucacuugaggauuuccuguaucacgaaggguacgcauguaccaguauucauggcgaccgcucccaacgagaucgggaggaggcuuugcaccaguuucguagcggaaaaucuccaauccuaguagccacggcuguggccgcaagaggccuggacaucucaaaugucaggcaugugauuaacuucgaucucccuagugacaucgaagaguauguucaccgcauugggcggacuggaagaguggguaaucugggccuugccacaucauuuuucaacgaaaagaauaugaacauaaccaaggaucuguuggaccuccuggucgaggcuaaacaggaggugcccuccugguuagaaaacauggcguacgagcaccauuacaaagggggaucuaggggccgaucgaaaagcaaucgcuuuuccgguggguucggcgcacgggacuauagacaaucaaguggaucuagcuccucaggcuuuggggccagcaggggaucuuccagucguagcggcggugggggauacggcaacucucgcgguuucggcgggggaggcuaugggggauuuuacaauuccgauggcuauggugggaacuacaauucacagggaguagacugguggggcaacuga

SEQ ID NO: 55197 - RNA, 1869 nt, Artificial Sequence
  derived and/or modified sequence opt3 from DDX41__Homo_sapiens__NP_057306
auggaggaaagcgagcccgaaagaaagagggcccggaccgacgaggugccugcuggcgggucccgcucugaagcagaggaugaggacgaugaagacuacgucccauauguuccgcugcgacagcguagacaacuccuucugcagaaauuguuacagaggcggcgcaagggagccgcggaggaagaacagcaagauucagguagugagcccagaggcgacgaagaugacaucccucuggggccacagagcaacgugucccuacucgaucagcaccagcaucugaaagagaaggcugaagccaggaaagagucugcaaaggaaaagcaacuuaaagaggaggaaaagauucuggagucgguagccgaaggacgggcuuugaugucagugaaagagauggcaaagggcauaacauacgacgaucccaucaaaacuagcuggacgccuccacgcuauguccucaguauguccgaggagcgacacgagagagugaggaagaaguaccauauucugguugaaggugacgggauucccccuccaaucaaaucuuucaaggagaugaaauuuccggccgcuauccugcggggacucaagaaaaagggcauacaccaucccaccccuauccagauucagggcaucccaacaauuuuaagcgggcgugauaugaucggaauagccuucacugguuccggcaaaacccugguguuuacacuucccgucauuauguucugcuuggaacaggagaagcgccugccuuuuucaaagagagaagggccauauggacuaaucauuugucccaguagggagcucgcgcggcaaacccacggcauccuggaguacuauugccgacuucugcaggaagacagcucuccguugcuccgcugugcacugugcaucggugggauguccgugaaagagcagauggaaacuauuagacacggaguacauaugaugguugccacaccuggcagguuaauggaccugcuccaaaagaaaauggugucacuugauauaugucgguaccuggcuuuggacgaggccgaucgcaugaucgacaugggcuucgagggggauauuagaaccaucuuuagcuacuucaagggacagaggcagacgcuacuguuuagugcaacuaugcccaaaaagauacagaauuucgcuaagucugcccucgucaaaccagugaccauuaacgugggucgugcgggcgccgcaucccuggacgucauccaagaaguugaguaugugaaggaagaggcuaaaaugguauaccuucuggaaugcuugcagaagacaccucccccagugcucaucuuugccgagaaaaaggcugaugucgacgccauucacgaguaucuguuacugaaggggguggaagcaguugccauccauggaggcaaagaucaggaggaacggacuaaggcuauugaggcguuccgagaagguaaaaaggacgugcuagucgcaaccgauguggccagcaaagggcucgacuuucccgcuauacagcacguaaucaauuacgacaugccugaggagauugaaaacuauguucacagaaucggcaggacaggacgcucgggcaauaccgggaucgccacgacuuucauuaacaaggcaugugaugagucugugcugauggaccuuaaggccuugcugcucgaagcuaaacaaaaggucccaccggugcugcagguccuucauugcggagaugaguccaugcuggacauagguggcgaacgggggugugccuucugcggaggcuugggucacagaaucacagauugucccaaacucgaggcaaugcagaccaaacaggugucaaauauugggaggaaggacuaccuggcgcauaguagcauggauuuuuga

SEQ ID NO: 55198 - RNA, 2817 nt, Artificial Sequence
  derived and/or modified sequence opt3 from DDX42__Homo_sapiens__NP_987095
augaacuggaauaagggcgggcccggaaccaaaagagguuucggcuuugggggauucgccaucagcgcuggcaagaaagaggaaccuaagcugccacagcaaucccacucugcauuuggugccacaucaaguagcuccggguucggaaaaucugcgccgccccagcucccuucguuuuacaagauuggcucaaagagggcuaacuucgacgaggaaaaugccuauuuugaggaugaagaggaggacagcaguaacguggaucuuccauacauacccgcagaaaauuccccuacucggcagcaguuccauucuaaaccagucgacagcgauuccgacgaugacccccuggaggccuuuauggcugaaguugaggaucaagcagcccgcgacaugaagcgauuggaggaaaaagauaaggagcguaaaaacgugaagggcaucagagacgauauugaagaggaagacgaccaggaggcuuauuucagguacauggccgagaauccuacggcggggguagugcaggaagaggaagaggauaacuuagaauaugacucagauggaaauccaaucgcaccgaccaagaaaauuaucgacccccugccuccaauagaucacagugagaucgacuaucccccuuuugagaagaacuucuacaaugaacaugaggaaauuacaaaccuaacuccacagcaacucaucgaucugcggcacaaacuuaaucugcgcgucagcggugccgcucccccgagaccugguucuuccuuugcccauuucggguucgacgagcaguugaugcaccagauuaggaagucagaauacacccagcccacaccaauccaaugccagggagugccuguugcacucagcggccgggauaugauagguauugcuaaaaccgggaguggaaagacugccgcguuuaucuggcccaugcugauucacaucauggaccagaaagagcuggagccaggcgauggccccaucgccgugauugucuguccuacacgcgaacucugccaacagauacaugcagaguguaagcgauucgggaaggcuuacaacuuaagaucuguggccguauauggagguggcuccaugugggaacaggcuaaagcccugcaggagggggcagagaucguugugugcaccccaggaaggcuuauugaccacgucaagaaaaaggccacgaauuugcaacgggugagcuaccugguguuugacgaagcugaucguauguucgacaugggcuuugaguaucagguccgcucgaucgcgucucauguuagaccggauaggcagacucuacucuucuccgcaaccuuucggaaaaagauagaaaagcuggcccgagacauucuuaucgaucccauccgcgugguacagggugacauuggggaggcuaacgaagaugugacacaaaucgucgagauucugcacucaggcccuaguaaauggaacugguugacuagaaggcucguggaguucaccagcuccggaucuguucuguuauuugugacaaagaaagccaaugcagaggaacuggccaacaaucucaagcaggaaggccacaaccuugggcuguugcauggagacauggaucagagcgagcggaauaaagucauaucagacuucaagaagaaagauaucccagugcuaguagcuaccgacguugccgcacgcggucuggauauucccaguaucaagacggugaucaacuacgacgucgcgagagacauugauacucacacacauaggauaggccguaccgggcgggcuggagaaaaaggcguggccuauacucuccugacaccuaaggacuccaauuuugcaggcgaucuuguccgaaaccuggagggggccaaucagcacgugagcaaagaguugcucgaccuggcuaugcaaaacgccugguucagaaagucuagguuuaagggcggaaaaggcaagaaauuaaauaucgggggagguggccugggguaccgcgaacggccaggacuaggcucagagaacauggauagagguaauaacaauguuaugaguaacuaugaagcauacaagcccagcaccggggcuaugggcgacaggcucacggccaugaaagcggccuuccagucccaguacaagucucauuucguggcugcaucgcugagcaaccagaaagccggauccucagcugccggcgcaaguggguggaccucugcgggaagccuuaauuccguaccgacaaacucagcccaacagggccacaauagcccugauucuccagucacuuccgcugccaaggguauucccggguuuggaaacaccggcaauaucaguggugcaccugugacauaucccagcgcuggcgcccaggggguuaacaauacugcaucuggaaacaauucccgcgagggcaccgggggaucaaacggcaagcgagaacgguacacagagaaucgugguaguagcagacacucgcauggggagaccggaaacaggcacuccgacucuccacgccauggcgaugguggccggcacggggacggauauagacacccugaaagcucaaguaggcauacugauggccaccgacauggggagaaucgccacggaggcuccgccggucggcauggggaaaacagaggagcuaaugacggcaggaacggugagucucguaaagaggcguucaaccgcgaaagcaagauggagcccaaaauggaaccaaagguggauuccucaaaaauggacaaggucgacagcaagacggauaaaacagccgacggcuuugcagugccggagccucccaagcggaaaaagaguagaugggauucuuga

SEQ ID NO: 55199 - RNA, 1947 nt, Artificial Sequence
  derived and/or modified sequence opt3 from DDX43__Homo_sapiens__NP_061135
augagccaccauggcggggcccccaaggcuuccaccuggguggucgcaucuagaaggucaaguacaguuagccgggccccugagcgccgaccagcggaagaacugaaccguacuggaccggaagguuacuccgugggcagagggggaagguggcggggcacgucuaggcccccugaggcuguagccgcaggucacgaggagcucccacuuugcuucgcccugaaaucgcauuuugugggggcugucaucggaagaggcggcucaaagauuaaaaauauacagagcaccacaaacacuaccauccaaauuauccaggagcagcccgaaaguuuggugaagauuuucggguccaaagcaaugcagacaaaggccaaggcuguuaucgacaauuuugugaaaaaguuagaggaaaacuauaauucugaguguggaauagauaccgccuuccaaccuagcgucgguaaagacggcuccacugauaacaaugugguagcgggggacaggccacugaucgauugggaccagauucgggaggaaggacuaaaguggcagaaaacaaagugggcagaucucccucccaucaagaaaaacuuuuacaaggagucaaccgccacgagugcuaugagcaaaguugaagccgacucuuggcgcaaggagaauuucaacauuacuugggaugaccugaaagauggcgaaaagcgaccaaucccgaauccuaccugcacauuugacgaugcauuccaguguuaucccgaggugauggagaacauuaaaaaggcugguuuucaaaagccaacucccauacagucccaggccuggccuaucguccuucaggggauugaccugaucggaguggcgcaaaccggcacaggcaaaaccuugugcuaccucaugccaggguucauccaccuggugcugcagcccucacucaagggacagagaaauaggccggguauguuaguccugacgccuacucgggaacuugccuugcaaguugagggcgaauguugcaaauauagcuacaaggggcugcguaguguguguguauauggaggcgguaaccgcgacgagcagauugaagaguugaaaaaggggguggauauaaucauugcaacacccggcagacucaaugaccugcagaugucuaacuuugucaaccuuaagaauaucaccuaccugguguuggaugaggcugacaaaaugcucgauaugggauucgaaccacagauaaugaagauucuguuagacguuaggccugaucggcaaacugugaugacauccgccaccuggccccauagcguccaccgacuggcucagucguaccucaaagagccaaugaucguguauguaggcacgcuugaccugguugccgugucuuccgucaagcagaacaucauugugaccacagaagaggaaaaauggucacacaugcagacuuuucuacaaaguaugagcuccaccgauaaggucaucguguucguuucucgcaaggcaguggccgaccaucuaagcucagaucugauucucgggaauauaaguguagagucccugcacggagacagagagcagagggaccgggaaaaagcucuugagaacuucaagacagguaaaguccgcauccugauugcgacugauuuggcaagcagaggccucgacgugcaugauguuacccacguguacaauuuugacuuccccaggaacaucgaagaguauguccaccguaucgggcggacaggacgagccggcagaaccggugugucuauuacuacgcugacaaggaaugauuggcgcguagcuucagaguuaauaaacauccuggaacgggccaaucagaguauuccugaggagcuagugagcauggcagaaagauuuaaggcccaucagcaaaaacgcgaaauggagcgcaagauggagcgaccacaggggcggccgaagaaauuccacuga

SEQ ID NO: 55200 - RNA, 3099 nt, Artificial Sequence
  derived and/or modified sequence opt3 from DDX46__Homo_sapiens__NP_001287789
augggcagagagagcaggcacuaccggaagcgcuccgccucucgagggcguucaggaaguagaagcaggucccggucucccucggacaaacgcucaaagagaggugaugacaggcggagccgcagucgagauagagacaggcggcgugaacgcuccagaucuagggauaaacggcgaagccgcuccagagacaggaagcggcugcgcagaucaaggagucgugagcgggaucgaagcagagaaaggcgccggucuagauccagggaccgccgacggucacguagcagaaguaggggccgccggucuagauccagcucgccugggaacaaaucuaagaagaccgagaauaggucccgaucaaaagaaaagacagauggaggcgagaguagcaaagagaagaaaaaggacaaggaugacaaagaagaugagaaggaaaaagacgcugguaacuucgaccagaauaagcucgaggaggaaaugcgcaaacggaaggagagaguggaaaaauggagggaggaacaacguaagaaggcaauggagaacaucggggagcuuaaaaaggaaauugaggaaaugaaacagggaaagaaauggucccuggaggaugacgaugacgaugaagacgauccagccgaggcggagaaggaaggcaaugagauggaaggcgaggaauuggacccguuagaugcuuauauggaggaggucaaggaagagguuaaaaaguuuaacaugcgcucugugaaagggggagguggcaaugaaaagaaaagcgggcccacuguaacgaagguggucaccgugguuacaacuaagaaagccguggucgacucagauaagaaaaagggagagcugauggagaacgaccaggacgcaauggaauacaguuccgaggaagaggaaguggaucuacagaccgcccucacaggcuaucaaaccaaacagcggaagcugcuugagccuguagaccaugguaagauagaguacgaaccauucaggaaaaauuuuuauguugaggugcccgaacuggcuaagaugagccaggaggaagucaacguguucagauuggagauggaggggaucacugugaaaggaaagggcugcccuaaaccaauuaagucuuggguccaguguggcaucucaaugaaaauucucaauagucugaagaagcacggguacgaaaaacccacaccuauccaaacccaggcaauaccagccaucaugagcggacgagaucugauugguaucgcuaagacgggcuccgggaaaacuauugccuuucucuuaccgauguuccggcauaucauggaccagcgcucucuggaggaaggagagggccccauagcgguuauuaugaccccuacaagagaacuugcauugcagaucacuaaggagugcaaaaaguuuucgaagacccugggucuaagggugguauguguguaugggggcacaggaauuagcgagcaaaucgccgaacucaaacggggcgcugagaucauugucugcaccccagggcgaaugauagauaugcuggccgcaaacuccggaagagugacgaaucuucgcaggguuacuuacgugguccuggacgaagcugaucguauguucgacauggguuuugagccccaggugaugcggaucguagauaacguuagaccugacaggcagacagugauguucucagccaccuuuccacgcgcgauggaggccuuggcacgacggauucucaguaagcccaucgaaguccaagugggcgggagaucugucguguguagcgauguugagcaacaggugauaguaauugaagaggagaaaaaguuccugaaauuacuggagcuccuuggacacuaccaggaguccggcucagucaucaucuuuguggacaagcaggaacaugcugauggucuguugaaggaccuaaugagggccagcuauccgugcaugucucugcacgggggcauugaccaguacgaucgcgacuccaucauuaaugauuucaaaaacggaacuuguaagcuccugguugcuacaaguguggccgcacguggccuugacgucaaacaccugauauuggugguaaacuauagcugcccuaaucauuacgaggauuaugugcacagagccgggcggaccggaagggcugguaacaagggcuacgcguauacguucaucaccgaagaccaggcacgcuacgccggggauauuaucaaagcucucgagcugucuggaacagccguucccccagacuuagaaaagcugugguccgauuuuaaggaccagcaaaaagcagagggcaagaucauuaaaaagucaagugguuucagcgggaaaggcuuuaaguucgaugagacugaacaggcccuagcuaaugagcgaaagaaacuccagaaggccgcacugggacuucaggacucggaugacgaagacgcggcugucgauauagacgagcaaaucgaauccauguuuaacucuaaaaagagagugaaagauauggccgcaccuggcaccagcucagugcccgccccaacagcugggaaugccgagaaguuggagauugcaaaacggcuggcucucaggaucaacgcccagaagaaucugggaauugaaagucaggucgacguuaugcagcaagcgacuaacgccauccuucgcggcgguaccauacuggcucccacaguguccgcaaagaccaucgccgagcaguuggcugagaaaauuaaugccaagcucaacuacgugccucuggaaaaacaggaggaagagagacaagaugggggacagaaugaaucuuucaagagguaugaggaagaguuagagaucaacgacuuuccacagacugcacgguggaaaguaacgagcaaggaagcgcugcagcguauuuccgaguacucagaagccgcuaucacaauacgcggcaccuauuucccgcccgguaaggagccuaaagaaggcgagcgaaagauuuaccuagccaucgagagcgcaaaugaacucgcuguccaaaaagccaaggcagagauuacuagacugaucaaagaagaacuuauaagguugcagaacaguuaucagccaaccaauaaggggcgguacaaggugcuguga

SEQ ID NO: 55201 - RNA, 2073 nt, Artificial Sequence
  derived and/or modified sequence opt3 from DDX4__Homo_sapiens__NP_001136021
augggcgacgaggauugggaagccgagaucaacccccacaugagcuccuacgugccuauuuucgaaaaggacagauauucuggggagaauggagauaacuuuaauaggaccccagcuucaaguagcgaaauggacgaugguccgucccggcgcgaccauuucaugaaaucuggcuuugcaucggggcgaaacuucggaaaucgugaugccggcgagugcaacaagagagacaauacaucaacuauggguggguuuggagucggcaagagcuucggcaacaggggguuuaguaauucccgguucgaggauggagacucuagcgguuuuuggcgcgaauccucaaacgauugugaggacaaucccacgagaaacaggggcuucaguaaacgcggggauaaugaccuggacccugaugaaugcaugcagcggaccggaggccucuuugguagccgaagaccaguucuuucugggacaggaaacggcgacacuucccaaucaaggagcggcagugggucugagcggggagguuacaaaggccugaaugaggaagugauaaccggguccggaaagaacagcuggaagucggaggcggaaggcggugagucuuccgauacacaggggcccaaaguaaccuauaucccuccacccccuccagaagacgaggauucaauuuucgcucacuaccagacuggcaucaacuuugacaaguaugauacaauuuugguggaggucaguggacaugacgccccgcccgcaaucuuaaccuucgaagaggccaaucugugucagacgcuaaacaauaacauagcuaaagcaggcuacacuaagcucaccccugugcaaaaauauagcaucccaauuauccuggccgggcgugaucuuauggcuugcgcccagacaggauccgguaagacugcggcauuccuguugcccauucucgcccacaugaugcaugacggcaucaccgcuucucgcuuuaaggaacugcaggagccugaauguauaauuguugccccaacaagagagcuggugaaucagaucuaccucgaggcaaggaaauucagcuuugggaccugcguccgggcugugguaauuuacggaggcacgcaauuaggucacucaauccgacagaucguucagggguguaacauucugugcgccacucccggccgccuuauggauauaaucggaaaggagaaaauuggcuugaagcagaucaaauaucuggugcuagacgaagcggacagaaugcucgauaugggguucggaccggaaaugaagaaacugauaaguuguccugguaugcccuccaaggagcaaaggcagacacuuauguuuagcgccaccuucccagaagagauucagcggcuggcagcugaguuuuugaagucuaauuaccucuucgucgccgugggccaagucgggggagcuugccgcgacgugcagcagacuguuuuacaggugggccaauuuucaaaaagagaaaagcugguagagauccugaggaacaucggugaugaacguacaaugguguucgucgagaccaaaaagaaagccgacuuuauugcaacguuccucugucaggagaagaucaguaccacaagcauucacggggaucgggaacagcgagagagagaacaggcccuuggcgacuuuagguucggaaagugcccugugcugguugcuacuuccguggcggcacgcggcuuggauauagagaauguccaacaugugaucaacuucgaccuacccucuaccauugaugaauauguacaccggaucgggagaacaggaaggugcggcaauacuggucgcgccaucucguuuuucgaccuggagagcgauaaccaucucgcucagccacugguuaaagugcuuaccgacgcccagcaggauguccccgcauggcuggaggaaauugccuuuuccacauacauaccuggguucucaggaaguacccgaggcaauguguuugcuucugucgacacucggaaggguaaaagcacguugaacacagccggcuucuccucaagccaagcaccaaauccgguggacgaugagucuugggacuga

SEQ ID NO: 55202 - RNA, 2214 nt, Artificial Sequence
  derived and/or modified sequence opt3 from DDX50__Homo_sapiens__NP_076950
augcccggcaagcugcucuggggagacaucauggagcuugaagccccucuggaggaaagcgagucccagaaaaaggaaagacaaaaaucugauaggcggaagucacgccaccauuacgacagugaugagaaaagcgagacccgagaaaacggagugacagacgauuuggacgcuccaaaggcaaagaaauccaagaugaaagagaaguuaaauggugauacugaagagggcuucaaccgucugucugacgaguuuucgaaaucacacaagagcagaaggaaggaucuaccgaauggggacauugaugaauaugagaaaaagaguaaacgggucuccucucucgacacgagcacccauaaguccucagauaacaaacuggaagagacacuuacucgcgaacagaaggagggagccuucaguaauuuucccauaagcgaggaaaccaucaaacuguugaagggcagagguguuacauaccucuucccuauucaggugaagaccuuugggccaguauaugagggaaaagaccugaucgcgcaggcuaggacuggcacaggcaagaccuucucuuuugccauuccccugaucgaacggcuccaacgcaaccaggagacgaucaaaaagucccgaucaccuaaaguguuaguccuggcaccaacuagagaacuugccaaucagguggcuaaggacuucaaggauauaaccaggaaauugagcguugcaugcuuuuacgggggaacaaguuaucagucucaaauuaaccacauccggaaugguauugacauccuggugggcacucccgggcguauaaaggaucaucuacaguccggacgccucgaccugagcaaacuuagacacgucgugcuggaugagguagaccagauguuggaucucggcuucgccgagcagguugaagacauuauccacgagucguacaagaccgauucugaagacaacccucaaacacuguuauuuuccgcuaccuguccacaguggguguauaaagucgccaagaaguacaugaaaucaagguacgaacagguggaucugguggguaagaugacgcaaaaagcggcaacuacagucgagcaucucgccauucagugccacuggagucagcggccggcuguuaucggggacgugcuucagguauauagcggauccgagggccgagccaucauuuucugugagaccaagaaaaaugugacugaaauggcaaugaacccccauauaaagcaaaaugcucagugccugcacggcgacaucgcccagucucagcgcgagauuacauugaagggguuuagagaagggagcuucaaaguccuaguggcgaccaacguugccgcaaggggucuggauaucccugagguggaccucgucauacaaucaaguccaccccaggauguggaguccuacauucaccggagcggccgcacggggagagcuggaaggaccggcaucuguaucugcuucuaucagccucgugaacggggucagcugcgauacguagagcaaaaggccgggauuacauuuaaaagaguuggcgugccaucuacuauggaccuugucaagucaaaaaguauggaugcuaucaggagccuggccuccgugucuuaugcagccgucgacuucuuucgccccucggcucagcgguugauugaagagaagggagcgguggaugcacucgccgcugcccuggcacauauaagcggcgccuccucauucgaaccgagaaguuuaaucaccucugacaaaggguuuguuacaaugacucuggagagccuagaggaaauucaggauguguccugugcuuggaaggagcucaauaggaagcugucaagcaacgccguaucucagaucacccgcaugugccuuuugaaaggaaacaugggugucuguuucgacgugccuacaaccgaauccgagcgacugcaagcagaauggcacgauagugacuggauccucagcguucccgcgaagcugccagagauugaggaauacuaugauggcaauacuucuuccaacucacggcagcguaguggguggagcucgggaagauccggcaggucuggucgcagcgggggccggucaggaggcagaagugggaggcagucccgacaaggaucucgcagcgguucccggcaggacggcagaaggcguucagggaaucgcaaccggagcagaaguggaggccauaaaaggucuuuugacuga

SEQ ID NO: 55203 - RNA, 2001 nt, Artificial Sequence
  derived and/or modified sequence opt3 from DDX51__Homo_sapiens__NP_778236
auggcccuguucuacguggcuagauaucccggcccugacgcagccgcggcugccgggccagagggagcagaagccggugcucacggcagggcacgggcccuccuugagcgccugcagagccgagcucgugaaagacaacagcagagggagccggcccagaccgaagcggcagccuccacagagcccgcuacucggcgcagaaggcggccucgccgaagaaggcgggucaacgaugccgagccagggucucccgaagcaccucaaggaaagcgucgcaaagcugacggcgaggaugccggugcggaaucaaaugaggaggccccaggggaacccagugcaggaagcuccgaggaagcuccuggcgagccaucugccggcucgucagaagaggcuccgggggagagaagcacgagugccuccgcagaagccgcucccgacggaccugcguuggaggaagcagccgguccauuaguucccggccuggugcuagggggauuuggcaagaggaaagcuccuaagguacagccauuccucccccgguggcuggccgagccgaacugcgugcgacgcaaugucaccgaagaucuugugccuaucgaggacauucccgauguucauccagaccugcagaaacaguugagagcacacgguauaucuagcuacuuuccugugcaagccgcugucauccccgcccuccuggaguccgcagcguguggguuccuggugggaaggggcggcuaucggccaucagaucucugcguaagugcucccacagggagcggaaagacuuuagccuuuguuauuccugugguccaggcacugcuuucucgcguggugugucauaucagagccuuggucguucugccaaccaaggaacuagcucagcagguauccaaaguguucaacauuuacacagacgccaccccgcucagggugucacuggucacuggucaaaagagccuugcaaaagagcaggaaagucuggugcagaagacagcugauggcuaucguugcuuggccgacaucguuguggcgacccccgggcggcucgucgaucacauagaccaaacgccuggauuuucucugcagcaguuacgauuccugaucauugacgaggccgauagaaugaucgacuccaugcaucagagcuggcucccaagggugguagcugcagccuuucaaucggaagaucccgcugacccuugugcccuucugcagcgccggcaggcacaggcgguuacugccgcuucuaccugcuguccacaaaugcccuugcagaaacuacuguucuccgccacacucacucagaauccggagaagcugcagcaacuuggccugcaccagccuagauuguuuucaaccggucucgcacacagggggcuggaggauacagacggcgauggagacaguggcaaguacgcuuucccagugggguuaacccaucacuauguccccugcagccuguccucuaaaccucuagugguccuccaucuggugcuugaaaugggauuuagccgcguuuuguguuucacgaacucacgagagaauagucaccggcuguuccuccuggugcaggccuuugguggcguagaugucgcagaguucuccagccguuacgggcccggacagagaaggaugauucuuaagcaauuugaacagggcaaaauccagcuguugauaucuacugacgccacagcucgcgguauugaugugcaagggguugagcucguggucaacuacgacgcgccacaguaucugcggaccuacgugcacagaguaggcaggacugcccgagcaggaaagacaggccaggcuuucaccuuacugcuaaaagugcaggaacgccgguuucucagaaugcugacggaggccggggccccugaacuucaaaggcaugaguugucaaguaagcugcuccagccccugguuccacguuaugaagaggcuuuaagccagcuggaggaauccgucaaagaggaacgcaagcagcgggcagccuga

SEQ ID NO: 55204 - RNA, 1800 nt, Artificial Sequence
  derived and/or modified sequence opt3 from DDX52__Homo_sapiens__NP_008941
auggacgugcacgaucuguucagaaggcucggcgccggggcuaaguuugacacccggcgcuucagcgcagaugccgcgcgauuucagaucggaaaacguaaguacgacuucgauuccucugagguccuucaaggucuggacuuuuucggcaacaaaaagucaguucccggggugugcggagcuagucagacacaucagaaaccucagaauggcgaaaagaaggaggaaucauugacugagagaaaaagggaacaauccaagaaaaagcggaaaacgaugaccucugagauugccucgcaggaggaaggugcaacaauacaguggaugucaagcguagaggccaagaucgaagauaagaaagugcagcgcgagaguaaguuaacuuccgggaaacuggagaaccuaagaaaggagaaaauuaauuuucucaggaacaagcacaaaauccauguccaaggaaccgaccugccagauccgauugcuacauuccagcagcuugaccaggaauauaagaucaauucucggcuguugcaaaacauacucgaugcaggcuuucagaugcccaccccuauccagaugcaagccauuccagugaugcugcacggccgcgaacugcucgcuagcgcccccacuggguccggaaagacauuagcguucucaaucccuauucugaugcagcuuaaacagccagcaaauaaggguuuucgagccuugaucauaagucccaccagagagcuggcuagccagauucauagggaacuaaucaaaauuucugagggcacgggguuccggauccacaugauccacaaggccgcaguugcugccaaaaaguuuggaccuaaguccagcaaaaaguucgacauucucgugacuaccccaaaccgucugauauaccuucugaaacaagauccgcccggcaucgacuuggcgagcgucgaguggcucgugguagacgaaagugauaagcuguucgaggacgguaaaacaggguuucgcgaucaguuagccucuauuuuccuggcauguacuucccauaagguuagaagggcuauguuuagcgccaccuucgcuuaugacguggaacaguggugcaagcucaaucuugauaacgucaucucggugucuauaggagcccgaaauuccgcaguggagacagucgaacaggagcuguuguuuguuggcucagagaccggcaaacuacuggccgugcgggaacucguaaagaaaggguucaacccuccagugcuggucuuugugcaaaguauugagcgcgcuaaggaacuuuuccacgagcugaucuacgaaggaaucaauguugacgugauucaugcggagagaacgcagcagcagagggauaacacuguccacagcuuucgggcagguaaaaucuggguguugauuuguacagcccuccuggcucgcggcauagacuucaaggggguaaauuuaguuaucaacuaugauuuucccaccuccucuguggaguacauucacagaaucggaaggacuggccgugccgguaacaaggggaaagcaaucacauucuuuaccgaagacgauaagccucugcuacggagcgucgccaaugugauucaacaggcuggcugcccaguccccgaguauauaaaaggauuccagaagcuccugucaaaacagaagaaaaagaugaucaagaaaccgcuugaacgagagaguauuuccacgaccccuaaguguuucuuggagaaagccaaggacaaacaaaagaaggugacaggccagaacagcaaaaagaaaguugcacuggaagacaagucuuga

SEQ ID NO: 55205 - RNA, 1896 nt, Artificial Sequence
  derived and/or modified sequence opt3 from DDX53__Homo_sapiens__NP_874358
augagccacugggcccccgaguggaagagagcugaagcaaacccuagggaccugggcgccuccugggaugugcgggggucucgcggaucagguuggaguggcccauucgggcaucagggaccgcgagcggcuggcagccgugagcccccucucugcuuuaaaaucaagaauaacauggucgguguugugauuggguacuccggaucuaaaauaaaggaccuucaacacucgaccaauacaaaaauccagauuaucaacggcgaaucagaggccaagguaagaauuuucggcaauagggaaaugaaggcaaaagccaaggcugcaaucgagacucugauacggaaacaggagagcuauaacagugaauccucuguggauaaugccgcuagccagacgccaaucgggcgcaacuugggaagaaaugacauugucggugaggccgaacccuuauccaacugggauaggauccgggcggcagugguugagugugagaagcgcaaaugggccgaccugccuccagugaagaagaauuuuuacauugaaucaaaagcuaccaguugcaugagcgagaugcaagucaucaacuggcgaaaggaaaauuucaacauaacaugugaugaccuaaaaucuggcgagaagagacucauucccaaaccuacuugcagguuuaaggaugccuuccagcaguauccagaccugcuuaaauccaucauucggguggggaucguaaagccgacccccauccagucacaagcauggccuauuauacugcagggaaucgauuugauuguuguggcucagacaggcaccgguaagacucucagcuaccugaugccaggguuuauccaucuggacagucagcccauaucucgugaacaacgcaauggaccuggcaugcucgucuuaacaccaaccagagagcuggcccuucacguggaggcggaauguuccaaauauagcuacaagggcuugaaaucgauuugcaucuaugggggaaggaaccggaacggucagaucgaggauauuucuaagggcguggacaucauuauagccacgcccgggcgacugaaugaccuacagaugaacaauuccgucaaccuccgcucaaucacuuaccugguuauugaugaagcagacaaaaugcuugauauggaguucgaaccgcaaaucagaaagauccuguuggacgugaggccugaucggcagaccguaaugacaagugcuacuuggcccgacaccgugcgccagcucgcccugagcuacuuaaaggauccaaugauugucuaugugggaaaucugaaccucguugcugugaauacagucaaacagaacauaaucgugaccacggagaaggagaaaagagcccuuacucaagaauuuguagagaauauguccccuaacgacaagguuauuauguucgugucucagaaacauaucgcagaugaccugagcucagauuuuaauauucagggcaucagugccgaauccuugcacgguaacagcgagcagucugaccaagaaagggcugucgaggacuucaagucagggaauauaaagauccuaauuacaaccgauaucgugagucguggccuggaccucaacgaugucacucacguguacaauuaugacuuuccccggaacauugauguuuacgugcaucgaguaggauauaucggcagaacagggaaaaccggaacgagcgucacccugauaacacagagggacuccaagauggcgggugagcuuauuaaaauccuggaucgcgcaaaccagucugugccagaagacuugguugugauggccgagcaguacaagcucaaucaacagaaacggcacagagaaacuaggucgcgcaagcccggccagcgacggaaggaguucuauuuccugagcuga

SEQ ID NO: 55206 - RNA, 2649 nt, Artificial Sequence
  derived and/or modified sequence opt3 from DDX54__Homo_sapiens__NP_001104792
auggccgcugacaagggccccgcagccgggccuagaucaagggcggcuauggcccaguggcggaaaaagaaaggacugcgcaagcgacguggugcagccucccaagcuagaggcucugauucagaggacggggaguucgaaauccaggcagaagaugacgccagggcucggaaacucggaccaggccgcccgcuucccaccuuuccuacaagugagugcacuagcgauguggaaccagacacgagagagauggucagggcccagaacaagaagaaaaagaaauccgguggguuccagucuaugggacugucguaccccguuuuuaagggcauuaugaaaaagggcuauaaggugccuaccccaauacaacggaaaacaauccccguaauuuuggaugggaaggacguggucgcgauggcacgcacuggaucagguaaaaccgccuguuucuuacugccuauguuugagcgacuaaagacacacagcgcucagaccggcgccagagcacucauccugaguccaacuagggaacuugcucugcagacauugaaauucaccaaggagcucgggaaauuuacgggacugaagacugcccugauucucggcggugaucggauggaagaccaguucgcggccuuacaugagaauccggauaucauaaucgcaacccccgggcgucuggugcacguugcuguggagaugucccuuaaguugcaaucugucgaauacgugguauuugacgaggccgaucgccuguucgaaaugggauuugcugagcagcuacaggaaauuaucgccagacucccuggcggccaucagacaguucuguucagcgcaacucuuccaaaacuguugguggaguuugccagggcugggcucaccgagcccguccugauucgguuagacguggacacaaagcugaacgaacaacucaaaaccuccuucuuccuugugcgagaggauacgaaggcggcaguccuguugcaccuacugcauaauguugugcgcccucaggaccagacuguaguguuugucgccacaaaacaccacgcugaauaucucaccgagcugcuuacuacacaaagagugucaugcgcccauaucuacagugcacuggauccaaccgccaggaagauaaacuuggcuaaguucacgcucggaaaauguagcacccugauuguuacagacuuagccgcacggggucuggauaucccccuacucgacaaugugauuaacuauucuuuuccggcgaagggcaaacuguuccuucaccgcgucgggagaguggcuagggccggacguuccggcacugcauacucauugguagccccugaugaaauccccuaucugcucgaccugcaucuuuuucugggucggagcuugacccucgcucgaccacugaaggagccuagugggguugccggcguggauggaauguuaggcagagucccccagucuguggucgacgaggaagauuccgggcugcagagcacacuagaggcaucgcucgaacugaggggacuugcucgcguggccgacaaugcgcagcaacaguacguucggucuagaccagcccccuccccugagucaaucaaaagggcuaaggaaauggacuuggugggucugggccuccacccacuguucaguagccgcuuugaggaggaagaguuacagcgacugcggcuuguagauuccauuaagaacuaccguucuagagcaacuauauucgaaaucaaugccagcucaagggacuugugcagucaggucaugcgcgcuaaacggcaaaaggauagaaaagccauugcaagguuucagcaggggcagcaaggacgacaggagcagcaggagggcccggugggucccgcgccuucccgcccagcccuccaagaaaagcagcccgagaaagaagaggaagaggaggcuggggaaagcguugaggacaucuucucugaaguggucggccggaagagacagaggucaggaccuaaccguggcgccaagcgccggagagaggaagcaaggcaacgagaucaggaguuuuauauaccauaccggcccaaagacuucgauagugagcgcgggcugagcauuuccggagaagguggcgcuuuugagcagcaggccgcaggggccgugcuagaccugaugggagaugaagcucaaaaucucaccagaggcaggcagcagcugaagugggaccggaaaaagaaacgauucguaggucagucugggcaagaggauaagaaaaagaucaagacagaaucgggcagauauaucagcuccucauacaaacgcgaccuuuaucagaaguggaaacagaagcagaaaauugaugacagggacagugaugaggagggagcgucugaccgucggggcccggaaagacgcgggggaaagagggaucgaggccaagccggugcaagcagaccucacgcuccagggacccccgccggacgggugaggccugaguugaagacuaaacagcagauccugaagcaacgccguagagcccagaaauuacauuuccuccagcggggcggucugaagcagcuuuccgcuaggaaccgccgaagaguucaagaacugcagcagggcgcauuugggcggggagccaggagcaaaaagggcaagaugcgcaaaagaauguga

SEQ ID NO: 55207 - RNA, 1524 nt, Artificial Sequence
  derived and/or modified sequence opt3 from DDX56__Homo_sapiens__NP_001244118
auggaggacagcgaagcccugggcuucgagcacauggggcucgaucccagacuucugcaggcugugaccgacuugggaugguccaggccuacauuaauccaagaaaaggcaauuccacuggcccuagaggguaaagaucuccuggcgcgggcucgcacuggcucugggaagacggccgcauacgccauaccgaugcuucagcuguugcuccaucgaaaagcuaccggacccgucguugaacaggcagugcguggccugguacuggugccuacaaaggagcucgccagacaggcucaaucaaugauccagcaguuagccacuuauugcgcgagggacguccggguggcaaacguuagugccgcugaggauagcgugucccagcgcgccguccugauggaaaaaccagacgugguaguugguacccccucuaggauucuuucgcacuugcaacaggauucacugaagcuaagagacagccucgagcugcuuguggucgaugaagcagaccuguuguuuaguuucggguuugaggaggaacucaagucccuguuaugucaucugccucggaucuaccaggcuuuccucaugucugccacauuuaaugaggaugugcaggcgcuuaaagaacugauuuugcacaacccagugacccuaaagcugcaagagagccagcuccccggaccugaccagcugcaacaguuccaggucguuugcgaaacugaggaggauaaauuucuucuguuguaugcccuccugaaguuaucccugauccgcggcaaaucacuacucuucgugaauacacuggaacgaaguuacagacuuagguuguuucuggagcaguucagcauaccaaccuguguacucaacggcgaacugccgcuucggucucgugcauccgaccccgaggcugggguggcccgcggaaucgacuuucaucacgucucagcugugcugaauuucgauuugccuccaacgcccgaagccuauauucacagagcagguaggacugcccgggcuaacaauccuggcaucguucucaccuuugugcugccaacagagcaauuccauuuagggaagauugaggaacugcuaagcggagagaaccgaggccccauccuccugccguaccaguuccgcauggaagagauagaagguuuuagauauaggugccgggacgcgaugcgcagugucacuaagcaggcaauuagagaggccaggcuuaaagagaucaaggaagaguugcugcacucugaaaaacucaagaccuacuucgaggauaauccucgugaccugcaguuacugcggcaugaucuucccuugcacccagcugugguaaaaccucaccucgggcauguucccgacuaccuggugccacccgcccuacgaggacuggucagaccucacaagaaaaggaagaagcucuccagcucgugucgcaaagcaaagcgggccaaaucucaaaacccacugagauccuuuaagcauaaaggcaagaaguucaggccgacagcuaaacccucauga

SEQ ID NO: 55208 - RNA, 2778 nt, Artificial Sequence
  derived and/or modified sequence opt3 from DDX58__Homo_sapiens__NP_055129
augaccacagagcagagaaggagccugcaagccuuccaggacuacauccggaagacucucgaucccacguauauucuuuccuacauggcuccuugguuucgcgaagaggaagugcaguauauacaggcagagaaaaacaauaagggcccaauggaagccgcgacccuguucuugaaauuuuuacuggagcuacaagaggaagggugguuccgaggauuucucgacgcucuggaucacgccgguuacucuggccuuuaugaggcaaucgaaucaugggacuucaagaaaauugagaagcuggaggaauaccguuugcuccugaagagacugcagccggaguuuaaaacaaggaucauucccacugauaucauaagugaccucagcgaaugcuuaaucaaccaggagugugaagagauucugcagaucugcuccaccaaggggaugauggccggagcugagaaacuugucgaauguuugcugcggucugauaaggagaauuggccuaaaacacuaaagcucgcacuggaaaaggagcgcaacaaauucucggaacuuuggauuguugagaagggcaucaaagacguggagaccgaagaucuggaggacaagauggaaacuucagauauacaaaucuuuuaucaggaggacccagaaugccagaauuugagcgagaacaguugucccccuuccgagguaucugauacaaaucucuacagcccauucaaacccagaaacuaccagcuggaauuagcccugccugcuaugaaggguaaaaauaccauuauuugcgccccaacgggguguggaaagacuuuugugucccuccuuaucugcgagcaucaccugaagaaauucccgcaaggccagaagggcaaagucguguuuuucgcgaaccagauccccguuuaugaacaacagaagucaguguucaguaaauacuuugagaggcauggguaucgggucaccggaauuagcggugcaacagccgagaaugugccuguagaacagauaguugagaacaaugacaucauuaucuugacuccacagauacuggugaacaaucugaagaagggcaccauucccucucucuccaucuucacacugaugaucuuugacgaaugucacaacaccucaaaacaacauccuuacaacaugauuauguucaauuaucuugaucagaagcuagggggaagcaguggcccauugccccaggucaucggucucacggcuucugugggggugggagacgccaaaaacacugaugaggcacuggacuacauuugcaaguuaugugcuucccuggaugccagcgucauagcgacaguuaaacacaaucuagaggagcucgaacaggugguauauaagccgcaaaaguuuuuccgcaaaguggaaucgcgaaucucugacaaguuuaaauacauuaucgcccagcugaugagagauaccgagucccuugcaaagaggaucugcaaagacuuggaaaaccugucacagauucagaaucgggaguucggcacucaaaaguacgaacaguggauagucacagugcagaaggcuugcaugguuuuucagaugccugauaaagacgaggagagucguaucuguaaggcccucuuccuguauaccagccaccuucgcaaauacaacgaugcucugauuaucuccgaacaugccagaaugaaggacgcauuggacuaucucaaagacuuuuucucuaaugugagggccgcuggcuuugaugagauugaacaagaucugacgcagcgguucgaggaaaaguuacaggagcuggagagcgucucacgagaccccaguaacgaaaauccaaaacuagaggaucucugcuucauccugcaagaagaguaccaccuuaacccugagaccauaacaaucuuguuugugaagacucgcgcgcugguagacgcacucaagaauuggauugaagggaaccccaaacuguccuucuuaaagccaggaauccugaccgguagaggcaaaacaaaucagaacacugggaugacccuucccgcccagaaguguauuuuggaugcuuuuaaagccagcggagaccauaauauccucauagcaacaucuguugccgaugagggcauugacaucgcucagugcaaccuggugauucuauaugaauacgucgguaacgugaucaagaugauacaaaccagggggcggggccgcgccagaggaucaaaguguuuccugcucacgaguaaugcaggcgucaucgagaaagaacagauuaacauguauaaggagaaaaugaugaaugauagcauccugaggcuucagacuugggacgaggcgguguuucgugaaaagauuuugcacauccagacacacgagaaauucauacgggauucccaagaaaagccuaagccaguuccggacaaagagaacaagaaacuguuaugccgaaaguguaaagcucucgccugcuacaccgcagacgugagaguaauugaagagugucauuacacuguccugggggaugccuuuaaggagugcuucgugucuaggccccacccuaagccaaaacaguuuucgagcuucgaaaagcgcgcuaaaaucuuuugugcccggcagaauugcucccaugacuggggaauccacguuaaguauaaaaccuucgagauucccgugaucaagauugaaucauuugucguggaggauauagcaacagguguacagacccuuuacaguaaauggaaggacuuccauuucgaaaagaucccuuuugauccagcugagaugucuaaauga

SEQ ID NO: 55209 - RNA, 1860 nt, Artificial Sequence
  derived and/or modified sequence opt3 from DDX59__Homo_sapiens__NP_001026895
auguucgugcccagaagccugaagaucaaaaggaacgccaaugacgauggcaaguccugcgucgcuaaaauuauaaagccugacccagaggaucuccagcuugacaaaucucgggauguuccgguggacgcaguagccaccgaagcggcuacaaucgaucgccacauuucagagaguugucccuuuccuagcccagggggacaacuggccgaagugcauuccgucucucccgagcagggugcaaaggacucgcacccuucagaggaaccaguuaagagcuucaguaaaacucagcgaugggccgagcccggcgaaccuaucugcguggugugugggcguuacggagaguauauuugcgauaagacggacgaagaugucuguuccuuggagugcaaagcuaagcauuuacuccaggugaaagagaaggaagagaagucuaaacuaagcaacccacaaaaggcagacuccgaaccggagucaccccucaaugccaguuacguauauaaagaacacccuuuuauccugaaccuucaggaggaucagauagagaaucugaagcagcaauugggcauccucguucagggucaggaagugaccagaccaauuaucgacuucgagcauuguagccugcccgaaguccugaaccacaaucucaaaaagucuggguacgaggugccuacaccaauucagaugcaaaugauccccgugggauuacugggcagggacauacuugcuuccgccgauacuggcucagggaaaaccgcggcauuuuugcugccggucauuaugcgggcccuauucgaaagcaagacaccuagugcucucauccugacccccacucgcgagcuugccauucagaucgagagacaggcaaaggaacugaugucuggauugccaaggaugaaaacaguucuccugguggguggcuuaccucugcccccacaacucuaucggcuucagcagcacguaaaggugaucauugcuacccccgggcgccuguuggacauaaucaaacaguccagcgucgagcuaugcggagugaagauuguuguggucgaugaagccgacacgaugcugaaaaugggcuuucaacaacaggugcucgauauccuggagaacauaccuaaugacugucagacuauucuuguaucggcgaccaucccaacaucuaucgaacagcuggccucccaguugcuccauaacccgguucgaauuaucacuggugagaagaaucugcccugcgcaaacgugagacagauuauauuaugggucgaggauccugcuaagaaaaagaaacuguucgaaauccuaaaugacaagaaacucuuuaagccacccgugcuggucuucguggauuguaaacuuggggccgacuugcugucagaggcuguucagaagauuaccggacucaagaguaucagcauccacuccgaaaaaucucaaauugagaggaagaacauacugaaaggccuucuggagggcgauuacgaagugguagucagcacagggguguugggacggggucucgaccugaucucaguucguuuaguggucaauuuugacaugccuaguuccauggaugaguaugugcaucagauuggccgcguagggagacugggacagaacggcaccgccaucacguucauuaacaauaacagcaagaggcuauuuugggacaucgcaaagcgggugaaaccaacugguucuauacugcccccgcagcugcuuaauucaccuuacuugcacgaucaaaagcgaaaagaacagcagaaggacaaacaaacacagaacgaucugguuaccggggccaaucucauggacaucauucgcaagcacgauaaaaguaacagccagaaguga

SEQ ID NO: 55210 - RNA, 1845 nt, Artificial Sequence
  derived and/or modified sequence opt3 from DDX5__Homo_sapiens__NP_004387
augagcggcuacuccucugacagagauagggggcgggaccgcggauucggugcuccccgauuuggcgggucacgugccggaccucugaguggcaagaaauucgguaacccaggggagaagcucgugaaaaagaaauggaaucuugaugaacugccgaaguuugagaagaacuucuaucaggaacaccccgacuuggcaagaaggaccgcccaagaggucgaaacauaccggcgcagcaaagagaucacuguuagaggacauaauugcccuaagccaguguuaaacuuuuaugaggcgaauuuccccgcuaacguaauggaugugauugccaggcagaauuuuacggaaccuaccgcaauacaggcccagggcuggccagucgcucuguccggccuagacaugguggggguugcacaaacaggaucugguaaaacucucucguaccugcuucccgccaucgugcacauuaaccaucagccuuuccuggagcggggcgaugggccaaucuguuugguccucgcuccgacccgcgaacuggcccaacaggugcagcagguagcggcagaguauugccgagccuguagacugaagucaacaugcauuuacggaggcgcucccaaagguccucagaucagggaccucgagcgugggguugaaauauguaucgccaccccaggacgguuaauugauuuucuggagugcggcaagacuaaucuucgcagaacaaccuauuuggugcuggacgaagcagauaggaugcuagacaugggcuucgagccccagauccggaagauugucgaucaaauccgaccugaccgccagacgcucauguggagcgcuacuuggccaaaagaagugagacagcuggccgaggacuuucuuaaggauuacauacacauuaacaucggggcgcuggaguugagugccaaucauaacauucuccaaaucguggacgucugucacgauguugaaaaagacgagaagcugaucagguuaauggaagagauuauguccgaaaaagagaauaagaccauaguguucguagagacaaaacggcgcugcgaugaacugacuagaaagaugaggcgugacggauggcccgcaauggguauccacggcgauaagucucagcaggagcgggacugggugcucaacgaauuuaaacaugggaaggcuccgauucuuaucgccaccgaugucgcuagccgaggacuggacguggaggauguuaaauucgugauaaauuacgacuauccuaacuccucagaagacuacauucacagaaucggcaggacagcccgcaguaccaagacggguacugcauauacauucuuuacccccaacaauaucaaacaggucagcgauuugauuucugugcuacgggaggccaaccaagcuaucaauccaaagcugcuccagcugguagaggacagaggguccggcaggucacgcggacgaggcgggaugaaggaugaccggcgugauagauacagcgcgggaaaaagggguggcuucaacacuuuucgcgaccgggaaaauuaugauagaggguacaguucucuucugaagagggacuucggagcaaaaacacagaacggcguuuauuccgccgcuaauuacaccaacgguagcuuugggucgaauuucgugucugccggcauucagacguccuuucgaaccggaaacccuacaggcacuuaccaaaauggguaugauucaacccagcaguacggaaguaacguccccaauaugcauaacgguaugaaucagcaagcauaugccuacccagcuacagccgcagcgcccaugauaggcuauccuaugccaacuggguacagccaguga

SEQ ID NO: 55211 - RNA, 5139 nt, Artificial Sequence
  derived and/or modified sequence opt3 from DDX60__Homo_sapiens__NP_060101
auggagagaaacgugcugaccacauucagccaggaaaugucccaacucauccuuaaugagaugcccaaggccgaauacucuucacuguuuaacgacuucgucgagagugaauuuuucuugauugauggcgacagcuuacugauaacuugcaucugugagauuuccuuuaaaccugggcagaaucuacacuucuuuuaucucguugagagguaccugguggaucuuaucucuaagggaggucaguucacgauuguauuuuucaaagacgcugaauaugcauacuuuaacuucccagagcuguugucgcuccggaccgcccugauccugcaucuccagaagaauacaacuauagaugugcgcaccacauuuucacgaugcuuaagcaaagaauggggcaguuuccuggaggaguccuauccguacuuccuuaucgucgcggacgaaggguugaacgaucugcaaacccagcuauuuaauuuccucauuauccacucuugggcucguaaggugaacguugugcugagcuccggacaggagucagacguccuuugucuguaugccuacuugcuccccaguauguacagacaucagauuuuuagcuggaagaauaaacaaaacaucaaggaugcauauacuacacuguuaaaucagcuggaaagguucaaacucucugcccuugcuccucuguuuggcuccuugaaguggaacaauauaaccgaggaagcacacaaaacggugucacuacugacucagguauggccagaggguagcgacauucggcgcguuuucugcgugaccaguuguucucucucccugagaauguaccauagguuucuugggaaccgggagcccagcucgggacaggaaacagagauccaacaggucaauucuaacugccugacuuugcaggaaauggaggaucucuguaagcugcacugcuuaaccgugguguuccugcuacaccucccucugucccaacgcgccugugcucgagucauuacaucacauugggccgaagacaugaagccacuuuugcagaugaaaaaguggugcgaguauuuuauccugagaaacauccacaccuucgaguuuuggaaucucaaccugauucaucuuagugaucugaaugacgaauugcuccugaaaaacauagcguucuacuaugagaaugaaaacguuaagggcuuacaccugaaucuaggcgacacgaucaugaaagauuacgaguaucucuggaacacugugagcaagcugguaagggacuuugaaguggggcagcccuucccucuucggacaaccaaagucuguuucuuggagaagaagccauccccgauuaaagauucuagcaaugagauggugcccaaccugggauuuaucccuacuucaaguuucguuguggacaaguuugcaggugauauacucaaagaccugccauucuuaaaguccgaugaccccauugucacaagccuggugaaacagaaggaauuugaugagcuuguacacuggcauucucacaagccuuugucagacgauuacgaccguagucgcugccaauucgacgaaaaaagcagagauccaaggguucuccgguccgugcagaaguaccaugucuuucagcgauucuauggcaauucucuggagaccgugucgagcaaaaucaucgucacgcagaccauuaaguccaaaaaggacuuuucagggcccaagaguaaaaaggcccacgagacaaaagcugaaaucauugcccgcgagaacaagaaaagacuauucgcaagggaagagcaaaaggaagagcagaaguggaaugcucugucuuuuagcauagaggaacagcucaaagagaaccugcauuccggaaucaagucacuugaagauuucuugaaaagcugcaagucuuccugugugaaacugcagguugagauggugggcuuaacugccugccucaaggcguggaaagaacacugucggagugaggaggguaagaccacaaaggaccugagcauugccguacaagucaugaaacgcauccacucucuuauggaaaaguacuccgagcuguugcaggaagaugacagacagcucaucgcaaggugccugaaauaucuaggguuugaugagcuggcuucaagucuccauccggcccaggacgcugaaaaugaugugaagguuaaaaagcguaacaaguacagcgugggaauuggcccugcccgguuccaacugcaguauaugggccacuaccuuauacgagacgagagaaaagaucccgacccaaggguccaggauuucaucccugacacuuggcaacgcgaguugcuggacgugguagauaagaacgaaucggcagugauuguugcccccaccuccucugggaaaacauaugcuagcuacuacuguauggagaaggucuuaaaagaaucagacgauggagugguggucuauguugcgccaaccaaggcacucgugaaucagguggccgcuacuguacagaaccgguuuacgaagaaucugcccaguggugagguccuuugcggcguguucacaagagaguacaggcaugacgcccugaacugucagguucuaaucaccgugccugcaugcuuugaaauucuccuguuggccccacaccgccaaaauugggucaaaaagauccgauaugugauauucgaugagguucacugucuggggggagaaaucggcgcugagauuugggaacauuuacucgugaugauccggugcccguuucuggcccuuuccgcaacuauuucuaaccccgagcaccugaccgagugguugcagagcguaaaaugguacuggaagcaggaagacaaaaucauagagaauaacacagcguccaagcgucaugucgguagacaggcuggguucccuaaggauuaucuccaagugaaacagucauacaaggugaggcugguccuauauggcgaacgcuacaaugaccuggagaaacacguuuguagcauuaagcauggagauauccacuuugaccacuuccauccaugcgccgcacuuaccacugaucacauugaacgguacggcuuucccccugaccucacacugaguccaagagagucuauccaguuguaugaugccauguuccagauauggaaauccuggcccagggcucaagagcugugcccggaaaacuuuauccauuucaauaacaaguuagugauuaaaaagauggacgcccgaaaguacgaggaaagccucaaagcagagcugacgucguggaucaagaaugggaacguagaacaggcucgcauggugcuucagaaucugucaccugaggccgacuugucuccagagaacaugauuaccauguucccccuccuggucgaaaaacuacggaagauggagaaacugccugcgcuuuuuuuccucuuuaagcugggagccguggaaaacgcugcagagaguguuuccacuuucuugaagaaaaagcaagagacaaaaagacccccaaaggccgauaaagaagcucacgugauggccaauaaguuaaggaaggucaaaaagagcaucgagaaacagaagauaauugacgaaaaaucucagaagaagacccguaacguggaucagagccugauccaugaggcagaacacgacaaucucguuaaaugucuggagaagaaccuugagaucccucaagauugcacauaugcggaccagaaagccguggauacugaaacccugcagaaggucuuuggucgcguaaaauucgagcggaagggcgaagaguugaaggcucuagccgaaagagggauuggauaccaccauuccgcaaugucauuuaaagagaagcagcugguggagauccucuucaggaaaggcuaucugcgaguugugacggcuaccgguacacuugccuuaggggucaauaugcccuguaagagugugguauuugcacaaaacagcguguaccuggacgcccucaauuaucggcagaugucuggccgcgcuggaagaaggggccaggauuugaugggggacgucuacuucuuugauauuccauucccgaaaauaggaaagcugaucaaauccaacguuccugaacuccggggucacuuuccccugucaauuacucuugugcugcgauugaugcuacuggcgaguaagggcgacgacccagaggaugccaaggcaaaagugcucagcgucuuaaagcauucccugcuuucuuucaaacagcccagagugauggacaugcugaagcucuacuucuuguuuucgcugcaauuccucguuaaagaaggguaucuggaucaggagggaaauccuaugggcuuugcuggucuuguaagccaccuacacuaccaugaaccaucaaaccugguguucgucuccuuuuuggugaauggguuauuccacgaccugugccagcccacccgcaagggcaguaagcauuuuucucaggauguuauggagaaacucgugcugguccuugcccaccuguucggaaggcguuauuuuccuccgaaguuccaagacgcccauuuugaguucuaccagagcaaaguguuucucgaugacuugccagaagauuucuccgacgcucuggaugaguauaacaugaagaucauggaagacuucacaacuuuucuacggauuguaucaaaacuggcagauaugaaucaggaguaccaacucccccuuucuaagaucaaguucaccggcaaagagugugaagacagccagcuggucagucacuuaauguccugcaaggaggggagaguggccauaagcccuuuuguuuguuugucuggaaacuucgacgaugaccugcucaggcuggaaacgccaaaucacgugacacuuggcaccaucggugucaaccgcucacaggcgcccgugcugcucucccagaaauuugauaaccgagggagaaagaugaguuugaaugcuuaugcccuggacuucuacaaacauggaagcuuaauuggccuaguucaagauaaccggaugaaugagggugacgcauacuaucugcucaaggauuuugcccuuacuaucaagucgauuucugugucccugagggaauugugcgagaacgaggacgauaaugucgugcuggcuuucgaacagcucagcacaaccuuuugggagaaacugaacaagguauga

SEQ ID NO: 55212 - RNA, 1452 nt, Artificial Sequence
  derived and/or modified sequence opt3 from DDX6__Homo_sapiens__NP_004388
augagcaccgccagaacagagaaccccgugaucaugggccuguccucucagaaugggcaacucaggggaccugucaagccaacugguggccccgggggaggcgguacgcagacccagcagcaaaugaaccagcuuaaaaauacaaacacuauuaauaacgggacccagcagcaagcucagucaaugacaaccacuauaaagccgggagacgauuggaaaaagacacugaaauugccuccaaaggacuuacggaucaagaccagugauguuacgagcacuaaaggcaaugaguucgaggacuacugccugaagcgcgaacuacucaugggcauuuuugagauggggugggaaaaacccuccccuauccaggaggagucuauuccaaucgcacugucgggacgagauauacuugcccgugcgaagaacgguaccggcaaaucaggggcuuaucugauccccuugcucgaaagacuggaccugaagaaggauaauauucaggccauggugaucguaccuacaagggagcucgcauuacaagugagccagauuuguauccaggucaguaaacacaugggaggcgccaaggugauggcuacuaccggugggacaaaccugcgggacgauauaaugcgccuugacgauaccguucauguggucauugcaacgccaggaagaaucuuggaccugauuaaaaagggcguggccaaaguagaucacguucaaaugaucgugcuagacgaagcugacaagcuccugucccaggauuucguccagaucauggaggacauuauacuuacucugccgaaaaauaggcagaucuugcucuacucugccacauuuccccugagcgugcaaaaguucaugaacucccauuuacagaagccuuaugagauuaaucugauggaagaacucacccuuaaaggcgugacucaguacuaugcguacgucacagaacggcagaagguucacugccugaacaccuuguuuucacgccuacaaaucaaucagaguauaauuuucuguaacagcucucagcgaguggagcugcucgccaaaaagaucucccagcugggguauucaugcuuuuacauccaugcaaaaaugagacaagaacacaggaaccggguauuccacgauuuucguaauggacuuugucgcaaccuggugugcacggacuuguucaccagagguauugauauccaggcugucaaugugguuauuaacuuugacuucccaaagcucgccgagacauaccugcauaggauaggccggagcgggcgauuuggacacuuaggccuggcaaucaaucuaauuacuuaugaugaccgcuucaaccucaagaguaucgaggaacagcuggguaccgagaucaaacccauuccuucuaauauagauaagucccuuuacguggcugaauaucauagcgagccagucgaagacgagaaacccuga

SEQ ID NO: 55213 - RNA, 1473 nt, Artificial Sequence
  derived and/or modified sequence opt3 from DEAF1__Homo_sapiens__NP_001280563
auggaggacagcgauuccgccgcuaagcagcugggccucgcagaagccgcggcuguggccgcagccgcugcagucgccgcugccgcggcagccgcugccgggggagaggcagaggaacccguucuuucuagagacgaagauucagaggaggacgcugauagugaagccgagagggaaaccccucgggugacagcgguagccgugauggcagcugagccaggucacauggacaugggcgccgaggcucugccggggcccgaugaagccgcagccgcugcggcauucgccgaggucacuacggugaccguugcuaacgugggagccgcagccgacaaugucuuuacaacuagcguggcuaacgccgcauccaucucuggccauguauugucgggucgcaccgcguuacaaauuggggauucacugaauacagaaaaagcuacccuaauaguugugcacacugacggaagcaucgucgagacaaccggccucaagggcccugccgcaccacugacgcccgggccucagaguccacccacuccucuugccccaggacaggaaaaagguggcaccaaguacaacugggauccguccguguaugacucugagcugcccgugcgaugccguaauauuagcgggacauuguacaaaaacagacucggauccggcugggaucugaagccuucaaggugucugcuccauuuaugcugucugcuucggcgccacgacuugaucacugucaccccaaguggucagauuacaaccagcggggcucugacguucgacagagccucuacuguugaggcaacagcugugaucuccgaaucacccgcccaaggagauguauuugcgggcgccaccgugcaggaggcuagcguccagccuccaugcagggcaagucaucccgaaccgcacuauccuggcuaccaggacucuugucaaauagcccccuucccagaggcugcccuaccuacuucccaccccaagaucgugcucacaagccugccagcacuugcgguucccccuccaaccccgacgaaagccgcucccccugcccuggugaauggguuggaacucucggagccacggucuuggcuguauuuagaggaaauggucaacucccugcucaauaccgcacagcagcuuaagacacuguuugagcaggcuaaacaugccucaacuuaccgcgaagcagccaccaaccaagcuaagauucacgcggaugccgagcgaaaagaagugauccaucccccuagauugccaaagguacuaggacugcagcagaguugcguuaauugugguagggaggcaaugagcgagugcacaggcugucacaaggugaacuauugcuccacuuucugucaacggaaagacuggaaggaucaccagcauauuugcgggcagucugcugccgucaccgugcaggccgacgaaguccacguggcugagagcguuauggaaaaagugacaguauga

SEQ ID NO: 55214 - RNA, 213 nt, Artificial Sequence
  derived and/or modified sequence opt3 from DEC1__Homo_sapiens__XP_011517055
augaccaugaacgugcuggaggccggcaaguggaaaagcaucguccccgcuccuggggaaggacuccuugcaguucugcacaugaugguguucacagacgccuugcauagagagagguccguaaaguggcaggcgggugugugcuacaauggcgggaaagauuuugcugucucuuuagcccggccaaaggcagccgaaggaauugcugacuga

SEQ ID NO: 55215 - RNA, 1008 nt, Artificial Sequence
  derived and/or modified sequence opt3 from DECR1__Homo_sapiens__NP_001350
augaagcugcccgccagaguguucuuuacccucggcagcaggcuuccuugcgggcuggcuccacggcgcuucuuuuccuacggaacaaaaaucuuguaucagaacacugaggcauuacaaucuaaguucuuuucaccgcugcagaaagccaugcuacccccuaauaguuuccaggguaaggucgcguuuauuacgggcgggggaaccggccucgguaaagggaugacaacucugcuuagcucccugggagcucaguguguuauagccucucgaaagauggacguguugaaggcaaccgccgaacaaaucucgucacagacaggcaacaaaguacacgcuauucagugcgaugugcgugacccagauaugguccagaauaccgugagcgagcucaucaagguugcaggccaucccaacauugugaucaauaacgccgcugggaauuucauaaguccuacugaaagacuguccccaaacgccuggaaaacaaucaccgacauuguccugaauggaacggcguuugugacucucgagaucgguaagcaauuaauuaaagcacagaagggcgccgcuuuccugucuaucaccacaauauacgccgaaacugggagcggauuuguaguucccuccgcaucagcuaaggccggcguggaggcgaugaguaaaagccuugccgcagagugggguaaguaugggaugagguucaacgucauucagccuggaccaaucaaaaccaagggcgcuuuuucucgguuggauccgacaggcaccuucgaaaaagagaugauugggcgcauccccuguggaagacuggguacgguggaggaacuagccaaucucgcugccuuccugugcuccgacuacgcaucauggaucaacggcgccgugauuaaguuugaugggggagaggaaguccuuauaagcggcgaguucaaugaccugaggaaaguuacuaaggaacagugggauacaaucgaggaauugauucggaagaccaaagguaguuga

SEQ ID NO: 55216 - RNA, 957 nt, Artificial Sequence
  derived and/or modified sequence opt3 from DEDD__Homo_sapiens__NP_001034801
auggccggccugaagagaagggcuagccagguguggcccgaggaacacggggagcaagaacauggacucuacucccuucaccggauguucgacaucgucgguacccaucugacacaccgcgauguucgaguguugucauuuuuauucguagacgugauugaugaccaugagcguggccugauaagaaacgggagggauuuucuacucgcacuggaacggcagggacgcugcgacgagucuaauuucagacagguccuucagcuguugaggaucauuacucggcacgaucuccugccuuaugugacgcugaaacgcagacgagccguuuguccagaccucguggauaaguacuuagaggaaaccaguaucagguaugucacaccgcgggcgcugagcgaccccgagccucguccaccccaaccuuccaaaacugugccaccccacuacccuguaguuugcuguccaaccucuggcccgcagaugugcucgaagcgccccgcuagagguagggccacacuugggucacagcggaaacgacgcaagagcgugaccccugauccaaaggaaaaacagacuugugacauuagauugaggguccgggcagaguauugccaacaugagacagcccugcagggaaacguguuuaguaauaagcaggauccccuagaacgccaguucgagagauuuaaccaagcuaauaccauccucaaauccagggaccugggcucuauaaucugugacauuaaguucagcgaacuuacguaccuggaugcauuuuggcgugacuauaucaacggcuccuugcucgaggcccugaaagggguguucauuacugauucauuaaagcaggcugucggacacgaagccaucaagcugcucguuaauguggacgaggaggauuacgaacuuggucggcagaaacuguugcgaaaccuaaugcugcaagcgcucccuuga

SEQ ID NO: 55217 - RNA, 1896 nt, Artificial Sequence
  derived and/or modified sequence opt3 from DEF6__Homo_sapiens__NP_071330
auggcccugagaaaggagcuccuuaaaagcaucugguacgcuuucaccgcacuggacguggaaaaguccggcaaagucucuaagucacaguugaaaguuuuaagucacaaccuguauacagugcuacauauuccccacgauccuguagcccucgaggaacauuuuagggacgaugacgaugggccagugagcucccaaggauacaugccguaucugaauaaguacauacuugacaaggucgaggaaggugcguucgugaaagagcacuuugaugagcugugcuggacuuugacggcuaagaaaaacuaucgggccgacucuaauggcaacucgaugcucucaaaucaggaugcauuccgccuguggugucuguuuaacuuccucagcgaagacaaguaccccuuaaucaugguuccugaugagguggaauaucugcuuaaaaaggucuugaguuccaugucucuggaggugagccuaggggagcucgaagaacugcuugcccaggaagcucagguagcacaaaccacaggaggccuguccguuuggcaguuuuuggaacucuucaauucaggucgaugccugcguggggugggaagagacacuuuaaguauggccauucaugaagucuaccaggagcugauccaggaugugcucaagcaaggcuaccuuuggaaaaggggccaucugcggcgcaacugggcugagagaugguuucaguugcagccaagcugucuaugcuauuucgggucugaagaguguaaggagaaaaggggaauuaucccccuggacgcccacugcuguguggagguccucccugaccgggaugguaagcgcugcauguuuuguguuaaaaccgcgaaucgaacauacgaaauguccgcaucagacaccagacagaggcaagaguggacugccgcuauacagauggccauccggcugcaggcagagggcaagacaagccuucacaaagaucugaagcaaaagcgucgcgaacagagagagcagagggaacggcgacgcgcugccaaagaggaagaguugcucagacugcagcaauuacaggaggaaaaggagaggaaacugcaggaacuagagcuccugcaggaggcgcaacggcaggccgaacgccuuuugcaggaggaagaggaaagaaggcguagucagcaccgggagcugcaacaggcacucgaggggcagcugcgagaagcugagcaggccagagcuucuaugcaagccgaaauggagcuuaaggaagaggaggcagccaggcagcgccagcggauuaaagaacuggaggaaaugcaacagagauugcaggaggcucuccagcuggaagugaaggcgaggcgcgacgaggaguccguacgaaucgcacaaacccgguuacuggaagaggaagaggagaagcuaaaacagcucaugcagcugaaggaggagcaggaacguuauauugagagagcccaacaggaaaaagaggagcuucagcaggaaauggcucaacagagcaggucguugcagcaagcccagcagcagcuggaggaagugcgccaaaaccggcagagagcagaugaggacgucgaagccgcucagaggaagcuccgacaggccucuacgaaugugaaacauuggaacguucaaaugaaucgccugaugcacccaaucgagcccggagauaagcggccugugacuuccucaaguuucagcggcuuucagccaccguuacuggcacacagagacuccucucuuaagagguugacccguugggguagccaggggaaccgcacacccucaccuaauaguaacgagcagcaaaaaucccucaacggaggcgaugaagcgccagcucccgccagcacuccucaggaggacaagcuggauccagcacccgaaaauuga

SEQ ID NO: 55218 - RNA, 285 nt, Artificial Sequence
  derived and/or modified sequence opt3 from DEFA1B__Homo_sapiens__NP_001035965
augagaacccuggccauccucgcugcaauucuucugguggccuugcaggcgcaagcugagcccuuacaggccagggcagacgaagucgccgcugcaccugagcagauagccgcugauaucccagaaguugugguaagccuggccugggacgagucccuagcgccgaagcaccccggcucucggaaaaacauggcaugcuacugucgcauuccugccugcaucgcuggggaacgacguuauggaacauguauuuaccaggguagacucugggccuucugcuguuga

SEQ ID NO: 55219 - RNA, 285 nt, Artificial Sequence
  derived and/or modified sequence opt3 from DEFA3__Homo_sapiens__NP_005208
augagaacccuggccauccucgcugcaauucuucugguggccuugcaggcgcaagcugagcccuuacaggccagggcagacgaagucgccgcugcaccugagcagauagccgcugauaucccagaaguugugguaagccuggccugggacgagucccuagcgccgaagcaccccggcucucggaaaaacauggauugcuacugucgcauuccugcaugcaucgccggggaacgacguuauggaacauguauuuaccaggguagacucugggcuuucugcuguuga

SEQ ID NO: 55220 - RNA, 294 nt, Artificial Sequence
  derived and/or modified sequence opt3 from DEFA4__Homo_sapiens__NP_001916
augagaaucauugcccugcucgcugcaauacuucugguggccuugcaggucagggcgggccccuuacaagcucgcggggacgaggccccuggacaggaacagcgggguccagaggaucaggacaucagcauuuccuucgcaugggauaagucuucagcccugcaaguuaguggcagcacccgagggauggugugcuccugucgucuaguauuuugcagaaggacagaacuccgggugggaaacugucugaucggcggugucucuuucacuuacugcuguacgcgcguggacuga

SEQ ID NO: 55221 - RNA, 285 nt, Artificial Sequence
  derived and/or modified sequence opt3 from DEFA5__Homo_sapiens__NP_066290
augagaaccaucgccauucuggcugcaauacuccuuguggcccugcaggcgcaagcugagagcuugcaggaaagggccgacgaggcaacaacucagaagcaguccggcgaagauaaccaagacuuagccaucucuuucgcugggaauggacugucagcacuacggacgagugguagccaggcccgcgcuaccugcuacugucgaacaggccguugcgccacuagagagucccucucuggggucugugaaauuucgggaaggcuguaucggcuuugcugucgcuga

SEQ ID NO: 55222 - RNA, 303 nt, Artificial Sequence
  derived and/or modified sequence opt3 from DEFA6__Homo_sapiens__NP_001917
augagaacccugacaauccucacugccgugcuucuggucgcuuugcaggcaaaggccgagcccuuacaagcggaagacgauccucugcaggcuaaagccuacgaggcagacgcccaggaacagaggggcgcuaacgaucaagacuucgcaguuagcuuugccgaggaugcuuccucuucacuacgggcccucgggaguacgcgcgcguuuaccugccacugucgacguagcugcuauuccacagaauacucuuauggaacuuguaccgugauggguauuaaucauagauucugcugucuguga

SEQ ID NO: 55223 - RNA, 204 nt, Artificial Sequence
  derived and/or modified sequence opt3 from DEFB103B__Homo_sapiens__NP_061131
augagaauccacuaccuccuguucgcccuucuguuuuuguucuuagugcccgucccuggccaugggggaauuauaaacacccugcagaaguauuacugcaggguucgggguggccgcugugcugugcuaagcugccucccaaaagaggaacaaaucgggaaguguuccacacgaggacguaaaugcuguagaaggaagaaauga

SEQ ID NO: 55224 - RNA, 219 nt, Artificial Sequence
  derived and/or modified sequence opt3 from DEFB104B__Homo_sapiens__NP_001035792
augcagagacuggugcuccuucuggccaucagcuuguuacuguaccaagaccuacccgucagguccgaguucgaacucgaucggauuugcggcuaugggaccgcucgcugucgaaagaaaugccguucucaggaguacagaauaggaagguguccuaacacauaugcaugcugucugcggaagugggacgaaucacuucugaaucgcacuaaaccauga

SEQ ID NO: 55225 - RNA, 237 nt, Artificial Sequence
  derived and/or modified sequence opt3 from DEFB105A__Homo_sapiens__NP_689463
auggcccugaucagaaagaccuucuacuuucucuucgcuauguuuuucauucuugugcagcugcccagcggcugccaagcaggguuggacuuuucccagccuuucccaucuggagaguuugccgucugugaaucaugcaaauuagguaggggcaagugucggaaagagugccuggaaaacgagaagccggaugggaauugucgccuaaacuuccucugcugucgacagcguauauga

SEQ ID NO: 55226 - RNA, 198 nt, Artificial Sequence
  derived and/or modified sequence opt3 from DEFB106A__Homo_sapiens__NP_689464
augagaaccuuccuguuucucuucgccgugcuguuuuuccuuacacccgcuaagaacgcauuuuucgacgagaaaugcaauaaguugaaaggcacuuguaagaacaauugcgggaaaaacgaagaguuaaucgcccugugucaaaagagccuaaagugcuguaggacgauucagccuugcggauccauaaucgauuga

SEQ ID NO: 55227 - RNA, 222 nt, Artificial Sequence
  derived and/or modified sequence opt3 from DEFB108B__Homo_sapiens__NP_001002035
augagaaucgccgugcuguuguucgcuauauuuuucuuuaugagccagguccuucccgcaaggggcaaguucaaagagauuugcgaacggccuaacggguccugucgcgacuuuugccuggagaccgaaauccacguuggacgaugucucaauucucaaccaugcuguuuaccgcugggucaucagccccguauugagucaacaacuccuaagaaagauuga

SEQ ID NO: 55228 - RNA, 342 nt, Artificial Sequence
  derived and/or modified sequence opt3 from DEFB112__Homo_sapiens__NP_001032587
augaagcugcucaccacaaucugcagacuuaaacuggagaagauguacagcaaaacuaacacguccucuaccauuuucgaaaaggccaggcacggcacagagaaaauaucaacugcucggagugaagggcaucacaucaccuuuagccgcuggaaguccuguacagcaauuggaggucgaugcaagaaucagugugacgauucugaguuccguaucucguauugcgccagacccaccacucauuguugcgugacagaaugugacccuaccgauccaaacaauuggauuccgaaagacucagucggcacgcaagagugguaccccaaggauagcaggcacuga

SEQ ID NO: 55229 - RNA, 471 nt, Artificial Sequence
  derived and/or modified sequence opt3 from DEFB125__Homo_sapiens__NP_697020
augaacauccugaugcucaccuucauuauaugcggccuucugacaagagugacuaaggggagcuuugagccccagaaauguuggaagaauaacgucggacacugcaggcggcgcuguuuggacacggaacgauacaucuuacugugccguaauaaacuauccuguugcauuucuaucauuucacaugaguauaccagaaggccugccuucccaguuauccaccucgaagauauaacacuggacuacagugauguggacagcuuuacugguuccccgguaucuaugcuuaacgaucugaucaccuucgacacaaccaaguuuggcgagacuaugacacccgaaaccaauacgccugagacuaccaugccacccucggaggcuacaacuccugaaaccacaaugccacccucagagaccgcaacgagcgaaacuaugccuccaccgagucaaacagccuugacccauaacuga

SEQ ID NO: 55230 - RNA, 336 nt, Artificial Sequence
  derived and/or modified sequence opt3 from DEFB126__Homo_sapiens__NP_112193
augaaaagccuccuguucacccuugccguguuuaugcuguuggcucaguuagucuccggcaacugguacguuaagaagugccugaaugacguggggaucuguaaaaagaaaugcaagcccgaggaaaugcacguaaagaacggaugggcaaugugugguaaacaaagagauugcugugugccugccgacaggcgggcgaauuauccagucuucugcgugcagacaaagacuacgcgcauuucuaccguuacagcuacuaccgccacaaccacucuaaugaugacaaccgcaucaaugaguagcauggccccgacgcccguguccccuacuggcuga

SEQ ID NO: 55231 - RNA, 207 nt, Artificial Sequence
  derived and/or modified sequence opt3 from DEFB1__Homo_sapiens__NP_005209
augagaaccagcuaccugcuccuuuucacacugugcuuguuacuguccgagauggccucuggcgggaacuuucuaacuggacucggucacaggucagaccauuauaauugugugaguagcggcgggcagugccuguacuccgcuugucccaucuucacgaagauucaaggaaccugcuaucggggcaaagcaaaguguugcaaauga

SEQ ID NO: 55232 - RNA, 195 nt, Artificial Sequence
  derived and/or modified sequence opt3 from DEFB4A__Homo_sapiens__NP_004933
augagagugcuguaccuccuuuucagcuuucuguucaucuuuuugaugcccuuaccuggcgucuucgggggaauuggugacccaguuaccugccugaaguccggcgccauaugucacccgguguuuugccccaggcgguauaaacagaucgggacauguggacuaccuggcacuaagugcuguaaaaagccauga

SEQ ID NO: 55233 - RNA, 972 nt, Artificial Sequence
  derived and/or modified sequence opt3 from DEGS1__Homo_sapiens__NP_003667
augggcagcagaguguccagggaggacuucgaaugggucuacaccgaucagccccacgccgaccggcgccgagagauccuggcuaaguauccugaaauuaaaucucucaugaagccagauccgaaccuuauauggaucauuaucaugaugguucugacacaauugggggcauuuuacauugugaaagacuuagauuggaaguggguaaucuucggagccuaugcguuugguucaugcauaaaucauaguaugacucuggcuauccacgagauugcccauaacgcagccuucggcaauuguaaagcuauguggaaccguugguuugggauguucgcaaaucuacccaucggcauuccuuacagcaucuccuuuaagagauaucacauggaccaucacagguaccucggagccgaugguguggacgucgauauaccaacggacuucgaagggugguuuuucugcaccgcuuuucggaaguucauuugggugauccugcagccccuguuuuaugccuuccgcccucuuuucauuaacccaaaacccaucacauacuuggagguuaucaauacuguggcgcaggucaccuuugauauucucauauacuauuuccugggaaucaagucucugguguacaugcucgcagccucguuacugggccuuggcuugcacccuauuucagggcauuuuaucgcugagcacuauauguuccugaaaggacaugaaacauacagcuauuacgguccacuaaaccuccugaccuuuaauguaggcuaucacaacgagcaccaugacuucccgaauauacccgggaagagucuuccucugguuagaaaaauugccgcagaauacuacgauaacuugccacacuauaauuccuggaucaaggugcucuacgacuuugucauggacgauacuaucucucccuauagcaggaugaagcggcaucagaaaggagagauggugcuggaguga

SEQ ID NO: 55234 - RNA, 972 nt, Artificial Sequence
  derived and/or modified sequence opt3 from DEGS2__Homo_sapiens__NP_996801
augggcaacagcgccuccagaucugacuucgaguggguguacaccgaucagccccacacacaaaggcggaaggaaauccuggcuaaauauccugcaauuaaggcccucaugcgcccagacccgcgacuuaaaugggcgguccugguuuugguguuaguacagaugcuggcuugcuggcuagugcgugggcucgccuggagauggcugcuguuuugggcauacgccuucggagguugugucaaucauucacuuacuuuggcuauacacgauaucagucauaacgcagccuuuggcacggggagggcugcccggaaucgcuggcucgcgguguucgcaaaccugcccguuggagugccuuaugccgcuagcuuuaagaaauaccacgucgaccaucacagauaucugggcggugaugggcucgacguggauguaccaaccagguuagagggaugguucuuuugcacacccgcccggaagcugcuuugguugguucugcagccuuucuuuuacucccuacgcccacucugugugcaccccaaggcagucacucgaauggaagugcugaauacccuugugcagcuggcugccgacuuggcgauuuucgcccucuggggccugaaaccugucguuuauuuacuggcaucuucguuucucggccuugggcugcauccaaucucaggacacuucguggcugagcauuacauguuuuugaagggucacgaaacauacagcuauuacggcccgcuaaacuggauuaccuucaauguaggguaucacguggagcaucacgauuuccccaguaucccuggauacaaccugccacucgucagaaaaauagcccccgaguauuacgaccaucugccucaacaccauuccugggugaagguucuuugggauuuuguguucgaagacucucugggcccauaugcuagggucaaacggguguaccguuuggccaaggauggucucuga

SEQ ID NO: 55235 - RNA, 1026 nt, Artificial Sequence
  derived and/or modified sequence opt3 from DEK__Homo_sapiens__NP_001128181
augagcgccuccgcucccgcagccgagggcgaagggaccccuacacagccagcgucugagaaggaaccggagaugcccggaccuagagaagagucagaggaagaggaagacgaggaugacgaggaagaggaagaggaagagaaagguaagggccaaaaacugugcgagaucgaaaggauucacuucuuucucaguaagaaaaagacugaugagcuucggaaccugcauaaguuguuauacaaucgcccagggacggugagcucccugaaaaagaacgucggacaguucucuggcuuucccuucgaaaaagguucgguucaguauaagaaaaaggaggaaaugcuaaagaaauuucgaaaugcuaugcucaagucaauaugugaggugcuggaccuugagcguagcgggguaaacagugaacuggugaaaagaaucuugaauuuccucaugcacccuaagccauccggaaaaccccugccuaagucuaaaaagaccugcagcaagggcuccaaaaaggagaggaacucaaguggcauggcccggaaagcaaagcgcacaaaauguccagaaauucugagcgaugagucuuccucagacgaagaugagaagaagaauaaagaggaaagcagugacgaugaggacaaggaaucugaggaggaaccgcccaaaaagacugccaaaagagagaagccuaagcagaaagcuaccuccaagagcaaaaagucggucaaaucugcaaacgugaagaaggccgauuccucaacaaccaaaaagaaucaaaacaguagcaaaaaggaauccgagucugaagacagcucagaugacgagccacucaucaaaaaguuaaagaaacccccuacugacgaggaacugaaggagacaauuaaaaaguugcuugcuagugccaaucuggaagagguuaccaugaaacagaucugcaagaaaguguacgaaaacuauccaacguacgaucuaacugagaggaaggacuuuauaaagaccacagucaaagagcucaucuccuga

SEQ ID NO: 55236 - RNA, 3030 nt, Artificial Sequence
  derived and/or modified sequence opt3 from DENND1A__Homo_sapiens__NP_065997
augggcagcagaaucaagcagaaccccgagaccacauucgaaguguacgucgagguugccuauccuaggacugggggaacgcuguccgacccagaagugcaacggcaguuuccggaggauuacucugaccaggaaguacuccagacccuuacaaaauucugcuuucccuucuauguggauucacugacugucagucaagugggucagaauuuuaccuucguuuugacagacauugauagcaagcagcgcuuuggcuucugucgauuauccucuggggcuaaaucgugcuuuuguauacugucauaccuaccuugguucgagguguuuuauaagcuccugaacauccuugcagacuacaccacuaaacgucaggagaaucaauggaacgaacuguuggagacacuccacaagcugccaauucccgauccuggagucagcgugcaucugaguguacacuccuauuucaccguuccagacacgagagaacuccccucuaucccugagaauaggaacuuaacugaguacuuuguggccgucgaugugaauaacaugcugcaucuuuacgcgagcauguuguaugaacggcgcauucugaucauaugcuccaagcuaucaacccucacagcuuguauccacggcagugccgcaaugcuguacccaauguauuggcagcauguguacauuccgguccuucccccucaccuguuggacuauugcugugccccaaugcccuaccucaucgguauucaccugagcuuaauggagaaaguuagaaauauggcucuggaugacgugguaauccucaacguggauacuaauacccuugaaacaccuuucgacgaccugcagucuuugccaaacgaugucauauccucacuaaagaauaggcugaaaaaggugagcaccacgacuggggacggaguugcacgggccuuccucaaagcucaggccgcguuuuucggcaguuaucgcaacgcacugaagauugagcccgaggaaccgaucacauuuugcgaggaagccuucgugucucauuaccgauccggcgcuaugagacaauuucuucagaaugccacccagcugcaauuguucaagcaguuuauugaugggaggcucgaccuguuaaacagcggagaggguuucucggaugucuuugaagaggaaaucaacaugggcgaguacgcagggucugacaaacuguaucaccaguggcuauccacugugcggaagggaucaggcgcuauccucaauacaguaaaaaccaaggccaacccugcgaugaaaacgguuuacaaguucgccaaagaucaugcaaagauggguauuaaggaggugaaaaaucgucugaagcagaaagacauagcugaaaacgggugugcccccaccccagaggaacaacuuccuaagacagcucccaguccauuggucgaggccaaagaucccaagcugcgcgaagacagaaggccuaucacugugcacuuuggacagguccggccaccgcgaccccacgugguuaagcgcccuaaaagcaauauugcaguggagggcagaaggaccuccguaccaucucccgagcagccucagccauaucggacacuccgcgaaagcgauucagccgagggcgacgaagcugagagucccgagcaacaggucagaaaguccacugggccggugccugcgccacccgacagggcagccagcaucgaucugcuugaagacguuuucucuaaccuggauauggaggcugccuugcagccucucggacaggcaaaaucacuggaagacuuacgugcccccaaggaucugcgggagcaaccagguaccuuugacuaccagcgacuagaucucggcgggagugaaagaagcaggggagugacagucgcucugaaacuuacccauccuuauaauaaguuguggucccugggccaggacgauauggccauacccucuaagccaccggcagcgucgccugagaaacccagcgcucuccuggguaacuccuuagcccugccacgccggccccagaauagagacucaauucuuaacccuagugauaaggaggaagugccaacucccacguuggggucuaucacaaucccuaggccgcaaggccgcaaaaccccagagcucggaauuguacccccuccacccaucccucgaccggcaaagcugcaggccgcuggcgccgcacuaggggacgugagcgaacggcugcagacugaucgugacagaagggcugcccucucccccggacugcuuccagguguugucccucaaggccccaccgaguugcugcagccauuaucaccugggcccggagcggccggcacaagcucugacgcucuccuggcacuucuggauccauuguccaccgccuggagugguagcacucucccgucucgcccugcuacacccaauguggccacgccauucacaccccaguucuccuuuccuccagcagggacucccacaccuuucccgcagccaccccugaacccuuuugugcccucaaugccagcggccccucccacccuaccacuggucaguaccccugcuggcccguucggagcacccccagccagccucggcccugcuuuugccucggggcugcuuuuguccucugcaggauucugcgcuccccaccggagccaaccaaaucugucagccuuaaguaugccuaaccucuuuggucagaugcccaugggcacucauaccuccccgcugcagccacuugggccucccgcgguugccccaucuagaauuaggacgcugccccuagcacgaagcuccgcucgcgccgccgaaaccaaacagggacucgcucugcggccuggcgacccgcccuugcugccaccuagacccccucaagguuuagagccaacacuccagcccucagcaccucagcaggccagggauccauucgaggaccugcuucaaaagacuaagcaggaugugagccccaguccggcgcuggcuccugccccagacucuguggaacaguugcguaaacaaugggagaccuuugaauga

SEQ ID NO: 55237 - RNA, 1191 nt, Artificial Sequence
  derived and/or modified sequence opt3 from DENND1B__Homo_sapiens__NP_001287787
auggccgcugcacccagagaggaaaagagguggccucagccaguguucagcaacccggucguucuguggaaauuucccgaggacuucggcgaucaagaaauccuccaguccgugccuaaguuuugcuucccauuugacguagagcgggugucucagaaucaggucgggcaacacuucaccuuugugcuuacagauauugaaucaaaacagcgcuucggauuuugucgacugacgagugguggcacuauaugcuuguguaucuuaagcuaccugcccugguucgagguuuauuacaagcuacucaacacccuggccgacuaucuugcgaaagagcuggaaaaugauuugaacgagacacuccguucccuguacaaucauccugugccaaaggcuaacacucccgucaaucugucugugcacucguauuuuauugccccugacguaaccgggcucccaacaaucccggaaucaagaaacuuaaccgaguacuucguugcaguggaugucaauaacaugcugcagcuuuaugccagcauguugcaugagaggcggauugugaucauaaguuccaagcugucuacucuaacagcuugcauccacggaagcgcagcccuccuguaccccauguacuggcagcauauuuauaucccugugcuuccaccccaccuguuggacuacuguugcgcuccuaugccauaucucauuggcauccacuccucacugauagaacgcgucaaaaauaagaguuuagaggauguugugaugcugaacguagacaccaauacgcucgaaagccccuuuucugaucuuaacaaucugccguccgacguggucucagccuugaaaaacaagcugaaaaagcaaagcacugcgaccggugaugggguggcaagagccuuccuaagggcucaggccgcacucuucggaaguuaccgggacgcucugcgcuauaagccuggcgagcccauuacauuuugugaagagucuuucguuaaacaucgauccagcgugaugaagcaguuucuugagacugccaucaaccugcaguuguucaaacaauuuauugacggcagacucgcgaagcugaaugccgggaggggauucucggaugucuuugaagaggaaaucaccucugguggcuucugcgggggaaaagacaaguuacaguacgauuauccauuuucccaguga

SEQ ID NO: 55238 - RNA, 3030 nt, Artificial Sequence
  derived and/or modified sequence opt3 from DENND2A__Homo_sapiens__NP_056504
auggacauguucagccuggauaugaucauuuccgaccccgccgcugaggcaucuagagccggcaagaaacagcuccgaggggugcaaaacccuugcccaucagcgcgggcucgcccgcgacacaagagucuuaauauaaaagauaagaucagcgaaugggagggaaagaaggaaguccccaccccugccccaucccguagagcagacggucaggaggauuaccugcccucuucgacaguugaaaggcggucaagcgacggcgugcgcacucagguaacggaggccaagaacgggaugagaccuggaaccgagaguacagaaaaagagaggaauaagggcgcugugaacgucggugggcaggauccagaacccggacaagacuugucccagccugagcgggagguggauccaucuuggggccgcggccgagaaccgagauuagggaaacugagguuucagaaugacccccuaagcguucucaaacaggugaaaaagcuggagcaagcacuuaaggauggauccgccggucuggacccucaguugccaggcacuuguuauucaccccauugcccuccagauaaagcugaagccgggaguacccuccccgagaaccugggaggcgguagcgggucugaagucucccagcgggugcacccgucagaccuggagggacgugagccuacacccgaacucguagaggaccgcaagggcagcuguagaaggccaugggaucggaguuuagaaaauguuuaccgaggcucugagggguccccuaccaaacccuucauuaacccacugcccaagccucgcagaacuuuuaaacaugcgggagaaggugacaaggauggcaaaccagggaucggauucaggaaggagaagcggaaucuuccgcccuugccuagccugccacccccuccacuacccucgucuccgccuccauccucagugaaccgcagacucuggacaggcaggcagaaaaguagcgcagaccaccguaaguccuaugaguuugaagaucugcuucaaucuagcucagagaguucccgggucgacugguacgcccagaccaaacuggguuugacgcgaacucucagcgaagagaauguguaugaagauauucuggaucccccuaugaaggagaaccccuacgaggacaucgaauuacaugggagaugccugggcaaaaagugugugcucaauuucccagcuucuccuaccucaaguauacccgacacacuuacuaagcagagccuguccaaaccagccuuuuucaggcaaaacucugagcgccggaauuuuaaguugcuagauaccagaaaacugucgagggacggaacaggcagcccguccaagaucucaccucccaguaccccaucuagccccgacgauauuuucuuuaaccucggggacccucagaacggacgcaaaaagcgaaagaucccaaaacugguccuucggauuaaugcaaucuaugaaguucguagagguaagaaaagggugaagcgccugucccagucaauggagagcaacucuggcaaaguaacggaugaaaauuccgagagugacagcgauacugaggaaaaguugaaggcucacucucagcggcucgugaacgucaaauccagacugaagcaagcccccagguacccuucauuagcgcgagagcugauagaauaccaggagcgccagcuauucgaguauuuugugguugugagucuccacaaaaagcaggccggggcagcuuacgucccggaacugacacaacaguucccacuuaaauuggagcggagcuucaaguuuaugagagaagccgaggaccagcugaaagcuauuccccaguucugcuuuccugaugccaaggacugggugccaguacaacaguucaccucggaaacuuuuuccuucguucucacaggagaggauggcucuaggcguuuugguuauugucgccggcugcuucccgggggcaagggaaaaagacugccugagguguacugcaucgucagcagguugggcuguuucucacucuuuaguaggauucuggacgaaguggagaagcggcgcgggaucuccccggcauuaguccagccccugaugagaucugugauggaagccccauucccugcucuaggaaaaaccauccucguuaagaauuuucugcccgguagcggcacggaggugauugaacuuugcaggccauuggauucccggcuggagcauguagacuucgagucacucuuuagcagucugucuguccgacacuuaguguguguuuucgcgucccugcuuuuggaaagacgcgugauauucaucgcagauaaacucagcauucugucgaagugcugccaugccauggucgcucuaaucuauccuuuugccuggcagcacaccuacauacccgugcugccaccggcaaugguagacauuguguguucaccuacacccuuccucaucgggcugcuuucuaguuccuugccacuguuaagggagcucccccuggaagagguucuugucguggaccuggugaacagccgguuuuugcgucaaauggaugacgaggauucuauccucccuagaaagcugcaggucgcccuagaacacauucuggagcagaggaaugaacucgcuugcgagcaagacgaaggaccacuggauggccgccauggucccgagagcuccccucuuaacgagguugugucagaagccuucgugcgauuuuucguagagaucgucgggcacuauaguuuguuucugacuagcggcgaaagagaggaacggaccuuacagagggaggcauuccgcaaagcggugucuuccaagucacuccgucauuuucuggagguuuucauggaaacacagauguuuagaggauucauucaggagcgggaacuuaggcgccaagacgcuaaaggccuguuugaggugcgagcccaggaauaccuagagacucucccgaguggggagcacagcggagucaauaaguuccugaaaggcuuggguaacaagaugaaguuccugcauaaaaaguga

SEQ ID NO: 55239 - RNA, 5721 nt, Artificial Sequence
  derived and/or modified sequence opt3 from DENND4A__Homo_sapiens__NP_001138295
augaucgaggacaagggccccagaguggccgauuacuucgucguugcugggcugaccgacgugagcaaaccucucgaagaggaaauucacuuuaacgaugcaugccauaagguagccaaaccaaaggagccgauaacagacguguccgucaucauuaaaucucuuggagaagaggugccccaggauuauaucuguauugacguuacuccuacgggucugucagcggauuugaauaacggcaguuuaguggggccacaaaucuaccugugcuauaggcggggacgcgacaagcccccucuaaccgaucucggcguccuguacgacuggaaggagcgacuuaaacaggguugugaaauaauccagagcacaccauaugggcgucccgcuaauauuuccggaucuacuucgucacagagaaucuacauuaccuauaggcgggccagcgagaacaugacacaaaauacccuggcagugacugauaucugcauaauuaucccuaguaagggcgaauccccaccgcacacauucuguaaaguagacaagaacuugaauaacucuauguggggcagcgccguuuaccucugcuacaaaaaguccguggcuaagaccaauacggucucauauaaagcagggcugauuugucgcuacccccaggaggauuaugagaguuuuagccugccugaaucugugccacucuucugcuuacccaugggagccacuaucgaguguuggccuuccaacucaaaguacccacugcccguguuuagcaccuucguccuuacaggugcuagugccgaaaaaguuuauggcgcggcaauccaguuuuacgagccguauucugaagagaauuugacugagaagcagagacugcuacucgggcugaccuccgccgacggaaaaagcgacucgucuaagacaauucauaccaacaaaugcauaugucuucugucccacuggccuuucuuugaugcuuucaggaaguuuuugacguuccucuaccgguacucaaucaguggcccccaugugcugccaauugaaaagcacaucagccacuuuaugcauaaaguaccuuuccccuccccacaacgcccccgaauauuagugcagcugucuccucacgacaaucucauucuuagccagccagucucaaguccgcugcccuuguccggugggaaguucagcacucuacugcagaaccucggaccugagaaugccgugacacugcuuguuuuugcagugaccgaacauaaaauccugauccacucuuugagaccaucaguccucacuagugugacagaggcucugguaagcaugauuuuccccuuucacuggccuugcccauauguucccuuaugcccgcuggcccuagcggaugugcucuccgccccuuguccauucaucgucggcauugacucuagguacuuugaucuguaugaccccccucccgaugugucgugcgucgacguggauaccaacacgauaagccaaaucggcgacaagaaaaacguugcauggaagauucuuccaaagaaaccuuguaagaauuugaugaacacccugaauaaccuccaucagcagcuggcuaaacuucaacagcggccccgugaugacgggcugauggacuuggccaucaaugauuacgacuucaacuccggaaagcgccuccacaugaucgaucuggaaauucaggaggcuuuuuuauucuuuauggccucaauacugaaagguuauagaaguuaccuaaggccaaucacacaggcaccgucugagacugccaccgacgcugcgagccucuucgcacugcaagccuuucuucggucccgagaucgcucacaucagaaguucuauaauaugaugacaaagacucagauguuuauuagauucaucgaagagugcagcuucgugucugacaaagaugcuuccuuggccuuuuucgacgauuguguagacaaggucgauauggacaaaaguggcgaagugaggcugauugagcucgaugaaagcuuuaagucugagcacaccguuuucgugacaccucccgagaucccacaucugcccaacggggaagagccuccauuacaguacuccuacaauggauuucccguccugcggaacaaucuuuucgaacgcccugagggcuuuuugcaagcaaaaaagaacaagcucccgucaaaaaguagcucgccaaauuccccccugccuauguucagaaggaccaagcaggagauaaaaucugcccacaagaucgcuaaacguuauagcucaauuccacagauguggagucggugccuacugcgacacuguuacggucucugguuuaucugccugcccgccuaugugaagguaugucauuccaaagugagagcacuuaagacugcguacgacguuuugaagaaaaugcagucuaagaaaauggacccuccggaugaagucugcuauaggauucugaugcaauuaugugggcaguacgaccagcccgugcucgcugugcgcguccuguucgagaugcagaaggccggcaucgauccaaacgcaauaacguauggauacuacaauaaagccguucuugaaagcacauggccuucccggucaagaagcggcuauuuucuguggaccaaggugaggaacgugguauugggggucacucaauucaagcgcgcucucaaaaagcacgcccaucugagucagaccacacuaucugacggauccgaucuggacgcagugagccacgguucgauggauucaggccacgggacccauacuguugagcaggcucccuuuaacacaggacucauuaaaguguacgccacggacgaucgaucuaguaccggcggucaauccgaccugggguauaauagccuuucuaaggaugaaguccggcguggcgacacuagcacagaggauauccaggaggaaaaagacaagaagggauccgacugcucaaguuugagcgagucugaauccaccaaaggcucagcggauugccugccaaaguuaaguuaccagaacagcuccucuauugugagacucacagggacuucgaauaacagcgccggaaaaaucucaggugaguccauggaaaguaccccugagcugcuucugauaucuagccuagaggacacgaaugaaaccaggaacauccagucccgcuguuuccggaagagacacaaaucagauaaugagacaaaccuccaacagcagguuguguggggcaauaggaaccgaaaucugucugggggaguauugaugggcuucaugcugaaccgcauuaaucaggaagcuacucccggugacaucgucgagaaguuaggggcagaugccaagauucucagcaacgugaucaguaaauccacccggccaaauacacuggacauaggcaagccgccucuuagaagcaaaagggauucucuggaaaaggagucauccgacgaugacacucccuuugauggaaguaacuauuuggcugacaaaguggacagcccagucauuuucgaucucgaggaccuggauucggaaaccgacguuucuaaggccggcugcguggcaacgcaaaaccccaaacguauccagcgcaugaauuccagcuuuucaguaaagccuuucgagaagacagauguggcgaccggguuugacccacuaagucugcuugucgccgaaacugagcagcagcaaaaagaggaagaggaagaggaugaagacgauucuaaguccaucagcacacccucagcucggagagaccucgccgaggagauugugauguacaugaacaauaugaguagcccucugaccuccaggacuccgucuaucgauuugcagcgagcaugugacgauaaacugaacaagaaaagcccacccuuaguuaaggcuugccggcgcuccucacucccucccaauucuccaaagccugugagacugaccaaaaguaagucguauacaaaaagcgaagagaagcccagggaccggcuuugguccucuccagccuucucaccuacguguccguuucgagaagagagccaggacacccugacucauuccagucccucuuucaacuuggauacacuccuggucccaaaacuagacgugcugagaaauagcauguuuaccgcaggaaagggcguugccgaaaaggcuucaaaaugguacucccgcuucacaauguacacuaccaguagcaaggaucaaucuuccgacaggacgucacuuagcucggugggugcgcaggauucugagaguacaucccucaccgacgaggaugucugccacgaacuggaggggccuauuagcucacaggaaacuuccgccaccucuggaacaaaacguauagacuugagccggaucaguuuagaguccagcgcaucucuggaaggcucacucaguaaguuugcucugcccgguaaauccgagguaacuagcucuuucaacgccucgaauaccaacauuuuccagaauuaugccauggaggugcuuaucucaagcuguuccagaugcaggacaugugauugccugguucaugacgaagagauuauggcuggcuggacggcagaugacaguaacuugaauaccacuuguccauuuugcgggaacaucuuccuaccuuuucugaauauagaaauccgcgaucuccgaagacccggacgguacuuccugaagucuagcccguccacagagaacaugcacuuuccaucaaguauuucuagccaaaccaggcaguccugcaucucaacuagcgccucuggccuugacacauccgcguuaagugugcaggggaacuucgaccugaauagcaagucgaaacuccaggagaacuuuuguacccgcuccauucaaaucccugcuaaucguucuaagacggccaugucaaaaugccccauauucccaauggcaagaagcauuaguacuuccggacccuuggauaaggaagacaccggccggcagaaacugaucucuacagguagccucccugccacccugcagggggcuacugauucacuuggacuggaguggcacuugccgucccccgacccagucacagugccuuaucuaaguccccugguaguguggaaggaacucgagagcuuacuggaaaacgagggcgaucaugcaaucaccgucgccgacuuuguugaucaccauccuauuguguucuggaaucuugugugguacuuuaggcgccuggaccucccaucuaacuugcccggucugauacucucauccgagcacuguaauaaguauagcaaaaucccucgacauugcaugucugaagauaguaaguacguccugauucagaugcuuugggacaacaugaaacuacaccaagauccaggccagccccuguauaucuuguggaaugcgcacacacagaaguacccgauggugcauuuacugcagaaaucggacaacuccuucaaucaagagcuccugaagagcaugguuaaaucaauuaagaugaacgacguauacgggccuaugucucagauccuugaaacucugaauaaguguccacacuuuaaaagacagcggagccucuauagggagauauuguuccugucccuaguggcucugggacgcgaaaacaucgauauugacgccuucgauaaggaguacaaaauggcauaugacagacucacccccagucaagucaagucaacgcauaauugcgauaggccuccaucuacaggcgugauggagugucggaaaaccuuuggggaacccuaccuuuga

SEQ ID NO: 55240 - RNA, 597 nt, Artificial Sequence
  derived and/or modified sequence opt3 from DENR__Homo_sapiens__NP_003668
auggccgcugacaucagcgaguccucuggcgcagauugcaagggggaccccagaaacucagccaaacuggaugcggacuacccucucagggugcuuuauuguggagucugcagucugccaaccgaauacugugaguauaugccggauguugcuaagugccggcagugguuggagaaaaauuuccccaacgaauuugccaaguuaacaguggaaaauagcccuaaacaagaggcagguauuuccgagggccaggggacugccggagaagaggaagagaagaagaaacagaagcgcggcggucgagggcagauaaaacaaaagaaaaagacgguaccacagaaggugaccaucgcuaaaauuccccgugcaaagaaaaaguacgucacaagaguguguggacuggccacuuucgagaucgaccuaaaagaagcucagagguuuuucgcccagaaguuuucuugcggcgcgucgguuaccggcgaggaugaaauuaucauacaaggggacuucacagaugacaucauugaugugauccaggagaaauggccugaagucgacgaugacucaauugaggaccucggagaggugaagaaguga

SEQ ID NO: 55241 - RNA, 1404 nt, Artificial Sequence
  derived and/or modified sequence opt3 from DEPDC1B__Homo_sapiens__NP_001138680
auggagcacagaaucgugggccccgggccuuacagggccacccggcuguggaacgaaacagucgagcuguuccgcgcuaagaugccacuucgaaaacaucguugcagauuuaagagcuaugaacacuguuucacugcagccgaggcgguugacuggcugcaugaauuguuaaggugcucccagaauuuuggaccggaggugacgcggaaacaaaccguacagcugcuaaagaaauuccucaagaaccacgugauugaggauauaaaggguaaauggggcgaagaggacuuugaagauaaucgccaucuguacagauuucccccuucuucaccacuuaagcccuauccuaaaaagccacccaaccagaaagacgucaucaaguucccugaguggaaugaucugccaccggggacaagucaggagaacauucccgugaggccuguugugaugaauagcgaaaugugguacaagcggcacuccaucgcuauuggagaggucccagccugucgcuuggugcaccgaagacaacucacugaagcaaacguagaggaaaucuggaaaucuaugacccugucguaucugcagaagauacucggcuuagacucacuggaggagguucuugaugugaaauuggucaauagcaaguucaucauucauaacguguacaguguguccaaacagggugucguuauccuggacgauaagucuaaagaacuaccccacugggugcucagcgccaugaagugccuggcuaauuggccuaacuguuccgaccuuaagcagccaauguaucugggguuugagaaagauguauucaagacaauugcagacuacuacggacauuugaaagaaccccuccugaccuuucacuuauucgaugccuuugugucaguccugggccuccuucaaaaggagaaaguggcuguugaagccuuccagaucugcugucuguugcuaccgccugagaauaggcggaagcugcagcuccugaugcguaugauggcgcgcauaugccuuaacaaggagaugcccccacugugugacggcuucgggacuagaacauugauggugcagaccuuuaguaggugcauucucuguagcaaagacgaagucgaucuggacgaguuacuggcagcccggcuagugacguuccucauggauaauuaucaagaaauccugaagguaccucuugcuuugcagacuucuauugaggaacgaguugcccaccuccgcagagugcaguuucaaaaauccuaccccgaggucuaucaggagagguucccaacccccgaaucagcagcucuccuguuuccugagaagccaaaaccgaagccccagcuucugaugugggccuugaagaaaccuuuccagccauuucaacggacacgcagcuucagaauguga

SEQ ID NO: 55242 - RNA, 1680 nt, Artificial Sequence
  derived and/or modified sequence opt3 from DEPDC5__Homo_sapiens__NP_001007189
augagaaccacaaagguguacaaacuggucauccacaagaaaggcuucgggggaagcgacgaugagcucguugugaaccccaagguauuuccucauauuaaacuuggugacauaguggaaaucgcccacccaaaugaugaguauuccccgcuguuguuacaggucaagucucugaaggaagaccuacaaaaagagacuauuucaguggaucagacgguuacccagguguucaggcuccggcccuaccaggacgucuaugugaacguaguugauccuaaggacgugacacuggaucuugucgaacugacuuuuaaagaccaauacaucggccgcggggauauguggcgauugaagaaaagucucgugagcacaugcgcuuauauuacccagaagguggaguucgcaggaauccgugcccaggcgggcgagcugugggucaagaaugaaaaaguuaugugugguuacauauccgaggacaccagagugguauuuaggucuacuucggcuaugguguauaucuucauucagaugucaugcgaaaugugggauuuugacaucuacggggaccuguacuucgagaaggccgucaacggauuucucgcagauuuauucacaaaauggaaggagaaaaauuguagccaugaagugaccguugugcuguuuagucggacguucuaugacgccaaguccgucgaugaguuuccagaaauuaaccgcgcuucuaucagacaagaccacaaaggcagguucuacgaggauuucuauaaggugguaguucagaaugaacggcgcgaggaguggacuagccuuuuggugaccauaaagaaacuguuuauucaguaccccguccuagugcgacucgaacaggcagagggcuucccucaaggggacaacuccacaucagcccagggaaauuaucuggaagcuaucaaccuuaguuuuaaugucuucgauaagcauuacauuaacagaaauuuugacaggacuggucagaugagcgugguuaucaccccaggcguggggguauucgaggucgaucggcuguugaugauccucacaaaacaacguaugauugacaacggaauaggcguggaucugguuugcaugggugaacagcccuuacacgccgugccucuguuuaagcuccacaaucgcucugcgccaagagacuccaggcuuggggacgauuauaacaucccgcauuggauuaaccacucauucuacaccagcaaaagucagcuguuuuguaauucuuucacgccccggaucaaguuggcaggaaagaaaccugccuccgagaaggcuaaaaacggccgagacacuagccuaggcucgccaaaggagucugaaaaugcccugcccauacaggucgauuacgacgcauaugaugcucaaguguuucgccucccugggccauccagagcccagugccugacaaccuguaggucaguacgggagcgcgaaagucauagcagaaaauccgcgucuagcugcgacgugucaaguucccccagccuuccgucuaggacucugccuacagaggaaguucguucacaggccagugaugacagcuccuugggaaagucugcaaacauucucaugaucccccacccacaucugcaccaguacgaggucucgagcuccuuagguuauaccucaacgcgggagcaccugggcuga

SEQ ID NO: 55243 - RNA, 1230 nt, Artificial Sequence
  derived and/or modified sequence opt3 from DEPTOR__Homo_sapiens__NP_073620
auggaggaaggcgggagcaccggauccgccgguucugacucaaguacaagcggcuccgggggagcucagcaaagagagcuggaaaggauggcagaggugcucgucacuggcgaacagcuucggcugcgcuugcacgaggagaagguuaucaaagaucgacgucaucacuuaaagacguaccccaacugcuucguggccaaagaacugauugacuggcuaauagagcauaaggaagcgucugauagagagaccgcuaucaaacucaugcagaagcuggccgacagggguauuauccaccauguaugugaugagcacaaggaauuuaaagacgugaaacuuuucuaucgguuucgcaaggaugacgggacauucccucuggauaaugaggucaaggcauuuaugagaggacagagguuguacgaaaaacucaugucgccagagaacacucugcugcaaccgcgggaagaggagggcgugaaguaugaacgcaccuucauggccucagaguuucucgacugguuaguucaggaaggcgaggcuacaacccgaaaggaagcagagcagcugugccacagacuuauggagcaugggauuauccagcacgugagcaauaaacaucccuucgucgauaguaacuugcuguaccaauuuaggaugaauuuccggcgucgcagaaggcuaauggaacuccugaacgagaaguccccuucuagccaggaaacucacgacuccccauuuugucuucggaaacagucacacgauaaucgaaagaguaccagcuucaugucugugucccccucaaaagagauaaagaucguaagcgccguucgcagaaguucuauguccagcugcggaucgucugguuauuuuuccucaaguccuacacugagcuccucuccacccguguuguguaacccuaaaagcguccucaagaggccagugacgucagaggaacuguuaacuccgggcgcucccuacgcccggaagaccuucacaauugugggggacgcggucggauggggcuucguugugcgcgguaguaaaccuugccauauccaggcaguagacccauccgggcccgccgcugccgcaggaaugaaggugugucaauuugucgugagcguuaauggccugaacgugcuccacgucgauuauagaacugugucuaaucuuauucugaccggcccuaggacaaucguaauggagguuauggaagaguuggaaugcuga

SEQ ID NO: 55244 - RNA, 957 nt, Artificial Sequence
  derived and/or modified sequence opt3 from DERA__Homo_sapiens__NP_057038
augagcgcccacaacagaggcaccgagcuggaccucuccuggaucucuaagauucaggugaaucaucccgcuguccuuaggcgggcagaacaaauacaggcccgccgaacaguuaaaaaggaguggcaggcggcuuggcuguugaaagccgugacuuucaucgauuuaacgacccugucaggggacgauacaaguagcaacauucagcgucuaugcuacaaggcaaaauauccuaucagagaagaccuccugaaggcccuuaauaugcacgauaagggaauuacuaccgcugcaguauguguguacccagccagggucugcgacgcugugaaagcccugaaggcggcagguuguaacaucccgguugccuccguggcugccggcuuucccgcagggcaaacacauuugaaaacccggcucgaggaaauacgccuggcugucgaggauggagccacugagaucgacgugguaauuaauagaucucugguucucacaggccagugggaagcguuauaugaugagaucaggcaguuccggaaggccugcggugaagcacaccugaaaaccauucuugcuacgggggaguugggaacucugaccaacguguacaaggccucgaugaucgcuaugauggccggcucagacuuuauaaagacaagcacuggcaaagagaccgucaaugcaacauucccuguggccauugugaugcuacgcgcuauccgagacuuuuucuggaagaccgggaacaaaauuggauuuaagccagcggguggcaucagaagugcaaaagauucccucgccuggcugucucuugucaaggaggagcugggggaugaaugguugaaacccgaacucuucaggaucggagcuagcacgcuguuauccgacauugaacggcagauauaucaucacguuacuggccguuacgccgcauaucacgaccugccuaugucauga

SEQ ID NO: 55245 - RNA, 696 nt, Artificial Sequence
  derived and/or modified sequence opt3 from DERL1__Homo_sapiens__NP_001128143
augagcgacaucggcgauugguucagauccauucccgccauaaccagguacugguuugcugcaacaguggccgucccucugguugggaagcucggacuuaucucuccagcguaucuguucuuguggccggaggccuuuuuauaccgguuccagauuuggcgccccaucacugcuacguuuuauuucccuguggguccaggcaccggguuucuguaccuaguaaaccucuauuuccuguaccaauauucaacacgacuugaaacuggagcauuugacggccgucccgccgauuaccuguucauguugcucuuuaauuggauuugcaucgugauaaccggucuggcuauggacaugcagcugcucaugaucccuuuaauuaugaguguccuguacgugugggcacagcuuaacagagauaugaucguuagcuucugguuugggacaagguucaaagccuguuauuugccaugggugauucugggauucaauuacaucauaggcggcuccuaucccauggaccuagggggacggaacuuucucucuaccccucaguuccuguaccgcuggcuuccaucgagaagggguggcgucucaggguuuggagugccgcccgcuagcaugcggcgcgccgcggaucaaaauggcggugggggacgacacaacuggggccagggcuucagacugggggaccaguga

SEQ ID NO: 55246 - RNA, 720 nt, Artificial Sequence
  derived and/or modified sequence opt3 from DERL2__Homo_sapiens__NP_057125
auggccuaccagagccugagacucgaguaucuucaaauucccccuguguccagggcuuacaccacagcaugcguccugacuacggccgcgguucaguuggaauuaaucaccccauuccagcuguauuuuaacccggagcuaauauucaagcacuuucagaucuggcggcucauuacaaauuuccuguuuuucggccccgugggguuuaacuuccuuuuuaauaugaucuuccuguaccgcuauugucgaauguuggaagagggaucuuuucgugguagaacugcugacuucguauuuauguuccucuucggcggguuucugaugacccuguucggacucuuugugucauuagucuuccugggccaagccuuuacaauuaugcuuguguacguuuggaguaggcggaacccuuaugugcgcaugaauuucuuugguuugcugaacuuccaggcaccauuucuacccuggguccucaugggguucagccugcuucugggaaauuccaucauaguggauuugcucggcaucgccguaggccauauuuacuuuuuccuggaagacguuuuuccuaaccagccagggggaaucagaauuuuaaaaacccccucuauccugaaggcuauauucgauacuccugacgaggauccaaauuacaacccgcuccccgaggaaaggccugguggcuucgcauggggagaggggcagcggcuuggcgguuga

SEQ ID NO: 55247 - RNA, 708 nt, Artificial Sequence
  derived and/or modified sequence opt3 from DERL3__Homo_sapiens__NP_001002862
auggccuggcagggccuggcugcagaguuccuccaagugcccgccgucaccagagcguacacagcugccugcguucuuacuacggcagccgugcagcuggaauuguuaagcccuuuucagcuguauuucaacccacaccuaguauuuaggaaguuccagguguggcggcucgucaccaauuuucuguucuuugggccgcuuggauucuccuuuuucuuuaacaugcuguucguguuucgcuacugucgaauguuggaggaagguucuuuccguggcagaacagcugacuucguuuuuauguuccucuuugggggagugcugaugacucugcucggcuuacuggguucacuuuucuuuuuggggcaagcacugauggccaugcuagucuauguguggaguaggcggagcccccgcguaagaguuaauuucuuuggacuccugaccuuccaggcuccuuuucuuccaugggcccugaugggcuucuccuugcuccugggcaacucuaucuuaguggaucugcucgggauugcggucggacauauauacuauuuucuugaggacguguuccccaaucagccugguggcaaaaggcuguugcagacaccaggguuucuaaagcugcuccuggaugcacccgccgaagacccuaacuaccuuccacugccggaggagcaacccggaccucacuugccacccccucagcaguga

SEQ ID NO: 55248 - RNA, 1413 nt, Artificial Sequence
  derived and/or modified sequence opt3 from DES__Homo_sapiens__NP_001918
augagccaggccuacuccucuucacaaagagugaguagcuauaggcggaccuucggcggggcucccggauuuccucuggguuccccacucucuucgccggucuucccccgcgcaggcuuugggucaaagggaagcaguuccucuguuacaagccgaguguaccagguaucccguacuucaggcggugccgggggacuuggcagucugagagcgagcagguugggcacgacccggacaccuucuuccuauggggcuggagaguuacuggacuucucacuagccgaugcagugaaccaggaauuucucacuacccgcacaaaugagaaagucgaacugcaggagcuuaacgacagauucgccaauuacaucgaaaaggugagguuucuggagcaacagaacgcugcauuggccgcugagguuaaucggcucaaaggucgcgaaccaacccgaguggccgagcuguaugaagaggagcugagagaacucaggcggcaggucgagguguuaacuaaccagcgugcgcgcguagauguugaaagagacaaucugcuugaugacuugcaaaggcugaaggcaaaacuacaggaggaaauucagcucaaggaggaggccgaaaacaaucuggcugccuuccgggcagauguggacgcugccacacuugcgcgaauagaucuggagcgcagaaucgagagcuugaacgaagaaauugccuuucucaagaaaguccacgaggaggaaaucagggagcugcaggcacaauuacaggaacagcaaguccagguggagauggacaugaguaagcccgaucugaccgcugcccuccgggacauucgcgcucaguacgaaacgaucgccgccaaaaauauaucugaggcagaggaaugguauaaguccaaagugagcgaucuuacucaggcugcgaacaagaauaacgacgcacugagacaagccaagcaggagaugauggaauacaggcaucagauccagucguauaccugcgagauugacgcuuugaaaggcacaaaugauucucuaaugcgucaaaugcgggagcuggaagaccgauucgccuccgaggcaucaggguaccaggauaacaucgccagacucgaagaggaaauuaggcaccugaaggacgagauggcucgccaucuucgggaguaccaggaucuguugaacguuaaaauggcccucgacguggaaaucgcaacuuauagaaagcuguuagagggagaagagaguaggauaaaucugccuauucagaccuacagcgcgcuaaacuuucgcgaaacauccccagagcaacgaggcucugagguacacaccaaaaagacggugaugaucaaaacuauugaaacacgggauggugaggucgugagcgaagcuacccagcagcagcaugagguucucuga

SEQ ID NO: 55249 - RNA, 486 nt, Artificial Sequence
  derived and/or modified sequence opt3 from DESI2__Homo_sapiens__NP_001284675
augggcgccaaccagcuggugguccucaauguuuacgacauguauuggaugaacgaguacaccagcuccaucgggauuggaguguuccacucugguauagaaguauauggcagagcugugguccuugggucaacagauuuucuggaggacgauaucgaaaagauuguggaggaauugggaaaagaguacaagggcaaugcauaucauuuaaugcacaaaaacugcaaucauuucaguagcgcccuguccgagauccuaugugguaaggaaauucccagguggaucaaccggcucgcguacuuuucuucgugcauaccuuuccugcaaucaugucuuccaaaagaguggcugacuccggcugccuugcagagcaguguuucccaggaacuccaggacgagcuggaggaagcagaggaugccgcugcaucugccagcguggcuuccacggccgcggggucacgccccggacgacacaccaagcuguga

SEQ ID NO: 55250 - RNA, 288 nt, Artificial Sequence
  derived and/or modified sequence opt3 from DEXI__Homo_sapiens__NP_054734
augcugggcgccagaguggcugcacaccucgacgcccuugggccccuggucccuuacguuccaccgcccuuguuaccuagcauguucuaugugggacuguuuuucguaaacgugcuaauccucuacuaugcguuucugauggaguacauuguccuuaaugugggucugguuuucuugccagaagauauggaccaggcucucguggaucugggcguccuguccgaccccgggucuggacucuaugaugccgacucagaguuagauguguuugacgcauaccuggaauga

SEQ ID NO: 55251 - RNA, 885 nt, Artificial Sequence
  derived and/or modified sequence opt3 from DFFB__Homo_sapiens__XP_011539165
augcugcagaagcccaaaagcgugaagcucagagcccuuagguccccucggaaauucggcgucgcugggcgcucuugccaagagguucugcgaaagggauguuugcguuuucaguuaccagaaagagguucaaggcugugccuauacgaggacggcaccgaacucacagaggauuauuucccgagugugcccgacaacgcagaacugguacuucugacuuuggggcaggccuggcagggaugugaguggcaaggccucuggcggaugugccugcugcucgaucgccacuuacuguuugugccucuugucgcggacgugagcgauaucagaagguucuuguccgcuuuucaugagccacagguuggucugauucaggccgcacagcaacuacucugugacgaacaggcuccccagcggcagcgccugcuugccgaucuguugcacaaugugucucaaaacauagcagccgagacgcgagcugaagacccuccaugguucgaggggcucgagucgagauuucagucaaaaagcggauaccugagguauaguugcgaaucccggauccguucuuacuuacgcgaggucagcuccuaucccucaaccgugggcgccgaagcgcaggaggaguuccugagaguacucggcaguaugugucaaaggcuucggagcaugcaguacaaugggucuuauuuugaucgaggagcaaaggguggcucccgccugugcacaccugaagggugguucucaugucagggaccauuugacauggauagcugcuugaguagacauucuauuaacccguacuccaauagggagagccggauccuauucucgacuuggaaccuggaccacauugauggcguucuccuguguggucccggguga

SEQ ID NO: 55252 - RNA, 1491 nt, Artificial Sequence
  derived and/or modified sequence opt3 from DFNA5__Homo_sapiens__NP_001120925
auguucgccaaggcuaccagaaacuuucugagggagguggacgcagauggcgaccucaucgccgucagcaaucuuaacgauuccgacaaacugcaguuguuaucucugguuacaaagaaaaagcgguucuggugcuggcaacgccccaaauaccaguuucuaucacucacucugggggaugugcuuauugaagaccaguucccuaguccaguaguggucgagagcgauuuugugaaguaugaaggaaaguucgcgaaucacguuuccgguacgcuggagaccgcuuugggcaaagugaagcucaaccuugggggaucuucgcgagucgaaucacagagcaguuuuggcacacugcguaaacaagagguggaccuccagcaguuaauaagagauuccgccgagaggacuaucaaucugcggaacccgguacuucagcaaguuuuggaaggucgcaaugaggugcuguguguccuaacccagaagauuacaaccaugcagaaaugcgugaucucugaacauaugcaaguggaggagaagugugggggaauugucggcauccagacuaagacaguucaggugagcgcaaccgaagacggcaacguaacgaaagauuccaaugugguccucgagauacccgccgcuacuaccaucgcauacggggugauugaacuguauguuaagcuggacggacaguucgaguuuugccuguugagagguaaacaaggcggguucgaaaacaagaaaaggaucgauucaguguaccucgacccucuggucuuucgggaguucgccuuuauugacaugccagaugcugcccacggaaucaguagccaggacggccccuuaucugugcugaagcaggcgacacuccuucuggagcgcaauuuccauccuuucgcagaauugccagagccccagcaaacugcccuauccgauauauuucaggcuguacuguucgacgaugaacuccugaugguucuugagccugugugugacgaucuggucucagguuugagcccaaccguggccguccucggggaacugaaaccgcgacagcagcaagacuuaguggcauuucugcagcuaguuggaugcagucuccagggcggcugucccgggccugaggaugcuggaucuaagcagcuguucaugacagccuauuuucuuguguccgcguuggccgagaugccagacagcgcagcugcccugcucgguaccugcuguaagcugcaaauuauccccacgcuuugccaccuguugagagcucucucggaugacggcguaucugaccuggaagauccuacuuuaacaccacugaaagacaccgagagguucgggauuguccagcggcuauuugccuccgcagauaucucacucgaacgucugaagaguagcgugaaagccguuauccuuaaggacuccaaaguguuccccuugcugcucuguauuacucugaacggauuaugcgcucugggccgcgagcauucuuga

SEQ ID NO: 55253 - RNA, 2724 nt, Artificial Sequence
  derived and/or modified sequence opt3 from DFNB31__Homo_sapiens__NP_056219
augaacgcaccccuggacggccucagcguguccucuucaaguaccgggagccuuggauccgcugccggugccggcgggggaggcggugcggggcugagauuguuaucugcuaaugucaggcagcugcaccaagcccuaacagcacuccugucggaggccgaacgggagcaguucacucauugccuuaacgcuuaccacgcacgccgaaauguuuuugaucuggugcguacguugagaguacuccuggacucaccugugaagaggcggcugcucccaauguuacgccuggucaucccgagaagcgaucagcuuuuguucgaccaguauaccgccgaaggacuguaccuacccgcuacaacuccuuauaggcaaccagccuggggcggccccgauagugcggggccuggagaggugcggcucguuucccugcgccgagcaaaagcccaugaaggucuuggcuuuucuauuagagggggaagcgagcacggcguggguauauacgucucccugguggagccagggucauuggcugaaaaggagggacucaggguaggcgaccagauccugcggguuaacgauaaaaguuuagcccgugugacccaugcagaagcugucaaggcccugaaaggcagcaagaagcucgugcuuucuguguauuccgcggggcgcauucccggagguuacgucacaaaucacaucuauaccuggguugacccucagggcagaucaauuagcccaccgagugggcugccccagccucacggaggcgccuugaggcaacaggagggugaucggcgaucuacucuacaucugcuccaagggggcgacgagaaaaaggugaaccugguacuuggagauggccgcucccugggguugacaaucagaggaggugcagaauacggccucgggauauacaucaccggaguggacccaggcagcgaggcugaagguucggggcugaaagucggcgaucagauuuuagaggugaauggaaggucuuuccugaacauccuacacgacgaagccguucggcuccugaaguccucacgccaucuuauuuugacggugaaagacgucggcagacugccccacgcuaggacuaccguggaugagacaaaguggaucgccaguagccguauacgggagacuauggcaaauuccgccggguuucucggagaccugaccacagaagguauuaacaagccuggcuucuauaaagggccagcuggaucucagguaacccuuagcucacugggcaaucagacgcgaguuuugcucgaggaacaggcgagacaccuguuaaacgagcaagaacaugcaacuauggccuacuaucuggaugaguacaggggugggaguguguccgucgaggcucuagugauggcccucuuuaagcugcuuaauacacacgcaaaauucagcuugcugucugaaguccgcggcaccaucucaccccaggaccucgagcgguuugaucaucugguguuaagaagggaaauugagaguaugaaggcccgccagccgccuggacccggcgcuggggacacuuauagcaugguuuccuacucugauacaggaucgagcaccggcucccacgguacgucaaccacagugaguucugcccgaaacacucuggaccuugaagagaccggggaggcaguacagggaaauaucaacgcguugccagaugucagcguggacgauguucgguccacaucacaaggccucagcucuuucaaaccucugccccguccacccccucuagcucaggguaacgaccugccacucggccagccgagaaagcuggggagggaagaccuucagcccccuuccaguaugccaagcuguucuggaacuguguuuuccgcaccccaaaaucgcucaccuccagccggcaccgcccccacaccggggaccaguagcgcucaggauuugccuucguccccaaucuaugccucugucagccccgcaaacccuucaaguaaacggccccuggacgcucauuuagcccucgugaaucagcacccaauuggaccuuuccccagaguacaguccccaccgcaccugaagucuccuagcgcggaggccacuguggcuggcgguugccuucugcccccaucccccucagggcauccugaucaaacgggaacaaaccagcacuuuguuauggucgaagugcauaggccagacagcgagcccgaugugaaugagguccgagcauugccucagacccgcacugccaguacccucucucagcuguccgacagcggccaaacacuaucggaagauucagguguugacgcuggcgaggccgaagcaucugcgccggggcggggaagacagaguguguccaccaagagcaggucuagcaaagagcugccacguaacgaacgccccacugauggcgccaauaagccuccagggcuccuggagcccacauccacgcuugugcgggucaaaaagucagcugccaccuugggaauagcaaucgagggcggugcuaacacuagacagccucugccgaggauuguaacaauccaacgagggggaagugcccacaauuguggccaguuaaaagugggucacguuauacucgaagugaacggccugacccuucgggggaaggagcaucgcgaagcagccagaauuaucgcugaggcguucaagacaaaagacagggauuacaucgacuuccuggucacugaauuuaaugugaugcuauga

SEQ ID NO: 55254 - RNA, 1059 nt, Artificial Sequence
  derived and/or modified sequence opt3 from DFNB59__Homo_sapiens__NP_001036167
auguucgccgcugcaaccaagagcuuugugaaacaggucggcgacgggggaagacugguucccgugccuucccucucugaggccgauaaguaccaaccacuuucacugguagugaaaaagaaaaggugcuucuuguuuccgcgguauaaguucacaaguacucccuuuacguuaaaggacauccugcuaggugaucgcgaaauuagcgcgggcauauccucuuaccagcuccugaacuaugaggacgaaucggaugucucacuuuacgggcgacguggaaaucacaucgugaacgacguuggcauuaauguggcugguagcgauaguaucgccgucaaagcauccuucgggauugugaccaagcaugagguagaaguuucuacacuguugaaagagaucacuaccagaaagauaaacuuugaccacagccucaucaggcagucccggucaagucgcaaagccgugcugugugucgugauggagagcauuagaacaaccaggcagugcucucuguccgugcaugcuggaauccggggcgaagcaaugcgcuuccacuuuauggaugagcaaaauccuaagggccgagacaaggccauugucuucccagcucauacuacaaucgccuuuucaguuuucgaacucuuuauauauuuagauggggcguucgaccugugugugaccagcguaaguaaaggagguuucgagagagaggaaacggcaacuuuugcccuuuuguacaggcugcggaacauucuauucgagcguaaucgcagagugauggaugucaucucuaggucccagcucuaucuggacgaccuuuuuagcgauuacuacgacaagccccugucgaugaccgauauuucuuugaaagaaggcacacacauccgggugaaccuccugaaucacaacaucccuaaggggccaugcauuuuauguggaaugggcaauuucaaacgagagacuguuuaugguugcuuucaguguuccguggacgggcagaaguacguccgccugcaugcugugcccugcuucgauauauggcacaaaagaaugaaguga

SEQ ID NO: 55255 - RNA, 1467 nt, Artificial Sequence
  derived and/or modified sequence opt3 from DGAT1__Homo_sapiens__NP_036211
augggcgacagagggagcuccaggcggcgccgaaccggaucucgucccucaagucacgguggcgggggaccugccgcugcagaggaagaggugagagaugccgcggcuggcccagacgucggugccgcaggggaugccccggcucccgcaccuaacaaggacggagaugccggcguuggcagcgggcauugggaacugaggugccaccggcuccaggacucccuuuucucuucggauucaggauuuagcaauuaccgcgguauccugaacuggugugugguaauguugauuuuaaguaaugcuagacuguuccuagagaaccucauaaaauauggcauccugguggacccaauucaagucgugucccuuuuucugaaggaucccuacucuuggccugccccaugcuugguuaucgcggcaaauguguucgccgucgcugccuuucagguggagaaaaggcucgcaguaggggcucugacagaacaggccggacugcucuuacauguugcgaaccuggccacuauucuuuguuuccccgcagcuguggucuugcugguggagagcaucacgccugugggcucccuacucgcccugauggcucacaccauacuuuuucugaaguuguucucauaucgggacgucaauaguuggugccgccgagccagagcaaaagccgcuagcgcggguaagaaggcaucuuccgccgcugccccacauacaguuucauacccggauaaccucacuuauagggaccuguacuacuuuuuauucgcacccacccuguguuaugaacucaauuuuccucggagcccacguauccgcaaaagauuccuucugaggcggauuuuggagaugcuauuuuucacacagcugcaaguggggcucauccagcaguggaugguacccaccauucagaacaguaugaagccuuucaaagauauggacuacucucgaaucauagaacgccugcuuaagcuggccgugccaaaucacuugauuuggcucaucuuuuucuauuggcuguuucacuccugcuuaaacgcugucgccgagcugaugcaauucggagacagagaguuuuacagggauugguggaauagcgaaucggugacuuauuucuggcagaacuggaauauucccguucauaaaugguguauccggcacuuuuacaagccgaugcuacgcagagggucuuccaaguggauggcaaggacaggcguguuccucgcgucagccuuuuuccaugaguaucuggucagugugccucuucguauguuucgguugugggcuuucaccggcaugauggcacagaucccccuggccugguuuguaggacgauucuuccaggguaacuacggcaacgcugccguuuggcucagccugauuauagggcaaccaaucgcagugcuuauguauguccacgacuacuacgugcugaauuaugaagcuccugccgcggaggccuga

SEQ ID NO: 55256 - RNA, 1038 nt, Artificial Sequence
  derived and/or modified sequence opt3 from DGAT2__Homo_sapiens__NP_001240820
augaagacccugaucgccgcuuacagcggcgugcucagaggggagaggcaggcagaagccgaccggucccaacgcucucacggaggucccgcgcuuucacgagagggcagugggcguuggggagucgcuugcagcgccauucugauguauauauucuguacagauugcugguugaucgcaguuuuauacuuuacuuggcugguguucgacuggaacacgccuaaaaagggcgguagaaggucccaguggguacggaauugggccguguggcgcuauuuuagagauuacuucccaauucagcuagucaaaacccauaaccuccugacaacuaggaauuauaucuuuggguaccacccgcauggaauuaugggccuuggcgcuuucuguaacuuuucuaccgaagcaacagaggugucgaagaaauuccccgggauccggccuuaucuggccaccuuggcuggaaauuuucgcaugccaguucuccgagaauaccugaugucagguggcauaugccccgugagcagagacacuaucgauuaccugcucaguaagaacggguccggaaaugccauuaucauugucgugggcggugcggcagagucuuuaagcuccaugccugggaagaacgccguaacacugaggaaucggaaaggauucguuaaacuugcuuugcgucacggcgccgaccuggugccaaucuauucauuuggcgagaacgaagucuacaaacaggugauauucgaggaagggaguuggggacgcugggugcaaaagaaguuucagaaguauauugguuucgcacccuguaucuuccauggcagagggcuauuuagcucugauaccuggggacucgucccuuacuccaagccaauuacgacuguugugggcgagccgaucaccauccccaaacuggagcacccuacacagcaggacauugaucuuuaucacacuauguacauggaagcucugguaaaguuguucgacaaacauaagaccaaauuuggucucccagagacagaagugcuggaggucaauuga

SEQ ID NO: 55257 - RNA, 1530 nt, Artificial Sequence
  derived and/or modified sequence opt3 from DGCR2__Homo_sapiens__NP_001167004
auggugcccaaggccgacagcggcgcuuuccugcuccuuuuucuguuggucuuaaccguuacagagccucugagaccagaagugacuggggagguaaggccgcaccauggaaaagaagcaguggauccccggcagggucgcgcccgaggcggggacccuucccacuuccaugcggucaacguggcucaaccaguucguuuuucuucauuccuaggaaagugccccacgggcuggcaccauuacgaggguaccgccaguuguuauagaguguaccucagcggggaaaauuauugggaugcagcccagacaugccagaggcugaacggaucccuugcuacuuuuucuaccgaccaggagcugcgguucgucuuggcacaagagugggaucagccugaacgcucguuuggcuggaaagaccagagaaagcucugggugggcuaccaguauguaaucacagggaggaaucggucacuggagggacgcugggaaguugccuucaaagguagcagugagguguuucugccacccgauccuauuuucgcuuccgccaugucugagaacgacaaugucuuuugugcgcaacuccagugcuuccacuuuccaaccuuacgacaccaugaucugcacagcuggcaugcagaauccuguuacgagaagucaaguuuccuuugcaagagaagccagacuuguguggacauaaaagauaacguggucgacgaaggcuucuauuuuacaccgaagggggaugaccccugcuugucuuguaccugccacggaggcgagccugaaauguguguugccgcucugugcgagaggccacaggguugccaacaguaccggaaagaccccaaggaguguugcaaauucaugugucuagauccugacggaaauucccucuuugauucaauggccagcgggaugcgucuggugguaaguugcaucucuuccuuccuuauucugagcuugcuccuguuuauggugcaccgcuuaagacagaggcggcgagaacgcaucgagucgcugauuggcgcaaaccuccaucacuucaaucuuggcagaaggaucccaggguuugacuacggacccgaugguuucggcacggggcugacuccguugcaucuaucugacgauggagaaggcgguaccuuucacuuccaugacccucccccaccuuauacagcuuacaaguaucccgauauagggcaaccagacgaucccccuccaccguacgaggccuccauccaccccgacucagucuuuuaugacccugcggaugacgaugccuucgaaccaguggagguuagucugcccgcaccuggcgacggaggcagcgagggggcucuccugcggcgccuugaacagccacugcccacugccggagcuuccuuggccgaucucgaggacucugcagauagcucaagugcccuguuagugccgccugacccagcucaguccgguagcacccccgcggcagaagcccugccuggcgggggaagacacucuaggucaagucuaaacacagucguguga

SEQ ID NO: 55258 - RNA, 663 nt, Artificial Sequence
  derived and/or modified sequence opt3 from DGCR6L__Homo_sapiens__NP_150282
auggagagauacgccgcugcacuggaagagguggccgacggcgcgaggcagcaagaacggcacuaucagcuccuuagcgcucugcaguccuuggucaaggaguuacccucuucauuccagcaacgccugaguuacaccacacuaagcgaucucgcccuggcacuucuggacgggacuguuuuugaaaucgugcagggauugcucgagauucagcaucugacggagaaaucccuguauaaccagcgacuccguuuacaaaaugaacacagaguacugaggcaggcccuucggcagaagcaucaggaggcucaacaggcaugccgcccucacaacuugccagugguccaggccgcucaacagagagaacuggaggccguggagcauaggauacgggaggaacagcgcgcgauggaucagaaaaucauucuagaacucgaccgaaagguugcagaucaacagucuacccuggagaaagccgguguggcuggcuucuacgucacaacuaauccgcaggaacuuaugcugcagaugaacuugcucgagcugaucagaaaguuacaacagagggggugucgggccggaaaugcagcucugggccucggugggcccuggcagucgccugccgcgcagugcgaccaaaagggaucaccagugcccccuuga

SEQ ID NO: 55259 - RNA, 2223 nt, Artificial Sequence
  derived and/or modified sequence opt3 from DGCR8__Homo_sapiens__NP_001177255
auggagaccgacgaaagccccuccccucugccaugcggcccggccggggaggcugugauggaaucuagagcaaggcccuuccaggcccucccucgggagcaaucaccacccccuccacuucagacaaguagcggagcggaagucauggauguugguuccggcggggacggacagucugagcugcccgcugaggauccuuuuaacuucuacggcgccucguuguuaucaaaggguagcuuuaguaaagggcgccugcuaaucgacccaaauuguuccggacacucuccgcgaacugcacgucaugcccccgcugugagaaaguucagcccugaucucaaacugcuuaaggacguaaaaauuuccgugucauuuacggaaaguugcaggagcaaggaucggaagguccuguauaccggcgcagagcgcgacgugagagccgaauguggcuugcuccugucuccaguuuccggggaugugcacgcuugccccuucggagguucagucggcgacggggugggaauaggcggugagagcgccgauaaaaaggacgaggaaaacgagcuggaucaggaaaagaggguagaguacgcgguucucgacgaauuagaggacuuuacagauaaucuggagcuugacgaagagggggcaggaggcuucacugccaaggcuaucgugcaacgggaucgcgucgacgaagaggccuugaacuuuccuuaugaagaugacuucgauaaugacguggaugcacugcuagaggagggccucugugcucccaaaaagcgaagaaccgaagagaaguacgggggagacagugaucauccaucugacggugaaacauccgugcagccgaugaugaccaaaauuaagacuguccugaaaagcaggggccggccucccacagagccacuuccugacggguggaucaugaccuuucacaacucgggaguucccguguaucugcaucgugaaucucgcguagugacgugguccagaccauacuucuugggcacugguucaauuaggaagcacgaucccccucucaguagcaucccaugccugcacuauaaaaagaugaaagacaaugaggagcgggaacaguccucugauuuaaccccgagcggggacgucucacccgugaagccucugagucgauccgccgagcucgaauuuccacuugaugagcccgacagcaugggcgcggauccuggaccacccgacgagaaggauccgcugggcgccgaagcagcuccuggggccuugggacagguuaaagcuaagguggaggucuguaaagacgaaucuguggaucuagaggaguuccgcucauaccuggaaaagagauucgacuuugagcaaguaacaguuaaaaaguucaggacuugggccgaacggcgccaguuuaacagagagaugaagaggaaacaggcagaaagugagcguccaauacuccccgccaaucagaagcugaucacccuuagcgugcaagaugcuccuaccaaaaaggaguucgucauuaaccccaaugguaaauccgaagugugcauccugcaugaguacaugcagcgggucuugaaggugcgaccaguuuauaacuuuuucgaaugugcgagagcaacacucgagauucugaucccugacuuugugaagcagacgucugaagagaaacccaaggacucggaagaguuagaguacuucaaucacauaagcauugaagauuccaggguauaugagcugacuucaaaagccggccuacucaguccauaccaaauccugcaugaaugccuuaagcgcaaccacgggaugggagacacaucuauuaaauuugaggucgugccgggcaagaaucagaaaagcgaguauguuauggcuugugguaaacacaccgugcggggguggugcaagaacaaaagagucggcaagcaguuggccucccagaaaauccugcaacuccugcauccucacgugaagaacuggggaucacuucugaggauguacggccgcgaaagcucuaaaaugguaaagcaggagacuuccgauaagagugugaucgaauugcagcaguaugccaaaaagaauaaacccaaccuccauauucugagcaaguuacaagaggaaaugaaacgacuggcagaggagcgggaagagacacguaagaagccaaaaaugucuauaguugcuuccgcccagcccgggggagaaccucuaugcaccgucgacguguga

SEQ ID NO: 55260 - RNA, 2208 nt, Artificial Sequence
  derived and/or modified sequence opt3 from DGKA__Homo_sapiens__NP_958853
auggccaaggagagaggccugaucagccccuccgacuucgcucagcuccaaaaauacauggaauauucuaccaagaaagugucagauguccuuaagcuguuugaggacggggaaauggcaaaauacguucagggagaugccauugguuaugagggcuuccagcaguuuuugaagauauacuuagaaguggacaacguaccuaggcaccugagucuagcgcucuuucagagcuuugagacagggcauugccugaaugagacuaacgugacgaaggaugucgugugucuuaaugacguuuccugcuauuucucucuguuggaaggaggccggccagaggauaaacucgaauuuaccuucaagcuguacgacacagaucgcaacgguauccuggacucgucagagguggauaaaauuauccuccaaaugaugcgagucgcugaguauuuagacugggaugugagcgaacugcguccgauucuucaggagaugaugaaggaaaucgacuacgacgggaguggauccguaucucaggccgaguggguuagagcaggcgccacuaccgugcccuugcugguccuacucggccuggaaaugacacuuaaagaugacgggcaacacauguggaggccuaagcgguuuccacgccccguguacuguaaucugugcgagagcuccauaggauuggguaagcagggccucucauguaaccugugcaaauauaccgugcaugaucagugugcuaugaaggcauuaccuugcgaggucaguacuuacgccaaaagcagaaaggacaucgggguucagucucacguguggguaaggggaggcugugaauccggucggugcgaucgcugucagaaaaagauucgaaucuaucauucacugacagggcuccacugcguguggugccaccuugagauucaugacgauugucugcaagcugucggacacgaaugcgacuguggcuugcuaagagaucauauccugccacccagcaguauauacccuucugugcucgccuccggcccagacaggaaaaauagcaagaccucgcagaagacgauggaugaccugaaccuuucuacuuccgaggcgcugcggauugacccgguucccaauacccacccuuugcucguguucgucaacccaaaaucagggggaaagcaaggucagcgugugcuguggaaauuucaguauaucuuaaauccccgccagguauucaaccugcuaaaggauggcccugaaauugggcucagacuguuuaaagacguuccagauaguaggauccuugugugcggaggcgacgguacagucggguggaucuuggagacuauugauaaggcaaaucugcccgugcucccgccugucgccgugcugccccuuggcaccggaaacgaccuggcucgguguuugcgauggggcgggggauacgagggucaaaaucucgccaagauacugaaagauuuagaaaugagcaagguugugcacauggaccgcugguccguagaggucaucccacagcagacagaagagaaaucugauccugugcccuuccagauuaucaacaacuauuucagcauaggcguugacgcaucaauugcucauagauuucacaucaugagggaaaaguacccagagaaauucaauagucggaugaagaacaagcugugguacuuugaguucgccaccuccgaaagcaucuuuucuacgugcaaaaagcuagaggaaucacucacuguggagauuugugggaaaccccuggaucuuaguaauuugagccuggagggaaucgcgguccucaacauuccuuccaugcauggcgguucuaaucuguggggcgacacacgcagaccacacggggauauauauggaaucaaccaagccuuaggcgcaaccgcuaaggugauuacugacccggacauccugaaaacaugcguacccgaucuuucggacaagagguuggaagugguugggcucgagggagccaucgaaaugggucagauuuacaccaagcugaaaaaugcuggccgucggcuagccaaguguagcgagauaacguuccauaccacaaaaacucugccuaugcagaucgauggggaaccauggaugcagacccccugcacaauuaagaucacucacaaaaaccaaaugccuaugcucaugggaccacccccgcgauccaccaauuucuucggcuuucugucauga

SEQ ID NO: 55261 - RNA, 2415 nt, Artificial Sequence
  derived and/or modified sequence opt3 from DGKB__Homo_sapiens__NP_004071
augaccaaccaggagaagugggcccaccugagccccuccgaguucucucaacuccagaaauacgcugaguauucaacaaagaaacuuaaggacgugcuggaagaguuucauggcaauggggucuuggcaaaauacaacccugaaggaaagcaggauaucuuaaaucagacuauugacuucgaggguuuuaagcuguucaugaaaacguuucuagaggccgaacucccagaugacuucaccgcgcaccuguuuaugaguuucagcaacaaguuuccgcauuccucucccaugguuaaaucgaagccugcccuucugucaggcggguugagaaugaauaaaggagccauaacaccacccaggacuaccagcccugcaaacacaugcaguccagaggugauccaccucaaggauauuguauguuaucugucccugcucgaacggggccgccccgaggacaaguuagaguucauguuucgacuguacgauaccgacgguaauggguuccuugauucuagcgaauuggagaacaucauuucccaaaugaugcauguggccgaauaucuggagugggacgucacugaacuaaauccuauccuccacgagaugauggaggaaauagauuacgaccacgauggaacagugucacuggaggaauggauccagggcggcaugaccacgauuccacuucugguuuugcucgggcuggagaacaaugugaaagacgacggacagcaugucuggcguuuaaagcacuuuaacaaaccggcuuauugcaaucugugucucaacaugcuuaucggugugggcaagcaggggcugugcuguaguuucugcaaauacacuguacaugaaagauguguugcaagggcucccccuagcugcauuaagaccuacgugaaaucuaagcggaauacagaugucaugcaccacuauuggguggagggaaacuguccaacuaagugcgacaaaugucauaagaccgugaaaugcuaccaaggcuugacaggucuacacugcgucuggugucagaucacccugcauaacaagugcgcuucccaccucaaacccgagugugauugcgggccucugaaggaccauauacuuccacccacgacuauuuguccgguugugcugcagacauugccuaccucaggaguaagcgugcccgaagaacgccagaguacugucaagaaagaaaagucuggcucccaacagccaaauaaagugaucgauaagaacaaaaugcagagagccaauagcguuacaguggacggccaagggcuccaggucaccccugugcccggaacgcacccacuguuaguauucguuaaccccaagucggguggcaagcagggggagaggauuuaucggaaauuucaguaccugcuaaauccucgccaaguguauucucucuccggaaacggcccaaugccgggucugaauuucuuucgagauguccccgacuucagagugcuugcgugcgggggcgauggaaccgucggcuggguguuggacuguaucgaaaaggcaaacguugggaaacacccuccaguggccauccugccccucggaacagguaaugaucuggcuaggugccuucgguggggcgggggauacgagggcgagaaccugaugaagauuuugaaagacauagaaaauucaacugagaucaugcucgaccguuggaaguuugaaguaauuccuaacgauaaggacgagaaaggugauccaguccccuauaguaucauaaauaacuacuucagcauugggguggacgccuccaucgcacaucgcuuucacaucaugagagagaagcauccggaaaaauucaauucuaggaugaagaacaaauuuugguacuucgaguuuggcaccagcgaaacauucucagcuacuuguaagaaacugcacgagaguguugaaauugagugcgauggagugcagaucgacuuaauuaacauaucccuggagggcaucgccauucuaaauaucccuagcaugcacgggggaucuaaccucuggggugaaucaaagaagcggcgaagucaucgcagaaucgagaaaaagggcagcgauaaaaggaccacagucaccgacgcgaaggaacugaaauuugccucccaggaucuuucugaccaguugcuggaggugguagggcucgaaggagcaauggagaugggccaaauuuauacuggucugaagucggcugggcggcgcuuagcccaguguagcugcgugguuauaagaacguccaagucacugccaaugcagaucgauggcgagcccuggaugcagacaccuugcaccauuaaaaucacucacaagaaucaagcucccaugcuuaugggaccaccucccaaaaccggcuuguucuguagucucgucaagaggacacguaaccggucuaaagaauga

SEQ ID NO: 55262 - RNA, 3513 nt, Artificial Sequence
  derived and/or modified sequence opt3 from DGKD__Homo_sapiens__NP_003639
augaacauguuccuguacuuucagaccaucauuaaggagggcaugcucacaaaacaaaauaacagcuuccagagauccaagaggcgguauuuuaaacuucgcgggcgaacucuguacuaugccaagacggcuaaaucuauaaucuucgacgaaguggauuugaccgacgcaucagucgccgagaguagcacaaagaauguuaacaauuccuuuacugugauuacccccugccguaaguuaauccugugugcggauaacagaaaagaaauggaggacuggauugcugcccuaaagacaguacagaauagggaacacuucgagccuacccaguacucuauggaucauuuuucgggaaugcacaacugguaugcaugcucacaugcccggccaacuuacuguaaugugugccgcgaggcucucagcggugucacaagucacggccuguccugugaagugugcaaauucaaggcacauaaaagaugugccguuagggcuaccaacaauugcaaguggacgacucuugccucuaucgggaaggacauaaucgaggaugcggacggaauugcaaugccgcaccaauggcuggaaggcaacuugcccgugagcgccaaauguaccgucugcgauaagacaugugguuccgugcuccggcugcaggacuggcgcugccuguggugcaaagcuaugguacacacuucauguaaggagagucucuuaaccaaaugcccucuggggcuuuguaagguuagcgugaucccacccacagccuugaauagcauugauuccgacggauuuuggaaagcaucaugcccuccaagcuguaccaguccccugcuagucuucgugaacucuaaguccggcgauaaucagggcgugaaguuucuccgaagauucaaacagcugcuuaacccugcucaagucuuugaccugaugaacgggggaccacauuugggucucaggcuguuccagaaguucgacacguuucggaucuuaguuugcggcggggauggaagcgugggcuggguacugucggagauagacucucucaaucuucacaaacagugucagcuggguguguugccgcuagggacuggaaacgaucuggcccguguccucggcuggggcuccgcgugcgacgaugacacacaacugccccagauucuugaaaagcuggagcgcgccucaaccaaaauguuggauagauggagugugauggcauaugaagcuaagcucccuaggcaggccagcuccucuacuguuacagaggacuucagcgaagauucagaggugcaacagauccuguuuuacgaggacagugucgcugcccauuuauccaagauucugaccagcgaucagcacucugugguaaucucaagugcaaaaguucuaugugaaacggugaaggacuucgucgcccggguggggaaggcuuacgagaaaaccacagaaagcuccgaggaaucugaggucauggcgaaaaagugcucggugcucaaggagaaacuggacagccuuuugaagacucuggaugacgaaucccaggcaucaaguucucucccaaaucccccuccaaccaucgccgaggaagcugaggauggagacgguagcggcuccauuugugggucaacaggagaucgacugguugccagcgcaugccccgcccgcccgcaaauauuuagaccuagggaacagcuuaugcugcgggcuaacucuuugaaaaaggccauccgccagauuaucgagcacacugagaaagcaguggacgaacagaaugcgcaaacccaggagcaggaaggcuucguacucggucuguccgagagugaggaaaagauggaucauagagucugucccccauuaagccacucugaguccuuuggggugccuaagggcaggucacagcguaaaguuaguaagagccccugcgaaaaacugauaucgaagggaucccuaucucucggcagcucagcuagucugccaccccaaccugggucccgggacggacuuccagccuugaacacaaaaauucuguauccgaaugugcgagcagguaugucuggcagccuccccgggggauccgucaucucaagacuguuaaucaacgccgauccuuucaauagcgagccagaaacccuggaguacuauacugagaagugcgugaugaacaauuacuuuggcauuggucuugacgcuaaaaucaguuuggauuucaacaauaagagggacgaacaucccgagaagugucgcucucggacgaaaaacaugaugugguaugggguacucggcacaaaggaacugcuacacagaaccuacaaaaaucuggagcagaaggugcuccuggaaugcgauggaaggccuauuccacuucccuccuugcagggcauagccguucugaacaucccgagcuaugcagggggaacuaacuuuugggguggcaccaaagaggacgacacauucgcugccccuucguuugaugacaagauuuuagaggucguggcgguguucgggucaaugcagauggccgucucucgcguuauccgacuccaacaucaccggaucgcucagugucguaccgugaagauuaguauacugggagaugaaggcgugccaguacaggucgacggugaggcaugggugcaacccccuggguacaucagaauuguucacaaaaauagggcccagacucuuacacgcgaucgggcuuucgaauccacgcugaagucuugggaggacaaacagaagugcgaauugcccagaccaccuucuuguagccuccaucccgagaugcuguccgaggaagaggccacccagauggaucaauuuggccaggcagcgggagugcuaauccacucaauuagggaaaucgcccagagucaucgagacauggagcaggagcuggcucacgccgucaacgcaagcucuaaauccauggaucgcguguacggcaagccacggacuacagaagggcucaauugcucauucguucuggagauggugaacaauuuuagagcucuuaggagugaaaccgaguugcuguuaagcggaaagauggcccuccaacuggacccgccucagaaagaacagcuuggcuccgcacuggccgagauggaucgucagcuacgccggcucgcugacacacccuggcugugucaaucugcggagccaggugaugaagagucgguaauguuggaccuggccaagagaagcaggucagggaaauuccgauuagucacuaaguuuaaaaaggaaaagaacaauaaaaacaaggaggcacacuccagucucggagcucccgugcaucuguggggcaccgaagagguggccgccuggcuugagcaccugucuuugugcgaauauaaagacauauucacgcggcaugauauccgcgguagcgagcuccugcaccuagaaagaagggaccugaaggaucuuggcgucaccaaaguugggcauaugaagcggauucucuguggaaucaaagagcugucccgaucagcuccugcaguggaagccuga

SEQ ID NO: 55263 - RNA, 1704 nt, Artificial Sequence
  derived and/or modified sequence opt3 from DGKE__Homo_sapiens__NP_003638
auggaggccgaaagaaggcccgcuccuggcagcccauccgaggggcuguucgcagacggacaccucauccuuuggacccugugcucuguguuguuaccggucuuuauuacauucugguguucacugcagcggagucgccgacaacuacaucguagagauauauuuaggaaaagcaagcacgguuggcgggacacugaucucuucucccagcccacguacugcuguguuugcgcccagcauauccugcagggcgcguuuugugacugcugugggcuucgcguggaugaaggaugccugagaaaggcugacaaaagguuccaauguaaggagauuauguugaaaaacgauaccaagguacucgacgccaugccucaccauuggauccggggcaaugugccacugugcucuuauuguauggucugcaagcagcagugcgguugucagcccaaacugugcgauuaccgcuguauuuggugccaaaagacagugcacgacgaauguaugaaaaacucgcucaagaaugagaaaugcgauuuuggggaguucaagaacuuaaucauaccuccaucauaucugacuagcaucaaucagaugcgaaaggacaaaaagaccgauuacgaaguucuugcaaguaaauugggaaagcaguggacaccccugauuauccuagccaacuccagaucuggcaccaauaugggcgaggggcuccugggagaauuuaggauucuucugaacccugugcaggucuucgacgugacuaaaacaccaccgaucaaggcuuugcaacucuguacccuguuacccuauuacagcgcacggguacugguuugcgguggcgacgggacggugggauggguccucgaugccguggacgauaugaaaauaaagggccaggagaaguauauuccucagguggcuguccuuccacuggguacugggaaugacuuguccaacacccuaggauggggcacaggcuacgccggggagauccccguugcgcaagugcugcguaauguaauggaagcagauggaauuaaacucgaccgcuggaaggugcaggucacuaacaaagguuacuauaaucugagaaagccuaaagaguuuaccaugaacaauuacuucucagugggcccagaugcccuuauggcucugaacuuucacgcccauagggaaaaggcacccaguuuguucagcucucggauccucaacaaggcuguuuaucuguucuacgggacaaaagacuguuuagugcaggagugcaaggaucugaauaaaaaggucgaacuagagcucgacggagagcgaguggcccugccgucccuugaaggcaucauuguauugaacauagguuauuggggcgggggaugucgccugugggagggcaugggggaugaaaccuacccucucgcgagacacgacgacggacugcuugagguugugggugucuauggcucauuucauugcgcccagauccaagugaaacuggcaaaucccuucaggauugggcaggcucacacgguccgguugauccucaagugcagcaugaugccaaugcaaguggauggagaaccuugggcccagggccccuguacuguuacaauaacccacaagacucaugcuaugaugcuguacuuuaguggugagcagacagacgaugacauuucuuccaccagcgaucaggaggacaucaaagccacggaauga

SEQ ID NO: 55264 - RNA, 2301 nt, Artificial Sequence
  derived and/or modified sequence opt3 from DGKG__Homo_sapiens__NP_001074213
augggcgaggaaagaugggugagccugacccccgaggaguucgaccagcuccaaaaguacuccgaguauucuaguaaaaagaucaaagaugcccuuacagaauuuaacgaagggggaucacugaagcaguacgacccucacgagccaauuagcuaugaugucuucaaauuguuuaugagggcuuacuuagaaguugaccugccgcagccccuauccacucaucucuuccuggcauuuucucagaagccucggcacgagacgucggaucauccaaccgaaggugccucaaauagcgaggcgaacagugcugacacaaauauacaaaacgccgauaaugcaacuaaggccgacgaggcuugcgcacccgauaccgaauccaacauggccgagaaacaggcuccugccgaagaccagguggcggcaacaccacuugagcccccuguaccacgcucuagcuccucagaaaguccgguggucuaucugaaggaugugguuuguuacuugagccuccuggagaccggccgaccccaggacaaacuggaguucauguuucgucucuaugauucugacgaaaauggguuacuggaccaagccgagauggauugcaucgugaaccagaugcuucacauugcucaguacuuggaaugggacccuacugagcugagaccaauccuaaaggaaaugcuccagggaauggauuacgacagggauggcuucgucucccugcaagagugggugcauggugggaugacaaccauuccccuucugguauugcucggaauggacgauucaggcagcaaaggcgacgggcggcacgccuggacgaugaagcacuuuaagaaaccuacuuauuguaauuucugccauaucaugcugaugggaguucgcaagcaggguuuauguugcaccuacuguaaauauacagugcacgagagaugcgucaguaggaacauaccaggcugugugaagacuuacucuaaagcaaagcgguccggggaagugaugcagcaugcuugggucgagggaaauagcucgguuaaaugcgaucgcugucacaagucuaucaagugcuaucaauccgugaccgcccgacacugcguaugguguagaaugacauuucauaggaaaugcgaacugucaacccucugugacggcggugagcuucgggaucacauucuguugcccacgaguaucugcccgauuacucgugaccgcccuggggaaaagagcgacggauguguguccgcgaaaggcgagcuagucaugcaguacaagaucauacccacaccaggcacccauccucugcucgugcugguuaaccccaaaucugggggaagacagggugagaggcuuaauuucuuucgggauacuccagacuuccgagugcuggccugcggcggggauggaacagucggcuggauuuuggacuguaucgauaaggcaaacuucgcuaagcaucccccuguggccguacucccacuggguaccgggaaugacuuagcucgcugccugagauggggcggaggcuaugaagggggaagccuaacgaaaauucucaaggauaucgagcagucaccgcugguuaugcuugacagguggcacuuggaagugaucccccgggaggaggucgaaaacggugaucaagugccuuacaguauuaugaacaauuacuuuuccauaggcgucgacgccagcaucgcacaccgcuuccacgugaugagagagaaacauccagaaaaguuuaacucuaggaugaaaaauaagcugugguauuucgaguuugggaccucagaaacauucgccgcuacuuguaagaaacuccacgaucauauugagcuggagugcgacggaguuggcguggaucuuaguaacaucuuucuggaagguauagcgauuuugaauauccccagcauguacgggggcaccaaccucuggggagagaauaagaaaaaccgugcaguaauccgggaaucccgaaagggcgucacagacccuaaagagcugaaguucugugugcaggacuuaucugaucagcugcuagaaguuguggggcucgagggagccauggagaugggucagauuuauacuggccugaagucggcugggagaaggcuugcccaaugcgcaagcgucaccauccgcacaaauaaauugcugccaaugcaaguggacggagaacccuggaugcagccgugcuguaccauuaagauaacucacaaaaaccaggccccuaugaugaugggcccaccccagaaguccucauuuuucagucuccggagaaaaucuaggagcaaggauuga

SEQ ID NO: 55265 - RNA, 3495 nt, Artificial Sequence
  derived and/or modified sequence opt3 from DGKH__Homo_sapiens__NP_001191433
auggccggcgcugggggacagcaccaucccccuggugcagccggcggggcggcugccggagcaggcgccgcugugaccagcgcagccgcuuccgccgguccaggggaggacucuucagauagugaagcggagcaagaaggaccgcagaagcugaucagaaaagucagcacauccggccagauuaggacuaagacgucuauaaaagagggccagcuccuuaagcaaaccucgucauuccagcgguggaaaaagcgcuacuuuaagcugcgagggcguacauuguauuacgcaaaagacagcaagaguuuaaucuucgaugaaguugaccuguccgaugccucuguggcugaggccagcacuaaaaacgcaaauaacuccuuuaccauuaucacacccuucagaaggcuaaugcucugcgcugagaaucggaaggaaauggaggacuggauuucaagucugaaaagcguacagacccgcgaaccuuaugagguggcccaguuuaacgucgagcacuucucuggaaugcauaauugguacgcguguucccacgccagaccaacuuuuugcaacguguguagggaaucacuuagcgguguuacaagucauggccugucuugcgagguguguaaguucaaggcacacaaacggugcgcuguccgcgccaccaauaacuguaaguggacgacuuuggcuuccaucgggaaagauauaaucgaagacgaggauggaguggccaugccccaccaauggcucgaaggcaaucugccuguaagcgcaaagugcgccguuugugacaaaaccugcgguucggugcugcgacuccaggauuggaaguguuuauggugcaaaacaaugguccauacugcuugcaaggaccuguaucacccaauuuguccccuugggcagugcaaggugucuaucauuccuccaaucgcguugaacuccaccgauucagacggauuuuguagagcaacauucaguuuuugcgugagcccgcugcuagucuucguuaauuccaaaucuggcgacaaccagggcgugaaguuucucaggcgguucaaacaacugcuuaaucccgcccagguauucgaucugaugaacgggggaccucauuugggucuccgucuguuucagaaguucgacaauuuucgcauauuaguguguggcggggauggaagcgucggcugggugcugucagagauugacaaacucaaccuuaacaagcaaugccagcuggguguuuugccacuagggaccggcaaugaucuggcuagagugcucggauggggcgggaguuacgacgaugacacgcagcugccccagauccuugagaagcuggaaagggccuccacuaaaauguuggaucgguggagcauuaugacauaugagcucaagcugccuccaaaagcaucuuuacugcccggaccgccugaagccucagaggaguucuacaugaccaucuacgaggacagugucgcuacucaccuaacaaagauccucaacagcgaugagcacgccgugguaauuuccucugcaaaaacccugugugaaacgguuaaggacuuuguggcgaaggucgagaaaaccuaugacaagacacuugaaaaugcuguggucgccgaugcaguggccucgaaaugcagcguuuugaacgagaagcuggaacaacuccugcaggcgcuucauacugacucccaggccgcacccgugcugccagguuugucaccucucauaguagaggaggaugcugucgaaaguucuagcgaggaaucccugggcgagucaaaagagcaguuaggggacgaugugaccaagcccagcucucaaaaggccguuaaaccacgagaaaucaugcugcgcgcuaauucccuaaagaaagccgugagacaggucauugaggaagcuggaaaggugauggacgaucccacaguacacccuugugagccagcaaaccagaguagcgacuacgauucuacugaaaccgacgaguccaaagaggaagccaaggaugacggcgcuaaagagucaaucacagugaagaccgccccgaggagucccgaugcacgggcgagcuauggucauucgcagacugacuccguuccugggccagccgucgcugccucuaaggaaaaucuccccgugcugaacacgcgcauaauuugcccuggccuuagagcaggauuggcugccagcaucgcaggcucaaguaucauuaauaaaaugcugcucgccaacaucgacccauucggggcuacacccuuuauugauccggaccuggauuccguggacggauacucugagaagugugucaugaauaacuauuucgguauaggcuuagaugcgaaaaucagccuggaauuuaauaacaagagggaggagcacccugaaaaaugccguucccggaccaagaaucuuaugugguacgggguuuugggaacucgagagcuccugcaaagaucauauaagaaccuagaacagagggugcagcuggagugcgacggccaguacauuccacuccccagccugcaagguaucgccgugcuuaacaucccuaguuacgcagggggcaccaauuucuggggaggcacaaaagaagaugacauuuuugcugcccccucuuucgaugacaagauauuggagguagucgccaucuuugauuccaugcagauggcugugagccgcguuauuaaacugcagcaucaccggaucgcacaauguagaaccgugaagauuacuaucuucggggacgagggagucccagugcagguugauggcgaagccugggugcagccucccgguauaaucaaaauuguacacaagaacagggcgcagauguuaacacgcgaccgagcuuucgagucgacgcucaagucaugggaagacaaacaaaagugcgauucugggaaaccaguccugcggacccaucuuuauauccaccaugccauugaccuggcaacugaggaggugagucagaugcaguuguguucccaggccgcugaagaacucaucacacguauaugcgaugcagccaccauucacugucugcuagaacaagagcuggcgcacgcugugaaugccugcagccaugcacucaacaaggccaauccgagauguccugaaucucugacaagggacacugcuaccgagaucgccauuaacgucaaagcacuuuacaaugagacggagagcuugcugguuggacgcgugcccuuacagcucgaguccccacacgaagaacggguaucaaacgcucugcauaguguggaagucgagcuucagaagcugaccgagauccccuggcuauauuacauacuccacccuaaugaagaugaggaaccacccauggacugcacaaagagaaacaauaggagcacuguguuucgaaucguuccuaaauucaagaaagagaaggugcagaaacaaaagaccucuucccagccgggcucaggugauacagaaaguggcagcugugaggccaacuccccagggaauuga

SEQ ID NO: 55266 - RNA, 3198 nt, Artificial Sequence
  derived and/or modified sequence opt3 from DGKI__Homo_sapiens__NP_004708
auggacgccgcuggcagagggugccaccuucucccccuuccugcagccaggggaccagcgcgggcuccggccgcagccgcugcagccgcugccagcccucccgguccauguuccggcgcggcaugcgcccccucugcugccgcaggggcuggagccaugaacccuucaaguagcgcgggcgaggaaaagggugccaccgggggauccucuucgucaggcagcggcgcagggaguuguugccugggagcugaggguggcgccgauccacgcggggcuggauccgccgcagccgcuggcgcggcagccuuggacgaacccgcugccgcaggucagaaagagaaggaugaagccuuagaggagaaacugcgaaaucuaacauuccguaagcaagugucuuacagaaaagcuaucagcagggccgggcuccagcaucuggcuccugcgcacccacuuucccugccggucgcuaacggacccgccaaggaaccucgggcaacuuuggacuggucagagaaugccguuaacggcgaacaucucuggcuggagacgaaugugaguggcgaucuguguuaucucggggaggaaaacugccagguacgcuuugcuaagagcgccuuaagaaggaaaugugcagugugcaagauugucgugcacaccgcuuguauagagcagcuggagaaaaucaauuuccggugcaagccaacauuucgcgagggagguucucgaucccccagagaaaacuucguuaggcaucacugggugcaccggcgucgccaagagggcaaauguaagcagugcgggaagggauuucagcagaaauucucauuucauagcaaggagauugucgccaucaguugcucuugguguaaacaagcguuccacaauaaggugacuugcuuuaugcuucaucacauugaagaaccuuguuccuugggcgcccacgcugcaguaaucguuccacccaccuggauaaucaaagugaagaaaccgcagaacagccugaaggccucgaauagaaagaaaaagaggacaucuuucaaacggaaggcuuccaaacgagguauggaacaggagaacaaggggcgcccuuuugucauuaagcccaucucaaguccacuaaugaaaccucuccugguguucgugaaucccaagagcggcggaaaccagggcaccaaaguccuucaaauguuuaugugguaccugaauccaagacagguuuucgacuugucccaggaagggcccaaggaugcccucgagcuguauaggaaagugccuaacuuacggauucuggcaugcggaggugacggcacuguaggguggauccucucuauacuugaugagcugcaauugagcccacagccgcccgugggaguccuaccucugggcacagguaacgaccucgcgcgcacccugaauuggggcgggggauacacggaugaaccagugucaaagauucuuugucagguugaggacggcacugugguccagcuggauagauggaacuugcauguggaaaggaaucccgaccucccuccagaggaacuggaggacgggguaugcaaguuaccccugaacguuuucaauaacuauuuuagucuaggauucgaugcccacgugacccucgaguuucaugaaucccgugaggcuaauccggaaaaauucaacagccgguuucgaaauaagauguucuacgccggugcagcuuuuucugacuuccugcaaagaucaaguagggaucuuagcaaacacgucaagguggucugugacggcacagauuugacuccuaaaauccaggagcugaaguuucagugcauuguguuccucaacaucccacgcuauugugccgggaccaugcccuggggaaauccuggcgaccaucacgauuuugagccccagcggcacgacgaugguuacaucgaaguuauuggguucacaauggcaucccuggccgcucugcaagugggcggacauggcgagagacugcaccagugcagggaaguaauguugcucaccuacaagucuauaccaaugcaggucgacggggagccuugucgccuggcgcccgccaugauccgaauuucguuacggaaccaggcaaauauggugcagaaaagcaagcguagaacguccaugccacugcuaaacgauccgcaaucaguuccugacaggcuccgcauccgggugaauaaaauaagucugcaggacuaugaaggauuucauuacgauaaggagaaacuuagagaggcuucuauuagcgacugguugaggacuaucgccggcgaacugguccaguccuucggugccaucccccucgggauucuggugguacgaggagauugcgacuuagagacaugccgcauguauaucgaucggcugcaagaagaccuucagucagugagcucuggcucccagagaguucacuaccaagaucacgagaccaguuucccaagggcuuugagcgcacagcgucucucuccccgcugguguuuucuggacgaucggucccaggaacaucuacacuucgucauggagauuucacaggacgagauauuuauccuggauccugacaugguggugagucaaccagccgguacucccccuggcaugccggaucucgucguugaacaggcgagcgggauuucggacugguggaacccagcucugagaaagaggaugcuuuccgacucuggauugggcaugaucgcccccuauuacgaggauagcgaccugaaagauuuaucacauagucgagugcuccaguccccugugucuagcgaagaccacgcaauccugcaggccguaauugcuggggaucuuaugaagcugauagaguccuauaagaacggaggcucauugcucauccaagguccagaccauugcagccugcuacacuacgcagccaaaacagggaauggagaaauugucaaguacauccuggaucacggccccagugagcuccuggacauggcggauucugagaccggugaaacggcacuucauaaagccgcaugucagcggaaccgcgccgugugccaguugcugguugacgcuggcgccuccuuaagaaagaccgauagcaaagggaagacaccucaggagagggcacaacaggcuggagacccggaucucgccgcguaucuggaaucgcggcagaauuacaaggugauuggccacgaggaccuugagacugccgucuga

SEQ ID NO: 55267 - RNA, 3816 nt, Artificial Sequence
  derived and/or modified sequence opt3 from DGKK__Homo_sapiens__NP_001013764
auggacagaggcgccgcugcagcccaggggaccgcgcccccucaagauggagagcagccagcugaaagcccggagcccccuccacccuggccuccacccccuccaccgcccgccccuccacccgcaccuccacugcucuccgaagccucucccgagccgaucccugaacccugcccagagcuugcuccuggucccuguccagaggcaacaucagaaagugccacugagcuguacacggaacccaccccugagccagcuacagagccggccagcgaacccgcgccugagccagcaacugaacccgccccugagccagcuaccgaacccgccccggagccugcaccagagcccgcuacagaauccgccccugagcccaccccagaaccugcguuggagucugugcccgaaccagccccggaguuaacuccugaggucgcacccgaacuggcuccagagcccacaccugaaccaguuaccgagcuagcccccgaguucugcccugaagcugccccggaguuuaggccaucgcccgcaccuugucuccugcagugcccaguggacacgcgggaacgcggccuuaagacuucacccagcccuaguccgucccccucuccacgaaccccuaugagcuggucccguauuaaaaagauacugaaagaggggcccauguugaagaacuguaauucauucaaaagauggaagcucagguauuuucugguacagggacaaaagcuguacuucgcccaccauccagcuuuugcgcacuucgaaacaaucgaucucagucaggcaacuguggccgagagcucuugccggaacuuaugucauuccuuuugcgucauuaccccucagcgcaaaaucacacuggcugcccccaauagaaaggacauggaggaauggauuaacaucauaaaaaccauccagcaaggcgagauuuauaagaucccagcagccgaaaauaacccguuccuuguggguaugcacuguugguacucaagcuauagucauaggacgcagcacugcaauguuugucgggagucuauuccugcuuugucccgcgaugccaucauaugcgaagugugcaaagucaagagccaccgacugugugcacuaagagcgucgaaggacugcaaauggaacacucucucuauuacagaugaccugcuucugcccgcugaugaggugaauaugccacaucaguggguagaggggaacaugcccguuuccucacagugugccgugugccacgaaaguuguggaagcuaccaaagguugcaggacuuucggugccucugguguaauuccaccguccaugaugacugccgucgcagauucucuaaggaguguugcuuuaggagccaccggucaagugugaucccuccaacugcacuguccgaucccaaaggcgacggccaguuaguggucagcucugacuucuggaaccuggauuggucaagugccuguagcugcccucuccuuauuuuuaucaauuccaagucuggggaccaccaaggaaucguuuuccugcgaaaauucaagcaguauuugaacccgagucagguguuugaucuacugaaagguggcccagaagcugggcucagcauguucaagaauuuugcccgcuuccguauucugguaugcggaggcgacgguuccgugucauggguccuuagucugauagaugcauuuggguugcaugagaagugucagcucgcugugaucccccugggaacaggcaacgacuuagccaggguucugggcuggggagcguucuggaacaaaucuaagagcccucuagauauucucaaucggguggaacaagccuccguccgcauccuggacagauggucagugaugauaagggagacccccagacagacgccacuuuugaaaggacagguagagauggauguuccucgguuugaagcugcagccauucagcaccuggagagcgcugccaccgaacucaacaagauccugaaagcaaaguaccccacagagaugaucauugcgacucgauuccuuugcucugccguggaagacuuugucguggauaucgucaaggcuuggggucaaauuaaacagaauaacaccgccauaguguccguuauccugaagagugacuugauguacgacagacucagcgugcugauugauguauuagcagaggaggcugccgcaacaucugccgaaaaauccgcuacugaguaugcggacucaaguaaggccgauaggaaaccauucaucccucagaucgaccauauugcaaaguguaagcuggaacuagcuaccaaagcccagagccuccaaaagucgcugaaacuuauaaucuuucaggucgagcaggccuuggaugaggaaucccgccagacaauuucugugaagaauuucagcucaaccuuuuuccuggaggacgauccggaagacaucaaccaaacuucgccccggagaaggucccgccgaggcacgcucucuagcauuuccucacugaaaagcgaggauuuagacaaucugaaccuugaucacuugcauuucacaccagaaaguauccgguuuaaggagaagugcguuaugaauaacuacuucgggauaggacucgacgcuaaaaucucucuggauuuuaauacccguagagacgagcacccuggccaguauaacuccaggcuaaagaauaaaaugugguacggucugcucgggacuaaggaacugcuucagcgcagcuaucggaaauuggaggaaagagugcaccuggagugugacggcgaaaccauuucguuacccaaccuccaaggaaucgucgugcugaauauuacaucauacgcaggcgggaucaacuucuggggaucuaacaccgccacuacagaguaugaggcgccagcuauagaugacgguaaacuugaaguaguggccauuuuuggcaguguucagauggcaauguccaggaucauuaaucugcaucaccaucgaaucgcccagugccacgaggucaugauaacgaucgauggggaagaggggauuccuguccagguggacggcgaggcuuggauccaacgccccgguuugauuaagauccgguacaagaacgcagcccagaugcucaccagagauagggacuucgaaaauagcaugaagaugugggaguacaaacacacugaaauacaggcggcuccgcagccacaacuggauuuucaggacucucaggagagccuauccgaugaagaguaugcccagaugcaacaucuggcacgucucgccgagaaccugauuucaaaacuuaaugacuugaguaagauccaccagcaugugagcguucugauggggucugugaacgcuuccgccaauaucuuaaacgauauuuucuacggccaggacucaggaaaugaaaugggcgcagcuaguuguaucccuauugagacacucagccgcaacgaugccguggacguaaccuuuucccugaaggggcuuuaugacgauacaacugcguuccuggacgaaaaacuacuccggucugccgaggaugaaaccgcacugcaaucggcuuuggacgccaugaauaaggaguuuaagaaacugagcgagauagauuggaugaaccccaucuucgucccagaagagaagucauccgacacggauaguagaucuuuaaggcucaaaauuaaguuucccaaacugggaaagaagaaaguggaagaggaacgaaagccuaaaagcggucaguccguucagucauucaucggcaaucuuuggcaccggcgccauagagaggacgaggcugaaggggaugacccgcugacccccucuaggagccaguuguga

SEQ ID NO: 55268 - RNA, 2829 nt, Artificial Sequence
  derived and/or modified sequence opt3 from DGKQ__Homo_sapiens__NP_001338
auggccgcugcagccgagcccggcgcgagagcuuggcugggaggggguagcccuaggccaggcuccccggccugcucucccgugcucgggucaggaggccgggcacgcccugguccagggcccggaccuggcccagaacgagccggcguccgugcucccgggccugcagccgcuccaggacacaguuucagaaagguuacccuuacaaaaccgacuuuuugucaucugugcagcgacuucaucugggguuuggccggcuuuuuaugugaugugugcaacuucaugucccacgagaagugucugaaacauguaaggauucccugcacgucuguggcgccuucgcuaguccgggugccaguugcacacuguuuugggccccgcggacuccauaagagaaaauucugcgccguguguaggaagguccuggaagcuccugcccuucacugcgaggugugugaacugcacuugcauccagacugcguacccuuugcaugcucagauugucggcagugccaccaagacggccaucaggaucacgacacccaccaucaccauuggcgcgaggguaaucucccgagcggggcucgaugugagguuugcagaaagacauguggaaguuccgaugugcuggccggcgucaggugcgaaugguguggcgugcaggcgcacucucugugcagcgccgcacucgcuccugaguguggguucggacgguuacguucccuggugcuucccccagccugcguccgcuugcugccugguggcuuuucaaaaacucagaguuucagaauaguugaagcugccgagcccggggagggaggcgacggugcagaugggagcgccgcugugggcccaggaagggaaacccaagcgacacccgagucuggcaagcagacccuaaaaaucuuugacggggaugacgcaguacggcgaucccaguuccgccucgugacugucucaagacuggccggagcugaagaggugcuugaagccgcacugagggcccaucacauuccugaggauccaggucacuuggagcucugucggcugccgcccagcagucaggcuugcgacgccugggcaggcgggaaggcgggaucugcuguuaucuccgaagagggccgcagcccugguucgggggaagccacaccagaggcaugggugauuagagccuuacccagggcucaagaaguccugaaaaucuacccuggcuggcucaaggugggaguagccuauguuucugugcgugucaccccaaaguccacggcacggucagugguccuugaggugcugcccuugcuaggccgacaggcugagaguccggagagcuuucagcugguugagguggccauggggugcagacauguacagaggacuaugcucauggacgaacaaccucugcuugaucgccugcaggacauacggcagauguccgucagacaagugucucagaccagguucuacguugcggagagccgcgauguggccccacacgucucauuguucgugggaggucugcccccuggccugagucccgaagaguauuccagcuuacugcaugaggcuggggcaacaaaagccacuguagugucuguuucacacaucuacaguagccagggagcugucgugcuagacguggccuguuuugcagaagcggagcgacucuauaugcugcuuaaggauauggccguccggggccguuugcugaccgcucucguucugccagaccuucugcacgccaaauugccucccgauuccugcccacuccugguguucgugaacccgaagucugguggguuaaaaggcagagaccugcuauguucguuuaggaagcuccugaauccucaucagguauucgaucuuacaaacggaggccccuugccagggcugcaccucuuuagccaaguccccugcuuccgcgugcugguuuguggaggcgacgguaccguggggugggucuuaggagcacuggaagagacgcgguacagacuugcuugcccugagccauccguggccauuuugccccucggcacugguaaugaucugggcaggguucuacgauggggagcaggguauucaggcgaagacccuuuuagugugcugcucucuguagacgaggccgaugcuguccugauggaccgcuggacaauccuuuuggaugcgcaugaagccgggagcgcagagaacgacaccgcugaugccgaaccgccaaaaauugugcagauguccaauuacuguggaaucggcauagacgccgagcugucauuagauuuccaccaggcucgggaggaagaacccgguaaguuuacuagcagacuccauaacaaggggguguacgucaggguuggacugcagaaaauuucucacucccguagucuucacaagcaaauccgccuccagguggaacggcaggagguagaauugccuagcauugagggccucaucuucaucaauauuccaucuugggguuccggcgcagaccugugggggucagauagugacacaagauuugagaaacccaggauggaugacggacuacuggaaguggucggcgugaccgggguugugcauaugggacagguccaaggcggucuccgaagcgggauacggaucgcccagggaucguauuuccgcgugacgcugcuuaaggcgaccccuguucagguggauggcgagccguggguccaggcucccggucacaugauuaucuccgccgcaggcccaaaaguacauauguugagaaaggccaagcaaaaaccuaggcgggcugggacaacucgagacgcaagagccgacgcggcucccgccccagaaucugauccucgcuga

SEQ ID NO: 55269 - RNA, 3354 nt, Artificial Sequence
  derived and/or modified sequence opt3 from DGKZ__Homo_sapiens__NP_001099010
auggagaccuucuuuagaaggcacuuccggggcaaggugcccgggccuggagaaggucagcaacgcccaagcuccgucggccugccgacagggaaagcccgacguagaucucccgcuggacaggcaucaaguagccucgcccagaggcggcgcuccucugcgcagcuucaaggcugccuguugucgugugguguuagagcucaggggucaagcaggcggcgcaguuccacugugccuccaucuugcaacccccgauuuaucguagacaagguguuaacgccucagccaaccacagucggagcccagcugcuaggcgcaccccuccugcuuacuggccugguggggaugaaugaggaagagggaguucaagaagauguggucgccgaggcuagcuccgcaauucagccugguaccaaaacaccaggcccgcccccuccaagaggggcccagcccuugcucccucugccaagguaccugcggcgugcuucaagucaucucuuacccgccgacgcgguguaugaucacgcacuguggggacuucauggcuacuaucgcagauugagccagaggcggccgucuggucaacacccugggcccggaggccgacgcgccuccggcaccacugcugggacaaugcugccaaccagaguaaggccucuaucacggcgcagacagguugcccucaggcguaaggcagcuggaccccaggccuggagcgcgcugcuugccaaagcaauaacgaagaguggucugcaacauuuggcuccacccccuccaacuccgggcgcccccuguucugaguccgaacggcagauccgaagcaccguggacuggucggagucugcuacauacggggaacacauuugguucgagacuaacgucuccggagauuuuugcuaugugggcgagcaguacuguguggccagaaugcucaagucagucaguaggcgcaaaugcgcagccuguaagaucguugugcacaccccuugcauugaacagcuggagaaaaucaauuuccgguguaagcccagcuuuagagaauccgguucuaggaacguacgcgagcccacauucgugcgacaucacuggguccaucggcguagacaagacgggaaaugcaggcacuguggcaagggauuucagcagaaguucaccuuucacagcaaagaaauaguggcuaucucaugcaguuggugcaagcaggcguaucauuccaaaguuagcuguuucauguuacaacagauugaggagccuugcucucugggcgugcacgcagccgucgugaucccacccacguggauucuccgcgcucggagaccgcagaauacucuuaaggccagcaaaaagaaaaagagggcaaguuuuaagcgaaaaagcuccaagaaagggccugaagagggacgcuggcggccauucaucauaagacccacaccuucuccccugaugaagccauugcuaguauucguuaacccuaaaucggguggcaaucagggggccaagauuauccaaucauuucugugguaccucaacccccgucagguguucgaucugucccagggaggcccaaaggaagcucuugagauguacaggaaaguccauaaucugcgcauuuuggccugugguggggacggcaccgugggauggauccucucaacucuggaucaguuacggcugaagccgccucccccagucgcaauccuaccccucggcacagggaacgaccuggcgagaacccuuaauuggggagguggcuauacggaugaaccugugaguaaaauuuugucucacguugaggaggggaacgugguacaacuggacaggugggaucuccaugcugaaccaaaucccgaggccggaccugaagaccgagacgagggcgcaaccgaucggcugccgcuugacgucuuuaacaauuacuucagccuggguuuugaugcccacgugacauuggaguuccacgaaucccgcgaggcuaacccagaaaaguuuaacucaagauucaggaauaaaauguuuuaugccgggacugcauucagcgacuuucucauggggucuuccaaggaucuggcuaagcauauacggguugugugcgacggaauggauuuaacccccaaaauccaggaccugaagccucagugugucguguuccuaaacauuccacgauacugcgccggcacaaugcccugggggcacccuggagagcaucacgauuuugaaccgcaaagacacgacgauggcuaucucgagguaaucgguuucacuaugaccagucuggcggcccuucaggugggcggacauggcgagcgcuugacacaguguagggaaguuguccugaccacuagcaaagcuauacccguccagguggacggugagccaugcaagcucgcagccucucguauucggaucgcucugagaaaucaagccacgauggugcagaaagcaaagaggcgcuccgcggccccuuuacacucagaccagcagcccguuccagaacaacugcgaauccaggugaguagagugagcaugcaugauuacgaggcacuucacuaugacaaggaacaguugaaagaggccucgguaccucucggcacagucgugguucccggggauuccgaccuggagcuaugucgggcacauauugaaaggcugcagcaagagccagauggagcuggcgccaagucuccgaccugccagaaacucagcccuaagugguguuuccuggacgcaacuaccgccucacgcuuuuaccguaucgauagagcucaggaacaccuuaacuacgugacagagauugcgcaagacgaaauauauaucuuggaucccgagcuguuaggggccagugcacggccagaccuccccaccccuacuuccccacugcccacaucuccuugcagcccgacgccaaggucccuucagggagaugcugccccaccucagggcgaggaacugauugaggccgcuaaacgcaaugacuucugcaaguugcaggaacuccaccgagcugguggggaucugaugcauagagacgagcaaucacggacccuacugcaccaugccgucagcacuggaaguaaagacgugguuagguaccuccuggaucacgcgcccccagaaauccuugacgcuguggaggagaacggcgaaacauguuugcaucaggccgcagcccugggucagcgcaccaucugccacuauauuguagaggcuggcgcaucuuuaaugaagacagaucagcaaggggacacuccuagacagagggccgaaaaggcgcaggauaccgagcucgcugccuaccuggagaaucggcagcacuaucaaaugauacagcgugaagaccaggagacggcagucuga

SEQ ID NO: 55270 - RNA, 834 nt, Artificial Sequence
  derived and/or modified sequence opt3 from DGUOK__Homo_sapiens__NP_550438
auggccgcuggcagacuguuccucagcaggcuucgggcacccuuuuccucuauggccaagucaccucuggagggggugaguagcucccgcggauugcacgcgggucgaggcccacguagauuaucuaucgaagggaacauugcugucggaaaaucgaccuucguuaagcugcuaacaaaaacuuacccggaguggcauguggccacggaacccguagcaaccuggcagaauauacaagccgcuggcacacagaaggcaugcacugcccagucacucgguaaccugcuugacaugauguauagggagccugcucgguggagcuacaccuuucagacauucaguuuucugucccgcuugaaagugcaacucgaaccauuccccgagaagcugcugcaggccagaaagccuguccagaucuuugagaggucuguguauagcgaucgguacauuuucgcgaaaaaucucuuugaaaacggguccuuaucagacaucgaguggcacauuuaucaggauuggcauaguuuccugcuuugggaauuugcaagccgcaucaccuugcacggauucauauaccugcaagccucuccacagguuugucuaaagcgacucuaucagagagcuagggaggaggaaaaaggcaucgagcuggccuaccuugaacagcugcauggccaacacgaggcaugguugauucacaagacuacaaaacuccauuuugaagcucugaugaauauccccguguuaguccuggacgugaacgaugacuucuccgaggagguaaccaagcaggaagaucucaugcgggagguuaauacguucgugaagaaccuuuga

SEQ ID NO: 55271 - RNA, 1428 nt, Artificial Sequence
  derived and/or modified sequence opt3 from DHCR7__Homo_sapiens__NP_001157289
auggccgcuaagagccagcccaacaucccuaaagcaaagucccuggacggcgugaccaaugauagaacagccucucaagggcaguggggaagggcgugggaggucgacugguucucacucgcuaguguuauuuuucuucuguuguucgccccauuuauaguguacuauuucaucauggcaugcgaucaguacagcugugccuuaacugguccgguaguggacauugucacgggccacgcucggcuguccgauaucugggcaaaaacacccccuauuacccgcaaggccgcucagcuauauacucucugggugaccuuucaaguucugcuuuacacaucucugccagacuucugccauaaauuuuugcccggguaugugggaggcauccaggaaggugccgucaccccugcgggggugguaaacaaguaccagauaaauggacuccaggcauggcugcugacucaccucuuaugguucgccaacgcucaucugcuuucgugguuuucaccaacaaucauuuucgauaauuggauccccuugcuguggugugccaacauucuaggcuaugcaguuagcaccuuugcuauggugaagggcuacuucuuuccuacgagugcccgagacugcaaauucacugggaauuucuuuuacaacuauaugaugggaaucgaguucaauccacguauagguaagugguuugauuucaaacucuuuuucaacggcagaccggggauugucgcguggacccugaucaaucuuuccuuugccgcaaagcaaagggaacugcacucucaugugacaaacgcuaugguguuggucaauguucuccaggccauuuacgugaucgacuucuuuuggaacgagacuugguaucugaaaaccaucgauauuugucacgaccacuucggaugguacuuaggcuggggugauugcguauggcugcccuaucucuacacacuucaggggcuguauuugguguaccauccuguccagcuaagcaccccacacgcugugggaguucugcuccugggccuugugggcuacuauauauuucgggucgccaaucaucaaaaggaccuguuccgcagaacggacgggagguguuugaucuggggacggaagcccaaagugauugaaugcuccuacacuucagcagauggucagcgccaccacaguaagcuccugguaagcggcuuuuggggaguugcccgacauuucaacuaugugggggacuuaaugggcucucuggcuuacugucuagcgugcggugggggccaccuccugccuuauuucuacaucauauauauggcaauucuuuugacacauagaugucugagggaugagcaccggugcgccuccaaauacggacgugacugggagcgcuacaccgcugccgucccauauagacuccugcccggcaucuuuuga

SEQ ID NO: 55272 - RNA, 1005 nt, Artificial Sequence
  derived and/or modified sequence opt3 from DHDH__Homo_sapiens__NP_055290
auggcccugagauggggcaucgugagcgucgggcucauuuccucugacuucaccgcuguucuucagacacugcccaggucagagcaccaagugguagcaguggccgcgcgggauuugagucgcgcuaaggaauuugcccagaaacaugacauaccuaaggcauacggaagcuaugaggaauuagccaaagauccauccgucgagguggcuuacaucgguacucagcacccgcagcauaaggcagccguuaugcugugccuagcugccggcaaagcggugcucugugaaaagcccacgggggucaacgcagccgaggugcgagagaugguagcugaagcccguucuagagcacuguuccuuauggaggcuauuuggaccagguuuuucccugccucggaagcgcugcggucaguuuuggcccaaggaacacucggcgaccugcgcguggcaagagcugaguuugguaagaaucugauccacgucccaagggccguggaucgggcucaggccgggggagcacucuuagacauuggcaucuauugcgugcaguucacuagcauggucuuuggcgggcagaaacccgagaagauaaguguugugggacgccgacaugaaaccgguguagaugacacagugaccguccugcuucaauacccuggcgaggugcacggguccuucacuuguucuaucacaguucaguugagcaacaccgccuccgugucaggaacgaaaggcaugguccagcugcuaaauccaugcuggugucccacugaacucgugguaaagggugagcacaaagaauuuccucugccaccgguucccaaggauugcaacuucgacaauggggcuggaaugaguuaugaggcgaagcaugugugggagugucuuagaaaaggcaugaaggaaagcccugucauuccacugucugaguccgaauugcucgcagauauccuggaggaagugaggaaagccauuggcgucaccuuuccccaggacaagcgguga

SEQ ID NO: 55273 - RNA, 564 nt, Artificial Sequence
  derived and/or modified sequence opt3 from DHFR__Homo_sapiens__NP_000782
auggugggcagccugaacugcaucgucgccguuucccagaauauggggauuggaaagaacggugaccuccccuggccuccacuuagaaaugaguucagguacuuucaacggaugaccacaacuucuucaguggaaggcaaacagaaccugguaauaauggggaagaaaacgugguucaguaucccggagaagaaucgccccuugaaaggacgaauuaacuuagugcugagccgugaacuaaaggagccuccacagggcgcucacuuucucuccagaucucuggaugacgcacuuaagcugaccgaacagcccgaguuggccaauaaagucgauaugguguggaucguuggugggucgucaguguauaaggaggcgaugaaccauccuggacaccucaaacuguucgucacaaggauuaugcaagacuuugaaagcgauacuuucuuuccagagaucgaccuggaaaaguacaaacucuuacccgaguauccuggcgugcugagugauguacaggaggaaaagggcauaaaguacaaauucgagguuuaugaaaagaaugacuga

SEQ ID NO: 55274 - RNA, 564 nt, Artificial Sequence
  derived and/or modified sequence opt3 from DHFRL1__Homo_sapiens__NP_001182572
auguuccugcuccuuaacugcaucguggccgucagccagaauaugggcauugggaagaacggagaccugcccagaccuccauugaggaaugaguuucgguacuuccaacgcaugacuacaacuuccucuguugaagguaaacagaacuuagugauaaugggccgaaagacgugguuuucaaucccggagaaaaaucguccccugaaggauagaauuaaccuaguacucaguagggaacugaaagagccuccacagggggcucacuuccuugcacggagccuggacgaugccuugaagcucaccgaacgccccgagcuggcgaauaagguggacaugaucuggauugucggaggcuccucuguguauaaagaggcuaugaaccaucugggucaccucaaguuauuuguuacaagaaucaugcaggauuucgaaucggacaccuuuuucucagagauagaucuggaaaaauacaaacuuuugccugaguauccaggggugcugagcgacguccaagagggaaagcauaucaaguacaaguuugaagugugugagaaagaugacuga

SEQ ID NO: 55275 - RNA, 1191 nt, Artificial Sequence
  derived and/or modified sequence opt3 from DHH__Homo_sapiens__NP_066382
auggcccugcucaccaaccuucugcccuugugcuguuuagcucugcuagcacucccugcccagagcugcggcccagggagaggaccgguggguaggcggcgcuacgcgcgaaagcaacuggucccccuucuguauaaacaguucguuccuggcgugccagagcguacauugggggcuuccggacccgccgaaggcagaguagcaagggguucugagcgguuucgcgaccucgugccuaauuacaacccagauaucauuuucaaggacgaagaaaauucaggggccgauagacugaugacugagagguguaaagagcgggucaacgcucuggcaauagccgugaugaauauguggcccggaguucgccuccgagugacggagggcugggacgaagauggccaccaugcucaggacaguuuacacuaugaggggagagcccuggauaucaccacaagcgacagggaucggaacaaguacggacuuuuggcgcgucuggcagucgaagccgguuuugacuggguguauuacgagucccgcaaucauguacacguuucugugaaagcugauaacucgcuagccgucagagcaggcgggugcuucccuggaaaugcuacugugaggcucuggucaggcgagcggaagggucugcgagaacuucaucgcggggacugggugcuggccgcggaugccagcggaagagucguuccaaccccgguguugcucuuucuggacagggacuuacagcggcgcgcaaguuucguagcuguggagacagaauggcccccuagaaagcugcuccuuaccccauggcaccuggucuuugccgcuaggggccccgccccugcaccaggcgauuucgcccccguguuugcucgucgguugcgagcgggggacuccguucuagcaccgggaggugaugcccugagaccugcuaggguggcccgcgucgcacgggaggaagccgugggcguauucgcuccccucacugcccacgggacacugcuuguuaacgacgugcuggcaucuuguuaugcggucuuggagagccaucaaugggcucacagagccuuugcaccacucaggcuguuacaugcccugggagcucuacucccuggcggugccgugcagcccaccgggaugcacugguacucccgccugcuuuaccgauuggcagaggaacugcucggcuga

SEQ ID NO: 55276 - RNA, 1188 nt, Artificial Sequence
  derived and/or modified sequence opt3 from DHODH__Homo_sapiens__NP_001352
auggccuggagacaccugaagaaaagggcucaggacgcagugaucauucucggcgggggaggucuucuguucgccagcuacuugauggcgaccggcgaugagcgguuuuaugcugaacauuuaaugcccacacugcaagggcuacucgacccugaguccgcccaccgccuggcaguccgauucacuucucuuggacuguugccacgugccagauuucaggauucagacaugcucgaaguuagggugcugggccauaaguuccggaacccgguagguauagcugcaggguuugauaaacacggagaggccguggacggccuguacaagaugggcuucggguuugucgaaaucggaagugugacgcccaaaccucaggaggguaauccacgccccagaguuuucaggcucccugaggaucaggcugugauuaaccgguauggcuuuaauagccauggguuauccgucguggaacaccgccugcgagccagacaacagaagcaggcgaaacuuaccgaggacggauugccacugggcguaaaccuagguaagaauaagacaucuguugaugcagccgaagacuacgcugagggggugaggguccucggaccccuggccgauuaucuuguggugaacgucucgucaccuaauacugcaggccugcggagcuugcagggcaaagcugagcuccgucgccuguuaaccaagguucugcaagaaagagacgggcucaggcgggugcaccgaccagccguacuugugaaaaucgcgccggaucugacaagucaggacaaggaggacauugccuccgucgugaaggaauugggaaucgauggucuaauaguuaccaacacuacagugucucgccccgcaggccugcagggggcucucagaagcgagaccggaggccuguccgguaaaccucuuagggaccugucaacgcagacuauccgggaaauguacgccuugacccaagggcgcgucccaauuaucggcgugggaggcguaaguagcgggcaggaugcucucgagaagauuagagccggagcaucucugguucaguuauauacagcccugacuuucuggggucccccuguggucggcaaagugaagagggagcuagaagcucuccugaaagagcaaggguuuggaggcgucaccgacgcgaucggugcagaucaucgucgguga

SEQ ID NO: 55277 - RNA, 984 nt, Artificial Sequence
  derived and/or modified sequence opt3 from DHPS__Homo_sapiens__NP_001193903
augcccaucauuccugccuucugggaggcugaagcaggcgggagcagagaggaagaguuugaaaccucccuggccaacaugauagagaagaaacucgagccacuuucucaggacgaagaucaacacgcggaccugacacagucaaggcggccguugacgaguugcacuaucuucuuaggauacaccagcaaucugauuuccucugguauccgcgagacaauucgauaucuagugcagcauaacauggucgauguucucgugacuaccgcuggcgggguagaagaggaccugaucaagugucuugcccccacauaccugggagaguuuucguugcguggcaaagaacucagagagaaugguauaaacaggaucgggaaucugcuggugccuaacgaaaauuauugcaaguucgaggauuggcucaugccaauuuuagaccagauggucauggaacaaaacaccgagggagugaaauggacucccucaaagaugaucgcacggcugggcaaggagauuaauaacccugaaagcguuuacuauugggcccagaaaaaucacaucccaguguuuagucccgcucuuacagauggcuccuugggggacaugauauucuuucauucuuacaagaacccuggacugguccuagauauuguggaggaccuccgccugaucaauacccaggcaauuuucgccaaauguacggguaugaucauccuuggcgggggaguaguuaagcaccauauugcuaacgccaaucugaugagaaacggcgcggauuaugcaguguacauaaacacugcccaggaauuugacgguagcgauuccggggcuaggccagacgaggccgucucauggggaaaaauccggguggacgcacaaccggugaaggucuacgcugaugccaguuugguuuucccccuccugguggcggaaaccuuugcccagaagauggacgcauucaugcacgagaaaaaugaggauuga

SEQ ID NO: 55278 - RNA, 783 nt, Artificial Sequence
  derived and/or modified sequence opt3 from DHRS11__Homo_sapiens__NP_077284
auggccagacccggcauggagagguggcgggaccgccuggcucucgugaccggggcaagcggagguaucggcgccgcggucgcucgagcccuuguucagcaagggcugaaggugguaggaugcgcacguacagugggcaacauugaagaguuggccgcugaauguaaauccgcagguuacccugggacuuuaauaccauauagaugcgaucugucuaaugaggaagacauccuaucaauguucagugccauuaggagccagcacuccggagucgauaucuguauuaacaaugcuggccucgcccggccggacacgcugcuuucuggcucgaccucaggguggaaggauauguuuaacgugaauguucuggcguugagcaucugcacacgcgaggcauaccagaguaugaaagagagaaacguggacgauggacauauaaucaauauuaacuccaugucuggucacaggguccucccccugagcgugacucauuucuauuccgccaccaaguacgcuguaacagcccugaccgaaggccuccggcaggaguuacgcgaagcacaaacucacauccgagcuacauguauuucaccugggguuguggagacccaguuugccuucaaacugcaugacaaggauccagagaaggcggccgcaacguaugaacagaugaaaugccuuaagcccgaggacgucgcugaagccgugaucuacguguugaguacuccugcucacauacagauuggagauauccaaaugagaccaaccgagcaggucacauga

SEQ ID NO: 55279 - RNA, 843 nt, Artificial Sequence
  derived and/or modified sequence opt3 from DHRS2__Homo_sapiens__NP_005785
augcugagcgccguggcuagaggcuaccaggggugguuccaccccugcgcaaggcucuccguccggaugucuucaaccggaaucgaccgcaaggguguucuugccaaccgaguggcgguagugacaggcaguacuagcgggauuggauuugcuauagcccguagacuggcaagggauggcgcccaugucgugaucuccucucggaaacaacagaauguugaccgcgcuauggcaaaguugcagggugagggguuaucgguggccggaauugucugucacgugggcaaagcugaagauagagagcagcugguagccaaggcgcuagaacauugcggcgggguugacuuccucguguguucagcaggagucaacccucugguggguagcacgcuuggcaccagugagcaaaucugggauaaaauucuguccgugaaugucaagucuccagccuugcuccugagccagcugcucccguauauggaaaacaggcgcggggcuguuaucuuaguguccucaauagccgcauacaaucccguaguggcucugggagucuauaacgugaguaagacagcccuuuugggccugacucggacccuagcgcucgagcuggccccuaaagacauccgaguuaauugcguggucccagguauuaucaagacagauuuuagcaaaguguuccacgggaacgagucucuuuggaagaauuuuaaagaacaucaccagcugcagagaauuggagaguccgaagacugugcaggcaucguaucauucuugugcagccccgaugcuaguuacguuaacggcgagaauauagccguggcuggguauucuaccaggcucuga

SEQ ID NO: 55280 - RNA, 567 nt, Artificial Sequence
  derived and/or modified sequence opt3 from DHRS4__Homo_sapiens__NP_001269916
augcacaaggccggccugcucgggcuuugcgcuagagcauggaacagcgugaggauggccuccucuggaaugacccggcgcgacccccuggcgaauaaagucgcuuugguuacagccucaacugaugguaucggcuucgcaauugcccgacguuuagcucaggacggggcacaugugguagugaguagcagaaagcaacagaacgucgaucaggccguggcuacgcugcagggagagggccuauccguuaccgguacagugugucacgucgggaaagccgaagacagggagcggcucguggcgacugcaguaaagcugcauggaggcauagauauccuuguuucuaaugccgcugugaacccauuuuucggcucgauuauggacgucaccgaagaggugugggauaaacgcagacugucaggggacaggguguuucacagcaguuugcaauccaucucuagccucgauggacaggguaagcggggcaagcaugaacgcaauccugccgacaaaaaggucagacgagcaagggggcugugcuggcaccggguuuucccggugcuguga

SEQ ID NO: 55281 - RNA, 936 nt, Artificial Sequence
  derived and/or modified sequence opt3 from DHRS7C__Homo_sapiens__NP_001099041
augggcgugauggccaugcugaugcucccccuucuguuguuagggaucagcggacugcuauucauuuaccaggaggucuccagacucuggucuaagucagcuguucaaaacaaagugguagugauaaccgacgcaaucaguggucugggcaaggaaugcgccagggucuuucacacagggggagcgcggcuugugcuguguggcaaaaauugggagcgcuuggaaaaccucuaugaugcucugauuagcguugccgacccuuccaagacuuucacgccaaaacuggugcucuuagaucugucugacaucucgugcgucccggauguggcaaaggagguacuugacuguuacgguugcguugauauuuugaucaauaacgccucagugaaggucaaagggcccgcucauaagauaagccuggaacuagacaaaaagaucauggaugcaaauuauuuuggaccuauuacccucacaaaagcccugcuuccaaacaugaucagucgacguacuggccagauugugcuggugaauaacauccagggcaaguucgggauacccuuuagaaccacauacgcugccuccaagcacgcggcauugggauucuuugacugucucagggccgaggucgaggaauaugauguugugauuucuaccguaagcccuacuuucauccgguccuaccauguguauccagagcaggguaauugggaggcuucaauuuggaaauuuuucuuucgcaagcugacauacggcguccaccccguggaaguugccgaggaagugaugagaaccgucaggcggaaaaagcaagagguguucauggcaaacccuaucccaaaagcugccguauacguucgcacguuuuucccggaguucuuuuucgcgguggucgccugcggggugaaggaaaaauuaaauguccccgaagagggauga

SEQ ID NO: 55282 - RNA, 1140 nt, Artificial Sequence
  derived and/or modified sequence opt3 from DHRS9__Homo_sapiens__NP_001276692
augcccgagggcagaagccacugcgccuguuccaucaccucucugacacuccuugugucacugacuagggucacguuggacauuuuacagaagcuggauccuccacaaccggcucauuggcggcaccaucuacucguucuguacaaaaaggggguguaucuuagucacaccggagguaaaaugcuguucuggguauugggccuccugauacugugcggguuucucuggacacgcaagggaaaauuaaagaucgaagacauuacugauaaguacaucuucauuaccggcugugacagcgguuuugggaaccuggcagcccgaacauucgauaaaaagggauuucaugugaucgcggcuugccuuaccgaguccggcucuacugccuugaaagcagaaacaucggagcgucugagaaccguccuacucgacgugacggaucccgaaaauguuaagaggacugcccagugggugaaaaaccaggucggcgagaaggggcuguggggacuuauaaauaacgcuggugugccuggcguacuggcaccaaccgacugguugacacucgaggauuaucgggaacccaucgagguuaaucuguucggguuaauuucagugacucugaacaugcucccucuugucaagaaagcccagggacgcgugaucaaugugagcagugucggcgguagacuggcuauuguugggggaggcuacaccccauccaaguaugccguggaaggcuuuaacgacucuuugaggcgggauaugaaagcguucgggguacacgugagcuguaucgagcccggacuauuuaagacaaaucuggcagacccugucaaagugauagagaagaaacucgccauuugggaacaacuguccccagauaucaagcagcaguacggugagggcuauauugaaaagucacuugacaaacugaaggggaacaaaaguuacguuaauauggacuugagcccgguggucgagugcauggaucacgcucucaccucucuguuccccaagacgcauuacgccgcaggaaaagacgcuaagaucuuuuggaucccuuuaucccacaugccagccgcgcugcaggauuuccuacuccugaagcaaaaagccgaacuugcaaaccccaaggcuguguga

SEQ ID NO: 55283 - RNA, 2760 nt, Artificial Sequence
  derived and/or modified sequence opt3 from DHTKD1__Homo_sapiens__NP_061176
auggccagcgcuaccgcagccgcggcuagaaggggccuggggcgggcccucccccuucuguggcgcggauaccagacagagcgagguguguauggcuaccguccuagaaagccagaauccagggagccgcaaggggcauuggaacggcccccugucgaccacggauuagcccgccugguuacuguguauugcgagcauggccacaaagcugcaaagaucaacccacuauucacgggucaggcccuccuggaaaauguacccgagauucaggcucuugugcagacccugcaagggccuuuucauacagccggauugcucaacaugggcaaagaggaagcgucucuggaggaaguccugguguaccucaaucagauauauuguggccagaucucaauugagaccagucaguuacaaagccaggaugagaaggacugguucgcaaaaagauuugaagaacugcagaaggaaacuuucacaaccgaggaaaggaagcaccuuuccaaauugaugcuggagucucaggaguuugaucauuuccuagccacuaaguuuucgacaguuaaacgguacgggggagaaggugcugagucaaugaugggcuucuuucacgaacuccugaagaugagcgccuauagugggaucaccgacgugauuaucggaaugccacaccgcggccgacuuaaccuguugacgggucuccugcaauuucccccugaguuaauguucagaaaaaugagggggcuguccgaguucccagagaauuuuucugcaacuggagauguccucagccaucuuaccuccucaguggaccuguacuucggcgcucaccauccguugcacguaacaaugcuacccaacccuagucaccuggaggccguuaauccaguggcggucggcaagacucgggggcgucagcagagccgccaagauggagacuacucucccgauaacuccgcccagccuggugacagagugauaugccuccaggugcauggcgaugcaucauucugugggcagggaaucgucccagaaaccuuuacacugagcaaucuuccccacuucaggauuggcgguaguguucaucugaucgugaacaaucaauugggguauaccacgccggcugagcggggccgaucuucccucuacugcagcgacauuggaaagcugguaggcugugccaucauacacgugaacggggauucgccugaagaggucgugcgcgcuacuagauuagccuuugaauaucagaggcaguuccggaaagacguuauuaucgaccugcuaugcuaccgccaguggggacauaaugagcucgaugagcccuuuuauacaaacccaauuauguacaagaucaucagagcaaggaaaucuauuccugacaccuaugccgaacaccugauagcugguggccuuaugacucaagaggaaguguccgagaucaagucaaguuacuacgcgaaauugaaugaucaccugaacaacauggcacauuaucgucccccagcccucaaucugcaggcucacuggcaggggcuugcccagcccgaggcacaaauuacaaccuggagcacgggagucccucuggacuugcuccgguucgugggcaugaaguccguagaaguuccacgagagcugcagaugcauucucacuuacugaaaacccacgugcagagcagaauggaaaagaugauggaugguaucaagcuagacugggccacagcugaggcccucgcacuggggucacuuuuggcgcagggcuuuaacgucaggcugaguggacaagaugugggccgcgggacuuucucccagcggcaugcuauagucgugugucaggaaaccgacgauacauacauuccgcucaaucacauggaccccaaccaaaaaggauuucuggagguuagcaauucuccuuuaucagaggaagccgugcuggguuucgaguauggcaugaguaucgaaagcccaaagcuguugccccucugggaggcacaguuuggggauuucuuuaacggagcccagaucauuuucgacacuuucaucuccggcggugaagcuaaauggcugcuacagucugggauuguaauacugcucccucauggcuacgacggagccggcccagaucacucgagcugcagaaucgagagguuucugcaaaugugugacuccgcagaggaaggggucgauggagacaccgugaauauguucguugugcaucccacaaccccggcucaguauuuucaccuuuugcgccgacagaugguccggaacuuccguaagccucugauuguggccucaccaaaaauguuacucagacugcccgcggccguaaguacucuucaggagauggcuccuggcacgacauuuaaucccgugaucggugauucuagcguugacccaaagaaggucaaaacccugguguucugcuccgggaagcacuuuuacucauuggugaaacaaagggaaagccucggagcaaagaaacaugauuucgccaucauucgcgucgaggaacuguguccuuuuccccuagacucucugcagcaggagauguccaaguauaagcacguuaaagaucauauauggagucaggaggaaccacaaaacaugggcccguggagcuucgugucuccucgguuugagaagcagcucgcuugcaaacugagacuuguggguaggcccccauugcccguaccugccgucggcaucgggacugugcaccuucaucagcacgaagacauuuuagcaaagaccuucgcguga

SEQ ID NO: 55284 - RNA, 2388 nt, Artificial Sequence
  derived and/or modified sequence opt3 from DHX15__Homo_sapiens__NP_001349
augagcaagagacacaggcuggaccucggcgaggauuaccccuccgggaaaaagcgggccggaaccgacgguaaagaucgcgaccgagaucgugacagagaagauaggucuaaggaccgggaucgcgagagagacaggggcgaucgggaacgcgagcgagaaaaagagaaggagaaggaacuuagagcuucaacaaacgcaaugcugaucagugccggguugccuccauuaaaagcgagccauuccgcucacucuacucauucggcccacucaacgcauagcacccacagugcacacuccacacaugccggacacgcuggccauacuucucugccgcagugcauuaaucccuucaccaaccuaccucacacaccaagguauuacgacauacucaagaaacggcugcaacuucccgugugggaguauaaggaucguuuuaccgacauccugguccgccaccagagcuucguuuuggugggugaaacuggguccggaaaaacaacccagauuccucagugguguguagaguacaugagaucacucccaggccccaagaggggcguggcaugcacgcaaccucggcgagucgccgcuaugaguguggcccagcgcguugcggacgagauggaugugaugcuggggcaggaagucggauauagcaucagauuugaggacuguucuuccgcaaagacuauucugaaauacaugaccgaugguaugcucuuaagggaagccaugaaugacccacugcuugagcgguauggcgugaucauauuggaugaagcucaugagcgcacacuggccacugacauccuaauggggguacucaaggagguugugagacagaggucagaucugaaagucauugugaugagcgcaacccuugacgcuggaaaguuccaaaucuacuuugauaacugcccgcuguugacaauucccggccguacccacccuguggaaaucuucuacacgccagagcccgaacgggacuaucucgaggccgcgauacgaacugucauucagauccauaugugugaagaggaggaaggugaucuguuacuguuucucacagggcaggaggaaauugacgaggccugcaaaagaaucaagagggaaguugacgaucuuggaccugaggugggcgacaucaaaauuauaccacuguacaguaccuugcccccgcagcaacagcagcgcaucuucgagccucccccaccuaagaagcaaaauggcgcaauugggcggaaaguaguggucucuacuaacaucgcugaaacaucccuaaccauagauggagugguuuuugugauugaccccgguuucgccaagcagaaagucuauaauccaagaaucaggguggagagccugcucguaacggcuaucucgaaggccucugcacagcagcgcgccggccgagcugggcggacccgucccggaaaauguuuuagacuguacacagaaaaggcguauaagacugagaugcaagauaacaccuacccugagauucuuagguccaaucugggcucaguuguguugcagcucaaaaagcuggguaucgacgauuuaguccacuucgacuuuauggauccaccggcacccgaaacacugaugcgcgcccuagagcuccugaacuaucuugcugccuugaaugacgauggggaccugacugaacucggcaguaugauggcagaguucccucuggauccacagcuugccaaaauggugauugcuagcugcgacuacaacuguuccaaugaaguccugucuauaaccgccauguugagcgugccccagugcuucguucggccuacagaggcaaagaaagcggcugacgaggccaagaugagauuugcacauaucgauggagaccaccucacccuguuaaacguguaccacgccuucaagcaaaaucaugaaucaguacagugguguuaugauaacuuuauuaacuacaggagucugauguccgcugacaauguccgacagcagcuaagccgcaucauggaucgguucaaccucccaagaaggucuacugacuuuacgucacgugauuauuacaucaauauucgcaaagcccuggugacaggcuauuucaugcaaguugcacaccuugagcggaccgggcauuacuugacugugaaggacaaccaggucgugcagcugcaccccaguaccguacucgaucacaaaccggaaugggugcuguauaaugaguuuguuuuaacaaccaagaacuacauaagaacuugcacagacaucaaaccugaauggcuggucaagauugcuccacaguacuaugauaugagcaauuucccccaaugcgaggccaagaggcagcuugaccgaaucauugcgaaauugcaguccaaggaguacucucaauauuga

SEQ ID NO: 55285 - RNA, 2946 nt, Artificial Sequence
  derived and/or modified sequence opt3 from DHX16__Homo_sapiens__NP_001157711
augagcgaggaccccagaggcccuaaggugccaaggaaagccgucguugaaaagccggcucgggcagccgagcgcgaagcgcgagcucugcucgagaaaaaccguuccuacagacuucuggaagauucugaggagucaagugaagagaccgugagcagggccggguccucuuugcagaagaaacggaagaagcgcaaacacuuaagaaagaaaagggaagaggaggaagaggaagaggcaucggaaaagggaaagaagaagacagguggcucaaaacaacagacugagaagcccgagagcgaagacgagugggaacggacggagcgcgaacgacugcaggaucuagaggagagagacgccuucgcugaaaggguacggcagcgugauaaagaccgcaccagaaaugugcucgagaggagugauaagaaagcauaugaagaggcccaaaagcggcugaaaauggcugaagaggaccgaaaggccauggucccugagcuucgcaagaaauccagaagggaauaccuggcgaagcgggagcgcgaaaaauuggaggaucucgaggcagaacuggccgacgaggaauuucuguucggggauguggagcucucuagacaugaaaggcaggaguuaaaguauaaacgucggguucgagaccuggcuagagaguacagggccgcaggagaacaggagaaacuugaagcuacaaaccgcuaucacaugccaaaggagacucggggccagcccgccagagcgguggauuuggucgaagaggagagcggugccccuggggaggaacaaaggcgcugggaagaggcacgacugggagcugccucccuaaaauuuggcgcucgggacgccgcaucacaggaaccaaaguaccagcucgugcuggaggaggaagagaccaucgaauuuguacgugccacacagcuucaaggcgacgaggagcccagugcuccuccaaccagcacucaggcgcagcaaaaagaaucuauucaggcaguuagaaggucccugccgguguuucccuuccgcgaggaauugcucgccgcuauagccaaucaucagguccugaucauugagggggaaacaggaucagguaagaccacgcagaucccucaauauuuauuugaggagggcuacacuaacaaagggaugaagauugcaugcacccagccacggagaguggccgcuaugagcguggccgcaagggucgcgcgagaaaugggaguuaagcugggcaaugagguggguuacaguauccgcuucgaagauuguacaucugagcggacuguacucagauauaugaccgacgggaugcuucugagggaauuuuuguccgagcccgaucuagcuagcuacucgguggucaugguggacgaggcccacgaacguacacugcauaccgauauacucuucggacugaucaaagacguugcacgcuuucggccugagcuuaaggugcuggucgccucugcuacgauggauacugccagauucuccacauuuuucgacgaugcaccaguguucaggauucccggccgacgguuuccgguagacaucuucuauaccaaagcuccugaagccgauuacuuggaggcgugcguugugucaguccuccagauucacgugacucagcccccaggcgacauccuggucuuuuuaacagggcaagaagagauagaggccgcuugugaaaugcugcaggaccgcugcagaaggcuaggaaguaagauucgggagcuccuggugcuuccuaucuaugcaaacuugcccagcgauaugcaggcccgaauuuuccagccaacgcccccuggugcuagaaaaguugugguagccaccaauaucgcagaaaccucccugacaaucgagggcauuauauacguccucgacccaggguuuuguaagcaaaagucuuauaacccgcgcacuggaauggagagccugaccgugacacccugcucaaaagcgagugccaaucagagggcuggccgugccggucggguugcagcugggaaguguuucagacuuuacacugccugggcauaccagcacgaacuggaggaaaccacagugccugagauccagaggaccuccuugggcaacgucgugcuccuguuaaaaagccugggcauucaugaucuaaugcacuuugacuuccucgauccacccccuuaugaaacucugcuuuuggcccuggagcaacucuacgcucugggagcguuaaaucaucugggggagcuuacgacaucuggacgcaagauggccgaauugccaguagaccccaugcucucaaaaaugauccuggcaagugagaaguauagcugcuccgaagagauacuaaccguggcugccaugcugucuguuaacaauucgauuuucuaccgaccgaaagauaaggucgugcacgccgacaacgcuagagugaauuucuuucucccugguggcgaucaccugguccuuuugaacguuuauacucagugggcagaaagcggguacuccucacagugguguuaugagaacuucgugcaauuucggaguaugaggcgcgcccgugacgugagagagcagcuggaaggauuacucgagcggguagaagucggccugucuagcugccagggugauuacaucagggugcgcaaggcgaucaccgcuggguacuucuaucauacagcccgacuuaccagauccggcuaccggacuguuaaacagcaacagacaguguucauucacccaaauucaagccuguuugagcagcagcccaggugguugcucuaucaugaacugguccuaacgaccaaggaguucaugcgccaagugcuggagaucgaaucuuccuggcuccuggagguugcaccucacuacuauaaagccaaggaacuugaggacccccaugcuaaaaagaugccaaagaaaauuggaaagacuagagaggaauugggcuga

SEQ ID NO: 55286 - RNA, 2232 nt, Artificial Sequence
  derived and/or modified sequence opt3 from DHX32__Homo_sapiens__NP_060650
auggaggaagagggccuggaaugccccaacagcuccucugagaagagauacuucccugaaucacucgacaguagcgauggggacgaggaggaagugcuugccugugaggaucuggaauugaauccauuugacggauuaccguauuccucuagguacuauaaacugcuaaaggagcgggaggaucuccccaucuggaaagaaaaguacucguucauggagaaccugcuucagaaucaaauugucauaguuucaggugacgcuaaaugcggcaagagcgcacaggugccucaguggugugccgaauauugccugaguauccacuaccagcaugggggaguaauuuguacccaagugcacaagcagacagucgugcaguuggcgcuccgcguugcugaugagauggacgugaacaucggccaugaagucgguuaugugauuccauuugagaauugcuguacuaacgagacgauccugcgauacugcaccgaugacaugcugcagcgugaaaugauguccaaucccuuccucgggucuuacggaguaauaaucuuagaugacauucacgagagaagcaucgccacagauguucugcuuggcuugcugaaagacgugcuacucgcaaggccugaacugaaacuuauuaucaacuccucaccacaucugauaaguaaauugaauagcuauuacggcaacguccccgugauugaggugaagaauaaacacccugucgaaguuguguaucucucugaggcccaaaaggacuccuuugagucaauccugcgguuaauuuucgaaauccaccauagcggggagaagggagauaucguaguguuucuggcuugugaacaggacauugagaaagucugcgaaacuguguaccaggguaguaaccucaauccagaucuuggcgagcugguuguggucccguuguaucccaaggagaaauguucucuauucaagccucuggacgaaaccgagaaacgcugccagguguaccaaagaaggguaguucucacaaccuccagcggggaauuucugauauggucgaacucugugcgguucgucaucgaugugggagucgagcgccgaaagguguauaauccaagaauuagggcaaacucccuuguuaugcagcccaucucacagagucaagccgagauacggaaacagauucugggcagcuccucuagcgguaaguuuuucugcuuguacacugaagaguuugcuucaaaggacaugacaccucucaaaccagccgaaaugcaggaggcgaaccugaccaguaugguguuauucaugaagcguaucgauaucgcagggcugggacacugugacuucaugaaucgccccgccccggaaucccuaaugcaggcucucgaggaucuggacuaccuugccgcauuggauaacgacggcaaucugagcgaguuuggcauuaucaugucugaguucccucucgacccccaacugucaaaaaguauucuugcuagcugcgaauuugauuguguagacgaaguccugacgauagccgcgauggugacugccccaaacugcuucucccauguuccucacggggcagaggaagcugccuugaccuguuggaagacauuucuccaccccgagggagaucauuucacucugaucucuauuuauaaggcuuaccaggacaccacauuaaauucgagcuccgaguauugcguggaaaagugguguagagauuacuuucugaacugcucagcccuaaggauggcagacgucauccgggccgagcuccuggaaaucauuaagcgaauagagcuuccauaugcugaacccgcguucgguaguaaagagaauaccuugaacaucaagaaagcacugcucucuggcuacuuuaugcagauugcccgcgauguggacgggagcggaaauuaucugauguuaacgcacaagcagguagcucaacugcauccucuuuccggcuacucaaucacuaaaaagaugccagaguggguguuguuccacaaguuuagcauuucugaaaacaauuacaucagaauaacauccgagaucaguccggaacucuucaugcagcugguuccccaguauuacuuuagcaaccuaccuccaucugaguccaaagauauucugcagcaagucguggaccaucucucacccgugaguaccaugaauaaggagcagcagaugugugaaacuugcccugagacagaacagagguguacccugcaauga

SEQ ID NO: 55287 - RNA, 3432 nt, Artificial Sequence
  derived and/or modified sequence opt3 from DHX34__Homo_sapiens__NP_055496
augcccccuccaagaaccagggagggccgggaccgccgagaucaccaucgugccccgagcgaagaggaagcucuggagaagugggacuggaacugccccgaaacaagaaggcuccuugaggaugcauucuuucgggaggaagacuacauccgccagggguccgaggaaugucaaaaauucuggacuuucuucgagagacugcagagguuucagaauuugaagacgucucggaaagaggaaaaggauccuggacagccaaaacacucaauucccgccuuagcggaccugccucgcaccuaugauccacgauacagaauaaaccuaagugugcucggucccgcuacaaggggcagccaagggcugggacggcaucuuccugccgagcgugucgcagaauuucgcagagcccuguugcacuaucucgacuuuggccagaagcaggcuuucgguaggcuggcaaagcugcagcgggagcgagccgcucucccaaucgcccaauacgggaaucgcauuuuacagacucugaaagaacaucagguugugguaguggcgggagauaccggcugcggcaaguccacacaggucccgcaauaucuuuuggcagccggguuuucucacguggcuuguacccagcccagaaggaucgccugcauuucgcuggcaaaacggguuggauucgagucacuaagccaguacgguagucaagugggcuaucagauccgcuuugaguccacuagaucugcugccacaaagauagucuuccucaccguggggcugcuucugaggcagauccagcgugaaccuagcuugccacaauacgagguacucauuguugacgaagugcacgagcggcaucugcacaacgauuuucuucugggaguccuccagcgacuucugcccacgagaccugacuugaaagugauccuaauguccgcgacuauuaauaucucacuguucaguagcuacuucucuaacgccccagugguccagguucccggcaggcucuuuccgauaaccgugguauaucagccucaagaagcagagcccacaacuuccaagucagagaagcuggauccacgcccuuuccuucgggugcuggaaagcauugaccauaaauaucccccagaggaaagaggugacuugcucgucuuucugagugggauggcugagaucucugccguguuagaagcugcccagaccuacgcaucccacacacagagguggguugugcugccccuacacagcgcccucucggucgcugaucaggacaagguguucgauguagcgccuccaggaguucgcaaauguauucugucuaccaauaucgcagagacguccgugacuaucgacggcauucgauuugucguggauucaggcaaggucaaagagaugaguuacgacccgcaagccaaguuacagcgguugcaggaguucuggauaagccaggcuuccgccgaacaacguaaagggagagcaggaaggacaggucccggcgugugcuuucgccuguaugccgaaucugauuacgacgcuuucgccccuuauccaguucccgagauccggagaguggcacucgauagccugguacuucagaugaagucaaugagugucggggacccuaggaccuuuccauucauugagcccccgccuccagcgucccuggaaacugcuaucuuguaccuccgagaucagggagcccuggacagcucugaggcauuaacacccauaggcucacugcuagcccaacucccuguggacguugugauugguaagaugcugauccuugggaguauguuuagcuuggucgaacccgugcugaccaucgcugccgcacucuccguacagucuccauucacgcgcucggcucagagcuccccugagugugccgcggcccggagaccccuggaaucagaucagggcgacccauuuaccuuauucaacguguucaaugcuuggguucaagucaaaagugagaggucucguaacagccgcaaguggugccggagaaggggaauugaggaacaucgacuguacgagauggcaaaucuucggcgccaguuuaaagaauugcucgaggaucacggccugcuagccggggcucaggccgcacaggugggagacuccuauucaagacugcaacagaggcgggaaagacgagcgcuccaucagcugaagcgccagcacgaggagggugccggcaggcgucggaaagugcuuagauugcaagaggaacaggaugggggaagcucugacgaagauagggcuggcccggccccucccggugcauccgacggggucgauauccaggacguuaaguucaagcugcgccaugauuuagcucaacuccaggccgcagccaguagcgcucaggaccugucucgagagcagcuugcgcuguugaaacucgugcugggcagaggacuauacccacaacuggccgugcccgaugcauuuaacuccucacggaaggacagugaccagauuuuccacacacaggcuaaacagggcgccguacuccacccuacuugugucuuugccgggagcccagaagugcugcaugcucaagagcuugaggcaucgaauugcgauggauccagggacgauaaggacaaaaugucuagcaagcaccaguugcugucauucguuaguuuacucgaaaccaacaagcccuaucuggugaauuguguccgcauaccugcccuucagucccugcuacucuuuucucguagccuggauacaaacggugacugcuccagauugguggcggauggcuggcuggaguuacagcucgcugacucagaaagcgccauccggcugcuugcagccagucugagguugcgcgcucgaugggagucugcacucgauagacaacuggcccaucaggcgcagcagcaacuagaggaagaggaagaggacacuccgguuuccccaaaagaaguggcuacccugagcaaggagcuucuccaguucacagccucgaaaauucccuacucacugcggagguugaccgggcuggagguacagaacauguaugucggaccucaaacuaucccagcaacgccccacuuaccuggccucuuugguucuaguacacuguccccgcaccccaccaagggcggcuacgccgugacugauuuccuuaccuauaauugccugacaaacgacaccgauuuguacagcgacugucuccgcacuuuuuggacaugcccacauuguggacugcacgcuccucuaacgccccuggaaagaaucgcccaugagaauaccugcccacaggcaccucaggacgggcccccaggggcugaagaggccgcgcuugaaacucuccagaaaacaucugugcugcaaaggccguaccacugugaggccugcggaaaggauuucuuguuuaccccuacagaggucuuacggcaucguaagcagcacguuuga

SEQ ID NO: 55288 - RNA, 2985 nt, Artificial Sequence
  derived and/or modified sequence opt3 from DHX36__Homo_sapiens__NP_001107869
augagcuacgacuaucaccagaacuggggcagagaugggggacccagguccucugguggcggguacggaggcgguccugccgggggacauggcggcaaucgggggucaggagguggcgggggaggcggugggggaggccgcggcgggcgaggacgucacccaggucaucugaagggcagagagaucgggaugugguaugcuaaaaagcaaggacagaaaaacaaggaagcagagaggcaggaacgggccgugguccacauggacgagcgcagagaagaacagauuguucaacuccuuaauagugugcaggcgaaaaacgauaaggagagcgaagcucagauauccugguucgccccggaggaccauggcuacgguaccgaaguaucuacaaagaauacucccugcucggagaacaaacuggauauccaggagaagaaauugauuaaucaagaaaagaaaauguucaggauccggaaccgcucauauauugaccgagauagcgaguacuuacugcaggaaaaugagccugacgggacgcuagaucagaagcuccuggaagaccuucagaagaaaaagaacgaucugagauauaucgagaugcaacacuucagggagaaauugccaaguuacggcaugcagaaggaacucgugaaucugauagacaaccaccaggucaccgugaucuccggagagacaggcugugggaaaacuacccaaguuacacaguuuauucuggauaauuacaucgaacggggaaaggguucugcaugccguauuguguguacccagccccgcagaaucagcgccauauccgucgcugagaggguggcagccgaacgggcugagucaugcggcagugggaacagcacuggauaucagauucgacuccaaucucgcuuaccuagaaaacagggcuccauccuguacuguacaaccgguauuauccuucagugguugcagucagacccauaucugagcaguguaucucauaucguucuagacgagauucacgaaaggaaucuccaauccgaugugcugaugacggucgugaaggaccuucugaacuuccggagcgauuugaaggugauacucaugucggccacucugaacgcggagaaauuuucugaauacuucgggaauugccccaugauccauauuccuggcuuuaccuucccagucguugaguauuuacuggaagacgugaucgagaagauacgcuacguaccggagcagaaagaacacagaucccaguuuaagaggggauucaugcagggccacgugaaccgucaagagaaagaagagaaggaggcaauuuauaaggaacgguggcccgauuacguccgagagcucagaaggcgcuacucagccaguacaguggacguuaucgaaaugauggaggaugacaaaguggaucuuaaucugaucgucgcuuugauucgguauaucgugcuagaagaggaggacggggccauucugguauuucucccuggaugggauaacauaagcacucugcaugaccuucugaugucccagguuauguucaagucugugaaucagacccaggucuuuaaaagaacaccacccggugugaggaagaucgucauugcaaccaacaucgcugaaacgagcaucacuauugacgaugugguuuacgugauagacggcgggaaaaucaaggagacacacuucgauacccaaaauaacauuucaacuaugagugccgaauggguauccaaggcgaaugccaaacagcgcaagggacgagcaggccggguccagccuggucauuguuaucacuuguacaacgggcuccgugcuagccuguuagacgauuaucaacugccagagauccuaagaacaccccucgaggagcugugccuucagauuaaaaucuugaggcugggcggaauagccuacuuccucucucgccugauggacccgccuucaaaugaggcugugcuucugaguauccggcauuugauggaacucaacgcccuggauaagcaggaggaauuaacgccccugggcguucaccuagcaagacucccaguggagccucacauugggaaaaugauccuguuuggagcccuuuucuguugcuuggaccccguccugaccauugcugcgagccucuccuuuaaggauccauucgugaucccccugggcaaggagaaaauagcagacgccaggcgaaaggaauuagcuaaagauacccgcucugaccaucugacaguagugaaugccuuugaggguugggaagaggcacggagaaggggguuccguuaugaaaaggauuacuguugggaguacuuucuuucgagcaacacuuugcagaugcuccacaauaugaaaggacaauucgccgagcaucugcuaggcgcugguuuuguuuccucacgcaacccuaaggacccagaaaguaacauuaauucugacaacgagaaaaucauuaaggccgucaucugcgcaggccuguauccgaagguggcgaaaauacggcucaaucuggggaagaaaagaaagauggugaaagucuacaccaagacagauggacuuguugcugugcaccccaagagcgugaacguagaacagacugacuuccacuauaauugguugaucuaccaucugaaaaugaggaccuccucaauuuauuuauacgauugcacagaggucagcccuuauugucuccuguuuuucggcggggacaucucuauucagaaggauaacgaccaggaaaccaucgccguggaugaguggauaguuuuucaauccccagcacgaauugcccaccuugugaaagagcugcggaaggaauuggacauccuccugcaggagaaaaucgaaaguccccauccugucgauuggaaugacacuaagagccgcgauugcgcugugcuaucugccauuaucgaccugauuaagacgcaggagaaagcaacaccaagaaacuuucccccgagguuccaggauggauacuacuccuga

SEQ ID NO: 55289 - RNA, 3684 nt, Artificial Sequence
  derived and/or modified sequence opt3 from DHX38__Homo_sapiens__NP_054722
augggcgacaccagcgaggaugccuccauccacagacuggaagggacagaccucgauugccaggugggaggucuuauuuguaagucuaaaucagcugcaagugagcaacaugucuucaaggcccccgcgccuaggccaagccuguugggcuuagaccugcuagcuucccucaaacggcgcgaacgagaggaaaaggaugacggggaggauaaaaagaagucuaaaguuucgucauacaaggacugggaggaaagcaaagaugaccagaaggaugccgaggaagagggaggcgaccaggcaggucagaacauacguaaagauagacacuauaggagugcccggguggagacuccgucccaucccgggggaguaucugaagaguuuugggaacgcagcagacaaagggagcgggaacgccgagagcacggcguguacgcuuccucaaaggaggaaaaggacuggaaaaaggagaaaaguagagacagggauuaugaccggaagcgugaucgcgacgaaagagauaggagccggcauucuucccgaucagagcgcgacggcgggagcgaaagaaguucuaggcggaaugagccugaguccccacgccacagacccaaagaugcagccacgccuagcaggucgaccugggaagaggaagacucuggauacgguuccucacgucggagucagugggagagcccaucccccacaccuucuuaucgagauagcgaaagaucacacaggcugaguacucgcgaccgggauagauccgucaggggcaaguacagcgacgacaccccacuuccgacacccucuuauaaauacaacgagugggcugaugaccgccgacaucuggggucaaccccucgguugagucguggaagaggcaggcgcgaggaaggugaggaagggaucagcuucgauacugaggaggaacggcagcagugggaggacgaucaaagacaggccgacagggauugguacaugauggacgaaggauaugaugaguuucacaauccacucgcguacuccucugaagacuaugugcgacgccgggagcagcaucugcacaagcagaagcaaaagagaauuucggcacagaggcgucagaucaacgaggauaaugaacgcugggagacaaaccggaugcugaccagcggcguugugcacagacucgaagucgacgaggauuucgaagaggacaaugccgcuaaggugcauuuaaugguacacaaccugguucccccuuuucuugacggcaggauuguguucacgaaacaaccagagcccgucaucccggugaaggaugccacuuccgacuuggcaauaaucgcucgaaaagggucacagaccgugcggaagcaucgcgaacagaaggagaggaaaaaggcccagcacaaacauugggaacuggcgggaacaaagcuaggugauauuaugggcgucaaaaaggaggaggaaccugacaaggccguuacugaggaugggaaaguggacuacagaaccgaacaaaaguuugcagaucacaugaaacggaagagugaggcuucuagcgaauuugccaaaaagaaguccauccucgagcagcgacaguaucugcccauuuuugcuguacagcaagagcuucugacaaucauaagagacaauucaauugugaucgucgugggagaaaccggcagcgguaaaacgacucaguugacacaguaccuccacgaggauggguauaccgacuacggcaugauuggaugcacucagccacgcaggguugccgcaaugucuguggccaagcgugucuccgaagagaugggcgggaaccugggagaagagguggguuacgcuauccgguucgaggauuguacaagugaaaauaccuuaaucaaauauaugacggacggcauucugcucagagagagccuuagggaagcggaucuggaccauuacucugcaauaaucauggacgaggcccacgaacgcuccuugaacaccgauguacuauuugggcugcuccgagagguuguggcuagacggucagaccugaaacuuauugucacaagugccacuauggaugcagagaaauucgccgcuuucuucggaaaugugccuaucuuccauauacccggcaggaccuuuccagucgacauucuguucagcaagacaccccaagaagauuauguggaggccgcaguuaaacagucgcuccaggugcaccucuccggugcgccuggggacauccugaucuuuaugccaggccaggaagauauugagguaacuucugaccaaaucgucgaacacuuagaggagcuggaaaacgcuccggcccuagcagugcuccccauuuacagccagcugccuucagaucuucaggccaagauauuccaaaaggcuccagacggaguucgcaaaugcaucguggccaccaauauugcagagacaaguuugaccgucgauggcaucauguuugugaucgacuccggguauuguaagcugaaaguauucaacccccguauuggaauggacgcucuccagauauacccuaucucucaggccaacgcgaaucagagaagcggucgggccggcaggacugggccaggacaaugcuuucgccuguauacgcaguccgcuuacaagaacgaacuucugacaaccacugugcccgagauucagcgaaccaauuuggcaaacguuguccuccuguuaaaaucacugggcgugcaggaucuacuccaauuccauuuuauggacccgccuccagaggauaauaugcugaacagcauguaccagcuuuggaucuugggugcccuggacaauacagggggccucaccaguacuggaagacugaugguggaguuccccuuagauccugcucugucuaagaugcuuauugucuccugugacaugggcugcagcucggaaaucuugcucauaguuucaaugcugucugugcccgccaucuuuuaucggccaaaggggagggaagaggaaagugaucagauucgcgagaaauucgcagugccugaguccgaccaccuaacauaccugaacguauaucuccaguggaagaauaacaauuacagcacgaucugguguaacgaucauuuuauucacgcgaaagccaugagaaaggucagggaagugcgggcucaacugaaagacaucaugguucagcagcguaugucucuugccagcugcggaaccgauugggacauagugcgcaaguguauuugcgcagcuuauuuccaucaagccgcaaaguugaaaggcaucggugaguacgucaauauucgaacugggaugcccugccaucugcacccaacauccucauuauucggaaugggcuauaccccggauuacaucguguaccacgaacucguuaugacaacuaaggaguauaugcagugugugaccgccguagacggugaauggcuggcugagcuuggcccuauguuuuacagugucaaacaggcgggaaagagcagacaggagaacaggcggcgcgccaaagaagaggcaucugcuauggaagaggaaauggcccuggccgaggagcaauugagagcuaggcggcaggaacaggagaagcgaucccccuuggggucagugagaaguacgaagauauauaccccaggccgcaaagaacagggggagcccaugacaccuaggcggacuccagcacguuucggacuguga

SEQ ID NO: 55290 - RNA, 2109 nt, Artificial Sequence
  derived and/or modified sequence opt3 from DHX40__Homo_sapiens__NP_001159773
augagcagauuccccgccguggcuggcagggcaccucggcgccaggaggaaggggagcgaucccgugaccugcaagaagagagacucucugccgucugcaucgcggauagggaagagaagggauguaccucacaggaggguggcacaacuccaacguuuccgauucagaaacagcggaagaaaauaauccaagcugaaaccgccauuaaguacaugacagacgggugccuucugaaacacaucuugggagaucccaacuuaacuaaguucaguguuauuauccuggacgaggcacaugaacgcacccuaacaaccgauauacucuuuggccugcuuaagaaacuguuccaggaaaagagcccuaauagaaaagagcacuugaaggugguagugauguccgccacuauggagcucgcuaaacugucugcauuuuucgguaacuguccaaucuuugacauucccgggaggcuguauccuguccgggagaaguucugcaaucucaucggaccacgcgaucgagaaaacacagccuacauucaggcuaucgugaagguuaccauggacauacauuuaaaugagauggccggcgauauucugguguuucuuacgggccaguucgaaaucgagaaaucgugugaguugcuguuucaaauggcggaaucagucgacuaugauuacgacgugcaggauacuacccuagacgggcuccugauucuucccugcuauggaagcaugacaacugaccagcagagaaggaucuuccugccuccaccgcccgguauccggaaguguguaauuaguaccaacauauccgcaacaucuuugaccaucgauggcauucguuacguuguggacgggggauuugucaaacaacucaaucacaacccucgccugggcuuagauauccuggagguggugccaauaagcaaguccgaagcccuccagagaucagguagggcugggcggacgaguagcggaaaaugcuuccgaauuuauucuaaggacuucuggaaucaguguaugcccgaucaugucaucccugagaucaaacgcacuucccuuacaucaguugugcugaccuugaagugccuagccauucacgacguaaucagauuuccauaccuggaucccccgaacgaaaggcucauucuggaggcacuuaagcaacuguaccagugugacgcuauagaucggagcggccacgugacucgcuugggccucaguauggucgaguucccucugcccccacauuuaacaugcgccgugaucaaagcggccucucuggacugcgaagaucuacuccugccuauugcagcuaugcuuuccguugagaauguguuuaucagacccgucgacccagaauaucagaaggaggccgaacagaggcaccgugaguuggcugccaaagcagggggauucaacgacuuugccacccuggcugugaucuucgagcaauguaagagcucgggugcgcccgcaucuuggugccagaaacauuggauucacuggcggugucucuuuuccgccuuccgaguagaagcucagcugagagagcuuauaaggaagcugaagcagcaaucagauuuuccuaaagaaacguucgagggcccaaagcacgagguuuugcgccggugccucugugccggguacuuuaaaaauguggcaagaaggagugucggacgcaccuucugcacaauggacggccgagguagcccggugcauauccaccccuccucugcccugcaugaacaggagacuaaguuagaauggauuaucuuucacgagguccuggugaccacaaaaguuuaugcucggauuguguguccuauccguuacgaauggguaagagaucuacucccaaagcugcaugaguucaacgcccacgaccuuagcucagucgcaaggcgcgaggugcgggaagaugcgagaaggcgauggacuaauaaggagaacguuaaacaguugaaggacgggauaaguaaagaugugcugaagaaaaugcagcgccggaacgacgauaaguccaucagcgacgcuagagccagguuccucgaacguaagcaacagcgcacccaggaucacucugacacacggaaagagaccggcuga

SEQ ID NO: 55291 - RNA, 2037 nt, Artificial Sequence
  derived and/or modified sequence opt3 from DHX58__Homo_sapiens__NP_077024
auggagcugagaagcuaccagugggaagugaucaugcccgcccucgagggcaagaacauuauaaucuggcuuccuaccggggcuggaaaaacaagggcagccgcguaugucgcuaagcggcaccuggaaacuguugacggugccaaagugguaguguuggucaaucgcgugcauuuaguuacgcaacacggcgaggaguuccgacguaugcuggaugggagauggaccgugacaacucuauccggagacaugggcccaagggcagguuuugggcaucucgcccggugccacgaucugcuuauuuguaccgcugaacuguugcagauggcacucacaucuccggaggaagaggaacaugucgagcugaccguguucucacugaucguaguugacgagugccaccacacucauaaggauacaguguacaacgucauuaugagucaguaucucgaauuaaaacugcagcgcgcccaaccccuuccucagguguugggacugaccgcuagcccaggcacgggcggggccuccaagcuagacggagcgaucaaucacgugcuccagcugugugcaaaccuugauacuuggugcauaaugucuccccagaauuguugcccucaacugcaggagcauucgcagcagccauguaagcaauacaacuugugccacagaaggucacaggaccccuuuggugaucuccugaaaaaguuaauggaccagauccacgaucaucuggaaaugccugagcucagccggaaauucggcacccaaauguaugaacagcaggucguuaagcugagugaggccgcugcccuggcaggguugcaggagcaacgcguguacgcucuacaccuucgaagauauaaugacgcccuccugauucaugauacaguaagggcgguggacgcccuugcagcucugcaggacuuuuaccaccgggaacaugucacuaaaacccagaucuugugugccgagcgucgccuccuggcuuuauucgaugacagaaagaacgaacuggcccaccuagcaacacacggaccagagaauccgaagcucgaaaugcuggagaaaauucuucagaggcaauuuuccucuagcaacucccccagaggcaucauauucacccgaacgcgccagucagcccauaguuugcugcucuggcugcagcagcaacagggucuucagacuguggauauuagagcucagcuguugaucggggcgggaaauagcucucaauccacacacaugacccagagggaccagcaagagguuauucagaaguuucaggauggcacucucaaccuguuaguggcaacaucagucgccgaagagggccuggacaucccucauugcaaugugguaguucgguacgggcuacucaccaacgaaaucagcauggugcaggcucgcggacgggccagggcagaucaaagugucuaugccuucguggcuacggaggguucucgugaacugaaacgggagcuuauuaaugaggccuuggaaacccugauggagcaggcagucgcggcugugcagaagauggaccaggccgaauaccaagcaaaaauacgagaucuccagcaggccgcucugacaaagagagccgcacaggcugcccaaagggagaaccagcgccagcaauuuccaguugagcacgugcaguuacuguguaucaacugcaugguagcggucggccacggguccgaccuucggaaaguggaaggaacucaucacguuaaugugaaccccaauuucagcaacuauuacaaugucucgagagauccugugguaauuaacaagguguuuaaggacuggaaaccaggcgguguuaucucuugcaggaauuguggggaggucuggggcuugcagaugauauauaaguccgugaaacuccccgugcugaagguccgcucaaugcuacuggaaaccccgcagggacggauucaagccaaaaaguggagucgaguuccuuucagcgugcccgacuucgauuuucuccagcauugcgcugagaaccuguccgaccuuucuuuggauuga

SEQ ID NO: 55292 - RNA, 3546 nt, Artificial Sequence
  derived and/or modified sequence opt3 from DHX8__Homo_sapiens__NP_001289552
auggccgucgcugucgcaauggccggcgcgcugaucgggagcgagcccggaccugcugaagaacucgccaaacuugaauaccuguccuugguuucuaaggugugcaccgaguuagacaaccaccuggguauuaaugauaaggaccuagcagaguucguaauaucacucgccgagaaaaacacaacuuuugauacguucaaggcuagucuggugaaaaauggcgcagaguuuaccgacagccuuaucuccaaccuguugagacucauucagacaaugaggccaccggccaagcccucuacuucgaaggauccugucgugaaaccaaagaccgaaaaagagaagcugaaagaacuguuccccguucucugucaaccugacaauccaucagugcggacaauguuagaugaggacgaugucaagguggcuguagacguucugaaggagcuugaagccuugaugcccagcgcggcagggcaggagaaacagcgcgaugccgaacaucgagaccguaccaagaaaaagaaaagaaguaggucccgggaucgcaacagagacagggaccgggaucgcgagcgaaauagagacagggaucacaagcggcgucaucgcucuagaagcaggucccggucacgaacucgcgaaagaaacaaagugaagaguagguaucggagccgcucuagaucccagucaccuccaaaggacaggaaagaucgugacaaguacggagagcggaaucuggaucgauggagagacaaacacgucgauaggccgcccccugaggaaccaacaaucggcgacauuuauaacgguaaggugaccagcaucaugcaauuugggugcuucgugcagcuagagggacuccgcaaacggugggaaggccugguccauauaagugagcuuagaagggaaggccgcguugcuaauguggccgauguagugucuaaggggcagcgagucaaggugaaaguucuguccuuuacgggaacuaagaccagcuugucgaugaaagacguggaccaggagacaggugaggaucucaaccccaaucggcguagaaaccuggucggcgaaacuaaugaggaaaccucuaugaggaacccugaccgcccaacacacuuaucccuggugucagcacccgagguagaagaugacagucucgagcggaagagacuuaccaggaucagcgauccggagaaaugggaaauuaagcaaaugaucgcugccaacguucuguccaaggaggaguucccugacuuugaugaagagacggggauuuugcccaaaguggacgaugaagaggacgaagaucuagagaucgaacuggucgaggaggaaccaccuuuccuccgaggacacacuaagcagucuauggacaugagccccauaaaaauugugaagaauccagauggcucacugagucaggcggccaugaugcaguccgcacuugcuaaagagcgccgggaacugaagcaagcccagagagaggcugaaauggacagcauccccauggguuugaacaagcauugggucgacccucucccagaugccgaggggaggcagauugcagccaauaugcguggaaucggcaugaugccgaacgacauccccgaguggaaaaagcacgcuuuuggcgggaauaaagcgucuuacggaaagaaaacacaaaugucaauucuggaacagcgcgagaguuuaccuauauauaagcugaaagaacagcuagugcaggcaguucaugauaaccaaauccucauugugaucggugagaccggcagcgggaagacuacacagauaacccaguaccuggccgaagcuggauauacgucccggggcaagauugguuguacccagccaagaaggguagccgcaaugucugucgccaaacgagugucggaggaguucgggugcugucuuggccaagaaguuggauacacaauccgguuugaggacugcacuagccccgaaaccgugaucaaguacaugacagauggcauguugcugcgcgagugucucauugacccugaucugacucaguaugcuaucauuaugcuugacgaggcccacgaaagaaccauacacacagauguccuguucggguugcucaaaaagaccgugcagaaaaggcaggacaugaagcugaucguaacuuccgcaacguuagaugcggugaaguucucacaauacuuuuaugaggcuccaauuuucacaauccccggacggaccuacccgguugaaauccuguauacuaaagagccugaaaccgacuaccuagaugccagucucauuacagucaugcagauacaucugaccgagccacccggugacauccuuguguuuuugacuggccaggaggaaauugacacagcaugcgagauccuguaugaacgaaugaagucucucgggccugaugugcccgagcugauuaucuuaccagucuacagcgcccugccuuccgaaaugcagacgagaauauucgaccccgcuccaccgggaucacgcaaaguugugaucgccaccaauauugcagagacuagccuuacaaucgauggcauuuacuaugugguagacccugguuuugucaagcaaaaaguguacaacucuaagaccgggaucgaucaguugguugugacacccauaucccaggcucaagccaagcagagggcgggccgugccggacggacuggcccagggaaauguuauagacucuacaccgagagggcuuaucgcgacgaaaugcugacgaccaauguccccgagauucagcgaacaaaccuagcaaguacugugcugagccucaaggccaugggaaucaaugaucugcuuucuuucgacuuuauggaugcuccuccaauggaaaccuugauuacagccauggagcagcuguacacuuuaggugcacucgacgaugaaggccugcuuaccagacuggggcggaggauggcggaguuccccuuggagccuaugcucugcaaaaugcugaucauguccguucaccuaggauguucagaagagaugcugacgauagugaguaugcucagcguacaaaacgucuuuuaucgcccgaaggacaaacaggcccuggcugaccagaagaaggccaaauuccaucagacagaaggcgaucaccuuaccuugcuggcaguguacaauucguggaagaacaauaaauuuuccaacccauggugcuacgagaacuucauccaagcucguucuuuaagacgggcccaggacauuaggaagcagaugcucgguaucauggaucgccauaaacuggacguggucagcugcgggaagucaacuguucgagugcagaaagcaauuuguaguggcuuuuucagaaaugccgcuaagaaggauccccaagagggauaucggacacuuaucgaccagcagguaguguacauacacccuuccucugcgcuguucaacaggcaaccagaaugccccaaacacuuucuaccugucguggccguugcagugagccucgagcagugucuguccaaguucgaagauuugaauaaagagcugggcuuagugaccugcuga

SEQ ID NO: 55293 - RNA, 3813 nt, Artificial Sequence
  derived and/or modified sequence opt3 from DHX9__Homo_sapiens__NP_001348
augggcgacgugaagaacuuccuguacgccuggugcgggaaaagaaagaugacccccagcuaugagaucagggcugucggaaauaaaaaccggcagaaguuuaugugugaaguucaaguggaggguuacaauuauacaggcauggggaacuccacuaauaaaaaggaugcacagucuaacgccgcgcgcgacuucguaaauuaccucgugcgaauuaacgaaauaaagucagaggaagucccugcuuuuggaguggccaguccaccgccccuuacggauaccccugacacaacugcaaaugccgagggcgaucugccaaccacaaugggugggcccuugccuccacacuuagcucugaaagcagagaacaauagcgaaguuggagccuccggcuauggcgugcccgggccuaccugggaccguggagcuaaccuaaaggauuacuauucuagaaaagaggaacaggagguccaggccacucucgagucggaagagguggaccugaaugcgggucuucauggcaacuggacacuggaaaaugcaaaggccagguugaaccaauacuuccagaaagagaagauccagggggaauacaaguauacccagguaggaccagaucacaaccggucauuuauugcugagaugacgaucuacauuaaacaacucggccgcagaaucuucgccagggagcaugguagcaauaagaaacuggcagcucagaguugcgcccugucccucguucggcaguuauaucaccuggggguggucgaagcguacucuggacuuacuaagaaaaaggagggcgaaaccguggagccguauaaagugaacuugagccaggaccuggaacaucaacuacagaauauaauccaggagcucaaccuggagauucuucccccuccagaagaucccuccgucccuguugcccugaauaucggcaaguuggcacaauuugagccaucacagcgccagaaccagguggggguagugcccuggaguccgccucaaagcaauuggaaccccuggacaucuuccaauauugacgaaggaccacucgcuuucgccacuccugagcagaucucaauggaucugaagaacgaauuaauguaccagcuggagcaggaccacgaccuccaagcuauacuucaggagcgagaacuguugcccgucaaaaaguuugagagcgaaauucuagaggccaucagucaaaauucugugguuauuaucagaggugcaaccggcugugggaaaacaacccaggugccacaguucauccuggaugacuuuauucagaacgauagggccgcugagugcaauauagucgugacgcagccccggcguaucuccgcgguaagcguugcagaacgcguggccuucgagagaggagaagaaccuggcaagucgugugguuauucugucagguuugaauccauucucccacggccgcacgcuucaaucauguucugcacuguggggguccugcuucgaaaacuggaggccggcauacgcggaauuagucaugugaucguugacgagauccacgaaagagauauuaacacagacuucuugcucgugguacugagggaugucgugcaggcauaccccgagguucggaucguguuaaugagcgccaccauugacacuuccauguuuugugaauacuucuuuaauugcccuauaaucgaggucuauggccgcacauacccagugcaagaauauuuccuggaggauuguauucagaugacccauuuuguacccccuccaaaggacaagaaaaagaaagauaaggacgacgaugggggagaggacgaugacgcuaacugcaaccuaaucuguggugaugaauacggccccgagacgagacucucuaugagccagcugaaugaaaaagagaccccguucgaacuuaucgaggccuugcugaaguauauugagacacucaacgugccuggggcaguucuggucuuucuuccaggauggaaucugauauacacuaugcaaaagcacuuggaaaugaacccccacuucggcucacauagguaucagauccucccucugcacagucagauuccccgugaggaacagcggaaaguguuugacccagugccugucgguguuaccaaggugaucuuauccacaaauauugcggagacuagcaucaccauaaacgaugugguauacgucaucgacucuugcaaacaaaaggugaaacuguucacagcucauaauaacaugaccaauuacgccacuguuugggcaucaaagacgaaccuagagcagcgaaaggggagagccggcagggugcgccccggauuuugcuuccaccucuguagucgggcuagauuugaaaggcuggagacacauaugaccccagaaauguuccgcacuccgcuucacgagauugccuugagcaucaaacugcuccgacugggcgggauuggacaguucuuagcaaaggcuaucgaaccucccccacuggaugccgucauagaggcggagcacacccuucgggaauuggacgcccucgaugcuaaugacgagcugacaccccuaggucguauucuggcaaaacucccuaucgaaccaagauuuggcaagaugaugauuauggggugcaucuucuaugugggagaugccauauguaccaucgcugccgcaacuugcuuucccgagccuuucauuaacgaaggcaaaaggcuggguuacauccaucgcaauuuugcggggaaccgguucuccgaccacguugcccuuuugucuguguuucaggcuugggacgaugccagaaugggcggagaggaggcagaaauuagguucugugagcauaagcgacugaauauggcuacauuacgcaugacgugggaagccaaaguacaacucaaggagauccugauaaacucgggcuuuccggaagacugccuucugacccaggucuucacuaacacagggccagauaauaacuuggacguggugauuagccuccuggcauuuggagucuaucccaauguuuguuaccacaaggagaaacggaagauccuaaccacagagggcagaaacgcccugauccacaaauccucagugaauugcccuuucaguucucaggauaugaaguauccaagccccuuuuucguauucggugagaaaauuaggacucgugcuaucuccgcgaaggggaugacccucgugacgccucugcagcuuuugcuguuugccucaaagaaaguccaaagcgacggacagauuguguuaguugaugacuggauaaagcuccagaucucucaugaggcagcugccuguauuaccggccugcgcgccgcuauggaagcacuuguggucgaggugacaaaacaaccggccaucauuucccagcuggaucccguuaacgagcggaugcuaaauaugaucagacagauaaguaggccaagcgcggcugguaucaaccucaugauuggcucuacucgauacggggacggaccucggcccccaaagauggcccgcuaugauaauggcuccggguacagaaggggaggcucaaguuacagcggugggggauauggcgguggcuacucguccgggggauauggcucugggggauacggcgguagcgcaaacucauuccgggccggguauggagcuggcguggguggcggguaccgaggagucaguagaggcggguuucgcggaaauuccggcggugacuauagggggccuucuggaggcuaccguggcagcgggggauuccagcgggguggcgggagaggagcauacggcaccgguuauuuugggcaaggaaggggcggcgggggauacuga

SEQ ID NO: 55294 - RNA, 561 nt, Artificial Sequence
  derived and/or modified sequence opt3 from DIABLO__Homo_sapiens__NP_001265233
augaaaagcgacuucuacuuucagaaguccgagccccacucucugucaagugaagcccucaugagaagggcugugagccuugucaccgauuccacaucuacuuuccugucgcaaacgaccuaugcauugaucgaggccauuacagaauacacuaaggcgguuuauaccuuaacaucacuguaccggcaguauaccagccuacucggcaaaaugaacagugaggaagaggacgagguguggcagguaauaaucggggcucgcgccgaaaugacuuccaagcaucaggaguaccugaaacuugaaacaaccuggaugacggcagugggacugucugagauggccgcugaggcagccuaucaaacuggugcugaucaggccagcauuaccgcgcgaaaucacauccaguuggucaagcuccagguggaagagguucaucaacugucccguaaggcagaaacaaaacuggccgaggcucagauugaggaacucagacagaagacucaggaggaaggcgaggaaagggccgagucagaacaagaggcauacuuacgggaggacuga

SEQ ID NO: 55295 - RNA, 3792 nt, Artificial Sequence
  derived and/or modified sequence opt3 from DIAPH1__Homo_sapiens__NP_001073280
auggagcccccuggcgggagccugggaccagguagaggcaccagggacaagaaaaaggggcgguccccggaugaacuccccucugccggaggcgacggugggaaaucaaagaaauuccuugagcgcuuuacaaguaugcgaaucaagaaggaaaaagagaagccuaacagcgcucaccguaauuccucugcaucguacggagaugacccaacugcccagucacugcaagaugugagcgacgaacaggucuugguuuuauucgagcagaugcugcuagauaugaaccucaaugaggaaaaacagcaaccccugagagagaaggacauuauaaucaaaagggaaauggugagucaguaucuuuacacguccaaggcgggcaugucucagaaggagagcuccaaaucagcuaugauguauauucaggagcugcggaguggcuugcgcgauaugccucuccugagcugccuggaaucucucagaguauccuuaaacaauaacccagugucauggguccaaaccuuuggggccgagggacuggcaagccuuuuggacauccugaagaggcuacaugaugaaaaagaggaaacagccgguaguuacgacucucggaauaagcacgagauuauccgcugucucaaggcuuucaugaacaauaaguuuggcauaaaaacuaugcuggagaccgaagaggggauccuucuguuggugcgagcaauggaucccgccguuccuaacaugaugauugacgcugccaagcuccuguccgcguuaugcauccugccacagccggaagacaugaaugagagagugcucgaagcaaugacagagagggccgagauggaugaagucgagcgguuccagccccuucuggacggacuaaagagcggcaccacuauugcuuugaaaguggguugucugcagcucaucaacgcccugauaaccccugcagaggaacuugauuuucguguacauauucgcucggaacugaugagauuggggcuccaccaaguucugcaggacuuaagggagaucgagaaugaagauaugcgggugcagcugaacgucuucgacgagcaaggagaagaggauucuuaugaccuaaagggccgacucgaugacauucgcauggagauggaugacuuuaaugaaguguuccagauccugcuuaacacagugaaagacuccaaggcugagccacacuuuuugucaauccugcagcaucuccugcuugucagaaacgauuacgaagccaggccccaguauuacaaacugauugaggaaugcauaagucaaaucguuuugcacaagaauggcgcggacccugauuucaagugucggcaucuccagauugagaucgaggggcugauagaccagaugauugauaaaacgaagguggagaaaagcgaagccaaggcagcugaauuagagaaaaagcuggacuccgaacuaacugcccgccacgagcuccagguagagaugaagaaaauggaaucugauuuugagcaaaagcugcaggaccuucagggagaaaaagaugcuuugcauagcgagaagcagcaaaucgccaccgaaaaacaggaccuggaggcagaggugucacagcucacaggugaagucgccaagcugacuaaggaguuagaagaugcuaaaaaggagauggcgagucuguccgcagccgcuaucaccgugccacccagcguuccgucuagagccccugugcccccagcaccuccccuuccaggcgacucagggacaauuauucccccuccaccggcccccggagauaguaccacgccuccacccccuccacccccgccuccacccccucccccauugccuggcggugucugcaucagcucacccccaucucuccccgggggcacugcuauaucgccucccccaccccugagcggagacgccacaaucccuccacccccuccgcuaccagagggcguggggauucccuccccuucaagucugccaggagguaccgcaaucccgccuccgcccccacucccuggcucugcgaggaucccacccccucccccaccgcugccugggagcgcuggcauucccccacccccuccaccccuuccuggagaagccgguaugccgccacccccucccccauugccugggggccccggaauaccaccuccgcccccauucccuggcgggcccggaaucccaccucccccgccagguaugggcaugccucccccacccccuuucggguuuggaguaccggcagcccccguucugccauucggcuuaacuccuaaaaagcucuacaaacccgaggugcagcugcgucggccuaacugguccaaacuugucgcugaagaccugucacaagauuguuuuuggacaaaagugaaggaggaccgauucgaaaauaacgaguuguuugccaagcucacccugacguucagcgcacagaccaaaacaucuaaggcuaaaaaggaucaggaggguggggaagagaaaaaguccguccaaaagaaaaaggugaaagaacuaaagguucuggacaguaaaacugcccagaaucucagcauuuuucugggcucuuucagaaugccauaucaggagaucaagaacgugauucuugaaguaaaugaggcggucuugaccgaguccaugauccagaaccugauaaagcaaaugcccgaaccugagcaguuaaaaaugcucucagaacugaaggaugaguacgacgaucuugccgaaagugagcaguuuggagugguuaugggcacagugccaaggcugcgcccccggcuaaaugcuauccucuucaaacugcaguuuagcgagcaagucgaaaacauuaagccggagaucgugucgguaacugcagccugcgaagaguugagaaaauccgagucuuucagcaaucuguuagaaauuacccuccugguggggaacuauaugaaugcuggaucaaggaacgccggcgcauuugguuucaauaucaguuuccuuuguaagcugcgcgacacaaaguccaccgaucagaaaaugacuuugcuccacuuucuggcggagcuaugcgaaaacgacuacccugauguucugaaguucccagacgagcuugcccacgucgaaaaggcuucucgagugagcgccgagaaccuccagaaaaaucuggaucagaugaaaaagcaaauauccgacguggagcgggacguccagaacuuucccgcagcuacggaugaaaaagacaaguucguugagaagaugacaucauuugugaaagaugcccaggaacaauauaauaaguugcguaugaugcauagcaacauggagacccuguacaaagaauuaggggaguauuuccucuuugacccuaagaaacugaguguggaggaguucuuuauggaucuucacaauuucagaaacauguuucugcaggcaguaaaggaaaaucagaagaggcgcgaaacugaggagaaaaugcggagagccaaguuggcuaaagaaaaggcggagaaagaaaggcucgagaagcagcaaaagcgagaacagcugauugacaugaacgccgagggagaugagaccggcgucauggacucucuacuggaagcacuucaguccggugcugccuuccgccggaaaagaggcccaaggcaggccaaucguaaggcugggugugcagugacaagccuccuggccucggaguugaccaaagaugacgcgauggcugccguucccgcaaagguguccaaaaacucugaaacuuuuccgacaaucuuagaggaagccaaggagcuggucggacgcgcuaguuga

SEQ ID NO: 55296 - RNA, 3306 nt, Artificial Sequence
  derived and/or modified sequence opt3 from DIAPH2__Homo_sapiens__NP_006720
auggagcagcccggcgccgcugcaagcggggccggagguggcuccgaggaaccugggggaggcagaucuaacaagaggucagcggguaaucgggcugccaacgaagaggaaaccaaaaauaagccaaaacugaacauccaaauuaagacacucgcagacgaugugcgcgaccgaauaacgaguuuccguaaaagcacugucaagaaggagaaaccgcuuauccagcaccccauugauucccagguugccaugucugaguuuccugcugcacagccacuguacgacgaaagaucguugaauuuaucagagaaggaagugcuggaucuauucgagaaaaugauggaggacaugaaccucaaugaagagaagaaagcuccccugaggaacaaggauuuuaccacaaagcgggaaaugguagugcaauauaucagcgcuacugccaaaagugggggacuuaaaaauuccaaacaugagugcacccugucuagccaggaauacguccacgaguugcgcuccggcauuucagacgagaagcuccugaacugucuggaaagucucagagugagcuuaacaucuaauccuguuuccugggugaacaauuucggccaugaggggcugggacuuuugcuggaugaacuagagaaacuccuggacaagaaacagcaggaaaacaucgauaagaagaaucaauauaaacuuauacagugccugaaggcguuuaugaacaacaaauucgguuugcagaggauccucggcgacgagcggucacuguuacugcucgcacgcgccauugauccaaagcagcccaauaugaugaccgagaucgucaaaauucuuagcgcuaucuguauagugggggaagagaacauucuggacaaguugcuaggagccaucacuacagcagcugaacgaaauaacagagagagguuuaguccuauuguagaaggccuggagaaucaagaggcccuccagcugcagguugcgugcaugcaauucaucaacgcccuugugaccucuccauacgaacuggacuuucggauccacuugcguaaugaguuccuccgcuccggucugaagacgauguuaccggaucugaaagaaaaggagaacgacgagcuagauauucagcucaaagucuuugacgaaaauaaggaggaugaccugacugaacuuagccauagauugaacgauauaagggcagagauggacgauaugaaugaaguguaucaucugcucuacaacaugcugaaagacaccgcugccgagaauuauuuccuuucgauccugcagcacuuuuugcucauucggaacgauuacuacauccgaccccaguauuacaagauaauugaggaaugugugucucaaaucguccugcacugcuccgggauggacccugacuucaaguaucgccagagauuagauaucgaccugacacaccuaauugauucauguguuaauaaagcuaagguggaggaaagugagcagaaagccgcagaguucagcaagaaauuugacgaagaguucacugccaggcaggaagcucaagcggagcuccagaagcgggaugaaaagaucaaagagcuggaagcagagauucagcagcuucgcacccaagcccagguauuguccucuagcucaggaauaccagggcccccugcugccccaccccugccgggcgugggcccucccccaccucccccagcacccccucucccaggaggugccccgcugcccccuccacccccuccauuacccggcaugauggggaucccgccuccacccccucccccacugcuuuuuggaggcccucccccaccgccucccuuggguggggucccacccccuccaggcauuagucucaaccugcccuacggaaugaagcagaaaaagauguauaaaccugagguguccaugaagagaaucaacuggagcaaaaucgaaccgacagagcuaucugaaaauugcuucuggcugaggguuaaggaggacaaguuugagaacccagaucucuucgcuaaacuggcccuuaauuuugcaacccagauuaaggugcaaaagaacgcggaagccuuggaggaaaagaaaacgggccccacuaagaagaaagucaaggagcugcguauauuagacccuaaaacagcccagaaucucucaaucuuccuggggaguuaccggaugccauaugaagauauucgaaacgugauccuugagguaaaugaggacaugcugagcgaagcauugauucagaaccucguuaagcaucugcccgagcagaaaauccuaaaugaacuggccgagcucaagaacgaauacgaugaccugugugagccugagcaauuuggaguggucauguccucugugaagaugcuucagccgagauugucgagcauacuguucaaauuaaccuuugaggaacacaucaauaacauuaagcccuccaucauugcugucacucucgccugcgaggaacugaaaaagucagaaaguuucaauaggcuucuggagcuagugcuccugguugguaacuacaugaacucuggcagccgcaaugcacaguccuugggguuuaaaaucaacuuccuguguaagauacgggauacaaagucagcugaccagaaaaccacguuacuccacuucauugccgacaucugcgaggaaaaguauagagauauucugaaauuuccagaggaacuugagcauguggagagcgcgucuaagguauccgcccaaauccugaaaaguaauuuggcuagcauggaacagcagauaguccaccucgagagggacaucaagaaauucccucaagcagaaaaccagcaugauaaguuuguggagaagaugaccucuuucacaaaaacugcccgcgaacaguacgagaagcuguccaccaugcacaauaacaugaugaaacuauaugagaaucugggagaauacuuuauuuucgacucaaagacaguuaguaucgaggaauuuuucggcgaucuuaacaauuuucgaacucucuuccuggaggcugugcgggaaaacaauaaacguagagagauggaggaaaagaccaggcgcgccaaguuggcaaaagagaaggcggaacaggagaaacuggaacggcaaaagaaaaagaagcaguuaauugacaucaacaaagagggugaugagacaggggucauggacaaucuccuggaagcccuucagagcggcgcugccuuuagagauaggcgaaagcgcauaccccggaacccagacaauagaagggugccucuggagcguucgcgcucccggcauaacggagcaauuucuagcaaauga

SEQ ID NO: 55297 - RNA, 3582 nt, Artificial Sequence
  derived and/or modified sequence opt3 from DIAPH3__Homo_sapiens__NP_001035982
auggagagacaccagcccaggcugcaucacccugcccaaggcagcgcugcagggaccccauacccguccucugccucacuccggggaugccgcgaaaguaagaugccccgacguaaagguccucagcauccacccccuccaagcggccccgaggaaccuggggagaagagaccaaaauuccaccuuaacaucaggacacugacugacgauauguuggacaaguuugcguccauucggauaccgggaucuaaaaaggaaaggcccccuuuaccaaaucugaagacggcuuucgccucgucagauuguagcgcagccccucuagagaugauggagaacuuucccaaaccacucagugaaaaugagcugcuugaacuguucgagaagaugauggaggacaugaacuugaaugaagauaaaaaggcuccccucagagagaaagacuuuuccaucaagaaggaaauggugaugcaguauauuaacaccgcaucuaaaacaggcagccugaagaggucccggcagaucucaccgcaagaguucauucaugaacugaaaauggguagugccgaugagcgccucgucacuugcuuagagagccugcgaguuucucuuaccuccaauccugugucauggguagagagcuuugggcacgagggauugggccugcuacucgacauccuggaaaaacuuauaaguggcaaaauccaggagaagguggucaaaaagaaccagcacaaggugauucagugucugaaggcuuugaugaauacacaauacgggcucgaaagaaucaugucugaggagaggucccugagcuuacuggccaaggcgguugauccccggcauccaaacaugaugaccgacguggucaaacuccuuucggcagugugcauuguaggagaagagucuauccuggaagagguuuuggaagcccuaacuuccgcuggugaggagaagaaaauagaucguuucuuuuguauuguggaaggccugcgccacaauucaguccagcuccagguggccugcaugcagcugaucaacgcacuugugacaaguccugacgaucuggacuucagauugcauauuaggaaugaguuuaugcggugugggcucaaggaaauccugcccaacuuaaagugcaucaaaaaugacggacuggauauucaacuaaaggucuucgacgagcacaaagaggaagaucucuuugagcugagccaccgacuugaagacauacgcgcugaguuggaugaagccuaugacguuuacaacauggugugguccaccguaaaggagacgagagcggagggcuauuucaucucuauucugcagcaucuccugcuuaucaggaacgauuacuucauacggcagcaauauuuuaaacugauugacgaaugugugagccagaucgucuugcaccgcgaugguauggacccagauuucacuuacagaaagaggcucgaccuggacuuaacccaguuuguggauaucugcauugaccaggccaagcuggaggaguucgaagaaaaagcaucagagcuauacaagaaauuugagaaggaguucacagaucaucaagaaacucaggcugaacuccagaaaaaggaggccaagaucaaugaacugcaggcugagcuucaagccuuuaaaagucaguucggggcauugcccgccgacuguaacauuccucugccaccguccaaggagggaggcaccggccacagcgcucugcccccuccacccccucucccaucugggggagguguucccccgccuccacccccucccccaccucccccauuaccgggcaugcguaugccuuuuucagggcccgugccacccccuccaccccugggauuccuuggcggucagaauaguccuccguugccaauacuccccuuugggcugaaaccuaagaaagaguucaagccagaaaucagcaugcggcgacuaaacuggcugaaaauuagaccccaugaaaugacagagaauugcuuuuggaucaaggucaacgagaauaaguaugaaaacguggaucuccugugcaaacuugagaauaccuucuguugccagcaaaaggaaaggcgcgaggaagaggacaucgaggaaaagaaguccauuaaaaagaagauaaaagaguugaaguuccuggauucuaaaaucgcgcagaacuuaucgauuuuucucagcuccuuccggguaccuuacgaagagaucagaaugaugauucuggaaguugacgagacgaggcuugcagagucaaugauccagaaucugauaaagcacuugccggaucaggaacaacucaacagucugucucaguuuaaaagcgaguauuccaaucuaugugaacccgagcaguucguggucgugaugucaaacgucaagcgccugcgaccacggcucagcgccauccuguuuaaacuucaauucgaagaacaggugaauaacauuaaaccugacaucauggcuguuucuacugccugcgaggaaauuaagaaauccaagaguuuuagcaaauugcuggaguuagugcuccugaugggcaacuacaugaaugcaggaucucguaacgcccagacauucggcuuuaaucuuuccucacuguguaagcuaaaggauaccaaaagugcugaccagaagacuacacuccugcacuucuugguagaaaucugcgaggagaaauaucccgauauacugaacuuugucgacgacuuagaaccacucgauaaggccagcaaagugucgguugagacccuggaaaagaaucuuagacaaauggggaggcagcugcagcaguuggagaaagaacucgagacguucccucccccagaggaccugcaugauaaguuugugaccaagaugucccgcuucgucauuucugcaaaagaacaauacgagacacuaagcaagcugcacgaaaacauggagaaacuuuaucagucaaucauuggauacuacgcgaucgacgugaagaaaguaaguguggaagauuuccucacugaccugaauaacuuucggaccacauucaugcaggcuauaaaggagaauaucaagaaaagagaggccgaagagaaggaaaaacgcguucgaauugcaaaggaguuggccgaacgcgagcggcuggagagacagcagaaaaagaagagguuacucgaaaugaaaacugagggugaugaaaccggcgucauggacaaccugcuugaggcucugcaauccggggccgcauuucgugaucgccggaagagaacaccgaugccuaaagacgugaggcagucuuugagccccaugucccaacgaccagugcucaaggucuguaaucaugagaaccagaaaguucagcugaccgaaggaucacggagccacuauaauaucaacugcaauaguacucgcacgcccguggcuaaggagcuaaacuacaaccuggauacacacaccucuacuggcagaauuaaggccgcggagaaaaaggaagccuguaauguggaauccaacaggaaaaaggagaccgagcuucucgguagcuucucgaaaaaugaaucaguaccugaggucgaagcucuguuggcacgguuacgagcccuguga

SEQ ID NO: 55298 - RNA, 5490 nt, Artificial Sequence
  derived and/or modified sequence opt3 from DICER1__Homo_sapiens__NP_001182502
augaaaagccccgcccugcagccucucuccauggcuggccuucaacugaugaccccagcaucuucaccgauggggcccuucuucggauugccuuggcagcaggaggccauacacgacaacauuuacacuccaaggaaauaucagguggaauuacuggaggcggcuuuagaucauaauacuauagucugccucaacacggguaguggcaagaccuucaucgccguucugcuuacaaaagaacugagcuaccaaauuagaggggacuuuucccggaauggaaagcgcacuguguucuugguaaacucugcaaaucagguggcccagcaggucucggcugugcgaacccacucagaucucaaaguuggcgaguauagcaaccuggaagugaaugcaaguuggacaaaggagcguuggaaccaagaguuuaccaagcaucagguccugaucaugacuuguuacguggcccucaauguacuaaagaacgguuaucugucccuuucugacauuaauuugcugguuuucgaugaaugccaccuagcuauccucgaccaucccuacagagagauaaugaagcugugugaaaacugcccuagcuguccaaggauccuugggcugacagccuccauuuugaauggaaaaugcgaucccgaggagcucgaagagaagauccagaaacuggaaaagauuuuaaagucaaacgcggagaccgcaacggaccuggugguccucgaucgguauacaagucagccuugugaaaucgugguggacugcggcccauuuaccgaucgcagcggccuuuacgagagacuguugauggagcuagaagaggcccugaauuucauaaacgacuguaacauuucuguccacuccaaagaaagggauucaacacucaucagcaagcaaauucugagugacugccgggcuguucuugugguacuggggccguggugugccgacaaaguggcaggaaugaugguccgcgaguugcagaaguacaucaaacacgaacaggaggagcuccaucgaaaguuucuguuauucacugauaccuuucugagaaaaauccacgcucuaugcgaggaacauuucucucccgccucccucgaccugaaguuugugacaccuaagguuauuaaacuuuuggaaauacugaggaaguauaaaccauacgagcggcaacaguucgaaagcguggagugguauaauaaccguaaucaggauaacuacgucucguggucugacuccgaggaugacgaugaagacgaggaaaucgaggagaaggaaaaacccgagaccaauuucccuucaccauuuacgaacauucucugcgguaucauauucguggaacgcagauauacugcgguaguucugaauaggcuuauuaaggaggccggcaagcaggaucccgaacuggcauacaucaguagcaacuuuaucacagggcacggaauuggcaaaaaucaaccgcggaacaagcagauggaggcugaguuccgaaaacaggaagagguguugcgcaaguuuagagcccacgaaaccaaucuccugaucgcuacuuccauugucgaggaagguguggacauaccuaaauguaacuuagucgugagguucgaucugcccacagaguaucggucuuacguucagagcaaggggcgcgccagagcaccaaucucaaauuacauuaugcuagccgacaccgacaagaucaaaaguuuugaggaagaucucaagacguauaaagcuaucgagaagauucugaggaacaaaugcuccaagagcguggacaccggagaaacagauauagacccuguaauggaugacgaugacgucuuucccccauacgugcuucgucccgaugacggcggcccucggguuacuaucaauaccgcgauugggcauaucaaccgauauugugcaagauugccaucugauccguuuacacaccuggcccccaagugcaggacucgcgagcucccugacggaaccuucuacucaacacuguauuuaccaauuaacaguccccugcgggcuagcaucguggguccuccaauguccugugucagacuugccgaaagggugguagcauugauaugcugugagaaacuccauaagaucggcgagcuggaugaccaccuaaugcccguggggaaagaaaccguuaaguacgaggaggaacuggaccuccaugaugaggaagagacuucugucccgggacgcccuggcucgacgaaacgacggcaaugcuauccaaaggccauucccgaaugucugcgugacagcuacccuagacccgaucagccaugcuaccuuuaugugaucgguaugguguugacaaccccucugcccgacgaguuaaauuuuaggcgccggaaacucuacccaccggaagauacuaccagauguuucgggauucugacagcuaagccuaucccccagauaccacacuuucccgucuauaccagguccggcgagguuacuauuucaaucgagcuuaagaaaaguggauucaugcugucuuugcagaugcucgaacugauuacacgacuacaccaauacaucuucagccauauacugcgccucgagaagccugcccuggaauuuaaaccaacggacgcagauuccgcguauugcgugcuucccuugaacgugguaaaugacucaagcacccuggauaucgacuucaaguuuauggaggauauugaaaaaucugaggcucggaucggcauuccuuccacuaaguacacaaaggagaccccguucgucuuuaaauuagaagacuaucaggaugccgugaucauaccaagauacaggaacuucgaccagccccaccguuuuuacguugcagacguguauacagaucucacuccucugaguaaguucccaagccccgaguacgaaaccuuugccgaguauuacaaaacgaaguauaaucuugaccugaccaaccuaaaucagccucuccuggaugucgaccauacaucuucccgcuugaaccuguuaacuccgcggcaccucaaucaaaaagggaaggcucugccccuuucaagugccgaaaagagaaaagcaaagugggagagccugcagaacaaacagauuuuggugccagagcucugcgcuauccacccuauccccgccucgcuguggaggaaggcgguuugucuaccauccauucuguaccgacuucauugccuccugaccgccgaagaguugcgggcucaaacagcaucugaugccggaguggguguacgcagccugccugcugacuucagauaucccaauuuagauuuuggcuggaaaaagucaaucgacaguaaguccuucauuucuauaagcaacuccucaagcgccgaaaaugauaacuacuguaaacacaguacuaucgucccagagaaugcagcgcaucagggggccaacaggaccucuucccucgagaaccacgaccagaugagcgugaauugccggacgcugcuuucggaaucaccgggaaagcugcauguggaggucucugcugauuugacagccauuaacggccucaguuacaaucagaaccuggcaaaugguuccuaugaccuagcuaaccgagacuuuugucaagggaaucagcugaacuacuauaaacaggaaaucccuguucagcccaccacuagcuacucuauucaaaaucuuuauagcuacgagaaccagccacagcccuccgaugaaugcacacuccugucaaauaaguauuuggacggcaacgccaauaaaaguaccagcgauggaucuccugugauggcaguaaugccaggcacuaccgacacaauccagguguuaaaggggagaauggauuccgagcaaucacccaguauaggauacagcucccgcacgcuggguccuaacccgggccucauccugcaggcccuuacccugucuaaugcuucggacggguucaacuuggagaggcuagaaaugcugggagauagcuuccucaaacacgcgauuacuacauaccuguuuuguaccuauccagacgcccacgagggccgucuuucauacaugcgguccaagaaggucaguaacugcaauuuauauagacuggguaaaaagaaagggcuccccucuaggauggugguuagcaucuucgauccucccgugaacugguugccaccuggcuacgucgugaaucaggacaaguccaacacagauaaaugggaaaaggacgagaugacuaaggauuguaugcuggcaaauggaaaacucgacgaagacuaugaggaggaagaugaggaagaggaaucacugauguggcgcgcucccaaggaggaggccgacuacgaagaugacuuucuugaguaugaucaagaacauauucgauucaucgacaacaugcugaugggcucuggggccuuuguuaaaaagaucagcuugaguccauucuccaccacggauagcgcuuacgaguggaaaaugccuaagaagucuucacuaggauccaugccguuuaguagcgacuucgaggauuuugacuacucgucuugggaugcaaugugcuaucuggaccccuccaaagccguggaagaggaugacuucgucguaggcuuuuggaauccaagcgaagagaacugugguguggacacagggaagcagucaauuaguuacgaucuccacaccgaacagugcaucgcggacaaaucuaucgcugauugcguugaggccuuacugggauguuaucuuacuuccugcggcgagagagcagcccagcuguuccucuguagcuugggucugaaggugcucccugucauuaaacggaccgacagggaaaaggcucugugccccacacgcgagaauuucaacucacaacagaagaaucuuagugugagcugugcagccgcguccguagcuucuagccguuccucagugcuaaaagauucugaauacggcugccugaagauaccaccuagauguauguuugaccaucccgaugccgacaaaacuuugaaccacuuaaucaguggguucgagaauuuugaaaagaaaauuaacuaucgguucaagaauaaggcauaccugcuccaggccuuuacccaugcuucguaucacuacaacacaaucacggauugcuaccagaggcuggaguuccuuggagacgccauucuggauuaucucaucaccaaacacuuguacgaggacccgcgccaacauagcccaggcguccugacugaccuacgauccgcacugguuaauaacacaauauuugcuucucucgccgugaaguaugauuaccacaaauauuucaaggcggugucaccugaacuuuuucaugucaucgacgauuucgugcaguuucagcuggagaaaaacgaaaugcaggggauggacagcgagaaguccuucuuacaaauguaccccguuccauugugugaaaauugccugaaauggaaccagaagcuccccaaucuggccagacuucgggagcugaccacuggaaggagugagucucucuggaaguga

SEQ ID NO: 55299 - RNA, 1689 nt, Artificial Sequence
  derived and/or modified sequence opt3 from DIDO1__Homo_sapiens__NP_071388
auggacgauaagggcgaccccagcaacgaggaagccccuaaagcuaucaagccaaccuccaaagaguucagaaagacauggggguuuaggcggacuacgauugcaaaacgcgaaggagccggugaugcggaggcugacccgcuggaacccccuccaccccagcaacagcucggccuuucucugcgacguucagggagacagccuaagaggaccgagcggguggagcaguucuugacaauagcccgcagaaggggacggcgcaguaugccagucagcuuagaagauuccggcgagcccacuucuugcccugcaaccgacgccgaaacagcuucggaggguucaguugagagcgcaagugaaacccgauccgggccacaaucugccagcacugcugugaaggagagaccggccuccucagaaaaaguaaagggaggcgaugaccacgaugacacaagugauagcgacucugauggccugacccuaaaagagcuccagaauaggcugcggcguaagcgcgaacaggagcccacggagagaccucuuaaagggauccaguccaggcugcggaagaagcgacgcgaagagggaccagcggaaacuguggguucagaggcaagcgacaccgucgaaggcguguugcccaguaaacaagagccugagaacgaccaggggguugugucucaggccggaaaggaugacagagaauccaaacucgagggcaaggcugcccaggauauuaaagacgaagaaccaggugaucuggggaggcccaagccggaaugugagggauacgacccuaaugcacuguauugcaucugucggcaaccccauaacaaucgcuuuaugauuugcugugauagaugcgaggaaugguuccacggcgacugugucggcaucagcgaggcuagggggcgucucuuagaacggaacggagaggauuacauaugcccaaauuguacaauccuucaggugcaggacgagacucauucggaaaccgccgaucaacaggaggcgaaauggcgaccuggugacgccgacggcacagauugcaccucuauugggacgaucgaacagaaguccucagaggaccagggaauuaagggcagaaucgaaaaagcagcuaaccccagugguaagaaaaagcugaaaauauuucaaccaguaauugaggcccccggggcuagcaaguguaucggcccuggaugcugccacguugcccagccagauuccguguauuguucuaaugacugcauuuugaagcaugcagccgcuacuaugaaauuccugagcucaggcaaggagcagaaaccgaagcccaaagaaaagaugaagaugaaaccugagaagccaagucuacccaaauguggggcgcaggcaggaaucaagaucuccagcguccacaaaaggccugccccagaaaagaaggagacaaccgugaaaaaggcuguggucguucccgcccgcucugaagcacucgguaaagaggccgcuugcgagucaaguacuccgagcugggccuccgaucacaacuacaaugcagugaagccugagaaaacagcggcuccaucucccucgcugcuuuauaaguguauguaccaucugggcguaggguugcucgacccuagccgguccuuuuggauugccauacccugggcaugcccaggacugggcguggccgcuuuauguuga

SEQ ID NO: 55300 - RNA, 2271 nt, Artificial Sequence
  derived and/or modified sequence opt3 from DIEXF__Homo_sapiens__NP_055203
augggcaagagagggagcaggucccagucucaacugcucaacacccuuacaaagaagcagaaaaagcaucugcgggacuucggagaggaacaccccuuuuacgaucgcgugucacgaaaagaggccaagccucagaucugccaguugagugaaagcuccgacucuucggauucagagagcgacagugaauccgagccacaacaggucucugguuaucaccguuuacuggcuacucuaaagaauguuagcgaggaagaggaagaggaugaggaagaggaagaggaagaggacuccauuguggaugacgcagagaugaacgaugaagacggcgggucagauguaaguguggaggaagagauggccgcggaaagcacggagucuccggagaaugucgcucucuccgccgaccccgaaggaaaagaggauggcgaagaaccuccagguaccucacagacaagccccgaagaguucacugacgcaaagcaugagagucuguuuucucuugaaaccaacuuccuggaggaagaguccggggacaauagcucguugaaagccucucaggauccuuuucuccaacacgugaacaaggagcugaaagaaaaggcuauacaggcaguugccacaaauccaaagaccacucaugagcugaaauggcccauccucggacaguuauucuuuuccucaaaguuccagaaacuggaaacauuuaagccuccaaaagacauugaucuuaagaguuugcaucugcaaaaaccgcuagagagcaccuggacgaagacuaacucccaguuccucucuggcccccagaaaagcucaaguccuuuuaccccacugcaaaaagaacuuuuccugaucaugaacuccuacagagacuuguuuuaucccgagaggacagcucucaagaauggcgaggaaauucggcacguguacugucugcacgucaucaaucacauauuaaaagccaacgcacaggugcuggggaauaacagccgcagaaggucucagaaguucggaguaggugaugacgaugacuuccgggaucagggccucacucgcccuaaaguucuuaucguggucccauuucgagaggcggcccugagaguggugcaauuguucauuucacuacuggaaggggacaguaagaagaaaaucauugucagcaauaagaaaagguuucagggagaguauggcuccgaucccgaggagcggccgccuaaccucaagcgucccgaggacuacgaagcuguuuucguggguaacaucgacgaucauuuucgcauagggguagccauucugcagagaucuaucaggcuuuaugcaccauucuacucgagcgacauucugaucgcuuccccuuugggacuccggaccaucauuggcggcgagggggagaaaaagcgagauuuugacuuccugucaaguauagaauuacugaucauugaucaggccgacaucuaccuaaugcaaaauugggaacacgugcuccaccugaugaaccauaugaaucuuuugccccuggauucucacggagucgacuuuagccgcgugagaauguggucccucaacaauuggucaaaguauuacaggcagacacugcuuuucggugcgcugcaggaugcccagauaaacagcguuuuuaauaaauauugcgugaacaugcaaggccaggucgcagugcggaauguaccaaugaccgggucuauuucccauguuuuggugcagcucccccacgucuuccagcgcauggaggcugagaaccuggccagugugaucgacgcuagauuuaauuucuucgucaacaagaucuuaccucaauacagggaugccgugaugagccauacgcugauuuauaucccaucuuacuuugacuucguucgucuacggaauuauuuuaaaaaggaggaacucaacuucacucacauuugugaauacacacagaaauccggagugucacgagcaagacacuuuuuccugcagggcgagaagcaauuucuuuuguucaccgagagguuucauuucuacaagcgcuauacuauaaaagguauccggaaucugaucuuuuacgaacucccgacauauccccacuucuacagugagauuugcaacaugcugagagccaccaaccgcggggaagaggcuacguggaccuguacaguauuauauagcaaguacgaugcgcagaggcuggcagccgucgugggcguugaacgagcugcccagaugcuucagucgaauaaaaacgugcauuuguuuaucacuggagagaaguga

SEQ ID NO: 55301 - RNA, 2397 nt, Artificial Sequence
  derived and/or modified sequence opt3 from DIP2A__Homo_sapiens__NP_001139587
auggccgacagaggcugcccccuggaggcugcaccucucccagccgaagugagggagagccuugcggaacuggaguuggaauuauccgagggggauaucacccagaagggauacgagaaaaagcgggcuaaacugcuagcccgcuauauuccgcucauacaagguaucgaccccucucugcaggcagaaaacaggauuccuggcccaucacagacaacugccgcugcacccaagcagcaaaaaucccguccuacggccagcagagaugagagguuccgguccgacguccacaccgaagcuguucaggccgcgcuugcaaaguacaaggagcgcaaaaugccaaugcccucuaagagaaggucggugcugguacauucaagcguggagacauauacuccuccagauaccaguuccgccucugaagacgaggggagcuugcggcgcccgggacgacucacauccacuccccugcagucacacaguagcgucgaaccuuggcuggauagagugauccaggguucuuccaccucaagcagugcuucuuccacaagcucgcauccaggcgggaggcccaccacggccccuucugcagcugccacuccaggagcggccgcaaccacagcucucgccggcuuagaggcucacacucauauuggcguucccgugaauagucgggucucaaguaaaauccaacagcugcuuaacaccuugaagcguccgaaacgcccuccccugaaggaauuuuucguggacgauuuugaggagcuacucgaaguacagcagccagacccuaaucaacccaagccagaggggagcgaaacauccguucugagaggagagccccuuaccgccggugugccuaggccaccgucucuguuggcaacgcuccagcgguggggcacuacacagcccaaaagcccuugucugaccgccuuagauacuacagggaaggcugucuacacccugacguauggaaaacucuggucacgaagucuuaagcuggcguacaccuugcuaaacaaacugacauccaagaaugaaccacuccugaaacccggcgaccgcguggcacuuguguucccuaacagcgauccagucauguuuaugguugccuucuaugguugccuguuggcugagcucgugcccguaccgauagaggugccucugacuagaaaggacgccgggucucaacaggucggauuuuuacugggcucauguggcguguuccuagcacucaccacagacgccugccagaaggggcugccaaaagcucagacuggagaaguugccgcauuuaaggguuggcccccucuuaguugguuggugaucgauggcaaacaccuggcgaagcccccaaaagacuggcacccucucgcucaagauaccgggacaggaaccgccuacauugaguacaagacuagcaaggaaggcuccacggucggugugacaguaucucaugcaucgcugcuugcccaguguagggcucugacccaggccugcggguauagcgaggcagaaacuuugaccaauguucucgacuucaaacgggaugcuggccuguggcacggaguguuaacauccgucaugaaccgcaugcauguggucucagugcccuacgcccugaugaaggcgaauccacuaaguuggauccagaaaguuuguuuuuauaaggccagagcugcacucgugaaaucuagggacaugcacuggagccugcuugcccaacguggccagcgggauguauccuugucaagccugcgaaugcucauugucgcugacggggccaacccguggucuaucuccaguugcgaugcauuccugaauguguuucagagcagaggauuaaggccugagguuauaugucccugcgcgucuuccccagaggcccugaccguggcuauucgccggcccccugaccuugguggcccacccccuagaaaggccgucuugucaaugaacgggcucaguuacggagugaucaggguagauacugaagagaagcugagcgugcuaacaguucaggacgucggccaagugaugccgggugcaaaugugugugucguuaaacuggaagggacgccauaucucugcaagaccgacgaggugggcgagauuugcgugucguccucugcuacuggaacagccuacuauggccugcuugggaucaccaaaaacguauucgaagcaguccccgugacaacuggaggugccccuaucuucgaucgcccauuuacccgaacgggcuugcugggguucauuggacccgacaauuuaguuuuuauagugggcaagcucgauggucugauggucaccggggugcggcgucacaacgcugacgauguuguggcgacagcccuugcaguagagccuaugaaauucgucuacagaggccgauga

SEQ ID NO: 55302 - RNA, 4731 nt, Artificial Sequence
  derived and/or modified sequence opt3 from DIP2B__Homo_sapiens__NP_775873
auggccgagagaggccuggaacccagcccugcugcaguggccgcgcucccaccggaggucagggcucagcuugccgaacuggaguuggaauuauccgagggggacaucacccaaaagggauacgagaaaaagcggucuaaacugcuaucacccuauaguccucagacacaggaaacugauagcgcaguucagaaggagcuccgcaaccaaacgccagcccccuccgcugcacagaccucugccccuucgaaauaccaccgaacacguucagguggcgcuagagacgaaagguaucggagcgauauucauacugaggccgugcaggcggcacuggccaagcacaaggagcagaaaauggcucucccaaugcccaccaagcgcagaaguacauucguacaauccccugccgacgcaugcaccccaccggauacuucuagcgcuuccgaagacgaggggucacugaggcggcaggccgcguugagugccgcacuccagcagagccugcaaaaugcugaaucuuggauaaaccgcuccauccagggaucaagcacaaguucuuccgccagcucgacccugucucauggcgaggugaaagguacguccgggucacucgcugaugucuuugccaauacucgaauugaaaacuucagugcacccccugacgugaccacaacuaccagcuccucuagcucaaguuccagcaucagaccagccaauauugauuuacccccuucuggaaucguuaagggcaugcacaaaggcucaaacaggaguagccugauggacacagcugauggggugccagucuccucucgggugucgaccaagauacagcaacuuuugaauacgcugaagcgucccaaacgcccgccucuaaaggaguuuuucguagacgauagcgaggaaaucguugaggugccccagccagacccuaaccagcccaaaccagaaggaagacagaugacucccgucaagggugagccucucggcgugauuuguaauuggccaccggcgcuggaauccgcacuucaaaggugggggacaacccaggccaaaugcucaugucugacugcuuuggacaugacaggaaagcccguguacacccucacguauggcaaacuguggagucggucuuuaaagcuggccuacacccuccuuaacaagcuggguacuaaaaaugagccugucuugaagccaggggaucgaguugcucuaguguaucccaacaaugacccuguaauguuuaugguggccuucuacggaugccugcucgcugaggucaucccagugcccauugaaguuccgcugacacgcaaagaugccggcggccagcagaucggguuucuucugggaagcugugguauagcauuggcgcucaccuccgaggugugccugaagggcuuaccuaaaacacaaaacggggaaauuguccaguucaagggauggccaagacugaagugggugguaacugacucaaaauaccuaagcaagcccccuaaagauuggcagccccauaucucuccagcuggcaccgagccugccuauauugaauacaagacauccaaagaggguaguguuaugggggugaccgucagcaggcucgcaaugcugucucacugucaggcccuuucccaagcaugcaauuauucagagggcgaaacuaucgugaacgucuuggacuuuaagaaggaugccggacuguggcacggcauguucgcaaacgugaugaauaaaaugcauacgaucaguguucccuacagcgugaugaagacauguccacucucguggguacagcggguccacgcucauaaagccaagguggcgcugguuaaaugccgcgaccuucacugggccaugauggcucacagagaucagagggacgugucccugucuagcuugcguaugcucauugucaccgauggggcaaacccguggucagugaguuccugugacgccuuucugucuuuauuccagagccauggacugaagccugaggcuauaugccccugcgccacuuccgcagaagcgaugaccguagccauccggcgaccaggugugcccggcgcuccucuaccagggagagccauucucucaaugaauggacugagcuauggcguuaucagggucaacacagaggacaagaauagugcacuuaccgugcaagaugugggucacgucaugcccgggggcaugauguguauaguuaaaccugacggaccgccacaguugugcaagacugaugagauuggcgaaaucugugugucuucccgcacagggggaaugauguacuuuggucuggcuggcgugacgaaaaacaccuucgagguaauccccgucaauagcgccgggucgccugugggagacguuccauucauucggucaggccuccuggguuuuguggggcccggcucuuuagucuucgugguuggaaagauggauggccugcuuauggugagugggagaaggcauaacgcagacgauaucguagccacuggauuggcugucgaauccauuaaaacaguguaucgcggccgaauagcgguguuuagcgucucuguuuucuacgacgagcggaucgugguaguggccgaacagcguccugaugcaagcgaggaggacuccuuucaauggaugucaagaguccuccaggcuauugauaguauccaccagguggguguuuacugccuggcccuagugccggccaauacccugcccaagacaccacucgggggaauccauauuagccagacuaaacaacuguuccuugaaggcucuuugcacccuuguaacauacugaugugcccccacaccugugucacgaauuuaccaaagccuaggcagaagcagcccggugugggcccagcuuccguuaugguggggaaccucgucgcaggaaaacgcaucgcccaggcggcuggccgggaccuggggcaaauugaggaaaaugaucuuguaagaaagcaucaguuucuggccgagaucuugcaguggagggcacaggccaccccggaccacgugcuuuucaugcugcuaaacgcuaaaggaacaacuguuugcaccgcaucaugucugcaacuccauaagcgagccgaacgcauugcgagugugcugggcgacaaaggucaccuuaaugcuggggauaacgucguguugcuguauccucccggaaucgaguuaauagccgcauuuuacggcugccucuaugccgguuguaucccaguaacagugcggcccccucacgcucagaaccugacugccacccuuccaacggucagaaugauuguugacgugagcaaggcagcuugcauccugacaucccagacccuaaugaggcuccugcguucucgcgaggccgcggccgcaguggaugucaagacuuggcccacaauuaucgacaccgaugacuugccucggaaaagacugccgcaauuauacaagccacccacuccugaaaugcucgcuuaucuggauuucucggugagcaccacaggcaugcuuacggggguuaaaaugucacauuccgccguaaaugcucugugcagggcaauaaaguugcagugugagcucuacaguucucgacagauugccaucugccuggaccccuauuguggacuaggcuuugcccuguggugccuuuguagcguguacuccgggcaccagucaguccucauuccaccuauggaacuggagaacaauuuguuccugugguuaucuaccgugaaccaauacaaaauccgggauacuuuuugcagcuauaguguuauggaacucuguacaaagggacugggcaaucagguggagguccuuaagacccgcgguauaaaccuguccugcgugagaacauguguagucguggcugaggaaaggccccggguugcguugcagcagagcuucucuaaacucuucaaggacaucgggcugucaccacgagcaguguccacuaccuuuggaaguagagucaauguggccauuugccuacaaggcacgagcgguccugauccgacaaccguuuacguggaccugaaaucgcuucgccaugauaggguccgucucguggagcggggcgcuccccagucucuguuguuauccgaaagcgggaagauccugccaggaguaaaagugguuauugucaacccugagacuaagggccccgugggggacucacaccucggagagaucugggugaauaguccacauaccgccucuggcuauuacacaauauaugacuccgaaacucugcaggcagaucacuucaacaccagacuuagcuuuggugacgccgcucagacacugugggcgaggacgggguacuugggauucguccgccgaaccgagcuaacugccgcaacaggcgaaagacacgaugcucuguauguagugggcgcccucgacgagacccuggaacuucggggguuaagguaccauccuauugauaucgagacuucaguuagucgcauccaccguagcauugcagagugugccguguuuacauggaccaaucugcucgucgugguuguggaauugugcggauccgagcaagaagcucuggaccucgucccccuggugacgaacguagugcuugaggaacauuaccugaucguuggugucgugguggucguugauccgggcgugauuccaauaaauucuagaggggagaagcagcggaugcacuugagggacagcuuccuagccgaucagcuggacccuaucuauguagcguacaacauguga

SEQ ID NO: 55303 - RNA, 4671 nt, Artificial Sequence
  derived and/or modified sequence opt3 from DIP2C__Homo_sapiens__NP_055789
auggccgacagaagccuggagggcauggcucucccccuugaagugagggcacggcuggccgaguuggaauuagagcuguccgaaggggauaucacccagaagggauacgagaaaaagcgcucuaaacuaauuggugcguaucucccucaaccaccgcgagucgaccaggcucugccccaggagcguagagccccuguuacaccaucaagugcaagcagguaccaccggcgcagauccucuggcucgagggaugaacgguaucgcucagacgugcauacugaggccguacaggcugcacuugccaagcacaaagaacgaaagauggcugugcccaugccuagcaagagaaggagucuggucgugcaaacguccauggaugccuacaccccacccgacacaucuagcggguccgaggaugagggaucaguucagggcgacagucaggguacuccuaccagcucucagggguccauaaacauggaacauuggaucucacaagcgauucacggaagcacaaccaguacuacaucuuccagcucgacccagucuggcggcuccggggcagcccaucgguuggcugaugugauggcccagacgcacaucgagaaucacucagcaccaccggacgucacuaccuauacaagugaacauagcauucagguggagcguccccaaggauccacugguucucgcaccgcuccuaaauacggcaacgccgaacucauggagacaggggauggaguaccaguuagcucaagagugagugcgaagauccagcagcuggucaauacccugaaaaggcccaagcggccuccacuccgagaguucuuuguggacgauuucgaagaguuacuggaagugcaacagcccgacccgaaccagccuaaacccgagggcgcccagaugcuugcaaugcgcggugaacaauugggggucguuacgaauuggccaccuucccuggaggcugcccuacagagauggggaacuauaagccccaaggcuccaugccucacaaccauggacacuaacggcaagccccuguauauccuuacauacggcaaacuguggaccaggucuaugaagguggccuacucaauuuugcacaaacucgggacgaagcaggagccuaugguacggccaggagaucgcguggcacuggucuuuccgaauaacgaccccgccgcuuucauggcggcauuuuaugguuguuuacuggccgaagugguuccugugccaaucgaggucccccucaccagaaaagaugcuggcagucagcaaauuggguuccuucugggaagcugcggcgugacaguagccuugacuuccgacgcaugucauaagggucuaccuaaaucuccaaccggggaaaucccccaguuuaagggcuggccgaagcugcucugguucguuacagagucgaaacaccugagcaagccuccaagggauugguuuccccacauaaaagacgccaauaacgauacugcuuacauugaauauaagaccugcaaagacggauccgugcuuggcgucacagugacccguacugcccuguugacgcauugucaggcacucacacaggcgugcggguacaccgaggcugagacuaucgucaaugugcuggauuucaagaaggacguuggauuauggcacgguauucugaccucagugaugaacaugaugcauguaaucaguaucccuuauucucuaaugaaagucaauccccucagcuggauucaaaaggugugucaguacaaagccaagguugcaugcgugaaaucccgggauaugcacugggcccuggucgcucaucgagaccagagagacauaaaccuuucaucauugaggaugcugaucguggccgauggcgcaaauccauggucuauuuccaguugugacgcuuuucucaacguauuccagagcaaggggcugcgccaagaagugaucugcccuugugccucuucccccgaggcgcuuacaguugccauacggagaccaaccgaugacucaaaccagccgccuggaaggggcguccugaguaugcacgguuugacuuauggggugauucgcguggauagcgaagagaagcucucgguccugacaguucaggacgugggcuuagugaugcccggagcuaucaugugcuccguaaaaccagauggcgucccccaacugugccgaacggacgagaucggggaacuaugugugugcgcaguugccaccggaacuucuuacuacggucucagcggcaugacaaagaauaccuuugagguguucccuaugacaucaaguggggcuccaauuuccgaauaucccuucauccggacuggacugcuuggcuuugucgguccugggggcuugguguucguugugggaaaaauggauggccugaugguagucucugggcguagacacaacgccgacgauauuguggcaaccgcgcucgccguggagccgaugaaguuugucuacaggggacgcauagcuguuuucagcgugacgguacugcaugacgaacggaucgugauugucgccgagcagagaccagauuccaccgaggaagacucauuucaguggaugagcaggguguuacaggcaaucgacaguauccaccaaguuggcguguauugucuggcucuuguccccgccaauacauugccuaaaacuccacucggugggauucaucugucugagaccaagcagcuauuccuggaaggaucccuccaccccugcaacgugcugauguguccucacacaugcguuacuaaucuuccgaagccccgacagaaacagccagagauaggcccugcaagcgugauggucgguaacuugguaucgggcaagcgcaucgcccaagcuagcgggcgggaucugggacagauugaagacaaugaucaggcgagaaaauuuuuauuccucucugaggugcugcaguggagggcccaaaccacgcccgaccauauccuuuacacacuguugaacugucguggcgcaauugcuaauaguuuaaccugcguucagcugcacaagcgcgccgagaaaaucgccgugaugcuaauggaacgggggcaucugcaggauggagaccacgucgcucucguguauccaccuggcauagaucugaucgcagccuuuuacgguugucuuuaugcggggugcguacccauuacugugagaccaccgcauccucaaaacaucgcuacaaccuugcccacugucaagaugauuguugagguguccaggagcgccugucugaugaccacacaguuaaucugcaaacuccugcgaucucgggaagcagccgcugcaguggacguccgcacguggccacuuauacuggauaccgacgaucuacccaagaagagaccugcccagauuugcaaaccauguaaucccgacacucucgcguaccuggauuucagcguguccacaaccggaauguuggcuggcguuaagaugucacacgccgcaacaagugccuuuugcaggagcaucaaacugcagugugaguuauacccuucucgggaaguagcuauuugccucgacccguauuguggucugggcuucgugcuuuggugccuguguuccgucuacucagggcaccaaaguaucuugauaccacccagcgagcucgagacuaacccugcccuguggcuacuggcagugucccaguauaagguucgagacaccuuuugcucuuacucggugauggaacuuuguacgaaaggacucggcagccagacagagucacugaaggcuagaggguuggaucugucccgcgucaggaccugcgugguagucgccgaggaacguccccggaucgcguuaacucagaguuucucuaaacucuucaaggaccugggacuucauccaagagccgugagcaccuccuuuggcuguaggguuaaucuggcaauuugcuugcaagguacaucagggccugaucccacuaccguguaugucgacaugcgcgcucuccgacacgauagagugcggcugguugagaggggaucuccacauagccuaccucugauggaaaguggcaagauccuuccgggugugcgcauuaucauagccaaccccgagacaaaaggcccacucggggacucccaccugggagaaauuuggguccauagcgcucacaaugcaucuggcuacuucacgaucuauggggaugagucauugcaguccgaccacuuuaacagucgucucagcuucggagauacccagacuaucugggccagaacaggcuaccuggguuuucuccggaggaccgaacugacugacgccaacggggagcgccaugaugcucuuuacgugguaggagcgcuggacgaggcaauggaauugcgaggcaugagauaucacccuauugacaucgagacaucggugauucgggcccauaagucuguuaccgaaugcgcugucuucacguggacuaaucuacuggugguggucguagagcucgauggcuccgaacaggaggcccuggaccuugugcccuuaguuaccaacgugguccuggaggaacacuaccucauaguggggguuguggucgugguagauaucggagugauuccaaucaauagcaggggugagaaacaacgcaugcacuugagagacggcuuucuggcagaucagcucgacccuauuuauguugccuacaacauguga

SEQ ID NO: 55304 - RNA, 597 nt, Artificial Sequence
  derived and/or modified sequence opt3 from DIRAS1__Homo_sapiens__NP_660156
augcccgagcagagcaacgacuacagaguggucguuuucggcgccgggggaguggguaaguccucucugguacucagguuugugaaaggcaccuuccgggauacauauaucccuacuauugaagacacguaccgccaagucauaucaugcgauaagaguguguguacccuucagaucacagacacuaccgggagccaccaguuuccagcuaugcagcgacuguccauuucuaaaggacaugcauucaucuugguuuuuagcgugacaucaaagcaaucguuagaggaacugggcccgauuuauaaacuaaucguccagauaaaggguaguguggaggauauccccguaaugcucguugggaauaagugcgacgaaacccagcgugagguggauacuagagaggcccaggcggucgcucaagaauggaaaugugccuucauggagacauccgcaaagaugaacuacaaugugaaagaacuguuucaggagcuucugaccuuggagacgaggcggaacaugucucucaauauugacggaaagcgcagcggcaaacagaagagaacugauagggugaagggcaaaugcacccugauguga

SEQ ID NO: 55305 - RNA, 600 nt, Artificial Sequence
  derived and/or modified sequence opt3 from DIRAS2__Homo_sapiens__NP_060064
augcccgagcagagcaacgacuacagaguggccgucuucggcgcugggggaguugguaaguccucucuggugcucagguuuguaaaaggcaccuuccgggaaucauauaucccuacaguggaggauacuuaccgccaagucauuaguugcgacaagagcauauguacgcuucagaucaccgauacaacugggucccaccaguuuccagcaaugcagcgacugucuauuucgaaaggacaugccuucaucuugguguauucaauuaccagccgucaaaguuuagaggaacugaagccgaucuacgaacagauaugcgagaucaaaggcgacguugaguccauucccaucaugcuaguggguaauaagugugaugaaucuccuagcagagagguccaguccucagaagcggaggcucucgccaggacauggaagugcgcauuuauggagaccagugccaaacugaaccacaaugugaaggaacuuuuccaggagcuguugaaccucgaaaaacggcgcacuguaagccugcaaauugacgggaagaaaucuaagcagcagaagagaaaagagaagcugaaaggaaaguguguuaucauguga

SEQ ID NO: 55306 - RNA, 315 nt, Artificial Sequence
  derived and/or modified sequence opt3 from DIRC1__Homo_sapiens__XP_011508847
augcccgaggcccacaugcagccugcuaagcugcaaaccagccucccaacaacugaccauggcuccaaaaagccggugucuugcuaccuucccccucugucaaacgcacacccaauguguaucgaaguccagaaugcccagaacugcaguagcgcggcugccacguuggagcccuccauuauaucugauaccuguuucuauaaaccuaucacaaaggaccaguuaucgucaagaagcgaacugaauacuguuaggcuaaaaugccucaacagucugcggggguggaagauucuuaaucaacuguccuugaccuga

SEQ ID NO: 55307 - RNA, 1437 nt, Artificial Sequence
  derived and/or modified sequence opt3 from DIRC2__Homo_sapiens__NP_116228
augggcagcagaugguccucugaggaagagaggcagccccugcucgggccuggacuugguccaggccugggggccucauggcggagucgcgaagcugcagccgcggcuuugccggccgcagugcccggaccuggccgagucuacggucguagaugguuaguucugcuacucuucagccugcuugccuuugugcaagggcugguauggaacaccuggggaccaauccaaaauuccgcuaggcaggcauauggcuucucuucgugggacauugccuugcucgugcuguggggccccauaggguuucugccuugcuucgcuuuuauguggcucuuagauaagcggggacugcgcaucacaguccuuuugacuucauuccugauggugcuagguacgggccucagauguauuccaaucagcgaccugauucuuaaaaggcggcugauccacgggggacagauguugaacggccucgccggucccaccguuaugaaugcggcaccuuuucugaguacaacuugguucuccgccgaugagcgcgcuaccgccacagcaauagcuucuauguuaagcuaccucgggggagccugcgcguuucuggugggcccacuugucgugccggcccccaacggcaccuccccucuguuggcagcugaaucaagucgagcccauaucaaggacagaauugaggcuguacuauaugccgaguucgggguugugugucugaucuuuagcgcaacucucgccuacuucccacccaggccuccacugcccccgucugucgcugcggcaucccagcggcuuucauaucgucgcagcgugugcagacuguugaguaauuuuagguuccucaugauugcccuggcuuacgccaucccuuuaggaguguucgcagguuggucuggcguccuggaucuaauacucacacccgcccacguuucccagguggacgcuggguggauuggauuuuggagcaucguaggcgguuguguggucgggauugccauggcacgguucgcggauuuuauccgaggcaugcugaaacuuaucuugcugcuccuguucucgggagcuacccuuucuuccacgugguuuacucugaccugcuugaacucaauuacacaucucccacugacuaccgugacauuauaugccaguuguauacugcuaggcguuuuccucaauagcuccgugccuaucuuuuucgaacuguuugucgagaccguguaccccguaccagaagggauuacgugcggaguugugacuuuccuuucuaacauguuuaugggugucuugcuguucuuucucacauucuaccacaccgagcugagcugguucaauugguguuuacccggcucaugccugcuuaguuugcuccugauccuauguuuucgcgaguccuaugacagacuguaccucgauguggucgugagcguuuga

SEQ ID NO: 55308 - RNA, 2787 nt, Artificial Sequence
  derived and/or modified sequence opt3 from DIS3__Homo_sapiens__NP_001121698
augcugaaaagcaaaaccuuccucaagaaaacaagagccggcggggugaugaagaucgucagggagcacuaccuucgggacgauauuggaugcggugcucccggcugugcagccugcgggggagcgcaugaaggcccugcucuggagccacagccgcaagaccccgccuccucuguuuguccucagccacacuauuuguuacccgauacuaacgugcugcuacaucagauaguaucagcauggcgcccugguacgugggccaguguggcuagcucccuccgacugccagggucucuugaaaccuacgucgagcaggaacaaggagagaaugcaaacgaccguaaugauagagccaucaggguggcugccaaaugguauaacgagcaccugaagaagaugucggcggacaaucaguugcagguuauuuuuaucacaaacgaucggcgcaauaaagaaaaggcaauugaggaaggcauccccgccuucacuugcgaggaguacgugaaaucacucaccgcuaacccugaacugauagacagacuggccugucucagcgaggaaggcaaugagaucgaaagugggaagauuaucuuuuccgagcauuuaccacugucuaaacuucagcaaggaauuaagagcgguacauauuugcagggcaccuucagggcaucccgggagaacuaccuggaagcuacugucuggauccacggggauaaugaggaaaacaaggagauaauucuacagggacucaaacaccugaaucgcgccgugcaugaagacaucguagcgguugagcuucugccgaagucacaguggguggcccccaguagcgucguguugcacgaugagggccaaaacgaagaggacguggaaaaagaggaagagacagagcgaaugcucaagaccgcagucucugaaaagaugcugaagccuacggguagaguuguggggauuaucaaaaggaauuggcggccauauugcggaauguuauccaagucagauaucaaggagagccgucgccaucuguuuacucccgcugacaaaaggauuccuagaauacggaucgaaacccgacaggccaguacacucgagggccgcagaauuaucguagcuauagacggcuggccaaggaacucucgguaccccaacgggcacuucgugcgcaaucuuggagaugucggugagaaggaaacugagaccgaagugcuguugcuagagcacgacguuccgcaucagccuuuuucccaagccgugcugagcuuccuccccaaaaugccauggucgauuacagaaaaggauaugaaaaacagagaggaccugaggcaccuuuguaucugcucugucgauccucccggcuguaccgacaucgaugacgcacugcauugccgugaguuggaaaaugggaaccucgaggugggaguacacauugccgauguuucccauuuuauccggccaggcaaugcucuggaccaggaaucagcgcgaagagguacgacuguguacuuaugugagaagaggauugauaugguccccgaacugcuaaguagcaaccucugcucccugaagugcgacguggaccgccuugcauucucuuguauaugggagaugaaucacaacgccgagaucuugaaaacaaaguuuaccaaaagcgucauuaauucaaaggcuagucugacuuaugccgaagcacagcuccggaucgauuccgccaacaugaaugacgauaucacaaccagccugagagggcuuaacaaacuggcuaagauuuugaagaaaaggcgcauagagaagggcgcccucacgcugucuucaccugaagugcgauuccacauggacagugagacccaugauccaaucgacuuacagacaaaagaacugcgggagacuaauagcaugguugaggaauuuaugcuacucgcaaacauuuccguggcgaagaaaauccacgaggaguucucugaacaugcucugcuucguaagcacccggcacccccuccaucgaauuacgagauuuugguaaaggccgccagaagcaggaaccuggaaaucaaaaccgauacagcuaagucccucgccgagucacuggaccaagcagaaagucccacuuucccuuauuuaaacacccugcuucgcauauuggcuacacggugcaugaugcaggccgucuacuuuuguucuggaauggauaaugacuuccaccauuauggccucgcgagcccaaucuacacccacuuuacuucccccauuagaagguaugccgaugugaucguucaucgacugcuagcuguggcaauuggggccgacugcacguacccggagcugacagauaaacacaagcucgcugacaucuguaaaaaccugaauuuccgccauaagauggcccaguacgcacagcgggcgucagucgccuuucacacccaacuuuucuuuaaaagcaagggaauagugucugaagaggcuuauauuuuguucguaagaaagaacgccaucgugguucugauuccuaaauacgguuuagagggcacugucuuuuucgaagagaaggacaaaccaaauccccagcucaucuaugaugacgaaauaccuucccugaagaucgaggauaccguguuucacguguucgacaaagucaagguuaagauuaugcuugauaguagcaaccugcagcaucagaaaaucaggaugucuuugguggaaccccaaauuccagggaucuccauaccuacagacaccucaaauauggaucucaacggacccaagaaaaagaaaaugaagcugggcaaguga

SEQ ID NO: 55309 - RNA, 1812 nt, Artificial Sequence
  derived and/or modified sequence opt3 from DIS3L2__Homo_sapiens__NP_001244210
augagccaccccgacuacagaaugaaccugaggccucucggcaccccacgcgggguguccgccgucgcuggaccgcaugauaucggugcaucucccggcgacaagaaaucaaagaaucggaguacacgagggaaaaagaaaagcauuuucgagacuuauauguccaaggaagauguuucugagggacuuaagcguggcacgcugauacaggguguguugagaaucaacccuaaaaaguuucacgaagccuucauuccaucgcccgacggggauagggacaucuuuauugauggaguaguggcgcggaaucgcgcuuuaaacggcgaccuggucgugguuaaacuacucccugaggaacauuggaagguggucaaaccagagucaaaugauaaggagaccgaagccgcauacgagagcgacauccccgaggaacugugcggccaccaucuuccucaacagagucugaaguccuauaacgauucuccagacgugauaguagaggcccaguucgaugggagcgacuccgaagacggacacgguaucacacagaauguuuugguggauggcgucaaaaagcucucagugugugugagugagaaagggagagaagacggagaugcuccggucacuaaggacgagaccacaugcauuagccaagauaccagggcacugucugaaaaaucccugcagcggucagccaagguuguguacauccucgagaaaaagcacagccgcgcugccacuggcuuuuuaaagcugcuugcggacaaaaacagugaguuguuccgaaaguaugcacuguuuucucccuccgaucauagaguaccuaggauuuacgugccacuaaaagacuguccccaggauuucgucgcccggccuaaggacuaugcuaauacacucuuuaucugccguauaguggauuggaaagaagacuguaacuucgcccugggucagcuugcaaagagccuggggcaagcuggagagauugaaccagagaccgaaggcaucuugacggaguacggcguugacuuuucggauuucucuuccgaggugcucgaaugccugccccagggguuaccguggacuauuccucccgaggaauuuucaaagcgcagagaccugaggaaagauuguaucuucaccaucgacccaaguacagcccgggaucucgacgaugcgcuuagcugcaagccucuggccgacggaaauuucaaagucggugugcacauugcagauguauccuacuuuguucccgagggcucugacuuggauaagguggcugccgaacgagcuacuagcgucuaucuagugcagaaagucgugccaaugcugccccgccuccugugugaggagcuuugcucacugaacccuaugagugacaaguugaccuucuccguuauauggacacucaccccagaagggaagauccuggaugagugguuuggaagaacgauuaucaggagcuguacuaaauuaucuuacgaacaugcccagucaaugauagagaguccgacagagaagauucccgcaaaagaacugccuccaaucagccccgagcacuccucugaagaggugcaccaacagaaugccgacaaggacggcgcugcgcaucuacaggcaucgcacagcccuuccgccgaagaugcugaggcccaaccaucaaccgaggaacggcuccccgagacucgcgguaucugcgacagagauccggacacaaggcuguucuuucuucagcagcagagucguguauuggaagcaaaaccucaaaacaccauucgggucgaggaacagacgacccagcugcagaucuga

SEQ ID NO: 55310 - RNA, 3165 nt, Artificial Sequence
  derived and/or modified sequence opt3 from DIS3L__Homo_sapiens__NP_001137160
augcugcagaagagagagaaagugcuccuucugaggaccuuccaaggccggacauugcgcaucguccgagaacacuacuuacgucccugcguuccuugucauagcccacugugcccgcagcccgccgcuuguucccacgacgggaagcuacucucuucagaugugacucauuauguaauuccugacuggaaagugguccaggauuaccuggagauacuugaauuuccagagcugaagggaaucauuuucaugcagacggcaugccaagccgugcagcaccagagagguaggcggcaguauaacaaauugcgcaaucuccugaaggacgcgagacaugauuguauccuguuugcuaacgaguuccaacagugcuguuaccuccccagggagcggggcgagaguauggaaaaguggcagacccgcagcauuuauaaugccgcaguuugguacuaucaccacugccaggaccgaaugccuaucgugauggucacagaggaugaagaggccauacaacaguacggguccgagacugaaggaguguuuguaaucaccuucaaaaacuacuuagacaauuuuuggccagaucugaaggcugcacaugagcuuugugacucuauuuugcagucgagaagggaacgggagaacgaaucacaagagagccacggcaaagaguaucccgaacaucugccucuagagguucucgaagccgguaucaagagugggcguuacauucagggaauccugaaugugaacaaacaccgcgcucagauagaggccuucgucagacuucagggcgcguccucuaaggauagcgaccugguguccgauauuuugauccacggcaugaaggcaaggaaucggucaauucauggggacguggucguuguggaacuccugcccaaaaacgaguggaagggacgaacaguagccuuaugcgagaaugacugugaugacaaagcuaguggugaaagcccgucugagcccaugccuaccggccgcguggucgggauccugcaaaagaacuggagagauuaugugguuacuuuuccauccaaagaagaggugcagucacagggaaagaaugcccagaaaauccucgucacacccugggacuacaggauuccuaagauacggaucagcacccaacaggcagaaacgcuucaggauuuccgcgugguaguuagaauugacaguugggagucuacuuccguguauccaaacggccacuuugucagggugcugggucguaucggggauuuggagggagaaauagcuaccauucuagucgagaauagcaucucggugauccccuucucugaagcccagaugugcgagaugccgguuaacacaccugagucccccuggaaggugucaccagaagaggaacaaaaacggaaggaccugcgaaaaagucaucucguauuuagcauugauccuaagggcugcgaggacgucgaugacacucuguccgugagaacccuuaacaauggcaaccuggaauuggggguucacaucgcggacgugacacauuucgucgcccccaauucuuacauugauauagaggcaaggacccgcgcuacgacuuauuaccucgccgaccggagauacgauaugcugccaagcguguuaucagcugaccuguguagucuacucggagguguagauagguaugccguguccaucaugugggagcuggacaaagcaagcuacgaaauuaagaagguuugguauggccgcacaaucauccgaucugccuacaaacuuuucuaugaggcugcgcaggaauugcuggaugggaaccucucagucguggacgauauucccgaguuuaaggaccuggaugaaaagagucggcaggcaaaacuugaggagcuggugugggccauaggaaaauugaccgacaucgcucgucacgucagagccaagagggauggcugcggugcacucgaacuggaggggguugaagugugugugcaguuagacgacaagaaaaauauucacgaucugaucccuaagcaaccacuagagguacaugaaacugucgccgagugcaugauucucgcuaaccacuggguggccaaaaagaucugggagagcuucccgcaucaggcacugcuucgccagcacccaccuccacaccaagaauuuuucuccgaguugcgggaaugugcgaaagcuaagggcuuuuucauagacacaagaucuaauaagacccuggccgauucgcucgacaacgcaaaugauccccaugacccuaucguuaacaggcuguuacgaagcauggccacgcaggcuauguccaaugcccuguacuuuucaaccggaaguugcgcagaggaggaguuccaccauuauggccuugcuuuggauaaauacacacacuuuacuucuccaauucgccgguacagcgacaucgugguccauagacuccugauggccgcgauuuccaaggauaaaaagauggaaaucaaagggaaccuauucucaaauaaggaccuggaagaacucuguaggcacauaaacaaucguaaccaggccgcucagcacagccaaaaacagucuaccgaacuguuucagugcauguauuucaaggauaaggaccccgcaacagaggagcgcuguauuuccgauggagugaucuacaguauucggacuaacgguguucuuuuguuuaucccgagauucggcauaaaaggggccgcuuaucugaagaauaaagacggauuagugaucagcugcggcccugacucuuguuccgaauggaagccagguucacuccagagguuccaaaacaaaauuaccaguacaaccacugauggggagagcguaacguuucaucuguucgaccacgucacagugcgaaucucgauucaggccucccggugccauucugauaccauccgccuugaaauaauuagcaauaagcccuacaagaucccuaacacugagcugauccaccagucaagucccuugcucaaauccgaacuggugaaggaggucaccaaaucuguugaggaagcacagcuagcgcaagaggugaagguaaauauuauccaggaagaguaucaggaauacagacaaacaaaaggcaggagccuguauacccuccuggaggagauucgggaccuugccuugcuggauguguccaacaauuacggaauauga

SEQ ID NO: 55311 - RNA, 2499 nt, Artificial Sequence
  derived and/or modified sequence opt3 from DISC1__Homo_sapiens__NP_001012975
augcccggcgggggaccucagggugccccagcugcagccggcgggggaggcgugagccacagagcggguuccagggacugccugccgcccgcugccuguuuccggcgccgacgucucgcaagaaggccuggguacaugcggucuucaaccggaccaggcaucggcuuucuuagucccgccgucgggacacuguuccgcuuuccuggagguguuagcggcgaggaaucccaucacucugagucgagagcuaggcaaugcggguuggauucacggggauuacuggugcgcagcccaguaaguaaguccgcagccgcucccacugugacgucuguccgaggcaccagcgcccauuucgguauucagcuaagagggggaacaaggcucccugaccggcuguccuggccauguggcccgggcucagcgggguggcagcaggaauuugcagccauggauaguagcgagacucuugacgcuucuugggaagccgcaugcuccgauggagcucgucgcgugagagccgcggguucacugcccagcgccgaguugaguucuaacuccuguagcccuggcugcgggccagagguucccccuaccccacccggaucgcacucugcauucacauccucauuuaguuucauaaggcucagccugggcuccgcuggugaacgaggggaggccgaaggcuguccgccuucucgggaggcugagagccauugccaaucaccccaggaaaugggagccaaagcagccagucuggacggcccacacgaggauccucgcugucucuccagacccuuuagcuuacuggcuaccagggugucugcggaccuugcacaggccgcucgcaauucaagucggccagaaagagauaugcacagcuugcccgacauggauccuggguccucuucgagccuggacccaucccuagccggaugcgguggcgaugggucaaguggaucuggcgacgcacauagcugggacacucuccugaggaagugggagccgguccuucgugauugucuguugcggaaccgaagacagauggaagugaucucccucaggcugaaauuacaaaagcugcaggaggacgccguagagaaugaugacuaugauaaagcugaaacacuccagcagcgccuugaggaccuggaacaagagaagauuucauugcacuuccagcuacccagccggcagccugcccugucuuccuuucucggucaucuggcagcgcaaguucaggcugcccuuagaaggggagcaacccagcaggccaguggcgaugacacgcacacuccacugcgcauggaaccccgauugcucgagccuaccgcucaagauagccugcacgugucuaucacacggcgugacugguuacugcaggagaagcagcagcuacaaaaagaaauugaggcccuccaggcaagaauguucguccuggaagcuaaggaucagcagcuuaggcgcgagaucgaggaacaagagcagcaguugcaguggcaaggaugcgaccugacuccacucgugggccagcugucccuugggcagcugcaagaagugucaaaagccuugcaggacacccucgcgagugccggacagauacccuuucaugcugagccgccugaaacaauccggagccugcaggagagaauuaagucguuaaaccugucccuaaaagagaucaccacgaaggucugcaugucugaaaaguucuguagcacucucaggaaaaagguuaaugauauugagacacaacugccagcacuuuuggaagccaaaaugcacgcuaucucagguaaccauuucuggaccgccaaggaccugacugaggaaauacgaagucucacauccgagcgcgagggccuggaaggguuacugucuaaacuuuuggugcucagcucccggaauguaaagaaacugggaucagugaaggaggauuacaacagacuaaggcgugaagucgagcaccaggaaaccgcauaugagacgagcgugaaggagaauaccaugaaauacauggaaacacugaagaacaaacucugcaguuguaagugcccccugcuuggcaaaguuugggaggcggacuuggaagccugucgccuguuaauucagucucuccagcugcaagaggcucgggguucccuuagcguggaagaugagagacagauggacgaucuggagggggccgcaccucccaucccaccuagguugcauucggaagacaagcgaaagacuccccucaaagagucauauauucugucugcugaacuaggcgagaagugcgaggauaucgggaaaaagcugcucuaccuggaagaccagcuucacaccgccauccacagucaugaugaggacuugauucagucccugcggcgcgaauuacaaauggucaaagagacacuccaggcaaugauacugcagcuucaaccagccaaggaagcuggcgagagagaggcggccgcaagcuguaugacugcuggggugcacgaagcccaggccuga

SEQ ID NO: 55312 - RNA, 4575 nt, Artificial Sequence
  derived and/or modified sequence opt3 from DISP1__Homo_sapiens__NP_116279
auggccaugagcaacggcaauaacgacuucgugguccuguccaauucuucaaucgcuaccagugcagccaaccccagcccucucacaccaugcgauggggaccacgcggcucagcaacuuacuccgaaggaggccacgagaaccaaaguuucccccaauggaugucugcaguugaacgguacagugaagucuucguuuuuaccucuggauaaucagaggaugccacagaugcuaccccaaugcugucauccuugcccauaccaccauccccucacuucacacagcagucaucaggaaugucacccugaggcaggcccagccgcuccguccgcacuggccucuugcuguaugcagccccacagcgaauauuccgcuucacuuugcccuaaccauaguccaguauaccagaccacauguugccugcaacccagcccuucuuucuguuugcaccauccauggcccgaccacuuucagcaccagccggugcagcaacauauugccaauauacggccuucccgccccuucaaacucccaaagucauaugcggcacugaucgccgauuggccugucgugguucuggggaugugcaccauguuuauuguggucugcgcucucgugggaguauuaguucccgagcugccagacuucagcgauccccuuuugggcuuugaaccucgagguacugccaucgggcagcgucuggugacauggaacaauauggucaaaaacaccggauacaaggcaacgcuagcuaauuauccauucaaguacgccgacgagcaggcgaaaagucacagagaugacagguggucugaugaccauuaugagcgggaaaagcgcgagguggauuggaacuuucacaaagacuccuucuuuugugacgugccgagcgauagauacucgagggucguuuucacuucuuccggcggcgaaacccucuggaaucugcccgccauuaagucaaugugcaacguggacaacagucggauccgcagccauccucaauuuggggaucuuugucagcgaacaacugcagcuuccugcuguccaucuuggacccugggaaauuacauagccaucuugaacaauagaagcucaugccagaaaauuguagagagggacgugagucacacacucaagcuguuacggaccugugcuaagcacuaucagaacgguacgcugggccccgauugcugggacauggccgcacgucgcaaagaucaacucaaguguacuaaugucccuagaaaaugcacaaaguacaacgccguguaucagauccuucauuaccugguugacaaagauuucaugaccccaaagacugcugacuaugcgacacccgcauugaaauacuccaugcuauucagcccgaccgagaagggggaaucuaugaugaauauuuaucuggauaacuuugagaauuggaacucaagugacggagugacgaccaucacaggcauagaguucgguauuaagcacagccucuuucaggacuaccugcuuauggauacugucuacccugccaucgcuauugugaucguacuguugguuauguguguguauaccaaauccauguucaucacacucaugacuauguuugccauuauaucuucgcugaucgucagcuacuucuuauauaggguggucuuucauuucgaguuuuucccauuuaugaaucugaccgcacuaauuauccucguggggauaggagccgacgaugcuuucguucugugcgacguguggaacuacacaaaguuugauaaaccccacgccgaaaccuccgagacuguaucaauuacgcuucagcacgcagcguugaguauguucgucacaucuuucaccacugcugccgcauuuuaugccaauuacgugagcaacaucaccgcuauccggugcuucggcguuuaugccggcacagcaauucuggugaauuacguccucauggugaccuggcugccugcuguagugguucuucaugagcgauaccuguugaacaucuuuacuuguuucaagaaaccccaacagcagauuuaugacaacaaguccugcuggacagucgccugucagaagugccacaaagugcucuuugcgauaucagaagccagccgcaucuucuuugagaaggugcugccauguauugucaucaaauucagauacuuauggcuguuuugguuccuagcucucacgguugggggagcauauaucgugugcauuaauccuaagaugaaacugcccucucuugaauuguccgaguuucaaguguucaggaguagccauccauuugaacgguacgaugccgaguauaagaagcuguucauguucgagcgcguacaccauggugaagaacuccacaugccgauaaccgucaucuggggcgugucuccugaagacaacgggaauccccugaacccaaaauccaagggaaaauuaacucuggauucaaguuuuaauauugcuagccccgccucgcaggcauggauccuucacuucugucagaaguugagaaaccagacauuuuucuaccaaaccgacgagcaggauuuuacauccugcuucauugaaacuuuuaaacaguggauggagaaucaagacugugaugagccugcgcucuauccaugcuguucucauuggagcuuccccuacaagcaggaaaucuuugagcugugcauaaagagggccaucauggaacuagagcguucaaccggcuaccaccuggacaguaaaacgccugguccgcgguucgacauuaacgauaccauccgagcuguugugcucgaguuucaguccacauaucuguucacucuugccuacgaaaagaugcaucaguucuauaaagaggucgacucuuggauuagcuccgaauugucaagcgcaccagaggggcugaguaauggcugguuugugucuaacuuagaguucuacgaucuccaagacucccugagcgauggaacccuuaucgcuaugggccugucgguugccguggcauuuucaguaauguugcucacaacuuggaauauaauuaucucucuguaugccauuaucaguauagcugggaccaucuucgucacggugggaucccuagugcugcucgguugggaacugaacguccuugagagcguuacaauuucuguggcgguaggcuugagcguggacuuugccguccacuacgggguggcauauagacuggcucccgauccugacagggaaggaaagguuaucuucuccuuaucacgcgugggcagugccauggccauggcugcacucaccacuuuugucgccggugcgaugaugaugccaagcacagugcuggcuuacacccagcuugggacuuucaugaugcugauuaugugcaucucuugggccuuugcaaccuucuuuuuccaguguaugugccggugucuaggcccccagggaacaugcggccaaauaccucucccgaaaaagcugcaguguuccgccuuuucacaugcuuugaguacgagccccuccgauaaagggcagucuaagacccacacuauuaaugcauaccaccuggacccaagaggaccuaagucggaguuagaacaugaguucuaugaacucgagccccuggccagccacucaugcacagcgccagagaaaaccacauacgaagagacucauaucuguuccgaguucuuuaacagucaggcuaagaaucuugguaugccuguucacgccgcauauaacucugaacugagcaaauccaccgaaucagaugccggcucugcuuugcuccaacccccacuggagcagcacacggugugccauuucuuuagccuaaaccagagguguaguugcccggacgccuacaagcaccugaauuaugggccucauuccugucaacagaugggagauugccuuugccaccaguguagccccacaaccucuucauucguccagauccaaaacggcguagcaccacucaaagcuacucaucaggccguggaggguuuuguucaccccauuacccacauccaucacugcccuugucugcaggggcgcgugaagccagcgggcaugcaaaauuccuugccccgaaacuucuuucugcauccuguccagcacauucaggcccaggaaaagauaggaaaaacaaaugugcacaguuuacagcggagcaucgaggaacaucucccgaagauggcagagccaucgucuuucguaugccguuccacuggcagccugcuuaaaaccuguugcgaccccgagaacaagcaaagagaacuguguaaaaauagggacgugucaaacuuggagaguucugggggaacagaaaauaaggcuggcgguaaggucgagcucucccugagccagacggaugccucaguuaacagugaacacuuuaaucagaacgagccuaaagugcuauucaaucaucugaugggggaggcuggaugccgcagcugucccaacaauucccagucuugcggccggauugugagagucaaguguaacagcguggacugccaaaugccaaacauggaagcaaauguuccugccguacuuacccacuccgagcucucaggugaaucucuguugaucaaaacuuuauga

SEQ ID NO: 55313 - RNA, 2052 nt, Artificial Sequence
  derived and/or modified sequence opt3 from DIXDC1__Homo_sapiens__NP_001033043
augcuggccugccucaccagaggcaaccuucuggacguguugcaggagggguucaaugaacaacaguuacaggcuuacgucgcauggguuaacgcccagcugaagaaaaggcccgcggugaagccuguacaagaucuacggcaggaccuccgcgauggagugauccuggcuuaucuuauugagauagucgccggugaaaaacugagcggcgugcaguuguccccagggaaucagcaagagaugaagaacaauguugaaaaagugcuccaguuugucgcaucuaagaagauccgaaugcaccagacaucagccaaagacauuguggauggaaaccugaagaguaucaugcgucugguacucgcuuuagcagcccauuucaaaccgggcagcuccagaacuguuaaucaggguagggacucucgggcuccccugcaaucgcaccgcccucauugugccacggcgguggcacagggggccgcugccgcacuugcugaugucugccacgacaugucaagaagcggaagggauguguuucgguaccgccagcgaaacaguuccauggacgaggagauugaaaauccauauuggucugugagagccuugguccaacaguacgagggccagcagaggagccccuccgaaucaaguuguagcucucugaccuccccuucaccaauccauagcgcgaagagugagucuauaaucacacaauccgaggaaaaagccgauuucguuauuauccccgcagagggcauugaaaaccggacugaggggaccgacagcccucuaucgcgugauuggcgcccaggaucuccggguacauaucucgaaaccuccugggaggagcagcugcuugaacagcaggaguaccuggaaaaggagauggaagaggcuaagaaaaugaucucaggcuugcaagcccuccuguuaaaugggagucugcccgaggacgaacaggagagaccucucgcucuuugcgaaccaggagugaaccccgaggaacagcugauaauuauccagagcagguuggaccaauccauggaggagaaucaggaucuaaagaaagaacugcucaaguguaaacaggaggcccggaaccugcagggcauuaaggacgcacuucaacagcgacugacucagcaagauacaucuguauugcagcucaaacaggaacuguuacgcgccaauauggacaaggaugagcugcacaaccagaacguggaccuacaaagaaagcucgaugagaggaaucggcugcuuggugaauauaaaaaggaguuggggcagaaagaccgccugcuccagcagcaccaagcuaagcuggaagaggcgcuuagaaaacugagcgaugucucauaccaucagguggacuuggaaagggagcucgagcacaaggauguucuguuagcacauugcaugaagcgugaagccgacgaggcuaccaacuacaauagucacaacucccagagcaauggauuucugcuaccuacggccggcaaaggcgcaacuucugugucaaaccgggggaccagugaccuccagcugguccgagaugcccuuaggagcuugagaaauuccuucucuggacacgacccacaacaucacacaaucgauucgcuggaacaggguaucagcucccucauggagcgccugcaugugauggaaacucagaagaaacaagagcggaagguaagaguuaaaucacccaggacccaggugggcagugaguaucgcgaaucuuggccgccuaacagcaaguuaccccacucccagucaagcccaacagucucuuccaccuguacgaaggugcuguacuuuacugaccgaagucuuacaccuuucauggucaauauucccaaacgguuggaggaagugacccucaaggauuuuaaagcugccauagaccgugaggggaaccauagauaucacuucaaggcacuggauccagaauuuggaacuguuaaagaggagaucuuccacgacgaugacgcgauucccggcugggaagguaagaucguggcuuggguagaggaagaucauggggagaauuga

SEQ ID NO: 55314 - RNA, 1545 nt, Artificial Sequence
  derived and/or modified sequence opt3 from DKC1__Homo_sapiens__NP_001354
auggccgacgcugaggugaucauucugcccaagaaacacaagaaaaagaaagaaagaaagagccucccugaggaagaugucgcagagauacagcaugccgaagaguuccuuaucaagccagaguccaaaguugcgaagcuggacaccucucaauggccguuguuacugaaaaacuuugauaagcuaaaugugaggacaacucacuacacgccccucgcuugcggcucaaacccucugaaacgggaaauuggggacuauauccgcaccggauucauuaaucuugauaagccaaguaaccccagcucccaugagguaguggccuggauccgacguauacugagagucgaaaagacaggucacucuggcacuuuggacccuaaagugaccgggugucucaucguuugcauugagagggcaacacggcuggugaagucgcagcagucagccggaaaagaguacgucggcaucgugcgccugcauaaugcuauugaaggugggacccagcucagcagagcauuagagacucugacaggagcccuuuuucaaaggccacccuugaucgcugccguaaagcggcagcugcgcguucgaaccauauaugaaaguaaaaugauugaguacgauccugaaagaaggcuaggcaucuucuggguguccugugaggcgggcacguauauucggacucucugcguccaccuggggcuucuguugggaguggguggccagaugcaggagcuccgucgcgugagaucuggggucaugagcgaaaaggaccacaugguuaccaugcaugaugugcuggacgcacaaugguuauacgauaaccacaaagacgaguccuaucugaggcggguaguguacccacucgaaaaacuucugacaucacauaagcgauuggucaugaaggauagugccgugaaugcuaucuguuacggagccaagaucaugcuaccgggcguucugcgcuaugaggacgguauugaagugaaccaggagauagucgugaucacuaccaaaggggaggcaauuugcauggcuaucgcccucaugacaaccgcgguaauaagcacgugugaccacggaauuguugccaagaucaaaagagugaucauggaaagggauacuuacccccggaaguggggccugggcccuaaggcaucucagaaaaagcugaugauuaaacaggggcuuuuggacaagcacggaaaaccaacagauuccacccccgcuacuuggaagcaagaguaugucgacuacucagaaagcgccaagaaagagguggucgcugaagugguuaaggccccucaggugguagcagaggccgcuaaaacagcgaagcgcaaaagagagagugaaucugaguccgaugaaaccccacccgcagccccgcagcucaucaagaaggagaaaaagaaaagcaagaaagacaagaaagcuaaggccggucuggagucgggcgcagaaccuggggauggagacucugauacgaccaagaaaaagaaaaagaaaaagaaggccaaagaggucgaauuaguguccgaguga

SEQ ID NO: 55315 - RNA, 801 nt, Artificial Sequence
  derived and/or modified sequence opt3 from DKK1__Homo_sapiens__NP_036374
augauggcccugggcgcugcaggggccaccagaguguucgucgcgaugguugcugccgcacucggaggucacccccuucugggcgugagcgccacauugaacuccguauuaaauucuaacgcuaucaagaaucugccuccaccgcuagggggagcagccggccaccccgguucagcugugagugccgcgccugggauucucuacccaggaggcaacaaauaucagacuauagacaauuaccaacccuauccuugcgcagaggaugaagaguguggcacggacgaauacugcgccagcccaaccaggggaggggaugcugguguccagaucugucuggccugccggaagcgccgaaaacguuguaugagacacgcaaugugcugucccggcaacuauugcaagaaugggauuuguguguccucugaccagaaccauuuuaggggagagaucgaagagacaauuacugagucguucggcaaugaucacucaacccuugacgguuacagccggcgcacaacccugaguuccaaaauguaucauacuaaggggcaggaaggaucuguuugcuugagaagcuccgauugugcuucaggccucugcugcgccaggcacuuuuggaguaagaucuguaaaccugugcugaaggagggccaagucugcacaaaacaccggcgcaaggggagccauggacuggaaauauuccagcgauguuacugcggugagggccucucuuguagaauccagaaagaccaccaucaggcguccaacucaagcagguuacauaccugccaacggcacuga

SEQ ID NO: 55316 - RNA, 780 nt, Artificial Sequence
  derived and/or modified sequence opt3 from DKK2__Homo_sapiens__NP_055236
auggccgcucugaugagaagcaaggacuccucuugcugucuccuucuguuggcagccguguuaauggucgagucaagucaaaucggcagcuccagggcgaaacugaacucuauuaagucgucacuagggggagaaacccccggucaagcugccaaucggagcgcaggcauguaccaggggcucgccuucggaggcaguaaaaaggguaaaaaccuggggcaggcuuauccuugcuccucugauaaggagugugaaguuggacgcuacugccacagcccacaucagggcuccucagcauguauggugugccgacguaagaaaaagagaugucacagggacggcaugugcuguccgaguacacggugcaauaacgggauauguauccccguaacugagagcauucuuacgccucauaucccagcccuggauggaacccgccacagagacaggaaucauggucacuauucuaaccacgauuugggcuggcaaaaucucgggcggccccauacaaaaaugucccacauuaagggacaugaaggcgacccuugccugcgcucaagcgauugcaucgaggguuuuuguugcgcucgacacuucuggacuaaaauauguaagccagugcugcaccagggggaggucugcaccaagcagaggaaaaagggaagucauggccucgaaaucuuucagagaugugacugcgccaaaggcuuaucuuguaagguguggaaagaugcgacauacuccagcaaggcacggcugcacguuugccagaaaauuuga

SEQ ID NO: 55317 - RNA, 1053 nt, Artificial Sequence
  derived and/or modified sequence opt3 from DKK3__Homo_sapiens__XP_006718241
augcagagacugggcgccacccuccuuugccuguuguuagcugcagccgugcccacagcgccugcuccagccccgacugcaacgagcgcccccgucaagccugggccagcucuguccuacccccaagaggaagcaacccuaaacgagauguucagggaaguugaggaacucauggaggacacacagcacaaacugcggucugccguggaggaaauggaggcugaagaggccgcggcaaaggccucaagugagguaaaucuugcuaaccugccuccaagcuaucauaaugaaacuaacaccgauacaaaagugggaaauaacaccauccacguccaucgcgagauucacaagauaacuaauaaccagacaggucagaugguguuuuccgaaaccguuaucacgucugugggcgacgaggaagggcgacguucgcaugaguguauuaucgaugaggacugcggacccucaauguacugucaauucgccagcuuucaguauacuugccagccuuguagaggccagaggauguugugcacccgggauagugaauguugcggugaccaacucugugucugggggcacugcacaaaaauggcaacucgcggauccaauggcaccauuugugauaaccagagagacugccagccaggccugugcugugcuuuccagagggggcugcucuuuccggugugcacacccuuaccuguagagggagaacugugucacgauccagccucucggcuuuuggaccugaucaccugggagcuagaacccgauggugcgcucgaccgcugcccuugugccagcggccugcuuugccaaccacauucccacucacugguuuacguguguaagcccacguucgucgggagucgagaucaggacggagagauauugcucccgagagaggugccugacgaauaugaggugggcagcuuuauggaagaggucaggcaggaacuggaggauuuagagcggucucugacugaagagauggcacuccgugaacccgcugccgcugccgcagcccuucuggguggggaggagaucuga

SEQ ID NO: 55318 - RNA, 675 nt, Artificial Sequence
  derived and/or modified sequence opt3 from DKK4__Homo_sapiens__XP_011542791
augguggccgcuguccugcucggccuuagcuggcugugcucccccuugggggcauuaguucuggacuucaacaauaucagaucuucagccgaucuacacggagcgaggaaggguagucagugucucagcgacaccgauugcaacacacggaaauuuugucugcaaccucgcgacgagaagccauucugcgcuacuugucgaggccuucguagaaggugccagcgggaugccauguguugcccggggacgcugugugugaaugacguaugcaccacaauggaagaugcaacucccauuuuggagcgccagcucgacgaacaggauggaacccaugccgagggcacaaccggucacccugugcaagaaaaccagccaaaaagaaagcccuccaucaaaaagucucaggggaggaagggacaggagggcgagucgugucugcggacuuuugacugcggcccugggcugugcugugcucgccauuucuggacaaaaauaugcaagccaguccucuuagaaggacaaguguguucacgaagaggucacaaagauaccgcacaggcccccgagauuuuucagaggugcgacuguggcccugggcugcuuugccggagccaguugacgaguaaucgucaacaugcucgccugagaguuugucagaagaucgaaaaacuauga

SEQ ID NO: 55319 - RNA, 636 nt, Artificial Sequence
  derived and/or modified sequence opt3 from DKKL1__Homo_sapiens__NP_001184230
augggcgaggccagcccucccgcuccagcaagaaggcaucugcucgugcuucuguuguuacuguccacccuagucaucccgucugccgcggcucccauucacgacgccgaugcacaggaaucaagucucgggcugacaggacuucaaagccuguugcaggguuucucccggcucuuucugaagggcaaccugcuccgcgggauagacucuuuauucucggccccuauggauuuucgaggacugccaggcaauuaccacaaagaggaaaaccaggagcaccagcuugguaauaacacuuugucaagccaucugcaaaucgacaagguuccccguauggaagagaaagaggcucuagugccuauucagaaggcaacggauaguuuccacaccgaacuccacccaagaguagccuuuuggaucauuaaacugcccaggcggcgcucccaccaggacgcucuugaagggggacauuggcugucugagaagagacacagguugcaggccauccgggauggccuccgcaagggcacacauaaagacgugcuggaggaggggacugaaagcuccucacacagucgauuaagcccuagaaagacccaucugcucuauauacuuaggccaucucggcaacuguga

SEQ ID NO: 55320 - RNA, 1944 nt, Artificial Sequence
  derived and/or modified sequence opt3 from DLAT__Homo_sapiens__NP_001922
auguggagagugugcgccaggcgggcucagaacgucgcacccugggccggccuggaggcgcgcuggaccgcucuccaagaaguuccugggacaccacgagugacuagccguuccggaccggcccccgcaagaaggaacucuguaacgaccgguuacggcggggugcgggcccuuuguggauggacaccuucaaguggcgcuacuccacgcaauagacuguuguuacagcugcuagguagccccgggaggcgguauuacucccucccuccacaccagaaggucccccugccuucucuuucgccaaccaugcaggcaggaacaaucgcccgcugggagaaaaaggaaggcgacaaaauuaaugagggcgaucugauagcugaaguggagaccgacaaggccacuguuggguucgagucauuggaagagugcuauauggcgaaaauccucguggcagaaggaacacgagaugucccgauuggugccaucauuuguaucaccgugggcaagcccgaggacauagaggcuuuuaagaacuacacgcuggauagcagugccgcaccuacuccacaagcugcccccgcgccuaccccagccgcaacagcuucucccccgacuccuuccgcccaggcucccgggagcuccuauccaccucauaugcagguacugcuccccgccuuaucaccaaccaugacaaugggaaccguucagagaugggagaaaaaggugggcgaaaaacugagugaaggugaccuuuuggcagagaucgaaacggauaaggccacuauuggguucgagguccaagaggaaggauaccuggcuaaaauccuagugcccgagggcacaagggacgugccucucggcaccccacugugcauuaucgucgaaaaggaggcggauauaagcgcauuugccgacuaucggccgacugaaguuacagaucuuaagccccaggugccuccacccaccccuccacccguagcugccgugccgccuacgccacagccccuggcaccuacccccucugccccauguccugcuacacccgccgggccaaaaggacgugucuucguguccccguuggcaaagaaacucgcgguugagaaggguauugaccugacucaggugaaaggcaccgggccugauggacgcaucacaaagaaagacauugacucauuuguccccagcaagguggcuccagcccccgcagccguaguuccuccaacuggccccgguauggcuccugugccgaccggggucuucacagauaucccaaucaguaauauuagaagggugauagcccaacgguuaaugcagucuaagcagaccaucccccacuacuaccuguccauugacgucaacaugggcgaggugcuccuuguucgaaaagaacugaauaagaucuuggagggacgcagcaaaauaucggugaacgauuuuauuaucaaggcaucugcucuagccugccugaaaguaccugaagccaauuccucauggauggacacugucaucagacaaaaccaugugguugaugugagugucgcggugagcacgccagcuggccucauuacacccaucguauucaaugcacacauuaaggggguggagaccauagccaacgacguugucucccuggcuacuaaggccagggaaggaaaacuucagccucaugaguuucaggguggcaccuucacaaucucuaaucuggggauguuuggaauuaagaacuucagcgcaaucaucaauccgccccaggcguguauuuuggccauaggcgcuucagaggauaaacucgugccagccgacaacgaaaaggguuuugauguggcaaguaugauguccgucacccugagcugcgaccaccggguuguggauggggcugugggcgcccaaugguuagcagaguuccgcaaauaucuggaaaagccuaucacuaugcuacucuga

SEQ ID NO: 55321 - RNA, 3276 nt, Artificial Sequence
  derived and/or modified sequence opt3 from DLC1__Homo_sapiens__NP_006085
augugcagaaagaaacccgacaccaugauccugacacagauugaggccaaggaagccugugauuggcucagggcaacuggcuucccucaguacgcccagcuuuaugaggacuuucuguucccaauagauaucagcuuggugaaacgggaacacgacuuuuuagaucgcgacgcgauugaggcucugugccgacgucuaaacacgcucaauaagugugccgucaugaaacuggaaaucuccccgcauagaaagaggucugaugacucagaugaggacgagcccugcgcaauuagugggaaguggaccuuccagcgggauagcaaacgcugguccagacuugaagaguuugacguuuucucuccuaagcaggaucuggugccaggaucgcccgacgacucacacccuaaagaugguccaagccccggcgggacauugauggaccucagugaaaggcaagagguauccucugugcggagccuguccucaacuggaagucugccuagccaugccccaccgucugaggaugcugcaacaccccgcaccaacuccgucaucucaguguguagcaguucuaaucucgccggcaacgacgauuccuuugguagcuuaccuucgccaaaggaacugucuuccuucucauuuaguaugaaagggcacgagaagaccgcuaagagcaaaacucgaucccuuuugaagagaauggaaucucugaaacuaaagagcucacaucacaguaaacacaaggcccccuccaaacucggacugauaaucagcggcccuauucuucaggagggcauggacgaagagaagcugaagcaguugaauugcguugagaucucugcgcucaacgggaauaggauuaacgugccaaugguccggaaacguucagugaguaauagcacacagaccuccucuucgagcucccaaucagaaacgaguucugcaguaagcacucccuccccgguuacccgcacaagaucacugagcgccuguaacaagagggugggaauguacuuagaggguuucgauccuuuuaaucagucuacuuucaacaaugucguggaacagaacuuuaaaaaucgggaguccuaucccgaagacaccguguucuacaucccagaggaucauaagccuggcacauuccccaaagcucugaccaacgggaguuuuagcccaucuggaaacaauggcuccgucaacuggcgaacggguucauuccacgggcccggacauauaagucuccgcagagagaauagcucggacuccccuaaggaacuuaagaggcggaacucuagcucaaguauguccucucgccugagcauuuaugauaauguuccaggcuccaucuuguacucaagcaguggcgaccuagccgaccuggagaacgaagauauuuuuccggagcucgacgauauccuguaucacgugaaagggaugcagagaaucguaaaucaauggucugaaaaguucuccgacgagggagauagcgacucggcacuugauucagugucucccugcccuaguuccccaaaacagauucaccuggacgucgauaacgacaggacuacacccagcgauuuggacucuaccgguaauagccucaacgagccugaggaaccauccgaaauacccgagcgucgggauucaggcgugggggcuagucugacucgaagcaauagacauagguuacgcuggcacucuuuucaguccucacaucggccgagucugaacagcguuucccuacaaaucaauugucagucuguggcccagaugaaccuccugcagaaguacucgcuuuugaaacugacagcgcuccuggagaaguacaccccuagcaauaagcacggauucucaugggccgucccaaaauuuaugaagagaauuaaagugcccgacuauaaggacagguccguauucggcguuccucuuacggugaacguccaacgcaccggucagccccugccacagaguauccagcaagcaaugcgauacuugcggaaccauugccucgaucagguggggcuguuucguaaaucuggcgucaagagcagaauacaggcuuuaaggcagaugaaugaaggagccauugacugugugaacuaugagggccaauccgcuuacgauguugccgacaugcugaagcaguauuuccgcgaucuaccugaaccccucaugacaaauaaacugucagagacuuuucuucagaucuaccaguaugugccaaaggaccaacgguugcaggcaaucaaagccgcuauuaugcugcucccggaugaaaacagagagguacugcagaccuuacuguacuuccuuucugacgucacagcggcagugaaggagaaucaaaugacuccuaccaacuuggccguuugccucgcucccagccuguuucaccuaaauacacugaaaagggaaaacaguuccccacgagugaugcagcgcaagcagagccucgggaaacccgaucagaaggaccugaaugagaaccuugccgcaacccaaggauuggcccacaugaucgcugaaugcaagaaacuguuccaggucccugaggaaaugucucgguguagaaauucauacacugagcaggaguuaaagccacucacgcuggaagcccuuggucaucugggcaacgaugacuccgcagauuaucagcacuucuugcaagacugcguggacgggcucuuuaaagagguaaaggaaaaauucaagggaugggugaguuacagcacaucggagcaggcggaacugucuuauaagaaaguuuccgagggucccccucuaaggcuguggcguagcgucauugaggugccggcugugccagaagagauacucaagcgccugcuuaaagaacagcauuugugggaugucgaccuguuagauucaaagguuaucgagauucucgacagucagaccgagaucuaccaauaugugcaaaauucuauggcuccccacccugcacgggauuacgugguacugagaacuuggaggaccaaccuuccaaaaggcgccugugcucugcuacucacauccgucgaccacgaucgagcccccgugguuggggugcgggucaaugugcuguugagccgcuaucugaucgaaccuugcggcccgggaaagucaaaguuaaccuacauguguagaguugaccucaggggccauaugcccgagugguacacuaaaaguuuugggcaccugugcgcagcugaagugguaaagauucgggauagcuucuccaaccagaacacagagacgaaagacaccaagucucgauga

SEQ ID NO: 55322 - RNA, 1530 nt, Artificial Sequence
  derived and/or modified sequence opt3 from DLD__Homo_sapiens__NP_000099
augcagagcugguccagaguguacugcucucuggccaagaggggccacuucaaccggaucucacaugggcuccaaggacuuagugcugucccccugcgcaccuaugcagaccagccuauugaugccgacguuacagugauagguagcggcccagggggauacguagcggcuaucaaagccgcacaguugggcuuuaagacuguguguauugagaaaaaugaaacguuaggugggaccugccugaacgucggauguaucccguccaaggcccuacucaauaacucucacuauuaccauauggcucacggcaaagauuucgcaucgcgaggcauugagaugucagaagugcgucugaaucuugacaagaugauggagcaaaagagcacagccguuaaagcucugacugggggaaucgcccauuuguuuaagcagaacaaagugguccacgugaaugguuauggcaagauaaccgggaaaaaccagguaacagcgaccaaggcagauggaggcacucagguuaucgacacaaagaauauucucaucgccaccgguagugaagugacgcccuucccugggauuacuaucgaugaggacaccauagucuccucuacaggagcucugagccugaaaaaggugccagagaaaaugguggucauuggcgccggcguuaucgggguggaacucggauccguauggcagagauuaggugcagaugugacugcugucgaguuucugggccacguugggggagugggcauugacauggaaaucucaaagaacuuccaaaggauccuucagaaacaggguuuuaaguucaaauugaauaccaaggugacaggggccaccaagaaaagugauggcaagauugacgucagcauagaggcggccucuggaggcaaagcagaggugaucacgugcgauguacugcuaguuuguauugggcggcgccccuuuacuaagaaccucggacuggaagaacuugguaucgaacuggacccuagaggcaggauaccagugaauacacgguuccagaccaaaauucccaacaucuacgcuaucggggacgucguggccggaccuauguuggcucauaaggccgaggaugaaggcauuaucugcgucgaggguauggcagggggcgccgugcacauugacuauaauuguguuccauccgugauauacacucauccggagguagcuugggucggaaagucagaggagcaacucaaagaagagggcaucgaauacaagguggggaaauuucccuucgcggcaaacagccgcgccaagacaaacgcugauaccgacggaaugguuaaaauucugggucagaagaguacggaucgaguguuaggcgcccacauccuggggccuggagcaggcgagauggucaaugaggccgcucucgcccuugaauauggugcaucuugcgaggacaucgcgagagugugucacgcucauccaacccuguccgaagccuuuagggaggcaaacuuggccgcuagcuucgggaagucgauuaauuucuga

SEQ ID NO: 55323 - RNA, 5268 nt, Artificial Sequence
  derived and/or modified sequence opt3 from DLEC1__Homo_sapiens__NP_031361
auggagaccagaagcuccaagacaaggcggucucuggccucacgcacuaacgaaugccagggcacgaugugggcucccaccaguccuccagcagggagcuccucuccgucgcaacccacauggaagucaagccucuacaguucccuugccuauucugaggcguuccacuacagcuucgcugcccgaccucguagacugacucaguuggcauuagcccagaggccagaaccccagcugcuacggcuccgcccuuccucacugagaacccaagacauaagucaucuucugacaggaguguucaggaauuuguauagcgcugaggucauuggugaugaaguuucugcaucccucauaaaggcccggggcucagagaacgagcgccacgaagaguuuguggaccagcugcagcagauacgagaacuguacaaacaaagacucgaugaguucgagauguuagaaaggcauauuacccaggcucaggcccgggcgaucgcagagaaugaacguguaaugagccaggccggggugcaagaccuggagagucuuguccgcuugccacccgugaagucuguuuccagaugguguauugauagcgaacugcuaaggaaacaccaucucaucucgccugaggacuauuacacugauacagugccauuucacucugcuccgaagggaauaucccugcccggcugcucaaaacuuaccuucaguugugagaaacggagcguccagaagaaagaacugaacaagaaauuggaggacuccugccgaaagaagcucgccgaauuugaggaugaacuggaccacacgguggauucuuuaacuuggaaucugaccccuaaagcaaaggagcgcacaagagagccacucaaaaaggcuagccagcccaggaacaaaaauuggaugaaccaucuucggguaccucaacgcgaacuggacagauugcuacuggccaggauggagucacguaaucacuuccucaagaacccacgguucuuucccccgaauacucgauauggugggaaaagucugguuuuuccucccaagaagccagcgccuaucggagaguuucaguccaccgagcccgaacagagcugugccgauacaccaguguuucuugcaaaacccccuauuggcuucuucaccgacuacgagaucggcccagucuacgagauggugauugcucugcagaacacgacuacaaccucuagauauuugagggugcucccgcccucaacuccuuacuuugcccugggguuaggaauguucccagguaagggcgggauggucgcucccggaaugacaugccaauauaucguucaguuuuucccugacugucugggcgauuuugacgauuucauccuaguggaaacccagagugcccauacgcuccugauuccacuucaggcacgccggcccccgccuguauugacccugagcccagugcucgacugcgguuacugucugaucgggggagucaaaaugacaagauuuauuugcaagaaugugggcuucuccguuggcagguuuuguaucaugcccaaaacuucuuggccuccccuuucguucaaggccaucgcuaccgugggguuugucgagcaaccaccuuucgggauucugcccagcguguuugaauuggcgccaggucacgcaauacucguagagguucuguucuccccgaagucauuaggcaaagccgagcagacauucaucauuaugugcgauaacugccagaucaaggaacuggugacuauagggauuggacagcuaaucgcucucgaccugaucuauauuaguggcgagaaaucucaaccugaucccggugaacuuaccgacuugacagcccagcacuuuauccgcuucgagccagaaaaucugcgaagcaccgcacggaagcagcucauuauacguaacgccacucaugucgagcuggcuuuuuacuggcagaucaugaaacccaacuuacaaccucugaugccaggggagacguucuccauggauucaauuaaguguuaucccgacaaggaaacagccuuuagcaucaugccuagaaaaggcgugcuuucuccgcacaccgaucaugaguucaucuuguccuuuaguccacacgaacucagggacuuccauagcguccugcagauggugcuagaggaaguucccgagccugugucuuccgaggcagaaucacugggacacaguagcuacucgguagacgaugucauugugcucgagauagaaguuaagggcuccguggagccauuucagguccugcuugaacccuacgcguugaucauuccuggggagaauuauaucggaauuaacgugaaaaaggcuuucaaaauguggaauaacucuaagagcccgauccgcuaccugugggguaagauaucagacugccacaucauugagguagaacccggcacuggggugaucgagccaagugaaguuggagauuuugaguuaaauuucaccggcggugucccugggcccacaucccaagaccuccugugugagauugaagauucuccaagcccuguggugcuucauaucgaggccgucuuuaaaggccccgcacugauaauuaacguuuccgccuugcaguucggacuccugcggcuaggccagaaggcuaccaauucaauccagauuagaaacgugagccaacugccagccacuuggaggaugaaagaaaguccggugucucuccaggagcgaccugaagacguaucccccuucgauaucgagccaagcucggggcagcugcacucacuuggagagugccgcgucgacauaacauuggaagcacugcauugucagcacuuagagacggugcucgaacuggagguugaaaauggugcuuggucuuaucuucccguguacgccgagguccaaaagccucacguguaucugcagaguucccagguugaggugcggaaccuauaccucggcguaccaaccaaaacuacaaucacccugauuaaugggacauugcugcccacucaguuucauuggggaaaguuacucggccaccaagcggaguucugcauggucaccgugagcccuaaacauggucugcuugggccgucugaggaaugucagcugaaguuggagcucacggcccacacccaggaagaacugacacaucuagcucugccaugccacgugagcggcaugaagaaaccccuuguccucggaaucuccggcaagccucaagggcugcagguugcaauuacuaucucaaaagagaguagcgauuguucuaccgaacaguggcccggacacccaaaggaguugagacuggacuuuggcuccgccgugccuuuaaggacacguguaacucgccagcucauacugaccaaccggucacccauuagaacgagguucagucuuaaauuugaauauuucgguagcccacaaaauucccugucuaagaagacaucguugccuaacaugccgcccgcucuccugaaaaccgugcgaaugcaggagcaucuagccaagcgggagcagcuggauuuuauggaaagcaugcuuucacacgggaaaggagcagcguucuuuccacauuucucccagggcaugcucgguccuuaccaacagcugugcaucgacaucacuggcugugccaauauguggggagaauacugggauaacuugauuugcacagucggagacuuacugcccgaagugaucccaguucacauggcugccgugggcugcccuauuaguucucuccgcaccacuagcuauaccauagaccaggcacagaaggagcccgcuaugagauuugggacacaagucuccggaggcgauacggugaccaggacucugcggcuuaacaauucaucuccgugugacauccgacuggauugggaaacauacguuccagaggacaaagaggauagauugguggaacuacuggucuucuaugguccucccuucccacuccgcgaccaggccgggaacgagcugguaugccccgauaccccugaaggaggcugucuuuuauggagcccgggucccaguuccagcucugaguuuucacaugaaacagacuccaguguggagggcagcucgucugcauccaauaggguugcccagaagcugauuagcgugauccuccaggcucacgagggggucccaucaggacacuuguacugcauuaguccuaagcaagugguagugcccgcgggcgggucuuccacuaucuauaucagcuucaccccuaugguccugucaccagaaauccuccauaaaguugaguguacgggauacgcccugggcuuuaugagucuugauagcaagguggaacgugagauucccgguaaacggcacagacugcaggacuucgcaguggggccuuugaagcuagaucugcauuccuaugucaggccagcucagcucucuguggaauuagacuacggaggcagcauggaguuucaaugccaggccuccgaucugauccccgagcagccguguucagguguucuuucugaacugguaacaacccaccaccucaaauugacuaacaccacagagauuccucauuacuuccgccugauggugagucgaccauuuucggucagccaggacggcgccucccaagaccacagagcucccgggccuggacagaagcaggaaugcgaggaggaaacugcaucugccgauaagcagcucgugcugcaagcgcaggagaauaugcuuguuaacgugucauucagccuaucccuggaauuguuaaguuaucagaaacugccagcugaccagacccuccccggcgucgauauccaacagucugccagcggggagcgggaaaugguguuuacacagaaucugcuucuggaguacacgaaccaaaccacucagguagucccgcucagggcagugguugccgugccugaguugcagcugucaacauccugggucgacuucggaaccuguuuugugagucagcaacgcguucgugaaguguaucuaaugaaucugagcggcugcagaucuuacuggacuaugcucaugggucagcaggagcccgcuaaggcagccgucgcguuccggguguccccaaacucagggcuucuggaagcuaggagcgccaaugcaccucccacaucgauagccuuacagguauuuuucaccgcucgcucuagugaguuguaugaauccacgauggugguugagggaguccugggcgagaaaagcuguacucuccgacugagaggccaagggucauacgaugaacgguauaugcuuccacaucagcccuga

SEQ ID NO: 55324 - RNA, 483 nt, Artificial Sequence
  derived and/or modified sequence opt3 from DLEU7__Homo_sapiens__NP_945340
auggccagccccgcuccucugguggcauccaucucucaccagauggucgcccuccaaacccuucagcuguugcagcaggaguggggcuggggcgacggaccaguugcgccggguaaccccagagauccugaccaugugucaacagcuccagccaggcggagugggcccccucgcgcacgaccagggcccggacgugaagagagaggcggugggguaggaacuaggagccggcgcacggccgcuagagcaaauuccccugaagaggaaguggucaggggcgccgagggcggggcugaguuacugccauucccgcgggaucgcggacccugcacccuagcccaaauggcgaugcgaucugcacucgccagagugguugacucgacaucagaacuggugagcgucgagcagacucuucuggguccuuugcagcaggaaaggaguuuuccaauucaccucaagcugcaacugcucgcuaacgaguga

SEQ ID NO: 55325 - RNA, 2679 nt, Artificial Sequence
  derived and/or modified sequence opt3 from DLG1__Homo_sapiens__NP_001191315
augcccgugagaaagcaggacacccaaagggcccugcaccuccuugaggaauaccggagcaaacugucccagacagaggaucgccaguugcgaucuucaaucgaacgugucauuaacauauuccagaguaauuuauuucaagcucugaucgacauucaggaguucuaugaaguuacucuacucgauaacccuaagugcaucgacagaagcaaaccauccgagccgauucagcccgugaauacgugggagaucucuucgcugccuucaagcaccguaacaagugaaacucuuccauccucucugagccccuccguggagaaguacagguaucaggaugaagacaccccuccacaagagcauauaucaccccagaucacaaacgaggucauuggcccugaauuggugcacguuagugagaaaaaucucagcgaaaucgagaacgugcauggguuugucucucacucccauauuucaccaaucaaggcaaauccgcccccugugcugguaaacaccgauagccuggaaacuccaacauacguuaauggaaccgacgccgauuaugaguacgaggaaauaacgcucgagcgggguaacaguggcuuaggguucucuauugcgggaggcacugacaauccccacaucggugaugacuccagcauuuuuaucaccaagaucauuacagggggagcugccgcacaggauggccgccugagagugaacgacuguauacuuagggucaaugaaguggacgugcgggaugucacucacucgaaagccguugaggcuuugaaggaagcaggcucuaucgugcgccuguauguaaaacgaagaaagccuguguccgagaaaauuauggagaucaagcuaauaaaggggccaaaaggacucgguuucucaauugccggcggggucggaaaccagcauauccccggcgacaauaguaucuacgugaccaagauuaucgaagguggggcugcccacaaagauggaaagcugcaaauuggcgacaaacuucuggcgguuaacaacgugugcuuggaggaagucacacaugaggaagcagugaccgcccucaagaauacgagcgauuuuguauaccugaaaguugcuaagccgacuuccauguauaugaacgacggcuacgccccucccgauauaacaaauucuagcucacagccaguggacaaccacgucaguccuuccagcuucuuagggcagacccccgcaucuccagcuagguauucacccgugaguaaggccguccugggagaugacgagaucacucgggagccucguaaagugguucuccaccgcgguagcacaggccuuggguuuaauauugugggaggcgaagauggugaggggaucuucaucuccuuuauucuggcgggcggaccagccgacuugucuggcgaacuaagaaagggggacaggauaaucucgguaaacagcgucgaucugcgggcagcuucccaugagcaagccgcugccgcacucaaaaaugccggacaggcugugaccauuguugcgcaguaccgaccggaggaauauucacgcuucgaggcaaagauccacgaccugagagaacagaugaugaacaguucuauuagcuccgguucaggcagccuuaggacgucucaaaaacggucccuguacgugcgcgccuuguuugauuaugacaagaccaaggauagugggcuccccagccagggacugaauuucaaauucggcgacaucuuacaugucauaaacgcuucugaugacgagugguggcaggccagacaggugacaccugauggugaauccgacgagguaggggugaucccaucaaagaggcguguugagaaaaaggaacgggcacgacugaaaacugucaaguuuaauaguaagaccagagauaaaggcagcuucaacgacaagaggaaaaagaaucuauuuucgcgcaaauuccccuuuuacaagaacaaggaucaauccgagcaggaaacaucugacgccgaccagcacgugacuagcaaugcuucagauagugaguccucuuaccggggacaggaagaguaugugcucagcuacgagccugucaaccaacaggaaguuaacuauaccagaccagugauuauccugggccccaugaaagacaggauuaaugaugaccuuaucuccgaguucccggauaaguuugggucaugugugccucauacaacccgcccaaaacgagacuacgaaguagauggacgggacuaucacuucgucacuagccgugagcagauggaaaaggauauacaggagcacaaauuuauugaggccggucaauacaacaaucauuuguauggcacgagugugcagucuguuagagaaguggcagagaaggggaaacacugcauccuggacgucuccggaaacgcgauuaagaggcuccagaucgcucaacuguaccccauaagcaucuucauuaagccuaaaucgauggaaaauaucauggagaugaacaagcgccuuacagaggaacaggcccggaaaaccuuugagagagcaaugaagcuggaacaggaguucacugaacauuuuaccgccauugugcagggcgauacauuggaggacaucuacaaucaaguuaaacagauaauugaggaacagucagguucuuauaucugggugcccgcuaaggagaagcucuga

SEQ ID NO: 55326 - RNA, 2250 nt, Artificial Sequence
  derived and/or modified sequence opt3 from DLG2__Homo_sapiens__NP_001136172
augcagagacccagcguguccagggccgagaacuaccaacugcucugggacaccaucgcuucucuuaagcagugcgaacaggcaaugcagcacgccuucauuccugucaauggcacagagauagaauaugaguuugaagagaucacucuggagcgggggaacucaggauuggguuucaguauugcgggcgggacggauaauccacauaucggagacgauccgggcauuuuuaucaccaaaauaauccccgguggggcugccgcagaagacggacgcuuacgaguuaacgauuguauucugcgugugaaugagguagacgugagcgaagucucccacucuaaggccguggaggcucuaaaagaggcaggcucgaucguuagacucuacgugaggcggcgcagaccuauucuggaaacagucguggagaucaaguuguucaaaggcccaaaggggcugggauuuucaauagccgguggcguagggaaccaacauauucccggagauaauagcaucuauguuacuaagauuaucgacggcggugcugcccagaaagaugggaggcuucaggugggagaccggcuccugauggucaacaauuacagucuggaagaggugacccacgaagaggcgguggcaauccucaagaacacauccgaggucguuuauuuaaaagugggcaagccuaccacuauuuacaugacagauccauaugggcccccugacauaacccauucuuacagcccaccgauggaaaaucaucugcuuuccggcaacaauggaacguuggaguacaaaacuucacugcccccuaucaguccaggucgcuauagccccauuccuaagcacaugcuaguagaugacgacuacaccucucacucccagcacucaacagccacucgacaaccaagcaugacccuccagagagcugugagucuggaaggcgagcccaggaaggucgugcuucauaaagggucuacaggacugggcuucaacaucguugguggggaagauggcgagggaauauuuguguccuucauuuuggccggcgggccggcagaccucagcggagagcugcagcggggugaucagaucuuaucggucaauggcaucgaccugcguggggcuucucacgaacaagccgcggccgcacucaagggagcuggccagaccgugacgauuaucgcccaguaucaaccugaggauuacgcucgcuuugaagccaaaauucacgaccuuagagagcagaugaugaaccauuccaugucaagugguagcgggucccugaggacuaaccagaagcggucuuuguauguacgagcaauguucgauuacgacaaaagcaaggauucaggccuacccagucagggacuguccuuuaaauauggcgacauacuccacguuaucaaugccagcgaugacgaaugguggcaagcucgcagagugaugcuggagggggacucugaggaaaugggagucauuccaucaaagaggcggguggagcgcaaggaaagagcgaggcuuaaaacagucaaguucaacgcaaaaccuggugugaucgauaguaagggcgacauccccgggcugggagaugacggcuacgguaccaaaacuuugcgugggcaggaggaucucauucugagcuacgagccaguuacacggcaggaaauaaauuauacccgacccgugaucauuuuaggcccuaugaaggacagaaucaacgaugaccugauuuccgaguuuccagauaaguucggaucuugcguaccgcauacgaccaggcccaaacgcgacuacgaagucgauggccgggacuaucacuucgugaucucgagagagcagauggaaaaggauauacaagagcauaaauuuaucgaggccgggcaguacaaugacaaccuauauggaacaagcguucaguccgugagguucgucgcugaacgcggcaagcacuguauucucgacgugucagguaaugccaucaaacgacugcagguagcacaacuuuacccuauugccaucuuuauaaagccacggaguuuggagccccugauggaaaugaacaagcgucucacugaggaacaggcuaaaaagaccuaugauagagccauuaaacuggagcaggaguucggggaauacuuuacagcaaucgugcagggagacacucuugaggauauuuacaaucaaugcaagcugguuaucgaggaacagucuggcccuuucauauggaucccaagcaaagaaaaguuguga

SEQ ID NO: 55327 - RNA, 1101 nt, Artificial Sequence
  derived and/or modified sequence opt3 from DLG3__Homo_sapiens__NP_001159750
augaugaacagcuccaugucuucaggcagugggagccugagaaccuccgagaagaggucucucuacgugcgggcccuuuucgacuaugaucgcacacgagacucgugccugcccucacagggauugagcuuuaguuacggugauaucuuacacgucauuaaugcuuccgacgaugaaugguggcaagcacgucugguuacuccucauggcgagucugaacagauaggggugaucccaagcaaaaagagaguagagaaaaaggaaagggcccggcuaaaaacggugaaguuccacgcgcgcaccggaaugauugaguccaacagaucaaucaagacaaaaaggaagaaaaguuuucggcucagccgcaaguucccguuuuauaaaucuaaggagaauauggcucaggaauccucaauucaggagcaaggcgucacuagcaacaccagugacucugaauccagcucgaagggucaggaggaugccauccugucuuacgagcccgugacacgacaggaaauacauuaugcaagaccuguuaucauucuugggccaaugaaagacagggugaaugaugaccugaucuccgaguucccccacaaguuuggaucaugugucccucauaccacucggccacgucgcgauaacgaaguggacggccaggauuaccacuucguaguuaguagagagcaaauggaaaaagacauucaggacaauaaguuuaucgaggccggccaguucaacgauaauuuguaugggacaagcauacaguccgugagggcugucgcagagcggggaaaacacugcauucucgacgugucugguaacgccaucaagcgacugcaacaggcucagcuguaccccauugccaucuuuaucaaaccuaagagcauugaagcgcucauggagaugaaucgcagacaaaccuacgaacaggcaaacaagauauaugauaaagccaugaaguuagagcaggaguucggcgaauacuuuacggcuaucgugcagggggacucacuggaggaaauuuauaauaaaaucaagcaaauaauugaggaucagaguggacauuacaucugggucccauccccggaaaaacuuuga

SEQ ID NO: 55328 - RNA, 2166 nt, Artificial Sequence
  derived and/or modified sequence opt3 from DLG4__Homo_sapiens__NP_001122299
auggacugccuguguaucgugaccacaaagaaauacagauaucaggaugaggacacucccccucucgaacacagcccagcccaucuuccgaaccaagcuaauuccccucccgucauuguuaacacggauacccuggaggcaccaggcuacgugaaugggacagaaggagagauggaauaugaggagauaacuuuggaaagggguaacucuggcuuaggguucucaaucgccggaggcaccgacaauccccacauuggugaugacccuaguaucuuuauuacaaagaucauaccagggggagcggcugcccaggauggccggcugcgcguaaacgacagcauccuauucgugaaugaggucgaugugcgagaaguuacccauuccgcagccguggaggcucucaaagaggcaggcucuauuguccgucuguacgugaugagaaggaagcccccugccgaaaaaguaauggagaucaaacuuauuaaggggccaaagggacuggguuuuucgaucgcuggcgggguuggaaaccagcacauaccgggcgacaauucaauuuaugugacuaagaucauugaagguggggccgcgcauaaagauggacgguugcagaucggcgacaagauccucgcagucaacagcgugggccuggaggaugugaugcacgaagacgccgucgcugcccugaaaaauacauacgacguuguguaucucaagguagcaaagcccaguaacgcuuacuuauccgauucuuacgccccuccagacauuaccacgagcuauucccaacaccuggauaaugagauaucacauaguagcuaccuugggacugacuaucccaccgcgaugacaccuacuucuccacgcagauacucccccguggccaaagauuugcugggagaggaagacaucccgagggagccucggcgcauugucauccaccgagguucaaccggccuaggguucaacauagugggaggcgaagauggugaggggauuuuuaucagcuucauccucgcaggcggacccgcugaccugaguggcgaacuuagaaagggggaucagauucugucuguuaauggaguggacuugaggaacgccucccaugagcaggcugccaucgcacucaaaaacgccggucagacagucaccauuauagcucaauauaagccagaggaauacagccgguuugaggcgaaaauccacgaucugcgugaacaguuaaugaauagcucucugggcuccgggacggcaucacuccgcaguaacccuaagagaggauucuauauuagggcccuuuuugacuacgacaaaacuaaggauugcggcuuccugagccaggcuuuguccuuucgguucggugacgugcuacacguaaucgaugccucugacgaggaaugguggcaggcacgacgcguucauagcgauucagagacagacgauaucggguuuauucccaguaagagaaggguggagcggcgcgaaugguccagacugaaagccaaggacuggggcucgucuucaggaagucaaggcagggaggauagcguccucuccuacgaaaccgugacucagauggagguccacuaugcucguccaauaaucauucuggggcccacaaaagaccgggccaaugaugaccuucugucugaguucccugauaaguucggaucgugugugccacauaccacgcgaccgaaaagagaauacgagaucgacgguagggacuaucacuuuguuagcucccgcgaaaagauggagaaggauauucaggcacauaaauucaucgaagcgggccaauacaacucacacuuguaugggaccagugugcagucuguacgggaggucgcugagcagggaaagcacugcauacucgacgugagcgccaaugcaguuagaaggcugcaggccgcucauuuacaccccaucgccauuuuuauccgcccucgaucccuggaaaacgugcuagagauuaauaaacggaucacagaggaacaagcacguaaggcuuucgauagagccacuaaacucgaacaggaguuuaccgaguguuucucagcgauagucgaaggcgacagcuuugaggaaauuuaccauaaggugaagaggguaaucgaggaucugucugguccauauauuugggugcccgcccgcgaacggcuuuga

SEQ ID NO: 55329 - RNA, 5760 nt, Artificial Sequence
  derived and/or modified sequence opt3 from DLG5__Homo_sapiens__NP_004738
auggagccccagagaagggaacugcucgcccaaugccagcagagccuugcucaggcaaugaccgagguggaagccguccugggcuuguuagaggcggcuggggcccuguccccuggagaacggcgccaacuagacgaggaggcagguggcgccaaggcugaacuccugcuuaaacuguugcucgcaaaggagcgagaucacuuccaggaccugcgugccgcucuggaaaaaacacagccacaucucuuaccgauccuguaccuuaacgggguugugggacccccucagccagccgagggcgcggguucuacuuauucaguauugaguacgaugcccagcgauuccgagucuucgucaagccugaguuccguggggaccacaggaaaggcaccuucuccacccccucuacucacugaccaacaggucaaugaaaaaguggagaaccugagcauucagcuuagacugaugaccagggaacggaaugaguugcgcaagagacucgccuuugcuacacacggcaccgccuucgauaagaggccauaccaucggcugaacccggacuaugaacgcuuaaaaauacaguguguucgagcaauguccgaucugcaaucacuccagaaucagcacacuaacgcucuuaagagaugcgaggagguggccaaagaaacagacuuuuaccauacccugcacaguagguugcuaagcgaucaaacgcggcugaaggacgaugucgacaugcuccgucgcgagaauggccagcugcuuagagaaaggaaccuguugcagcagucuugggaggauaugaaacggcuccacgaagaggaccaaaaggagaucggggaccugcgagcgcagcagcagcaaguguuaaagcauaauggauccucagaaauucugaacaaacuauaugauacugccauggacaagcucgagguaguuaaaaaggauuacgacgcacugcgcaaaagauauagcgaaaagguggcuauccacaaugccgaucuuaguagguuggagcagcugggugaagagaaccagcggcuccugaaacagaccgagaugcuuacacaacagcgcgacacugcuauucagcugcagcaucaaugugccuugucucucagaagguucgaagcaauccaccacgagcugaauaaggccaccgcucagaacaaggauuuacagugggaaauggagcugcuacaauccgagcucacagaacugcguaccacgcaggucaaaacugcgaaggagagcgaaaaauaccgggaggaacgagacgcaguguacucggaguauaagcuuauaaugucugagagagaucaggugaucuccgaauuggacaaacugcagacagaggucgaacucgccgagucaaagcugaagaguagcaccuccgaaaaaaaggcugccaaugaggagauggaagcauuaaggcaaauuaaagauacuguuacaauggacgccggccgcgcuaacaaggagguggaaauccugcggaaacagugcaaggcccuuugucaggaguugaaggaagcacuccaggaggcggacguagcuaaaugcagaagggauugggccuuucaagagcgcgacaagauuguggcagaacgagauucuauccggacccugugugacaaccuacguagagagagggaucgcgccgucagcgaacuggcugaggcccuccggucacuggacgauacgagaaaacagaagaaugacgugaguagggagcuuaaagaauugaaggagcagauggaaucccagcuggagaaggaagcacgauuccgccaauuaauggcucauagcucucacgauucagccauagacaccgauaguauggagugggagacagaaguuguggaguuugaacgggagacugaagacauugaucucaaagcgcugggguucgacauggccgagggagucaacgagcccugcuuuccuggcgacugugguaucuucgugaccaagguagauaaagggagcauugcugacggaagacuuaggguuaaugauuggcuguugcguaucaacgacguggaucucaucaauaaggacaaaaagcaggcaauuaaagcccugcuaaacggcgaaggcgcuauaaauauggucgugcgccggagaaagucccuggggggaaaggucgugacaccacuccauaucaaccugucuggucagaaagauucgggcauuagccuugagaaugggguuuacgccgcagcgguguugcccggauccccugccgcuaaggaaggcucacuggccguaggugacaggaucgucgcaauaaacgggauugcuuuagauaauaaaagucucaacgagugcgaaucucugcuucgaagcugucaagacucccugacucuaucacuccugaagguguuuccacagagcucuuccuggaguggccagaauaucuucgagaacaucaaagauagcgacaagauguugucuuuucgggcccacggacccgagguucaggcacauaauaagcgcaaccugauucaacacaacaauuccacccagacagauaucuucuauaccgacagauuagaagacaggaaagagccgggcccucccgggggaucaaguagcuuccuccacaagccauuuccugguggcccccugcaggugugcccacaggccugccccucggcuuccgaacggucucuuagcucauuccgaagugaugcguccggggacagaggauuuggccuggucgaugugcgcgguaggcguccuuugcucccauucgagacugagguagggccguguggcgugggagaagccucucuggacaaagcagauagcgagggcuccaacucagggggaacguggcccaaggcuaugcuaagcaguacagccguuccugaaaaacugucugucuacaagaagccaaaacaacggaaguccauuuuugaccccaauaccuucaaaagaccucagacuccacccaagauagauuaucuucucccggguccuggcccagcccauagcccccagccuucgaaaagggcugggccccugaccccaccuaagcccccacgccgaucagacucuaucaaguuucagcacagauuggagacaaguuccgaaagcgaggcaacccuggugggaucuagcccguccacuucaccucccagugccuuaccacccgauguggacccuggcgagccaaugcaugcgagccccccucggaaagcuaggguccgcauugccucuuccuacuauccggaaggugauggggacucaagucaccucccagcaaagaaaagcugcgacgaggaucugacaucccaaaagguugacgaacuuggccagaaacguagacggcccaagucugccccuucguucaggccaaaacuggcucccguggugaucccugcacaguuuuuggaggaacagaaguguguaccggccagcggagagcucucacccgagcugcaagaaugggcgccauacuccccuggccacaguucucgccauagcaaccccccacuauacccuucccgacccucagucgggacggugccaagaucucugaccccgagcacuacaguuaguuccauccuucggaauccuauuuauaccgugaggagccaccgcgucggacccugcucuucaccacccgcugccagagaugcaggcccucagggucuccauccauccgugcagcaccaagggaggcugaguuuggacuuaagccaucggacauguucggauuacucugagaugcgugccacucacggauccaacagccugcccucaagugcucgccucggcucuuccagcaaucugcaguucaaggccgaacgaauaaaaaucccuucaaccccgagauauccaaggaguguuguggguagcgagcggggcuccguaucucacagcgaaugcuccacgcccccucagucaccccuuaacauugacacccugucuaguuguucgcagagccaaacauccgcaucuacuuugccacgcaucgcugucaauccugccucacuaggggagagaaggaaggaucggcccuacguggaggaaccacgacaugugaaaguccagaagggaagcgagccucugggcauuuccaucguuaguggggaaaaaggaggcauauaugugucuaagguaaccguggguagcaucgcgcaccaggccgggcucgaguacggagaccagcugcuugaguuuaacggcauuaauuuaagaucagcaacagaacaacaggcucgccugaucauuggucagcagugcgauacuaucaccauacucgcccaauauaacccgcauguccaccaguuguccagucauagcaggucuuccucacaccuggaccccgcuggcacgcacagcacacuccaggggucgggaaccacuacaccagagcauccuucugugauugauccccugauggaacaagacgagggcccaaguaccccucccgcaaagcaguccagcucacggaucgccggggaugccaauaaaaagacucuugaaccgcguguuguguucauuaaaaagucccagcuggaguugggaguccaccuauguggcgguaaccugcaugggguguuuguugcugagguggaagacgacucuccagcgaaaggaccugauggccucguccccggugacuuaauccuggaguacggcagccuugauguaagaaauaagaccguggaagagguuuacguggaaaugcugaagccaagggacgggguccgccucaaagugcaguaucggcccgaggaguucacaaaggcaaaaggauugccuggcgauaguuucuacauacgagcccuguaugacagacucgcugauguagaacaagagcuguccuuuaagaaagacgauauccuuuacguggacgauacgcuaccgcaggggaccuucggaagcuggauggccuggcagcuggacgaaaacgcacagaagauucaaaggggccagauccccucuaaguaugucauggaucaggaguuuucacgccgguugaguauguccgaaguuaaagacgacaacagcgccacuaagacauuaucugcugcggccagacguucguucuuuaggcggaaacacaagcacaaacgcucagguagcaaggaugggaaggaccugcucgcacuggaugcuuucuccagugacucuauuccacuuuuugaggauagcgugucccuggccuaccagcgagugcaaaaagucgacugcaccgcacucagaccuguguugauccugggaccccuacuggauguuguaaaggagaugcucgugaaugaagccccuggcaaauucuguaggugcccacuugaggucaugaaggcuucacagcaggccauagaacggggcgugaaagacugccuguuuguugauuauaagcgcagaagugggcauuucgacgugacaacugucgcgucuauuaaagagaucaccgagaagaacaggcacuguuuauuggauaucgcaccccaugccauugaacgacugcaccauaugcacaucuacccuauugugauauuuauccacuacaagagcgcuaaacauauuaaggagcagcgggacccaaucuaucuccgugacaaaguaacgcaaagacacuccaaggaacaguucgaggccgcucagaaacuggaacaagaguacucacgcuauuuuacaggagucauucaggguggcgcacuuagcucuaucugcacccagauacuggccauggugaaucaggagcaaaacaagguucucuggauccccgcuuguccguuguga

SEQ ID NO: 55330 - RNA, 2028 nt, Artificial Sequence
  derived and/or modified sequence opt3 from DLGAP1__Homo_sapiens__NP_001003809
augaaccugaucuuccacaaggacauucucuuuggcauacccgccaauaaagugccucaggaugaguggaccggguacacaccaagaggaaaggacgaugaaaucccgugcaggcggaugcgcagcgguuccuauauuaaagcuaugggcgacgaggauucuggggacucagauacgagucccaagccuagcccaaaagucgcagcccgacgugaauccuaccuuaaggcgacucaacccucucugaccgaguugacaacuuuaaagaucucgaacgaacauucaccuaaacugcagauuagaagccacaguuaucuaagggcuguuuccgaggugucuaucaaucggagccucgacucccuggauccagccggacuucugaccucacccaaguuccgcaguagaaacgagagcuacaugagggcaaugucuacaauaucccagguaucagaaauggaggugaauggccaguuugaaagcgucugugagaguguguucucugaguuggaaucccaagccguugaggcucucgaccugccuaugccagguugcuuucggaugcgcagccauucguaugugcgagcaaucgaaaaaggguguucucaggaugacgagugcgucucccugagaucaaguagcccgcccaggaccacuacaaccgugcggacgauucaguccucuacuguaagcucauguaucaccacauacaagaaaacuccuccacccguuccuccacguaccacaaccaagcccuucauuaguaucacggcccaguccagcacugaaucugcucaagaugccuauauggacggacagggccagcgcggcgacauaauuucacagagugggcucagcaacuccacagagucuuuagauucgaugaaggcgcugaccgcagccaucgaggcugccaaugcacaaauucacggaccggcuagccagcauauggguaacaauacugccacagugaccacgaccacaacuaucgcgaccgucacaacugaagacaggaaaaaggaucacuuuaaaaagaacagaugccuuuccaucggcauucagguggacgaugccgaggaaccugacaaaaccggggagaauaaggcacccucaaaauuccaaagugugggaguccagguugaagaggagaaguguuuucggcgauucacacgcucuaacagcgugaccacugcuguacaggccgauuuggacuuucacgauaaucuggaaaacucccuagagucaauagaagacaauagcugcccaggcccuauggcuagacaguucucuagggaugccuccacgaguacagugagcauccaagguucugggaaccauuaccacgcaugugccgcugacgacgauuuugacaccgauuucgaccccuccauucucccacccccugauccauggaucgacucaauaacugaggauccgcuggaagcgguccagcggagugugugccaucgcgacggacacugguuccuuaagcuguugcaggcagagagagauaggauggagggcuggugucagcaaauggaacgugaggaacgggagaacaaucuccccgaggacauucugggcaaaauccgaaccgccguugggagcgcucaguuacugauggcccagaaguuuuaccaguucagagaacucugcgaggaaaaccuuaauccuaacgcacacccaaggcccacaucgcaagaucuggccggauuuugggacauguugcagcuauccaucgagaauauuucuaugaaauucgaugaacugcaucagcucaaggcuaacaauuggaaacagauggacccucuggacaagaaggagcgccgggccccacccccggugccuaaaaagccagcaaaaggucccgcgccucuuaucagagagaggagccuggaaucaagucaacgccaggaggcucgaaagcgguugauggccgcaaaacgugccgcuuccgucagacagaacucugccaccgaaagcgcagaguccauugaaauauauauccccgaggcucaaacuaggcucuga

SEQ ID NO: 55331 - RNA, 2928 nt, Artificial Sequence
  derived and/or modified sequence opt3 from DLGAP2__Homo_sapiens__XP_011533064
augaagggccugagcggguccagaacccagcccccucucugcucuggacacacauguggucuugccccaccggaggacugcgaacaucugcaccauggccccgaugcuaggccuccauacuuguuaucacccgcagacaguuguccugggggacggcaccgcugcagcccacgauccucugugcauucggagugugucaugaugcccguugugcugggcgaucacguaucaagcaguacuuucccucguaugcacuauuccucucauuacgacacgagagaugacugcgccguggcgcacgcuggugccaaaaucaacaggauuccagcaaaucuacucgaucaauuugaaaagcagcugccgcuucaucgggacggguuccacacccugcaguaucagcgcacaagcgccgcugcagagcaaagauccgaaucacccggaaggauacggcacuugguccauagugugcagaaacucuuuacuaagagccacucucuggagggcuccucaaaaagcaacgccaauggcaccaaggcugaugggcgcgccgacgaucaucaccaugcgcaccacgcaaagcauaguaaacgaucuaaguccaaagagagaaagccugaaggaaaaccaaggcccgguaugagcucgugguggucuuccgacgauaaccuggacucagacaguacauaccggaccccuagcguucucaaucgucaccauuuaggcccaguggcccacuguuaucccgaugcucugcaguccccguucggggaccuuucuuugaagacuagcaagucaaacaaugaugucaaaugcagugccugugagggacuggcacuaacaccugacgcuaaguaccucaaacgcuccagcuggucuacccugacggugucacaggccaaggaagcguauagaaaaaguagccuuaaccuggauaagcccuugcuccaccaagacgccaaaccagcacugaggccuugccauuacuuacagguaccccaggaugaguggggcgguuacccaacugggggaaaggacgaggaaauccccugucggcgaaugcgcuccggcucuuauauuaaggcuaugggcgaugaggaaucgggggagagcgacuccucaccuaaaaccaguccaaagucugccauccugccggaaccccuccuuaaaagcauuggacagagaccucugggugagcaccaaacacagacuuacuugcaggcugccuccgauguuccagugggccauucacuagaccccgcagccaauuauaacagcccuaaguuuaggucucggaaucaauccuacaugcgcgcugucaguacccugagccaggcgucuugcgugucccaggugucagaggcagaaaucaacgggcaguucgagagugucugcgaaagcguguuuucggagguugaaucccaagccauggacgcucucgaucugccaggauguuucagaacaaggucucacagcuaucuucgugccauacaggcaggcuacucacaggacgaugagugcauccccaugaugaccccgagugacauuacguccacuauccggucuacagccgcuguaagcuauaccaauuacaaaaagacuccuccacccgugccuccccgaacaaccuccaagccacugauuucagucacggcccagagcaguaccgagucuacacaagaugcauaccaggacuccagagcgcagaggaugagcccuuggccccaggauucgcgcgguuuguauaacucaacugacucucucgauaguaauaaagcuaugaaccuggccuuagaaaccgcagccgcucaacggcaucugccagagucccagagcucuagcgugagaacauccgacaaggccauccuaguuucaaaagcagaggaacuccugaagaguagguguagcucuauagggauucaggauuccgaauuuccggagcaccagccuuacccccgcucagacguggagacugcuaccgauagugacacagaaagccgaggccuucgggaguaucacuccgucggagugcaaguagaagacgagaaacgucauggcagauucaagaggucuaacucgguuaccgccgcggugcaggccgauuuggagcuggaaggguuuccaggacacaucacuacggaggacaagggucuccaguucggcagcucauuucaacgccauuccgaacccaguacaccuacccaguacucugcuguccggacugugagaacccaggggcuguucagcuauagggaggauuaccgaacacaggucgacaccuccacucuuccacccccugauccguggcuggaaccagcaauugacacaguggagacgggacgcaugucacccugccggagagauggcucuugguucuugaaacuccugcacgccgagaccaagaggauggaagguugguguaaagagauggaacgugaggcugaagagaaugacuuaagcgaggaaauccuggggaagauccgcagugccguuggcuccgcacaacuacucaugagccagaaauuucagcaguucuauuggcugugccaacagaacauggauccuucugcgaugccacggcccacuucacaggaccuugccggauacugggauauguugcagcuguccauugaggacgugaguaugaaguuugaugaacuccaaagacugagguuaaaugacuggaagaugauggagagcccugaacgaaaagaggagcggaagguaccgcccccaauaccuaaaaagcccccaaaaggcaaguucccuaucacacgcgaaaaaucgcuggaccuucccgauagacagaggcaggaggcucggcgaagauugauggccgcaaagcgcgcugccucuuuuaggcaaaacuccgcaagcgaacgugccgacucaauugagaucuacauaccagaggcucagacccggcucuga

SEQ ID NO: 55332 - RNA, 2940 nt, Artificial Sequence
  derived and/or modified sequence opt3 from DLGAP3__Homo_sapiens__XP_011540181
augagaggcuaccacggggacaggggaagccauccccggccugcccgcuucgcugaucagcaacacauggacguggguccagcagcccgagcgccguaucugcucggcucccgugaggcuuuuucuaccgaacccagauucugcgccccuagggcagggcuuggacauaucucaccagagggcccccugaguuugagcgaagguccuuccgucgggccagagggaggccccgccggcgcugggguuggaggugggucuucgacauuuccucggauguacccagggcagggaccguucgauacuugugaagacugcgugggccacccccaggguaagggggcaccucgcuuaccacccacgcugcuagaucaguuugagaaacaacucccuguacagcaggacggauuccauacccugccauaucagagaggccccgccggcgcugggccgggaccugcccccgguacaggcacugcgccagagccuaggucagaaagccccagucggauucgccaccuugugcacuccguccaaaagcuguuugcaaaaucucauagcuuggaggccccagggaagcgagauuacaacggacccaaagcugaaggcagagguggguccggcggagacucauauccuggcccagggaguggagguccgcacaccagccaucaccaccaucaccaucaccaucaccaccaucaccagucuaggcauggcaagcgguccaagucaaaagaucguaagggggacggacgccaccaggccaaaagcacaggcugguggaguucugaugacaaucucgauuccgacagcgguuuccuggcagggggcagacccccuggagagccaggcgggcccuuuugucuggagggaccugacgguucguacagggaucucucuuucaagggccgguccgggggaucagaaggccgaugcuuagcuuguaccgguaugaguaugagccuggacgggcaguccgugaaacgcucugccuggcacacuaugaugguuagccaaggcagagauggauauccaggcgcggggcccggaaagggccuuuuggguccggagacaaaggccaaagcaaggaccuaccauuaccuacaggugccucaggacgauuggggcggauauccaacgggcgguaaggacggcgaaauacccugccggcgcaugagaucagggaguuacaucaaagcuaugggagaugaggaauccggcgacagcgaugggucuccuaagacuucacccaaagccgucgcuaggcguuuuaccacacggcgaaguagcuccguggaccaagccagaauuaacuguugcguaccaccuaggauccacccccggucuucgauuccaggauauagccgcucccugacuaccggccagcucucagaugagcugaaucagcagcuugaggcaguuugugguaguguguucggggaacuggagucucaagccgucgacgcuuuggaccucccgggaugcuuuagaaugaggagccauuccuaccugcgcgcgauccaggcaggcuguucacaggaugacgauugcuuaccucugcucgccacacccgcugccgugagcggucgaccagggucuuccuucaacuuccggaaggcacccccuccaauacccccuggcagucaggccccgccacguaucagcauuaccgcucaaucuuccacggacucagcccacgaaaguuuuacugcagcggagggacccgcuagaaggugcagcucggccgauggccuugacgggccugcaaugggagcccgcacacuggaauuggcuccagugcccccucgggccuccccgaaacccccaacccuaaucauuaagacuaucccuggcagagaggagcugaggucucucgcacgacagcgcaaguggcggcccagcauagguguccagguugaaacaauuucagauagugacaccgagaauagauccaggcgugaguuccauucuaucggggugcagguagaagaagauaaacgccgggcuagauuuaagaggagcaacuccgugacggccggaguccaagcggaccuggagcuugagggccuggccgguuuggcuaccguggcaacagaagauaaagcccuccaguucggccgaucauuucagcggcacgcuagcgagccacagccugggccccgcgccccaacuuauaguguuuucagaaccgugcacacacaaggacagugggcauacagggaaggcuauccgcugccuuacgagcccccagcgacugacgggucucccggaccugccccagcucccaccccuggcccgggugccgggcggcgagauuccuggauugagagaggaagccgcucguuaccagacucaggcagggcaucucccuguccucgugacggcgaaugguuuaucaagaugcugcgggcugaggucgaaaaacuagagcauuggugccagcaaauggaaagagaggccgaggauuacgaacuccccgaggaaauccuggagaagauuaggagugcagugggguccacacagcuuuugcugagccagaagguacagcaauucuuucgccucugucagcagucuauggacccaaccgccuucccuguucccacuuuucaggaucuggcuggauucugggaccuucugcaauugagcauagaagaugugacgcucaaauuucuggaguuacagcagcugaaggccaauuccuggaaacuacucgagccaaaggaagagaaaaaggucccuccgcccaucccaaagaaaccucugcgagguagaggcgugcccgucaaggaacggucacuugacaguguggauaggcagcgccaagaggcgcguaaaagauugcuggcagcuaagcgggccgccagcuucaggcacucuuccgcuacagaaucagcagacaguauugagaucuauauaccagaggcccagacccgccucuga

SEQ ID NO: 55333 - RNA, 2529 nt, Artificial Sequence
  derived and/or modified sequence opt3 from DLGAP5__Homo_sapiens__NP_001139487
augagcuccucucacuucgccucaagacauaggaaggacaucaguaccgagaugauucggacaaaaauagcucaccgcaagagccugucccagaaagaaaaccgacauaaggaguacgaacguaauagacacuuuggccucaaagaugugaacauccccacucuugaggggaggauucuggucgaauuggacgagacgucucaaggauuaguuccugagaagaccaaugugaagccacgggcaaugaaaacaauccugggugaucagcgcaagcagaugcuacagaaauauaaggaagagaaacaacuccagaagcugaaggaacagagagagaaagccaagaggggcauuuucaaaguagggcgguaccgcccggacaugcccugcuuucuucugucgaaccagaaugcggugaaggcugagccuaaaaaggccaucccaucaagcguccgaauaacuagaaguaaagcaaaggaucaaauggaacagaccaagaucgacaacgaguccgaugugagggccauucggcccggaccucgucagacaucugaaaagaagguuagcgacaaagagaagaaagugguccagccagugaugcccaccuccuugcgcaugacuagaucagcuacacaagcagccaagcagguaccuaggaccguuaguagcacgacugcucggaagccagugacccgagccgcgaaugaaaacgagccggagggcaaaguccccucuaagggucgcccugccaaaaauguggaaacaaagccagauaaagggaucuccuguaagguggacucagaggaaaacacucucaauagccagaccaacgcaacaaguggaaugaaucccgauggcguccugucuaagauggagaaccugccugaaauuaauaccgcuaaaaucaagggcaaaaacuccuucgccccaaaggacuuuauguuccaaccccucgauggguuaaaaacguaucagguuacuccgaugacaccuagaagcgcaaacgcuuuucugacccccucguacacuuggacaccacuuaagaccgagguggacgagucucaggccacgaaggaaauauuggcgcagaaaugcaagaccuauuccacaaaaacuauucaacaggacucaaauaagcugccuuguccccuaggaccacucaccguauggcaugaggaacacgugcugaacaaaaaugaggccacaacuaagaaccuuaauggucugcccaucaaagaagucccuaguuuggagaggaacgagggccggauugcacagccacaccauggggugccguacuuccgcaauauccuccagagcgaaaccgagaagcugacaucccacugcuuugaaugggauagaaaguuagagcuggacauccccgaugacgcuaaagaucucauuaggaccgccguuggacaaacucgucuucugaugaaggagcgguucaaacaguuugaaggcuugguggacgauugugaguauaagcgagguauaaaagaaacgacaugcaccgaccuagauggguucugggacauggucucuuuucagaucgaggaugugauucauaaguucaacaaucugaucaagcucgaagagagcggauggcagguaaacaauaacaugaaucacaacaugaauaaaaacguuuucagaaagaaaguggucucaggcauagcuaguaagccuaaacaagacgacgccggcaggauugcagcccgcaaccggcuggcugcgaucaagaaugcaaugagagagaggauccgccaggaagagugugccgaaacugcuguguccgucauuccaaaggagguggauaaaaucguuuuugacgccggguucuuucgaguggaaagccccguaaaacuuuucucuggacugucagucaguagcgaggguccuucccagcgguugggcaccccaaaaucugugaacaaggcaguuucgcagagccguaaugagauggggauuccccaacagacaaccuccccggaaaacgccggaccucagaauacuaaaucagagcacgugaagaagacacucuuucugaguauaccagaaucuagaagcuccaucgaggaugcucaaugccccggcuuaccugaccugauugaagagaaccaugucgugaauaaaacggaucuaaagguagacugucucucaagcgagaggaugucucugccccuuuuggccggugggguggcagaugacaucaacaccaauaaaaaggaaggcaucuccgauguugucgagggaauggaacugaacaguagcauuacuucucaggacgugcucauguccucaccagagaaaaauacagcgagucagaacagcauacuggaggaaggcgagaccaagaucucgcaguccgaacuuuucgauaauaaaucucugacaacugagugccacuugcucgacagcguggggucauguuacgucgcucgcgccggacuggaaguuuuagguaguuccgauccuaccacgucugcaagccggguggccggcaccacagcuagauccaagcugcaauga

SEQ ID NO: 55334 - RNA, 1152 nt, Artificial Sequence
  derived and/or modified sequence opt3 from DLK1__Homo_sapiens__NP_003827
augaccgccacagaggcucugcucagagugcuucuguuguuacuggcauucggccacagcacuuacggggccgaaugcuuucccgcguguaacccucagaauggauucugcgaggacgauaacgucuguaggugccaaccagguuggcagggcccgcuaugugaccagugcguuacgucccccgggugucuccauggacugugcggcgaaccuggucaguguaucugcaccgaugggugggacggagagcuuugugaucgggacgugcgcgcuuguucuucagccccaugcgcaaauaacggcacaugcguaagucuggaugacggcuuguaugaaugcagcugugcccccggguacuccggaaaggauugccagaaaaaggacgguccuugugugauuaauggcucuccaugccaacacgggggaacuugugucgaugacgagggccgagcuucgcaugcaucaugccucugucccccugguuuuagcgggaacuucugcgagauaguggccaauaguuguaccccaaacccgugcgaaaaugauggaguuugcacagacaucggcggcgacuuucguuguagaugccccgcuggguucauugauaaaaccuguuccaggccugugacuaacugcgccucuagcccaugucagaauggagguacaugccugcagcacacccaagucuccuaugagugucugugcaagcccgaauuuacgggccucacuugugugaaaaagcgggcguuaucaccucagcagguaacccgccugccaaguggguacggacuugcauauagauugacacccggcguucaugagcugccggugcagcaaccugagcacaggauccuaaaggucagcaugaaagaacucaacaagaaaacuccccugcuuaccgagggucaggccauuugcuucacaauccuggggguguugaccucucucgugguccugggcacgguuggaauaguguuuuuaaauaagugugaaacuuggguauccaaccugcgguacaaucacaugcuccgcaaaaagaagaaccuucuguugcaguauaacucaggcgaggaccuagcugugaauaucauuuucccagagaaaaucgauaugacaaccuuuagcaaggaagccggggacgaggaaauuuga

SEQ ID NO: 55335 - RNA, 2172 nt, Artificial Sequence
  derived and/or modified sequence opt3 from DLL1__Homo_sapiens__XP_011534060
augggcagcagaugcgcccuggcucucgcagugcuuuccgcccuguugugucaggucuggucuucagggguuuucgaguuaaagcugcaagaauuugugaacaaaaagggacuacucgguaauaggaacugcugucggggcggggcgggacccccuccaugcgcuugucgcaccuucuuucgaguaugccugaaacacuaccaggccagugugagcccggagcccccuuguacauauggcuccgcagucacuccagugcuugguguugacucuuucucgcugcccgaugggggaggcgccgacucagcuuuuagcaauccuauccguuucccauuuggcuucacguggcccgggaccuuuaguuugauuauagaagcacuccauacagauuccccugacgaucuggccacugagaacccagaaagacugaucucuaggcucgcuacccagcggcacuuaacagugggagaggaguggagccaggaccugcauuccucaggucgcaccgaucuuaaguacaguuauagauucgucugcgacgaacacuacuauggcgagggguguagcguguuuugcaggccgcgggaugacgccuucggacauuuuacuuguggcgaacgcggugagaaaguaugcaaucccggguggaagggaccuuacugcacagagccaauuuguuugcccggcugcgaugaacaacacggcuucugugacaagccuggggagugcaaaugucgaguuggauggcaggguagauauugcgaugaauguaucagguacccaggcugccugcacgggaccugucagcagcccuggcaaugcaacugucaggagggauggggcggucuauucugcaaucaggaccucaacuacugcacgcaucacaagccguguaaaaauggggcgacuugcaccaacacaggccagggaucuuauacuuguuccugccggccuggcuacaccggggcaacaugugaacugggaauugacgagugcgaucccucaccauguaagaaugguggcagcugcaccgaccuugagaacaguuauucuuguacgugcccucccggguuuuacggaaaaaucugugaacuguccgccaugacuugcgcugauggcccaugcuucaauggugggcguuguagcgacucgcccgauggcggauauucuugccgcuguccugugggcuacuccggguuuaacugcgagaagaagauagacuauuguucaaguagcccaugcuccaauggagccaaaugugucgauuugggugacgcauaccucugcagaugucaagcuggcuucucugggaggcauugcgaugacaacguggaugacugugccagcucaccgugcgcgaacggaggcacaugccgggacggugugaaugauuuuaguuguaccugucccccuggguacacuggccgaaacugcuccgccccagucagccgcugcgaacacgcacccugucacaauggagcuacaugccaugagagaggccacagguauguuugugaaugcgcccggggguacggaggcccuaacugucaguuccuguuaccagagcugcccccggguccugcugugguagaccucaccgagaaacuugaagggcagggaggcccauuucccuggguggccgucugcgccggugugauccugguuuugaugcuacugcucggcugugcagcuguggucgugugcguacgccugagacuucaaaagcauaggccucccgcggauccaugccguggggagacggaaaccaugaauaaccuggcaaauugucagcgggagaaggacauuucuguuucaaucauuggagccacacagaucaaaaacacuaauaagaaagcugauuuccacggcgaccauagugccgauaagaacggguuuaaggcacgauauccugccguggacuacaauuugguccaggaucucaaaggagacgauaccgcugugagagacgcccacagcaagagggauacaaaaugccaaccccagggcuccucuggugaagagaaggggacuccaaccacacugcgcggaggcgaggcaucggaacggaaaagaccggacagcgguuguuccaccucaaaggacacuaaguaucagagugucuacgugauaucugaggaaaaagaugagugcguuauugcgacggagguguga

SEQ ID NO: 55336 - RNA, 1857 nt, Artificial Sequence
  derived and/or modified sequence opt3 from DLL3__Homo_sapiens__NP_058637
auggugagccccagaauguccggccugcucucucagaccgucauccuugcccugauuuucuugccucaaacaaggccagcugggguuuuugaguuacagauacacucauucggaccgggucccggcccuggggcaccacggagucccugcagcgcccgccugccuugucgacuauuuuuccgugugugccucaagccaggacuguccgaagaggcggcugaaucucccugugcccuuggcgcagcccugucggcuagagguccuguauacacugagcagccaggggcaccggcccccgacuugccucucccagauggacugcuccaggugcccuuuagggacgcuuggccuggcacguucucauuuaucauugaaaccuggcgggaggagcugggcgaucaaaucgggggaccagccuggagcuuacuggcgcgcgucgcagguagaaggcggcuugccgcuggcgggcccugggcccgcgacauucagcgagcaggagcuugggaauugagauucaguuauagggcccggugcgagccgccugcggugggcacagccuguacucgucugugccgccccagauccgcaccaucuaggugugguccugggcuacggcccugcgcuccacucgaagaugagugugaggcuccccugguuugccgagccggauguagcccugaacauggcuuuugcgagcagccaggcgaaugccgcugucuugagggguggaccggaccgcugugcacagugcccgucuccaccucaaguuguuugagcccuagagguccaucuuccgccacuacaggcugccucgugcccgggccuggaccaugugacggcaaccccugcgcaaauggugggucauguagcgaaaccccgaggaguuucgagugcacguguccucggggcuuuuacggacugcgcugcgagguaucuggcguuacuugugccgaugggccaugcuucaacggagguuuaugcgugggcggggcugaccccgauuccgcguauaucugucacugcccucccggauuucagggcagcaauugugagaaaagagucgacaggugcucgcugcaaccaugucguaacggugggcucugccuugaucugggccaugcauugcggugucgaugcagagccggauucgcuggcccuaggugugaacacgaccuagaugacugcgccgggcgcgcaugugccaauggagguaccugcguggaaggcgggggagcucaucggugcucuugugcccugggcuucggugggagagacugcagggagcgcgcagaucccugugcggcucgaccaugcgcccacggcggacgguguuacgcacacuuuuccggccucgugugcgccugugcuccgggguauaugggagcccguugcgaguucccuguccaucccgacggcgcaucagcucugccagccgcgcccccuggucuuagaccaggggauccccagagguaccuguugccuccggcccucggacuguuaguugcugcaggcguggccggugcugcccugcuacucguacacgugcgccggagaggccauagucaggacgcagggagcaggcugcuugcgggaacaccagaacccuccguccacgccuugccugaugcucugaacaaucuccgaacucaggagggcucuggggacggaccaagcucaaguguggauuggaaccgccccgaagacguugauccucaaggcauauaugugaucuccgccccgagcauuuacgcacgggaggucgcuacaccccuguuuccaccucuucacaccgguagagccgggcagaggcagcaucuguuguuccccuacccaucuucaauccucagugugaaguga

SEQ ID NO: 55337 - RNA, 2058 nt, Artificial Sequence
  derived and/or modified sequence opt3 from DLL4__Homo_sapiens__NP_061947
auggccgcugcaagcagauccgccucuggcugggcgcugcuccuucugguggcuuuguggcagcaaagggccgcagggucaggagucuuccaguuacagcugcaggaguuuaucaacgaacgggguguucuagccaguggccgccccugcgagccugggugucgaaccuucuuucgugugugccucaagcacuuccaagcuguagugagcccaggaccguguacauuuggcacugucuccacgcccgugcuggguaccaauucuuucgcaguuagagacgauucgucagggggaggcaggaacccucuucagcugccauuuaauuucacauggcccggcacuuuuagcuugauuauagaagccuggcaugcuccuggggacgaucuccggccagaggcccugcccccugacgcgcugaucaguaaaauugcaauccagggaucccucgccgugggucagaacugguuacuggaugaacaaaccucuacacuuacccgcuugagauacagcuauagggucauuugcuccgacaauuacuauggcgauaacuguucacggcugugcaagaaacgcaaugaccacuucgggcauuacgugugucagccagauggaaaccuaaguugccucccgggcuggacuggugaguauugucagcagcccaucugccugagcgggugucacgagcaaaauggauacugcucuaagccugcugaaugccuuugucgaccaggcuggcagggcagacugugcaacgaguguauaccccauaaugggugcaggcacggaacauguuccaccccuuggcagugcacgugugacgaagguuggggcggguuguuuugcgaucaagaccucaacuauuguacucaccauucaccaugcaaaaauggagccaccuguagcaacaguggccagcggucuuacacaugcacuugccgucccgguuacaccgggguagauugugagcuggaguuauccgaaugcgacagcaauccgugucgcaacggcggaucgugcaaggaccaggaggauggcuaucacugucugugcccucccggguacuauggacuccauugugaacacucuacacuuuccugcgcagacucaccauguuucaacgguggcaguugcagagagaggaaucagggggcuaacuacgccugugaaugcccucccaauuuuaccggaagcaacugcgagaagaaaguugaucgguguacguccaauccaugcgcgaacggcggucaaugucugaaucgagggcccucucgcaugugcagauguaggccuggcuucacuggaacauauugcgaguugcacgugagcgacugugcccggaacccaugcgcacauggcgggaccugucacgaucuagaaaauggacugaugugcacuuguccggcugguuucucaggccgcagaugcgaggucaggacaaguaucgacgccugcgcuuccagccccuguuuuaaccgugcaaccugcuacacggaucucucuaccgacacauucguguguaauugcccuuauggguuugugggaucacggugugaguucccagucggccugcccccuaguuuuccauggguugccgugagccuugguguagggcuggccguguugcucguccuguuaggcaugguggcuguugcggugcgacagcugagacuaaggcgccccgaugacggaucccgggaggcaaugaacaaucucucugauuuccagaaggacaaccugauuccggccgcucagcuuaaaaauacuaaccaaaagaaagaauuggaggucgacugcggccuggauaagucgaacugugggaagcagcagaaucauacccucgacuacaaccuggccccuggaccacuuggcagagguacaaugcccgggaaauuuccucacagcgauaagucccugggagagaaagcacccuugaggcuccauucagaaaagccagagugccgcaucagugccauuuguucuccucgagacagcauguaccaguccgugugccugaucucagaagaacggaaugaauguguaauagcuacugagguuuga

SEQ ID NO: 55338 - RNA, 1362 nt, Artificial Sequence
  derived and/or modified sequence opt3 from DLST__Homo_sapiens__NP_001924
augcugagcagauccaggugcgugucucgggccuucucacgcagucucagcgcuuuucagaagggcaacuguccccuugggcgacguucccugccuggagucucuuugugccaagguccaggcuaccccaauucgagaaaaguugugaucaacaauucaguauucagcgugagguuuuuccggaccacagcagucuguaaggacgauuuagugacuguuaaaacgccggccuuugcggagagugugaccgaaggggacguccgcugggagaaggcugugggagauacaguagccgaagacgagguugugugcgaaauugagacugauaaaaccuccguccaggugccuucuccagcaaacggcgugauagaggcccugcuaguccccgacggugggaagguugaaggaggcacaccucucuucacccugagaaagacuggcgcugcaccagccaaagcuaagcccgccgaggcgccugcagccgcugccccaaaagcagaaccgacagcugccgcggugcccccuccagccgcacccaucccuacccagaugccacccguaccgagcccuucccagcccccaucagggaagccugugagugcugucaaacccacgguggccccaccccuugcugagccuggagccgguaagggccugaggagcgagcaccgggaaaagaugaaucgcaugcgacaaagaauugcacagagguugaaagaggcccagaacacuugugcuaugcucaccacauuuaaugaaaucgauaugucuaacauucaggagaugcgggcgcgucauaaggaagcauuccugaaaaagcacaaucugaaacucggguuuauguccgccuucguuaaggcuucagccuuugcauuacaagagcagccaguggucaacgccgugaucgacgauacuaccaaagagguaguuuaucgcgacuacauagauaucagcguggcugucgccacaccgagaggacuggugguccccgugauuaggaauguugaagcaaugaacuucgcggacaucgagcggaccauuacggaacuuggcgagaaggcucgaaagaaugaauuggccaucgaggauauggacggugggacuuuuacaauaaguaacggaggcguguucggcucucuguucgggaccccuauuaucaauccaccccaguccgcaauucuaggaaugcaugguaucuuugaccgcccuguagccaucggcgggaaagucgaggugagaccaaugauguauguugcucucacuuacgaucacaggcugauugacggacgggaagccgugacauuccuucgcaagauaaaagcagcugucgaggaucccagagugcuguugcucgaccuguga

SEQ ID NO: 55339 - RNA, 390 nt, Artificial Sequence
  derived and/or modified sequence opt3 from DLX1__Homo_sapiens__NP_001033582
augaccaugacaacuaugcccgagagccugaacuccccugugucuggcaaggccgucuucauggaauuugggccaccgaaucagcaaaugucacccaguccuaugagccacggacauuacuccaugcacugccuccauucugcuggucacucgcagccagacggcgcauauucaagcgccaguuccuucucuagaccccuuggguacccuuauguuaacagcguguccucacaugcgaguagcccauacaucucuuccguacagucauaucccggaagcgcuagucuggcccagucuagguuggaggauccuggccaagacuuagugccaaaacaggcaauucagguccaggaagccgaugaggcugguuggggaggguccggcggcuga

SEQ ID NO: 55340 - RNA, 987 nt, Artificial Sequence
  derived and/or modified sequence opt3 from DLX2__Homo_sapiens__NP_004396
augaccggcguguucgacagccuggucgccgauaugcacuccacacagauugcugcaucuucaacuuaccaucaacaccagcagcccccuagugggggaggugccggcccagggggaaacagcuccucuucgucaagccuccauaagccgcaggagagucccacgcuuccuguuuccaccgcgacagacucuagcuauuacacuaaucaacagcacccagcuggcggugggggaggcggcgggucccccuaugcccauaugggaucauaccaguaucaggcaaguggucugaacaaugugccuuacagcgccaaaucuuccuaugauuugggcuacaccgcugcauacacaucauaugccccauacgggaccagcaguucucccgcuaacaaugaaccugagaaggaagacuuagagccagaaauuagaauaguaaacggaaaaccgaagaaagugaggaagccccggacuaucuauuccagcuuucaacuggccgcgcuacagcgccgauuccagaagacacaguaccucgcacugccugagcgugccgagcuugcugccucgcugggcuugacccaaacgcaggucaaaauuugguuucagaauagaaggucuaaguucaaaaagauguggaaauccggugaaaucccaucagagcaacaccccggggcaagugcuagcccuccaugcgccucucccccgguguccgcgccugccagcugggauuuuggaguuccccagcggauggcaggcggcgggggaccagguucaggcgggaguggagcuggcuccagcgguucuucaccuaguagcgccgcuuccgccuuccucgggaacuaucccugguaccaccagacuucuggcucggcaagccaucugcaggccaccgcuccacugcuccaccccacacaaacuccucagccacaucaccaccaucaccaucacggaggcgggggagcgccgguguccgcagguaccaucuuuuga

SEQ ID NO: 55341 - RNA, 864 nt, Artificial Sequence
  derived and/or modified sequence opt3 from DLX3__Homo_sapiens__NP_005211
augagcggcuccuucgacagaaagcugucuucaauccucaccgauauuaguagcucccuuucuugccacgccgggucgaaagacucacccacacugccugagagcagugugacugauuugggauacuauuccgcuccacagcaugacuacuauucuggucaaccguacggccagacggucaaccccuauaccuaccaccaucaguuuaauuuaaacgggcuggcaggaacaggcgccuauagcccuaaguccgaauacacuuacggugcgucauauaggcaguacggggcuuaucgggagcaaccacuacccgcccaggauccuguuagugugaaagaggaaccagaagcagagguacgcauggugaauggaaagcccaaaaagguccgaaagccucguaccauauacagcucuuaucagcucgccgcucugcagagaagguuccaaaaagcacaguaccuugcccugccagagcgggcugaauuggccgcgcagcucggccugacacagacccaagugaagaucugguuucagaaccgcagauccaaauucaagaaacuguauaagaauggcgagguuccgcucgaacacucacccaacaauagcgacaguauggcauguaacucuccuccaucccccgccuuaugggauacuagcucgcauucuaccccugcuccagccaggucccagcugcccccgccucuucccuacucagcaaguccaagcuacuuggacgauccuacaaauuccugguaucacgcucaaaaccugucugggccccaccuacagcagcagccaccccaaccugccacgcuccaucacgcgagcccaggaccgcccccuaauccaggugccguguacuga

SEQ ID NO: 55342 - RNA, 723 nt, Artificial Sequence
  derived and/or modified sequence opt3 from DLX4__Homo_sapiens__NP_612138
augaccagccugcccugcccucucccaggcagagacgccuccaaggcuguguucccggaucuugcacccgucccuucuguugccgcggcuuacccacugggguugucacccacaacugccgcaaguccuaacuuaagcuauuccaggccauacggacaucugcuaucuuaucccuacacggagccugccaauccaggugacucguaucucucaugucagcaaccggcugcacugagccagccccuuugcggcccugccgaacacccacaggagcuggaagcugauagugagaaaccccgguuguccccugaaccaucugagcgccgaccccaggccccggcgaagaaacuccguaagccuagaaccaucuacagcucccugcaacugcagcaccucaaccagagguuucagcauacacaauauuuagcacugcccgagcgggcccagcuugcugcccaguuggggcugacucagacccaagugaaaauuugguuccagaauaagcgcucaaaguacaaaaagcuacucaaacagaacaguggaggccaagaaggugacuuuccagggagaacauucagcguaucuccuuguucacccccacugcccucccuuugggaucugccuaaggcaggaaccuugccaacuagcggcuacggcaauaguuuuggggcuugguaucagcaccauucuuccgacgugcucgccagcccgcagaugauguga

SEQ ID NO: 55343 - RNA, 870 nt, Artificial Sequence
  derived and/or modified sequence opt3 from DLX5__Homo_sapiens__NP_005212
augaccggcguguucgacagaaggguccccagcauccgguccggggauuuucaggccccuuuccaaacaucugcugcaaugcaccauccaucacaggagaguccgacucugcccgagagcuccgccacggacucugauuacuauucgccuaccggaggugcgccacacggcuacugcucacccacaagcgcuaguuaugggaaggcccucaacccuuaccaguaucaguaccauggaguuaauggcuccgcagguucuuauccagccaaggcuuacgcagacuacagcuaugccuccucauaccaccaauaugggggagcuuacaaccgcgugcccagugccacuaaucagccugagaaagaaguaaccgagccagaagugcgaauggucaacggcaaaccgaagaaagugcguaagcccagaacaauuuauagcucuuuucagcuugcggcacugcagaggcgguuccaaaagacccaguacuuggccuuaccugagcgcgcugagcuggccgcaucccuaggccucacucagacacagguuaaaauaugguuucaaaauaagagaucaaaaaucaagaaaauuaugaagaacggggaaaugccacccgagcauagcccuaguucuuccgauccaauggcuuguaauagcccccagucgccggccgugugggaaccucagggaucuuccaggucacugagucaccacccccaugcgcacccaccuaccagcaaccaaucccccgccucuagcuaucuugaaaauucagcaaguugguacacguccgcugccagcucuaucaacucacaucugccacccccugguaguuugcagcacccacucgcucuggccagcggcacucuguacuga

SEQ ID NO: 55344 - RNA, 882 nt, Artificial Sequence
  derived and/or modified sequence opt3 from DLX6__Homo_sapiens__NP_005213
augaugaccaugacaacuauggccgacggccuggaggggcaggauuccuccaagucugcuuucauggaauuuggacaacagcagcagcaacagcagcagcaacagcagcagcaacagcagcaacagcagcagcccccuccaccgcccccuccacccccucaaccacacucacagcagaguagccccgcaauggccggugcgcauuacccucuccacugccuucauuccgcugccgcagccgcugcagccggcucucaccaucaccaccaucaccagcaucaccaccaugggucgccauaugcuucaggaggcgguaacagcuacaaucacagaagucuggccgcguauccguacaugucccauucucaacacagccccuauuugcaguccuaccauaacucaagugcagccgcucagacgaggggagacgauaccgaccagcagaaaacaacugugaucgagaauggggaaauucgguucaacggcaagggcaaaaagauacgcaaaccucgaaccaucuauagcucuuuacaacugcaggcccuaaaucaccguuuucagcaaacacaguaccucgcacugccagagagagcugaacuugccgcgucccugggguugacccagacucaagucaagauuugguuccagaacaagaggucaaaauuuaagaaacuccugaagcagggaagcaauccccacgagagugauccucugcaggguucugccgcacucuccccacggagccccgcuuuaccgccuguuugggacgugucggccucugcuaaaggcguauccaugcccccaaacucauacaugccuggguauagucauugguacagcagcccccaccaagauacaaugcagcgcccacagaugauguga

SEQ ID NO: 55345 - RNA, 5358 nt, Artificial Sequence
  derived and/or modified sequence opt3 from DMBT1__Homo_sapiens__NP_004397
augggcaucagcaccgugauucuggagaugugccuccuuugggggcagguccuguccacaggagguuggauaccccgaacuacggacuacgcaucuuugaucccuucagaaguuccauuagauccgaccguggcugagggcagucccuucccuagcgaauccacacuggagucuacuguagcagaagggucgccaauuucacuggagagcacccucgagaguacaguggccgaaggaucccugauccccucugagagcacccuugaauccacugucgcggagggcucagacaguggucuggcuuugaggcucgugaacggggauggacggugucaaggccgcguugagauucuguaucgaggcagcugggggacagugugcgacgauucuugggacaccaaugaugccaacgucgugugucgucagcugggaugcgguugggcaauguccgccccuggcaaugcuugguuugggcagggaucaggcccaaucgcacucgacgauguaagauguagcggucacgaaaguuacuuauggucuugcccccauaacggguggcugucccacaauuguggacauggcgaggacgccggcguuauaugcagcgcugcccagccucaaucgacgcuuaggccagaaucuuggccggugcggaucucacccccugucccaacugaggggagcgaaaguagcuuggcgcugcgccuagugaacggaggugauagauguaggggccggguggagguccucuaucgcggguccuggggaaccguuugcgacgauuacugggacacaaaugacgcaaacgugguaugucgacagcugggcugcgguugggccaugucugcucccgggaaugcccaguucggccagggaagcggcccuauugugcuugaugacgucagaugcucagggcacgagaguuaucugugguccuguccacauaacggaugguugacucacaauugcggucacagcgaagaugcaggcgugaucuguucugcuccccaaucaaggccgaccccuagucccgacacauggccaaccagccaugccuccacggcggggccugagucuucgcucgcccugcgguuaguuaacggaggcgaucguugccagggucgcguggaaguccuguacagagggagcuggggcacugugugugacgauuccugggacacaucagaugcaaauguaguuugcaggcagcucggauguggcugggcuaccagugcccccgggaacgcucgguuuggacaggguucuggcccaauugugcuugacgauguccgaugcagcggguaugaguccuaccuguggucauguccccacaauggaugguugagccauaacugccaacacucugaagacgccggcgugaucuguuccgcagcccacaguuggagcacuccuucuccagacacacuaccgaccauaacgcugcccgcuuccaccgucgguucagagaguagccucgcgcugcgccuugugaacgggggcgauagaugccagggaaggguugaggugcuguaccagggcucgugggggacaguaugcgacgauuccugggacacuaaugaugcaaacgucgugugucggcaauugggaugcggcugggccaugucugcuccugguaaugcccgcuucgggcagggaagcggcccaauuguucucgacgaugugagauguucaggucaugaaaguuaucugugguccugcccccacaacggcugguuaucucauaauugugggcacagcgaggacgcaggagucaucugcuccgccucacagagcaggccuaccccaagucccgauacauggccgacuucucaugcuuccaccgccggcagcgaaucgucacuggcacuacgucucgugaacgggggagaccggugucagggccgaguagaggugcuguacagagguucuugggggacaguuugcgaugacuauugggauaccaaugacgcgaacgucguguguaggcaacuuggaugcggcugggcuaugagugccccugguaaugcacgcuuuggccagggguccggaccaauuguguuggacgauguccgguguagcggccacgaaucuuaccuguggagcugcccccacaacggguggcucucccauaauugcggacaccaugaggacgccggcguuaucuguucagcuagucagagccagccuacucccucuccagauacguggccuacaucccacgccucaaccgcagguagugagagcucccuggcucuuagacuggugaacgggggagacaggugccaaggccgcguggaaguauuguaucgagguucuuggggcacugucugugaugacuacugggauaccaaugacgccaacgugguuugccggcagcucggguguggaugggcgacaucggcccccggcaaugcucguuucgggcagggaagcggcccaaucgugcuggaugacgucagaugcucaggucacgaguccuauuuauggaguuguccgcauaacggguggcugucucacaacugcggacaucacgaagaugcaggcgugauuuguagcgccucccagucacaaccuacccccucuccagacacuuggcccacaagcagggcuaguacggccggcuccgagagcacccuagcacuccgccugguuaaugggggagaucggugcagagguaggguggagguacuuuaccagggcucuugggggacugucugugacgacuacugggauacaaacgacgcgaauguggugugccgacaguugggaugcggcugggccaugucagcuccugguaacgcccaguuugggcaaggauccggcccaauaguccuggaugacguucgcuguaguggccaugaaagcuaucucuggucgugcccccacaauggguggcugucucacaacuguggacaucacgaggaugccggugugaucugcuccgcugcccagagccagucaaccccucggccggacacaugguuaacuaccaaucugccagcacuuacgguaggcagugaaucuuccuuggcccucagacuggugaacgggggagauaggugucguggccgcgucgaggugcuauaccgggguagcugggggaccguuugcgacgauucaugggacacaaaugaugcuaacguggucuguagacaacugggaugcggcugggcgaugagugcccccggcaaugcaagguucgggcagggaagcgguccuauugugcucgacgacguucgauguuccggcaacgaaucuuaucuguggagcugcccacauaagggguggcuuacucacaauuguggacaucacgaggaugcuggcgugaucugcuccgccacccagauaaacucaacaacuaccgacugguggcaccccacgacaaccacuacagcccggccuucuaguaauugcgguggguuuuuguucuacgcuucgggaaccuuuagcuccccgucuuaucccgcauacuauccaaacaacgccaaaugugucugggagauugaaguaaauucaggcuaccgcaucaaccugggcuucagcaauuuaaagcucgaggcgcaucacaacugcuccuuugauuacguggaaaucuucgacgggagucuaaauucuagccuucuguugggaaaaauuuguaacgauacuagacagaucuucaccucauccuauaauaggaugacaauucauuuucggagugacauauccuuccaaaacacggguuuucucgcuugguacaauucuuucccuuccgaugccacccugagacugguuaaccuaaauucaagcuauggccucugcgcagggagaguggagaucuaccacggaggcacuugggguacagucugugacgauucguggaccauucaggaagccgaggugguaugccgccagcugggguguggaagggcugugucugcacuuggcaacgccuauuuuggcaguggguccggacccaucacauuggacgaugucgagugcagcgguacugaaucaacccuguggcagugucguaaucggggcugguucucccacaacugcaaucauagagaggacgcggggguuaucuguucuggaaaccacuuaagcacgccagcuccuuuucucaacauuacaaggcccaauaccgauuacaguugcggcgguuuccugucccaaccaagcggggacuuuucuucaccguucuauccuggcaacuaccccaauaacgccaagugcgugugggacauagaagugcagaauaacuaccgcgucacugugaucuuucgagauguucagcuugagggaggcuguaauuaugacuacauugaaguauucgaugggccauauagaaguagcccccugaucgcacgggugugcgacggagccagggguagcuuuaccucuucgucaaacuucaugagcauucgcuucaucuccgaucauaguauaacacguagaggcuuucgggcugaguacuauucuagcccuuccaaugacucaacuaaccuacucugucugccaaaucacaugcaggccagugucucuaggagcuacuugcaaucccugggguucucagcaagcgauuuagugaucucuaccuggaacggauauuacgagugccgcccccagauuacaccuaaucucguuaucuuuacgauuccguacuccggcugugguaccuucaaacaggcugacaacgauacuaucgacuauaguaauuuucugacagccgcggugagcgggggcauaauuaagcgaagaaccgaucuucggauccaugucucgugcaggaugcugcaaaacacuuggguggacacaauguacauugccaaugauaccauccacguagcaaacaacacgauacaggucgaagaggugcaguauggaaauuucgacguuaacaucuccuuuuacacuucuucauccuucuuguauccagugaccagucgccccuacuaugucgaccucaaucaggaucuguacgugcaagcugaaauucuacacuccgacgccguucugacacuuuuuguggauaccugugucgcuucuccuuacagcaacgacuucacuucacucacauaugaucugaucagauccggcugcgugagggacgauaccuacgggcccuauaguagcccaucuuugcggauugcacguuuucgcuuccgagccuuucauuuccugaauagauucccuucaguauacuuaagguguaagauggugguuugccgggccuaugaccccuccagccgcuguuacagaggaugcguccucaggucuaaacgggauguggguaguuaucaggagaagguggacgucguacugggcccaauccagcuucagacaccuccgcgaagagaggaggaaccccgcuga

SEQ ID NO: 55346 - RNA, 1023 nt, Artificial Sequence
  derived and/or modified sequence opt3 from DMC1__Homo_sapiens__NP_008999
augaaggaggaccagguggucgccgaggaacccggcuuccaagaugaagaggaaagccuguuucaggacaucgaucuccuucagaaacacgggauuaacguugcugacauaaagaaacugaaguccgugggaaucugcaccauuaaagguauccagaugacaacuagaagggcauuguguaauguaaagggcuuaucugaggccaagguggauaaaauuaaggaggcggcuaacaaacugaucgaaccuggguuccuaacggccuuugaguacucagaaaagcggaaaauggucuuccauauaaccacaggaagucaagaguuugacaagcuccugggcggugggaucgagagcauggcaauuacugaagccuucggagaguuucgcaccggcaagacacagcuuucccacacccugugcgugacugcucaguugccaggcgcagggggauauccggguggcaaaaucauuuucaucgauacagaaaauaccuuucgacccgaccgucucagagauauagccgacagguucaacguugaucaugacgcugugcuggauaauguccuguacgcccgggcguauacgucugagcaccagauggaacucuuagacuacguggcagccaaguuucaugaggaggcugggauuuucaaacugcuuaucauugacucgaucauggccuuguuucgcguagauuucucaggaagaggcgaacuggcagagaggcaacagaagcuagcucagaugcucagccggcugcagaaaaucagugaagaguauaacguugccguguucgucacuaaucaaaugaccgcggacccuggugccacaaugacuuuucaggcagauccaaagaaacccauugggggacacauacuugcucacgccuccaccacacgcaucucucugcgaaagggcagaggcgaauugaggauugcuaagaucuacgacagcccugagaugccagagaacgaagccaccuucgcaauaacggccgggggaauuggugaugcuaaagaguga

SEQ ID NO: 55347 - RNA, 11034 nt, Artificial Sequence
  derived and/or modified sequence opt3 from DMD__Homo_sapiens__NP_000100
auggaggacgaaagagaggaugugcagaagaaaaccuucacaaagugggucaacgcccaauuuagcaaauucggcaagcagcacaucgaaaaucuguuuuccgaccuccaggaugggaggcggcuucuggacuuguuagagggacugacuggucagaaacuacccaaggaaaagggcucuacgcgcguucaugcucucaacaaugugaacaaagcacugcgaguacuucaaaauaacaauguggaucuggucaacauugggucaaccgacauaguggauggaaaucacaaguugacacucggccugaucuggaacauuauccugcauuggcagguuaaaaaugugaugaagaacauuauggccggucuccagcagacuaauagugagaaaaucuuacugagcuggguccgucaauccaccagaaacuacccucaggugaauguaauaaacuucacaaccucuuggucggacgggcuugcguugaacgcucugauccacucacauaggccagaucuauuugacuggaauagcguugugugccagcagagugccacucaacggcucgagcacgcauucaacauugcccgcuaucagcugggaaucgaaaagcuucuggauccggaggacgucgauacaaccuaccccgacaagaaauccauuuugauguauaucacgucucucuuucaggugcugccucaacaggugagcauagaagcuauucaggaggucgagauguuaccaagacccccuaagguuacuaaagaagagcacuuccagcugcaucaccaaaugcauuacucccagcagaucaccgugucacucgcacagggcuaugaaaggacaaguagcccaaagccccgguuuaaaucuuacgccuauacucaagcugccuacguaaccacauccgacccuacccgcucaccauucccgagccagcaccuugaggcgcccgaagauaagaguuuuggcucuucccugauggagagcgaggugaauuuggaccgauaccagacggcacuagaagagguccugucguggcuccugucugccgaagauacucuucaggcucaaggggagauuuccaacgacguggaaguugugaaagaucaguuccacacacaugagggauauaugauggaccugaccgcccaccaggguagagucggcaauaucuugcagcucgggucaaagcugaucggaacuggcaaguuaagugaggaugaagagacagaagugcaagagcagaugaaccugcuaaauagcaggugggaaugucuccggguagcauccauggagaaacagucuaaccugcaucguguucuuauggacuugcaaaaucagaagcugaaagagcucaacgauuggcugaccaagacggaagagcgcaccagaaaaauggaagaggagccucuugguccagaccuggaagauuugaagaggcaggugcagcaacacaagguccuccaggaggaccuggaacaggagcaggugcgggucaauagcuuaacacauauggugguugugguagacgaaucaaguggggaucacgcuacugccgcgcuggaggagcaacuaaaaguccucggagaccgaugggccaacauuugccgcuggaccgaagauagaugggugcugcuucaggacauauugcugaaguggcagaggcucacagaggaacagugucuguuuuccgcaugguuaagcgagaaagaagaugcuguuaauaagauccacacuaccggcuucaaagaccaaaacgagaugcugucuucacuucagaaguuggccgugcucaaggcugaucuggagaaaaagaaacagaguaugggcaagcuauacagccugaaacaagaccuccuguccacacuuaagaauaagucugucacccagaaaacugaagccugguuggauaacuucgcacggugcugggacaaccuggugcagaaguuagagaaaucgacggcccagauuagccaagcuguaacaaccacucagcccucccucacccagacaaccgugauggaaacuguuacaacggucaccacucgcgagcagauccuggugaagcaugcgcaagaagagcuuccuccacccccgccucagaaaaagagacagauaacaguggauucagagauuaggaaacgucuggacgucgauaucaccgaauugcacaguuggaucacacggucugaggcaguucuccagagccccgaauuugccauuuuccgaaaggaggggaauuuuuccgaccugaaggagaaagugaacgcuaucgaaagagagaaggccgaaaaauucaggaagcuacaagacgcaucacgcagcgcccaggcucugguggagcagaugguaaaugaaggagucaacgccgauucuauuaaacaggcauccgagcaacucaauagucgguggauagaguuuugucagcugcuuagcgaaagauugaacuggcuggaguaucagaauaacaucauugcguucuacaaucaauuacagcagcucgaacagaugacuaccacggcugagaacuggcugaagauccaaccaaccacaccuucugaacccacugccaucaagucccagcuuaaaauuugcaaggacgaggugaauaggcugucaggucuacagccacagauagagcgccucaaaauccaaaguauugcacugaaggaaaaaggccaggggcccauguuuuuggaugccgacuucguugcuuuuaccaaccauuucaagcagguguuuagcgauguccaggcccgagagaaggaacugcaaacaaucuucgacacuuuaccuccaaugcgguaucaggagaccaugucggcaauucguacgugggugcagcaauccgaaacaaaacucucuaucccgcagcugagcguuaccgauuacgagauaauggagcagagacuuggagaacugcaggcuuugcaaucaagucuccaggagcagcaguccggccuguauuaccuaucuacuacagugaaggaaaugagcaaaaaggcccccuccgagaucucaaggaaauaccaaagcgaguuugaagagauugaaggucgcuggaagaagcugaguucucagcuuguagagcacugucagaaacucgaagagcagaugaauaagcugcggaaaauccaaaaccacauucagaccuugaagaaauggauggcggaggucgacguguuccugaaggaagaguggccugccuuaggggauuccgaaauccucaaaaagcagcugaagcagugcagacuucuggugagcgacauacaaacuauucagccaucguugaauucagucaacgagggcggacagaaaaucaagaacgaagcugagcccgaguucgcaucuaggcucgaaaccgagcugaaagaacuaaauacacaaugggaucauaugugucagcagguuuaugcccgaaaggaggcucugaaaggcgggcuugaaaagacggugagucuccagaaggaccuguccgagaugcacgaguggaugacccaagccgaagaggaauacuuggagcgcgauuuugaguauaaaacuccugacgaauuacagaaggcaguagaggaaaugaaacgggcgaaggaggaagcccagcagaaagaggcuaaggugaagcugcucacagagagcgucaacucugugauugcccaagcaccacccguugcucaggaagcccugaaaaaggagcuugaaacccugacaacuaauuaccagugguugugcaccagacuaaacggaaaauguaagacgcuggaggaagugugggcaugcuggcaugagcuccugagcuaucuugagaaagccaauaagugguuaaacgaagucgaguucaagcugaaaacaaccgaaaauaucccggguggcgcugaggaaauauccgaggugcucgacucauuggagaaccugaugaggcacagugaagauaauccuaaccagauccguauucucgcgcaaacucugaccgacgggggaguuauggaugagcuuaucaaugaagagcuggagacauuuaacagccgcuggcgggaauugcaugaggaagccgugagaaggcagaagcuacuggagcagucuauucaauccgcacaggaaacugagaaaucacuccacuuaauccaggagagucugaccuucauagacaagcagcuugcugccuacauugccgauaaagucgacgcugcacaaaugccacaggaagcccagaagauccagagcgaucugacaucccacgagaucucucucgaagagaugaagaaacauaaucaaggcaaggaagcggcucagcgaguauugucgcagauugacguggcccagaaaaagcugcaagauguuagcaugaaauuucggcucuuccagaagcccgcaaacuuugagcagcgccugcaagagucaaaaaugauccuugacgaagugaagaugcaccuaccugcccuggagacgaaguccgucgaacaggaggugguacagagucaguugaaucauugcgugaacuuauauaaaucucugagcgaagucaaguccgagguugagauggugauuaaaaccgguagacaaauagugcagaagaaacagacugaaaaccccaaggagcucgaugaaagggucacagcucugaagcuucacuacaaugagcugggggcaaaagugaccgagcggaagcagcaacucgaaaaauguuugaagcugucacgaaaaaugagaaaggagaugaacguucuaacugaauggcuggccgcgacagacauggagcucaccaagcgcucugcuguagaaggcaugccaagcaaucuugacagugagguggccuggggaaaagcaacgcagaaggagaucgaaaaacagaagguccaucugaaauccauuacugaggugggcgaagccuuaaagaccguuuuggggaagaaagagacacugguggaagauaagcucagccugcuuaacucuaauuggaucgcugucaccucaagggccgaggaguggcugaaccucuugcuggaauaccagaaacacauggagacuuucgaccaaaauguggaucacauuacaaaguggaucauacaggcagacaccuuacuagaugaauccgagaaaaagaaaccucagcagaaggaagacguacugaagcgucucaaagcugagcuuaacgauauccggcccaaggucgacaguacaagagaucaagccgcgaaucugauggccaacaggggagaccauugccgcaaauugguggagccacagauuagcgaacugaaucaccgauuugcagcuaucucgcauagaauuaagacugguaaagccucuaucccgcucaaggagcuggaacaguucaacuccgauauacaaaagcuucucgagccucuggaggcugaaauucagcagggcguuaauuugaaagaggaagacuuuaacaaggauaugaaugaggacaacgaagggaccgugaaagagcuguuacagcggggagacaaucuacaacagaggaucacggaugagcgcaagcgugaagagaucaaaauuaagcagcagcugcuccaaacaaagcacaacgcacuuaaagaccugagaagccagcggaggaagaaagccuuggaaauaucacaccagugguaucaguacaagcgccaagccgaugaccugcucaaaugucuggaugacaucgagaagaagcuugcuaguuuacccgaaccacgagaugagagaaaaauuaaggagaucgaccgggaacugcagaaaaagaaagaggaacucaacgcggucaggcgccaggcagagggcuugucugaagauggugccgcuauggccguggagcccacccaaauucagcuguccaagagauggagggagaucgaaagcaaauucgcacaguuucggcgucuaaauuucgcccagauacauacuguucgcgaggaaaccaugauggugaugacagaggacaugccucuggagaucucauaugucccaaguacuuaccucaccgaaauuacgcacgugagccaagcucuucuggagguagaacaguugcugaacgcgcccgaucucugcgccaaggacuucgaggaucuguuuaagcaggaagaguccuuaaaaaauaucaaggacucucuucagcaaagcuccgggcgaauugacaucauacauucaaaaaagacagcagcucugcagucugccaccccuguggagagaguuaaacuccaggaagcacuaagucagcuggauuuccaaugggagaaggucaacaagauguauaaagacaggcagggccgguuugaucgcucgguggaaaaguggagaagguuccacuacgacauuaaaaucuuuaaucagugguugacugaggccgaacaguuccugcggaagacacaaaucccggagaacugggagcaugcuaaauauaagugguaccucaaggaacuucaggauggaauuggccagcgacaaaccguggucagaacucugaaugccacaggggaggaaaucauacagcagagcuccaaaaccgacgcgucuauuuugcaggagaagcugggaucacucaacuuacgcuggcaagaaguauguaaacagcugagcgauaggaagaaacggcuugaggagcagaagaauauccuguccgaauuucagcgugaccuaaacgaguucgugcucuggcuggaagaggcagauaauauugccaguaucccauuggagcccggcaaggaacaacagcugaaagagaagcucgaacagguuaaacuucugguggaggaauuaccucugagacaggguauauugaagcaacucaacgagacggggggaccaguccuggugucugcucccauuagcccugaggaacaggacaaacuagagaauaagcuuaagcagacuaaccugcaauggaucaaaguuucaagggcccucccggaaaagcagggcgagaucgaagcucagauuaaagaucugggucaguuggagaagaaacuggaggaccucgaagagcaacuuaaucaccuguuacugugguugucccccauccgcaaccagcucgaaauuuacaaccagccaaaucaggagggcccuuuugacgugcaagaaaccgagauagcaguccaggccaagcagcccgauguggaggaaauccugaguaaagggcagcaccuauauaaggagaagccagcuacacaaccuguaaaacggaagcuugaagaccugagcucugaguggaaagccgugaaccgacuccugcaggaguugagagcaaagcagcccgauuuagcgccaggacugaccacaauuggcgccuccccgacucaaaccguuacgcucgucacacagccuguggugacuaaagaaaccgcuaucucaaagcuugagaugcccagcucgcugaugcuagaagucccagcccuggcagacuucaauagggcuuggacagagcucaccgauugguugucucugcuugaccagguuaucaagagucagcgcgugaugguaggggaucuggaagacauuaacgagaugauaaucaaacaaaaggccacuaugcaggaucucgagcagcggagaccccaguuagaagagcugauuaccgcagcccaaaauuugaaaaacaagacauccaaucaggaagcucguacgaucauuacugacaggaucgagcggauacagaaccagugggaugaagugcaagagcaucugcagaaucgccgacagcagcucaacgagaugcuuaaagacagcacccaauggcuggaagcgaaggaggaagccgagcagguccuaggacaggcaagagcuaagcuggaaucauggaaagagggcccuuacacaguggaugccauccaaaagaaaauuaccgagacuaagcagcucgccaaagacuugaggcaguggcagacaaauguugacguggcaaacgaucuggcucuuaagcuguuacgggacuauuccgccgaugacacccgcaagguccacaugaucacggaaaauauuaacgcgucuuggagaagcauccauaaaaggguaagugagcgagaagcugcccucgaggagacucaccggcuguugcaacaguuuccacuggaucucgaaaaguuccuugcauggcugacagaggccgaaaccaccgcuaaugugcuacaggacgcaacucguaaagagagacugcucgaagauuccaaggguguuaaagaguugaugaagcaguggcaagaccugcagggggagauagaagcccacacagauguguaccauaacuuagacgagaacagccagaaaauucuucgcucucuggaaggaucagaugacgcgguccuccugcagaggcgguuggacaauaugaacuucaaguggagugagcugagaaagaaaucccucaauauccgcagccaccuugaagcuucuucggaucaauggaagaggcugcaucuaucacugcaggaguuacucguguggcugcaguugaaagacgaugagcuuagccgacaagcccccauuggcggugacuuuccugcaguccagaagcagaacgaugugcaccgggccuucaaaagagaacugaagaccaaggagccgguuaucauguccacacucgaaacugugaggauauuucugacggagcagccauuggaaggccuggagaaacuauaucaagagccccgcgaacucccucccgaggaacgugcucagaauguaacccggcuucugagaaagcaggccgaggaggugaacacagaaugggagaaauuaaaucugcauagugcagacuggcagaggaagaucgaugaaacucucgagcgccugcaagaauugcaggaggcuaccgacgagcuugaucugaaacuccgacaggccgaagucauuaaggggucuuggcagccaguuggagaccugcuaaucgauagcuugcaagaccaccuggagaaggugaaagcgcuccggggcgaaauugccccucuuaaggagaacgucucccacgugaaugaucuggcaagacaguuaacaacccuggggauccagcucucacccuacaaccugaguacuuuggaagaccuuaauacgagguggaaacugcuccagguagcuguggaggaccgcguuagacaacugcaugaggcccaccgggauuucggaccagcaucucagcauuuucuaagcaccuccgugcagggcccuugggaaagggcuauaucaccgaacaagguccccuauuacauuaaucacgagacacaaacuaccugcugggaccacccaaaaaugacagaauuauaccagagccuggccgauuugaacaaugugcguuucucugccuaucgaaccgcgaugaagcuccgcagacugcagaaggcucuuugucuggaccuccuguccuugagugcagccugcgaugcucuugaccagcauaaccugaaacaaaacgaucagccuauggacauccuacagaucauuaauugucucacuacaaucuacgaucggcuggagcaggaacacaacaauuuagucaacgugccccugugcguugacauguguuugaauuggcuccugaacguauaugauacggguaggaccgggcgcauaagagugcuuagcuuuaagacuggaauuaucucgcugugcaaagcccaucucgaggacaaguaccgguauuuguucaaacaagucgcauccucuacaggcuuuugcgaucagaggcgacugggucuucuguuacacgacucaauucagaucccacgucagcuaggcgagguggccagcuucgggggaaguaauauagaaccuuccguuagaucuuguuuucaauucgcuaacaauaagcccgagaucgaagcggcccucuuucuggacuggaugcgccuggagccgcagagcauggugugguugccaguccuccaucggguggcagcugccgagaccgcaaaacaccaggccaagugcaacauuuguaaggaaugcccuaucauuggcuucagguacagaucacugaaacacuucaauuaugauaucugucaauccugcuuuuucagugggcgcguagcuaagggacauaaaaugcacuaccccaugguggaguacuguaccccaacaacuagcggcgaagacguucgggauuuugccaagguccuuaaaaacaaguucaggacgaagcgauauuuugcgaaacaucccagaauggguuaccugccugugcagaccguguuagagggggacaauauggaaacaccggucacucucauuaacuucuggcccguugauucugcaccagccucauccccucagcugagccacgacgauacccauucucggaucgagcacuaugcuaguagguuggccgagauggaaaauucgaacggauccuaccuuaacgacagcauaucacccaaugagucuauugaugacgaacaccugcuaauccagcauuauugccaaagccucaaccaggauuccccucugagucagccacgcucacccgcacagauccugauuucuuuggagagcgaagagcguggcgagcucgaaagaauacuggcugaccuugaggaagagaaucgaaaccugcaagccgaauacgacagguuaaagcagcagcacgagcauaaaggccucuccccucugccaagucccccggagaugaugccuacaagcccacaguccccccgggaugcugaacuaaucgccgaggcaaaguugcugcgccaacacaaagggagacuugaagcgaggaugcagauucucgaggaccacaauaagcagcuggagucucagcugcaucgguugcgccaacuucucgaacagccucaggccgaggcuaaggugaacggaaccacuguaucaagcccaucgacgucccugcaaagaagugauucuagccagcccauguuacugcgaguggucgguucacagacauccgacucuaugggcgaagaggaucuacucaguccgccucaggacaccagcacugggcuggaagaggugauggagcaauugaauaacuccuuucccucaagcaggggacggaauaccccaggcaaaccuaugcgugaagauacaauguga

SEQ ID NO: 55348 - RNA, 2601 nt, Artificial Sequence
  derived and/or modified sequence opt3 from DMGDH__Homo_sapiens__NP_037523
augcugagacccggcgcccagcuccuuagggggcuguuguuacggagcugcccucugcaaggauccccaggucgcccgcgaucuguguguggccgugagggggaagagaagcccccucuaucagcugaaacccaguggaaagacagagcagagacagucaucauuggaggcgguugcguuggggugagucucgccuaccaccuggcgaaggcuggaaugaaagauguagugcuucuggaaaagagcgaguugacugccggcuccacguggcaugcagccggccucaccacauauuuccacccagggauaaaccugaaaaagauccauuacgacucuauuaagcuguaugagaaacucgaagaggaaacuggacaggucguggguuuucaccagcccggcucgaucagguuagcuaccacaccuguucggguggaugaguucaaguaccaaaugacccgcacuggguggcaugcaacagagcaguaucugauugaaccagagaaaauccaggaaauguuuccccuuuugaauaugaacaagguccuggccggacuauacaauccuggcgacggucacauagauccauauucacucaccauggcucuggccgcgggggcaagaaaauguggagcccuucugaaguacccggcucccgugacgagcuugaaggccaggagugacggcacuugggauguagagaccccucagggcuccaugcgggcaaaccgcaucguuaaugcugccggguucugggcgcgagaagugggaaaaaugauuggucucgagcacccacugauccccguccaacaucaguacguggugacaucuacuauuagcgaggucaaggccuuaaaaagagaacugccuguucucagggaccuugagggcuccuauuaccugcggcaggaacgugauggguugcuauuuggaccauaugagucacaggaaaagaugaaagugcaagacaguuggguaaccaacggcgugcccccggguuucgggaaggagcuguuugagagcgaucucgaccgcaucauggaacacauaaaagcagcuauggagauggucccugugcugaagaaggccgauauuaucaauguugugaacggccccauuacauacucuccagacauccuuccuauggucggaccccaucagggcgugagaaauuauuggguagcuaucggguucggauacgguauuauacacgccggcgggguuggaaaauaucuguccgacuggaucuugcacggcgaaccacccuuugaucucauugagcuggacccuaacagguacgguaaguggaccacgacucaguacacagaagcaaaagcccgggagucauauggguucaauaacaucgugggcuacccaaaggaggaacgauuugcuggacgcccgacccaaagagucagcggcuuauaucagaggcuggagaguaaaugcucuaugggguuccaugcgggaugggaacagccccacugguuuuacaagccuggucaggauacucaauaucggccauccuuccgcagaacaaauugguucgagcccgugggcagcgaguacaagcaggucaugcagaggguggcaguuaccgaccuaucgccuuuugggaaauucaacauaaagggacaggauucuauucgucuccuggaccaucuuuuugccaaugugaucccaaaaguaggcuucacgaacaucucccacauguugacccccaagggucgggucuaugcugaacugacagugucacaucaaaguccgggggaguuucuccugauuacuggcagcggauccgaacuucacgaucugcgauggaucgaggaagaggccguuaaaggcggguacgacguggagauuaagaacauaaccgaugaauugggaguccucggcguggcagguccucaggccagaaagguacugcagaaauuaacaucugaggaccugagcgaugacguguucaaguuucuacagacuaaaucacucaagguuaguaauaucccagucaccgcuauuaggaucuccuacacaggggaacugggaugggagcuuuaucaccgccgggaagacagcguggccuuguacgaugcaaucaugaacgcgggccaagaggaggguauugacaauuucggcaccuaugcuaugaacgcccugagacucgaaaaagcauuuagggccugggggcuggagaugaauugugauacuaaccccuuagaagcuggacuggaguacuucgugaaacuuaauaagccugccgacuuuauaggcaagcaggcauugaagcagaucaaagcuaaggggcucaaacgccgacuggucugccuaacgcuggccacagaugacguugaucccgaaggaaacgagucuauuugguauaauggcaaggugguggguaacaccacuucagggaguuacagcuauuccauccagaaaucucucgcguucgccuacguaccaguccaacugucggaggugggacagcagguugaaguggagcuuuugggcaagaauuacccugcugucauuauccaagaaccccugguguuaaccgagccaacacggaaccgucuccagaagaaagguggcaaggacaaaaccuga

SEQ ID NO: 55349 - RNA, 273 nt, Artificial Sequence
  derived and/or modified sequence opt3 from DMKN__Homo_sapiens__NP_001030593
augaacaugaagcccgccaccgcuagcgcacugcuccuucuguuguuaggccuggccuggacacaggggucccacggauggggugcggacgcuucuucacuacagaaaagagccggcagggcagaucaaaauuacaacuauaaucagcaugccuacccuacugcuuaugggggaaaguacagugugaaaacgccagcaaagggcggugucagcccguccucuucggccucacggguucagcccgggcuccugcaaugggugaaauucugguga

SEQ ID NO: 55350 - RNA, 1494 nt, Artificial Sequence
  derived and/or modified sequence opt3 from DMP1__Homo_sapiens__NP_001073380
augaagaucagcauucugcucauguuccuuuggggccuguccugcgccuugcccgugaccagauaccagaacaaugagucugaagacucagaggaauggaaagggcacuuagcucaagcaccuacaccaccgcuggccaacgaggaucccagugacagcacucaguccgaagagggacuagguucugaugaccaucaguauauauacaggcucgcgggcggguuuucgcggucaacgggaaagggcggugaugacaaagaugacgaugaggacgauagcggggacgauaccuucggagacgacgauaguggcccuggcccaaaggaccgccaggaagggggaaauucccgacuggguucugaugaggacagcgaugacacaauccaagccuccgaagagucagcuccccagggccaggauagugcacaggacacuaccagcgagucucgugaacuugauaacgaggacagagucgauuccaaaccugaagggggagacucaacacaagagagcgaaagugaggagcacuggguuggcggugggucugacggagaauccagccauggcgauggcucggagcuggacgaugaagggaugcagucugacgauccagaguccauuaggucagaacggggaaauagucgcaugaacagcgccgguaugaaguccaaggagucuggcgagaauagcgaacaggcuaacacccaggacucagggggaagucaauugcucgagcaccccuccagaaaaaucuuuaggaagagucggauuucugaagaggaugaccgcucagaacuggaugacaauaacacuauggaggaggugaaaagugauagcacagaaaauuccaacucucgagacaccggccugucgcagccuagaagggauagcaagggugacucccaggaggacucaaaagaaaaucucagucaagaggagucucagaacguagaugggccaagcuccgaaucaagccaggaggcaaauuuaucuucccaggaaaacaguagcgagucucaagaagagguggucuccgagucacggggcgacaacccggaucccacgacuagcuauguggaagaccaggaggauagcgacucguccgaagaggauucuagccauacccugucacacaguaaguccgaaucucgugaggagcaggccgacagcgaauccucagagagccuuaauuucagugaagagucuccugaauccccagaggaugagaacagcucgucacaggaaggauugcaaucucacaguuccagcgcugagucucagagcgaagagucccauucagaggaagacgauagugacagccaggauucuucccgcucaaaggaggacaguaauagcacagaauccaaaucuucgagcgaggaagacggccagcugaagaacaucgagauagagucaagaaaacuaacuguugaugccuaccacaauaagcccaucggggaccaagaugacaacgauugucaggacggauauuga

SEQ ID NO: 55351 - RNA, 1875 nt, Artificial Sequence
  derived and/or modified sequence opt3 from DMPK__Homo_sapiens__NP_001075029
augagcgccgaggugagacugaggcggcuccagcaacuuguccuggaccccggcuucuugggguuagaaccucugcuagaucuccugcuuggaguucaccaggagcugggugcuuccgaauuggcacaggacaaguacguggccgauuuucuccagugggcggagccaaucguagugcgccugaaagaaguccgacugcaacgugacgauuucgagauucucaaggugauaggcagaggggcuuuuucugagguugccguggucaaaaugaagcagaccggacagguguaugcaaugaaaaucaugaacaagugggacauguuaaagaggggcgaaguaucaugcuuccgggaggaacgcgauguucuggugaauggugacagaagguggauuacacagcuucauuuugccuuccaagaugagaacuacuuguaucuggucauggaguacuaugucgggggagaccuacucacucugcuuaguaaauuuggcgaacggaucccggcugagauggcacgcuucuaccuggccgaaauugugauggcuaucgauagcgugcaccgauugggcuauguucauagagacauaaagcccgauaauauccuccuggacaggugugggcacauucgguuagccgacuuuggauccugccugaaacuccgugcggaugguacggugcgcucucuuguagcagugggcaccccugacuaccugucgccagagaucuugcaggccgucgggggaggccccgguacagggucauacggaccugaaugugauuggugggcucuaggcguguucgccuaugagauguuuuacggccagacuccauucuaugcagacagcaccgcugagacauacgggaagauuguucauuauaaagaacaccugagucucccccugguggaugagggagucccugaagaggccagagacuuuauccagaggcuucugugcccaccggaaacccgguugggucgaggcggggcgggagauuuccgcacucaccccuucuuuuucggccucgacugggauggucugagagacuccgugccuccauuuacacccgauuucgagggggccaccgacacguguaacuuugacuuaguagaggauggccugacugcaauggaaacccuaucugacauaagggagggagcuccucucggcguucaucugccauucgugggguacagcuauuccugcauggcccuucgggauucagaaguccccggaccgacaccuauggaguuggaagcugagcaacugcucgagccccacgugcaggccccaagucuggaaccuagcgucucuccccaggacgagacugcagaaguggccguuccagcugcggugcccgcagccgaggcugaggccgaaguaacccuucgcgagcugcaagaagcauuggaggaagagguccucacaagacagucccugucaagggagauggaagccauucguaccgauaaucagaacuuugcuagccaguuacgggaggccgaagcacgaaauagagaccuggaggcgcaugugaggcaacuacaggaacgcauggagcuccugcaggcugagggugccacggcaguuacuggcgugccuaguccacgggccacagauccgcccucucaccuugacgggccuccagcugucgccgugggacagugucccuugguaggcccugguccaaugcacagaaggcaucugcuccugcccgcacgcgugccgcgaccuggguuauccgaagcucugagccuucucuuguucgccguuguccugucgcgggcggccgcucuaggcugcaucggacugguggcacacgccggccaacucaccgcuguguggcguagaccaggggccgcaagggcgcccuga

SEQ ID NO: 55352 - RNA, 1122 nt, Artificial Sequence
  derived and/or modified sequence opt3 from DMRT1__Homo_sapiens__NP_068770
augcccaacgacgaggccuucagcaagccuuccaccccaucugaagcuccgcacgcacccggcgugccuccacaggggagagccggagguuuuggcaaagcgucaggggcucuggucggagccgcaaguggcagcuccgccggugggucuucgaggggaggcggcucagggagcggagcuagugaucucggugcaggcuccaagaaaucuccccggcuuccuaagugcgcccgcugucgaaaucauggguacgcuagcccacugaaaggacacaagcguuucugcauguggagagacugucaaugcaagaaauguaacuugaucgccgagaggcagcggguuauggcggcacagguggccuuacgcagacagcaagcucaggaagaggaacugggcauuucccaucccauaccucuaccaucagccgcagagcuccugguaaagagggagaauaacgguaguaauccgugccuuaugacagaauguagcgggacuucucagcccccuccagcuuccgugcccacgaccgccgcgucagagggacggauggucauccaggauauuccugccgugacaagccgcggccacguugaaaacacuccagaccuggugagugauucuaccuauuacuccagcuuuuaucaacccucguuguucccguacuauaauaaccucuacaauugcccucaguauucuauggcacuggcugccgacuccgcuucaggcgaggucgggaacccccugggagguaguccagugaaaaauagccuccgaggcuuaccugggcccuacguaccaggacagacaggcaaccaguggcaaaugaagaauauggagaacagacaugccauguccucucaguacaggaugcacagcuauuaucccccuccaucauaccugggucagaguguuccgcaauuuuucaccuuugaagaugcacccuccuacccugaggcccgggcuagcguguucucuccacccucaagucaggacagcgggcuugucuccuugucuucgagcuccccuaucucaaauaaaaguacuaaggcggugcuggaaugugagccagcaucugaacccagcuccuuuacagugaccccggucauugaggaggaugaauga

SEQ ID NO: 55353 - RNA, 1164 nt, Artificial Sequence
  derived and/or modified sequence opt3 from DMRT2__Homo_sapiens__XP_006716781
auggacaagaaaggccugagcgggaagcagaacaauuucgagagaaaagccguguaccaaaggcagguccgggcucccucccuccuugcaaagucuauccuggaaggauaucgcccuauuccagccgagaccuacguugguggcacauuuccguugcccccuccagugucagaucgaaugcguaaaagaagggcguucgcugacaaggaauuagagaacauaaugcuggaacgggaguauaaggagcgcgaaaugcuagagacuucccaggccgcagcccucuuucugcccaauagaaugguaccugggccagauuacaacagcuauaaauccgcuuacucucccucgccuguggaaccaccgucaaaggacuucugcaauuuucuucccacgugucuggauuugaccaugcaguauagcggaaguggcaacauggagcucaucuccucuaaugucagcguggcaacaacuuacaggcaauacccucuguccucacgguuccugguuuggccaaaaugcggucccauuagugacacccucuuauaucagcagugucugcuuaacgccacaaccagcgugcaggcuuugaagccuggggccucuugggaucugaaaggagcgcgcguccaagacggccuauccgcagagcaggauaugaugccaucaaagcucgaaggcagccuggugcuuccccacacuccggagauccagacaacccgaagugaccugcaggggcaucaagccguaccugaaagaucugcuuuuagucccccaaggcggaauuucagcccuauuguugauacggacucguuggccgcacagggacacgugcucacuaagaucucuaaagagaacacccgucauccccugccauuacgccacaaucccuuucauucccuguuccagcaaacacucacugauaagucagguccugaacuuaaaaccccauuugucaaggaggcuuucgaggaaacaccgaaaaagcacagagagugccuggugaaagacaaccagaaguacaccuuuacgauagacaggugugccaaggauuuguucguggcgaaacaggucggcacuaagcuaaguguuaaugaaccccugagcuucuccguggagucuauccucaaacggccuagcucagccauuacacgaguaagucaguga

SEQ ID NO: 55354 - RNA, 1419 nt, Artificial Sequence
  derived and/or modified sequence opt3 from DMRT3__Homo_sapiens__NP_067063
augaacggcuacgggagccccuaucuguacaugggagguccugugucccagccaccgagagcuccccuccaaaggaccccuaagugcgcccggugucgcaaucacggcguccuuucuuggcugaaagggcauaagcgauauugccguuucaaagacuguacaugcgagaaguguaucuugauuauagaaagacagaggguuauggcagcccagguggcguuacggcgccagcaagcuaacgagucacuggaaagucuaaucccagauagccucagagcccugcccggaccuccacccccuggcgacgcaguagccgcuccacagccgcccccugcaucccagccaucucagccccaaccuccaaggcccgccgcugagcuugccgcggcagccgcucugcgguggacugccgaaccgcagccuggugcauugcaggcucagcucgccaaacccgaucugacggaggagcgccugggggacggaaagucggcggauaauaccgaaguguuuucagacaaggauacagaccaacgaagcaguccagaugucgccaaauccaagggcugcuucacuccugagucucccgaaauugugagcguugaggagggcggguacgcagugcagaaaaacggagguaauccagaauccagacccgacucaccuaagugucacgcugagcagaaccaucucuuaaucgaaggcccaagugggaccgucagccugccguuuucucuuaaagccaauaggcccccuuuggaggugcugaagaagauuuucccaaaccaaaaacccacaguacuagaacucauccugaagggaugcggcggugaucuuguuuccgcuguggagguccuguugucaagccggaguucugugaccggggccgagcguacuuccgcagaaccugagagccucgcccugccaucgaauggacacauauuugaacauacauuaucuuccuaucccaucucaaguagcaaaugguccgugggcucugcuuuccgcgucccggacacccugagauuuagcgcggauucaaguaacguugugccuuccccacucgcaggcccccuucagccucccuucccacagccucccagguacccacugauguugcggaauacgcuagcccgaagccagucuucaccguuucugccuaacgacguaacucucuggaauaccaugacacugcaacagcaguaucagcuucgcagucaauacgugagccccuucccauccaacucuacuucggucuuuagaagcucccccgugcugccugcuagggccaccgaggacccacggauuucaauccccgaugacggguguccuuucguuaguaagcagucuauuuacacagaagaugacuaugaugagcgcagcgacuccucagauagcagaaccuugaauacgucuuccuga

SEQ ID NO: 55355 - RNA, 1515 nt, Artificial Sequence
  derived and/or modified sequence opt3 from DMRTA1__Homo_sapiens__NP_071443
auggagagaagccagugcggcuccagggaccgcggggugucuggacggccccaccuggccccuggucucgucguugcugcaccaccgcccccuucaccagcccuucccgugccuaguggcaugcaaguaccacccgcguuccugcgaccuccauccuuguuuuuacgugcugccgcagccgcugcagccgcugccgcggcaaccuccgggucuggaggcuguccgcccgccccuggucuggaaucgggggugggagcugucggcugcggcuacccaagaacacccaagugugccaggugccggaaccauggggugguuucagcacuaaaaggacacaagcgcuucuguagauggagggauugcgcuugugccaaaugcacucucaucgcggagcggcagcgcgugauggccgcacaggucgcucugcgaagacagcaagcccaggaagagagcgaagcuaggggucuucagcggcuguuguguaguggccucuccuggccuccagggggacgugccucuggcggugggggacgcgcagagaauccccagagcacgggcggcccggccgcuggggcggcacugggacugggugcccucagacaagcuagcggcucagccaccccugcauuugagguguuccagcaggacuaucccgaagagaagcaggaacaaaaagagaguaagugcgagagcugucagaacgggcaggaagaguuaaucucuaagucccaucaacuguaccuuggaucaagcaguaggucuaauggcguaauagguaaacaguccaucgggagcucgauuucugaauauuccaacaagccagauucaaucuugaguccucaccccggcgagcagagcggaggcgaagaguccccacggucucugagcucaagugaccuagaguccgggaaugaaagcgaguggguuaaagaucucacagccacuaaggcuucucugcccaccgugucaagucgaccucgcgacccacuugauauucugacaaaaaucuuuccgaacuacagaaggagccgguuggaaggaauacuccgcuucugcaagggugacgucgugcaggccaucgagcaagugcugaauggcaaggaacauaaacccgauaacagaaauuuagcaaacuccgaggagcuggaaaauaccgcguuucagagggcuucuucguucagccucgccgggauuggauuuggcacucuugguaacaaguccgcauucucaccucugcagacaaccagugccucuuaugggggcgacagcuccuuguacggagucaauccacguguuggcaucucaccccuacggcuggcuuauagcucugccgggcgaggacucuccgguuuuaugaguccuuaccugacgccaggccuugugcccacucugccguucagaccugcauuggauuacgcuuuuagcgggaugauuagggacucuuccuaucucucaaguaaagauagcauuaccugcggacgccuguacuuccggccaaaccaggacaaucccuga

SEQ ID NO: 55356 - RNA, 2019 nt, Artificial Sequence
  derived and/or modified sequence opt3 from DMTF1__Homo_sapiens__NP_001135798
augaccgccacaacugagguggcugacgaugaagucacggagggcaccguuacacagauccaaauucugcagaacgaacagcucgacgagauaagcccccuugggaaugaagagguguccgcaguaucucaggccugguucacuaccaaggaggauaaagacucacugacaaacaagggacacaaauggaagcaagguauguggaguaaagaagagaucgauauuuugaugaauaacaucgaaagauacuuaaaggcgaggggcauuaaggacgcuaccgagaucauauuugagaugagcaaagaugaacggaaggacuucuaucgcacuaucgccugggggcugaaucgaccucuauuugcaguguaccguagaguccucaggauguaugaugaccggaaccaugugggaaaauacacaccagaggaaauugagaagcugaaagaacuucgcaucaagcacggcaaugauugggccaccauuggugcugcacuggggagauccgccucuucgguuaaggacaggugccgguugaugaaagauacguguaacacuggaaaguggaccgaggaggaagagaaacgccucgcugaagugguccaugagcugacaucaacugaaccgggcgacaucgugacccagggcguaagcugggccgcgguugcagagcgaguggggacaagaagugagaagcagugcagguccaaauggcugaauuaucucaacuggaagcagucuggagguaccgaauggacgaaagaggacgaaauaaauuuaauucugcggaucgccgagcuugaugucgcugacgaaaacgauauuaauugggacuugcuggccgagggcuggagcuccgugcguucaccccaauggcuacgcaguaagugguggacuaucaagagacagaucgcaaaccacaaagaugugagcuucccuguccucauuaaggggcugaaacagcuucaugagaaucagaagaacaacccaacacuguuggaaaauaaaucuggauccggcguucccaacucaaauaccaacagcagugugcaacacguacagauaaggguggcucggcucgaggacaauacugccaucucuuccagcccuauggcggcccugcagauuccaguccaaaucacacacgugucgucugcagauucccccgcuaccguugacucagaaacgauaaccuuaaacagugguacacugcagacuuuugagauucucccuagcuuccaucuucagccaaccgggacaccgggaacuuaccuguugcagaccuccucuagccaaggccuaccccugacacucaccgccucaccuacugugacgcugacagcugccgcaccagccagucccgagcagaucaucguccacgcucuuuccccugaacaucuguugaauaccagcgauaacgugacuguacagugucacaccccacgaguuauuauccagacaguggcgaccgaggacauuacuucuucaauaagucaagcagaacucacagucgauagcgacauccaguccucugacuuucccgagccgccugaugcccuggaagcugacacguuccccgaugagauucaccauccaaagaugaccguggagccuucguuuaaugacgcccacgucagcaaguucuccgaucagaacucaacugaauuaaugaauagugugaugguucgcacagaggaagagaucucugacaccgaucugaaacaggaagagagccccuccgaccuagcaucagccuaugugacagagggccucgaaagcccaacuaucgaggaacaaguagaucagaccauugacgaugagacgauacugaucguccccucuccucauggguuuauucaggcuuccgacgugaucgauaccgaaaguguucuuccauugacaacucugaccgacccgauucuccagcaccaucaagaggagagcaacaucauaggaucuucccuggguucacccgugagugaagacagcaaggaugucgaggaccuugugaauugccacuga

SEQ ID NO: 55357 - RNA, 1077 nt, Artificial Sequence
  derived and/or modified sequence opt3 from DMTN__Homo_sapiens__NP_001107611
auggagagacugcagaaggccaaaauggacaaccaagugcucggcuacaaggaucuugcugcaauccccaaagacaaggccauucuggauauagaaaggccugacuugaugaucuaugagccacacuucaccuacagcuuacuggaacaugucgagcuaccgcggucccgcgaacgaucucucucacccaaaaguacaagcccuccacccuccccugagguuugggcggauucucguucgccagggauuaucucacaggcuagcgcccccagaacuacgggaaccccuaggacaagucugccacacuuucaucacccggagacuucccggcccgacucuaauauuuauaagaagccuccaaucuacaaacagcgcgaaagcguggguggcucaccccagaccaagcaucuuauagaggaucugaucauugaauccaguaaauucccugcagcccaaccacccgacccgaaccagccugcuaagaucgagacagauuauuggcccugcccaccuagcuuggcaguaguggagaccgaauggagaaaaaggaaggccucucggcgcggggcugaggaagaggaagaggaggaagacgaugacuccggagaggaaaugaaggcccuccgagagagacagagggaagaacugucaaaagucacuagcaaucugggcaagaugauucucaaagaggaaauggagaagaguuuacccauccggcguaaaacacgcucucugccagauagaacccccuuucacacgucccuucaccaggguacuagcaagucgucuuccuugccugcguacgggaggaccacacugucacggcuacaaaguacugaguucagcccauccggaucugagaccggcagcccgggccuccagauauaucccuacgaaaugcuggugguuacaaacaaagggcgaaccaaacuuccuccaggaguggaccgcaugagacuggagaggcauuugucagcagaggacuuuagucgggucuucgccaugucccccgaagaguuugguaagcucgcucuguggaagcgcaaugaauuaaagaaaaaggccagccuguucuga

SEQ ID NO: 55358 - RNA, 2025 nt, Artificial Sequence
  derived and/or modified sequence opt3 from DMWD__Homo_sapiens__NP_004934
auggccgcuggcggggcagagggagguagcggccccggggccgcgaugggagacugcgcugaaaucaagucccaguucagaaccagggagggcuuuuacaaacugcucccuggugauggggccgcacggcgcucuggaccagccucagcucaaacaccggugcccccucagccaccccagccuccacccggcccugcaagugccagcggcccaggggcugccggaccggcguccucucccccuccagcaggucccggcccugggccagcccuucccgcuguccgacugucguugguucguuuaggagaaccggacucagccggcgcuggugagccucccgcaacuccagccgggcugggaagcggcggcgauagaguguguuucaaccuagggagggaacucuauuuuuacccuggaugcugucggcgcgguagucagagauccauugaccugaauaagcccauagauaaaaggaucuauaagggcacgcaaccaaccugccacgacuucaaccaguuuacagcggccacugagaccauuucucuucugguaggguucagcgcaggacaggugcaguacuuggaucucaucaaaaaggacacauccaagcuguuuaaugaggaacggcugauugauaaaaccaaggucacuuaucucaaaugguuacccgagucagaaagucuguuccuugcuagccaugccucuggccacuuguaccuguauaacgugucccauccuugugcuucagccccaccgcaauacagccuacucaagcagggugagggguuuaguguuuacgcagccaaaucuaaggcuccccgcaauccucuggcgaagugggcagugggcgagggaccacuuaacgaguucgccuuuucccccgacggccgacaccuggcuugcgucagccaggauggguguuugagaguguuccauuuugacucgaugcuccugaggggauuaaugaaaucuuauuucgguggccugcucugcguauguugguccccugaugggcgguacguugugacaggaggcgaagacgaccuugucaccguguggucauucacggaaggucguguggucgcccgcgggcacggccacaagaguuggguuaaugcaguggccuuugauccauauacuaccagagcugaggaagccgcaacagcggcuggagccgacggcgagaggagcggggaggaagaggaagaggaacccgaggcagccggaacugguuccgcuggcggggccccgcugucuccuuugccaaaagcaggaagcaucaccuaccgguucggcucagcuggucaggauacacaauuuugccuaugggaccugaccgaggauguacucuauccccauccuccccuggcccgaacgcgcacucuuccagggacaccuggcaccacucccccagcggccaguuccagcagaggaggcgaaccggggccuggaccccugccaaggucuuugucacggaguaacagccucccccacccugcuggcggugggaaggcaggaggcccagguguggccgcugagcccggcacaccuuucuccauagggcgcuuugccacccugacguuacaggaaagaagggaccguggagcagagaaagaacauaagcgguaccacucucugggcaauaucucgcgagggggaagcggcgguuccgggucaggaggcgagaaaccgagugguccaguccccagaucuaggcuagauccugcgaaggugcucggcaccgcccuguguccacgcauucacgagguuccccuuuuggaaccucuggugugcaagaaaaucgcucaggagcggcucacaguccugcuuuuccuggaagacugcauuaucacugccugucaagagggguugauaugcaccugggcaagaccgggaaaggcuuuuacagaugaggaaacugaggcccagaccggcgaagggagcuggcccagguccccaucaaaaagcgugguagagggaauuucuucccagccuggcaacagucccagcgguacaguuguguga

SEQ ID NO: 55359 - RNA, 9147 nt, Artificial Sequence
  derived and/or modified sequence opt3 from DMXL1__Homo_sapiens__NP_001277250
augaaccugcaccaggugcucaccggcgccgucaaucccggggaccauugcuucagcguuggauccaucggugaucaaagauuuacagcuuacgcaucuggcugugacauugugauacuugggucagauuucgagaggcugcagaucauuccuggagccaagcacggcaacauccagguagguugcguggacuguaguaugcagcaagggaaaauugcggcuagcuauggaaaugucaucuccauauuugaaccagugaacuugccgaagcagaaaaagaauuuagagcuguacucucaguggcagaaaucgggccaauucuuucuagaaucaaucgcccauaacauuacuugggaucccacgggcagccggcuccugaccgggaguuccuaucuucagcuguggucuaauacaaacuuggagaagccuacugaagacgagaaucucaacaagaccgaucugaauuucggagacuggaaaugcaucuggcacuguaagacagcaagccagguucaucugaugaaauuuuccccagauggugaguucuuugccaccgcuggcaaggacgauugccucuuaaaagugugguacaacgucgaaaauuggcgcacugcagugacaucacccgacgggaguagcgagaagcagucucaaggagaaauugauuucuccuuuguauaucuggcccacccucgagcuguuaacggcuucucauggcguaagaccagcaaauacaugccaagagccaguguguguaauguccuuuugacgugcuguaaggacaacgugugcaggcuguggguggagacuuuucuacccaacgacugucuccuguaugguggggauugcucucacuggaccgaguccaucaaucuuacaaacaauuucaaacggaacgcgagcucgaaggaacgcguccagaaugcacuggagguuaacuugagacauuucaggcggggacgccgaagaucucucgcccugguggcucacacuggcuacuuaccucaucagcaagacccacaccacguacauaggaauaccccgcugcacgccaacgcacucugccauuuucacauagcugccuccauuaaucccgcgacagauaucccucuucugccaucaauuaccaguuugagccuaaacgaaaaugaggaaaaaacgggccccuucgugguccauuggcugaacaauaaggagcuccacuuuacucuguccauggagguguuccuucagcagcugcggaaaucuuuugaacagccuagcucagaggccaguguugaagacuccaaccaagcagaugugaagagcgacgaggaaacagaugacggggucgaugacuugaagaucaauccagagaaaaaggagcucggaugugauaaaauggugcccaacucuucauucaccagucugagcuccgcugccaucgaccaccagauugaaguauuacugucugaguggucgaagaacgcugacaugcuauuuagcauacauccgauggaugguucccuccugguuuggcacguggacuggcuugaugaauaccagccuggcauguuccgucagguccaagugucauuugucagucgcauccccguggccuucccaacuggggacgcaaauucuuugugcaaaagcauuaugauguaugccuguacaaagaacguugaucuggcuauccagcagggaaagcagaaaccuuccggccucaccagaucaacgagcaugcugauaucuuccggucauaauaagaguagcaacucucuuaaacuguccauuuuuacccccaaugugaugaugaucucaaagcacgcggacgggaguuugaaccaauggcucguaagcuucgcagaggaaucggccuuuuccacaguccugucuaucagccacaaaucaagguacugcggccaucgguuccacuuaaaugaucuggcuugucauagugugcuaccacuccugcuuacuaccucccaccauaacgccuugcgaacacccgacguugauaauccugagcagccauucgacgcacugaacauugaggaaugcucucucacucagcagaauaagagcaccguggaugucgccuuucaagacccguccgcuguguauucagagcugaucuuauggcgcguagaucccgugggaccucugagcuucaguggcgggguuucugaacuugccagaauuaacuccuugcacgucagcgcauuuucgaauguggcguggcucccaacacugauacccucauacugucuaggagcuuauugcaacucuccuagugccuguuucguggcauccgacggucaguaccugaggcucuaugaggccgucaucgacgcuaagaaacugcuuagcgaguugucuaauccagaaauuagcaaguacguuggcgagguguuuaacaucgugucccagcaaucaaccgcccggcccgggugcaucauugcacuggauccgauaacuaaauuacacggacgcaagacgcagcuccugcauguauucgaagaggacuuuauccuuaacaaucuggaaaaaaagaguuugggcaaggauagcauucucucuaacgcugguuccucaccuaauggguucagugagaaauuuuaccugaucgucauugaguguacacaggacaacagaagccuacugcacauguggaaucuccaucugaaguccaucccagugucucuugaugaaaaaguugacaccaaguugucggaggccguguggcagcccgaagagcacuauagcucauccccugaaaaaauacugagucccuucucucaaaaguaccaggcgugcagggccaacuuacagagcacuucccgucucacccuguuuucagagauggucuauucucaggagcuucaucugccagaaggcguggagaucauuagcaucaaaccuagugcuggacaccuauccagcucuucaauuuaccccgcaugcuccgccccauaucuccuggcuacaaguuguagcgaugaaaagguucgguucuggcgaugcagagugaccgacggcgagucggccacuucuaagaaugggaaaaucgauuuggcauacauaugggaagaguggccgcuguuaauugaggacggacuccaauccaacagcucaaucacaguaccugguaggcccgucgaagugaguugugcgcacacgaaucgccuggccguggcuuauaagcagccagccucuaacucccggagcucacaggauuuugucaugcauguuaguauuuucgagugcgaaagcaccggcggguccuguugggugcuugagcagacuauccaccuggacgaguugucuacaguacucgauagcggaauauccguggacucaaaucuggucgcauacaacaaacaagacauguaccuaucuaguaaggaaaauaucaccucgaacacaaaacaucuggugcaccuugauuggaugagcagagaggacggcucccacauucucacuguugguaucgggucuaagcuguucauguauggccccuuggcuggaaaggugcaggaucagaccggcaaagaaacgcuggccuuuccuuuaugggagucaaccaaggucgugccacucagcaaauucguucugcuuagguccguggaccuggucaguucuguagaugggagccccccuuuuccggugucauuguccuggguucgcgacggaauucucguggucggcauggauugcgaaaugcauguguacugucaauggcagccaaguagcaagcaggagcccguaaucacagacucuuauuccgguucaacuccuagcauaaccucgcugauuaaacagucuaauaguuccagcgggcuacacccacccaagaagacacugacucgaucaaugaccucccuugcacaaaaaaucugcggaaagaaaacggccuucgauccuucuguggacauggaggauagcggccucuuugaagcugcgcauguccugaguccgacauugccccaguaccacccauuacagcugcucgagcugauggaccuugguaagguucggcgugccaaagcaauccugucccauuuggugaaguguauugcuggcgaaguggucgcccuaaacgaggccgaaagcaaccacgagagaaggcugcgcucucucaccaucucagcuaguggguccacuacacgggacccucaggcauucaauaaggccgagaacaccgauuauacugaaauugacagcgugcccccacugccucuuuacgcguuacuggcugccgaugacgauucuugcuauucgucacucgagaaaagcuccaaugaaaguaccuugucuaagagcaaccaacuguccaaagagucauacgacgaacucuuucagacacagcugcuuaugacggauacccacaugcuggagacugacgaggaaaauacaaagcccagaguuauagauuugagucaguacucuccaaccuauuucggaccggagcaugcacaaguacuaagcggccaccugcuccauuccucauuaccugggcugagcaggauggaacagaugucucuuauggcccuggcugacacaaucgcaacuaccuccacggauauuggagagagucgagaccgcagccagggcggugagacacucgaugaauguggguugaaauuucugcucgccgugcggcugcacaccuuccuuacuaccucgcuacccgcguacagagcucagcuguugcaccaaggauuauccacaucucauuuugccugggcauuccacucagucgccgaggaagagcugcucaacaugcugccagcuaugcagaaggacgaccccacuuggagcgaacuuagggccaugggcguggguugguggguucguaauacccgcauccugcggaaaugcauugagaagguggcaaaggcugccuucuauagaaaaaacgauccucucgacgcggccaucuuuuacuuggcaaugaagaaaaaggcugucauauggggccuguauagggccgagaaaaauacacgaaugacgcaguucuuugggcauaacuucgaagaugagcgguggcgcaaggcugcacuaaagaaugccuuuagucugcucggaaaacaaagauucgaacacuccgccgcuuuuuuccuucuggcgggcugcuuaagggacgcaaucgagguguguuuggaaaagcugaacgauauucagcucgcccugguaaucgcucggcuuuacgagucugaguuugacaccagcgccgcauauaaaucaauucugcgaaagaaaguccucgggaucgauuccccagugagugaauugugcagccugaauauaaacaugcaucacgaccccuucuuaagaucuauggccuacuggauucuagaggauuacucaggagcucuggaaacucucaucaagcagccuauccgcgagaaugacgaucagguucuuuccgcgagcaacccgacaguguuuaauuucuauaacuaccugaggacccacccauugcugcuccgucggcauuuuggcucuagugacacuuucucgacacacaugucccugaccgguaagagcgggcuugccggaacgauuaaccucucagaaagaaggcuguucuuuacuaccgcaucugcucauuugaaagccggcugucccaugcuggcauuagagguccuaagcaagaugccuaaagugauaaagaaaacacgccccuucuaucgagccuccaguuuucuggauaccucaaaggacugcucuccaagcuccccucucaagcuugacgcuagagaggauaaaaguagcgccguugacuggucccaaucucugaucaaugguuucggcucaagcucggaaggguccagugagaagcagucuaacagcacuuugucauuugauuggucccagcccucuguggucuuccaggacgauagucuggaacucaaaugggacagcgauaaugacgaggagaacgaagaugugccaauuuccaugaaggagcugaaaccucuucaacggaagacagacaagaaauuagaugacaucucaagcaauuacaccgaaucuuuuaguacacuggacgagaacgaucucuugaauccguccgaagacauuaucgcgguacagcugaaguucagggcaugucuaaaaauacugacuguggagcuccgcacccuuagcacgggauaugagaucgauggcgggaagcugcguuaccaguuguaucacuggcuggaaaaagagguuauugcccuccagagaacaugcgacuuuuguucagaugcugaagagcugcaaucugccuucggacggaacgaagacgaguuuggcuuaaaugaggaugcugaagaccuuccccaccagaccaaggucaaacagcugagggagaacuuccaagaaaagcgccaguggcuccuaaaguaccagucccuguugcgaauguuucugucguacugcauccuccaugguagccacgggggaggccuugcaagugugagaauggagcugauuuugcugcuccaggaaucucaacaggagacuuccgagccauuauucagcucaccucugagugaacagaccuccgugccccuucuguucgccuguacagcuaaugccaaaacugucguagcaaacccacuacuccaucugagcaauuugacccacgauauccugcaugcgauaauuaacuuugacucuccuccccacccggauauccagucaaauaagguguauguuaugcacacgcucgccgcuagccuuuccgccugcaucuaccaaugucugugcggcucucauaacuauaguucguuccagacaaaccaguuuaccgggaugguguaccagacugucuuacugccacaccggccuagcuugaaaacaggaucccucgacgaggcacugacccccaauacuucaccagcucaauggcccgguauuacaugccuaaucaggcuucugaacucuagcggcgaagaggcccagagugggcucaccgugcuguugugugagauacugacggcaguuuaucucucccuuuucauucauggacuggccacucacucaucuaaugaauuauuucgcaucguggcucauccucugaacgagaagauguggagcgcggucuucggcgguggggcccacgugccguccaaagaacagacccacaguaagacauugcccguaagcucucucguggaggaaggagagaagcagaauaaaagauuuaggccaucaaagauguccugccgggagagcgcaccucugacccccaguucugcuccuguuucccaagaaucgcuagccgucaaagagaaguucauuccacccgaacuuagcaucugggauuacuuuauagccaaaccuuuccugccaucaucccagucucgugcagaguaugacagugaagagagccucggcucagacgaugacgauaacgacgaugacgaugacgugcuggcuuccgauuuucauuugcaggagcacagcaauucuaacaguuacuccuggagcuuaaugcgccuggccauggugcaacucguccuuaauaaccugaagacauucuaccccuuugcgggccaugaccuagcugaacugccgguuucaucuccucucugucacgccguguugaagacucugcagugcugggagcagguacuucugcgaagacucgaaauucacgggggaccaccccagaauuauaucgcaucgcauaccgccgaggaaagcuuauccgcugguccugcaauccugaggcacaaagccuugcuggagccaacgaacacacccuucaagaguaaacaucaccucgcgcuuucugugaagcggcuguggcaauaccuagucaaacaggaggaaauucaggagacuuucaucaagaauauuuuuaccaagaaacgcugucugaacgaaucacucgaggauaauagcgagacaauaaagaacuccaugauggaagagccgaacaucaauaaaauugaagcugacuugggcuauccugggggaaaggccagaaucauccauaaagagagugacauuauaaccgcauucgccgugaacaaggcuaauaggaacugcaucgccauugcaucuagccacgauguucaggaacuggacguguccggcauccuugcuacucaagucuacaccuggguagaugacgauauugagguggagacaaaagguucagaagacuuucugguuauccacgcccgggaugacuuaacggcggugcaggggacuacccccuauacacauagcaauccaggaaccccuauaaacaugcccuggcucggcucuacucagacaggccgaggggccuccgucaugaucaagaaggcaauuaauaacgugagacgcaugaccagucacccaacgcugcccuacuauuugacuggagcucaggaugguucagucaggauguucgaguggggccauagccaacagaucacauguuuucggucggggggaaauucccgugugaccagaaugagguucaacuaccagggcaauaaauuugguauuguugacgccgauggguaccugucucucuaucaaaccaacuggaagugcuguccugugacuggaaguaugccaaaaccguaccuuacauggcagugccacaauaagaccgcaaacgacuucguauuugugagcucauccucucugaucgcuacagccggccuaagcacugauaaucgcaacgucugucugugggacacgcucguugcccccgcgaacaguuuggugcacgcuuucaccugccaugacuccggcgcaacaguccuggccuaugcuccuaaacaccaguuacuuauaagcgggggacggaaggguuuuacuuacguguucgaucugugccagcgacaacagagacagcucuuucagucucaugacucaccaguaaaggccguggcaguugaucccaccgaagaguauuucgugacaggcuccgccgaagggaauauuaaaaucuggagccugaguaccuucggauugcugcacacuuuugucucugagcaugcuaggcaaucaauuuuccgcaacaucggcacgggugugaugcagauagagaccgggccugcgaaucacaucuuuuccuguggagccgacggcacaaugaagaugcggauucucccagaucaguucagcccccuuaacgaaguccugaaaaaugacgugaaguuuaugcuauga

SEQ ID NO: 55360 - RNA, 9114 nt, Artificial Sequence
  derived and/or modified sequence opt3 from DMXL2__Homo_sapiens__NP_001167587
augcaucugcaccaggugcucaccggcgccgucaaccccggggacaauugcuacagcguuggauccgugggugauguaccuuucacagcuuauggcucugggugugacaucgugauucuugcaaacgauuuugaaugcguccagaucaucccaggagccaagcacggcaauauucaggugucauguguugaaugcaguaaccagcaggguagaaucgcggcuagcuacgggaaugccguguguauuuucgaaccgcugggaaucaacucccauaaaagaaauugccaauugaagugucagugguuaaaaacuggccaguuuuuccugucuucggucacguauaaccucgcaugggacccccaggauaaucggcuccugaccgccacagacucaauacaacuuugggcuccuccaggcgaugacauccuggaagaggaagaggagauugauaacacugugcccccuguauugaaugacuggaagugcguuuggcaguguaaaaccagcgugaguguccaccucauggaaugguccccagauggggaguacuuugcaacagccggaaaggacgauugccugcugaaggugugguaucccaugaccgguuggaaaucuagcaucauuccucaggaccaucacgaagugaagcgccgacaguccucaacucaauucaguuuugucuaccucgcucacccacgugccguuacaggcuucagcuggagaaaaaccucuaaguauaugccgaggggguccguguguaacguauuacugacgucaugccaugacggagugugccggcuuugggcggagacuuugcugcccgaggauugucuacucggcgaacagaucugcgagaccacaacuagcaguauagcaucuucccugagccacgccggucgccauaaagacaggauucagcacgcucuugaaaccauccaccaucugaagaauuugaggaaggggcaacggcgcucgucuguccucgugacacacgccgagcugaugccugaucagaccgcaaugcaugaaguucagcgacacauuucccaucacgcuaacgccuuaugucacuuucauaucgcggccucaaucaauccagcaacggacauucccaacgugcuggucggaacugcuuucaacguggaugacggcaauggcggguuuguaguucacuggcucaacaauaaagaguuccauuuuacaaguagcaccgagguguucaugcaccagcuuagaaagcuguccgauaaacaagucgaccacgaaaacgaugacgccgauagggaggacgaagaacauucucaggaagaccgggagcguggauugcacaugaagcuagaucaugaccugagccucgaucgcgagucagaagcugguacuggcaguuccgagcacgaagacggggagagagaaggaagcccuaggacauacucucggcugucagugccaaugccccuuccgaccguccuguuggaucgaaaaauagagacgcuccugaccgaguggaauaagaacccugacauguuauucacaauccaucccguggauggcacuuuucugguuuggcacgugaaauaccuagacgaauauaauccagguauuuuccgccagguacaggucaguuuuagcuccagaaucccuguggccuuccccucuggggaugcaucgagccucuccaagaacauaaugauguacgccugcauuaaugcuaccaaggacucacaccauacacugcuucaccaagagggcaugaguguuggaucuccacauggcagccagccccacuccaggucacauagcacucacaugaacaucuuggcgccuaccgugaugaugaucucuaaacacauugaugggucccugaaucagugggcagucacauuugccgacaagagugcuuucaccacugugcucacgguaagccauaaauuucgguauuguggacaccgcuuccaucugaacgaucuugccugccacucugugcugccauugcuccugacauccucacaccauaaugcauuacugaccccggaacuagacugucagugggacagugauaacaagcucagcagacugauggaccccguuaaacacaucaaggguucguccaagcaaccucuuaggaaugccgcuacucguaccuuucaugauccaaacgccauuuacucugaguugauacuguggcgggucgaccccaucggcccucucagcuauacagggggagugucagagcuggcacgaauuaacaguuuacacaccuccgcguucucuaauguggcuuggcugccaacucuuauccccagcuacugcuugggcacauauuguaacuccgccucagcaugcuuugucgccagcgaugguaaaaaucucagacuguaccaggcuguuguggacgccaggaagcuacuggaugaacucagugacccggagucuuccaaacugaucggggaaguguucaacauuguaagccagcagucgacggcacgcccuggcuguauaaucgagcuugaugcuauuaccaaucaaugcggaucaaacacucaguugcugcaugucuuucaggaagacuucaucauuggcuacaagccacacaaagaggauauggagaagaaggaaacagagaucuucuuucaacccucucagggguaucggccucccccauucagugaaaaauuuuucuuagugguuauagagaaggacuccaauaacaauagcauccuccacauguggcaucugcaccuuaaaucugugcaggccugccuggcgaaggccagcgaaggagcuuccucagagaguuugcucagcgucccuggucagaaaaacguggauucuucccccgagaccucaccaaguguuagcccgaugccucauuccucuucgauugcaaaucugcaaacagccagcaagcuaauccugucauccagacucguguacagucagccccuggaccuuccagaaucuguagaggucauuagggcuacucccagcgccggccacuuguccucaucuagcaucuauccugugugucuggcaccauacuuaguggucaccacgugcagugacaacaagguucgcuuuuggaaauguugcauggaagcgaaucccgaguguaacaaguccgaugaaaaagagauauaucacuggaagcgauggccucucaugaaugacgagggggaagauaacagcucuaccgugucaauuguaggacggccgguggccgucuccugcaguuacacaggccgucuggcuguggccuauaaacagccaauccaucacaacgguuucguuagcaaggaguuuucgaugcauguguguauuuucgaaugcgagucuacugggggcuccgaguggguccuugaacagaccauccaccuggacgaucuagugaaaguuggaagcgugcucgacucaagagucaguguagauucuaaucuguuuguguacuccaagagcgacgcauugcugucaaaggauagguacuuaauacccaacaucaaacaucucguucaccuggacugggugaguaaggaggauggcagccacauucuuacagucggggugggagcuaauaucuucauguauggccgccuguccgguauuguaacugaacaaaccaacucuaaagacgggguggccgucaucacguugccucucggaggcagcauaaagcaggguguuaaaucccggugggugcugcuaagaucaauugaccuggugucuagugucgauggcacaccaucgcuucccgugagccucuccuggguuagggacgggauccugguagugggaauggauugugagaugcaugucuacgcacaguggaagcacgccgugaaguuuggcgacaccgaagcugauucuucaaaugcggaggaggccgcaaugcaggaccauagcacuuucaaauccaacauguuggcucgaaagaguguuguggaagggacagccaucucugaugacgucuuuugcagcccuaccgugauucaagauggaggccuguucgaggccgcucacguauuaucaccgacucucccccaguaucacccaacccagcugcuugaacugauggacuuggguaaaguccgccgggcaaaggccauccucucccaucuggugaaauguauugcgggggagguugcuauagugagagauccugacgccggagaaggcacaaagaggcaccuaagucguacgaucagcgucucugguuccaccgcaaaggagacugugacaguuggcaaagaugggacccgcgacuacacagagauugacucaauacccccacugccucuuuaugcccuccuggcugcagaucaagacacuagcuaccggauuucggaagagucuaccaagaucccccagaguuaugaagaucagacggugucccagccagaggaccaauacagcgaauuguuccagauacaggauaucccgacagacgauauugacuuagagccugagaaaagagaaaauaagucaaaagucaucaaccugucccaguacggacccgccuauuuuggccaagagcaugcgagggugcucucuagccaccugaugcauaguucccuuccagggcugacccgauuggaacagauguuccuaguagcucuggccgauacuguggcaaccacaagcacugagcucgacgagucucgggauaagucaugcaguggacgcgacacccuggaugaaugcggccuuagauacuuacuggccaugaggcuccacacauguuugcugacgucccuacccccucuguaucggguucagcuucugcaccagggugucaguaccugccauuuugcuugggccuuccacucugaggcagaagaggaauugauuaauaugaucccagcuauacaacgaggggacccccaguggucggagcuaagagccaugggaauuggcuggugggugcgcaacaucaauacucugaggcguuguaucgagaagguggcgaaagccucauuucagcggaacaaugacgcacucgaugcugccuuauucuaccugagcaugaagaaaaaggcugucguauggggucuuuuuagaucccagcaugacgagaaaaugacaaccuucuuuagucacaacuucaaugaggauagguggcgcaaggcagcccugaaaaacgccuuuucucucuugggcaagcaacgauucgaacagagcgcugcguucuuucugcucgcagggucccugaaggacgccauugaggugugccuugagaaaauggaggauauacagcuagcuaugguuaucgccagacuguaugagucagaguucgagacaagcucuacauacauuagcaucuugaaccaaaagauuuuaggaugucagaaagacggcuccggguuuucaugcaagcggcugcauccugauccguuccucaggagccuggcauauugggugaugaaagacuacacccgcgcccuugauacgcugcucgaacagacuccaaaggaggacgaugaacaccaggucaucauaaagucuuguaaucccguggcuuuuuccuucuacaacuauuugcguacccacccucugcuaaucagacggaaucuggcgagucccgagggaacacucgccacccuuggccugaaaacugagaagaacuuuguugacaaaauuaauuuaaucgaaaggaaguuguucuuuacaaccgcaaacgcucauuucaaaguggguugcccaguccuggcccucgaggugcugagcaagauuccuaagguaacaaaaacuucggcacuuuccgccaagaaagaccaacccgauuuuaucucucaccgcauggacgaugugccaucacauagcaaggcucugagugacgggaauggauccucuggcauagaauggagcaacguuaccucaucccaguacgauuggagucagccuauugucaaaguggacgaggagccgcucaauuuggauuggggcgaagaccacgauagcgcccuggacgaggaagaggaugacgcggugggguuagucaugaagucuacggaugcacgagaaaaggacaaacagucagaccaaaaggccuccgaucccaacaugcuacugacaccacaggaggaggacgauccugaaggagacaccgagguugaugugaucgcugaacagcucaaauucagagccugucuuaagauccugaugacugaguugcggacccuggcuacagguuaugaaguagacggcgggaaacucagguuucagcuguacaauuggcuugagaaggagauugcagcccuccacgaaaucugcaaccaugagagcgugauaaaggaauauucuaguaaaacuuacucgaaggucgaguccgaucuguuggaccaagaagagaugguggauaaacccgacauuggaagcuaugagcgccaccagaucgaaagaaggcggcugcaggcuaagcgugagcaugccgaacgccgaaaaucaugguuacaaaagaaucaggaucuacugagaguuuuccucucuuacuguagccuucacggcgcacagggugggggacuggcguccgugaggauggaguugaaauuccugcuccaggagagucaacaggaaaccacggucaagcagcugcagucaccacuuccuuuacccacaacccugccgcucuugucugccagcauugcuuccacuaagacaguaaucgccaacccagugcuguaccuaaauaaccauauacacgacauucuguauaccaucguucaaaugaaaacuccuccccacccaaguaucgaggacgugaagguccauacacuccacagccuugcagcuucccugucugccucaauuuaccaggcauugugcgauagccauucguauuccagucagaccgaaggcaaucaguuuacgggcauggccuaccaagggcugcuccugucugaccggcgcagauuaaggacugagagcaucgaagaacacgcuacccccaacucauccccugcgcaguggccgggagugucuagucuuauuaaccugcucagcuccgcccaggaugaggaccagcccaaacuaaauauacuguugugcgaagcagucguggcuguuuaucugucacuccuuauccacgcccuggccacaaacagcucuagugaguuguuccggcuggcagcucauccacucaauaaccgaaugugggccgcgguguuugguggcgggguaaaguuaguggucaaaccuagacgccaauccgaaaauauuagcgcucccccuguucugucagaggauaucgacaagcacaggcggcguuucaacaugagaaugcuugugccaggaaggcccgucaaggaugccaccccuccacccgugccggcagaacgcccuucuuacaaagagaaguuuaucccacccgagcuguccaugugggacuauuucguagccaaaccuuuucuaccacucucggauagcggcgugauuuacgacagugaugaaucuauacauuccgacgaggaagaugacgcuuucuuuagcgacacacagauccaggagcaccaagaucccaauucauacaguugggcacuguugcaucugacuaugguuaagcucgcccuucacaacgugaaaaauuucuuuccgauugcgggucuggaguucuccgaguuaccugucaccagcccccuggggaucgcugugauuaagaacuuggagaauugggaacagauccuccaggagaagauggaccaguuugaaggaccaccucccaacuauauaaauacguacccaacagaucugucugucggcgccggccccgcaauccuacggaacaaagccaugcuugagccugagaauacuccauucaagucacgagacagcuccgcuuucccggugaaaagacuguggcacuuucucguuaagcaagaaguacugcaggagaccuucauuagguauaucuuuacuaaaaagcgcaagcagucugaaguggaggccgauuugggguaccccggagguaaagcaaaggucauucauaaagaaagugacaugaucauggcuuucucggugaacaaggccaacuguaaugagauaguucuggcgagcacccacgaugugcaggagcucgacgucacuucccuucuggccugccaaucauauauuuggaucggcgaagaguacgaucgggaaucuaaaagcagugacgauguggacuauagaggguccaccacaacguuauaccagccuucagcaacuucuuacagcgcuucccagguacauccacccaguagccugccuugguugggaaccggccagacaucuaccggugccucagugcucaugaagcguaaccugcacaauguuaaaaggaugacuucccauccaguccaccaauauuaccuaacaggggcacaggauggaagcgugcggauguuugaguggacccgcccccagcaacuuguguguuuccgacaggcuggcaacgccagagucacgaggcuguauuuuaauagucagggcaacaagugcgggguugccgacggagaagguuuccucucuauuuggcaagugaaucaaacugcguccaacccuaagccguacaugucguggcagugucacagcaaagcuacaucagacuuugcauucaucaccuccucuagucugguagccaccagcggccauucaaaugauaaccggaaugugugcuugugggacacuuuaauauccccagggaacagccugauccacggauuuacaugucaugaucacggcgcuaccguccuccaguaugcccccaagcagcaacuucugauuucuggugggcgcaaaggacacgugugcaucuucgacauuagacagaggcagcuaauccauacauuucaggcacacgauagugccauaaaggcucuggcgcucgacccuuacgaggaguauuucacuacgggcuccgccgaaggcaauauuaaaguuuggcgauugaccgggcauggacugauccacagcuucaagucagagcaugcaaagcaaucuaucuuucggaacauuggugcuggcgugaugcagaucgauauaauucaggggaaucgucuuuucucguguggagccgacggcacacugaaaacuagaguccuccccaacgcauuuaacaucccaaaucgcauuuuagauauccuguga

SEQ ID NO: 55361 - RNA, 3183 nt, Artificial Sequence
  derived and/or modified sequence opt3 from DNA2__Homo_sapiens__NP_001073918
auggagcagcugaacgaacucgagcuucugauggaaaagagcuucugggaggaagccgaguugcccgcugaguuauuucagaaaaagguggucgcauccuucccuagaaccguucugucuacaggcauggacaauagguaccuagugcucgccguaaacacugugcaaaauaaagaagggaacugcgagaagcggcuggucaucacggcgucacagagucuugaaaauaaagagcuguguauuuugcgcaacgauuggugcagcgugccaguugagccgggagacauaauccaccucgaaggugauuguaccuccgacacauggauuaucgauaaggacuuuggcuaucugauucuguaccccgauaugcucaucucugggacuucgauagcuucaagcauccgaugcaugcguagagccguguuaagugagaccuucagguccucugacccugcaacacggcagaugcugauuggaaccguccuucaugaaguguuucaaaaggccaucaauaacagcuucgcuccagagaaauugcaggaacuggcauuucagacuauucaggagauccgccaccuaaaggagauguauagacucaaucugucccaagaugaaauaaaacaggagguagaagacuaccuucccucauucuguaagugggccggcgauuuuaugcauaaaaacacaaguaccgacuucccucagaugcagcugagcuugccaucugauaauuccaaggacaacucaacgugcaauauugagguugugaagcccauggacaucgaagagagcauuuggaguccuagguuuggucucaaagggaagaucgaugucacugugggagugaaaauccaccggggcuauaagaccaaauacaagauuaugccacuggaguuaaaaacaggcaaggaaucuaacuccauagagcaucgcagccaagucguucuguauacucuccuuucgcaggaaagacgagcugacccggaggccgggcuguugcuauaccugaagaccggacagauguaccccgugccugcgaaucaccucgauaaaagggaacugcuuaagcugcggaaccaaauggcauucucuuuguuucaccguaucuccaaaucagccacacgccagaagacccagcucgcuagucugccacagauuaucgaggaggagaaaacguguaaguauugcagccaaauagguaacugugccuuauacuccagagcaguagaacagcagauggacugcucuagcgugcccauugucaugcugccuaagaucgaagaggagacucagcaucuaaaacaaacacaccucgaauauuucucacuguggugucuuauguugacccuggagagucaguccaaggauaauaaaaagaaccaucagaauaucuggcucaugccagcuagcgaaauggagaaaucuggcucaugcauugggaaccugaucaggauggaacacgugaagauuguuugcgacggacaguaccuucacaauuuccaauguaagcauggcgccauacccgugacuaaccugauggcgggugaucgggucaucgugaguggggaggagcgaucuuuguuugcccucucccgcggauauguaaaagaaauuaauaugacaaccguuacgugccuguuagacagaaaccugucugugcuaccggagucgacccucuucaggcuggaucaggaagagaagaauugugacaucgauacaccucuuggcaacuugagcaaacugauggaaaauacuuuugucuccaagaaacuccgggaccugaucauugacuuccgcgagccccaguuuauaucauacuuaaguucugugcugccacacgaugcaaaggacaccgucgcuugcauccuuaagggcuugaacaaaccucagagacaagccaugaagaaagugcuccugagcaaggauuauacacuaauuguugggaugcccggaacugguaaaaccacaaccaucuguacucuggugaggauucucuacgcuugcggcuucuccguacugcuuacgucauacacacauagcgccgucgacaauaucuugcugaaguuagcaaaauuuaagauaggguuccuccgucugggacagauccagaaggugcacccagccauucaacaguuuaccgagcaggaaaucugucggucuaaauccauuaagagucuugcucuguuggaggaacucuauaacagccagcugaucguugcgacuaccugcaugggcauaaaucaucccauuuucucucgaaaaaucuuugauuucuguauuguggacgaggcaucccaaaucucacagccuauaugccuagguccacuguuuuucaguagaagguucguccucgugggggaucaccagcagcugccgccccuuguauugaaccgcgaagcccgggcucugggcaugagcgagucguuauuuaagagacucgagcaaaacaaauccgccgugguucagcugacaguccaguacaggaugaauagcaagaucaugagccuuucaaacaagcugaccuaugaaggaaaacuagaguguggcagugacaagguggcaaaugccgugauuaaccuccgccacuucaaagaugucaagcuggaauuggaguuuuacgcugacuauuccgauaauccuuggcugauggggguuuucgagccaaacaaucccgugugcuuuuuaaacacugacaaagugccugccccagaacagguagagaagggaggugucucuaaugugacagaagcaaagcucaucguuuuccugacgagcauuuuugugaaagcgggcugcucccccucagauaucgggauaauugcuccguaccgacaacagcuuaagaucaucaacgaccuguuggcccggagcauuggaauggucgaggugaauaccguugacaaauaucagggccgugauaagaguaucgugcucguaucuuucgucagauccaacaaagacgguacugugggggaacugcuaaaggauuggaggcgccugaauguggcaauuacacgggccaagcauaaacuuauacuccugggcugugucccuagcuugaacugcuacccaccccuggagaaguuacucaaucaccugaacucggagaaacuuaucauugaccugccuucaagagaacaugagucuuugugucacauccucggagauuuucaaagggaauga

SEQ ID NO: 55362 - RNA, 2178 nt, Artificial Sequence
  derived and/or modified sequence opt3 from DNAAF1__Homo_sapiens__NP_848547
augcaccccgagccuagcgaaccagccaccggcggggcugcagagcuggacugcgcccaggaaccgggaguggaggaauccgcgggugaucauggcucugcugggagaggaggcuguaaggaggagaucaacgaccccaaagaaauuugcgucgguucaagugauacaagcuaccacucccaacagaagcagucuggggacaauggaucgggcggccauuucgcccacccuagggaggaucgggaagaccgcgggccacgaaugacuaaaucaagccuccagaaacuuuguaaacaacauaagcuguauauaacgcccgcauugaacgauaccuuauaccugcacuuuaagggauucgaccguaucgagaaucuagaggaauauacaggucucagaugccuguggcuucagaguaacggcauucagaaaaucgagaaucuggaagcccagacugaguugaggugucucuuucugcaaaugaaccugcuccggaagauugaaaauuuagagccucugcagaaacuugaugcuuugaaccuguccaauaacuacaucaagaccauagagaaucuaucuugccucccaguucugaacacacuucagauggcacacaaucaucuggaaaccguggaggacauccagcacuugcaagaaugucuccgccugugcguauuagaucugagccauaacaaacucuccgaccccgagauucuuucaauccuggaaaguaugccugauuugagagugcuaaaucugauggggaacccagucauuaggcagaucccgaacuaucggcgcacugugacaguucgacucaagcaccugaccuaccuugacgacagacccguguucccuaaggauagggccugugcugaggccugggcgcggggaggcuaugcagccgagaaagaagaacgucagcaaugggaaagccgcgagagaaagaaaauaacggacucuauugaagcucuggccaugaucaagcagagggcagaggagcggaaacgacagcgcgaaucccaggagagaggugaaaugacuucaagcgaugacggggagaaugucccagcuagugccgagggaaaggaggagcccccuggcgauagggaaacccggcaaaagauggaguuguuugugaaggaaucuuucgaggcgaaggacgagcucugcccagaaaaacccuccggcgaggaaccgccuguagaggccaagcgcgaagaugggggacccgagccagaggguacacugccugcagaaacuuuacugcuaagcucgcccguugaggugaaaggcgaagacggggauggagagccagaaggcacccuccccgcugaggccccuccaccgcccccuccagucgaggugaagggugaagacggggaucaggagcccgaaggcacacugccugcugagacccuuuugcugucuccacccgugaaagucaagggagaggacggcgacagagaaccggaggggacgcucccugccgaagcaccacccccucccccacugggagccgcuagggaggaaccuacuccccaggcgguugcaacagaggguguguuuguaaccgagcuugauggcacucguacagaagaccuggagaccauucgguuggaaacgaaggagaccuucuguaucgaugaccucccagaucuggaagacgaugacgagacagggaaauccuuagaggaucagaacaugugcuuuccgaagaucgaagugauuucaagucugagcgacgauuccgacccugagcuagauuacacuucucuccccguccuggaaaaucuuccaaccgacacauugagcaacauauucgccgugucaaaagacaccaguaaggcugcccgaguucccuuuacugauaucuucaaaaaggaggcaaagagagaccuggaaauuaggaaacaagauacaaaguccccucgcccacucauccaggagcugagcgacgaggaucccucuggacaguuacugaugccuccgaccugccagcgggacgccgcuccacuuacuucaaguggcgauagagacagcgacuuuuuggccgcauccucucccgugccuacggaaucggcggcuacaccacccgagaccugugucgguguggcccaaccuagccaggcacucccgacuugggaucugaccgccuuccccgcuccaaaagccuccuga

SEQ ID NO: 55363 - RNA, 2370 nt, Artificial Sequence
  derived and/or modified sequence opt3 from DNAAF2__Homo_sapiens__NP_001077377
auggccaaggcugcagccagcuccucucuggaggaccucgaucuuucaggcgaagaggugcagagacugaccagugcguuccaagaccccgaauuuaggcggauguucagccaguacgcugaggaauugacagauccugagaaccgccgacguuaugaggccgaaaucacugcauuagagagagaaaggggagucgagguucgguuugugcacccagagccggggcauguacugcgcacgucccuagacggugccagaaggugcuucgugaaugucuguucuaacgcucucgugggcgcacccucgucacggccugggagcggaggcgaucgcggugccgcuccagggagucacuggucccugcccuacucucuugccccuggacgagaauaugcgggcagaagcuccucaagguacaugguuuaugacguggucuuucauccagaugcacuggccuuggcucggcgucacgagggcuuccgccagaugcucgacgccaccgcacuggaagcuguggagaaacaguuugggguaaagcuggauagaaggaaugccaaaacacucaaggcgaaauacaagggaacucccgaagccgcaguuuuacggaccccucugccaggugugauuccggcucgacccgacggcgagccuaaggggccacuucccgauuucccuuauccauaccaauaccccgccgcuccgggaccucgcgcccccaguccaccugaggcagccuugcagcccgcuccaacagaacccagauauagcgucgugcagaggcaucacguggaccugcaggauuaccggugcucucgcgacuccgcgccuucaccagucccgcacgagcuaguuauaaccaucgaacucccccugcuuagaagcgcagagcaagccgcucuggaagugacuaggaaauugcucugucuggacagucguaagccugauuaucgguuacgacugucucucccauaccccguagacgauggcagagguaaagcccaguuuaacaaggcaaggcgccagcuuguggucacacugccugugguuuugccagccgcucggagagagcccgccguggcagucgcggcugccgcaccggaggaauccgccgacaggagcgggaccgauggacaggcuugcgccucggcacgcgagggcgaagcuggcccugcccgaucucgggcggaggacgggggacaugauacguguguggccggugcugcaggcuccgggguaacuacccuaggagacccagaaguugcucccccucccgccgccgcaggcgaggagcgugugccaaaaccuggugaacaagaucugucaagacacgcggggagucccccaggcagcgucgaggaaccguccccuggaggcgaaaauucucccgggggagguggcagcccaugccucucaaguaggucccuggccugggggagcucugcuggacgcgagucagcccggggcgacaguagcguggagacaagagaggaauccgaggguacugggggccagaggucugcaugugcuaugggaggccccgggaccaagucgggagaaccucuuugcccaccccuguuguguaaccaggauaaggagacacucacccuguuaauucaagucccucgaauccagccgcagagccugcagggugaccuaaauccacucugguauaaacugcgcuucuccgcccaagaccuuguguacucauuuuucuugcaguuugcacccgagaacaagcugaguacgacugaaccuguuauuucuaucagcuccaauaacgccgugauagagcucgcuaaaucaccagaaagccauggccacuggcgggagugguauuacgggguaaauaacgauucucuggaacuucaggagugcuccaauagugaccagcugcaaggaaaggaggaaagagucaacgaggaaagccacuugacagagaaagaauacaucgagcauuguaauacccccacuacagauucugacuccucaauugcggugaaggcccuccagaucgauaguuucggccugguuaccugcuuccagcaggagagcuuagacgugucgcaaaugauucuggguaaaucccagcagccugaaucuaagaugcagagcgaguuuaucaaggaaaaaucagcaacgugcaguaacgaggagaaggauaaccuaaaugaauccgucauaaccgaggaaaaagagacagacggggaucaccucucuagccugcuuaacaagacuaccgugcauaauauuccgggcuucgacuccaucaaagaaacaaacaugcaagauggaucaguacaggugauuaaggaccacguuacuaauugugcuuuuagcuuccagaacaguuugcuguaugaucucgacuga

SEQ ID NO: 55364 - RNA, 1827 nt, Artificial Sequence
  derived and/or modified sequence opt3 from DNAAF3__Homo_sapiens__NP_001243643
augcugccccuccuugacagcuccaagagagccggcacccuggggucuggaugcggugugccuaggguccacucagcugcauugagucgggaggaaggcgccagccgcgauaucuggcgaauuaaaguuugggcgcgugugaugacaacuccagcuggguccggaucuggcuucgguucgguaucaugguggggguuaagcccggcccuggaccuacaggcagagagagaugccacgguggacgcucuccccaccacaauggucccucaaccagcagugauacugcccggaccuccaguugaucccgacagucaggccgauacugugcauuccaacccugaacuugacguccuguugcucggcucuguggauggcaggcaucugcugcggacccucagccgcgcuaaguuuuggccaagaaggcgguucaacuuuuucguauuagagaauaaucuggaagccguugcgcgccacaugcuuaucuuuuccuuggcacuggaggagccggagaaaauggggcuacaggagcgaucagaaacauuccucgagguguggggaaacgcccugcuuagacccccugucgcugccuuugugagggcacaggcugaccuguuggcccaccucgugccagagcccgaucggcuggaagaacaauuaccuuggcugagucuccgugcgcuuaaguuccgcgaaagagacgcccuggaggcagucuuuagguucugggcugguggcgaaaaagggccacaggccuuucccaugagccgguugugggauucucgacuacgccauuaccugggauccagauaugacgcuaggcggggcguuucagacugggaucuccgcaugaagcugcacgacagaggugcccaggugauucacccgcaggaguucaggcguuggcgggauaccgggguagcauuugagcuucgagacagcagugccuaccaugugccuaauagaacucuggcuucuggaagguugcucuccuaucgcggcgaacgggucgcggcaagaggcuacuggggagauaucgccacagggcccuucguggcuuucgguauugaggccgacgaugaaagccuguuaaggaccucgaacggccaaccaguuaagacggcaggggagaucacucagcacaaugugaccgaacugcuacgcgacgucgccgcuuggggacgagcccgggcaacaggcggugaucucgaggagcagcagcaugcggaagggucuccugagcccggcacuccagcucccaccccugaauccuuuacagugcacuuccugccacuuaacucagcccaaaccuugcaccauaaaaguuguuauaauggacguuuucagcugcucuacguagcaugcggcaugguucaucugcuuauaccggagcugggggccuguguggcucccggagguaacuugaucgucgaacucgccagauaucugguggacgucaggcaggagcaauuacagggcuucaauacgcgcgugcgggagcuggcacaggcugccggguuugcgccucagacuggagccagaccaagcgaaacauucgcuagguuuugcaagucccaagagucugcacuaggcaacaccguucccgccguggaaccugguacuccaccccucgauauucuggcucagccgcuugaggccagcaauccugcauuggaggggcugacacagccacuccagggcggaacgccccacugugaaccuugccaacugcccucagagaguccaggcuccuuaagcgaaguacuggcgcagccucagggggcccuugcucccccaaacugugagucugacucaaaaaccggagucuga

SEQ ID NO: 55365 - RNA, 2568 nt, Artificial Sequence
  derived and/or modified sequence opt3 from DNAAF5__Homo_sapiens__NP_060272
auggccgcucugggcguggcagaggccgucgcggcuccccacccugccgaaggggcagagaccgccgaagcuguugagcucagcagagcacuuuccaggcuguugccaggauuagaagccgacucuaagccgggucggcgccgagcucuggaggcccuacguagagcgcucgaggaacccggcccugcagccgauccaacagcuuuccaggggcccugggccaggcugcuucugccucgguugcuccgcugccugucagacccagcagagggauguagagcucuggccgugcaucucuuagaucugggccuuaggcgggcggcccgcccccgagacgcauugccuagacugcuaccagcucucgccgcuaggcuggccgguccgguacccgcacggcguccuccagaagccugcgaggagcuucgccuggcuuuggugcaacuccugggguuagcggucgaucuguguggagcagcccucgcuccccaccuugacgaugcccugagagcauugaggugcagucuacuggacccuuuugccgcugugcggcgagaaagcuguuccugcgccgcagcgcucgcucaggccacuccagaucauuuccacaugcagucugagucgcugaucggcccccuuaugcagacgauuucacaucaacacuggaaaguucgcguggcagccauagaagcuaccggcgccgucauccacuuugggaacggaaagagcguggacgauguacugagucauuucgcacagagauuguuugacgauguuccucaggugaggcgggcugucgccuccgugguggguggcuggcuccuguguuuacgcgacagauacucuuucuuucacaaacugauuccgcuacuccugagcucccuuaaugacgagguccccgaaguuaggcaguuggcggccucacugugggaggauguggggcuccaauggcagaaggagaacgaagaggaccugaaagauaaacuugacuucgcuccaccuacacccccacauuaucccccucacgaacgucggccaguacugggaugccgagaguugguguuuagaaaucucaguaagauccugccggcauuaugucacgauauuacugacugggucgugggcaccaggguuaagagcgcccagcugcuacccgugcuccugcuucaugcugaagaucacgccacacagcauuuggaggucgugcugcgcacccucuuccaagcaugcacugacgaggaagcggccguaguucagucuuguacacgguccgcugagcugguggguaccuuugucucaccugaaguguucuuaaagcugauccuuagcacguugaaaaagacuccaagugccucugggcuccugguccuagcauccgcuaugagaggaugccccagggaggcccugcagccucaccucgcagccauagcuaccgaacuggcgcaagcccauaucugccaggcaagcgagaacgaucuuuacuuggagcgccuguuacucugugugcaggcucugguuucggugugccacgaagacuguggcguagccucucuucagcuguuggauguccuccugacaauuguggcccuagcuggcgcaacugggcugcgagacaaagcccaagagaccauggacucccucgcgaugguugaaggagugucaaguugccaggaucuguaucggaagcacaucgguccacuuuuggagcgugucacagcuagccaucuggacuggaccgcccacucccccgaguuacuccaguuuucugugauuguagcacagagcggcccggcccugggggaagcacuuccucaugugguuccaacgcugagagcuugucuacaacccucacaggauccucagaugaggcucaagcuguucaguaucuuguccacuguccuguuacgcgccacagacaccauaaauagccagggacaauuccccucuuaccucgagacugugacaaaagauauucuggcgccaaaccuucaguggcacgcuggccggaccgccgcagccaucagaacggcugccgugucaugccugugggcauugaccaguagcgaaguccucuccgcugagcagauuagggacguucaggaaacacugaugccucaagugcuaacuacccuggaggaggauucuaagaugacacgacuuaucucgugucgcaucauuaauacuuuucucaaaaccagcggugggaugacagaccccgaaaagcugauacggaucuauccagaguugcugaaaagauuagaugacguguccaacgauguaaggauggccgcggccucaacccucgucacuuggcugcagugcgugaagggcgcaaaugcuaaaaguuacuaucagucuagcguucaauaccuuuaccgugaacuguuggugcaccucgacgauccggagcgcgccauucaggacgcuauccuggaaguccuaaaggagggauccggccuguucccugaccuucucgugcgggagacggaagcaguuauacauaagcacagaucagccacauauugugagcagcuguugcagcaugugcaagccguacccgcuacccaguga

SEQ ID NO: 55366 - RNA, 13551 nt, Artificial Sequence
  derived and/or modified sequence opt3 from DNAH11__Homo_sapiens__NP_001264044
auggccgcucaaguggccgcccgagaagcgagggacuuccgggaagcucccacccugcgccucacaagcggcgccgggcuugaagcugucggagccguugaacuggaagaagaggaggaaaacgaggaagaggcugcagcccgacgugcuagauccuuugcccaagaugcgagggugcgguucuuggguggccgcuuagcaaugaugcugggguuuacugaggaaaaguggucucaauaccuagagucagaagacaauagacaggugcucggagaguuccuggaaaguacgagcccugccugccuuguguuuuccuucgcugccucuggcaggcuggcagcuucgcaggagaucccacgggaugccaaccacaaauuggucuuuauuucaaagaaaauuaccgagagcaucggugugaaugacuucagucaaguugugcucuuuggggaacugccggcgcugucccucggacacgucucugccuucuuagaugagauucuggugcccguacuuagcaacaagaauaaccacaaauccuggucauguuuuacaagucaggacauggaauaucacaucgagguuaugaagaagaaaauguacauuuuccgcggcaagaugagccgaagaacuuugcugccuaucccaaccguggcaggcaaaauggaucuagaccagaauugcucugaaaacaagcccccuuccaaugagaggauaauccuccacgcuauugagucagucgugaucgaauggagccaucagauucaagagaucauagaacgggauagugugcagcgucugcuuaacgggcugcacuugucuccacaggccgagcucgacuuuuggaugaugcgcagagaaaaucuguccuguauuuaugaucaguuacaagcucccgucguucugaaaauggugaagauccucacaaccaagcagagcucguacuucccuacucuuaaagacauuuuccuggccguagagaacgcauugcuagaggcccaggauguggaacuguaucucaggccacugcggcgacacauccaaugccuucaggagacagaauuuccgcagacccgcauccugauugcucccuuguuccauacgauaugucucaucuggucucacuccaaguuuuacaauacuccugcgagagucauugugcuguuacaggaguucugcaaccuguuuaucaaucaagcaaccgccuaucuaucaccagaggaccuccugaggggagaaauagaggaaagucuugagaaaguucagguggcugucaacauuuugaagacauucaaaaacagcuuuuucaauuaccggaagaaacuggccuccuacuuuaugggucgcaagcucagacccugggacuuccagucucaucugguguuuuguagguucgauaaguuucuugaccgucugaucaaaaucgaagauauuuucgcaacuaccuuggaguucgagaagcucgaacggcuggaguuuggcgggacaaaaggagccaucuuaaacggccagguacacgaaaugagcgaggaacugauggagcuaugcaagcuauucaaacaaucaaccuaugacccuagugauuguacgaauauggaguuugaauccgacuacguugcuuucaagagcaagacucuggaguuugaucgaagacuugguacaauuauaugcgaagccuucuuuaacuguaauggguuggaggcagcguucaaacugcucaccaucuuuggaaacuuccuggaaaagccaguggucauggagauauuuucuuuacacuauucaacucuggugcauauguucaauacagagcuugacgucugcaaacaguuguacaacgaacacaugaagcagaucgagugcggccaugugguucucaauaaaaacaugcccuuuaccaguggcaauaugaagugggcucagcaagugcugcagaggcuacagauguucuggagcaacuucgccucccugcgcuaucucuuucuggggaauccggaucacgcacuuguauaccagaaguaugucgaaaugacgaccuugcuggaccaauucgagucucggaucuacaacgaguggaaaucgaauguggaugaaauuugugaguuuaacuuaaaccagccucucguuaaguucagcgccauaaauggacugcuuugcgugaacuuugaccccaaacuggucgcuguguugagagaaguaaaguaccuccugaugcucaagaagcaggacaucccagauuccgcccuggcaauuuucaagaaaaggaauacaauccucaaguauauugguaaccuggaccuuuuggugcaaggcuacaauaaacugaagcagacuuuacucgagguugaauauccucugaucgaggaugagcuucgcgcuauagacgaacagcugaccgccgcgacaacuuggcuaaccuggcaggaugacuguuggggguacaucgagcgaguccgggccgcuacaucagaacucgagcaucguguggaaagaacccagaagaacgugaaggucauucagcagacuaugaggggaugggcacgcugcguucugcccccacggagagagcacaggcgagaggccgcuuuuacguuggaagauaaaggcgaccuguucacaaagaaguauaaauuaauccagggugauggguguaagauucacaaucucguggaggaaaaccgcaaacuguuuaaggccaaucccagucuugacaccuggaaaaucuacguggaguucauagaugacauuguagucgaaggcuuuuuccaagcaaucaugcaugaucuggacuucuuuuugaagaacacugagaagcagcucaaaccugcgccauucuuucaggcccagaugauucugcuaccgcccgagaucguguucaagccuucucuggaccgggaagcuggagauggcuuuuaugaccuuguugaggaaaugcucugcaauagcuucagaauguccgcccaaaugaacaggauagcaacccaccuggagaucaaaaauuaccagaacgauauggacaauauguuggggcuggcugaggugcgucaggaaauuaugaaccgcgucgugaacguuaucaauaagguguuagauuuucggaacacacucgagacccauacuuaccuguggguagacgauagagccgaguucaugaaacacuuucuucuguauggacacgcagucucaagcgacgagauggaugcccaugcuaaugaagagauuccagagcaacccccuacauuggaacaguucaaggagcagaucgacauauacgaagcgcucuaugugcagaugucuaaguuugaggauuucaggguguuugacuccugguucaaagucgauaugaagccauucaaaguuagucugcuaacgauuaucaagaaauggagcuggauguuucaagaacaucugcuucgauucgugaucgacucucucaacgagcugcaggaguuuauuaaggaaaccgacuccgguuugcagcgggaguuaaaugaaggcgaucaugacgggcugguagauaucauggugcaccuccuggccguccgcucaagacagagggcaacugacgagcuuuucgaaccccugaaggagacaauuaccuugcuagagaguuacggacagaagaugccggaacagguguauauacagcuggaggaacucccugagcggugggagacaacuaagaaaaucgcugccaccguucgacaugaagugagcccacugcacaacgccgaggucacgcuuauuagaaagaaauguaucuuauuugaugcuaagcaggcagaguuccgcgagagguuucgucacuacgcaccccugggcuucaaugcggaaaacccuuauaccgcucucgacaaagccaaugaggaguuggaagcacuggaggaagagaugcuccaaaugcaggaaucgacacggcuguuugagguggcccuucccgaguacaagcagaugaagcagugcagaaaagaaauuaagcuguugaaaggucuaugggauguuaucauauacgugaggcgcuccaucgacaacuggacuaagacccaauggcgacagauucaugucgagcagauggauguagaacugagacgguucgcuaaagagaucuggucucucaauaaggaagugaggguuugggacgcauauacaggguuagagggcacugugaaggauaugaccgccagccugcgcgcgauuacggagcuucaaucaccagcucugcgugacagacacuggcaucagcucaugaaagccaucggagucaaguuuuugauaaacgaagcaacaacccuggccgaccuccuggcacuucggcuacacaggguggaggaugacguacgccgaauuguggauaaagccgucaaggaacugggcacugagaaaguuaucacagagaucagucagaccugggcaacuaugaaguucuccuacgaagugcauuauagaaccgggauuccuuuguuaaagucugacgagcagcuguuugaaacacucgagcacaaucaagugcagcugcagacgcuucugcagagcaaauacgucgaauauuucauagagcaagugcucuccuggcagaacaaguugaauaucgcugaucugguuauuuucaccuggauggagguacagcggacuuggucacaccuagaaagcaucuuuguguguagugaggacauuaggauccagcuggucaaagaugcccgcagauucgacggaguggaugcggaauuuaaggagcucauguucaaaacagccaagguugaaaacgugcuugaggcaaccugcaggcccaaccuguacgagaaguuaaaagacuugcaaucucggcugucccucugugaaaaggcucuggccgaguaucuugaaacaaaacguauagcuuuuccacgcuucuacuuugucagcucggcagaucugcucgacaucuugucaaagggugcccagccgaaacaggugacuugccaucuggccaaguuauucgauucuauugcugaccuacaauuugaggacaaucaggauguaagugcgcaccgagcagucggcauguacuccaaggaaaaagaguaugugccuuuccaggccgagugcgaauguguugggcauguggagaccuggcugcuccagcuugaacaaacgaugcaggagacagucagacacagcaucaccgaggcuauuguggccuacgaagagaagcccagggaacuguggaucuuugacuucccagcacagguugccuugacuucuagccagauaugguggaccacagaugugggaauugcuuuuucccggcuggaggaaggcuaugagacugcgcucaaagacuuccacaagaaacaaaucucacagcugaacacccuuaucacacuccuguugggugagcugcccccuggggaucgccagaagauuaugacgaucugcaccauagacguccaugccagagaugugguagcaaaauuaauuagucagaaggugguuagcccacaggcuuucacuuggcuaucucagcugaggcaccggugggaagacacacagaagcauuguuuugucaauaucugcgaugcccaguuccaauacuuuuaugaguaccucggcaacagcccccgacuugugauuaccccucugacugacagauguuauaucacauugacccagucacugcaccucacgaugaguggagcaccggccggcccagcugggacuggaaaaaccgaaacaaccaaggaucugggccgcgcccuugguaugaugguguacgucuucaauugcagcgagcagauggacuacaaauccauagggaacauuuauaagggauuaguacaaacuggcgcgugggguuguuuugaugaguucaauaggaucucuguggagguucugucgguggucgcagugcagguuaaaaugauccaugacgccauucggaaccguaagaagagauuuguguuccucggcgaggcuaucacauugaaacccagcgucgggauuuuuauaaccaugaauccuggauacgccggcaggacagaacugccagagaaccuaaaggcucuguuccgccccugcgcaaugguggccccugacaucgaacucauuugugagauccuucugguagcugaaggguuuguggaugcccgggcauuggcgcgaaaauucaucacucuguauacccucugcaaggagcuguuaucaaaacaggaccacuacgauuggggacuuagagccauuaaguccguucuggucguggcuggcagucucaagaggggugacaaaaaucgcccggaggaucaggugcuaaugcgggcccugagagacuuuaacaugcccaagauagucacggaugacaucccaguuuucuuggggcuggugggagaucucuucccugcacuugacguaccccguaggcggaaacugcacuuugaacaaauggugcgccagucuacauuggagcugcgacuccagccagaagagagcuucauuuuaaaggucgugcagcuggaggaacuucuggcuguuagacauuccguguuugucguaggcaaugccgguaccggcaaaucaaagauccuaaggacucucaaccggaccuaugugaauaugaagcaaaaaccuguuuggaacgaucugaaucccaaggcagugacaacugacgaguuguucggguuuauucaccaugccacccgcgaauggaaagacggaaagaucgucuacucuuauuucauaggccuguuuagcaguauccucagagagcaggcuaaccuuaaacacgaugggccaaaguggauugugcuggacggagauaucgacccgauguggauugaauccuuaaacacggucauggaugacaauaaagugcugacauuggcgagcaacgagaggaucgcccucaccccuuucaugcgacugcuauuugagauacaccaucuucggucugcaacucccgcuacaguuucacgugccggcauucuguacgugaauccacaggaucucgguuggaaccccuacguagccuccuggaucgacagacgcaggcaccagagugaaaaggcaaaucugaccauuuuguucgauaaguaugugccugcuugucuggacaaacuccggacuagcuuuaagacaaucaccucgauaccagagucuucccuuguccaaacgcugugcguuuuacuggaaugcuugcucacucccgagaacgugccuagcgauucaccgaaagaagucuacgagguguauuucguauuugccuguaucugggcguucgggggaacccugcuacaggaccagauuagugauuaccaagcugacuucucuagaugguggcagaaggagaugaaagccgugaaguuuccaucccagggcacaaucuucgacuauuacguugaucauaagaccaagaaacuucugcccugggcagacaaaauugcccaguuuacaauggauccugacgugccccuccaaacuguccuggugcacaccacggaaacagcucgcuugagguauuucauggaguuacugcucgaaaaagguaaaccacuuaugcuggucggcaaugcaggggugggaaagacuguuuuuguaggcgauacccuagccagccugucagaggacuacaucgugagucgagucccuuucaacuacuauacaaccagcacugcgcuccagaagauauuggaaaaaccccuggagaagaaagcugggcauaauuacggaccaggcgguaacaagaaacuuauuuauuuuaucgaugacaugaauaugccugagguggaucuguacgggaccguucagccgcacacacucauccggcagcacauugacuauggacauugguacgauagacaaaaggugauguuaaaggaaauccacaacugccaguaugucgccuguaugaaucccauggugggcuccuucacgauaaacccaaggcugcagcgccauuuuacuguauucgcauuuaauuucccuucuuuggacgcccugaacaccauuuacggccagaucuuuagcuuccacuuccaacagcaggcuuuugcccccuccauucuccguucagggccaacacuuauccaagcaaccauagcuuuccaccagacuaugaugugcaacuuucugccuacagccaucaaauuccauuacauuuuuaaucuacgggaccugucuaacguguuccagggaauccucuuugcgagucccgaguguuugaaggguccgcuggaucuuauucaccugugguuacaugaaucggccagaguuuauggcgacaaacucaucgauaagaaagacugcgaucuguuccagaggcgcauguuggagaccgcauacaaguauuuugaggggauugacagccacaugcugcuccaacagccacuuaucuacugucauuucgcugaucgaggaaaagacccucacuauaugcccgucaaggauugggaagugcugaagacgauacuaacugagacacuggacaauuacaacgaacucaaugccgcaaugcacuuggugcuguuugaggaugcuaugcagcaugucugccggauuuccagaaucuuaaggaccccacagggcugugcccuucugguugguguagggggaucuggcaaacaaucacucagccgccuggccgcguauuugagaggccuggaaguauuccagaucacccucacugagggguacgguauucaagagcuucggguggaccuggcuaaccuauacauaaggacaggagcaaagaauaugcccaccgucuuccuguuaacagaugcccaggugcucgacgaauccuuucugguuuugaucaacgaccuucuggcuaguggcgagauuccugaucucuucucugacgaagauguggacaaaaucauuagcgggauccacaaugagguccaugcccugggaaugguggauucacgugaaaacugcuggaaguuuuucauggcacgaguacgcuugcaacugaaaauaauccuauguuuuuccccgguuggcagaacucuccgggugagggcccgcaaguuccccgcuauugucaauugcacggcgaucgacugguuucacgccuggccacaggaggcacuugugagugugagcagacgguucauugaggaaaccaaggguaucgagccuguccauaaagauucuauaucccuguuuauggcucacguucacacaacugugaacgaaaugucaaccagguauuaccagaaugagcgacgucauaacuauacaacccccaagagcuucuuagaacagauuucgcuguuuaaaaaucuccugaagaaaaagcaaaacgagguaucugagaagaaagaaagauuggugaacgggauccagaaacuuaaaacuacggccagucaggucggagaccugaaggcacgccucgccucccaagaggcugaacugcagcuacggaaucacgaugccgaggcguugaucaccaaaauuggccugcagacagagaaggugagcagggaaaagacuauagcagacgccgaggaaagaaaaguuaccgcuauccagacagagguguuccaaaagcagcgcgaaugcgaggccgaucuccuuaaagcagagccugcucuggucgccgcuaccgccgcauuaaacacucugaaucgggugaaccucucagaacugaaggcguuuccaaaucccccuauugccguaacaaacguuacggcugccgugauggucuugcuugcaccaaggggccgagugcccaaagacagauccuggaaggcugccaagguuuucauggggaaaguggaugacuuccugcaggcacucaucaauuacgacaaggagcauauuccggaaaacugucugaaagucgugaaugagcacuaucuaaaggauccugaauuuaacccaaauuuaauccggaccaaaucuuucgccgcggcuggacugugcgccuggguaauaaacaucauuaaguuuuacgagguguauugugacgucgagcccaaaaggcaggcauuggcccaagcuaaucucgaacuggccgcagcuacugagaaacuugaagccauccgcaagaaacugguugaucucgaccguaaccugagcagauugacagcgaguuucgagaaggcuaccgccgaaaaagugcgaugccaggaggaggucaaucagaccaacaagacaauuaaacuugcaaacaggcuggugaaggaacuagaggccaagaaaauccgguggggucaguccauuaagagcuuugaagcucaagagaaaacucucuguggcgauguacuguuaacggcagccuucgugucuuacguugggccuuuuacccgccaguacagacaggagcuggugcacugcaagugggucccauucuugcaacagaaagugucaauaccccucacagaaggacuggaccuuaucaguaugcugacugaugacgcgaccauugccgcuuggaauaacgagggccucccguccgauaggaugagcacagaaaaugcagccaucuugacccauugugagcgguggccucugguuaucgacccccagcagcaagguauuaaguggauaaagaacaaauaugggauggaucuuaaggucacucaccugggacagaaaggcuuuuuaaaugcuaucgaaacggcccuagcauucggcgacgugauucucaucgagaaccuggaggaaacaauugacccagugcuggauccuuugcucgggcgcaauaccaucaagaaaggaaaguacauaagaaucggugacaaggagugcgaauuuaacaaaaauuuccgacugauucuucauacuaagcuggcuaacccccacuauaaaccagaguuacaggcccagaccacacuccugaauuuuacuguaaccgaagauggcuuggaggcgcaacuucuggccgaggucgugucuaucgaaaggcccgaccuagagaagcucaaacugguucugacaaagcaucagaacgauuucaaaauugaauugaaguaccucgaggacgaucugcuucugcgguuaucggcagcugaagggucauuccucgacgauacgaagcugguggagcgucuagaggccaccaaaacuacagucgcagaaaucgagcacaaggugauagaagccaaagagaaugagcgcaagauuaacgaagcuagagaguguuauaggccuguugccgcgcgggcuagcuugcuguacuuugugaucaaugaccuucagaaaauuaacccacucuaucaguucucccugaaggcauuuaacguacuguuccacagagccaucgaacaagcugauaaggucgaggacaugcagggacgcauaaguaucuugauggaaucuauuacccaugccguguuucuuuacacuagccaggcacucuucgagaaagauaagcugacauuuuuaucccagauggccuuccaaauccugcuaagaaagaaggagauugacccgcucgaacuggacuuuuugcugagguucaccguggagcacacgcaucuuucacccguugauuuucucaccagucagucuuggagcgcuaucaaagcgauagccgucauggaagaguuccggggcauugacagagauguggaagguuccgcaaagcaguggcguaaguggguagagucagagugcccugaaaaagagaagcugccacaagaauggaaaaagaaauccuuaauccagaagcugaucuugcuccgcgccaugaggcccgaccggaugacauacgcucugagaaauuuuguggaggaaaaacuuggggcaaaauaugucgagcgaacuaggcuggaucuagugaaggccuucgaggaaucuuccccugcuaccccaauuuucuuuauccucagucccggaguugacgcccugaaagauuuggagauacugggcaagcgccuuggcuucacaauugacagcgggaaauuucacaacgugucgcucggacagggucaggaaacugucgcggagguggcacuggagaaggccuccaaaggcgggcacuggguuaucuuacaaaaugugcaucugguagcuaagugguugggaacccucgaaaagcugcuugagcgguucucucagggcucacacagagauuacagggucuuuaugagcgccgaaagugcaccuacaccggacgagcauauuaucccacagggucugcuagaaaacuccauaaaaaucaccaaugagcccccuacugggaugcucgcuaaccugcacgccgcguuguauaauuucgaucaggacacgcuggagauuuguucuaaggaacaagaguuuaaaagcauccuuuucucauuaugcuacuuucaugccugcguggcuggccgccugcguuucggaccccagggcuggucccggaguuauccauuuaacccuggggaucucacaauuugugcaagcguucuguacaauuaucuagaagccaacucuaaggugcccugggaggacuugagauaccuguucggagaaaucauguacgguggccacauuaccgacgauugggaccgaaaacucugcagggucuaucuugaggaguuuaugaauccaucacugacugaagaugagcucaugcuggcuccgggguucgcagccccucccuacuuagacuaugcuggauaccaccaguauaucgaagagauguugccacccgaauccccugcccuguacggccuucauccaaacgcagagauagaguuccugaccgugacaagcaauacgcucuuucgcacccugcuagaaaugcagccccggaacgcccuuucuggugaugagcuggggcaaaguacugaagagaagguaaagaaugugcucgacgauaucuuggagaaacugccugaagaguucaacauggcggaaauuaugcagaagaacucgaauagauccccguaugucuuaguuuguuuucaggagugcgaaaggaugaacauccugauucgcgagauaagaaucagccucgagcaacuugaccugucauugaaaggcgaacuggcucucucuccagccguggaggcacagcaguucgcccuaagcuacgauacagugcccgacaccugguccaagcuggcuuacccuaguacuuauggacuugcccagugguuuaaugaucugcucuugcggugucgagaacuggacacauggacccaagacuuaacacugccagcagucguguggcucucaggcuucuuuaacccccagucuuuccuuacugcuauuaugcagaccauggccaggaaaaaugaguggccucuggauaagacgcguuugaccgcggacguuacaaagaaaacuaaggaagauuacgggcaucccccaagagagggagcauaucugcauggucucuuuauggagggcgcccggugggacacccaggcugggacaaucguagaagcccgccuaaaagagcuggcuugcccgaugccugugauuuucgcaaaggccacucccgucgauaggcaagaaaccaaacagacguacgaguguccaguguaucgaacaaaguuaagaggaccuagcuacaucuggaccuuucggcugaaguccgaagagaaaacugcgaaguggguucucgccggcguggcucuuuugcuggaggcauga

SEQ ID NO: 55367 - RNA, 11895 nt, Artificial Sequence
  derived and/or modified sequence opt3 from DNAH12__Homo_sapiens__NP_001278590
augagcgaugccaacaaggcugcaaucgccgcggaaaaggaagcucugaaucucaaacuucccccuauugugcaucugccagagaacauaggcgucgauaccccgacacaguccaaauuguuaaaguacagaaggucuaaagaacaacagcagaagaucaaucagcugguuauugacggggccaagcggaaccuagaucgcacucucggaaaacgaacgccccugcuuccuccacccgacuauccucagaccaugacaucagagaugaagaaaaaggguuucaauuacaucuauaugaaacagugcguggaaaguagcccacugguacccauucagcaggagugguuggaucacaugcuccgucugaucccugagucccugaaggaaggcaaggagagagaagaacucuuagagucucugauaaacgaagugucgucagacuuugagaauagcaugaaaagguaccuuguccaaaguguguugguuaagccaccggugaaaucccuggaagaugaaggcgggccccuaccugaaucuccagucgggcucgacuauagcaaccccuggcacuccucauacgugcaggcacggaaucagaucuucaguaaccugcauauuauccacccuacuaugaagaugcuucuggauuuggguuauaccacauuugccgacaccguacuccuggauuucacugggauucgcgcuaaaggaccaaucgacugugagagcuuaaagacagaucugucuauacagaccagaaaugcagaggagaagauuaugaacacgugguaccccaagguuaucaaucucuuuacuaagaaagaggcccuugaaggcgugaagccggagaaacuggacgcuuucuacuccugcgucucaaccuugaugagcaaccaacuaaaggaccugcucaggcggacaguggaaggcuuugugaaacuguucgauccuaaggaccagcagcgccuucccauuuuuaagaucgagcugacuuucgaugacgauaaaauggaguuuuauccaaccuuccaagacuuggaagauaauguccucagucugguugagcgaaucgccgaagcguuacagaacgugcagacaauuccuucuuggcuguccgggaccagcacgcccguaaaccuagacacugagcucccagaacaugugcugcacugggcagucgauacacuuaaggccgcugugcacagaaauuuggagggagccaggaaacauuacgagaccuauguugaaaaguacaacuggcugcucgacgguacugcaguggagaauauagaaacauuucagaccgaggaucacacguucgacgaguauaccgaguucaucgagaaauuucugucgcuugcuucugaaauuaugcuguugccccaauggauccauuacacaaugguccggcucgacugugaggaucugaagacuggcuuaaccaacaaggccaaagcguucgccaauauacugcuaaacgacauugcauccaaguaucguaaagaaaaugagugcaucuguucagaguuugaagcuaucaaggagcacgcccucaaagugccugaaacaacugaggaaaugauggaucugauuaguuacguagagaaggcucgcaccguugggaucgaggaacuuauuuugagaauacaggagagcaagaggcagauguccuacuuccuggacguguuucucuucccacaggaagaucuggccuuaaacgcaacaguccugauguggccgcggaaaaucaaucccauuuuugacgagaacgaugaacuuaucgagaaugccaagcacaaaaaggagaacgaauugauggcuaaacgagagaagcucauccuggaaauugagaaagagucucgcagaauggaagaguucaccgaauuugcggagcuagaaaggaugcaacaguaugugacugacguccggcagcugcagaagcgcauacaagagagcgaggaagcagugcaguucaucaauaaggaggaagaacucuuuaaaugggaacugacgaaguacccugagcuugauaaauugaagguuaacauugagccauaucagaaauucuuuaauuucgugcugaaguggcagagaucagaaaagagguggauggacggaggcuucuuagaucucaacggugagaguauggaagccgacguagaggaauuuucccgugagaucuucaaaacacugaaguuuuuccaaaccaaacuuaagaaagagcugcaggaaaagcggaaggcugcccgaaaaagguccuuggaggaagagaagauugaggaggagcccaaagauaacgcaacuaucaccaugugcucuacagucauggaacagauaaaggccuuuaaagaguacaucccuaccgugucaauucucuguaauccagggaugagggcucgccauuggaagcaaaucagugaaauuguuggauaugaccugacucccgacagcggcacaacgcuacggaaggugcugaaacucaaccugaccccguaccuugagcaguucgaggucaucuccgccggcgcaucuaaggaauuuucguuggagaaagcgaugaauacuaugauagggacaugggaagauauugcuuuccacaucagccuguauagagacaccggagugugcauuuuauccucaguagaugagauccaggccauacucgacgaucagaucauuaagacacaaacuaugagggguaguccuuuuaucaaaccauucgaacaugagauuaaggcaugggaggaccgccugauccgaauacaggaaaccauugaugaguggcuuaaagugcaggcccaguggcuguaccuagaacccaucuuuuguucugaggacaucaugcaacagaugccugaagagggccggcaguuccagacgguugaucgucacuggagagacauuaugaaguuuugcgcuaaggaucccaaaguccucgccgcaaccagccugacaggguugcuggagaaguuacaaaacuguaaugaacuccuggagaaaaucaugaagggacuuaacgcuuaccuggagaagaagagguuguucuucccacgcuuuuucuuucucuccaaugacgagaugcuggagauucuaucagaaacuaaggauccucugcgggugcagccccaucuuaaaaagugcuucgagggcauagccaaacucgaauuucugccaaacuuggacaucaaggcgauguauagcucugagggugaaagaguggagcugauugccuuaaucuccaccagugcugcaagaggggccgucgagaaauggcucauucagguugaagaccugaugcuucgaagcgugcacgaugugaucgcugccgcacgccuggcguacccggagucugcccggagagacuggguaagggaauggccuggccaagucguguugugcauaucccagauguucuggacaucagagacucaggaaguuaucaguggaggcaccgaggggcucaagaaguauuacaaagagcugcagaaucaacuaaacgaaauuguggagcugguccguggaaaacuuagcaaacagacgcgcacaacccucggugcucuggugacuaucgauguucacgcccgggacgugguaauggauaugauuaagaugggcgucucgcaugacacagacuuuuugugguuagcacagcugagauauuacugggaaaaugagaacgcuagggugcgaaucauaaauuguaacgugaaauaugccuacgaauaccucggaaauagcccccggcuggucauuaccccacuuacugaccgcugcuauagaacccugaucggagcauucuacuugaaccuaggcggugcccccgaggggccugcuggcacaggaaagacggagaccacuaaggaucuggcgaaagcccucgcaguucagugugugguauuuaacugcucugacggccuggauuaucuugcuauggggaaguucuuuaaaggauuagccagcucaggugccugggcuuguuucgacgaguucaauaggaucgaacuggaagugcucagugucguggcacaacagauuuugugcauacagcgggccauccagcaaaagcugguuguguuugucuucgagggcacagagcucaaacugaacccaaauuguuuuguggcgauuaccaugaaccccggguacgcuggacgauccgaacuuccugacaaucugaagguuuuguucagaacaguggccaugauggucccgaacuaugcacuaaucgccgagauuucucuguacagcuauggcuuucucaaugcucgcccauuauccguaaagaucgugaugacuuacaggcugugcucagaacagcuuagcagucaguuccacuacgauuaugguaugcgugcaguuaaagccgugcuggucgcggcugggaaccucaaguugaaauaccccaaugagaacgaagacauacugcuccugcggucuaucaaggaugugaaugagccuaaauuucuuucccaugacauuccacuauucaacggcaucaccagcgaucuguuucccggaauuaaguugccugaggccgacuaucacgaguucuuagagugugcacacgaagccugcaauguacauaaccugcagccggugaaauuuuuccucgagaagaucauacaaacguacgaaaugaugauugucagacacggcuuuaugcugguuggggagcccuucgcugccaagacaaaagugcuucaugugcuggcagauacccucacuuugaugaaugagcacggauauggcgaagaggaaaaggucaucuacaggaccgugaacccaaaaucgaucacaaugggucagcuguucgggcaguuugacccuguuucacaugaguggacugauggaauuguagcuaacaccuuccgcgaauuugcccuaucugagacacccgaccgaaaguggguggucuucgauggcccaaucgacacgcuguggauagagaguaugaauaccgugcucgaugacaacaagaaacuuugucugauguccggugaaauuauccaaaugagcccucagaugucuuuaauuuuugagacuauggacuugagccaggcgucccccgccacaguuucaagaugcggcaugaucuaucuggaaccaagucagcucgggugggagccgcuggugagcucuuggcuuaauucccugaagggaccucucugcgagcccgaauaccaagcauugcugcggggcuuauucgcuuggcuaauaccacccucacugaaccagagggucgagcucuuucagcuuaauuaccuguauaccacuauugugaguaaaaucuugaagauccugauuacauuccgcaucagcaacuacuuuaaauauguaccucucaagacccaguguacguucauuaaauuuuuccugcaccaacaggccugcuuuauauucucccuuaucuggucuauugggggaucgugugauacugacggccguagagucuucgauaccuuuauccggcucaucauucuggguaaggacgaugaaaauccagugcccgacagcguugggaagugggagugcccuuucgaugaaaaaggauugguguacgacuauauguacgagcugaagaacaaaggaagguggguccacuggaaugaguuaauaaagaacacaaaucuaggugauaaacagaucaagauucaggacaucauugugccgaccauggauacuauccgcuauacauuucugauggaccucucaauaaccuacgcuaagccacuucuguucguuggccccacagggacuggaaaauccguguacgucaaggauaaauugaugaaccaucuggaaaaggaccaauauuuuccuuucuacaucaaucucagugcacgaaccucugccaaccaggugcagaauauuaucauggccagacuggacaaacggaggaagggcguauuugggcccccaaugggcaagaaguguauuaucuucauagaugacaugaacaugccugcucuugagaaguauggcgcgcaacccccaauugaauuacugcgccaguuuuucgauugcggucacugguacgaccucaaagauacgagcaagaucacauugguggacauugagcugaucgcagccauggggccuccgggaggcgguagaaaucccguuaccccaagguguauacggcauuuuaacaucugcuccauuaacucauucucugaugaaacuaugguccguaucuuuagcaguauuguggcuuucuaucuacgcacccacgaguucccucccgaguacuuugugaucggcaaucagauagucaacgggacaauggaaauuuauaaacaguccguagagaaucugcucccaacuccuaccaagagccauuacacguucaaccuucgagacuuuucuagagugaucaggggaugucuguugaucgaacgggaugccguugcaaauaaacacacaaugauucgccuguucgugcacgagguccucagaguguuuuacgacaggcugaucaacgaugacgaccggcgaugguuauuccaacuuaccaagacuguuauaaaggaucauuuuaaagaaucauuccacuccauuuuuagucaucugagaaagcagaaugcccccgugacagaggaggaccuccgcaaccuaauguucggcgauuauaugaauccggaccuggaaggggaugacagggucuacaucgagauuccaaacauccaccacuuuagcgaugugguagaccagugcuuggaugaauauaaucagacccauaaaacucggaugaaccuggugauauuccguuacguucucgagcaccuuucgagaaucuguaggguccugaagcaaucuggaggcaaugcuuugcuggugggucucgggggauccggccgccagagcuuaacacggcuggcgaccucaauggccaaaaugcauauuuuucagccugagaucaguaagucuuauggcaugaacgaauggcgagaggacaugaaggggcuucugagaaaugugggaaugaaaggucagaagacggucuuccuaauuacugauacccaaaucaaagaagaggcauuccucgaagacauugauuccguucugaacacaggcgaggugcccaacaucuuugcugccgacgagaagcaggaaguaauggagggggugaggccagucgcacaggccggaaauaaacacgacgaauugagcccccuggcucucuucgccuuuuucgugaaccgcugcaaggauaaucuucauguuguggucgcguuuucaccuauaggcgacgcauuccggaacagacugcgucaguuuccgaguuuaauuaauugcuguaccaucgauugguuccaaagcuggcccgaggacgcccuggaaaggguagcugugaaguuuuuggagacacucgagcugacugaaguugagcagcaggaaaucgugccaauuugcaaacacuuccacaccuccauaauggaucuaucugagcgguuucuucaugaacugggucgccacaacuacgucacggccacaagcuaucucgagcugaucggguccuuccgacaauugcugacucagaagagacaggcugugauggaggcaaaacagagguacaugaauggacucgacaaacuugccuuugcugaaucacaagucggcgagaugcagauggaacugguggaguuacagccuaaacuggaggaagccaagauugagaacgcaaauaugaugcagguuaucgaaauugagucugugcaaguagaagcgaaacggcaguucgugaaguuggaugaggagaucgccaguggcaaggcugaagaggcccaggcacucaaaaacgaaugugagucggaccuggcugaagccauacccgcacuagaggccgcucuuagcgcgcuggauacccucaagccugccgacaucacaauugucaaauccaugaagaauccacccucugggguuaaacuggugauggcagcugucugcgugaugaaggauaucaagccugagaaaauuucagacccaagcggaaccgguggcaagaucuuggacuacugggggcccuccaaaaaguuacugggagauaugaacuuccuccgcgaccuuaaagaauaugauaaggacaauauaccgguaacugugaugcagaagauuagaagugaguaccugaugaacccugaauuugauccacccaaaguugccaaggccucuagcgcagcugagggccuauguaaauggaucauggccauggaaguguaugacagggucgcgaagguggucgcuccuaaaaaggcccgacugucagaggcacaaaagucccucgccgagaccauggaauugcugaaucagaaacgggcugagcuugcagaaguggagcaucaccuggagaaccuccagaugacauucuuagaaaagacggaggaaaaagccgcgcuggaggaucaaguugaauugugcgcuaagaaacuggagcgugccagucagcucaucggugggcuuggaggcgaaaagucaagaugggcacaggccgcugacgaucugcagauuacuuacgaaaaccuaaccggcgacguacuggugucugccggggucauagcauaucucggagcuuuuacauccgguuuccgccaaaccuguacuaaggauuggucaauguugugcaaaaagaaaaagaucccauguagcgaggaauuucugcuuucgaaaacacugggcgaccccgugaagauuagggccuggaauaucgcgggguuaccgaccgauacguucucuauugacaacggaguuaucgugaauaacugccggagauggccucucaugauagacccccagggccaggccaauaaauggaucaagaacagugagaaggaaaaucagcuguccgucauuaaauugagcgauucagacuacaugcgcacucuggagaacuguauccaauuugguacaccacuccuucuggagaaugugggggaagaacuagauccuucccuggaaccccucuugcugaggcagaccuucaagcagggaggcauugacugcauccgauuaggcgagguaauuauagaauauucuuuugauuucaaauuuuacaucaccacuaaacuucggaacccacacuacaugcccgagcuggcaacaaaagugagccuccugaauuucaugauuaccccugagggguuggaagaccagcugcucggaaucguugucgcuaaggagagaccagaacuugaggaggaaaggaacgcccugauccuacaaagugcagcuaauaagaaacagcugaaggauauugagaaaaagauauuagaaacacucuccagcucugaggguaacauccuggaagacgagucagccauuaaaguguuggauagugccaagaugauguccaaugagaucacuaagaaacagcaaauugcggaaaagacggagcuuaaaaucgcugaaagccgcgagggcuaucguccgauagcaaagcauucuucggugcuguuuuucucaaucgccgaccucgcuaacauugaucccauguaccaguauagccugaccugguucgucaacuuguacaucaauuccauucacgacaguaacaaaucuaagauccuggaaaagcggcuaagauaucucaaugaucauuuuacauacaaccuuuauugcaauauauguaggagccuguucgagaaagacaaguuacuguuuuccuuccuccugugcgccaacuugcuucuggcacgcaaagagauugaauaccaggagcucauguuucugcuaacugggggaguuucauugaagagugccgagaaaaauccugacccaaccuggcugcaggauaagucuugggaagaaaucugucgagcuagcgaguuccccgcguuucggggccucagacaacacuucugcgagcauauuuacgaauggagggagaucuaugacuccaaagaaccucacaacgccaaguuuccagcacccauggauaagaaucuuaacgagcugcagaaaauaaucauuuuacgcugucugagaccugacaagaucacaccggcuauuaccaauuacgugacugauaaacucgguaagaaauucguagagccacccccuuuugaccugacgaagucauauuuggauagcaacugcaccaucccccuuauauucgugcugucuccaggggccgacccuauggcaucccuccugaaguucgccaaugauaaaaguaugagcggaaacaaguuucaggcuauuucgcuaggccagggccaagggcccaucgccgcgaaaaugaucaaggcagccauugaagagggaacaugggucuguuuacagaauugccaccuggcuguguccuggaugccaauguuggagaagaucugugaggacuucacuucugaaaccugcaacagcagcuuucggcucuggcugacaaguuacccguccucuaaguucccuguuaccauacuucagaacggugugaagaugacuaaugagcccccaacaggccugaggcucaaccuguugcagagcuaucuuacggaucccgucucagacccugaguuuuucaaagggugucguggaaaggaacuggccugggagaaacuacucuuuggcgugugcuucuuucaugcacugguacaagaacgaaagaaauucgguccauuaggguggaauauucccuacggcuuuaacgaguccgaccugcgcaucaguauuagacaguugcaacucuucaucaaugaauaugauaccauaccuuuugaggcuaucagcuaccugacuggagagugcaacuacggcgggcggguuacagacgauugggacaggcgccuucugcucaccauguuggccgauuucuauaaucuguacauuguggaaaacccgcacuauaaguucucuccaucaggaaauuacuuugcucccccuaaggguaccuaugaggacuacaucgaguucauuaaaaagcugccauuuacacagcaucccgaaaucuucggccuucacgaaaacgucgauauuuccaaagacuuacaacagacuaagacgcuauuugagagccuccugcugacccaagggggaucuaaacaaacaggcgccagugguucgacugaucagaucuugcucgagauaaccaaggacauccugaauaaacuuccuuccgauuucgacauugaaauggcacugagaaaguaucccgugcgguacgaggaaagcaugaacacaguguuaguccaggagauggagagguuuaauaaccucaucauuaccauacgaaauacucugcgugauuuggaaaaggcgaucaaagggguugugguaauggacucagcccuugaggcucugucuggcagccuacucgugggaaaggucccagaaauuugggccaaaagauccuacccgagucugaagccucugggcucauauaucacggacuucuuggcacgccucaacuuucugcaggauugguacaacucugggaaacccuguguguucuggcuuagcggauuuuucuuuacacaggcuuuccugaccggugccaugcagaauuaugcacggaaguacacuaccccaauugacuuacucggcuaugaguucgaaguuaucccuuccgauacaagugacacuagccccgaggaugggguguacauacacggacuguaucuagacggcgccaggugggauagagaguccgguuugcuggcggaacaguacccaaaacuucucuuugaccugaugccuaucauuuggaucaaacccacccagaagucucgcauuaucaaaucagaugcuuacgucugcccgcuguauaagacaagcgagcggaaagggacguugucgaccacuggccauuccacaaacuucgugauagccaugcuucucaagaccgaccaaccaacuaggcacuggauuaagcgaggaguagcacuguuaugucagcuggaugacuga

SEQ ID NO: 55368 - RNA, 13389 nt, Artificial Sequence
  derived and/or modified sequence opt3 from DNAH17__Homo_sapiens__NP_775899
augacaauggcccccgaugugagacuggaauaccucgaagaagucgcuagcaucguucuuaaguucaaaccugauaagugguccaaacugauuggcgccgaagaaaacguggccuuguuuacagaguucuuugaaaagccagacgugcaaguguuaguccugacucuaaaugcggcugggaugauaaucccgugccucggauucccccaaucucugaaaucaaaggguguguauuuuauuaagacgaaaagugaaaacaucaauaaggauaacuacagggcccggcuucuguauggcgacauuagcccuaccccaguugaucaguugaucgcuguggucgaagaagugcucuccucucugcugaaucagucggaaaacauggccggguggccccagguaguuucagaagacauugugaaacaaguccaccgccucaagaaugaaauguucgugaugagcggaaaaaucaagggcaagacauuacugccuauuccagaacaucuugguaguuuggaugggacucuggaguccauggaacgaauccccucuagccuagacaaccuccugcuucacgcuauugagaccacaaucauagauuggucccaucagauucgugacgugcugucaaaagauagugcucaggccuugcucgacggacugcacccuuuaccacaggucgaauuugaguucugggauaccagacugcucaaucuuaaguguauccaugagcaacugaacaggccgaaaguuaauaagauuguggaaaucuuggagaaagcuaagagcugcuacuggcccgcccuacagaacguauauacuaaugugacagaaggccugaaagaggcgaacgacaucguccucuaccugaagccucuucggauucuguuggaagagauggagcaggcagacuuuaccaugcucccaacguucauagccaaggugcuggauacuaucuguuuuauuugggcuaccucugaauauuacaauacacccgcccgcaucauaguuauuuuacaggaguucugcaaccaaaucaucgaaaugacuagaaccuuucuguccccugaggaagugcuaaaaggccuccagggggagauugaggaaguccugucaggaaucagccuugcagugaacguauugaaggagcuguaccagacauaugacuucuguugcguuaauaugaaacucuucuuuaaggauaaagaaccagugcccugggaguucccgaguucucuggcuuuuuccaggauuaacagcuucuuucaacggauacagaccaucgaggaacuuuacaagacggccauugaguuccugaaguuggagaagaucgagcucgguggcguccgcgggaaucuguuaggaucgcuggugacucgaaucuaugacgaagucuuugagcuagugaagguuuucgcggauuguaaauacgacccucucgaucccggcgacucuaacuuugauagagacuaugccgauuucgagauuaagauacaggaccuggacaggcggcuugcaacaaucuuuugccaggguuucgaugacuguuccugcauuaaaucaagugcuaaguugcuguacaugugugggggacucauggaacguccacugaucuuagccgagguggcuccucgcuauagcguaaugcuggaacuuuuugaugccgaguuggacaaugcaaagauucucuacgaugcccaaauggcugcguccgaagagggcaacaucccccugauacacaaaaauaugccacccgucgcaggccagcuaaaguggucucuggagcuccaggaaagacuggaggugagcaugaaacaccuuaagcauguugaacacccugugaugucaggggccgaggcuaaauugaccuaccagaaguaugacgaaaugauggagcuguuaaggugccaucgggagaagaucuaccaacagugggucgccggaguggaucaggacugccacuucaaccucggucagccacugauucuucgagaugcagccaguaaucugauccacguaaacuucuccaaggcuuugguggccguucuccgcgaagucaaguaucugaauuuucaacagcagaaagagauuccggacagcgcagaaucucuauucucagagaacgagacuuuuagaaaguucgugggcaaucuggaacucaucguggggugguacaacgagauaaaaacaauugucaaggcgguugaauuucugcuuaucaaaagugaguuggaagcuauugaugugaagcuguuaagcgccgagaccacgcuauucuggaauggagagggcguguuucaguauauccaagaaguaagggagauacugcauaaccuucagaaccggaugcagaaggcaaaacaaaauaucgaagguauuucccaggccaugaaggacuggucugcuaacccccuguucgagcgcaaagauaauaagaaagaagcccuacucgaccuggacgggagaaucgcaaacuugaauaagagguacgcugccguccgugaugcgggcgugaagauucaggccaugguugcugagaacgcagagcuguuucgggccgacaccuuaucgcucccuuggaaagauuaugugaucuacauagacgauaugguccuggacgaguucgaucaguuuauucgaaagagccuuuccuuccugauggacaauauggugaucgaugagucaaucgcuccauuguuugaaauuagaauggagcucgacgaagauggacugacauucaaccccacucuagagguuggcagugacaggggguuccuggcccuuaucgagggacucgugaaugauauuuacaacguagcacgccugauaccucgguuggcgaaagacagaaugaauuauaagauggaccuggaagauaacaccgacuuaaucgagaugagggaagaggucucuagccucgugauuaaugccaugaaagaggcugaagaguaccaagauuccuuugaacgcuauucauaccuguggacagacaaccuucaggaguucaugaagaauuuucugaucuaugguugugccgugacugcagaagauuuggacaccuggacagaugacaccauuccaaagacucccccgacgcucgcucaguuccaggagcaaaucgauagcuacgagaaacuguaugaagaggucucuaagugcgaaaacacaaaaguuuuucacggcuggcuacagugugacugccgaccuuucaagcaggcccugcuuuccaccauacggcguuggggguuuauguucaaaagacaucucaguaaccacgugacuaauagccuggcagauuuggaggccuuuaugaagguagcuaggaugggauuaaccaagccacugaaagaaggcgacuacgacggucucguggaggucauggggcaucugaugaaggugaaagagcgccaggcggccacagauaacauguucgaaccccuuaagcaaaccaucgagcuguugaaaacuuacggcgaagagaugccugaagagauucaccuaaagcugcaggagcuccccgaacacugggcaaauacuaagaaacuggcuauccagguuaaacuuacgguggccccauuacaagccaacgaggucucuauucugcggagaaaaugucagcaguuugaacucaaacagcaugaguucagggagcgauuccgccgggaagcuccuuuuuccuucucagaccccaauccauauaaaaguuugaacaagcaacagaaaagcaucucggcaauggagggaauaauggaagcccuguccaagucuggcgggcucuuugaggugccgguuccugauuacaagcagcugaaagcgugccacagagaagugaggcuucugaaggaguugugggacauggucguagugguuaauaccagcauugaggauuggaaaacuacaaaguggaaagacaucaacguggaacagauggauaucgacuguaagaaguucgcuaaagauaugcguucacuagacaaggagaugaaaaccugggaugccuuugucggacuggacaauacagugaagaacguaauuacaagucuccgcgcaguguccgaauuacaaaaucccgccauacgggagagacauuggcagcagcugaugcaggcuacccaagucaaauucaagaugucugaagagacgacccuugcagaucugcuccaguugaaccugcacagcuaugaggacgaaguuaggaauaucguggacaaggccgugaaagaguccgguauggaaaagguccucaaagcgcuggauucaacauggagcaugauggaguuucagcacgaaccacauccccgaacuggcaccaugaugcuuaagaguucugaggugcuaguugagacacuggaagacaaccagguacaauugcagaauuuaaugauguccaaauaccuggcucacuuccucaaggaggugacuagcuggcagcaaaagcugucgaccgccgauucagucauuucuaucugguuugaagugcagcggacguggagucaucuugaguccauuuucaucgggagcgaggacauacgcacacagcugccuggagauucucagagauuugacgauaucaaccaagaguucaaagcacucauggaggacgccguuaagaccccaaacguggucgaagcuacuagcaaacccggcuuguauaauaagcuggaggcccucaagaaaucccuggcaauuugcgaaaaagcucucgccgaguaccuugagacaaaaaggcuggcguuuccucgguucuauuucgugucaagugccgauuuauuggacauccugagcaacgguaaugauccgguagaagucucucgacaccucuccaagcuguuugacucacuuuguaaacugaaguucagacucgaugcaagugacaaaccauugaagguggggcugggcauguacagcaaagaggacgaauacaugguuuuugaucaggagugcgacuuauccggacagguggaagucuggcuaaaccgcgugcuggauaggauguguucuacccuccgucaugagauucccgaggcuguugugacuuaugaagagaagccucgggaacaguggauccuugacuacccagcccaagucgcucugaccugcacacagauaugguggacgaccgaggugggcuuggcauucgccagacuggaagagggguaugagaaugccauuagggauuacaacaagaaacagaucucgcagcucaauguacugaucacucuucucaugggaaaccugaaugcuggcgaccgcaugaagauuaugacaaucugcaccauagaugugcacgcgcgagacguugucgcaaaaaugauuguggccaagguggaaagcucacaggcuuuuacauggcaggcccaguugagacaccggugggaugaggagaaaaggcauuguuucgcaaacaucugcgacgcccaaauucaguauuccuacgaguaucuggguaauacuccccgcuuagucaucaccccucuaacggaucguuguuacauaacacugacccagagucuccaccuuauuaugggaggggcuccggcgggccccgccgguacuggcaagaccgagacaacuaaggaccuggggagagcauugggaaccaugguauacguguuuaacugcucugaacagauggacuauaaaagcuguggcaauaucuacaaggggcuggcucaaacaggagccuggggcugcuucgaugaguuuaaccggaucuccguugaagugcucucagucauugcagugcagguuaaaugugugcaggacgccaucagggcuaagaaaaaggccuucaauuuucugggugagauuauagggcuuaucccaacggucggaauuuucaucaccaugaacccuggcuaugcgggucgcgcagaauuacccgagaaucugaaggcccucuuucgaccaugcgcuauggugguaccugauuucgaguugaucugugaaauuaugcugauggccgagggcuuccuagaagcuagacugcucgcacggaaauuuauaacucuuuacacacugugcaaggaguugcugucuaaacaggaccauuaugauugggggcucagggccaucaagagcgugcugguugucgcuggaaguuuaaaacgcggcgaccccuccagagccgaagaucaagugcuuaugagggcacugcgggacuucaacauuccaaagaucgugaccgaugaccucccggucuuuauggggcuaauuggagaucuguucccugcguuggacguuccccguaaacgcgaucugaacuuugagaagaucauaaagcagagcaucguggagcucaaacuucaggccgaagacucuuucguacugaaggugguccaguuggaggaacugcuccaagugcgacacucaguuuuuauugugggcaaugcugguuccgggaaaagucaggucuuaaagagccugaacaaaacuuaccagaaucuuaagagaaagccaguagccguggaccuggaucccaaagcaguuacaugugacgagcuauucggaaucauuaacccugugaccagggaauggaaggauggccucuuuucgacgaucaugcgggaccuggcuaauauaacucaugaugguccaaaauggauuaucuuggacggcgauauugaccccauguggaucgagucucugaacaccgucauggaugacaauaaggugcucacacuugccuccaacgagcgcauaccucugaauagaaccaugagguuagucuucgaaaucagccaucugcggacugcaacaccggccaccgugucacgagcugggauuuuguauaucaacccagcggaucucggauggaaucccguugugaguucuuggauugagagacgcaaaguacaguccgaaaaggccaaccugaugauccuauuugacaaguaccuuccuacaugccuggacaaacucagguucggcuuuaagaaaauaacucccgugccagagauuaccgucauccaaacgauccuguacuugcuggagugccuccuuacagaaaagaccguuccucccgauagcccacgggagcuguaugaauuauacuucguguucacuuguuuuugggcauucgggggagcuauguuucaggaccagcuggucgauuaucguguggaguucucaaaaugguggauuaaugaauuuaagaccaucaaguucccuagucaaggcacaauauuugacuacuauauugauccggacacuaaaaaguucuugcccuggaccgauaaaguacccagcuuugagcucgacccugaugugccccugcaggccucccuaguucacacgacagagaccaucagaauuagguacuucauggaccuucugauggaaaagucuuggccagugaugcucgucgguaacgccgggacuggaaaaagcgugcugaugggcgauaaguuggaguccuuaaauacagacaacuaucugguccaggcagugccuuuuaacuucuacaccacuucagcuaugcuccagggcguucuugaaaaaccccuggagaagaagucugggcgcaauuacggaccgccagguaccaaaaagcuaguauauuuuaucgaugacaugaacaugccugaaguggacaaauacggcaccgucgcaccacacacgcugauacggcaacacauggaucaucgacacugguaugacagacacaagcucacuuugaaagauauccauaauugccaguacguggcguguaugaacccaaccagugggucguucacaauugacagcaggcugcagcgccacuucugcguuuuugcuguguccuuccccggacaggaggcccuuaccacaaucuauaauacuauucugacccaacaucucgcauuucggucugucucaauggccauccagagaauuagcucccaguuaguggcugcagcccuggcguugcaccagaagaucacggcuacauuccugccuacugccauaaaguuucauuacguauucaaccuccgugaucuuaguaauauuuuucaaggccugcuauucucuaccgcagaggugcugaaaacaccgcucgacuugguuaggcuguggcuucacgaaaccgagcgggucuauggugauaagaugguggacgaaaaagaucaggagacucugcaccgcgugaccauggccagcacaaagaaauuuuucgacgauuuaggggacgaacuccuguuugcuaagcccaacaucuucugucauuuugcccagggaaucggcgauccaaaguacgucccuguuacggacauggcacccuugaauaaacugcucguggacguacuugauucauacaacgaggugaaugcugucaugaaccuggugcuauucgaggacgccguugcgcacauuugccgaauaaauagaauccuggaauccccuaggggcaacgcccucuuggugggggucggagguaguggcaagcaaagccugucucgguuagcagcuuauauuuccgggcuugauguguuccagaucacucugaaaaagggauacggcauuccagaccucaaaaucgaucuggccgcacaguauauaaaggcugccguaaagaauguucccucaguguuuuugaugaccgacagccaggucgccgaggaacaauuccuggugcucaucaacgaucuucuggcgucgggugagauuccugggcuauuuauggaggacgaaguggagaacaucauuucuaguaugcgcccacaggucaaaucccugggaaugaaugauacaagagaaaccuguuggaaguucuuuaucgagaaaguuaggcgacaguuaaaggugauacucugcuucagccccguaggcucagugcugcggguccgugcuagaaaauuuccggcagugguuaacuguacugccauugacugguuccaugaauggccugaggaugcuuugguguccgucucugcccgcuuucuugaggaaacagagggcaucccaugggaagugaaggcaagcaucaguuucuuuauguccuacguacacaccacgguuaaugagaugagcaggguguaucuggccacugaacggagauacaacuauacaacccccaagaccuuccucgagcagauuaaacuguaccaaaauuugcuggcuaagaaacgcacugagcuagucgcgaagauagaaaggcucgagaacgggcuuaugaaacugcagucuacagccucacagguggacgacuuaaaggcaaaacuggcuauccaggaagccgagcucaagcaaaagaaugaaagugcagaucagcugauucagguugugggaaucgaggccgagaaagucuccaaggaaaaagcuauugccgaccaagaggaagugaagguagaggugaucaacaaaaaugucaccgagaagcagaaggcgugcgaaacagauuuggcaaaagccgagccugcacuucuggccgcacaggaagcucucgacacucugaacaagaauaaccuaacggagcuuaagagcuuugguucuccacccgaugccguugugaaugucaccgcugccgugaugauacugacagcaccgggcgggaagaucccuaaagacaagucguggaaggcggccaaaauuaugaugggaaagguagauacuuuccucgacucacuuaaaaaguucgauaaagaacacauccccgaggcuugucugaaggccuuuaagccauaccagggcaacccuaccuucgaccccgaguuuauucgaagcaaauccacagcagcugccgguuuaugcaguuggugcaucaauauugugcgguucuaugaaguuuacugugauguggcaccaaagagacaagcccuggaggaagcgaacgcugagcucgccgaagcacaggagaaacugucuaggauaaagaacaaaaucgccgaguugaaugcuaaccuuagcaaucugaccuccgccuuugaaaaggcaacugcugagaaaauuaagugccagcaggaagccgacgcgacgaaccgcgucauccuccuggcuaaucgucuaguagggggauuagccucagagaacauccggugggcagaaaguguugagaauuucagaucucaaggcgucacccuguguggcgauguguugcucauuagcgccuuuguguccuauguaggguacuucacaaagaaauauaggaacgagcugauggaaaaguuuuggauacccuacauccauaaucuuaaagucccuauuccaaucacuaacggacuggacccgcucucacuguugaccgacgaugcugacguggcaacauggaauaaccagggucuucccagcgaucgcaugucuaccgagaaugccacuauucugggcaacacagaacgauggccucuaaucguugacgcgcagcuccaggggauaaaguggaucaaaaauaaguaucgguccgagcugaaggccauuagauuaggacagaaaaguuaccuggaugugaucgagcaggcuauuagcgaaggcgacacguugcucaucgagaacauaggugaaaccgucgauccagugcuggacccccuucuggggaggaacacuauuaagaaaggaaaguacaucaaaauuggcgauaaggagguugaauaucacccuaaguuccgccucaucuugcauacaaaauacuuuaauccacacuauaagcccgagaugcaggcacagugcacccugauaaacuuccuugugaccagagacggccuggaggaucaauuacuagccgcuguagucgccaaagaacggccugaccucgagcagcugaaggcaaaucugacaaaaucgcagaacgaguucaagaucguguugaaggagcucgaagauucccugcuugcuaggcugucugccgcgucagggaacuuuuuaggagacacugcccucguggagaaccuggagacgaccaaacauacagcaagcgaaauugaggaaaagguugucgaggcuaaaaucacugaagugaagauuaaugaggcccgugagaacuaccgaccggcagccgaacgcgcuaguuugcuuuauuucauccugaaugaccuaaacaaaauaaauccaguauaccaauuuucccucaaggccuucaacguggucuuugagaaagcgauucagagaaccacacccgcuaaugaagugaagcagcggguuaucaaccugaccgaugagaucacuuauucuguguacauguacacggcaaggggucuguucgagcgcgacaaguugauuuuucucgcccaggucacauuccaagugcugagcaugaaaaaggaacuuaauccuguugagcuggacuuuuuacucagauuccccuuuaaagcuggcgugguaucaccagucgacuuccugcagcaccagggguggggaggcaucaaggcccuauccgaaauggaugaguuuaaaaacuuggacagugauauagaagguagcgcaaagcgguggaagaaacugguggagucugaggccccugaaaaggagauuuuccccaaagaauggaagaacaaaaccgcuuugcaaaagcucuguaugguuaggugccugcgaccagaccguaugacuuaugcgaucaagaauuucguggaggagaaaauggggucaaaguuugucgagggcagauccguggaguucagcaaaucuuacgaagagaguucgccguccaccagcauauuuuucauccugucaccuggaguagaucccuugaaggacguggaagcccuuggcaaaaagcucggguuuacaauagauaacggaaagcugcacaaugucucuuuaggucaaggccaggagguuguggcagaaaacgcccuggacguggcugcagagaaagggcauugggucauccuacagaauauucaccucguggcccgcuggcugggaacuuuggacaagaaacuggagcauuauagcaccggcucccacgaagauuaccggguuuucaucagugcugagccagcccccucaccugaaacacacauuaucccacaggguauucuugagaacgcgaucaagauaacgaaugagcccccuaccgggaugcaugcaaaccuccacaaagcccuggacuuauuuacucaagauacacuggaaauguguaccaaggagauggaguucaagugcauguuguuugcucucuguuauuuccaugccguaguggcagagaggagaaaauuuggcgcucagggauggaaucgcucuuacccguucaacaauggcgaccugacuaucagcauuaacguccuuuauaauuaccuggaagccaacccaaaggugcccugggaugaccuacgguaccucuuuggggagaucauguauggaggucacauuacagaugacugggauaggcgacugugcagaaccuacuuggcggaguauauacggacggaaaugcuggagggcgacguucuucucgccccuggguuccagaucccacccaaucuggauuacaaaggauaucaugaauacauugacgagaacuuaccucccgaauccccauaucuguacggcuugcacccgaacgcugagaucgguuuccucaccgugacaagugagaagcuguuuaggacuguccuugaaaugcaaccuaaagagaccgauagcggggcaggcacaggagugucccgcgaagagaagguaaaagccgugcuggacgacauucuagaaaagauccccgagacuuucaauauggcugagauaauggcaaaggccgcugagaaaacaccauacgucguuguggccuuucaggaaugugaacguaugaacauccucacaaaugagaugagacgaucucugaaggaguugaaccugggccuuaaaggggaauuaaccauuacuacggaugucgaggaccugucaacagcacucuucuaugauaccgugccugacacuuggguugccagggcguaccccagcaugaugggacuggcugccugguaugcagaucuauugcugcggauccgcgaacucgaggccuggaccacagacuuugcacuuccaacgaccguguggcuggccggcuucuuuaauccucagucguuccucacugcaauuaugcaguccauggcuagaaagaacgaauggccccuggauaaaaugugcuuaaguguagaggugacaaagaagaauagggaggacaugaccgccccgccacgggaagguucuuacgucuauggguuguuuauggagggagcgcgcugggauacucaaacaggcgugaucgcagaagccagacugaaagagcuuaccccugcuaugcccguuauauucauuaaggccaucccagucgaccgaauggaaaccaaaaauaucuacgagugccccguguacaagacuaggauucgggguccuaccuauguguggacguuuaaucugaaaaccaaggagaaggcugcaaaauggauacucgccgcgguagcccugcuacuucaggucuga

SEQ ID NO: 55369 - RNA, 12798 nt, Artificial Sequence
  derived and/or modified sequence opt3 from DNAH1__Homo_sapiens__NP_056327
auggagcagcccaacagcaagggauacucccuggggagaaccccucaaggaccagaauguucuucagccccggcugugcaggucgguacucacagaggccucgaguauaaucccgggaagauccuuccuggaagugacuacggccuggguaacccacccgcauuggauccuaaguuaccacaucugccccuaccuccagccccgcccacucucagcgaccuggggcagccucggaaauccccacuuacgggaaccgauaagaaauauccccugaugaagcagcgcggcuucuacucugacauuuugucgccuggcacacucgaucaacugggggaaguuugccgaggaccacguaugucacagaaucugcucagacaggcggacuuagauaaguuuacucccaggguggguagcuucgagguaccggaagacuuucaggagcggauggagcaacagugcaucggcaguaccacacgccugcuugcucagaccgauuucccuuugcaggccuaugaacccaaaaugcaagugccauuucagguccugccugggcagcaccccagaaagaucgagauugaaaggcggaaacaacaguaccuaucccucgacaucgagcagcugcuuuucucucagggaauugauagcaacaagcugaugccacgccauuuggaccaccaacauccccagacuaucgagcagggccacgauccuauuuuuccaaucuaucucccgcugaaaguguucgacaaugaagacuuugauugucgaacacccagagaguggauuaacauggguuuagaaccugggucccuggacaggaagccaguucccggaaaggcacuccuuccuaccgaugacuuccugggccacgaggauccaaaaucacagaaguugaaauacaaguggugcgaagugggcguccuagacuacgaugaggagaaaaagcuguaucucgugcauaaaacggacgaaaaggggcugguacgggaugagaugggacgucccauccuuaaugccgguguuacuaccgaaggccgcccgccucugcaagugugucaguacugggucccaaggauucaguugcucuuuugcgcugaggaccccuguauguucgcacagaggguggugcaagccaacgcucugcggaagaauacagaagccuuacugcuauauaaccucuacgucgauugcaugccuagugacgggcagcacguuaucagcgagcagucucuguccaaaauuaagcagugggcgcuuucaacuccccgaaugcgcaaaggaccaagcguguuggagcaucugaguucucucgcaagagaaguaucccuggacuaugagaggagcaugaauaagauuaacuuugaucacguggucucgucuaaaccugaaaccuucuccuacgugacacuucccaagaaggaggaagaacaaguuccagagcggggccuggugucagucccgaaauaucacuucugggaacagaaggaggacuuuaccuucgugaguuugcucacgcgcccugaaguaaucacugcccugagcaaaguuagagcugaguguaauaaggugacagccauguccuuauuucauucuagccugucaaaauacagucaccuagaggaguucgagcagauucaaucccagaccuuuagccagguccagauguuccucaaggauucuuggaucucaagucugaagguggcaaugaggagcucccuucgugacaugucuaaagguugguacaacuuguaugaaacuaauugggaggucuaccugaugucgaagcuccggaaacugauggaauuagugaaguauaugcugcaagauacacuucgauuuuugguucaggacagccucgcuuccuucucacaguuuaucagugauaccugcuguucugugcugaacugcacggacgauaugguauggggagacgaucuaauuaacagccccuacagaccaaggaaaaauccccuguucauaauggaccucguccuggauuccucaggcgugcauuauagcaccccucuugagcaguuugaggccucuuugcugaacuuauucgacaagggaauccucgcgacacacgccguuccacaacuggaaaaacuugugauggaggacauuuuuaucuccggcgauccccuguuggaaagugucgggcuccaugagccucugguggaagaauuacgcgcaacuauugcuagcgccguaucuaaagcuaugauuccgcugcaggccuacgcaaaggaguaucggaaauaccucgaacugaauaacaaugacaucgccuccuuccuuaagaccuaccagacacagggauugcuggcucaagaggugagagaaguugucuuaacucaccucagggagaaagaaauccuggauucaagucuuccaagcucgauuaucauuggucccuucuauauaaacaccgacaaugugaagcagucccugucuaaaaagcgcaaggcgcuagcaacaagcgugcucgauauccuggccaaaaacuugcacaaggaggucgacucaauuugcgaggaauuucgaaguaucucccggaaaaucuacgagaagccuaauucuauugaagaacuggcugaguuacgugaauggaugaaaggcauaccagagagacucguugggcuggaagagaggaucgugaaggugauggaugacuaucagguaauggaugaguuccuuuacaaccugagcuccgacgauuuuaaugacaaguggauugccucaaacuggcccagcaaaaucuugggacaaauugagcucguccagcagcagcauguggaggaugaagagaaguuccgcaaaauccaaauaauggaccagaauaacuuucaggaaaagcuggagggccuacagcugguuguggcagguuucaguauccacgucgaaauuucucgggcccaugagaucgcuaaugaggugagaaggguuaaaaagcaacuuaaggacugucagcagcucgccaugcuguauaacaaccgagaacgcauauuuuccuugccuaucaccaauuacgauaaacugagccggauggugaaggaguuccagccguauuuagaccucuggacuacggcaucggauuggcugagauggucagaaucuuggaugaacgacccccuuagugcgauagaugcugagcaacuggagaagaauguagucgaggccuuuaagacaaugcacaaaugcgugaagcaguucaaggacaugccagcaugucaggagguggccuuggauauuagggcucguaucgaagaguuuaaaccuuacauuccccucauccaggggcugcgcaacccaggcaugcggauaagacacugggaaacccuauccaaucaaaucaacauuaaugucaggccuaaggccaaccugacuuucgcacgaugccuugagaugaaucuccaggaccauaucgagagcauuucuaaaguugcugaaguggccggaaaggaguacgcgaucgaacaggcccuggauaaaauggagaaggaauggagcaccauauuguuuaacguauuacccuauaaagcuacagacaccuacauucugaaguccccagaugaggcaucacaacuccuggacgaccacaucgugaugacucagaauaugaguuucagcccguauaagaaaccuuucgagcagcggaucaacucuugggaaaauaaacuuaaacugacacaggaggucuuggaagaguggcuaaacugucaacgcuccuggcuguaccucgaacccauauuuucaagugaggauaucaaucagcagcugccaguggagagcaagagauaucagacgauggaaaggauuuggaaaaagauaaugaagaacgccuacgagaaccgggaaguuaucaaugugugcuccgaccuucgaauguuagauucucugagagacuguaacaaaauucucgauuugguccaaaagggccugucggaguaucucgaaaccaaacgcagcgcuuuccccagguuuuacuuccugucagacgaugagcuucuggagaucuugucccagacuaaggacccuacagccgugcagccacaucuacguaaaugcuuugaaaauauugcacggcuacucuuccaggaggauuuagaaaucacccacauguacagugcggagggggaggaaguucaacuguguuuuucuauauaucccagcuccaacguggaggacuggcuuagagaagucgagaggucaaugaaggccucuguacaugauaucauugaaaaggcuauccgcgccuacccuacaaugccgcgaacucagugggugcugaauuggccaggacagguuaccauugcagguugccaaacguauuggaccauggagguggcugaggcccucgaagcaggcaacuugagaagccagcuguucccccagcucugucagcaacugagugaccuugucgcccuagugcgggggaaacuguccaggaugcagcgcgcuguauugagcgcguuaaucgugauagagguccacgccaaggauguugugucuaaacugauucaggaaaauguggucucagugaacgacuuucaguggaucucccaacuccguuacuauuggacaaauaacgaccuguacaucagagcaguuaaugcugaguucauuuauggauacgaauaccuuggcaacaguggucggcugguaauaacuccucucaccgauaggugcuauuugacacugacuggggcccuacaccugaaguuuggcggagcccccgcuggcccagcagggaccggaaaaacggagacaaccaaggaccucggcaaggcccuugcgauccagacuguggucuucaauugcagcgaucagcuggacuucauggcuauggguaaauuuuucaagggguuagccucggcaggagccugggcuuguuuugaugaguucaaccgcauugacaucgaaguguugucuguuguggcacagcaaauuacaaccauccagaaagcccagcagcaacgagucgagagauuuauguucgaaggcguggagauaccucugguacccuccugcgcggucuuuaucacuaugaauccagguuacgcuggccggaccgaacucccugauaaccugaaggcccuuuucaggccgguggcaaugaugguucccgacuaugccaugauuacagagaucagccuguacucauuuggguucaacgaggcuagugugcucgccaaaaagauuacgaccacuuuuaaguugucuuccgaacagcugagcucacaggaucauuaugacuucggaaugcgcgcagucaaaacagugaucagugcugccggcaauuuaaagagagagaacccaagcaugaaugaagaacugauaugucugagggcgauucgggauguuaacgugccuaaauuucuccaagaggaccuuaagcuguucuccgggaucgucucugauuuguuccccaccaucaaagaagaggacacagacuacgggauucuggaugaagccauccgugaggcaugccgcaauagcaaccucaaggacguggaaggcuuucugacuaaauguauacagcuuuaugagaccacgguagugcgacacggucucaugcugguugggccaacaggauccggcaagucaaccugcuacagagucuuggcugccgcuaugacuucucugaagggucagccuaguauuucgggcgggauguacgaggcagugaauuauuacguguuaaaccccaaaagcaucaccaugggacagcuauauggcgaguucgaucugcucacacaugaguggacugacgggaucuuuuccucuuucauuagggccggagccauaaccucagauacaaauaagaaaugguacauguuugacggcccggucgaugcuauuuggaucgaaaacaugaauacgguacuugacgauaacaagaaacuguguuugagcuccggugagaucauuaagcugaccgaagcgaugacuaugauguucgaggugcaagaccucgcaguugccaguccagcuacagugucucggugcgggauggucuaucuggagccuagcauccuuggauuaaugcccuuuauugaauguuggcugcgcaagcucccacccuugcugaaaccuuacgaggaacacuucaaggcccuauuugugucauuccuggaggaauccauaaguuuuguuagaagcucugugaaagaggucaucgcauccaccaauugcaaccucacuaugucacuucugaaguugcuggauuguuucuuuaaaccguuccuccccagggagggccugaagaagauuccaagcgaaaaauuaucgcggaucguggagcuuaucgaaccuugguucauauuuucucugauuuggaguguaggugccacaggcgacuccagcgggcgaaccucauucucccauuggcucagacuaaagauggagaaugagcagcugacguugcuguuucccgaagagggacucguguucgacuaucgccuugaagaugcuggcaucucugggacuaacgacagcgaggaugaagaggaggaauacaaacagguugcgugggucaaguggauggacaguuccgccccuuuuaccauggugccagauacaaauuacugcaacauuaucgugcccaccauggacacuguccagaugagccaccuguuggauaugcugcucacaaacaaaaagccuguuuuaugcauuggaccaaccggcacagguaagacucugaccaucucugacaaacuucugaagaaucuagcacucgauuauauaucacacuuccugacguuuagugcuaggacauccgccaaccaaacccaggacuucaucgauagcaaauuggacaagcggcguaaagggguguuuggacccccgcugggcagaaauuucauauuuuucaucgaugaccucaacaugccugcacuugagacuuacggcgcccagccacccauugaacuguuaaggcaguggauggaccaugggggaugguaugaucgcaagaucauaggugcuuuuaaaaaucugguagacauuaacuucgugugugccaugggcccuccagggggaggccggaauaccgucacaccccgauugaugagacacuucaacuaccucucuuuugcggagauggaugaagugucgaagaagaggaucuucucaacuauucuggguaauuggcuagacgggcuucugggagagaaaagcuaucgcgagcggguuccgggcgcaccucauaucgcccacuuuaccgaaccccucguggaggcuacgauaauggucuacgccacaaucaccucccaacuguugccaacuccugcuaagagucacuauacauucaaccugagagaucucucuaaaguauuucagggcaugcuuauggcagaccccgccaagguggaagaucagguucaacuguuacgucugugguaccaugagaauugcaggguguuccgggaccgcuuggucaacgaagaggaucgaagcugguuugaccagcuccugaaaagauguauggagcagugggaagugaccuucaauaaggucugcccauuucagcccauucuauacggggauuucauguccccuggaucagacgugaagaguuaugagcuuaucacuucugaaagcaaaaugaugcaaguuauugaggaguacaucgaagacuauaaccagauaaauacagcuaagcugaaacucgugcuguuuauggaugccaugucccacauuuguaggaucucacggaccuugcgccaggcauuagguaacgcgcugcuccuuggcguagggggaagcggcagaucuucccugacgaggcuagccagucauauggcugaguacgaaugcuuccagaucgagcugagcaagaacuaugguaugucggaauggcgagacgaugugaaaaagguccucuugaaggccgggcugcaaaaucuuccaauuacuuuucuguucuccgacacccagaucaaaaacgagucuuuccucgaggauauaaauaacguuuuaaauucaggagacauuccgaaccuguacacagcagaugaacaggaccagaucgugagcaccaugcggcccuauauucaagagcagggcuugcagccuacaaaggcuaaucugauggccgcauacacuggccgugucagaaguaacauccacauggugcucuguauguccccaauaggggaaguauuucgcgccaggcuucggcaauuccccucucuggugaauugcuguaccaucgauugguuuaacgaguggccugcugaagcgcuaaaaagcguugccacgguguuccugaaugagauuccagagcucgaaucaucccaggaggaaauccagggauugauucaggucugcguguacauccaucaaagugucagcaagaaauguauugaguaucuggcagaacuuacaagacacaacuacgugacucccaagucuuaucuggaguuacuccacaucuuuucaauacugauuggucagaagaaauuggagcugaagaccgcuaaaaaucgcaugaaguccggccucgacaaacuucugaggacaagcgaagauguugccaagaugcaggaggaccuagaaucuaugcauccucugcucgaggaggccgcaaaagauaccauguugacuauggaacagaucaagguagacaccgcuaucgccgaggaaacacgaaacagugugcaaacggaggaaauuaaggcgaaugagaaagcuaagaaagcccaggcaauagccgacgaugcucagaaggaccuggaugaggcauuaccggcccuugacgcggcucuggccucgcuccggaaccugaacaaaaaugaugucacugaagugagagcaaugcagaggccacccccugggguuaaguuggugaucgaggccgucugcauuaugaagggaaucaaacccaagaaagugccaggcgaaaagccugguaccaaaguagacgauuacugggagcccgggaagggacugcuccaagacccaggccacuuccuugaaucccuguuuaaguucgauaaagacaacauuggcgaugugguuaucaaggcuauacagccguauaucgacaaugaggaguuucagccugccacaauugcaaaagucagcaaggcuugcaccucaaucugucagugggugcgcgccaugcauaaauaccacuucguggcgaaggccgucgaacccaagcgucaagcacuacuggaggcucaggaugacuuagggguuacucagcggauucucgacgaagccaaacaaagacugagggagguggaagauggaaucgcaacaaugcaggcuaaguaucgcgagugcauaaccaaaaaggaggaauuggagcuuaaaugugaacagugcgagcagcgacugggucgggccggcaagcucauuaacgggcugucugacgagaagguaagauggcaagaaacgguggagaauuugcaguacaugcugaacaauaucagcggagauguccuaguggccgcgggcuuuguugcuuaccucgguccauucacugggcaguauaggacagugcuuuacgacuccugggucaaacagcugcgcagucacaacgugccccauaccucagaaccuaccuuaaucggaacucugggcaauccaguaaagauuagaucuuggcaaauagcaggccuccccaacgauacacugagcguugagaauggggugaucaaccaguuuucccagcgguggacccacuucauugacccucagagucaagccaauaaauggaucaagaacauggaaaaagauaauggauuggacgucuucaaacuuagcgauagggacuuucugcguuccauggagaacgcuauucgauucgguaaaccgugucuccuggagaacgugggcgaagaacuugauccagccuuggaacccgugcugcucaagcagacauauaagcagcaagggaauacuguccuuaaacugggagacacgguuaucccuuaccaugaggacuuucgcauguauauaaccacaaaguuaccaaacccccacuacacuccugaaaucucuaccaaacugacacucauuaauuucacccugucacccagcggcuuggaggaucagcuucugggucaggugguagcagaggaaagaccagaccucgaggaagccaagaaccagcugaucauuucgaaugcuaaaaugcggcaagagcuaaaggauaucgaagaccagauuuuauauaggcuguccaguucugaggggaacccgguggaugacauggaguugauaaagguccucgaagcgagcaaaaugaaggccgcagagauccaggcuaaagugcgcauugccgaacagacugagaaggauaucgaccugacgagaauggaguacaucccuguugcaauucggacccaaauacuauuuuucugcgugucagaucuggccaaugucgaccccauguaccaguauucccucgaaugguuucugaacaucuucuugucuggcauugcuaauagugagagggccgauaaccuuaaaaagcgaaucagcaauauuaaccguuaccugacauauucccuauacucaaauguguguagaagccucuuugaaaagcauaaacugauguucgcguuuuuacugugcguacgcaucaugaugaacgagggaaagauaaaucagucugaauggcgguauuugcucaguggcggguccaucagcauuaugacugagaacccagcaccugacuggcugucagauagggccuggagagacauccuugcucugucuaaccuccccaccuucuccucguuuagcagugacuucguuaaacacuugucugaguuccgcgugauuuuugauucccuggaaccacaccgggagccucuucccggaaucugggaccaguaccuggaucaauuccagaagcuccuaguccuaaggugucugcgaggugacaaagugacaaaugccaugcaggauuuuguugcaaccaaccuggaaccgagauucauagagccacagacugcuaauuugagcguggucuuuaaggacucaaacaguacaacgccucucauuuucgugcugucccccggcaccgauccagccgcugaccuuuauaaguuugccgaagagaugaaauucagcaagaaacugucugcaaucucauuagggcaaggacagggcccccgggcggaggccaugaugaggagcuccauugaacgcgguaaguggguauuuuuccagaauugccaucucgcuccuucuuggaugccggcccuggagcguuugaucgaacacauaaacccagauaaagugcauagagacuuucgacuuuggcugacaagucuacccucgaauaaguucccugucagcauccuccaaaacggguccaaaaugacaauugagcccccaaggggcguucgggcaaaucugcugaagucauacucuagcuugggagaagauuuccucaacaguugucacaaggugauggaguuuaaaucccugcuucugucauuaugccucuuccacggcaaugcucuggagcgcagaaaguuugggccucuaggauucaacauccccuacgaauuuaccgacggugauuugaggauuugcaucucucagcugaaaauguuccuugacgaguaugacgauauaccauacaagguccucaaauauaccgccggcgaaauuaauuacgggggacgggugacagacgauugggaccgcagauguaucaugaacauccuggaggauuuuuauaauccugacguacugagcccggagcauuccuacagugcaagcggcauuuaucaccagauacccccaacuuacgauuugcaugguuaccuuucuuauauaaagucacucccucugaacgacaugcccgaaauuuucggguuacacgauaacgccaauaucacguuugcgcagaacgagaccuucgcucugcuaggcacaauuauccaacuccagccaaaguccagcagugccggaucucagggccgagaagagauaguggaagacguuacucagaauauccuguugaaagugccugagcccauuaaccugcaaugggucauggcaaaguacccggugcuuuaugaggaauccaugaauaccguucucguccaggaggugaucagguacaaccggcuguuacaggugauuacacagacccugcaagauuugcucaaagcccugaaggggcuuguagucaugucgagccagcuggaacuaauggcugccucacucuauaauaacacugugccagagcugugguccgcaaaggcuuacccuucuuugaagccccugaguagcuggguuauggaccuucuccagcgucuggacuuuuuacaagccuggauccaggauggcauuccagcgguguucuggaucucaggcuuuuucuucccccaggcuuuucugacggguacauugcagaauuucgcccgcaaguuugucauauccaucgacaccauuagcuucgauuuuaaagugauguucgaagcaccuucugagcucacucaaagaccccagguugggugcuacauccauggacuguuucuugagggcgccaggugggacccagaggcuuuccagcuggcagagagucagccuaaggaacuauauaccgagauggccgugauuuggcuccugccgacacccaaccggaaagcgcaagaucaggacuuuuacuuguguccaauauauaagacucugaccagagccgguacacuuuccacgaccggccacagcacuaauuacguaaucgcugucgaaauuccuacacaccagccccagcgccauuggaucaaacgagggguggcauuaauuugcgcccuggauuauuga

SEQ ID NO: 55370 - RNA, 2619 nt, Artificial Sequence
  derived and/or modified sequence opt3 from DNAH2__Homo_sapiens__NP_001290199
augagcuccaaggccgagaaaaagcagagacugucuggcagggggucaagucaagcuagcugguccggacgggcaacccgcgccgcgguggcuacacaggaacaggguaacgcccccgcagucucugagccugaacuccaggccgagcuuccaaaagaggaaccggagccccgacuggaaggcccucaagcucagucggaggaaucaguugagccagaggcagacgugaagcccuuguucuuaagccgugccgcucugacugggcuagccgaugcgguauggacgcaggaacacgacgcaauccucgagcauuuugcccaggauccuaccgaaaguauucugacaauauucaucgacccaugcuuuggacuuaaacuggaguugggcaugcccgugcaaacucagaaucagcucgucuacuucauuagacaggcuccugugccaaucaccugggaaaacuuugaggccacaguucaauucgguaccgugagggggccguauauucccgcacugcugcggcucuuaggaggcgucuuugcuccucagaucuucgccaauacuggcuggccagaguccauacgcaaccacuuugcgucucaucugcacaaguuccuugccuguuugacagauaccagauacaagcuggaagggcauacggugcuauauauccccgcagaggcuaugaauaugaaaccugaaaugguaauuaaggacaaagagcucguucagaggcuggaaacuagcaugauccacuggacccggcaaauuaaggagaugcuuuccgcccaggagacaguggaaacuggagagaaccuggguccauuggaagagaucgaauuuuggcgcaaucgaugcauggaucucucaggcauaaguaaacagcuggucaagaagggggugaaacacguggagagcauuuuacaucuggcuaagucuuccuaccucgcccccuucaugaaacuugcacagcaaauccaggacggaucaagacaggcccagagcaaccugaccuuuuugaguauucuaaaggagccguaucaagaacuggcuuucaugaaaccuaaggauaucucuuccaaacuccccaagcugaucagccuuauuaggauaaucugggucaauucgccacacuacaacacacgggagcgucugaccucuuuguuccgcaagauguccaaugaaauuaucagacucuguugccaugcgauaucacuggacaggauuuuugagggcuauguuaguagcuccaaagaggauuuacaggguuguauccugugcugucacgcauggaaggaccacuacgugcaggccguacagaugcauauccaauucucuagccgggggugggugcuagaucagacgucaauuuuugcucaggucgacgccuucgugcagcgaugcaaagaccucaucgaaguuugugauugccaauaccacuuugcacgcugggaggacggaaagcagggcccucugcccuguuucuuuggcgcccaggggccacaaauuacuagaaaccuuuuggaaauagaggauaucuuccauaaaaaucugcacacacucagggcugugcggggagguauucuggacgucaagaauaccugcuggcaugaagauuauaacaaguuucgcgccggcaucaaagaccuugaggugaugacucagaaccugaucacaagugcauucgaguugguaagagauguuccccacggggugcuccuguuagacaccuuucacaggcuggcgucccgugaagcuauuaagcggacguacgauaaaaaggccgucgaccuauauaugcuguucaacagcgagcucgcacuugugaaucgagaaagaaacaaaaaguggccugauuuggagccauacgucgcccaguauucuggaaaggcuaggugggugcauauacugcgccggagaaucgacaggguuaugaccugccucgccggcgcacacuuucugccgcgcauugguacagggaaagaaucagugcauacuuaccagcaaaugguacaggcuaucgacgaguuaguccgaaagaccuuccaggaguggacaaguagccuggauaaagacuguauucggcgucuugauacucccuugcucagaaucucccaggaaaaggccggcaugcuggacgugaauuucgauaaauauaggucucaccuagcgccuuuuccauacacaccccugcuccaacugucgcaggaguuccacagccaucuuuugaccccucuguuuauaaucuuaucccucucacacaccauuugccugcuuaguucuuucuacuuuuucuuuagcuccuucaucuuuguuucaccacaucugcccccguguuaucagcacuucaacuuuacuacguacuugaagacacagcaaaauaagaccaugauuggacaggcccgcuggcucacuccugugaucccagcucugugggaagcagaggucggcgccagccuagaaccccggucucugagaaccgcuugggccacauggcagaacccuguguccgcgaaaaauaccaagauaaguugggcaugguggcauaaacccguagugagcgccacuugggagggggagguuggagguucuccagaaccuggcaggcaacgacuccaguga

SEQ ID NO: 55371 - RNA, 12351 nt, Artificial Sequence
  derived and/or modified sequence opt3 from DNAH3__Homo_sapiens__NP_060009
augggagccaccgggagacuggaacucacucuugcugcacccccucacccagggccggccuuccagaggucgaaggcgcgggaaacucaaggugaagaagagggcuccgaaaugcagaucgcuaagucugacucaauucaucacaugagucauagccaggggcagcccgagcugccuccauugcccgccuccgcaaaugaggaaccuucuggauuauaccaaacggugaugucgcacucauuuuauccaccccugaugcagcgcaccagcuggacacuugccgcuccuuucaaggagcagcaucaccaccgaggcccaagugauuccauagcaaauaacuacucucucauggcccaggaccugaaacuuaaggaucuguugaaagucuaucaaccggcuacuaucagcguuccccgugacagaaccggucaggggcucccuuccucaggaaauaggaguagcucugaaccaaugcggaagaagacaaaauuuuccucacgcaacaaggaggauagcaccagaauuaaacuggccuucaagacaaguaucuuuucucccaugaaaaaggaggugaagacaucccugaccuucccuggcagcaggccaaugucgcccgaacagcagcucgacguaauguuacaacaggagauggaaauggagucuaaagaaaagaaaccguccgagucagaucuggagcgguacuauuacuaucuuacgaauggcauucgcaaggacaugaucgcgccugaagagggggaagugaugguccgaauaaguaaauugaucagcaacacucugcuuaccucccccuuucucgagccacugauggugguucuugugcaggaaaaggagaaugauuacuacugcucucugaugaaaagcauugucgacuauaucuugauggauccuauggagagaaagagacucuucauugaaucaaucccccggcuguuuccacaacgugugauacgcgcacccguuccuuggcauaguguuuacagauccgccaagaaauggaacgaggaacacuuacauacagugaauccaaugaugcugaggcucaaggagcuuugguucgcugaauuucgggaccugcgauucguccgcacugccgagauuuuggcaggaaaacuaccgcugcagccccaggaguuuugggaugugauccagaagcacugucucgaagcucaccaaacccugcuuaacaaauggauuccuacaugcgcccagcuguucaccagcagaaaggagcauuggauccacuucgcgccaaagucuaauuaugacucaaguaggaacaucgaagaguacuuugccagcguggcauccuucaugucuuugcagcuccgggagcuggucauuaaaucguuagaagaccugguuagccuauuuaugauacauaaggaugguaaugacuucaaagagcccuaucaggaaaugaaguuuuucaucccucaacucauuaugaucaaacuggagguguccgaaccaauaauuguauuuaaccccucauucgauggcuguugggagcuuauccgcgacagcuuuuuggagaucauuaagaacucuaacgggaucccgaagcugaaauacauuccucucaaguucagcuuuacggcugccgcugccgauagacagugcgugaaagcagccgaaccaggagagcccuccaugcacgcugcggcaacugccauggcugaacugaagggcuauaaccuucuguuggguacagucaaugccgaggaaaaacucgugucagacuuccugauacagaccuuuaagguuuuccagaagaaccaaguggggccuuguaaauacuuaaaugucuacaagaaauauguggaucugcuagacaacacugcagagcagaauaucgccgcuuuccucaaggagaaccaugauauugacgauuuuguaacaaaaaucaaugccaucaagaaaaggcguaacgaaauugcaagcaugaauauaaccguuccccuggcgauguucugccuugacgcuacggccuugaaccacgaccugugugagcgggcacagaaucucaaggaucaccugauccaguuucaaguggacgucaaccgagauaccaauacaucuauuugcaaccaguacucccauaucgccgacaaggugagugaagucccagcuaauacuaaagaguuagugagccugauugaguuccuuaagaaaucuuccgccguuaccguguuuaaguugagaaggcagcuccgcgaugcaucagagcggcuggaguuccuaauggacuaugcugaucugccuuaccaaaucgaagacauauuugauaacaguagaaaccuccugcuucacaaaagggaccaggccgagauggauuugaucaagcgcuguagcgaguucgagcugcgauuagagggauaucaucgggaacucgagucguuucguaagagagaaguaaugacaacugaggaaaugaaacacaaugucgagaagcugaacgagcuuuccaaaaaucugaacagggcguucgccgaauuugaguugauuaauaaggaagaggaacuccuggagaaagagaagucuaccuacccccuacugcaggcuaugcucaagaacaaagugccauaugaacagcuguggagcacagcauacgaguucucaaucaagagugaagaguggaugaauggcccgcuauuuuugcugaacgccgaacaaauugcugaggagaucggcaauauguggcgcaccacuuacaaauuaauaaagacgcucuccgacguuccugcuccccggagacuggcagaaaacgugaaaauuaagaucgauaaguucaaacaguauauuccaauccuuucuauaagcugcaaucccgggaugaaggacaggcacuggcagcagaucuccgagauugucggauacgaaaucaaaccuacagagaccacuugucugucaaacaugcuagaguucgguuuuggcaaguucguggaaaaacucgagccaauuggggcggccgcuagcaaggaauauagucuggagaaaaauuuggaccgaaugaagcuggauuggguaaacgugaccuuuucuuucguuaaguaccgcgacacagauaccaauaucuuaugcgccauagacgauauucaaaugcuccuggacgaucaugucaucaaaacucagacaaugugcggaucccccuuuaucaagccuauugaagcagagugucggaaaugggaggaaaaacuuaucaggauucaggacaaccuggaugcuugguugaaaugccaggccacguggcucuaucuggagccgauauucagcucggaagacaucauugcacaaaugccagaggaaggcaggaaguuugguaucguggauucauacuggaagucucuaaugagucaggccgugaaagacaaccguauucuggucgcugcggaucagccccgcauggccgagaaacuucaagaggcaaauuuccuccuggaagacauccagaaaggguugaacgacuaucuggagaagaaacgguuauuuuucccuagauuuuucuuccucuccaaugaugaacugcuugagauacugagcgaaaccaaggacccauugaggguucagccccaccucaagaaauguuuugagggcaucgcuaagcuggaguucacugauaaccuagaaauugugggaaugaucucuagcgagaaagaaacagugccuuuuauucagaagaucuacccggccaaugccaaaggcaugguagagaaguggcugcaacaggucgagcagaugaugcuugcuuccaugcgagaagugauagggcucggaauugaggcauacguuaaggugccccggaaccauuggguccugcaguggccaggucaagugguuaucugcgugucaaguaucuucuggacccaggaaguaagccaggccuuggcggagaauacauuacuggacuuucucaaaaagucuaacgaucagauugcucaaauaguccagcuggugcgcggcaaacuuuccucaggggccagacugacuuugggagcacuaaccgugaucgacguccacgccagggauguuguggcuaagcugagugaagaccggguaagcgaucucaaugacuuccaguggauuucccagcugcgauauuacuggguggcaaaagauguccaagugcagaucauuacgaccgaggcccuuuauggcuacgaguauuuagguaacucuccuagacugguuaucacaccccucacugaccgcuguuacaggaccuugaugggggcgcugaagcucaaucugggcggagcuccagaaggcccugccgggacaggaaagacugagaccacgaaagaccuugcaaaggcccuggcuaaacagugcguggucuuuaacuguucggaugguuuggacuauaaggccaugggcaaauucuuuaaggggcuagcacaagcuggagccugggcgugcuucgaugaauuuaaucguauagagguggaaguucugagcguggucgcccagcagauccucucaauucagcaagcaaucauucggaaauuaaagacauucaucuuugagggcaccgagcugucccuuaaccccacuugugcuguauucauaacaaugaauccagguuacgccgggagagcugaacugccggacaaccucaaggcauuguucaggaccguggccaugaugguuccugauuacgcccugauuggcgagaucagucucuauucuaugggauuucuggacagccgcucccuugcucagaaaaucguggcgacuuaccgacuaugcucagaacagcugucuagccagcaucacuaugauuacggcaugagagcagucaagaguguguugaccgccgcugggaacuuaaaacugaaguaucccgaggaaaaugaguccguacuccugcuucgggcccugcucgacgugaacuuggcaaaauuccuggcccaagaugucccacuauuucagggaauuaucagcgaccuguuccccggcguugugcucccuaagccagauuacgagguguuucuuaagguccugaaugacaacaucaagaagaugaaauuacagcccgugccuugguucauugguaagaucauucagaucuaugaaaugauguugguuaggcacggguacaugauaguaggagauccgaugggcgguaaaacaucugcuuacaaggugcuggcggccgcacucggcgaccugcaugcugccaaucaaauggaggaauuugcagucgaguauaagauuaucaacccaaaagccaucacgauggggcagcuuuacggauguuucgaccaggugucacacgaguggauggauggcguucuggcuaaugccuuucgcgaacaagcguccagucucagcgacgaucguaaguggauuaucuucgacgggcccguggaugcaauuuggauagagaacaugaauaccgucuuggacgauaacaaaaagcugugcuuaaugucgggagaaaucauucagaugaacucuaaaaugucccuaaucuuugagccugccgaccuggaacaggcuagccccgccacugugucaagaugcggcaugaucuauauggagccacaucagcucgguuggaagccucuuaaggauaguuacauggacacacugcccucuuccuugaccaaagagcacaaggaacugguaaacgauauguucauguggcucguccaaccaugucuggaguuugggcggcuucauugcaaauucgugguucagacaagcccuauucaccucgcuuucucaaugaugaggcuguauaguagcuugcuggacgaaauacgcgcaguggaggaagaggagauggaauuaggagagggccuauccucucagcagaucuuucuguggcuccaaggucuuuuccuguuuagcuuggucuggacuguggccggcaccauuaaugcugauucccgaaagaaauucgacguauuuuucagaaaccugaucauggggauggacgauaaucacccgcggcccaagucagugaaacucacgaagaacaauauuuuuccagaaaggggaucuaucuacgacuucuauuuuauaaagcaggccaguggccauugggagacauggacccaguacaucacuaaagaagaggagaaggucccugcaggggcgaaagugucggaacugauuauccccaccauggagacagcccgccagagcuucuuucuuaagacuuacuuagaucacgaaauuccaaugcuguucguaggaccuaccggcacagguaaauccgcuaucacgaacaacuuucucuugcaucugcccaagaauaccuaucuaccgaacuguauaaauuucucugccagaacuucagcaaaccaaacacaggacauuaucaugagcaagcuggauaggcggcguaaaggacucuucggaccaccuauuggcaagaaagcugugguuuuugucgacgaucuuaauaugcccgccaaggagguguacggugcacagccacccaucgagcuguugcgccaguggauagaccacggcuauugguucgauaaaaaggacaccacucgacuggauaucguggacaugcuccuggucacagccauggggccuccgggaggcgggagaaacgacauuaccggaagguuuacgcggcacuuaaauaucauuuccaucaacgcuuucgaagaugacauacuuacuaagauuuuuaguucuaucguagauuggcauuucggcaaagguuuugacgugauguuccugcgcuacgggaagaugcucguucaagcgaccaaaacaaucuauagagaugccguggagaauuuucuacccaccccaagcaagucacacuacgucuucaaccugagggacuuuucccgggugauucagggaguuuugcugugcccucauacucaccuccaggauguggaaaaauguauccgacuuuggauacaugaggucuauagaguguucuacgaccgccugauugauaaggaagacaggcaaguauuuuucaauauggugaaggagacaaccaguaacugcuucaaacagacaaucgagaagguuuugauucaccugagccccacuggcaaaaucgucgaugacaauauacggucucucuuuuucggcgauuacuuuaagccugaauccgaccagaaaaucuaugacgagauuaccgauuuaaagcagcugacgguggugauggaacacuaccuugaggaguucaacaauaucucaaaagcaccaaugagccuggucauguuucguuucgcuauugagcauaucucgagaauuuguaggguucuaaagcaagacaaggggcaccuccuguuggugggaaucgguggcucugggcgccagagugccgccaaacuguccacauuuaugaacgcauaugagcucuaccagauagaaauuaccaagaacuaugcuggaaaugauuggcgggaggaccuuaaaaagaucauccugcagguaggcguggccacuaaaagcaccgucuucuuauuugcggauaaccaaauuaaggacgaaucauucguggaggauauaaauaugcuguugaacacaggugacguucccaauaucuuuccugcugaugaaaaggccgacauuguggagaaaaugcagacugcagcccgaacccagggggagaaggucgaaguaacgccacucuccauguacaacuucuuuaucgagagagugauuaauaaaaucucuuucagccuggcuaugagucccauaggagaugcauucaggaaccgccuacggauguuuccgucccuuaucaauugcuguacaauugacugguuccagagcuggccuaccgacgcccuggaacucguugcgaacaaguuucuggaggauguggaguuggacgauaauaucagagucgaaguggucucuaugugcaaauauuuccaagagucagugaagaagcugagucucgacuacuacaacaaacuucguaggcauaauuauguuacuccaacauccuaccuggaauuaauucugaccuuuaagacuuugcucaacagcaaacggcaggagguggcuaugaugcgcaaucgauaucugacaggccuacagaaacuugauuucgccgcaucucaaguagccgugaugcagagagaacugaccgcucuccagccccagcugaucuugacgucggaggagacugccaaaaugauggucaagauagaagcagagaccagggaagcugacggcaagaaauuacugguucaagccgaugagaaggaagcgaacguggccgcagcuauugcccaggggaucaaaaacgagugugagggagaccucgcagaagcuaugccugcccuugaggccgcgcuggcugcacuagauacacugaauccagccgacaucucacucgucaagagcaugcagaaucccccggguccugugaaauugguaauggaauccauuugcauaaugaagggcaugaagcccgagcggaaaccagauccuagugggucuggaaagaugaucgaagacuacuggggcgugagcaaaaagauucugggugaucuuaaauuucuggagucccucaagaccuaugacaaagacaauauacccccauuaacaaugaagcgcauuagagagagguucaucaaccaccccgaauuucagccugcuguuauaaagaaugugucaagugccugcgaggggcuguguaaauggguccgagcaauggaaguguacgaucgggucgccaaggugguugcuccaaaacgugagagauugcgcgaggcggaaggaaagcuggccgcacaaaugcagaaacucaaccagaagagggcugagcuuaagcugguaguggaccggcuacaggcccugaaugaugacuucgaagagaugaacacuaaaaagaaagaucucgaagagaauaucgagauuugcucucaaaaguuggucagagcagaaaaacugaucagcggccuuggcggggagaaggaccgcuggaccgaagccgcuaggcagcugggcauucgauauacgaacuuaacaggugaugugcuccuguccucaggcacuguugccuacuugggggcguuuaccguggacuaccggguccagugucaaaaucaguggcuggcagagugcaaggauaaagugaucccgggauucagcgacuuuucucucucccacacacuuggcgaucccauuaagauaagagccuggcagaucgcuggucugccuguagacaguuucagcauugauaacgggaucaucgugagcaauuccaggcgcugggcccuaaugauugacccacauggacaggcaaacaaauggauaaagaauauggaaaaagcuaacaagcuggccguuaucaaguucucugacucaaacuauaugcguaugcucgagaaugcuuugcaacugggcacccccgucuuaauugagaacaucggcgaagaacuugaugccagcauugaaccuauccugcucaaagcaacuuuuaagcagcaggggguggaguacaugcggcugggagaaaauauaaucgaguauaguagagacuucaaauuguacauuaccacaaggcugcgcaacccacacuaucuccccgagguggcggucaagguuugucuucugaauuuuaugaucacgccucuaggucugcaggaucaauuacucggcauuguggccgcuaaagaaaagccggagcuggaagagaaaaagaaccaguugaucguagaguccgccaagaauaaaaagcaucuuaaagaaauagaggacaagauucuggaagugcucucuaugagcaaagggaacauccuggaggaugaaacugcaauuaaggucuugucauccaguaaggugcugagcgaggagaucucugaaaaacagaagguugcuucaaugaccgagacacagauagacgaaacccgaaugggauacaaaccaguggccguccacuccgcaacuaucuucuuuugcauuagcgaucuagccaauaucgagcccauguaucaauacucucucacaugguucauuaaccuuuacaugcauagucugacccacucgacgaaguccgaagaguuaaaucugcggaucaaauauauaauugaccacuuuacucucagcaucuacaacaauguguguagaucacuguucgagaaggauaaguugcuauuuucucugcuccugacaaucggcauuaugaaacagaagaaagaaaucaccgaggaaguaugguauuuccuauugaccggugggauagcgcuggacaacccuuaccccaauccagcuccucaguggcucagcgagaaggccugggcagaaauuguuagggccuccgcccuucccaaacugcauggauuaauggagcaccuggagcagaaccucggcgaauggaagcugaucuaugauagugccuggccacaugaggaacaauugccgggcucauggaaguuuucucaggggcuugagaaaauggugauucugcgcugccucagaccugacaagaugguccccgcagugcgggaguucaucgcugaacacaugggaaaacuguacauagaggccccaacuuucgaccuacaggguagcuauaacgauuccaguuguugcgcgcccuuaaucuuugugcugagcccuuccgcugacccaauggccggcuugcucaaguucgcagaugaccuggggaugggaggcacaaggacccaaacaauuucucuuggucaggggcagggccccaucgccgcuaaaaugauuaauaacgcaaucaaggauggaacuugggucguucugcagaauugucaccucgccgcgucauggaugccuacgcuggagaagauuugcgaggaagugaucguaccggagagcaccaacgcccguuuucgauuguggcuuacaucguacccauccgagaaguuccccgugaguauacugcaaaauggcaucaagaugacuaacgaaccuccaaaagggcuacgcgcuaaucuccugagaucuuacuuaaacgaccccauuagcgauccugucuuuuuccagucaugcgcaaaggccgugauguggcagaaaaugcuguuuggauuguguuucuuucaugcuguugugcaggagcggaggaauuucgguccccucggcuggaacaucccauaugaauuuaaugaguccgaccugcgcauuucuauguggcaaauacagauguuccuuaacgauuacaaggaagucccguuugacgcccugaccuaucucacaggggagugcaauuacggaggcagagugaccgaugacaaagaucggagguugcugcuuagucuguuaagcauguucuauuguaaggagaucgaagaggacuacuauucccuagcaccuggugacacuuacuacauucccccacacgggucauaucagagcuacaucgauuaucuccgaaaccugccuauuacggcucaucccgaaguauucggccugcacgagaaugccgacaucaccaaggauaaccaggaaacaaaccaauuguuugagggaguucuccugacucuuccacgucagucuggcgggaguggaaaauccccucaggagguggucgaagaacuggcgcaagacauauuaagcaagcuccccagagauuucgaccuggaagaggugaugaaauuguacccgguuguguaugaggaaucaaugaauaccguccuucgccaggagcugauccgguuuaacaggcuaacaaaggugguaagacgcucucucauuaaucugggucgggccaucaaaggccaggugcugauguccucggaauuggaggaagucuucaacagcaugcucguugggaaggugccagcaaugugggcugccaagaguuacccuucucugaaaccccuuggaggcuaugucgcagaucuguuagccaggcucaccuuuuuccaggaguggauugacaaggguccacccgugguauuuuggaucuccggguucuacuuuacucaaaguuuccugacaggcgugucacagaauuacgcucgaaaauauacgauaccuauugaucauaucggauuugaguucgaaguuaccccgcaggagacugugauggaaaacaauccagaggacggcgccuacaucaaggggcuauuuuuggaaggagcgagaugggaucggaaaacaaugcagauuggcgagagucugcccaagauacuuuaugacccucuccccaucauuuggcugaagccaggugaguccgcuauguuccugcaccaagauaucuacgucugcccuguguauaaaaccagcgcaaggcgcgggaccuugucuacaacuggacacucaacgaacuacguucuuagcauugaacuccccaccgacaugccacagaagcauuggaucaaucguggcgucgccucccugugucaguuagacaacuga

SEQ ID NO: 55372 - RNA, 13875 nt, Artificial Sequence
  derived and/or modified sequence opt3 from DNAH5__Homo_sapiens__NP_001360
auguucaggaucggcaggcggcagcuguggaagcacagcgugacccgcguccucacacaacgacuuaaaggggaaaaggaagccaaacgugcucuguuggacgcaagacauaacuacuuauuugccauuguugcguccugccuggaucuaaauaagacugaaguggaagacgcuauacucgaaggaaaccagaucgaaaggauugaucagcuguucgccguggguggccuucggcaccugauguuuuauuaccaggacguggaggaggcagaaacggggcaauugggaucucucggcggugucaaucuggugucagggaaaaucaagaagcccaaaguuuucgugaccgagggaaacgaugucgcccugacaggcguguguguauuuuucauucgcacugacccuaguaaggcuaucaccccagauaauauacaucaggaaguuagcuuuaacaugcucgacgcagccgauggcggguuacuaaauuccgugagaaggcuuuugucugacaucuucauuccggcucugcgggccacaucgcacggauggggugagcuagagggccuccaggaugcggcaaacauccgccaggaauuucugucaagccuugagggguucgucaaugugcugaguggagcccaagaauccuugaaagagaaggugaaccuccgaaaaugcgacauucuggaauuaaagacccugaaggagcccacugauuaucucacacuugcuaauaacccugagacccugggcaaaaucgaagacuguaugaaggucuggauaaaacagacggagcagguuuuggccgaaaauaaccagcuacugaaggaggcagacgauguggguccaagagcugaacucgagcauuggaaaaagaggcugucuaaauuuaauuaccuucuggagcaauugaaaucccccgacguaaaggccgugcucgcgguccuggccgcagcuaaauccaaguuacugaaaacuuggcgggaaauggauauucguaucaccgacgccacaaacgaggcuaaggauaacgugaaauaucuauacacucucgaaaagugcugugacccucuguauucaagugauccacuuagcaugauggacgccauucccaccuugaucaaugcaaucaagaugauuuacucuauaucccacuacuauaacacaucagagaaaaucaccagccuguucguuaaggugacgaaucagauuaucagugccugcaaggcuuacauaacuaacaaugggacagcgucuauuuggaaccagccucaagaugucguggaagagaagauccucuccgcaaucaaacugaagcaggaguaucagcuuuguuuucacaagaccaaacagaagcugaaacaaaauccaaacgccaagcaguucgacuucagcgaaauguacauuuuuggaaaauucgagacuuuucaucgcagauuggcuaagaucauugauauauucacaacccucaagacguauucgguacugcaggacucuaccaucgaaggcuuagaggacauggccacaaaauaccagggcauuguugcaacuaucaagaaaaaggaguauaauuuucuggaucaaaggaaaauggacuucgaucaggacuacgaagaguuuugcaagcagaccaacgaucuacacaaugaacuccggaaauucauggacgugacauuugccaagauccagaacacuaaucaagcucugcgaaugcuuaagaaauucgagcgcuugaacauuccgaaucuggggauagaugacaaguaccagcucauccuggaaaacuauggagccgauauugacaugaucuccaaauuauacaccaagcagaaauaugaucccccucuggcaagaaaccagccacccauugcggguaagauccuuugggcuaggcaauuguuucaucggauacagcagccuaugcaacucuuccagcagcacccagccguccugucaacagcagaggccaagcccaucauucgcaguuacaauagaauggcuaaagugcuacuggaguuugaaguccucuuccacagggccuggcugcgucagaucgaggaaauucaugugggccuugaggccagcuugcugguuaaggcuccggggaccggagaauuauucgugaacuuugacccucaaauccucauacuguuccgggagacugaguguauggcccagaugggccuugaaguaagcccccuggcgacgucuuuguuucagaaacgagauagauauaagaggaauuucagcaacaugaaaaugaugcucgccgaguaccagcgcgucaagucaaagauuccagcugcaaucgaacaacugauugugccucaccuagccaaaguugacgaggcucugcagcccggucucgccgcacugacauggaccagucuuaauaucgaagcguauuuggagaacacuuuugccaagauaaaagaccuggaguuacuccuggaucgggugaaugaccuuaucgaguucagaauugaugcuauccuggaggaaauguccagcaccccacuaugccagcucccccaggaggagccucugacaugugaagaguuuuugcaaaugaccaaggaccugugcgucaacggggcccagauuuuacauuucaaaucuucacucguggaagaggcaguaaaugaacuggugaacaugcuucuggauguugaggucuugagugaggaagagagcgaaaagaucuccaaugagaacucugugaauuacaagaacgaaucgagcgcuaaaagggaggagggcaauuuugacacucucacauccucaauaaacgcccgcgcaaacgcccugcuacugacgaccgugacucgaaagaaaaaggaaacagagaugcuuggagaagaggcucgggaacuccugagucacuucaaucaucagaacauggaugcguugcugaaagucacccguaauacauuagaggccauuagaaagaggauccacucuagccacacuaucaacuuucgcgacuccaauucagcaagcaacaugaaacaaaauucucucccaauuuuccgggcuuccguuacccuggccaucccgaacauugugauggcccccgcucuugaggaugugcagcagacgcugaauaaggcaguagaaugcauaaucagugucccuaagggcgugagacaguggagcucugaguugcucuccaaaaagaaaauucaagaaaggaagauggccgcgcugcagucaaacgaggacagugauagcgacguugagaugggggaaaaugagcuacaggauacccuggaaaucgcuucggugaaccuuccaauucccguccagaccaaaaauuacuauaagaacguguccgagaauaaggaaaucguuaaacucgugucuguacugagcacuauaaucaacucaaccaagaaagaggucauuacaaguauggacuguuuuaagcgauacaaccauaucuggcaaaaaggaaaggaggaagccauuaagacuuucaucacccaguccccuuuguuaucugaguucgaaagccagauacuguauuuucagaaucucgagcaagaaauuaacgcagagccagaguacgugugcguggguuccaucgcccuguauacggcugaccuuaaauucgcacugacagccgaaaccaaggcguggauggucguuaucggccgccacuguaauaaaaaguaccggucagagauggaaaacauuuuuauguugauagaggaguucaauaaaaagcuaaacagacccaucaaggaucuggacgauauuaggaucgcuauggccgcacucaaagagauucgugaggaacagaucagcauagacuuucagguggggccgaucgaggaaaguuaugcccugcuuaaucgcuacggauuacugauugcucgggaggagaucgauaagguagacacucuccauuacgccugggaaaaauugcuggcaagagcuggcgaggugcagaacaagcucgucucucugcaaccuuccuucaaaaaggaacuuauuagcgccguggagguuuuucugcaggauugccaccaguucuauuuggacuacgaucuaaaugguccaauggcgucggggcugaagccccaagaagccucagacaggcucaucauguuucagaaccaguucgauaauauauaucgaaaauacauuacauauaccggcggagaggaguuauuuggccugccugcaacucaguacccccaacuucuggaaaucaagaaacagcucaacuugcugcagaagaucuauacccucuacaauucugugauugagacagucaacaguuacuaugacauccugugguccgaagugaauauagagaaaauuaacaaugaacuucuagaguuccagaaccggugucgcaagcugccaagagcuuugaaagacuggcaagccuucuuagaucugaagaagaucauugacgauuuuagcgagugcuguccucuccuggaauacauggcuucuaaagcaaugauggagaggcacugggaacggaucacgacccuuacugggcauagccuggacguuggaaacgaguccuucaagcuccgaaauauaauggaagcccccuugcugaaauauaaggaggagauugaagauaucugcaucucagccgugaaagagagagacauugaacagaagcuaaagcaggucaucaacgagugggauaauaaaacauuuaccuucgguaguuuuaagacacgcggcgagcugcuccuuagaggggacagcacuucugaaauuauagcuaacauggaggauucccugauguuauugggaucacugcucaguaaucguuacaacaugccauucaaagcgcagauccaaaaguggguacaguaucugagcaauuccaccgacauuaucgaaucuuggaugacggugcagaaccuuuggaucuaccuggaggcaguuuuugugggcggugauauugccaaacaacucccgaaggaagcuaagcgguucucgaauauagacaaaagcugggucaagaucaugacaagagcccacgaggugccuucaguagugcaguguugcgucggggaugagaccuugggccagcuguuaccccaucuacuggaccagcucgaaauuugucaaaaaucccuuacuggauaucuggagaagaaaagguugugcuuuccacgcuucuuuuucguuagugaccccgcacugcucgaaauccugggccaggccucugauagccacaccauucaggcucaucuucucaacguguuugacaauaucaaguccgugaaguuccacgagaaaauauacgaucgaauccugucaauuucuagccaggaaggggagacaaucgaguuggacaagccugucauggcggaaggaaacguggagguuuggcugaauaguuuacuagaagagucccaaagcucucugcaccucguaauuagacaggccgcagcuaacauccaggaaacuggcuuccagcuuaccgaguuucugucauccuucccagcccaaguggguuugcuggggauacagaugauuuggacacgggauagugaggaagcacucaggaaugccaaauuugacaagaaaaucaugcagaagacgaaccaggcuuuccuggagcuuuuaaacacccugauugaugucacuacacgcgaccucagcucgaccgaacgugugaaauacgagacuuugaucacaauacauguucaccaaagagauaucuuugacgaucugugccauaugcacauuaagucucccauggacuucgaguggcuaaagcagugucgguuuuauuucaaugaagauuccgacaaaaugaugauccauauuaccgacguggccuuuaucuaccagaacgaguuccugggaugcacggauaggcucgucauaacuccucuuaccgaccgcuguuauauuacacuggcgcaagcauugggcaugagcauggguggcgccccggcugggccagccggaaccggcaagacugaaacaaccaaagauauggggcgaugccugggaaaguacgugguagucuuuaauuguucagaccagauggauuucagaggccucggucggaucuuuaaagggcuggcucagaguggaucuuggggcugcuucgacgaguucaacaggaucgauuuacccgugcuuuccguugcagcccagcaaauuagcaucauacugacauguaagaaggaacacaaaaagucauuuauuuucacugacggugauaaugugaccaugaacccugaguuuggccucuuccuaacgaugaauccaggguaugcuggacgccaggagcugcccgaaaacuugaaaaucaauuuuagaagugucgccaugauggugccugacaggcagauuaucauacggguuaagcuggcaagcugcggcuucaucgauaacgugguccucgcgcguaaauuuuucacacuuuacaagcugugugaggaacaguuguccaagcaagugcacuaugacuuugggcugcgcaauauucucucuguauuacgaacccugggagccgcuaaaagagccaacccgauggacacugagagcaccaucgugaugaggguucuucgggauaugaaucuguccaagcuaauugacgaagaugagccccucuuccugucauugaucgaggaccuguuuccaaacauucuccuugauaaagcaggcuacccugaacuggaggcugccaucucucgccaggucgaagaggcagguuuaauaaaucaucccccauggaagcugaaagugauucaguuguucgaaacacagagagugaggcacgggaugaugacucucggaccuaguggcgccgguaagaccacgugcauccauacacugaugcgggcuaugaccgacuguggcaagccccaccgagagaugagaaugaacccaaaagcgaucacugccccgcaaauguuugggcgccuagaugucgcaacaaacgacuggaccgauggaauuuucucgacucuuuggaggaagacacugcgggcuaaaaagggcgagcacauauggaucauucucgacgggccuguagaugccaucuggauugaaaaucugaacagcguguuggacgauaauaaaacccugacgcucgccaacggagaccguauccccauggcaccaaauugcaagauaaucuucgagccccauaacauugacaaugcuuccccugccacuguuucuagaaacggcaugguguuuaugucaagcuccauccuugauuggaguccaauucuggaagguuuccuaaagaaaaggucuccccaggaggcggagauccugcgccaguuguacaccgagagcuuuccugaccucuaucgguucugcauacaaaaucuggaguacaagauggaaguccuagaggcuuuugugauuacacagucaaucaacaugcuucaggggcugaucccgcucaaagaacagggaggcgagguuucccaagcccaccugggccgauuguucguguuugcauuacuguggagugccggggcugcacucgagcuugauggaagaaggcgccuggaacuauggcugcggagcagaccaaccgguacacucgaguugcccccucccgccggcccaggggacacugcguucgauuauuacgucgcuccugacggaaccuggacgcauuggaauacacguacucaggaauaucuguaccccucugauaccacaccagaguauggcuccauucuugugccuaacguagacaaugugaggaccgauuuucugauacagacuaucgccaagcaggguaaagcaguucucuuaauuggggaacaaggaaccgccaagacagucaucauuaaaggcuucaugucaaaguacgacccggagugucacaugaucaagagccugaacuuuucgucugcuacgacucccuugauguuccagcggaccauagagaguuacguggauaaacgcaugggcacaaccuaugggccuccagcaggaaagaaaaugacuguguuuaucgacgacgucaauaugcccauuaucaacgaauggggugaucagguuacaaacgagauugugcgacagcugauggaacaaaauggcuucuacaaccucgagaagccaggggaguucaccuccaucguagacauucaguuucuugcagcuaugauacauccuggaggcgguagaaaugauaucccccagaggcugaaacggcaauucagcauuuuuaacugcacgcuaccgucagaggccuccguggacaagaucuucggggucaucggagugggccacuauuguacucagcgcggcuuuucugaggaaguuagagauagcgugacaaagcuggucccacucaccaggcgauuguggcagaugaccaaaauuaagaugcugccuacucccgcgaaauuccacuacguauuuaaucuucgggaccugagucguguguggcaggggauguuaaacacaaccuccgagguuauaaaggaaccaaaugaucuccugaaauuguggaagcaugagugcaagagagugaucgccgaccgcuucacagucagcucugaugugacuugguuugacaaagcacuggucucacucguggaggaagaguucggagaagagaagaaacuucugguugauugugguauugacacguauuuuguggauuuccuaagggacgcucccgaagccgcaggcgagaccagugaggaagcugacgccgagacaccuaagaucuacgaaccgauugaguccuuuagccaccugaaagaacggcucaacauguucuugcaacuguauaaugagucuaucagaggggccggaauggauaugguauucuuugcggacgcuauggugcauuuagucaagauaucgcgcguuaucaggacuccccagggcaacgcacuucuggugggugucgggggaucaggcaagcagagccucacccgacuggccuccuucauugcuggcuacgugaguuuucagaucacauugacccggucuuacaauacuagcaaccugauggaggaucucaaaguacuuuauagaacggccgggcaacagggaaaggguauuaccuucaucuuuacagacaaugaaauaaaagaugaguccuuccuggaauacaugaacaaugugcuaucaaguggcgagguuucuaaccuguuugcaagggacgaaauugaugagaucaacagcgacuuagccuccgugaugaagaaagaguucccacgcugccucccuacuaaugaaaaccugcacgauuauuuuaugucacguguccggcagaauuugcacauugugcuuuguuucagccccgucggggagaaguuuagaaacagggcucugaaauucccugcgcucaucucuggaugcaccauagacugguuuucccgcuggccaaaggaugcccugguggcaguuagugaacauuucuugacaagcuacgacaucgauuguucgcuggagauuaagaaagagguagugcagugcaugggcuccuuccaagacggugucgcugaaaaguguguggacuauuuucagcgauuccggagaucuacccacguuacucccaaaucauaccucagcuuuauccagggguauaaguucauuuacggagagaaacauguggaagucaggacauuagccaaucgcaugaacacgggccuugagaagcugaaggaagcaagugaguccguggccgcuuuaucuaaagagcuggaagccaaggagaaagaacuccagguagcgaaugauaaggcagacauggugcugaaagagguuaccaugaaggcccaagcugccgaaaaggucaaagcagaggugcagaaggugaaagauagagcucaggccaucgucgacagcauaucaaaggauaaagcuauugccgaggaaaaguuggaggcagcgaagccugcccuugaagaggcugaagccgcacugcaaacuauccggccauccgacaucgcuacaguuaggacccucggccgucccccgcaccugauuaugcgaaucauggauugcgugcuauugcuguuucagcgcaaaguaagugccgugaagauagaccucgagaaaagcugcaccaugccuucuuggcaggagucacuuaagcugaugacagcagggaacuucuuacagaaucugcaacaguuuccaaaagauacuauuaacgaagaggucaucgaguuccucucccccuacuuugagaugccugacuauaauauugagacggccaagagaguguguggaaacguugcgggucugugcagcuggaccaaagcuauggccucuuucuuuaguaucaauaaggaaguguugccacuuaaggcaaaccuggucgugcaggagaaucggcaucuccuggccaugcaggaucuacaaaaagcucaggccgaauuagacgacaagcaggcagagcuggauguaguucaggcugaauacgagcaagccaugacagagaaacagacuuugcucgaagacgcggagaggugucgccacaagaugcagaccgcuucgacacugauauccggccuugccggggaaaaagagagauggaccgaacaaagccaggaguucgcagcccagacuaagcggcuggugggagauguccuccuggcuacggcauucuugucauauucuggccccuuuaaccaggaguucagggaccuucugcuaaacgauuggcgaaaggaaaugaaagcccguaagaucccguuugguaaaaaucucaaccugagcgagauguuaauugacgcgccuacaaucuccgaauggaaucugcaaggguugcccaacgaugaccucaguauucagaauggcaucauugugaccaaggccucaagauacccacugcuuaucgauccucagacucagggaaaaauauggaucaagaacaaggagucucgcaaugaacugcaaauuaccagccucaaccacaaauauuuccggaaucauuuggaggacucccugagucuuggcaggccccuguuaaucgaggaugugggggaagaacuggacccagcucucgauaacguccuggaaagaaauuuuauuaagacaggaagcacuuucaaaguuaaggugggugacaaagagguagacgugcuggauggcuuucgcuuguacauaaccacaaagcuccccaacccugcauauacgccagagaucuccgcccggaccucuauuaucgacuucacugucacaaugaaggggcuggaagaucagcuucugggaagggugauuuuaaccgagaaacaggaacucgagaaggaacgaacucaccugauggaggacguuacagcuaauaaaagacggaugaaggaguuggaagauaaccuucuguacaggcuaaccucaacgcagggcagccucguggaggacgaaucgcugaucgucgugcuguccaauaccaaacgcacagccgaggaaguaacucaaaaguuggagauaagugcagagaccgaaguucagaucaacucugcucgugaggaauacagaccgguggccacacgagguagcauucucuauuuucugaucacugagaugaggcuugucaacgaaauguaccagaccucacugcggcaguucuuagggcucuuugaucugucccuagcgcgcucugugaaaagucccauuacaagcaagagaaucgccaauauaauugagcauaugaccuaugagguuuacaaguaugcagcuaggggcuuguacgaagaacacaaauuccuguuuacucuucuccugacgcugaagaucgacauccaacggaaccgcgugaaacacgaagaguucuugacacuuauuaagggaggcgccucccucgaucugaaagcaugcccuccaaagcccucaaaguggauauuagacaucaccuggcugaaucuagucgagcucagcaaacugagacaguucucugauguguuggaccagauuagucgaaacgaaaagauguggaaaaucugguuugauaaggagaauccugaagaggaaccacugcccaacgccuaugacaaaucccuugacuguuucaggcggcuccuguuaauucguagcuggugcccugaucgcacuaucgcucaagccagaaaguacauaguagacucaaugggggagaaguacgcggagggagugauccuggauuuggagaaaacaugggaagaaucugacccgaggacaccacucauuugucugcuuuccauggguucggaucccacggacagcaucauugcucugggcaagcggcuaaaaaucgagaccagauaugucaguauggggcagggacaggaaguucaugcacgcaagcuccugcagcaaacuauggccaauggcgguugggcuuugcugcagaacugccaccuugggcucgauuuuauggacgagcugauggauauaauuaucgagacagaauuagugcaugacgccuuccgacuguggaugaccacugaggcacacaaacaguuuccuauuacauugcuccagaugucuaucaaguucgccaaugaucccccacaaggccugagggcuggacuuaagcggaccuacuccggcgucagccaggaccugcuagacgugucaagugggucccaguggaaaccuaugcucuaugcgguagccuuucugcauagcacagugcaggaaagacguaaguucggagcauugggcuggaacauccccuacgaguuuaaucaagccgauuucaacgcuacuguucaguuuauucagaaucaccuggacgauauggacgugaaaaagggugucucuuggaccacgauacgcuauaugaucggggaaauucaauacggaggcagggugaccgaugacuaugauaaacggcuuuuaaacacauucgcaaagguuugguuuucagagaauauguucgguccagacuucagcuuuuaccagggcuacaacaucccgaaguguuccacugucgauaacuaucugcaguacauucagucucucccugccuaugacagucccgagguguucgggcugcacccaaaugcugauaucaccuaccaaucgaaacuagccaaggacguguuggauacaauacugggaauccagcccaaagacacuagcggcgggggagacgaaaccagagaggcgguagucgcacgacucgccgaugacaugcuugaaaagcugccuccagauuaugugcccuuugagguuaaagagaggcuccagaagaugggcccuuuccagccgaugaacauuuuucugcgccaagaaaucgaccggaugcagagaguguuauccuuggucaggucaacgcugacagagcuuaaacuggcuauugaugguaccauaaucaugucugaaaaucuccgcgacgcccuggauugcauguucgacgcacguauuccagcuugguggaagaaggccagcuggaucaguuccacucuaggguuuugguucacagagcuuaucgaacggaacucacaguuuaccucuuggguguucaauggaagaccccauuguuuuuggaugacuggcuucuuuaacccucaggguuuccugaccgcgaugcgacaagagauuacaagggccaauaaaggcugggcucucgauaacaugguuuugugcaaugaggugacgaaguggaugaaagacgauauaagcgcaccacccaccgaagggguauacgucuauggacuguacuuagagggcgccgggugggacaagcgcaacaugaaacugaucgaauccaagccuaagguacucuucgagcuuaugcccgugauucggaucuacgcugaaaauaacacucugagagauccaagguuuuauaguugcccgauuuacaaaaagccuguucgcacagacuugaauuauaucgcagccgucgaccugagaaccgcucagacucccgagcacugggugcuccggggaguagcccuacugugugaugugaaauga

SEQ ID NO: 55373 - RNA, 12477 nt, Artificial Sequence
  derived and/or modified sequence opt3 from DNAH6__Homo_sapiens__NP_001361
augaccuuccgagccacagacagcgaauuugaucugacuaacaucgaagaguacgcugaaaauuccgcacucucuaggcuuaacaauauuaaggccaagcagcgggugucauaugucacgagcaccgagaacgaaagcgacacacagauacugacuuuccgccacaucaccaaggcgcaggagaaaacacgaaagcgucagcagccaauuaaauuggagccuuuaccaguucugaagguguaccaagaucauaagcagccggaauauauccacgagcagaauagauuucagcuaaugaccgcuggcauuaucaaaaggcccguguccauagccaagaaaucuuucgcaacuucgucaacacaauuucucgaacaucaggacgccgugaagaaaaugcagauccaccggccuuacgucgagguguucagcccaagucccccuaagcugccacauaccgggauuggaaagcgcggucuuuuuggcacgagauccucugcuuaucccaaauacacuuuccacgauagggaggaaguugugaaggcaaacauccgggacccucugcagauuaucaaaauaauucgcgagaaugaacacuugggguuucucuauaugaucccagccgucccgcgaagcuccauugaguacgauaccuacaaccugaaggugguaucauaugaaaauaucaacaaaaaugacuacuauacaaucagucaaagagcuguuacucauauuuacaacgaggauauagaguucaucgaaauugacaggugggagcaggaauaucuguaccaccgggagcucaccaagauccccauauuuagcuuauuccguaaauggaaggccuuuucuguguggcgcaagaaugucagauccaaaaagauuacaggaugccagaaaucacugcaaaagaaccuuuucaucgugaauccucauuugaggccagcgcugcuaaaaaucaacgaacucuguuaucaccugagcuucaugggccuuugcuacauugagaagugucacaccuacacgcugcaggaguuuaaggcagcccaggugauccgguuggcugaagucacugagcgacucggugaguuccgcaacgaggccaaauauguugugagaagggcaugccgguuugcucugcgcgccgcgggguucguacccgaugacugugccuuuggaccuuucgaagauuaccauaaggugcagaguucuggcuccuuuauuaauacaccacacgaguuacccaccuauggcgacagcgagaaaaugacuuacacagaacaagcaucgaagagacauuauugcaugaggcugaccuguuucauacgucucaacgacuaccuuaucgagaauacgaugcacauucugaccgucaacgcuguaaauucuuugcuaaaccaucugacagauaaacucaagcggacuccguccgccgacguuauccagaaguggaucaccgaagagaaaccugaggugcccgauaagaaagggacacugauggucgaaaagcaggaggaagacgagucacuuauuccaauguuucugacugaauugaugcucaccgugcagagucuguuauucgagccuagccuggaggauuuucuagacggaauacucggugcuguaaaucacugccaaaacacaguucuguccgugcccaaucuugucccagauucuuauuucgacgccuuuaccagccccuacaucaacaauaaauuggaaggcaagacuugugggacgggaccuucacuggcagccguguucgaggaugacaagaacuuccacacaauuaucagucagauuaaagaaaccauccaggcugcguuugaguccgcacgaauauacgccgcuacuuucgaaaaguuucagaucuucuuuaaagagaaugagagccucgaucugcaagcccuuaagcugcaggaaccagacauuaacuucuuuucugagcaguuggaaaaauaucauaagcagcacaaagacgcagucgcccucagaccgaccaggaaugugggccuguuacugaucgauacacgccuacuccgggagaagcugauucccucaccucuuagaugcuuggaaguucugaacuucaugcucccaaggcaaaguaagaaaaagguggacgcuaucauauuugaggcccaggaugcagaguacaaacuggaguucguacccaccacuacaacggaguauguccauagcuuacuguuucuugacgaaauucaggagcgcaucgaguccuuggaagaugaggguaacauugugacccaaauguacaagcucauggaacaguaucagguuccuacuccacccgaggacuucgcgguguuugcuacaaugaaaccgucuaucgucgccgugcgaaaugcaauagauaagucgguaggggaccgggaaagcuccaucaagcaguucugugugcaccugggaucagaucuagaggagcugaacaaugaaguuaacgaggucaaacuccaagcccaggacccucagauucuggauaucagugcugaccaggauaagauucgucuuaucuugaauaaccugcaaucuguguuagccgaccuccagaaaagagcauuccaguacaagagcuaucagaaaaauuuuaagguggaagucuccaaguucgaggcucuggaagagguuucagccgagcuuaaacugaagcaauugcucugggacagcuuuucugaaugggauaaacugcagcaggaguggcuaaaguccaaauucgacugccuggauccagaagugcucaacggccaagugaguaaguacgcgaaguuuguaacccagcuggagaaaggccuucccccuaauagcgucgugccccaguugaaguacaaaguugaaaagaugaaagagaagcugccagugauaauugacuuaaggaacccuacacucaaagcccgccacugggcugcaaucgagcagacugucgaugccacccugguggacgcugaaaucccccuuacgcuggagcggcuaucucaacuccauguuuucgauuuugggcaggaaauucaggacaucuccggacaggccucaggugaggcagcgcuggaggccauuuugaagaagguggaagauaguuggaaaaccacagaguucguaauacugccacacagagacagcaaggaugucuuuaucuuaggcgggacugacgauauucaagugcuccuggacgacucgaccaucaauguggcuacacuugccuccucuagguaucugggaccguugaaaacucgagucgaugaauggcagaagcagcucgcacuguucaaccagacccuagaggaauggcugacgugccaacgcaauuggcuuuaccucgagagcauuuuuaacgcuccugacauccagcggcagcugcccgccgaggcaaaaauguucuugcagguugauaagucauggaaggaaauaaugagaaaagugaauaggcugccaaacgccuuacgugcugcgacacaacccggccuccuggagaccuuccagaacaauaacgcccuucuggaccagauccaaaaguguuuggaagcauaucucgagaguaaacgcguaauuuuuccucgguucuacuuucuguccaaugaugaacuacuggagauccuugcucagacuagaaacccacaggccgugcagccccaucucaggaagugcuucgacucuauuagcaaacuggaguuugccuugaugccuccggcugaagguaagaucccagggauagauggcgagcccgaaaaggucuauacaaaugacauuuuagcaaugcuguccccugagggagaacgagugucacucggcaaagggcugaaggcccggggaaacguugaggaguggcuugguaaaguggaagaggcgauguucaccagccugcgcagauuguguaaggcugccaucgcagauuaccaaggcaaacuaaggacugacugggucguggccgggcacccaagucagguuauccugaccgugucucagauuauguggugccgggaucucacagaaugucuggagacggagcauuccaaucacauacaggcucuuaagaacuuugaaaaggucaauuucgagcgauuaaacgcacuggccgcgaucguacaaggaagccuccccaaauugcacagaaauauucugaccgcucucaucacuauugacgugcaugcccgcgacaucguuacagaacuggugcagucgaaggucgagaccguggaaucauuugauuggcagaggcagcuucguuauuacugggacauagaucuggacaacugcguagcacggauggccuugucucaauacacauauggcuacgaguaucuaggugcuuguccuagacuggugaucacuccgcucaccgauaggugcuacuuaugucugaugggggcccuucagcuggaccucggcggagcacccgcuggcccagccgggacgggaaaaacagagaccacuaaggauuuggcgaaagcccuggcaauucagugcgucguuuucaauuguagugacggucucgauuauaagaugaugggccgcuuuuucuccgggcuggcucaaagcggagccuggugcugcuuugacgaguucaaccgaaucgauauugaggugcuuucugugaucgcucagcagcuaauaaccauuagaaaugcaaaggccgccaaacugagccgguucauguuugaaggcagggagaucaaguuggucaugacaugugcugcguucaucacuaugaacccugguuacgcagggcgcaccgaauuacccgacaaccugaaagcccucuuucguccauucgcuaugauggugccuaauuaugcccugauugcagagguuauccuuuacuccgagggcuuugaaucaaguaagauacuggccagaaaaaugacacagauguacaagcucugcagcgagcaauugucucagcaggaucacuaugacuucggaaugcgggcuguaaaauccgugcuggucauggcgggcucacuaaagagggaaaaccccgaccugaaugaggaugugguucucauucgcgcccuucaggacaguaaccugccaaaguuuuuaacggaugacgcauugcuguucagcgggaucauuuccgaucucuuuccgggagugcaaaucccugaacaugacuacggcauacugcagucuaccauugucgaugugaugaaucgacagaaccuucagcccgagauguguaugguaagaaaagucauccaauucuaugagacuaugcuggugcggcacgguguuaugcucguggggccaacaggaggcgguaagaccacugucuacaggaucuuggcugaaacacugggcaauuuacagaaacuagggauugagaacucguuuuaucaggccgugaagaccuacguucugaaucccaaaagcaucacgaugggagaacucuauggcgaggugaacaaucuuacucuggaguggaaggacggguugauggcacugucaguccgcgccgcugugaacgauaccuccgaagaccauaaguggauuauaagugauggaccuguagacgcccucuggaucgagaauaugaacacagugcuggaugacaauaaaaugcuuugccucgcgaacucugaaagaauuaagcugaccccacagauccacauguuguucgagguucaagaccugagggucgcaagccccgccacugugucccgguguggcaugguguuugucgauccugaagaguuaaaauggaugccguacguaaagacauggaugaaagguaucucaaagaagcuaaccgaggaaacacaggaguacauucugaaucucuuccagcguuauguggacgaagggcuucacuucauaaacaaaaagugcucucaagcuaucccacagguugauauuagcaaagugacuacccuguguugcuugcuggagagucucauccugggaaaggacggcgucaaccuugccauggaacagacgaaauuaaauacaauucugugucagaccuuuguguucugcuaccucugguccuuggguggcaaccugacugagaauuauuacgauagcuuugacaccuucauccgcacacaauuugaugacaaccccgaugcucgacuaccuaauucuggggaccuguggucaauacauauggauuucgacacuaagagacucgaccccugggagaggaucauuccaaccuuuaaguauaaccgggauguuccuuucuuugaaaugcuugugcccacgacagacaccguccgcuacggauaucugauggagaaauugcuggcagugaagcacuccguacucuucacuggcaucacaggggugggaaaaaguguuauugccaagggccuguuaaauaaaauccaggaaagcgcugguuacgucccaguguaccuuaacuuuucggcccagaccucuuccgcaagaacucaggagauaauugaaagcaagcuggagaggaaacggaagaauauccucggggcgccuggaaacaagcgaauugugaucuucgucgaugaccuaaauaugccgagacuggaucgcuauggcucacaacccccaauagaguugcugaggcaguaccaggacuuugguggcuucuaugaucggaacaaacucuucuggaaggaaauccaggacguuacaauuaucagugccugugcuccucccgggggaggccguaauccagugaccccuagauuuauuaggcauuucucuaugcuuugccugcccaugccguccgagcacagcuugaaacaaaucuuucaggccauacugaacggguuccucucagauuuucccccugcaguaaagcagacggcuaguagcauuguggaagccuccgucgagaucuacaauaaaaugucuguggacuuacugcccacuccagcaaagagccacuauguuuucaaccuucgcgaucuguccaagugcgugcaaggaauccuacagugugaccccggcaccauucgggaggaaauccagauauuucgacucuucugccaugagugucagagagucuuucacgauaggcugauuaacaaugaagacaaacauuacuuccacguaaucuugacagagauggccaacaagcauuuugguauugcuaucgaccuggaauauuuccucaauaaaccuauaaucuuuggggauuucauuaaguucggagcggacaaagccgaucgcaucuacgacgauaugccggacauugagaagaccgcaaacgugcuucaagauuaccuggacgauuauaauuuaacaaaccccaaggagguuaaacugguguuuuuccaggacgcuaucgaacacgucucacggauugccagaaugauccgucaggagaggggcaaugccuugcucgugggcgucgggggaacugguaagcagucucugacccggcuagcagcucacauaugcggcuacaaaugucuucaaauugaacugagucgcggguauaacuacgauucguuucaugaggaccuccgaaagcuguauaaaauggccggaguggaagacaagaauaugguuuucuuguuuacggauacacagaucgugguagaggaguuccuggaagacaucaacaauauucucaacagcggcgaggugccaaaucuuuuugaaaaggaugagcuggaacaggucuuagcggcuacuagaccuagggccaaagagguugguauauccgaggggaaccgggacgaaguguuccaguacuuuaucucuaagguccgccaaaaacugcacauuguguugugcaugucacccguaggagaggcauucagaaguaggugucgaauguuuccuucccucgugaauugcuguaccaucgauugguucguucaguggccacgggaagcccugcuaagugugucuaagacauuuuucagccaggucgacgcuggcaacgaggagcuuaaagaaaagcugccccucaugugcgugaacguccaucugucaguguccaguauggcagagcguuauuacaaugaauugagacgcagguacuauaccacuccuaccagcuacuuagagcugauuaaccucuaucuuucuaugcuguccgaaaaacggaagcaaaucauaucagccagagaucgcguuaagaauggccuaacaaaacugcucgagacgaacaucuugguagacaagaugaaacuggaucuuagcgcgcuggagccagugcucuuagcuaagucggaagacgucgaggcccugauggaaaaauuggcaguggaucaggagucugccgaccagguuaggaauacugugcaggaagaugaggcuaccgccaaggucaaggcagaggaaacacaagcuauugccgacgacgcgcagcgagaucuggacgaggcccuccccgcacuugaugcugccaacaaagcacuggacagucuagauaaggcugacaucuccgaaauucggguguucaccaaaccgccugaucugguaaugacugugauggaggccaucagcauacucuugaaugccaagccagacuggcccucagcgaaacagcugcuuggggauuccaacuuucugaagagauuacucgaauacgacaaggagaauauuaaaccucagauccuggcuaaguugcaaaaauauaucaacaauccagauuucguucccgagaaggucgaaaaagugucuaaggcauguaagagcaugugcaugugggugagggccauggaccuguacagucgcgucguuaaagugguagagccgaagcgucagaaacuccgggcugcccaggcagaacuugauauuacaauggccacccugagagagaagcaggcucuacugaggcaaguggaggaccagauacaggcgcuccaggacgaauaugauaaaggagucaacgagaaggaauccuuggccaagacgauggcacugacuaaagcucgcuuagugcgagccgguaaacuuacagcagcccuggaggacgaacaaguucggugggaggagagcauccagaaauuugaagaggaaauuucuaauaucaccggcaacguguucauugcugccgcgugcgucgcauacuacggggccuuuaccgcucaguauagacaaucacucaucgaguguuggauacaggauugccagagucuggaaaucccuauugaccccuccuucagcuugaucaauauucugggagauccauacgagaucaggcaguggaacacugacggccucccucgcgaucuuauuucuacagagaacgguauacuggugacccaagggagacgguggccccuaaugaucgacccacaggaucaggccaauagguggauucguaacaaggaaucgaaaucaggacugaagaucaucaaauuaacagacagcaauuuucuccgcauucuggagaacuccauaagauugggccuucccguacugcucgaagaacugaaggaaacuuuggauccugcacuggagccaauccuacucaagcagauuuucaucaguggcgggagacuucugauucgguuaggagacucugacaucgauuaugacaaaaauuuuagguucuacaugacgaccaagaugccgaacccccacuaucugccugagguuuguauaaaagugacaaucauuaauuuuacugucaccaagagcggucucgaagaucaacuguuguccgacguggugcgccuugagaaaccaagacuggaagaacagcggaucaagcucauugucaggaucaacacagauaagaaucagcugaaaaccauagaggaaaagauucuacgaauguuguucacuucagagggcaacauccuggacaaugaagaacucauugauacgcuucaggacaguaaaaucaccucuggggcuauaaagacacgucuggaagaggccgagagcacugaacaaaugaucaacguugcuagagagaaauaccgccccguggccacccagggauccguaauguauuuugugauugcaucauuaagcgaaaucgauccuauguaccaguacucucugaaguauuucaagcaacucuucaauacaaccauugagacuuccgucaaaacagaaaaccugcagcagcgguuggacgugcuucuggagcagacgcuccugaccgcguacguuaaugugaguaggggccuauuugagcaacacaaguuaaucuauagcuucaugcugugcgucgaaaugaugagacagcaggguacuuugucggaugccgaguggaacuuuuuccuccgcggguccgcuggacuggaaaaagagcggccacccaagccugaagccccguggcuuccaacagcaaccugguuugcuuguugcgaccuggaggagucuuuccccguguuucauggccucacccagaacauacugucacacccuauuagcaucagguugggcaguuucgaaacauacaucaauccccaaaaaugggagggguauuccaagaugaagcaugaagauaaacacaugcgacaggagaaggaggccgcacaucaggacccauggucugccggacuuagcucauuucacaaacugauucuaaucaaguguugcaaagaagagaagguaguuuucgcgcucacugacuuugugauagaaaaccuggguaaacaguucauugagacgccucccgucgauuuaccaacccuguaccaagacauguccuguaauacaccguugguguucauccucaguacuggcagcgauccuaugggggcuuuucagagauucgcccgggaaucuggauauucagagaggguucaguccauuagccugggccagggucaagggcccaucgcagagaagauggugaaggacgccaugaaaucuggaaacugggucuuucuucagaauugccaccuggcugugaguuggaugcucgccauggaagaguugauaaagaccuucacagauccagacucggcaaucaaagauaccuuucgccuguuccuuuccagcaugcccucaaacacuuuuccuguaacggugcugcaaaauucugucaagguuacaaacgaaccacccaaaggcuuacgugcuaauauuagacgagccuucaccgagaugacuccuagcuuuuucgaagagaacauccuaggcaagaaguggaggcaaauuaucuuugggauuuguuucuuucaugcgaucauacaggagcggaaaaaguucggaccgcucgguuggaauaucugcuacgaguucaacgacuccgaucgcgagugcgcucugcugaauuugaaacucuacuguaaggaaggcaaaauuccaugggacgcccugaucuauauuaccggggagauaacauacggaggcagagugacugauaguugggaccagaggugccuucggaccauccugaagcgcuuuuucucacccgaaacauuagaggaggauuauaaguacucugaaagcgguauuuauuuugcaccuauggccgacucccuccaggaguucaaagacuacaucgaaaaccugccauugauugaugaccccgagaucuuugggaugcacgagaaugcuaaccuugucuuccaauauaaggaaacgaguacccugauaaacacuauccuagaggugcagccuagaagcuccacaggcggagaaggcaaaucuaaugaugagauuguacaggaacucguggcaucaguucagacccgagugcccgagaagcuggagauggaaggggccagcgagucgcuguuugucaaagacuugcaaggaaggcucaacucccugacuacagugcuuggucaggaaguugaucgguucaauaaccuguuaaagcucauccauaccagucuggagacgcuaaauaaggcgauugccggcuuugucgugaugucugaagagauggagaaaguguacaacagcuucuugaauaaccagguaccagcucuguggucaaauaccgcauacccgucccuuaagccucucgggucuugggucaaagaccugauccugcguacaaguuuuguggauuuguggcuuaagcgcggacagcccaaaagcuauuggauauccggcuucuuuuucccacaagguuuccucacugggacccugcagaaccacgccagaaaguacaauuuaccuauugacgaacugucauuuaaauauagcguuauccccacauacagggaucaggcugccgugaucgaggcagcuaagacuguccaauucggccaggaacuaccaauggacauggagcucccuucucccgaagauggagugcugguucacggcauguuuauggacgccagucggugggacgauaaggagauggugauugaggacgcguugccggggcagaugaacccaguacugccugucgugcauuucgaaccccagcaaaauuauaaaccaucccccacccuuuaccacuguccucucuacaagacaggagccagagcagguacccugagcacuacgggccauucaacaaacuuugugguuaccgucuuacugccgucuaaacgcuccaaggauuauuggauagcuaaagggucggccuugcucugccagcugagcgaguga

SEQ ID NO: 55374 - RNA, 12075 nt, Artificial Sequence
  derived and/or modified sequence opt3 from DNAH7__Homo_sapiens__NP_061720
augucauccgaacaggacaagucugccucaaaagaaaagaguaaaaagcccgugagauuccugccucaacucucaauggaaaaacuugcuuccaaggaaaaguuuaaagcaccagccagagcgcugccgcaauugucuauggucucgaccaagccccacuggcagcaggcugccccuucauuccacuuauccguuaaacaagaugacgaaaguccagaacccuuuuccgugaagaacgaacagucucacgcagaguacauggaacgguucggcaaaaaggggaagcugccucaucagguugaugacagcuaugugggaccauccacaucaaaaaguaaggguaaaagcccccacaaggagcgcgaaaauuuucgaucuacucuagucaacgugaucaugcagcaagaugccgaccucgauuccgcuguuccugacggcucaacgauuccaaaaccgaccgcaagcgccauagagaaggauauccugcguuacuauuacuauauucaucacgggaucgacacagaucacguggcucccauggaggacaguuggcuugaacauguccuggauuuggugccucagcaccucaaaguauucacugacucuauuguuacccuguccgacgagaugagagaagauuaccugcucagcgugagaaagucgaucgucgacuuuguguuaaaggauccacgggagaaaggagacgauaagaaaacagacgaacugcccgcccaucgcgcggagauggagauacuuccuaagccauggagaaaaucuuucuuggcagccuccucauauaucagggaucaccugaaugcuaugaaccccaccaugcuagccgugcucgaccuguggcacacuaauuuuaagaaacuucggcuggucgauauuaaagaguuccauaacugucaggacgcauuggagcucaguagcuuucagaauaucauuaugcgccacauggauuccgcuaaggaaacacuguuaaaaaugugguucccggagguucaaaacaucuacuaccagggcaauaagaaaaagcagcugccuaccggugacucuagcgccaagcucgaaucauuuuucaacugugcggccgcacuuaugacgcugcaauugcaggaccuaacucuggugaguaugcaggauuucaccgaccucauagcucagcccccagauuccguacgagccuuugagcauccuggguucauuaugagacugauccuugacaaugauacaauuaaauuugagcccgaacugagcgacuauaucgauaucuucuugaacguguacgacgucaugauuaaggcugugucuuuuguuccaaggguggagacuaaacucuauucaaagugggaaaguaaaagcaagcccaccacacugaagccuauaaucuuaaaugagauugucgaugcccacaaagaaaagaucaaagaggugauaaugaaggaguccguagcaccaaccgaacaucugcggcuauacgacaaauaugauuuccucauuacgcguaaggccgagcgcgacguugauaacuuucuggcugaaaaucacucuuacgagaaaaucaucgacgagauuugcaaguaucaaaaacuuaucgaagagauucaguacacuucgauaaaaacaaucagauugggaauguucgaaaugcacugugaggaacugauuagggcgcucgugaagcgggcagacaucaucugcggcaaacugcuugccaagauguuucgagaucaucaggaggucaacacccgccugugugacgaguucgaaagaauugcugagaaagccuugagcacuccgcccaacacagcagaacucauggagaugaaggccuacauacagaagguggaagucaccgauaugaucgagcuggagcaaagguuaguggacuccaaaaauugccuggcuuuucuaauugaauauguuaacuucagcccugccgauaugcggcucaauaacaguguguuucagugguacggccgcaugggggagaucuucgaagaacacagaaagauuaucaaagaaaagauagagcaguaucaggagggacugaaacuuaggugugaacguuucguagaggaauuggagucuuacgcaaagcaaagcgaggaauuuuauuccuucggugaccugcaggauguccagcgguaccucaagaaagcgcagauccugaauggcaaguuagaccuggcugccgauaaaauugagcaauuuaacgcagaagaggaagccuucggguggcuuccaucaguguauccccagcgaaagaaaauccaggacggauugaauccuuaccucagacuguacgagacggcuguugaguuuagcucuaacuauagggccuggaccgaaggcccauaccauaaggugaaucccgaucaagucgaggcagacauugguaacuauuggcgcgggcuauacaagcuggagaagacauuccacgauuccccguaugcucucgccaugacuaagaaagugcggaguaagguagaggacuuuaaacagcacaucccucugauacaggugauuugcaauccaggacuuagacccaggcauugggaagcgaugagcgccaucguuggcuacccuuugcagcccucugacgauuccaccgucucaaguuuccuggacaugaacuuagagccauauauugaucgcuuugagggcaucagcgaagcugcaucgaaggaguacucccucgaaaaagccauggagaagaugauaacagaaugggacgcuguggaguucgugauccacucuuaccgagagacugggaccuuuauucuggccagcgucgaugaaauccaaaugcuucuggacgaucauauuaucaagacacagaccaugcggggaucaccuuucauaaaacccuaugagaagcagaugcgugaaugggaggguaaauugcuccugcuacaggagauucuggacgaauggcucaagguucaagcaacuuggcuguaccuugagccaaucuuuaguuccccggauaucaugucucagaugccugaagagggcagaagguucacggcgguggacaaaacauggcgcgauauuaugcggagcgugaugcaggacaagcacguauugaccgucgugacuaucgacagaaugcuggaaagguuaaagaaauccaaugagcuccuggagcuuauucugaaggggcuaaacgaauaucucgagaaaaagcgacuguucuuuccccgcuucuuuuucuugucaaaugaugaacuguuagagauacucagcgaaaccaaagacccaacacggguucagccccaucugaagaaguguuuugagggaaucgccaaaguggaguucaccgaaacucuugauauuacacacaugaagaguucugagggcgaagucguggagcugaucgaaauuaucuccacggcuaaagccagaggucaaguugagaagugguugguggagcucgaaaggguaaugauaaacagcauccacaaagucaccggggacgcaacuuuugcuuacacaaaguaugagcguauuaacugggugcgcgauuggccuggccagaccgugcugugcgucucgcagaucuucuggacaaaggaaguucaaacugccauuccaaugggaaucaaagcacuagagcaguaccugaagaccuguaaucggcagauagacgauauugugacgcuuguaagaggcaaacucucaaugcagaacagggugacccugggggccuuggucgugcuggacguucaugcucgagauguguuaucuagucucgucaagaaaaauaucuccgacgauagcgacuuugaguggcugucucaacuucgguauuacuggcaggaaaaccaccuggagacaaagaugaucaaugcgggauugcgcuacgguuaugaauaccucggcaacagccccagacuggugauuacuccucuaaccgauaggugcuaucggacacuguucggggcccuucaucuccaccugggaggcgcaccggaggguccagcugggacuggcaagaccgaaacgacaaaagacuuggccaaggccguugcuaaacagugcguggucuuuaauuguuccgacggauuagauuaccuggcacucggcaaguucuucaaagggcugcuuucaugcggagccugggcguguuuugacgaguucaaccgaauagaucuggagguauugagugugguugcucagcaaauccuaaccauucagagagguaucaaugccggcgcagacauucugauguuugaagggacugagcucaagcuggaucccacaugcgccguguucaucaccaugaacccuggauaugcuggccgcagcgaacuuccagacaauuuaaaagcacuguuuaggacugucgccaugauggugcccgauuacgcgaugauagcugagaucguacucuauucuugugguuucgugaccgcccguccuuuguccgucaagauuguugcaacauaccggcugugcucagaacagcucaguagccagcaucacuacgacuaugggaugagagccgugaaguccgugcugacggcugccggcaaccuuaaacugaaguacccgaaugagaacgaggaaaucuugcuacugaggucuauuaucgaugucaaucuccccaaauuuuuaucgcacgaccugccacuuuucgagggaauaaccagcgaucuguuuccuggcgugaagcuccccaaaccagacuauaacgauuugcuggcagcuauuaaggacaacugugccucaaugaaucuccaaaugacugcguucuuuuccgaaaagauccugcagguuuacgagaugaugaucguacgccauggguucaugauugugggagaaccuuuuggcgguaaaacaagugccuaucgaguccuugcaggggcucuaaacgacaucugcgagaagggacugauggaggaaaauaaagugcagauaaccguuuugaaccccaagucugugacaaugggccaguuauacggucaauucgauagcgucucccacgaguggucagacggcgugcuggccguaucuuucagagcuuuugcaagcagugucacuccagaucggaaauggcucauuuucgacgggccgguggaugccguuuggaucgaaaauaugaacaccgugcuggacgauaauaagaaacuuugucugauguccggagagauuauccagaugagcccucagaugaaccucauauuugagcccauggacuuggaagucgccucuccagcuacggugucaaggugcggcaugauuuauauggagccccauaugcugggguggcgcccucuaaugcuguccuggguuaaucuccuuccagcgagugugagcgucauccaaaaagaguucaucaugggacuguuugaucguauggugcccguaucgguggaguucauuagaaagcacacaaaagaauuaucuccuaccuccgacacuaacuugguucggagccugaugaaucucaucgauuguuuuauggacgacuucgcagaugaggucaagcugaaagagaggaacgaccgcgaaaccuacucacuucuggagggcauuuuucucuucaguuugauauggucugugggugccuccugcacagaugacgaucgacugaaguuuaauaagaucuuaagagaacuaauggagagcccgauuucagaccggacuaggaacaccuucaaacugcagagugggacagaacagacgagcuccaaggcucucaccgugccauuucccgagaaaggaacuaucuacgauuaucaguucgucacagagggcaucgguaagugggaaccuuggauuaaaaagcugaaagaggcacccccaauaccuaaggacguaauguucaaugaaaucauugugcccacccuugauacuauccgcuacucugccuugauggagcugcucacaacccaccaaaagccaagcauuuuuguuggcccuacggggacuggaaaauccguguauaucaccaacuuccugcuuaaccagcucaauaaggaaauauacaaaccgcuguugaucaacuuuucagcccagacaaccgcugcgcagacucaaaauauugucaugucuaagcuggacaaaagaaggaagggcguguucgggcccccauuaggaaagcggaugguuguguuugucgaugacgugaacaugccugcccgugagguauauggcgcacagcccccaaucgagcuacugcgccaguggcucgaucauuggaauugguacgaccuuaaagacugcaguaugauuaagcugguggauauccagauaaugugugcuauggguccucccgggggaggccgaaacccgguuacaccaagauauaugaggcacuucaauauuaucaccauuaacgaauuuucggacaaaagcauguacacaaucuucucccggauauugacuuggcaucuggagaucugcuacaaguuuccugaugaguuccucgaccugaccacgcaaauugucaaugguacaaugacccuuuauaaagaggccaugaagaacuuacugcccacuccagcaaagucucacuaccucuuuaauuugcgcgauuucucaagagugauccagggcgugugucugagcaggcccgagaccacagaaacuaccgaggucauuaaacggcuauggguucaugaagugcugcgaguauauuacgacagacuccuugauaacacggaccgcuccuggcugaucaauuauauacaggagauuuugaggaacuacauguaugaagauuuucacgagcuguuccaacggcucgacuucgauaaugacgggaugguggaggccgacgaucugcguaguuuaauguuuugcgacuuccacgauccuaagagagaagacacaaacuacagggagaucgcugaugucgacaaucuucgcaugaucguggaaauucaucuggaggaauacaacaacaucucuaaaaagccgaugaaucucguucuauuucgguucgccauagagcacauuagccgaaucucaaggauucugaaacagcccaggucccaugcguugcuggugggagucggcgggaguggacgccagagcguaacccggcucgcagcccacauggcugauuauucuguguuucagguugagaucuccaagggcuacgacacuacagaauggcacgaggaucuuaaggugauacugagaaaaugugccgaaggugagaugcaaggggucuucuuguuuaccgacacucagaucaaggaagagucauuccuggaggaugugagcaaccucuuaaaugcuggagaaauuccaaaccuguuugcacuugacgagaaacaggaaaucugcgauaagaugcgucagcuggacaggcaacgggacaaaacaaagcagaccgauggcucgccuauugcccuauucaauauguuuaucgaccauugucgcucucagcuccacgucgugcuggcuaugagucccauuggcgaugccuuccgaaacagauugaggaaauuuccugcacugguuaauugcuguacgaucgacugguuccaguccuggccagaggaugcgcuccaagccguggcuagccgguuccuugaggaaauagagaugucagaagagauucgcgacgggugcaucgauauguguaaguccuuucauacuucuaccaucgaccugagcaagaguuucuuuguagaauuacagagauauaacuacgugacacccaccuccuaucuggaguugauuagcacauucaaacuccugcuagagaagaaaaggucugaagucaugaagaugaaaaagcgauacgagguuggacuugaaaagcuggauucagccaguucccagguggcaacuaugcagauggagcucgaagcucugcacccucaauugaaagucgccagcaaggagguggacgagaugaugauaaugaucgaaaaagagucuguagaaguggcaaagaccgagaaaauuguuaaggccgaugaaacgaucgcuaaugagcaggcgauggccucgaaggcaauuaaagacgagugcgaugcugaccuggccggugcccucccaauccuugaaucagcacuggcugccuuagacacacugacugcgcaggauauaaccguggucaagagcaugaaaagucccccggcuggcgugaaguuggucauggaggccaucugcauucucaaagggaucaaggcagacaagauuccugauccaacaggaagcggcaaaaagaucgaagacuuuuggggucccgccaaacggcugcuaggggauaugcguuuccuucaaucucugcaugaguaugacaaggauaacauaccuccagcuuacaugaauauuaucaggaagaacuacauccccaauccggacuuugugccugagaagauucgcaacgcaagcaccgccgcggaaggacucuguaaguggguuauagcuauggauuccuaugacaaaguagccaagaucguggcacccaaaaagauuaaacuggccgcugccgagggcgaauugaagaucgcaauggauggcuuaaggaaaaagcaggcugcccugaaggagguccaggacaaacucgcgcggcuucaggacacucuggaacuaaauaagcagaagaaagccgaucuggagaaccagguggaccucugcagcaagaaguuggagagagcagaacagcugauugggggacuugguggcgagaagacccgcuggagucacacagcucuggaacucgggcaguuauacaucaaccugacgggagauauauugaucucuagcggcguuguggccuaucugggugcauucacuuccaccuacaggcaaaaucagacaaaagaguggaccacucucuguaaggggcgagacauuccaugcucagaugacuguagccuuaugggaacacugggcgaagcugucaccauccggacguggaacauugccggccuaccuucugauuccuuuaguaucgacaaugggauuauaaucaugaacgccagaagguggccccugaugauugauccacagagccaggcgaauaaauggaucaagaacauggagaaagcuaauucgcucuaugugaucaaguuguccgagcccgacuacguacgcacucuggaaaacugcauucaauucggaacaccugugcuucuggagaauguuggugaagaguuagauccaauacucgaaccgcuguugcugaagcagaccuuuaaacagggcgggucuaccuguauccgucucggagacucaacuauugaguaugcacccgauuuccgguuuuacaucacaaccaaacuuagaaacccucacuaccugccagagacaagcgucaaagugacucuacugaauuucaugauuacgcccgaaggcaugcaagaccagcucuuggguaucguggucgcccaggagaggccugaccuggaagaggagaagcaggcuuuaauacuucaaggggccgaaaacaaacgccagcugaaggagaucgaagauaagauucucgagguucugaguuccucugaaggaaauaucuuggaggacgagaccgcaauuaaaauccugagcucauccaaggcccucgcuaacgaaauaagucagaaacaggagguggcggaagagacagaaaagaaaauugauacuacccgaaugggcuaucggccaaucgccauucauagcucuauccuuuucuuuucacuggcagaccuagcuaauauagagcccauguaccaauauucccugacaugguucaucaacuuauuuauucucagcaucgagaacucugaaaagagugagauucuggccaaaagauugcagauccuuaaggaucacuucaccuacucgcuguauguaaaugugugcaggucccucuuugaaaaggacaaacuguuguucagcuuuugucugacuauaaaccuacuccuucaugagcgcgcaauuaauaaggccgaauggagauuccuguuaacgggcgggaucggacuggauaacccuuacgcuaaucucugcaccuggcugccgcagaaaucaugggacgagaucugucgguuggaugaccuuccagccuuuaagacaauuaggcgugaguucaugcgacugaaagaugguuggaagaaggucuaugacucucucgaaccccaccacgagguguuuccugaagagugggaggauaaagcgaacgaguuccagcgcaugcugaucauaagaugccuacggcccgacaagguuauuccaauguugcaagaguuuaucauuaauaggcugggccgcgcauucaucgaaccucccccauucgaccucgccaaggcuuuuggggauagcaacugcugugccccgcuuauauucgugcuguccccuggagcagaccccauggcugccuuacugaaguuugcugaugaccagggcuacggugggaguaaacucucaucucugagcuugggacagggccaaggcccaaucgccaugaagaugcuugagaaggcagucaaagaagggacuugggugguacugcagaauugccaucucgcgaccuccuggaugcccacacuggagaagguuugugaggaacuaaguccugagagcacccacccagauuucagaaugugguuaacuuccuaccccucuccuaacuuuccggugucaguccugcagaauggagugaaaaugacaaacgaagccccaaaggguuugcgggcuaauauuaucaggagcuaucucauggaccccauuucggauccugaguucuuuggcuccugcaaaaagccagaagaguucaagaaacugcuuuacgggcugugcuuuuuccaugcccucgugcaggagcgacguaaguuuggaccccugggcuggaacaucccuuaugaguucaaugagacggacuugagaauuaguguccaacagcuucacauguuccugaaccaguacgaagaacuacccuaugaagcacuccgcuacaugaccggugagugcaacuaugggggccggguuacugaugacugggauaggagaacacugcgcucuaucuuaaauaaauuuuucaacccagagcugguggaaaauagcgacuacaaguuugacucauccggaauauacuucguaccgccuucuggcgaucauaaaaguuauaucgaguacaccaagaccuugccccucacaccagcuccugaaauuuuugggaugaacgccaaugcagacaucacuaaagaucagagcgagacgcaacugcuuuucgacaacauucugcucacccagucccggucagccggagcgggugcuaagagcucugaugagguggucaaugaaguggccagugacauauugggcaagcugcccaacaauuuugauaucgaggcagccaugaggcgauauccaacaacuuacacccaguccaugaacacaguucuugugcaggaaauggggagauucaauaaacuguuaaagaccauucgggacagcugugucaacauccaaaaagcuauuaagggacuagccgugaugucaacugaucucgaggaaguaguuucuuccauccugaaugugaaaauaccugagauguggaugggcaagucguaucccagccugaagccguuggguaguuacgucaacgacuuucucgcaaggcugaaauuccuucagcagugguaugagguggggccaccucccguauuuuggcugucuggcuucuuuuucacgcaggcuuucuuaacaggagcccaacagaauuacgcgcgcaaguacaccaucccaauugaucuccugggcuuugacuaugaagugauggaggauaaagaauacaagcaucccccugaggacggggucuucauccacggauuguuucuugacggugcuuccuggaaccguaaaauuaagaagcuggccgaaagccauccgaaaauccuauaugauacugugccaguaauguggcucaagcccugcaaaagagcagacauaccuaagcgacccucauacguggccccacuguauaaaaccagugagaggcggggcguccuguccacaacugggcacagcaccaacuucguuauugcuaugacauugccuucugaucagcccaaggagcauuggaucggacgcggcguggcacuccugugucaacuuaauucauga

SEQ ID NO: 55375 - RNA, 14124 nt, Artificial Sequence
  derived and/or modified sequence opt3 from DNAH8__Homo_sapiens__NP_001193856
auggaaaaggacgccgaagacggcgcucccagcgaaggggcagaagccccuccauccaccgaagaagcggcuccgcccagaucugaagaagaagaagccccuagaccacccaccguggaagccccugccgaggacggauucucaccaagugcugaggaugcagucagcuccguuguggacuaccgggaucugauccccucugaagaggguauuguacucccugacgaucacgaagccgaccuuaaccgcgugcgacagcgucuggcuccaagaccgguccaaucggugauaucagagguuuugagcuuacccaguuccaggcggucuagccgcuauagaagguccaugucaggccugccuaaucuacaggaaacucucaaagagcggcaggcccgcuuucgagaggcgagagaaaguaggcggcugaagaucgauccaagcuacaaauauauuuucgagauccuugcagaaaaccugggguuggacauugugacggucgaggaacucauccuggauugccccucucuggaggccuuuaccaauuucuuugcuaaggacggauguaaaacacucaaguucuuauaccaggagggcgaugugccugguauugaaugcgggcguacuaucgccggagcaaccaagggcgcuaaaaugaugaagcuguauauugacaacgccgcgccagacaaacuuaagggcuuguguaucuuuuucguacgcugcagaaaugauguugccauuaacgugaaaacaauccaagaggaagcacuguuuaccgucuuagacgcuuccaaggggcuccugaauggaauaagggauaugcuugccaacauuuuccugcccgcuguguuggccacuaauaacuggggugcacucaaucagucaaagcagggcgagagcgaaaaacauaucuuuacagagaccauuaaccgguaccugaguuucuuagacggggcccgaaucucuaucgagggaacggugaagcugaaaacuauugauaaugucaacuuuuccaagcuccacaccuucgaagagguuacagcugcggcaagcaauucggaaacugugcaucagcuugaggagguacugauggugugguauaaacaaauagaacaggucuugaucgagucugaacagaugcgcaaggaggccggcgacuccgguccguuaaccgaacuggagcacuggaaaagaaugucagcuaaguucaacuacauuaucgagcagauaaaggggccuaguuguaaagccgugauuaacguucucaauguggcacauagcaagcugcuuaaaaacuggagggaucuggacgcccggaucacagauaccgcuaaugaauccaaggacaacguccgcuacuuguauacgcucgagaaagugugccaaccccuguacaaucacgauuuaguaucuauggcccacggaauccagaaccugauuaaugcaaucagaaugauucauggcguuagcagguauuacaacacuucagaacguaugacaagucuauuuauaaaggugaccaaucagauggucacugcguguaaggcuuauaucacagacggcgggcucaaccacgugugggaccaagagaccccagucgugcugaaaaagauucaggauugcaucuuccuuuuuaaagaauaccaggccuccuuccauaagacgcggaaauugaucagcgagucuucaggagagaagaguuuugaaguuagcgagauguauauuuucgguaaguuugaagcauucuguaaacgacuggagaagauaaccgaaaugaucacagugguacagacuuacuccacccucucuaauucgacaauugagggcaucgacauuauggccaucaaauuuagaaacauauaccaaggggucaagaaaaagcaguaugauauccuggacccuaggcgcacugaguucgauaccgacuuucuugauuucaugacaaagauuaauggacuggaagugcagauccaggcuuuuaugaacagcuccuucggcaaaauuuugucaagucaacaggcccuccagcuguuacagcgguuccaaaagcugaauauccccugccuaggucucgagauaaaccacaccauugaaagaauccugcaguacuauguugcagagcuugacgcuacuaaaaaguuguaccacucucagaaagaugacccaccccuggccaggaacaugccuccaauugcggggaagauccucugggugcgccagcuguaucgacggauaagcgagccgaucaauuacuuuuucaaaaacuccgauauuuuaucaagccccgacggcaaggccgucauccgucaauauaauaagauuucuuacgugcugguagaauuugaggugguuuaccauacggcuuggaucagagaaauaucccagcuucacuaugcauugcaggccacacucuucgucaggcauccugagaccggaaaacugcuagugaacuuugauccaaagauucuggaagugguccgcgagacuaaauguaugaucaagaugaaacucgacguucccgagcaagcuaagcggcugcuuaaguuggaaaguaaacugaaggccgacaaauuauaccuccagggccugcuucaguauuacgaugagcugugccaggaagugccuagcguguucguaaauuugaugaccccaaagaugaaaaaggucgagucugugcucagacaagggcugacaguucuaaccugguccucacugacucucgagagcuuuuuccaggaaguggagcugguccuugacauguuuaaccaguugcugaagaaaaucagcgauuuaugcgaaaugcacauugacacagugcucaaggagaucgcaaaaacgguucugauuucgcuucccgaauccggagcgaccaagguggaggauaugcugacucuaaaugaaacauauaccaaagagugggccgacauacucaaccauaagucuaagcacguagaggaagcugucagggagcugaucagcauuuucgaacagaucuacgaggugaaauauacagguaaggugggcaaacaaucagagcagcgaaagcacgucguuuuugggagugaaacuggagagggcgaaaauaacgauuacgaggccaauauugugaacgaguucgacacccaugauaaagaggacgaguuuaagaaagaauguaaggagguauucgcauucuuuucccaccaguugcuggauucuuuacagaaggcuacgcgccucagccuggacaccaugaaacggagaaucuucguggccucccuuuacgguaggaagcaaucagaagauauaaucagcuuuauuaaaagugagguccaucuggcaaucccgaaugugguuaugauuccuucuuuggacgacauccagcaggccauaaaccguaugauucaacucacacuggaagugucccgcggggucgcucacuggggccagcagcagauccggccaaucaagagcgugauucccucgccuacuaccacagauguuacucaccaaaauaccggaaaacuacugaagaaggaggagagaucauucgaagaggcgauacccgccaggaaacuuaagaacuuuuauccaggcguggcagaacauaaagacaucucuaagcucguccuguugcugaguuccagcguaaacucuuuacgaaaagcugcccacgaggcccuccaggauuuccagaaguacaagacgcuguggacagaagaccgggaugugaaaguuaaggaguuucuugcuaauaacccuagccugaccgagauucgcuccgaaaucuugcauuaugcaacuuucgagcaggaaauugacgagcucaaacccaucauaguggucggggcccuggagcuacacacagaaccaaugaagcuggcgcuuucaaucgaggcuaaagccuggaagaugcuccugugcagauacuugaaugaagaguauaagaaaaagaugaguuacaugauugcauuuaucaacgaauaucuaaagaagcugagcaggccgauucgggaucucgacgaugugcgauucgccauggaggcucugucuuguaucagagacaaugagauacaaauggauaugacccuuggaccuauugaagaggcauacgccauccugaaccgcuuugaaguagaggugacuaaagaagaguccgaggcggucgacaccuugagguacucauucaauaagcuacagaguaaggcuguuagcgugcaggaagaccuggugcagguccaacccaaauucaaguccaaccuccuggagucuguggaaguuuuucgugaggauguaaucaauuucgccgaagcauaugagcuugaggguccaauggugcccaacauuccuccacaggaagccucgaaucgguuacagaucuuucaggcuagcuucgacgaucuguggagaaaauuugucacauacucauccggcgagcaacucuucggguugcccgugacggacuaugaaguucugcauaagaccaggaaagagcucaaccugcuucagaagcuguacggauuguaugauacugugaugaguucuauaagcggcuacuaugagauucuauggggugacgucgauaucgagaagauuaaugccgagcugcucgaauuucagaaccgcugccgaaaguuaccuaaggggcugaaagacuggcaagcauuccuugaucugaagaaaagaaucgacgauuuuuccgagucauguccgcucuuggaaaugaugacaaauaaggcuaugaaacagcggcacugggacaggauaucugagcugaccggcacaccauucgauguggagagcgacaguuuuugccuccgcaacauuauggaagcaccacugcuuaagcacaaggacgauaucgaggacaucuguauuuccgcgaucaaagaaaaggauauugaggccaaacuaacucagguaauagaaaacuggaccaaucagaaccugagcuucgcagcuuuuaagggaaaaggcgaguuguuacugaaggggacggagucuggagaaaucauuacacucauggaggacucacugaugguccuuggcucccugcucaguaaucguuacaacgccccuuucaagaaaaauauccaaaacuggguguacaaguugagcaccucgucugauaucauugaagaguggcugguugugcagaaucuaugggucuaucuggaagcuguguucguugguggggacauagcaaaacagcucccacaggaggccaagagauuucaaaacaucgauaaauccuggauuaagaucaugcagcgggcccaugagaaucccaacgugauuaauugcugugucggagacgaaacuaugggccagcuucugccucacuuacaugagcaguuggaagugugccaaaagagccugaccgguuaccucgagaaaaagaggcugcuuuucccgcgcuuuuucuuuguaucagaucccgugcugcucgagaucuugggccaggcuagugacucucacacaauacagccacaucugccugcgguuuccgauaacaucaaugaagucacuuuccacgcaaaagacuaugaucgaauuauggccgugaucagcagagagggggaaaagauuguguuagacaacucagucauggcuaaaggacccguagagaucuggcuacuggaccuccuuaagaugcaaaugaguagccugcacaauauaauucgguccgccuuuuaccagaucucugauagcggcuuccaguugcugccauuucucucccauuucccugcacagguggggcugcuugggauucaaaugcucuggacccacgacucagaagaggcccugaggaacgcuaaagaugaccgcaagaucaugcagguuacaaaucagaaguuuuuggauauacugaacacguuaaucucucagaccacucaugaccuaaguaaauucgauagagugaaguuugagacacugauuaccauccacguccaccaaagggacauuuucgaugaccucgugaaaaugcauaucaagucgcccacugauuucgaauggcuuaaacagagccgguuuuauuucaaggaggaccuggaccagacaguuguguccauaaccgaugucgacuuuauuuaccagaacgaguucuugggcuguacggaucgucuggugaucacuccacucaccgaccgcugcuauaucacacuggcgcaagcccuugguaugaauaugggaggagcaccggcuggcccugccgguaccggcaagacugagacaaccaaagauauggggcgaugcuuaggaaaguacguagugguuuuuaacuguucugaccagauggauuucagaggccuggggaggauuuuuaaaggacucgcacagucaggcagcugggguugcuucgacgaauuuaaucggaucgaguugcccguccuguccguggccgcucagcaaauauacauugugcuaacagcccgcaaggagaggaagaagcaguucaucuuuagugauggggacugugucgaucugaacccagaguucggaauuuuucucacuaugaaucccggcuaugcggguaggcaggagcuuccugaaaaccugaagauccaauuccggaccguugcaaugauggugccagaccgacagauaaucaugagaguaaaauuggccucuugcggcuuccuggagaaugugauucucgcucagaaguuuuacguccuguauaaauuaugugaagaacagcuuacgaagcaagugcacuacgauuucgggcugcgcaacauccucagcguucuaaggacacugggaucacagaaacgggcccgucccgaggacuccgaauugaguauugugaugagaggccugagggacaugaaucucagcaaacuugucgaugaggacgaaccucuguuuuugucucugaucaacgaucucuucccgggguuacagcuggacuccaauaccuaugcugagcuucagaacgcaguagcccaucaagugcagauugagggacugaucaaucacccacccuggaaccuaaagcucguucagcuguacgaaacuucauuggugcgccauggccugaugacccucgguccuagcgggucgggaaaaacaacugucauaaccauucuuaugaaggcucagacggagugcggccggccccaccgagaaaugagaaugaauccaaaagccaucacagcaccucaaauguuuggcaggcuggauaccgcgacuaacgacuggacagaugggaucuucucuaccuuauggcgcaagacucugaaagccaagaaaggagagaacauauuuuugauacucgacggucccguggaugcuaucuggauugaaaaucugaacaguguccuagacgauaauaagacacuuacccuggccaacggcgaccggaucccaauggcaccuuccuguaagcuccuguucgaggugcacaauauugagaacgcuagcccggccacgguuucaagaauggggaugguguauaucuccucuagcgcauugaguuggcgucccauacugcaggccuggcucaaaaagaggacugcucaggaagcggccguauuucuuacccuguacgagaaaguguucgaagacacauacaccuauaugaaguuaaaucugaacccaaaaaugcaauugcucgagugcaauuacaucguccagucccugaaccuacuugaaggacugauuccuagcaaggaggagggcgguguuucuuguguggaacaucuccacaagcuguuugucuucggguugauguggucauuaggagcacugcucgagcuugaaagucgggagaaacuggaggcuuuucuacgccagcaugaguccaagcuggaucuccccgagaucccaaaaggcagcaaucagacaauguaugaguucuacgugacugacuauggcgauugggagcacuggaacaagaaauugcaaccuuacuauuaccccaccgacucuauuccggaauacucgucaauccugguaccaaauguggauaacauacgaacgaauuuccuuauugacacaaucgccaagcagcacaaggccguucugcucacuggggagcagggaaccgcaaaaacagugauggucaaggcuuaucugaaaaaguacgauccugaggugcagcuaagcaaauccuugaacuuuaguucugccaccgaacccaugauguuccaaagaacuaucgagagcuaugucgacaagaggauugguuccaccuacggcccacccgggggacggaagaugacaguguuuauagaugacaucaacaugccuguuauuaaugaauggggcgaucagaucacgaacgagauuguacgccagaugauggaaauggaggguauguauucacuggacaaaccgggggauuucacuaccaucguggacguccagcucauagcggcuaugauccaucccggaggcggcagaaaugacauuccacaaaggcuuaagcgacaguuuacaguguucaacugcacccugccuaguaaugccucuaucgauaaaauuuuugggaucauuggaugugguuacuucgaccccugccggagcuuuaagccucagauaugcgagaugaucguuaaccuaguguccgucggccgugugcuguggcaauggacuaaaguaaagaugcucccaacacccucaaaguuccacuauauuuuuaauuugagagaucugagccgcaucuggcaggggaugcuuaccaucaaagcagaagagugugccucuauuccuacgcuguuaucccucuucaagcaugaaugcaguagggugauagcugaccgguuuaucacuccagaggaugaacagugguucaacgcacaccugacaagagccguugaggagaauauuggaagcgacgcggcuucguguaucuugcccgaaccguacuucgucgauuuucugcgcgagaugccugaaccaaccggcgacgagcccgaagauuccguguucgaggugccuaaaauuuacgagcucaugccaucuuuugacuuccuugccgaaaagcugcaguuuuaucaaaggcaguucaacgagaucauacgagguaccucacuagaucuggucuuuuucaaagacgcaaugacucaucucaucaagauuagccggaucauuagaacaaguugcgggaaugccuugcugguuggagugggcggcuccgggaaacagucuuuaagcaggcuugcuucauuuaucgccggauaccagauauuccaaauuacccugacacgcuccuauaacguaacuaaucucacggaugaccugaaggcauuguacaagguggcuggugccgacggcaaagggaucaccuuuauuuucacagauagugaaaucaaggacgaggcguuucuggaguaucucaacaaucuucugagcucuggagaaauaucaaaccuauucgcccgugaugagauggacgaaaucacucagggccugauuuccgucaugaaacgggaguuacccagacacccgccuaccuucgauaaccucuacgaauauuuuaucagcaggucucgcaagaaucugcacgugguuuuguguuucagucccgugggugagaaauuucgagcacggucgcuuaaguucccagggcugauuuccggaugcacaauggacugguuuagcagauggccuagggaggcucucaucgccgucgcaucauacuuccugucugauuacaacauaguguguagcuccgaaauuaagcgccagguaguugagaccaugggcuuguuucaugacauggugagugaaucaugcgagucuuauuuccagagauaccggaggcgugcucacgucacucccaaaagcuaucuguccuuuaucaauggcuacaagaacaucuaugccgaaaaagugaaguucauuaaugagcaagccgagcgaaugaacaucgggcuagauaaacucauggaagcgagugagagcguggcuaaacuuucccaggaccuggcagucaaggaaaaagaguuagccguugcuucuauaaaggccgaugaagugcuggcagagguaacggugucagcccaggcuagcgcgaaaauuaagaaugagguccaggaagugaaagacaaggcccaaaagaucguugacgagauugauucggaaaaagugaaggcagaguccaaacucgaggcugccaagccagcacuggaagaggccgaagcugccuugaacaccaucaaacccaaugacauagcgacaguccgcaaacuugcaaaaccuccacaucugaucaugagaauuauggauugugugcuccugcuauuucagaagaagaucgacccgguaacuauggaucccgagaaaaguugcuguaagccuucuuggggagaaaguuugaaacugaugucagccaccgguuuccucuggucccuucagcaauucccaaaggacacaauuaacgaggagaccguugaacuguuacagcccuacuuuaauauggaugacuauacuuucgagucugcuaaaaaggugugcggcaacgucgccgggcugcucaguuggacacuggcaauggcuaucuuuuacggaauuaaucgggaaguguugccucuuaaggccaaccuggcuaaacaggagggcaggcucgccguugcaaaugcggaacuggguaaggcccaggcucuauuagaugagaaacaagccgagcuggacaaggugcaggcaaaauucgaugcugccaugaacgaaaagauggacuugcucaacgaugcagacacgugccgcaagaaaaugcaggccgcgagcacccugaucgacgggcuuuccggcgagaagauaagauggacucagcaaucaaaagaauuuaaggcucagaucaaucggcuggucggagauauucuccuguguacaggcuucuugagcuaccuugggccauuuaaccagaucuucaggaauuaucugcuaaaagaccagugggagauggaacuccgagcccguaagauucccuuuaccgagaaccugaauuuaauaucuaugcugguggauccuccgaccaucggagagugggguuugcaaggccucccaggggacgaucugaguauucagaacggaaucauuguaacaaaggcaacuagauacccccuucugaucgacccucagacgcaaggcaaaaccuggauaaaguccaaagaaaaggagaaugaucuccaggugacuagcuugaaccacaaauauuuccgcacucaccuggaagacucacuuucucugggucggcccuuacuaaucgaggauauucaugaggaacucgacccagcccuggauaauguccuggagaagaacuuuaucaaauccgggaccacauucaagguuaaggugggcgacaaagaaugcgauauuauggacaccuuuaaguuguacaucacuacgaaacucccuaaucccgcuuucacaccagagauaaacgccaagaccucggucauugacuucacugugaccaugaaaggacuggaaaaucagcuucugaggagaguaaucuuaacagagaagcaggagcucgaagcagagcgcgugaagcuguuggaagauguuacuuuuaacaaacggaagaugaaagagcuugaagacaaucugcuauauaagcucagcgcuaccaaaggcagucugguggaugacgagucucugaucggggucuugaggacaacgaagcaaaccgccgcggagguguccgaaaagcuccacguugcugccgagacugaaauuaaaauaaacgcagcccaggaggaguuccgaccggcugcaacaagaggaagcauccuguacuuucuuauuaccgagaugucaauggucaacaucauguaucagacaagucuggcccaguucuuaaagcucuuugaucaauccauggcgcggagcgagaaaucuccucugccccagaagaggauuacaaauaucauagaauaccuaaccuacgagguguucacguauucagugcgcgguuuguacgaaaaccauaaauuucuguucguacuucucaugacccugaagaucgaccugcagcguggcacagucaagcacagagaguuucaggccuugauuaaagggggagcugcacuugaucucaaggccuguccacccaaaccuuaucgauggauccuggacaugacuugguuaaaucugguggagcuaagcaagcucccacaauucgcugaaauuaugaaccagaucuccaggaaugagaaaggcuggaagucuugguuugauaaggacgcccccgaagaggaaauaauuccugaugguuacaacgacagucuggauaccugccauaaauugcugcuuauccggucgugguguccggaucgcacaguuuuccaggcaagaaaguauauugcugacagccucgaggagaaauacacugaaccagugauccugaauuuagagaagaccugggaagaguccgauacaaggacaccccugaucugcuuuuugucaauggggucugacccuacuaaccagauugaugcccucgcgaaaaagcugaaacuugaaugucggacgauaagcaugggccaaggacaggagguccacgcccgcaagcugauccagaugaguaugcaacagggcgggugggugcuacuccagaauugccaccugggauuggaguucauggaagaacugcuugaaacacucauuaccacugaggcauccgacgauucauucagaguuuggaucaccacagaaccacaugaccgauuucccauuacgcuguuacagaccucucugaaguucacuaacgagccuccccaaggcgugagggcugguuugaaacggacauuugccgggaucaaucaggaucuccuggacauaagcaaccuuccaauguggaagccgaugcuguauaccguagcauuccuacacuccacuguccaggagcgucgcaaauuuggaccucucggcuggaauauccccuacgaguucaacagugccgauuuuagcgcuucugugcaguucauucaaaaucaucuggacgagugugauaucaagaaaggugugucauggaacacaguuagauacaugauuggcgaaguccaguaugggggaagggugaccgacgacuuugauaagcgguugcugaacugcuucgccagaguaugguuuuccgagaagauguucgagcccagcuuuuguuucuacacaggcuauaaaauaccucuuugcaagacuuuagaccaguacuucgaauauauccagagucugcccucucucgauaauccagagguguuugggcugcacccuaacgcggacauuaccuaccaauccaauacggcuucggcaguccuagaaaccaucacaaacauccagcccaaagagagcggaggcggugugggggaaacucgcgaggccauuguuuaccgauugucagaggauaugcuguccaagcucccgccagacuauauaccucaugaagugaaaucuaggcuuaucaagaugggacaccugaauaguaugaacauuuuccuccggcaggagaucgauagaaugcaacgugucauuagcauccugcgcucauccuuaagcgacuugaagcuggcuauagaaggcaccaucauuaugucugagaaucuuagggaugcccuggacaacauguacgaugcacggaucccccagcucuggaaaagagugaguugggacuccagcacacuggguuuuugguucacugaacuacuugagcgaaaugcccaguuuucaaccuggauuuucgagggcaggccaaacguguuuuggaugacgggguucuuuaauccccagggauuccugacagcuaugcgccaagaaguuacccgggcgcacaagggcugggcccucgauacuguaacaauccauaacgaggucuugagacagaccaaagaagagauaacuucuccuccgggggaaggaguguauauuuacggccuguauauggacggugcagccugggacaggcgcaaugggaaguuaauggagucgaccccaaaaguucuguuuacacagcuccccgugcuucacaucuucgcuauuaacagcacggcaccuaaggaucccaagcuguacgucugcccaaucuauaaaaagccucgucggaccgacuugacuuuuauaacagugguauaccugagaaccgugcucucccccgaucauuggauccuacgaggagucgcccugcuuugugacauuaaauga

SEQ ID NO: 55376 - RNA, 13461 nt, Artificial Sequence
  derived and/or modified sequence opt3 from DNAH9__Homo_sapiens__NP_001363
augagacuggccgaagaaagggcugcucucgccgcggaaaacgcugauggcgaacccggggccgaucggcgccuucgacuguuggggaccuacguggcaaugagcuuacguccugccgcuggugcaugggaaagaugcgccggcuccgcugaagccgaacagcugcuccaagcguuccucgggagggacgcagccgaaggaccacggccgcugcuugucguucgccccggcccuagaggucuggcuaucaggccaggguuggaagugggacccgaaucuggccucgccggcgcaaaggcucuguuuuuccugcggacagggccugaaccacccggaccugauucauuucgcggugccgugguguguggcgaccucccagcggccccguuagagcaccuggcagcucuuuucagugaggucguguugcccguucuggccaaugagaagaaccgacuaaauuggccucauaugauuugcgaggaugugagaaggcacgcucauagccuccagugugaccuguccgucauacuugaacaggugaaggggaaaacucuguugccacuccccgccggaucugagaagauggaauuugcagauucgaaaucagagacgguacuggacagcaucgauaagaguguuauuuaugccaucgaguccgcugugauuaaguggucuuaccagguccaagugguguuaaaacgggaaagcucccagccucugcuccagggcgagaacccaacccccaaggucgaacuugaguucuggaaaucacguuaugaagaccugaaguacaucuauaaucaguugcgcacaauaacuguuagagguauggcgaaacuacuggauaagcuccaaaguagcuacuuuccggcauucaaggccauguauagggacgugguagcugcccuggcagaggcccaggauauccacgugcaucuuauuccucugcagcggcacuuggaggcucucgaaaacgccgaguuucccgaagucaaaccacagcugcgaccuuuacugcacgugguuugccuaaucugggcaaccuguaagucuuaccgcucccccgggagacucacagugcugcuucaagagauuugcaauuugcugauccagcaggcgucaaacuaccucagcccagaagaccugcuuaggagugaggucgaggaaucucaacggaaacugcaagugguauccgacaccuugagcuucuuuaagcaggaguuccaggaucgcagagaaaaucuccauacuuauuuuaaagagaaccaagagguuaaggaaugggacuuccagucgucucugguguucgucagguuagauggauuucugggccagcuacacguggucgagggccuccugaaaacagcucuugacuuccauaaguuggggaagguggaauuuuccggaguucgugguaaugcccugucacagcaagugcagcagaugcacgaggaguuccaggagauguaccggcuccugaguggcagcuccucugauuguuuauaucugcaaagcaccgacuuugagaacgauguaucagaguucaaucagaaagucgaggaccuugaucgaagauuggggacgauauuuauucaggcauucgacgaugcccccggacucgaacacgcuuuuaagcugcuagacaucgccggcaaccugcucgagaggccucugguggcacgcgacacaagugauaaauaccuuguuuugauucagauguucaauaaggaccuggaugcugugcggaugaucuauucccaacauguccaggaagaggccgaguuagguuuuagcccagugcacaaaaacaugccgaccguagcagggggacucagaugggcccaggaacugaggcaacgcauccagggacccuucucuaacuuuggccgaauuacacauccuugcauggagucagcugaagggaagcggaugcagcagaaguacgaggacaugcuuagucuguuggaaaaauaugagacucgucucuacgaggauugguguagaaccgugagcgaaaagucccaauacaaucugucucagccacuacugaaaagggaccccgagacaaaggaaauaaccaucaacuucaauccucagcucauuucgguucugaaagagaugagcuaucuugagccacgcgaaaugaagcacaugcccgagacggcagccgcuauguucuccucacgggauuuuuacagacaguuggucgccaaccuggaauuaauggcaaauugguauaacaaggugaugaaaacucuccuggagguggaguucccgcuugucgaggaggaacugcaaaauaucgaccuaaggcuccgagcggccgaggaaacacugaacuggaagaccgagggaauaugcgauuacguuacugaaauuacaaguucuauccaugacuuggagcagcgcauccagaaaaccaaggauaauguggaggaaauucagaacaucaugaaaacgugggugaccccuauuuuuaagacaaaggacgguaaacgggagagccuguuaucccucgaugacagacacgacaggauggaaaaguauuacaaucugauaaaagagucaggccuuaagauccacgcucugguacaagaaaacuugggacucuucagcgccgauccaacuucuaauauuuggaaaaccuaugucaacuccaucgacaaucugcuacugaacggauuuuuccuugcaaucgaguguagucucaaguaccuguuggagaacacagaaugcaaagcuggccugacucccauuuuugaggcccaguuaagccucgcaauaccugaacugguguucuaccccucucuugaguccgguguuaaagggggcuuuugcgauaucguggagggacugauuaccucaaucuuccguauuccaaguuuggucccucgccucagcccccagaauggcucgccacauuaucaaguggaccuggaugggaucccggaccuagccaacaugcggagaacacugauggaaaggguucagcgaaugaugggacuuuguugcgguuaccaguccaccuuuucucaguauagcuaccucuauguggaggaucggaaggaaguacugggccaauucuuguuauacgggcacauacugacuccugaggaaaucgaggaccaugucgaggauggcauucccgaaaauccaccccuccugucacaguuuaaagugcagaucgacaguuaugagacgcuuuacgaagaggugugucgccuggaaccuauuaaggucuucgauggcuggaugaaaaucgacauaagaccauucaaggcuuccuugcuaaacauuaucaaaagguggucucugcucuuuaagcagcaccugguugaucacgugacacauagccuugcgaauuuagacgccuucauuaagaaauccgagucaggucugcucaagaaaguagagaagggggacuuucaaggcuugguggaaaucaugggacaccugauggcagucaaagagcggcagagcaacaccgaugaaauguucgagccccucaagcagacuauagaacugcuuaagaccuacgagcaggagcugccugaaacaguguuuaaacaauuggaggaacuaccggagaaguggaauaacaucaaaaagguugcuauuaccgugaaacagcaggucgccccacugcaggccaaugaggugacucucuuacgacaaagaugcacagcuuucgacgcagaacagcagcaauuuugggagcaguuccauaaggaagcccccuuucgcuucgauaguauccacccucaucagaugcuggacgcgaggcacauugagauccagcaaauggaaucuacgauggcuuccauaagcgagucggccucacuuuuugagguuaacgugccagauuauaagcagcugcgucagugucggaaagaagucugccagcucaaggaguugugggacaccauuggcaugguaacuucuaguauccacgcaugggaaacaacccccuggagaaauaucaacguggaggccauggaacuggaguguaaacaauucgcuaggcauauucgcaaucucgauaaggagguucgagcaugggacgccuucacagggcuggaauccacuguguggaacacccuuagcucucuaagagcggucgcugagcugcagaauccugccauccgggaaaggcacuggcgccaguugaugcaggcaacgggagugagcuuuaccauggaucaagacacaacuuuagcccaucugcuccagcugcagcuucaccauuacgaggaugaaguacguggcauuguggacaaagcugccaaggagauggguauggagaaaacccugaaggaacuccaaacaacuugggcagggauggaguuccaguaugaaccgcaccccagaaccaacgucccauugcugugcuccgacgaggaucuaauagagguucuggaagacaaccaggugcagcuccaaaaucuugugaugucaaaguacgucgcauuuuuccuggaggaagugaguggauggcagaaaaaguuaagcacgguugaugccguaaucucuauuugguuugaggugcagcggacauggacccacuuggaauccaucuucacuggcucagaggacauuagggcgcagcugccucaagauaguaaacgcuuugaggguaucgacauagauuucaaggaacucgccuaugacgcacagaaaauccccaacgucgugcagacaaccaauaagccaggccuguacgagaaacuugaagauauucaggggcgacugugucucugcgagaaggcuuuggccgaauaucuggacacuaagagauuagcuuuuccucgguucuacuuucuaagcuccucugaucugcucgacauccuuucgaacggaaccgcaccccaacagguucagaggcaucugagcaaauuguucgauaauauggccaagaugcgcuuucagcuggacgccucaggcgagccaacaaaaacgucccucgggauguacaguaaggaggaagaguauguggcuuucucugaaccgugugacugcagcggacaagucgagauuuggcugaaccacgugcuuggccauaugaaggcgaccguaagacacgaaaugacugagggugucacagcauacgaggaaaaaccuagggagcaguggcuauucgaucaccccgcccagguggcucugaccugcacacaaaucugguggacuaccgaaguugggauggccuuugcacgguuggaggagggauaugaauccgccaugaaggacuacuauaaaaagcaaguggcucagcugaaaacguuaauaacaaugcuaauuggccagcugucaaagggugaucgucaaaagaucaugaccaucuguacuauugacguccaugcgcgcgaugugguugccaaaaugauagcacagaagguggacaaugcucaggccuuccucuggcuuucucagcugcgacacagaugggaugacgaggucaaacauugcuuugcaaacaucugugaugcccaauucuuguacagcuaugaauaccugggcaauaccccaaggcucgugauuacaccccugacugaccggugcuacaucacccuuacacagaguuuacaccugacgauguccggggcuccugccggaccagcgggcaccgggaagacugagacaaccaaagaucucggacgcgcauugggcauucugguauauguguuuaacuguagcgaacagauggacuacaagucuugcgguaauaucuauaaggggcuagcccagacuggagcuuggggcuguuucgaugaguuuaacagaauaucaguugagguccuguccgugguggccguccaaguaaaaaguauccaggacgcuauuagggacaagaaacagugguucagcuuucucggugaagagaucucgcuuaaucccucugugggcauuuucaucacaaugaacccuggguacgcaggacggaccgaacugccggagaauuugaagucccuguuucgaccaugcgccaugguugugcccgauuucgaacucauaugugagauuaugcuggucgcugagggcuuuaucgaagcccagagcuuagcaagaaaauucaucacgcuuuaucagcugugcaaggagcuccuaucaaaacaggaccauuacgauugggggcugcgcgcgauuaagaguguguugguuguggccggaucucugaagaggggcgacccugaucggcccgaagaccagguccucaugcguucccuuagagauuucaacaucccaaaaauagugacugacgauaugccuauuuuuaugggucugaucggggacuuguuccccgcucuggauguaccaaggcgccgggacccuaacuuugaggcccucgugcgaaaggcaauuguugacuuaaaacugcaagcugaagauaauuucguccuuaagguggugcagcuggaggagcuacucgccgucagacacagcguuuuugugguaggaggcgcaggcaccgggaaaucacaggugcugaggaguuugcacaagacauaucagaucaugaagcgccggccggucuggaccgaccugaaccccaaagccgugacuaaugaugaacucuucggaauaauuaacccagcuacaggugaguggaaggacggccuuuuuagcuccaucaugagagaacuggcgaauaucacccaugaugggccuaaauggauuuuacuggacggagauaucgaccccauguggauugagucuuugaacacaguuauggaugacaauaaggugcucacucuggccagcaacgagcguauaccacuaaauccuaccaugaaacuucuguucgaaaucucccaccucaggacggcaacacccgcuaccgucucacgggccggcauucuguacaucaacccggccgauuuggguuggaauccaccuguaucuaguuggaucgagaagcgcgaaauucaaacugagcgagcaaaccugaccauacucuuugacaaguaccuucccacaugucuggauacuuuaagaaccagguucaaaaagaucauuccaauccccgaacagucgauggugcagaugguuugccaucuguuggagugccuccugacgacagaggacauuccugcugacuguccgaaagaaaucuaugagcacuacuuuguguucgccgcgauaugggcuuuugggggagccaugguccaggaucaguuaguggacuaucgggcagaguucagcaagugguggcuuaccgaguucaaaacugucaaguuucccucccagggcacaaucuucgauuacuauauugacccagaaaccaagaaauuugagccuuggucuaagcuggugccccaguucgaguuugauccugaaaugccacuccaagccugccugguucacacuucagagacaauccgcguguguuacuucauggaaagauugauggcuaggcagcgacccguaauguuagugggcaccgcagggacgggaaaaagcguccugguuggugccaagcucgcgucccuugacccugaggcuuaucuggugaaaaaugucccauuuaacuacuacacuaccagugccaugcuacaggcagugcuggaaaagccccucgagaaaaaggccggccggaauuaugggccgccuggaaacaagaaauugauuuacuucaucgaugacaugaauaugccagagguagaugcuuauggcacagugcagccccauaccauaauucgucaacaccuggacuacggucauugguaugauagaucuaaacuuagccugaaagaaaucacaaacguucaguacgugucaugcaugaacccuacugccggguccuuuaccauuaauccacgccuccagaggcacuucagugucuuugugcugagcuuccccggagcagacgcucugucuuccaucuauucaauaaucuugacgcagcaucugaagcucggcaacuuuccggccagccuucaaaaaucgauuccuccccugaucgaccuagcgcuggccuuccaccagaagauugcaacaacuuuccucccaaccggcaucaaguuucacuacauauucaauuugcgggauuuugcuaacauuuuccaggggauccuguuuucuagugucgagugugugaaauccacaugggaccuuaucagacuguacuuacaugaaagcaaucgcguuuauagggauaagaugguagaggagaaagacuucgaucucuuugacaagauucagaccgaagugcugaaaaagacuuucgaugacaucgaggauccugucgaacaaacccagucacccaacuuguacugccacuuugccaauggaauaggugagccaaaguauaugcccgugcaguccugggaacugcucacacagacgcuuguugaggcacuggagaaccauaaugaagugaacacugucauggaccuagugcuguucgaggaugcuaugcgacacguaugucacauuaaucggauccucgaaucuccuagaggcaacgccuugcugguggggguuggaggcagcgguaaacaaaguuuaaccaggcuugccgcguuuauuuccagcauggacgucuuccagaucacacugcgcaagggguaccagauacaagauuuuaaaauggaccucgcuucucugugcuugaaggcaggagugaaaaaucugaacaccguguuccucaugacugacgcccaggucgcugaugagcguuuccuuguucugaucaaugaccuacuggccucaggcgaaauuccagauuuauauagugacgaugagguggagaacaucauuuccaacguacggaaugaaguaaagagccagggccucgucgacaacagagagaauuguuggaaguuuuucaucgauaggauucgccgacagcugaaagugacauugugcuuuucuccgguugggaacaaacuucgggugagaucgaggaaauuccccgcaaucgucaauuguaccgccauacauugguuucacgaauggccucaacaggcucuggagucagugagccuccgcuuccugcagaacacggaaggaauugagccaacuguaaagcaguccaucaguaaauuuauggcguucguucauacaucugugaaucaaaccagccaguccuacuugucaaacgagcagagauauaauuacaccacucccaagaguuuucuggaguucauccggcuauaccagucucuccuucacaggcaucguaaagagcugaagugcaagacagaacgauuagagaacggucugcucaaacugcacagcaccuccgcccaagucgacgauuugaaggcaaaacuugcugcccaggagguggaacugaagcagaaaaaugaggacgcagauaagcucauucaaguggucggcguugaaacagacaaggugucacgcgagaaagccauggcugaugaagaggagcagaagguagccgugauaaugcuggaagucaaacagaagcagaaagacugcgaggaagaccuagcgaaggcagagccugccuugacugcugcccaagcagcucugaacacgcucaauaagaccaaccuuacagaacuaaagagcuuugggucuccacccuuagccguguccaauguuagugcugccgugaugguccugauggcaccuagaggacgggugccgaaggauaggagcuggaaagcggccaagguaacuauggcuaaaguugacggcuuccucgauucgcugaucaacuuuaacaaggagaauauucacgagaacuguuugaaggccauccgcccauaucuucaggaccccgaguucaauccugaguucguggcaaccaaauccuacgcugccgcaggucugugcucuugggucauuaacaucgugagauuuuaugaaguuuucugugauguggagcccaagcggcaggcccucaauaaagcgacagcugaccugaccgccgcacaggaaaagcuagccgcuauaaaagccaagaucgcacauuuaaacgagaaucuggcuaaguugacugccagguuugagaaagcgacggcugauaagcucaaaugccaacaggaagccgaggucaccgcagugacaauuucacuggccaaccgacuuguagggggacuggcuagcgaaaaugugcguugggcagacgccguccagaacuucaagcagcaagagagaacucucuguggcgauauccuguugauuaccgcguuuaucaguuaccuuggcuucuuuacuaagaaguaucgccagucccugcuagaccggaccuggaggccauaccucucucagcugaaaacuccuauacccguuacaccagccuuagauccgcugagaauguugauggacgacgcugauguggcagccuggcagaaugaggggcucccugcugaccgcaugagcgucgaaaacgccacgauucugaucaauugcgagcgguggccccuuaugguggauccacaacugcagggaaucaaguggauuaagaacaaauauggugaagaccucaggguaacccagauaggccaaaagggguacuugcagaucauugagcaggcacuggaagcuggagccgugguucuuaucgagaaucuggaggaaucaauugaucccguguuaggcccucuacucggucgagaggucaucaaaaaggggagauucauaaaaaucggcgacaaggaaugugaguacaacccaaaguuucggcugauucugcacacuaaauuggcgaacccccauuaucagccugaacuccaagcccaggcaacacugaucaauuucaccgugaccagggauggacuugaggaccagcuguuagcugccguugucuccauggagcgcccggaucucgaacagcugaagagugacuugacaaaacaacagaacggcuuuaagauuacucuuaaaacgcuggaggauagccuacucucucgucugucauccgcaagcgggaauuuccugggagaaaccguguugguggagaaccucgaaaucacaaagcagacugccgcugagguagagaagaaaguccaggaagccaaggugaccgagguuaaaauuaaugaagcgagagagcacuaccgaccagcugcagccagggcuucucugcuuuauuucauaaugaacgaccugaguaagauccaucccauguaccaauuuucguuaaaagccuucuccauuguguuucagaaggcagucgagcgggccgcuccugaugaaagccuccgcgagagaguggcgaaucugaucgacucaaucacauucucuguuuaucaguacaccauuaggggucuauuugaaugcgacaaguugacuuaucuggcccaacuuacguuccagauacuccugaugaaccgggaggugaaugcaguagaacuggacuuuuugcuucgcagcccaguccagacaggcaccgccucccccguggaguuccucagucaccaggcuuggggagcggugaaaguucugucaucuauggaggaauuuagcaacuuagacagagauaucgagggguccgccaagaguuggaaaaaguucgucgaaagcgaguguccugaaaaagagaagcugccccaagaguggaaaaauaagacugcucuacagcgacucugcaugcugagggccaugcggccagaccguaugaccuacgcguugcgcgauuuuguggaagagaagcugggcuccaaauacguaguggguagagcacuugacuucgccacaucuuuugaagagucagggccggcuacuccuauguucuucauucucagccccggcgucgauccacugaaggacguggaaucgcagggaaggaaauuaggcuauaccuuuaacaaucagaacuuccacaauguuucccuggggcaaggacaggagguggucgccgaggcagcuuuggaucucgccgcgaagaaaggucauugggugauccugcagaacauucaccuuguugccaaguggcugaguacacuagaaaagaaacucgaggaacauucugagaacagccacccugaguuucggguguucaugucagcugaacccgcaccauccccugagggccacaucauaccccaggggauccuggaaaauucuauuaagaucacgaacgagccgccaaccggaaugcaugccaauuugcacaaagcucuggacaacuuuacucaagauacacuugaaauguguaguagagagaccgaguucaagagcauucucuuugcacugugcuacuuccaugccguagucgcugaacgccgaaaauuuggcccucaggguuggaauagguccuaucccuucaacacuggggacuuaacaaucucagugaauguucuguacaacuuuuuggaggccaaugcaaaggugccauaugaugaccuccgguaccuguucggcgaaauaauguauggaggccacauuaccgacgauugggacagacgucuuugccgcacguaccugggggaguuuaucaggcccgaaaugcuagagggagagcucagccuggccccuggcuucccguugccagguaacauggauuacaauggguaucaucaguacauugacgcggaacugcccccugagucucccuaucuuuacggauuacacccaaacgcugaaaucggcuuccugacccaaacaagugagaagcucuuucggacuguccuggaacuacagccuagagauucccaggcccgagacggugcaggcgccaccagggaggagaaagugaaggcuuugcuggaagagauacucgaacgcguaacagaugaguucaauauccccgagcuuauggccaaaguggaagaacggacuccauauauugucguugcauuucaggaaugugggagaaugaacauccugaccagggagauucaacgcagccuccgugaacuggaguuaggauugaagggcgagcugacaaugaccucacacauggaaaaucuucagaacgcucuguacuucgacauggugccugagucuugggcccggagagcguauccguccacugcagggcucgccgcuugguuucccgaucugcuaaaccgaaucaaagaacuugaggccuggacgggagacuucacaaugccaucgaccguguggcugacuggcuuuuucaauccucagagcuuucucaccgcuauaaugcagaguacagcaaggaagaacgaauggcccuuggaucaaauggcccugcagugcgacaugacgaagaaaaaucgcgaggaguuccggucuccaccuagagaaggugcguacauucauggguuauuuauggagggagccuguugggacacccaggcuggcaucaucacugaagcaaagcugaaagaucucacacccccgaugccagucauguucauuaaggccaucccugcugacaaacaggauugcagguccguguacagcugucccguuuauaagaccucacaacgcgguccaacuuacguauggacauuuaaccuuaaaaccaaggagaaucccaguaagugggugcuggccggcgucgcauugcugcuccagauauga

SEQ ID NO: 55377 - RNA, 2100 nt, Artificial Sequence
  derived and/or modified sequence opt3 from DNAI1__Homo_sapiens__NP_036276
augauccccgccagcgcuaaggcaccucacaaacagccacauaagcaauccauuucuauaggcagagggaccaggaaacgggacgaggauucaggaacagaagugggugagggcacugacgaaugggcccagaguaaggcgacgguccgcccgcccgaucagcuggagcucaccgacgcugaacuuaaagaggaguucacacgaauccugacugccaacaauccucacgcaccacagaacauuguucguuacagcuuuaaggaagggaccuauaagcccaucggauucgugaaucaauuggccguacauuacacacaggugggcaacuuaauuccuaaagauuccgacgaggguagaaggcagcacuaucgggaugaacuggucgcugggucucaggagucggugaagguuaucucagagaccggaaaucuagaagaggacgaagaaccaaaagaacucgagacugagcccggcagccaaacagaugugccugcagccggcgcugccgaaaaggucaccgaggaggagcugaugacgccaaaacagccgaaggaacgcaaacuuacuaaccaguuuaauuucagugagagagcgucccagaccuacaacaaucccgugagggaccgggagugccaaacagaaccuccaccccgcacuaacuuuucugcaaccgccaaucagugggagauauaugaugcuuacguagaggaacuggaaaaacaggagaagacaaaagagaaggaaaaagccaagaccccuguugcuaaaaagagcgggaagauggcaaugcgaaaauugacguccauggagucacaaacugacgaucucaucaagcugagucaggccgcgaaaauuauggaaagaauggugaaccagaauacauaugacgacaucgcccaggauuucaaguacuacgacgaugcagcugacgaguauagggaucaagucggaacccugcucccauuauggaaauuucagaacgacaaggccaagcggcugagcgugacugcucuuuguuggaaucccaaauaccgugauuuguucgccguggguuauggcucuuacgacuuuaugaagcagucccgcgggaugcugcuacucuauucacugaaaaacccgagcuucccugaguacauguuuaguucuaacuccggagucaugugccuugauauucauguugaccaccccuaucugguggcaguaggccacuacgaugguaauguggccaucuacaacuugaagaaaccacauagccagccuucguucuguucuuccgcuaagucagggaagcacagugaccccgucuggcaagugaaauggcagaaggacgauauggaccagaaucucaacuuuuucagcguuuccucugauggaagaauagugagcuggacacuggucaaaaggaaguuagugcauauugacguaaucaaacugaagguugaaggcucaaccacggaggugccagaaggccuccagcuucaccccgucgggugcggaaccgcguucgauuuucacaaggagauugacuauauguuccugguggguacagaagagggcaaaaucuacaaguguaguaaauccuauagcucucaauuuuuggauacuuacgacgcacauaauaugucagucgauaccgugaguuggaacccuuaucacacaaagguuuucaugagcugcuccucugacuggacugugaaaaucugggaucauaccauuaagacaccaauguuuauauacgaccuaaauucggccguaggggaugucgcuugggccccguauagcuccaccguguucgcagccguuacuacggacggaaaagcucacaucuuugaccuggccauuaacaaguacgaggcaaucuguaaucagcccguggcggcuaagaaaaaccggcucacacauguccaguucaaucugauacacccuauuaucaucgugggcgaugaccgaggucacauuaucucacuuaagcugaguccaaacuugcgcaaaaugcccaaggaaaagaaggggcaggagguacaaaagggcccugccguggaaauugcaaaacucgauaagcuguuaaaucugguuagagaggucaaaauaaagaccuga

SEQ ID NO: 55378 - RNA, 1782 nt, Artificial Sequence
  derived and/or modified sequence opt3 from DNAI2__Homo_sapiens__NP_001166281
auggagaucguguacgucuauguuaagaaaagaagcgaguucggcaagcagugcaacuuuuccgacaggcaagccgagcugaauauugauauaaugcccaacccugaacucgcugagcaguucguggaacggaauccaguagacaccgggauccaguguucuauuucaaugagugagcacgaggcaaacagcgaacgcuuugagauggaaacacgaggagugaaucaugucgaggguggcuggccgaaagaugugaacccccuugagcuggaacagacuauccguuucagaaagaaaguugagaaggacgaaaauuacgugaacgccauuaugcaauugggguccaucauggagcacugcauaaagcagaauaacgcgaucgauauuuaugaagaguacuuuaaugacgaggaagcuauggaggucauggaagaggauccuucugccaaaacgaucaacguguucagggacccacaggaaauuaagcgggcagccacccauuuaucguggcaccccgauggaaaucgcaaacuggcuguagcauauucaugucuagacuuucagagagccccuguuggcaugagcagugauuccuacaucugggaccucgagaacccaaauaagcccgagcuggcucuuaaaccuucuagcccacuggugacauuggaguucaacccgaaggauucccauguccuccugggugggugcuauaacggacaaauagccuguugggacacuaggaagggcucacugguggcggaacucaguaccauugaaagcucucaccgggaccccguguacggcacaaucugguuacaguccaaaaccgggacugagugcuuuucagcaagcacagauggacaggucauguggugggacauucgcaagaugagugaaccuaccgagguugugauccuggauaucacgaaaaaggagcagcuugaaaaugccuugggugcuauuucucuggaguucgaauccacucuaccaaccaaauuuaugguaggcacagagcaagggauagugaucagcuguaaccgaaaggccaaaacuucggcagagaagauugucugcaccuuccccggacaccauggcccuaucuacgcucuccagagaaauccauuuuaucccaagaacuuccugacagugggugacuggaccgccaggauauggucugaagauucccgggagucaaguauuauguggacgaaauaccacauggcguaucuuacugacgccgcauggagcccgguucguccuacaguguucuuuaccacucgcauggaugggacacuggacaucugggauuucauguuugaacagugugaccccaccuugucccucaaggauaauggaugccugaucgcuuguggcucucaauuaggcacgaccacacugcucgaggucagcccagggcuuucaacucugcagagaaacgagaaaaauguggccaguuccauguucgaaagggagacccggcgagaaaagauuuuggaggcucgccauagagaaaugaggcuaaaagagaagggaaaggccgaaggucgggacgaggagcagacagacgaagaacuggcaguagaucucgaagcccugguuagcaaagcugaggaagaguuuuucgacaucauuuuugcggagcuuaagaaaaaggaagcagaugccauaaaacugacuccugugccccagcaaccaucucccgaggaagaccaggucguggaggagggcgaagaggcugccggggaagagggagaugaagaggucgaggaagacuuggcauga

SEQ ID NO: 55379 - RNA, 1194 nt, Artificial Sequence
  derived and/or modified sequence opt3 from DNAJA1__Homo_sapiens__NP_001530
auggugaaggagaccacauacuaugacguccugggcguuaaacccaacgccacucaggaggaacucaagaaggcuuacagaaaacuugcacugaaauaucacccugauaagaauccaaacgaaggggagaaguucaaacaaaucagccaggccuacgaaguguuguccgacgcgaagaaaagggaguuauaugauaagggaggugagcaggcuauuaaagaaggcggggccggaggcgguuuugggucuccgauggacauauucgauauguuuuucggaggcggcgggcggaugcagcgcgagcgacguggaaagaauguagugcaucaacugucagucacgcuagaagaccucuacaacggugcaaccagaaagcuggcccuucagaaaaaugugaucugcgauaagugugagggcaggggagggaaaaagggcgcuguugagugcugucccaacugccgggguacagggaugcagauucgcauccaccagauuggaccuggcauggugcaacagauccagagugucuguauggaaugccagggccauggggagagaauaagcccaaaagacagguguaaguccugcaauggacggaaaaucgugcgcgaaaagaagauucuggagguacacaucgauaaagguaugaaggacggccagaaaauuacuuuucauggggaaggagaucaagagcccggcuuggagccuggugacaucauaauuguucucgaucagaaggaccacgcaguguucacccgaagaggggaagaccuguuuauguguauggauauccaacuggucgaggcccucugcggcuuccagaaaccaauuucuacauuagacaacaggaccaucgugaucacuucgcaccccggacagauugugaagcauggcgauauaaaguguguccugaaugaagggaugccuaucuaucggcguccauacgagaaaggacgccuuauuaucgaauuuaagguuaacuucccggagaauggcuuuuugucacccgacaaacugagccuacucgagaagcugcuuccugaaagaaaagagguggaagagacagaugaaauggaccagguagagcugguggauuucgacccaaaccaagagaggcggcgacacuacaauggugaggcuuaugaagaugacgaacaucacccccgcgggggaguccagugccagaccaguuga

SEQ ID NO: 55380 - RNA, 1239 nt, Artificial Sequence
  derived and/or modified sequence opt3 from DNAJA2__Homo_sapiens__NP_005871
auggccaacguggcugacaccaagcuguacgauauccucggcguucccccuggggcaagcgagaaugaacuuaaaaaggccuauagaaaacuggcgaaggaguaccacccagacaaaaacccgaaugcuggagauaaguucaaggaaauuuccuuugccuaugaggucuugucuaaccccgagaaaagggaauuauacgaccgguauggugagcagggccugcgcgaagggucaggaggcggugggggaauggaugacauauucagucauaucuuuggcggcgggcuauucggauuuauggguaaucaaagccgaucccguaacggcagaaggcgcggggaggauaugaugcacccucucaaggugucucuggaagaccuuuacaauggaaaaacaacuaagcugcaguugucgaaaaacguacucugcucagcauguagcggccagggugggaagaguggagccgugcagaagugcuccgcuugucggggcagaggcgucaggauuaugauccggcaacuggcaccagggauggugcagcagaugcagucuguuugcagcgauuguaauggagagggugaggugauuaacgaaaaagaccgcugcaagaaaugugagggcaagaaagucaucaaggaagugaaaauacuggagguacauguugauaaggggaugaagcacggacaacgaaucacguucaccggcgaagccgaccaggcucccgguguggagccuggggauauuguccucuuacugcaggagaaagaacaugagguguuucagagagacggcaaugaccuucacaugacauauaagaucggauugguggaagcccugugcggcuuccaauuuacuuucaaacaccuagaugggaggcagauugucguuaaguacccacccggaaaagugaucgagccugguuguguacgggugguccguggcgaagggaugccacaguaccgcaacccguuugagaagggagaccucuauauaaaguucgaugugcaauuucccgagaauaacuggauuaauccugacaaacuguccgaacuugaggaucuguugccaucaagacccgaaguuccuaacaucauuggcgagaccgaagagguggagcuccaggaguucgacaguacaagggguagcgggggcggacagcggcgagaagcguacaacgauucuuccgacgaagagucaagcagucaucacggcccagggguccagugcgcacaucaauga

SEQ ID NO: 55381 - RNA, 1362 nt, Artificial Sequence
  derived and/or modified sequence opt3 from DNAJA3__Homo_sapiens__NP_001128582
auggccgcuagaugcagcaccagguggcugcucguggucguuggcacaccccggcuuccugcaaucuccgggcgcggagcccgaccaccgcgugagggugugguaggcgcguggcugucuagaaaguugucagugcccgcuuucgccaguagcuuaacuuccugugggccuagggcacugcuaacgcuccggccaggagucucucugaccggcacaaaacacaaccccuuuauuugcacugccucguuccauaccucagcuccucuugcaaaggaagacuacuaucagauacugggugugccacgcaaugccagccaaaaagagaucaagaaggcuuacuaucaguuggccaagaaguaccaccccgauacaaacaaagacgauccuaaggcgaaagaaaaguuuagucagcucgcagaggccuaugaaguucuguccgacgaggugaaaagaaagcaguacgaugcuuaugggucugccggauucgacccaggcgcaagcggcucccaacauucauacuggaaagggggaccgaccgucgaucccgaggaacuguuuaggaaaauuuucggugaguuuaguucuagcuccuucggcgacuuucagacuguguucgaucagccucaggaauacuuuauggagcucacauucaaucaagcugccaaggggguaaacaaagaguuuaccguuaauaucauggacacgugugaacggugcaacggaaagggcaaugagccagguacuaaagugcagcacugucauuauugcgggggaucaggcauggaaaccauuaacacaggccccuucgucaugcgcagcacuugucgaagaugcgggggaagggguaguaucauaaucucuccuuguguggugugccggggcgcggggcaggccaagcagaaaaagcgugucaugauuccaguucccgcaggaguggaggauggccaaaccguacgcaugccgguggguaagagagaaaucuucauuacauuuaggguccagaaauccccuguguuccggcgagacggggcugauauccacagcgacuuauuuauaucgauugcccaggcucugcuuggcggaaccgcccgcgcacaaggcuuguacgagacgaucaauguuacuauucccccagggacacagaccgaccagaagaucagaaugggagguaaaggcaucccuaggauuaacucuuauggguacggagaucacuauauacauaucaagauucgggugcccaaacgccugacuuccagacagcaaucacuaauccucaguuacgccgaggacgaaacagaugucgagggcaccgugaaugguguaacgcugaccagcuccgggaagaggucuacaggcaacuga

SEQ ID NO: 55382 - RNA, 1077 nt, Artificial Sequence
  derived and/or modified sequence opt3 from DNAJB11__Homo_sapiens__NP_057390
auggcuccccagaaccugagcaccuucugccuccuucuguuguacuuaaucggcgccgugauugcagggagagacuuuuauaagauacugggagucccuagguccgccucuaucaaagauauuaagaaagcguaccggaagcuagcucuccaacugcacccagaccgcaauccggaugacccccaggcccaggagaaauuccaggaucuuggugcagccuaugaaguucugucagacagugagaagcgaaagcaauacgauacauauggcgaagagggguugaaagacggacaucagagcucccacggcgauaucuuuucucauuucuuuggugacuucggguuuauguucggaggcacuccucgucagcaggauagaaacauuccaaggggcucggacaucauaguggaucucgaaguaacgcuggaggagguguacgcugggaauuuugucgaagugguucggaacaagcccguggcacgccaagccccuggaaaaagaaaguguaauugcaggcaggagaugcggaccacacagcuggguccaggccgcuuccagaugacucaagaagucgugugugacgagugccccaacguaaaacucguuaaugaggaacgaaccuuagagguggaaaucgagccuggggucagagacggaauggaauauccauuuauuggcgagggugagccgcacguggauggggaacccggagaccugagguuccggaucaagguggucaagcauccuauuuuugagcgucgcggcgaugaccuuuacacaaacguuaccaucucauugguggaaagccugguaggcuucgagauggauauaacucaccuagacgggcacaaagugcauauuaguagagauaagaucacaaggccaggagcuaaacucuggaagaaaggugaaggccugcccaauuucgacaacaauaacauuaaggggucccuuaucaucaccuuugaugucgacuucccuaaagagcagcugacggaggaagcccgggagggaauuaagcaguugcucaagcaaggcucugugcagaaaguuuacaauggucugcagggguauuga

SEQ ID NO: 55383 - RNA, 951 nt, Artificial Sequence
  derived and/or modified sequence opt3 from DNAJB13__Homo_sapiens__NP_705842
augggccaggacuacuauagcgugcuggggaucaccagaaacuccgaggaugcccaaauuaagcaggcuuacaggcggcucgcacuuaaacaccauccccugaagucuaaugaaccuucaagugccgagauauuccgccagaucgcggaggcuuaugacgucuugagcgauccaaugaaacgaggaauuuacgacaaguuuggugaagaaggcuuaaaagggggaaucccgcuggaguucggcucccagacacccuggacuacggguuauguuuuucacgggaagccugagaagguguuccaugaauuuuucggaggcaacaauccauuuucugaguucuuugaugccgaaggcucggagguagaccuaaacuucgggggacuccaaggucguggcgugaaaaagcaggauccccaggucgagagagaccuguaccuuucacuggaagauuuguuuuucgggugcaccaaaaagauuaaaaucagcaggcgggugcucaaugaggacggauauaguuccacaauaaaggauaagauccugacuauugacguuaaaccuggcuggcgccaggguaccagaaucacauuugaaaaggagggggaucaaggaccaaacauuauccccgcagacauaauuuucaucgugaaagaaaagcugcacccuagguuccggcgcgagaaugacaaccucuuuuucgucaauccaauuccguuaggcaaagcccugaccuguugcacuguggagguacgaacacuugaugacagauugcugaacauccccaucaaugauauuauacauccuaaguacuuuaaaaagguuccaggcgaagggaugccccuaccugaggacccaaccaagaaaggagaucucuucaucuuuuucgacauucaguuucccacgaggcugacuccgcagaagaaacagaugcuucggcaagcucuguugaccuga

SEQ ID NO: 55384 - RNA, 723 nt, Artificial Sequence
  derived and/or modified sequence opt3 from DNAJB1__Homo_sapiens__NP_001287843
auguucgccgaguuuuucggcgggagaaaccccuuugacaccuucuuuggacagaggaauggugaagagggcauggauaucgacgauccuuucagcggguuuccaaugggaaugggcgguuucacaaacgugaauuuugggcggucccgcucugcucaagaaccggcacgaaagaaacaggaucccccugucacucacgaccugcguguuucacucgaggaaauuuacaguggaugcacgaagaaaaugaagauaagccauaaaagacuuaacccagacggcaaguccaucaggaaugaggauaagauucugaccaucgaggugaaaaagggcuggaaagaagggacaaagauuacuuuccccaaagagggagaccagaccucuaacaauaucccugccgauauaguauuuguguugaaggacaagccacacaacaucuucaaacgggaugguucggacgucauuuaucccgcgcgcaucucauuaagagaagcucuguguggcugcacagugaauguuccuacccuagaugggaggacuauuccaguggucuuuaaggacgugauccggccgggaaugcgccgaaaaguacccggcgagggucucccucugccaaagacacccgagaaaagaggggaccuuauaauugaguucgaaguuaucuucccugaaaggauuccacagaccagccggacggugcuggagcaagucuugcccaucuga

SEQ ID NO: 55385 - RNA, 834 nt, Artificial Sequence
  derived and/or modified sequence opt3 from DNAJB2__Homo_sapiens__NP_001034639
auggccagcuacuaugagauccuggacgugcccagauccgcuucugcagaugacauuaagaaagccuacaggcggaaggcgcuccaguggcacccugauaaaaacccagacaauaaggaauuugcugagaaaaaguuuaaggaagucgccgaggcauaugaaguucuuucagauaaacauaagcgcgagauauacgaccgauauggccgugaggggcugaccggaacagguacuggcccgaguagagccgaagcugggagcggaggccccgguuucacguuuaccuucagguccccugaggaaguguuucgggaguucuuugggucuggagauccauucgcagaguuguuugacgauuuaggccccuucucggaacugcaaaaccgcggcucaagacacagcgggccuuucuucacauuuaguuccucuuucccaggacauagcgacuucuccucaaguagcuuuucuuucucccccggugccggcgcuuuuaggucaguaagcacgaguaccacauucgugcaggggcggcgcaucaccacucgaagaauuauggagaauggacaggaaagggucgagguggaagaggauggccagcuaaaaucuguuacaaucaacggugugccugacgaucucgcccuggggcuugagcugucccggcgugaacaacagccaagcgucaccucgcgcucuggaggcacucaggugcagcaaacuccggcguccugccccuuggacucagaccucagugaggaugaagaccugcagcuggcaauggccuacagccucuccgagauggaagcugccggcaagaaaccugcagauguauuuuga

SEQ ID NO: 55386 - RNA, 1389 nt, Artificial Sequence
  derived and/or modified sequence opt3 from DNAJB5__Homo_sapiens__NP_001128476
augggcggggccgaggcugaacccugggggagagcaccugguccagccaucggcgggaggcgggcgggagacagcugcccgggcuggcgccgacguuccagaucuaggggucgggggcagcgccugucacacggacccagaaggcggccucaacuccuuaccgcugccccaccccugcaggcacgcggcgccuuccgaaguuuuccucauagcuggggcgaggauuucuuggcuuccuuaauguuuaagauucagcuggaaccacuaaaacucagagcauggacacugaacggguucgugaaguuuaggaauaaagagacuucugccggacccgucgcuguuauggguaaggacuacuauaaaauacuuggcaucccuucgggggccaacgaagaugagauuaagaaggcguaccggaaaauggcacugaaguaucacccagacaaaaauaaggagccgaacgccgaagagaaauucaaggaaaucgcugaggccuacgauguguugucagaccccaagaaacguggacucuaugaucaguacggcgaggaaggucugaagacgggaggaggcaccagcggcgggaguuccggaucuuuucauuauacauuccacggugacccucaugcaacuuuugcuagcuucuuuggcggguccaauccauucgauaucuuuuucgccucaagucgcagcaccagacccuucucuggauuugacccugaugacauggauguagacgaggacgaagauccauucggcgcguuugguagguucggguuuaacggccugucccggggaccccgacgcgccccggagccucucuaccccagaaggaaagugcaagacccaccugucgugcacgaauuacggguuucacuggaggagauuuaccacggcagcacaaagcgcaugaaaauaaccagaaggcgucuuaaucccgaugggcggacugugcgaacagaagacaagaucuugcauauugucaucaaaagaggauggaaggaggguaccaagauuacguucccaaaagaaggcgaugcaacucccgacaacaucccugcugauauaguguuuguacugaaggacaaaccacacgcccauuucaggcgcgaugggaccaauguucuauauagugcucucauuucucugaaggaggcccuuuguggaugcacagugaacaucccgacuauugacggccgggucaucccccugccuuguaaugaugugaucaaaccagguaccgugaagagauugcgcggggaaggccuccccuuuccuaaggucccaacacagaggggagaccugauuguugaguucaaagugcgauuucccgaccgguuaaccccgcagacgcgucagauacugaagcaacaccucccuugcuccuga

SEQ ID NO: 55387 - RNA, 726 nt, Artificial Sequence
  derived and/or modified sequence opt3 from DNAJB6__Homo_sapiens__NP_005485
augguggacuacuaugagguccugggcguucagagacacgccagccccgaagauaucaagaaggcuuacaggaaacucgcacuuaaauggcauccugacaagaacccagagaauaaagaagaggccgaacggaaguucaagcaaguggcggaggcuuaugagguacuguccgaugccaaaaagcgcgacauuuacgauaaauaugggaaggaaggauugaacgguggcgggggaggcgguucucacuuugacucaccguucgaguuuggguucaccuuucgaaaucccgaugacguguuccgugaauuuuucggaggcagagauccuuuuaguuucgacuuuuucgaggauccauuugaggacuucuucggcaacaggcgggggccccgcggaagcagauccagggguacaggcucguuuuucucugcauuuucaggguucccuagcuuuggaaguggcuucuccucuuuugauacugguuucacgagcuuuggguccuuaggacauggcggccugaccucauucaguagcacaucuuuugggggauccgguaugggcaauuucaaaucaauaagcaccaguacuaagauggucaacgggcggaagaucacaaccaaacgcauuguggaaaauggacaggagcgaguugaaguggaggaagacggccagcuaaagucucucacuaucaacgguaaagagcagcugcuuagacuggacaauaaguga

SEQ ID NO: 55388 - RNA, 930 nt, Artificial Sequence
  derived and/or modified sequence opt3 from DNAJB7__Homo_sapiens__NP_660157
augguggacuacuaugagguccugggccuccagagauacgccagccccgaagauaucaagaaggcuuaucacaaaguugcacuuaaauggcauccugacaagaacccagagaauaaagaagaggccgaaaggaaguucaaggagguggcggaggcuuacgaaguacuguccaacgaugagaaacgggacauuuaugauaaguacgggaccgaaggauugaaugguggcgggucucacuuugacgaugagugcgaguauggauucacauuucauaaaccggacgauguguucaaggaaauauuucacgagcgcgaccccuucucauuucauuucuuugaagauaguuuagaggaccugcuaaaccgaccuggcagcuccuacgguaaucguaacagagaugccggguacuucuuuucuacugcaucggaauauccaaucuucgagaaauuuucaagcuacgacacgggauauaccagucaaggcucccucggccacgaggggcugacaucuuucagcucccuugccuucgacaauucaggaauggauaacuacauuagugucacuaccagcgacaagaucgugaaugguaggaacauuaauacaaagaaaaucauagaaucugaucaggagcgggaagcugaggacaacggcgaacugaccuuuuucuugguuaauuccguggcaaacgaggagggguuugccaaggaauguucauggcgcacucagagcuucaauaacuauagucccaacucucacuccagcaaacaugucucgcaguacacauuuguggauaaugacgagggaggcaucucuuggguaaccuccaacagagauccuccaauuuucucagcugguguuaaggaagggggaaaaaggaagaaaaagaagcggaaagaggugcaaaagaaaaguacgaagcgcaauugcuga

SEQ ID NO: 55389 - RNA, 699 nt, Artificial Sequence
  derived and/or modified sequence opt3 from DNAJB8__Homo_sapiens__NP_699161
auggccaacuacuaugaggugcugggcguccaggcuagcgcaucccccgaagacaucaagaaagccuacagaaagcucgcgcuuagguggcacccugauaaaaauccagacaacaaggaggaagcugagaaaaaguucaagcugguuucugaagccuaugagguguugucagauaguaaaaagcggagcuuauacgaccgcgcagggugcgauuccuggcgagccggagguggcgcuucuaccccguaucauucgcccuuugacacaggguacacuuuccguaauccugaggauauuuuuagagaauuuuucggaggccuggacccauucucauuugaguucugggauagccccuuuaacagugacaggggugggcggggacacggccuacgcggcgcauucuccgccggguuuggagaguucccugcuuuuauggaagccuucucuagcuucaauaugcucgguuguuccggcgggucacauacgaccuuuaguagcacaucuuucggaggcuccucaagcgguaguucuggguuuaaauccguaaugagcucgacugagaugauaaacggacacaaggugaccacaaaaagaaucgucgaaaauggccaagagaggguggaaguugaggaagauggccagcugaagucugugaccgucaacgggaaggagcagcuuaaauggauggacuccaaguga

SEQ ID NO: 55390 - RNA, 672 nt, Artificial Sequence
  derived and/or modified sequence opt3 from DNAJB9__Homo_sapiens__NP_036460
auggccacaccccagagcaucuucauuuuugcuauaugcauccugaugauuaccgagcucauccuugcauccaagucuuacuaugacauucugggcgugccuaaaucagccagugaaagacaaaucaagaaagcguuccacaaguuggcuaugaaauaccauccagauaagaacaagagcccggacgccgaggcaaaauuuagggaaauagccgaggcuuaugaaacuuuauccgaugcaaaucggcgcaaggaguacgacacgcuggggcacucugccuucaccucgggaaaaggucagcgaggcucagggagcaguuuugagcaguccuucaacuuuaauuucgaugaccuauuuaaggauuucggauuuuucggccagaaccaaaauacagguucuaaaaagcguuuugaaaaccauuuccagacuagacaggacgggggaagcuccaggcagcggcaccauuuccaagaguuuucauucggcggcgggcucuuugaugacauguucgaagauauggagaagauguuuaguuucagcggauuugacucuaccaaucagcacacaguccagaccgagaaccgcuuccacgguuccucaaaacauuguagaacuguuacacagaggcggggcaauauggugaccacguauacugauugcagcgggcaauga

SEQ ID NO: 55391 - RNA, 2244 nt, Artificial Sequence
  derived and/or modified sequence opt3 from DNAJC10__Homo_sapiens__NP_001258510
augggcguguggcugaacaaggacgauuacaucagagaccucaaaaggauuauacuuugcuuccugaucgucuauauggccauuuugguugggaccgaucaggacuuuuacagcuuacugggaguguccaagacagcuucuucacgggagauccgccaagcauucaaaaagcuagcccucaaacugcaccccgauaagaauccuaacaauccaaacgcgcauggugacuuucuuaagauuaaucgagcuuaugaaguacugaaagaugaggacuugcguaagaaauacgauaaguauggcgaaaaagggcucgaggacaaccagggaggccaguacgaaaguuggaauuauuacagauacgauuucgguaucuaugacgaugacccggagauaaucacucuggagaggcgggaauuugacgccgcagugaacagcggggagcugugguucgucaauuuuuacucccccggauguucucacugccaugaucucgccccuacguggcgcgacuucgcuaaggaaguggauggcuuacugagaauuggcgcaguuaacuguggggacgauaggaugcuuugccggaugaagggagucaauucguauccaucauuguuuaucuuccgcagcgguauggcccccgugaaauaccacggcgaccgaaguaaggagucccuggugucuuuugcuaugcagcauguaagaagcaccguuacagagcuauggacugggaacuucgucaauuccauucaaaccgccuuugcggcaggaaucggcuggcucauaacauucuguucaaaagguggggauugccugaccagucagacuaggcuucggcugagcggaauguuguuccucaacucucuggacgccaaggaaauuuauuuagaggugauccacaaucugccugauuuugaacuccuuuccgcuaacacacuggaggaccguuuggcccaccaucgcuggcuacuguucuuucacuucggcaaaaacgaaaauucaaacgauccagagcucaagaaacugaagacccuucugaagaaugaccauauucaggugggcagauuugacuguagcagugcacccgauaucugcucuaacuuguacguguuccagccuucccucgcugucuuuaaagggcaaggaacgaaggaguaugaaauccaccacgguaaaaagauucuguacgacauauuagccuucgcgaaagagagcguuaauucgcaugugacuacccugggcccacagaacuuuccggccaaugauaaggaacccuggcuaguagacuucuuugcaccuugguguccacccugcagggcucuccugccugagcuucggcgagccucuaacuugcuguacgggcagcucaaguucggaacacuggauuguacugugcacgaaggccuuugcaauauguauaacauccaggcuuacccaaccacagucguguuuaaucaauccaacauucaugaguaugagggucaccauucagccgaacagauccuggaguucauagaagacuugaugaaucccaguguugugagccucaccccgacgacuuucaacgagcuggucacacagcgcaaacacaaugaaguguggaugguagauuuuuacuccccuuggugccaccccugucaaguuuuaaugccagaguggaagagaauggcaaggacccugacugggcuaauuaacgugggcucuaucgacugccagcaguaucauagcuucugugcccaggagaacguccaacgguacccugaaauccgcuuuuucccacccaaaucaaauaaggcuuaucacuaccauaguuacaacggauggaauagagaugcguauucccucaggauuuggggccugggguuucuuccccaggugagcacagacuugaccccucagacguucucugagaaaguccugcagggaaagaaccacugggugaucgauuuuuacgcaccauggugcgguccgugucaaaauuucgcccccgaauuugagcuccuggcucguaugauuaagggcaaaguuaaggccgggaaaguggacugccaggcauaugcccagaccugucagaaggcuggaauacgggccuacccuacaguaaaauucuauuuuuacgagcgagcaaagagaaacuuccaagaggaacagaucaauacuagggaugcgaaggcuauugccgcauuaaucucagaaaaacuggagacccuucgcaaccagggcaagcggaauaaagacgaauuguga

SEQ ID NO: 55392 - RNA, 597 nt, Artificial Sequence
  derived and/or modified sequence opt3 from DNAJC12__Homo_sapiens__NP_068572
auggacgccauccugaacuacagaagcgaggauaccgaagacuauuacacacuccuuggcugcgaugagcuguccucuguggaacagauuuuggcugaguucaaggucagggcauuagaaugucaccccgacaaacauccugagaauccaaaggccguugagacuuuucaaaaacugcagaaggcgaaagaaauacuaacgaacgaggaaucacgggcucgcuaugaucacuggcgacguagucagaugagcaugccguuccagcaaugggaggcccucaaugacuccgugaagaccucuaugcauuggguagugagagggaagaaagaucugaugcuugaggaaucggacaagacacacacuaccaaaauggagaacgaagagugcaaugaacagagggagcggaagaaagaggaacuggcaucaacagccgagaagaccgaacagaaggagcccaaaccuuuggaaaagagcgucaguccacagaacuccgauucuagcggauuugcugacgugaaugguuggcaucuccgcuucagaugguccaaagaugcacccucagagcugcugaggaaguuucggaacuacgagaucuga

SEQ ID NO: 55393 - RNA, 6732 nt, Artificial Sequence
  derived and/or modified sequence opt3 from DNAJC13__Homo_sapiens__NP_056083
augaacaucauuagagagaauaaggaccuggccugcuucuacaccaccaagcacagcuggaggggcaaguauaaacggguguuuuccgucgggacucaugcuauaacgaccuacaaccccaauacccucgaaguuacuaaccaguggccuuauggagauaucuguucuauuucaccaguggguaagggccaggggaccgaguucaaucuuacauuucgcaaaggaaguggcaaaaagagcgaaacccugaaauucuccacugagcaccgaacagaauuguuaaccgaggcacugcguuuuagaacggacuucucugaggguaagaucacugggaggcgguacaacugcuauaaacaucacuggucggauucacgcaagccggugauucuugaagugacccccggaggcuuugaccagaucaauccugccacaaacagaguccucuguagcuacgauuauaggaauauagagggcuucguggaccugagugauuaccaagggggauuuugcauccuuuacgguggcuucucccggcugcauuuguuugcgucugaacagcgcgaggagauuaucaaaagcgcuauugaccacgccgggaacuauaucggaauaucccuccgaauuagaaaggaaccacuggaguucgaacaauaccugaaucucagguuuggcaaguauucaacugaugagaguaucaccagcuuagcagaguucguugugcagaaaauuucuccccggcacuccgaaccugucaagcgugugcuggcccuuacagagaccuguuugguagaacgcgacccagcuacguacaacaucgcaacucugaaaccccuaggugagguuuucgcccucgugugcgauucagaaaauccucagcuguuuacaaucgaguucauuaaggggcaggucagaaaauauagcaguaccgaaagggacucucuucuggcuuccuugcucgauggagugcgggccagcggcaaccgagacgugugugucaagaugacuccaacacauaaaggccaacgcugggggcuguuaucgaugccgguugacgaggagguggaaucucugcaccucagauuucuugcgacacccccuaauggaaacuucgcagaugccguauuuagguucaacgcuaauauauccuacucaggugugcugcaugccgucacgcaggacggcuuguuuagugagaacaaggaaaagcuaaucaauaacgcaauuaccgcucugcucagccaggagggggaugugguugccuccaaugcggaacuggagucucaguuccaagccgugcggcgccuugucgcaagcaaagcuggauuucuggccuucacacaguugccaaaguuuagagagaggcucggcgugaaaguaguuaaggcucugaaacguucaaacaaugguaucauacacgccgcaguggacauguuaugcgcccugaugugucccaugcacgaugacuaugaucuacggcaggaacaacucaacaaggcuagucugcuuuccagcaagaaauucuuggagaaucugcucgaaaaguuuaacucucaugucgaccacgggacuggcgcgcuggugauuucaagucuucuggauuucuugaccuucgcacucugcgccccuuacagcgagacaacugagggacagcaguuugacaugcuguuagaaauggucgcuuccaauggccgaacccuguucaaacuauuucagcauccaucuauggccaucaucaagggggcaggacucgugaugaaagccauuaucgaggaaggugauaaggagauugcuacaaagaugcaagaacuggcccuuucggagggcgcauugcccagacaucugcacaccgcgauguucacuauaagcuccgaccagaggaugcucacgaaccgccagcugucacggcacuuaguugggcuguggacagcugacaaugccaccgcaacuaaccuuuugaaaagaauccucccgccuggacugcuagccuaccuggagaguucugaucucgugcccgaaaaggacgcugauaggaugcacguacgcgacaaugucaaaauugccauggaucaguauggcaaguuuaacaaagugccagaguggcaacgacuggcagguaaggcugccaaggaaguugagaaauucgcgaaggaaaaaguggaccuugucuugaugcauuggcgggaucguauggggaucgcccagaaggagaacaucaaucagaaaccugugguacugagaaagaggcgccagcggauuaaaauagaggcuaacugggacuuauuuuacuauagauucggccaagaucacgcaaggagcaaucucaucuggaacuuuaagacccgagaggaacugaaggacacacuugaauccgagaugcgcgccuucaauauugaucgggaacugggaucagcuaacgugaucagcuggaaucaucacgaguuugagguuaaauacgaauguuuggccgaggaaauuaagaucggcgacuauuaccucagacugcuacuggaggaggaugaaaacgaggaaucuggguccauaaaaaggaguuaugaguucuuuaaugaacucuaccaccguuuccugcuuacccccaaggucaacaugaaaugcuugugccugcaggcauuagcgaucguguacggacgcugucaugaggagauugguccauucacugacacacgguauaucauuggcaugcucgaaagaugcacggacaagcuggagagggaucgacuuauccuguuucuaaauaagcucauacugaacaaaaagaaugugaaagacuugauggauagcaacgggauucggauccuggucgacuuacucacccuggcccaccuucauguuucucgcgcuacugugccccugcaguccaaugugauugaagccgcaccugauaugaagagagagucagaaaaagagugguacuucggaaacgcugacaaggagaggaguggcccauaugguuuucacgaaaugcaggaguuguggacaaaggggaugcucaacgccaaaacccgguguugggcacaaggcauggauggauggcgaccgcugcagagcaucccccagcuaaaguggugccugcuugccucgggccaagcuguacucaaugaaacagaccuggcgacuuugauacugaacauguuaaucaccauguguggguacuucccuuccagagaucaggacaaugccauuauccgcccacuccccaaagucaagaggcugcuuucugauagcacgugccugccucauauuauccaguugcuccugaccuuugacccaauucuaguagagaaaguugcaauacugcuuuaucacaucaugcaggauaacccccaacucccgcgucuguacuugucaggaguguucuuuuucaucaugauguauacaggcaguaaugucuuaccuguggcucgguuucugaaguacacucacaccaagcaggccuucaaauccgaagagacaaagggucaggacauuuuucagagaucuauccucgggcauauucugccagaggccaugguuuguuaccuugaaaacuaugagcccgaaaaauucagcgagauauuccugggagaguuugacacuccugaagcuaucugguccucagagaugaggcgcuugaugauugaaaagaucgcagcccaccuagcggauuucacaccccgacugcaaagcaauacgagagcucucuaccaguauugcccaauuccuaucauaaacuacccccagcuggagaaugaacuauuuuguaacaucuauuacuuaaaacagcugugcgacacacuccgguucccagauuggccgauuaaggacccugugaaauugcugaaggauacccucgacgccuggaagaaagagguagagaagaaacccccaaugaugaguaucgaugacgcauaugaaguccugaaucuuccccaaggccaggguccucaugaugagucuaagauuaggaaagccuacuuucgccuggcucagaaguaccacccagacaagaaccccgaaggccgugauauguucgagaaagugaauaaggcauaugaauuuuuguguacuaaauccgccaagaucguggacgggccugacccggagaacauaauucuaauccugaaaacacaaagcauccucuucaauagacauaaggaggauuuacagccauacaaguaugcgggauaccccaugcugauucggaccauaacuauggaaaccucggacgaucuucuguuuucaaaagagucuccucucuugccagcugccacagaacuggcauuccacacggucaacugcagugcccucaacgcugaggaacugaggcgcgagaauggccuugagguucuacaggaagccuuuucccgaugcguggcaguacugaccagagcuagcaagcccucugacaugagcgugcaggucuguggguauaucuccaaaugcuacucaguggccgcgcaauucgaggaaugucgggagaagauuacugagaugccuaguaucauuaaagauuugugcaggguuuuauauuuuggaaagagcaucccgcgcguggccgcacugggcgucgaaugugugucuuccuucgcuguugacuucuggcuccagacacaccuguuucaggccgguauacuuugguaccugcucggguucuuguuuaacuacgauuauacccuggaggaaucaggaauccagaagagugaggaaacaaaucaacaggagguggcuaacagccuagcaaaacuguccguccaugcccucucuagacuuggcgguuaccuggccgaggaacaggcuacucccgagaauccaaccauuaggaagucguuagcgggcauguugacgccuuauguagcacggaaacuggccguggcuagcguuacagaaauccucaagaugcugaacucaaauaccgagucccccuaccuuauuuggaacaauaguacucgugccgaacugcucgaguucuuggagucucagcaagaaaacaugaucaaaaagggggacugcgauaagaccuauggaagcgaguuuguguacuccgaccacgcaaaagaacugauagucggcgagauuuucgugcgcguauauaaugaagugccaacauuucaguuagaggucccuaaggccuucgcugcgucacuacuggauuacaucgggucucaggcccaguaccuccauacuuuuauggcaaucacccacgcugccaaaguugagagcgaacaacacggagaccgacuucccagaguggagauggcacuggaagccuugaggaacgugauuaaguauaauccaggcagugaguccgaguguaucggucauuucaaacugauauuuagccuccugcggguccacggggcuggacaggugcagcaacuugcccucgaaguuguaaacauugugacaucuaaucaggauugcgucaacaauaucgcggagucaauggugcuguccaguuugcuggcauuacuacauagccugccgucgucucgccagcucguucuugaaacgcuguacgccuugaccuccagcacuaagauuaucaaagaggcuauggccaagggcgcucugauauaucuccuggacauguucuguaacucaacacacccucaggugagagcacaaaccgccgaacuuuuugcuaagaugacugccgacaaauuaauuggucccaaggucaggaucacacugaugaaauuccucccaaguguguucauggaugcaaugcgggacaaccccgaggcggccguacauaucuuugagggcacccacgaaaauccugaguugauuuggaacgauaauucucgagacaaggucuccacgacugugagagaaaugaugcuggagcacuucaaaaaccagcaggauaauccagaagcuaacuggaagcuacccgaggacuuugccguuguguucggggaggcagaaggagagcuggcugucggcgggguguuucuccgcaucuucauugcccagccugcauggguucuuaggaagccgcgggaauuucugauagccuugcuggagaaacucaccgaacuguuagagaagaauaacccacauggagagacacuugaaacccugacuauggcuacagugugccucuucagcgcgcaaccccagcuagccgaucaggucccuccccugggccacuugccaaaagugauccaggcaaugaaucaucguaacaaugcuauuccuaagucagccaucagaguaauccacgcccugagugagaacgaacucugugugagggcaauggcuagccuugagaccauugguccccugaugaaugggaugaaaaagcgcgccgacacaguuggauuggcgugcgaggcuauaaaccggauguuucaaaaggaacaguccgagcuggucgcccaggcacucaaagccgauuuagugccauaccugcuuaagcugcuagaaggcaucggccucgagaaucuggacucuccugcugcaacuaaagcccaaauugugaaggcguugaaagcuaugacccgaagccugcaguauggggaacaggucaacgagauccucugcagauccucaguauggucugccuucaaggaucagaagcacgaccuuuuuauuagugagucgcaaacggcaggauaccugacagguccgggcguggccggguauuuaaccgcuggaacuagcaccuccguuaugucuaaccugcccccaccuguggaucaugaagccggcgacuuggguuaccagacauga

SEQ ID NO: 55394 - RNA, 2109 nt, Artificial Sequence
  derived and/or modified sequence opt3 from DNAJC14__Homo_sapiens__NP_115740
auggcccagaagcaccccggcgagagagggcuguacggagcucaucacagcgguggcgcaucccucaggacccuugggccuucuguggacccagaaaucccgucauucaguggacugcgggauagcgccggcacagcgcccaacgguacucgcugcuugacggagcauuccgggccuaaacacacccaacauccaaaucccgcucacugguuagacccuucucacggaccacccggcggcccugggccaccgcgagaugccgaagaccccgaucagucggagacaucaagcgaagaggagaguggagucgaccaggaacuguccaaggagaacgaaacugguaaucagaaagauggcaacucuuuucuaagcauuccuuccgcauguaauugccaagggaccccaggaauacccgagggcccuuauucagagggugggaacggaaguagcucuaauuucugucaucacugcacauccccagcccucggcgaagacgagcuggaagaggaauacgaugacgaggagucacuuaaguuucccagcgauuucagucguguuucuuccggcaaaaagccgccuagcagaaggcagcggcaucgcuuucccaccaaggaagacacuagagaagggggaaggcgggauccacgcucgccuggucgacacagacugggcaggaaacggucucaggcugacaagcguaaaggguugggacucuggggcgcagaggagcugugucagcugggucaagccggguucugguggcucaucgaauuacuggugcuuguaggcgaguauguggagacaugcggacacuugauuuacgcuugucgccagcugaaguccucagaccuagaucucuuuagagucuggaugggcguguggaccgggaggcugggagguugggcccagguuauguuccaguuucuuagucaaggcuucuauugcggggugggacuguuuacgcgguucuugaaacuccugggcgcguuacugcuccuugcacuggccuuguuucuagguuuccugcagcucggguggcgauuccuggucggccuuggagaccgccugggcuggagagauaaggcuacuugguuguuuagcuggcucgacucccccgcccugcagagguguuuaacccugcuacgggauucucgcccauggcaaagacucgugaggaucguacaguggggguggcuggaacuucccuggguuaagcagaacauuaaucgucagggaaacgcaccuguggcuagcggucgguacugccaaccagaggaagaggucgcccgauugcugacaauggcgggcgugccggaagacgagcucaaucccuuccaugugcugggggucgaggccacugcaucagauguugaacuuaaaaaggcuuauagacagcuggccgugaugguacacccugacaaaaaccaucacccaagggcugaggaagccuuuaagguguugcgcgcagccugggauaucgucaguaaugcugagaaacggaaggaguacgaaaugaaaagaauggcggagaacgaacucuccaggagcgugaaugaguuccugucuaaguuacaggacgaucugaaggaagcaaugaacaccaugauguguucacgcugccagggaaaacaucgacgguuugagauggaccgugagcccaagagugccagauacugcgcugaauguaacaggcuacacccugccgaggaaggcgacuucugggcagagagcuccaugcucggucugaaaauaacauauuuugcccuuauggaugggaagguuuacgacaucaccgaaugggcuggcugccaacgcgugggaauuucuccagauacgcaccggguccccuaucauaucucguucggcagcaggauuccggggacuagaggacgacagcgcgccacaccugacgcaccacccgcggauuugcaggacuuucugucccggaucuuccaggugccucccggccaaaugccaaaugguaacuuuuucgcugccccucagcccgcaccaggggccgcugccgcaucaaaaccgaauaguaccguaccuaagggagaggcuaagcccaaaagaaggaagaaaguucgucgcccauuucagcgguga

SEQ ID NO: 55395 - RNA, 453 nt, Artificial Sequence
  derived and/or modified sequence opt3 from DNAJC15__Homo_sapiens__NP_037370
auggccgcuagaggcgugaucgcacccgucggggagagccugagguacgccgaauaucuccagccuuccgcgaagcggccagacgcugauguugaccaacagcgccuugugcgaucucugauugccguaggauuggguguggcagccuuagcuuucgcaggccguuacgccuuuagaauauggaaaccgcuggagcaggucaucaccgaaacagcuaagaaaauuucaacucccaguuucagcuccuauuacaaagggggauuugagcagaagaugucuaggcgggaagccggccuaauccucggugugucgccuucagcggggaaggcaaagauucgcacggcccacagaaggguuaugauccugaaccauccagauaaaggaggcagccccuauguggcugccaagauaaaugaggcaaaagaccuucuggagaccacaacuaagcacuga

SEQ ID NO: 55396 - RNA, 1077 nt, Artificial Sequence
  derived and/or modified sequence opt3 from DNAJC18__Homo_sapiens__NP_689899
auggccgcuacccugggcagcggggagagauggacagaagcauacaucgacgccgugaggcggaacaaguaucccgaggauacuccuccagaaucccacgacccgugcggauguugcaauuguaugaaagcgcagaaggagaaaaagucugaaaacgaguggacgcaaacccgccagggugagggcaauucaacauacagugaggaacagcuccuugggguccagcgaauuaaaaagugccguaacuauuacgaaauacugggaguuagcagagaugcuuccgacgaggaguugaagaaagccuauaggaaguuagcacugaaauuccaucccgauaagaauugugccccuggcgcuacugacgcauuuaaagccaucgguaacgcuuucgccgugcuaucuaauccagauaagcggcuccgcuacgacgaauauggggaugagcaaguaaccuuuacagcgcccagagcaaggccuuacaacuacuaucgggacuucgaagccgauauuaccccagaggaacuguuuaauguguucuuuggaggccacuuccccacuggcaacauccauauguuuucgaaugucacagacgauaccuacuauuaccgccgaagacacaggcaugagcggacgcagacucagaaggaggaagaggaagagaaaccucagaccacauauucagcuuucauucaacuucugccaguguugguuaucgugauaaucagcgucauuacucagcuccuggccaccaacccgcccuacagucuguuuuauaaguccacacucggguacaccaucucucgugaaacgcagaauuuacaggugccuuacuucguagacaaaaacuuugacaaggcauaucgcggagcuagccugcacgaucuugagaaaacuauugagaaggacuacaucgauuauauacaaacauccugcuggaaagaaaagcagcagaagucagaguugaccaaucuggccggucuauacagagacgaaaggcucaaacaaaaggcggagagucugaaacuugaaaacugugagaagcugagcaaauugauuggccuccggcgagggggauga

SEQ ID NO: 55397 - RNA, 351 nt, Artificial Sequence
  derived and/or modified sequence opt3 from DNAJC19__Homo_sapiens__NP_660304
auggccagcaccguggucgcuguuggccugacaaucgcagccgcgggguucgcuggaagauacgugcuccaggccaugaagcacauggagccccaaguaaaacagguguuucagucccuuccuaagucugcauucucagguggcuauuacaggggaggguuugaaccaaaaaugacuaagcgggaggccgcucugauuuugggcgucaguccgacggcaaacaaagguaagauacgcgacgcccaucgacguaucauguuacugaaucaccccgauaaagggggaagcccuuauauugcugccaaaaucaacgaagcgaaggaccuacucgagggccaggcaaagaaguga

SEQ ID NO: 55398 - RNA, 1665 nt, Artificial Sequence
  derived and/or modified sequence opt3 from DNAJC1__Homo_sapiens__NP_071760
augaccgcccccugcagccagccugcucaacugccaggcagaaggcagcucgggcuugugccguuucccccuccacccccucggacaccacuguugugguuacugcuacuccugcuugcagccgucgcgcccgcucgcggaugggaguccggugaccuggaauuguucgaucucguugaggaagugcagcugaacuucuaccaguuucugggcguacaacaggacgccucuucagcagauauccgaaaggccuaucguaaacucaguuuaacucugcacccugacaagaauaaagaugagaacgcugaaacgcaguucagacagcuuguggcaauuuacgaggucuugaaggacgaugagaggcggcaacgcuaugacgauauacugaucaaugggcuaccagacuggagacagccgguguuuuacuauaggcggguucgcaaaaugagcaacgccgaacucgcucugcuucuguucauuaucuugaccgugggacauuacgccgucgugugguccauuuaucucgagaagcagcuggaugaauuacugucucgaaagaaaagagagaagaaaaagaaaacaggcucgaagucaguagacguuagcaagcucggugcgagugagaaaaaugaaaggcuucugaugaagccccaguggcacgauuugcuaccuuguaaacuggggaucugguuuugccucacucugaaggcacuuccacaucugauacaagacgccggacaguucuacgcuaaauacaaggagacccgguugaaagaaaaggaggacgcccucacacguaccgaacuggagacuuuacagaagcagaaaaaggugaaaaagcccaaaccugaguuuccagucuauacaccccuggaaaccacguacauccaauccuaugaucacggcacuucuauugaggaaaucgaggaacagauggacgauuggcuagagaaccgcaauagaacccagaagaagcaagcaccggaguggacagaagaggaccucagccagcugacuagguccauggugaaauucccuggcgggacccccggacggugggaaaagauugcucaugagcuuggucgaucagugacagaugucaccacgaaagccaagcaguugaaagacaguguuacuuguagcccaggcauggugcgccugucugaacucaaguccacaguacagaacucaagaccuaucaagaccgcgacuacacugcccgaugacaugauaacccaaagggaggaugccgaggggguggcagcugaagaggaacaggagggagacagcggcgagcaggaaacgggugccaccgaugcucggccacgcagaaggaaacccgcccgucuucuggaggcaacagccaagccugaaccagaggagaaaagucgggcuaagcgacagaaagacuuugacauugcggaacaaaaugagucuuccgaugaagagagcuugagaaaggaaagggcacgcucggccgaggaaccguggacucagaaccagcagaagcuccuggaguuagcucugcaacaguacccccgggggucuuccgacagaugggauaaaaucgccaggugcgucccuucaaagaguaaagaggacuguauugcacgcuauaagcuacucguggaacugguucagaaaaagaaacaagccaagagcuga

SEQ ID NO: 55399 - RNA, 822 nt, Artificial Sequence
  derived and/or modified sequence opt3 from DNAJC27__Homo_sapiens__NP_057628
auggaggccaacaugcccaagagaaaagaaccuggcaggagccugcggaucaaggugauuuccauggggaaugcugaggucggaaaaucuugcauaaucaagcgcuacugugaaaaacgauucguuucaaaguaucucgcaaccauugguaucgacuacggcgugacaaagguacacgugcgugauagagagauuaaagucaacaucuuugacauggccgggcauccauucuuuuaugaagugaggaaugaguucuacaaggauacucagggaguuauacuuguguaugacgucggccaaaaagauaguuuugacgcgcuggaugcuugguuggccgagaugaagcaggaauuagguccgcacgggaacauggagaauaucauuuucgugguaugcgcaaacaaaaucgacuguacgaagcaucggugcguugaugaaagcgagggacgccugugggccgaguccaagggcuuucuauacuucgaaaccucugcucagacaggcgaggggauuaaugaaauguuucagacuuucuauaucucgauaguggaccucugugagaacggagguaaaagacccaccacaaauucaagcgcaaguuuuaccaaggaacaagccgaugcuauuaggcggauccgcaacuccaaagacucuugggauaugcugggcgucaagccuggggccagccgagacgaggugaauaaagcguacagaaaacuugcagugcuguugcacccagacaagugcgucgcccccggauccgaggaugcuuucaaggccguugugaacgcaaggacugcucuccugaagaauauuaaauga

SEQ ID NO: 55400 - RNA, 1167 nt, Artificial Sequence
  derived and/or modified sequence opt3 from DNAJC28__Homo_sapiens__NP_060303
augaacaccauguacgugaugauggcccagauccugagaagccaccucauuaaggcuacagucauacccaauaggguuaaaaugcuuccuuauuucggcaucauucggaaccgcaugauguccacucauaagucuaaaaagaaaauccgagaguacuaucgucuguugaauguggaagaggggugcucagcagacgaaguaagagagaguuuucacaaguuagccaagcaauaccauccagauagcggauccaacacggcggacucugcuaccuucauuaggaucgaaaaagccuaucggaaggugcugucgcacgucauagagcagacaaaugcaucacagagcaaaggugaggaagaggaagauguggagaaguuuaaauacaagacuccgcagcaucgccacuaucuaaguuucgagggcaucggguuuggaacccccacacaaagagaaaagcacuacaggcaguuccgggccgaccgcgcugcagagcagguuauggaauaccagaaacaaaagcuccagucccaguauuuuccugauucugugauugucaaaaacauccgacagagcaagcaacagaaaauuacccaggccaucgagagacugguggaagaccuuauacaagaguccauggcuaagggcgauuucgacaaucugucagguaaagggaagccauugaagaaauuuagugauuguagcuacauugaccccaugacucauaaccucaauaggauccugauugauaacggauaucagccugaguggauccugaagcagaaagaaaucucugacacaauugagcagcuccgggaagccauauuaguaucccguaagaaacugggcaauccaaugacccccacggagaagaagcaauggaaccacguuugcgaacaguuccaggagaauauccgcaaacuuaacaagagaauuaaugauuuuaacuugaucgugccuauacugacuaggcagaaaguccauuucgacgcgcaaaaggagauugugcgggcacagaaaaucuacgaaacccuaaucaagacaaaggaggugacugaccgaaacccaaauaaccucgaucagggcgaaggggagaaaaccccggaaauuaagaaaggauuucugaauuggaugaaccuuuggaaguucaucaaaauucgcucauucuga

SEQ ID NO: 55401 - RNA, 1707 nt, Artificial Sequence
  derived and/or modified sequence opt3 from DNAJC2__Homo_sapiens__NP_001123359
augcugcuccuucccagcgccgcugacggcagagggaccgcaaucacacacgcccugacuuccgcgucuacguugugccagguggagccugucggaaggugguucgaagcauuuguuaagcggcgcaaccgaaaugccucagcaaguuuccaagaguuagaagauaaaaaggagcugagcgaagaguccgaggacgaagaacuacagcucgaagaguuuccaaugcugaaaacccuugauccgaaggacuggaaaaaccaggaucauuacgccgugcuggguuugggccacguacguuauaaggcuacacagagacaaauuaaggcagcccauaaagcuauggugcucaagcaccaucccgacaaaaggaaggccgcgggggagccuauaaaagaaggagauaaugacuacuucacuuguaucaccaaggcauaugagaugcugucugauccagucaagcggcgcgccuuuaacucgguggaccccacauucgauaauucaguuccuagcaaaagugaagcuaaggacaacuuuuucgagguguuuaccccagucuucgaaagaaauuccagguggucuaacaaaaagaaugugcccaaacugggcgauaugaacagcuccuuugaggacguagacauuuucuacucauuuugguauaauuucgauaguuggcgggaguucagcuaccucgacgaagaggaaaaggagaaagccgaaugccgcgaugagcgaagauggaucgagaagcagaacagggcaacucgggcucagcguaagaaagaagagaugaaucgcauuagaacauuaguugacaacgccuauucuugugauccuaggaucaagaaauuuaaggaagaggaaaaagcgaagaaggaggccgagaaaaaggcaaaagcugaagccaagcggaaagagcaggaagcuaaggagaagcaacgacaggccgagcuggaagcagcccgccuugcuaaagagaaggaagaggaagaggugagacagcaggcguugcuggcuaaaaaggagaaagacauacaaaagaaggccaucaaaaaggaaaggcagaaacuacgcaauuccugcaagauugaggaaaucaacgagcagauucggaaagaaaaggaggaggcugaagccagaaugaggcaagcaucaaagaacaccgagaaaagcacgggugggggaggcaauggcaguaagaacuggucugaagaugaccuccagcugcuuaucaaagccgucaaucuguucccagcugggacuaacucccguugggaggugauagccaauuacaugaacauucacagcucgucuggagugaagcggaccgcaaaagaugucaucgguaaggcgaaauccuugcagaagcucgacccgcaccagaaggaugacauuaauaaaaaggcuuuugacaaauucaagaaagaacauggcguugugccccaagccgauaacgcaacaccuucagagcgauuugaggggccauacacugacuucacccccuggacaaccgaggagcagaagcuguuagaacaggcccugaagacguauccuguaaauacuccagagagaugggagaaaaucgcugaagccgugcccggaaggacaaagaaagauuguaugaagcgcuacaaagagcucgucgaaauggugaaggcaaagaaagcugcccaggagcaaguucuuaacgcgagucgggccaagaaauga

SEQ ID NO: 55402 - RNA, 1515 nt, Artificial Sequence
  derived and/or modified sequence opt3 from DNAJC3__Homo_sapiens__NP_006251
augguggcccccggcagcgucaccuccagacuggggucuguuuucccuuuucuccuugugcugguagacuugcaguacgagggagcugaaugcggugugaacgcagaugucgagaagcacuuagaacugggcaaaaagcuacucgccgcggggcaacuggcugacgcccuuucacaguuccaugcagccguggauggagacccagauaauuauaucgcuuacuauaggcgggcaacaguuuuucuggccaugggcaaaaguaaggcugccuugccggaccucacuaaagugauucagcugaagauggauuucacggcggcacgccugcagcgaggucaccucuuacugaagcaagggaaacuugacgaggccgaagaugacuuuaagaaaguccucaagagcaaccccuccgagaaugaggaaaaagaggcucagucucagcugauaaagucggaugaaaugcagcgucuaagaucacaagcccucaacgcauucggaagcggcgacuacaccgcugccaucgcguuucuggauaagauucuugagguguguguaugggacgccgagcugagggaauugcgggcagagugcuucaucaaagaaggcgagccucgcaaggcuauuagugaccucaaagccgcuuccaagcugaaaaaugauaacacagaagccuuuuauaagaucucuacuuuauacuaucagcugggggaccaugagcucagccuuuccgagguuagagaaugucugaaauuggaucaggaccacaagaggugcuucgcacauuacaaacaggugaaaaagcuaaauaaacugauagagucagccgaagaguugauccgggauggacgcuacaccgacgcuacaaguaaguaugaaagcgucaugaaaaccgagccaucuauugcggaguacacugugcgauccaaggaaagaaucugucacugcuuuucaaaggaugagaaacccguggaagcaauuagggucuguagcgagguucugcaaauggaaccugacaacgugaaugcccuuaaggaucgggcugaggccuaucugaucgaggaaauguacgacgaggcaauacaggauuaugaaacagcccaggagcacaacgagaaugaccaacagauucgugaagguuuggagaaagcucagcgccuccugaagcagagucaaaagagagacuacuauaagaucuuaggcguaaagaggaacgccaaaaagcaggaaauuaucaaagcauaccggaagcuggcgcuacaguggcauccagauaauuuccagaacgaggaagagaaaaagaaggcugagaaaaaguuuaucgacauugccgcagccaaagaagugcucucugaucccgagaugcgaaagaaauucgacgauggggaagacccucuggaugcugagucccaacagggaggcggugggaauccauuccaccgcagcuggaacucguggcagggauuuaacccguucucuuccggcggccccuuuagauucaaguuucauuucaauuga

SEQ ID NO: 55403 - RNA, 597 nt, Artificial Sequence
  derived and/or modified sequence opt3 from DNAJC5__Homo_sapiens__NP_079495
auggccgaccagagacaaaggagccuguccaccucuggcgagucacucuaccacgugcuugggcuggauaagaacgcuacaagugacgauaucaaaaagagcuaucggaaauuggcauuaaaguaccaucccgacaaaaauccugauaacccagaagccgcggacaaguucaaggagauuaauaacgcucacgccauacugacugaugcaacgaaacgcaauaucuaugacaaguacggaucccuaggucucuaugucgccgaacaguuuggcgaggaaaacguuaauaccuacuucgugcugucuucguggugggcuaaagcacuuuuuguauucugcgggcuguugacauguugcuauuguugcuguugccucuguugcuguuuuaacugcuguugcggaaagugcaaaccgaaggcccccgagggcgaggaaacugaguucuacgugucaccugaagaucuggaggcucagcugcagagcgacgagcgagaagccaccgauacaccaauugucauccaacccgcgagugcaaccgagacuacacagcucaccgccgacucccauccuucuuaccacacggaugguuuuaauuga

SEQ ID NO: 55404 - RNA, 1317 nt, Artificial Sequence
  derived and/or modified sequence opt3 from DNAJC7__Homo_sapiens__NP_001138238
augugccccaagaacgccagcuacuauggcaauagagcugcaacccugaugaugcucgggagguuccgggaggcccuuggagacgcgcagcaauccgugcgccuggaugacucuuuuguccgaggucacuugcgugaaggcaaaugucauuuaucacuggggaacgcuauggccgcaugcagaaguuuccagagggcccuagagcucgaucacaagaaugcucaggcacagcaagaauuuaaaaacgccaaugcuguuauggaguacgaaaagaucgccgagacagacuucgagaaacgggauuuucgcaaggugguauucuguauggacagagcgcuggaauuugcuccugccugccauagguucaagauucuuaaagcugagugucuggccauguugggacgguauccagaagcacagagcguggcuuccgauauacuccgcauggacucuacuaacgccgaugcgcuguacguccgaggccugugccucuauuacgaggacuguaucgagaaggccgugcaguuuuucguucaggcauuaagaauggcuccggaucacgaaaaagccugcauugcuuguaggaaugccaaggcacugaaagccaagaaggaggacgguaacaaggcuuuuaaggaagggaauuauaaacuugcguacgaguuguacacggaagcacugggaaucgaucccaacaauauuaagaccaacgccaaacuauauugcaaucggggcacagugaacucgaagcuccguaaacuggacgacgcuaucgaggauuguacuaaugccgucaaacuugacgauaccuacauaaaggcauaucugcgcagagcccaaugcuacauggacacagagcaguaugaagaggcugugagggauuacgaaaaaguauaucagaccgagaagacuaaagaacauaagcaguugcucaaaaacgcccaacuggaguuaaagaagucaaaacggaaggacuacuacaaaauccugggcguugauaagaacgcaagcgaggacgaaauuaaaaaggcguaucgaaagcgcgcucucaugcaccacccugauagacauaguggggccuccgcagaggugcagaaagaagaggaaaagaaauucaaggaggucggagaggccuuuacaauccuuucugaccccaaaaagaagaccagguacgauagcggucaggaccuggacgaagagggcaugaauaugggggauuucgacccaaacaauauuuucaaagcauuuuucggaggcccugguggguuuuccuucgaagccucaggaccaggcaacuuuuucuuucaauucggcuga

SEQ ID NO: 55405 - RNA, 573 nt, Artificial Sequence
  derived and/or modified sequence opt3 from DNAL1__Homo_sapiens__NP_113615
auggccaaggcuaccacaaucaaagaggcacuggccagaugggaagagaagacuggccagaggcccagcgaagcgaaagagauuaagcucuacgcucaaauaccuccaaucgaaaagauggacgccucccuuucuaugcuggcaaacugcgagaaguugucauuaaguacgaauuguauugagaagaucgccaaccugaaugggcucaaaaaccuacggauucugagccuuggacgcaauaacaucaagaaucugaacgguuuggaagcugugggcgauacccucgaggaacuguggauauccuauaauuucaucgagaaacugaaggggauucacaucaugaaaaagcucaagauuuuauacaugucuaacaaucuggucaaagacugggcagaguuuguuaaacuugccgaauugccgugccuggaggaucuaguguucguaggaaacccccucgaagagaaacauucggcugaaaauaacuggaucgaggaggccacaaagcgagugccuaaacugaagaaacuugacggcacuccagucauaaagggugaugaagaggaagacaauuga

SEQ ID NO: 55406 - RNA, 849 nt, Artificial Sequence
  derived and/or modified sequence opt3 from DNASE1__Homo_sapiens__XP_011520696
augagaggcaugaagcugcucggggcccuucuggcuuuggcagccuuacugcagggagcggugagccuaaaaaucgcugccuucaacauucaaaccuuuggugagacaaagauguccaaugcaacucucgucucuuacauaguucagauccugucaagguaugacauugcccuugugcaggaaguacgggauagucaccugacggcugugggcaaauugcucgacaaccugaaucaggaugcacccgacaccuaccauuaugucgugagcgagccucuggggcgcaacuccuacaaggaacgauaucucuucguuuaccguccagaucaagugucugccgucgacucguauuacuacgaugacggaugcgagccguguggcaaugauacauuuaacagagaacccgcuaucgugagguucuuuucacgguucacugagguacgcgaguuugccauuguuccuuuacacgcggcaccaggugacgccguggcugaaaucgaugcccuguaugacgucuaccuugaugugcaggagaaauggggguuggaagacgugaugcugaugggagacuucaaugcaggcugcagcuaugucagacccagucagugguccucuauaaggcuauggaccagcccuacauuucaguggcucaucccagauuccgcugacaccacugccacacccacccauugugcguacgaucggauuguuguggccggcaugcugcuucgcggggcaguagugccugacucagcucugccauucaacuuucaagccgcuuauggauugagugaucagcucgcccaggcaaucagcgaccacuacccggucgaggugaugcugaaguga

SEQ ID NO: 55407 - RNA, 900 nt, Artificial Sequence
  derived and/or modified sequence opt3 from DNASE1L2__Homo_sapiens__NP_001288609
augggcgggcccagagcccugcucgcugcacuuugggcccuggaggcggcuggaaccgccgcauugaggaucggugccuucaacauucagagcuuuggcgacuccaaggugucugauccugcuugcgggucaauaaucgcaaaaauuuuagccggauacgaccuggcucuaguccaagaaguucgggauccagaccucagugccgugagcgcgcugauggagcagaucaauuccguaucugaacacgaguauucguucgugucaagccagccgcuuggccgcgaucaguacaaggaaauguaucuguuugucuaccgaaaagacgcagugaguguuguggauacauauuuguaccccgacccugaggaugucuucucccgugagccauuugugguaaaguucucugcccccgguacuggggaaagagcuccuccacuccccagcaggcgggcccugacgccuccaccgcugcccgcagcugcccaaaaccucguuuuaauuccucugcaugcggccccacaccaggcaguggcugagaucgacgcccuuuaugaugucuacuuggacgugauagauaaauggggaaccgacgacaugcuguuucuaggcgauuucaaugcugacuguuccuacgugcgcgcccaggauugggcagccaucagacucaggucaagugaagucuuuaaguggcugauucccgacagcgcugauacaacuguuggcaacucugacugcgcguaugaucggaucguggcauguggggcccgccuucgaagaucccugaagccucagucagcuaccguacaugacuuccaagaggaguuuggauuggaucagacacaggcccucgcaauuagcgaccacuucccaguggaagucacccugaaauuucauagguga

SEQ ID NO: 55408 - RNA, 828 nt, Artificial Sequence
  derived and/or modified sequence opt3 from DNASE1L3__Homo_sapiens__NP_001243489
augagcagagagcuggcuccccuccuucuguuguuacuguccauccacucugcccuagcaaugaggauuugcucauucaacgugcggaguuuuggcgaaagcaagcaggaggacaaaaaugccauggaugucauaguuaaggugaucaaacgcugugacauuauccucguaauggaaauuaaggauuccaacaaucgaaucugcccuauacugauggagaaacuuaaccgugaaaagcuggugucugucaagagaucguaccauuaucacgacuaccaagauggggacgcggauguguucucaagggagccauuuguugugugguuccagagcccgcauaccgcugucaaagacuuugugaucauucccuugcacacaacuccugagacgaguguaaaggaaaucgaugagcucguugaaguguauaccgacgucaaacaucgguggaaggccgagaauuucauuuuuaugggagauuucaacgcagguuguuccuacgugccaaagaaggccuggaagaauauccgccugagaacagaccccagguuuguguggcugauaggcgaucaggaggacacuaccgucaaaaagucuacaaacugcgcuuaugaccggauuguucuccgcgggcaggaaaucgugagcuccguagugccuaaaucaaauagugucuucgauuuucaaaaggcauacaaauuaaccgaggaagaggcccuggacgugagcgaucacuucccaguugaauuuaaacuucagucuucccgagcuuucacuaacagcaaaaagucagugacauugagaaagaaaaccaagaguaaaaggucuuga

SEQ ID NO: 55409 - RNA, 462 nt, Artificial Sequence
  derived and/or modified sequence opt3 from DNASE2B__Homo_sapiens__XP_011540180
augccccagcugugcaccagagccagcuccucugagaucccuggcaggcuccuuacaacucugcaaucagcucaggggcagaaguucuugcacuuugcaaaaagugacagcuucuuagaugacauuuuugccgcguggauggcucagcggcugaagacgcaucuacucaccgaaacauggcaacgcaaacgacaggagcugccauccaacuguucucuuccguaccacguguauaauauaaaggccaucaaacugucgcgucauucauacuucagcaguuaucaggaucacgcaaaguggugcauuucccagaagggaacuaaaaacagauggaccuguaucggugacuugaauaggucuccccaucaagccuuucggagcggcggguucauuugcacacagaacuggcagaucuaccaggcuuuucaaggacucguccuguauuacgaauccuguaaguga

SEQ ID NO: 55410 - RNA, 1083 nt, Artificial Sequence
  derived and/or modified sequence opt3 from DNASE2__Homo_sapiens__NP_001366
augaucccccugcuccuugccgcucuguugugcgugccugcaggcgccuuaaccuguuacggggacagcggacagccagucgauugguucguuguguauaagcugccggcgcuaagagguuccggcgaggcugcccaaagggggcuccaguacaaauaucuggacgaaucuucaggaggcuggcgggauggucgcgcacuuauuaacagucccgagggggccguaggacgaagccugcagccuuuguaccguuccaauacaucucagcucgcuuuucugcuguauaacgaccaaccaccccagccuucgaaggcacaggauucaagcaugagaggccacacuaaaggcgugcucuuacuggaccaugaugggggauucuggcuuguccacagugugccaaauuuucccccuccagccuccucugcugccuacagcuggccgcauuccgcgugcacguauggucagaccuugcuguguguuucauuccccuuugcacaauucaguaagaugggcaaacagcuaacauacacuuacccuuggguguauaacuaccagcucgaagggauauuugcccaggaguucccagaccuggaaaaugucgugaagggacaccauguaagccaagagcccuggaacucuuccaucacccuuacaucacaggcuggcgccguuuuucagagcuucgcaaaguuuaguaaauucggugaugaccuguauucugggugguuggcugccgcgcucggaaccaaucugcaagugcaguuuuggcacaagacugucggcauuuuaccuuccaacugcagcgauaucuggcaagugcugaaugugaaccagauugccuucccaggccccgcagggccgucguucaauucuacagaggaccacuccaaauggugugucucaccuaagggacccuggaccugcguuggugauaugaacaggaaucagggcgaggaacagcgcgggggaggcacgcucugugcucagcuuccagcccuguggaaggcuuuucagccuuuggugaaaaacuaccaacccugcaaugguauggcccggaagccaaguagagcauauaaaaucuga

SEQ ID NO: 55411 - RNA, 1062 nt, Artificial Sequence
  derived and/or modified sequence opt3 from DND1__Homo_sapiens__NP_919225
augcagagcaagagagacugcgagcuguggugugaaagggugaaccccgagaauaaagccgcucucgaagcauggguccgggagaccggcauccgccuuguucaagugaacgggcagcgaaaguacggagguccuccaccgggcuggguagggucucccccuccagccggauccgaaguguucauuggccgucugccccaggaugucuaugagcaccaguugauaccuuuauuucaaagaguggguaggcuguacgaguuccggcuaaugaugacauuuucagggcucaaucgcggauucgcguaugcuagauacaguagcaggcggggcgcccaggcagccaucgcuacucugcauaaccacccacuucgccccuccugcccucuguugguuugucgaucuacggaaaaaugcgagcucucgguggacggccugccaccgaaucugaccagaucagcacucuuacuggcccuucagcccuuggggccuggacugcaggaagcuaggcuacucccaagccccgguccugccccaggccaaauugcgcugcuuaaguuuaguucccaucgggcagccgcuauggccaaaaaggcacuggucgaggggcagucucacuuguguggagaacagguggcuguagaguggcucaagcccgaucugaaacagcguuuacgccaacagcugguuggcccguuccucagaagcccucagcccgaggguucccaacuugcccuggcgagggacaaguugggguuucagggagcccgggcaacacuacagcugcucugccagcgaaugaaacugggcucaccaguguuccuuacuaagugucugggcaucgggccugcuggauggcaucgcuuuugguaucaagucgugauucccggucacccagugcccuucaguggcuugaucugggucguucucacccuggaugggagagacggacacgaaguggccaaagaugcuguaagcgugagguuacugcaggcccuaucugaguccggcgcaaaccuccuguggucagccggugcugaagcggggacaauggucaagcaguga

SEQ ID NO: 55412 - RNA, 2214 nt, Artificial Sequence
  derived and/or modified sequence opt3 from DNER__Homo_sapiens__NP_620711
augcagcccagaagggcccaagcuccuggcgcacagcugcucccagcccuugcgcuguuguuacugcuacucggggcuggaccgcgggguagcucccuggccaaccccgugccugcagccccacuuucugcucccggcccuugcgcagcccagccaugucgcaaugggggagucugcaccucacgacccgagccugacccacagcacccggcucccgccggcgaaccugguuacaguuguacaugcccagcggggaucagcggagcaaacugucaacugguugccgaucccugcgcuuccaauccuugucaucacggcaacuguucuucgucaagcaguuccucuagcgacggcuauuugugcauuugcaaugagggguacgaaggaccaaacugugagcaggcccuccccucccugccggcaacugguuggacggaaucaauggcuccucgucagcugcagcccgugccagccacccaagagccugauaagauacuccccagaagucaggcgacaguaacuuuaccaaccuggcagcccaaaacaggccagaagguggucgagaugaaaugggaccaaguggaaguuaucccugauauugccugcgggaaugcaagcucuaacuccucagcuggaggcaggcuggugagcuucgaggucccacagaauaccagugugaagauccggcaggacgccacugcuucucuuauuuugcuguggaaaguaacagccaccgguuuucaacagugcucccuaaucgaugggcgcagcguuacgccgcuccaggcaucgggaggccuggugcuucuggaagagauguuggcccucggcaacaaucauuucauaggguuugucaacgacucugugacuaaguccaucguggcucugagauuaacccuggucguuaaggugucaacauguguacccggagagagucacgcgaaugaucucgaaugcagcgguaaaggcaaguguacuaccaaaccuuccgaggcaacauucucuugcaccugugaagaacaguauguggggacguuuugcgaagaguacgacgccugucaaaggaagccaugccagaacaaugcuagcuguauugaugccaacgagaaacaggacggaucaaacuucacuugcgucugucuucccggcuauacaggugaacugugccagaguaagaucgauuacugcauuuuggacccuugucggaauggggcaaccugcaucuccagccuaucuggcuuuacuugucaaugcccagagggauauuucggcucagccugugaagagaagguggaccccugcgcuaguagcccgugucagaacaaugggacaugcuacguugauggagugcauuuuaccuguaacugcuccccugguuucacgggcccaaccugugcccagcugauagacuuuugcgcacucucucccugcgcgcacgggacaugucgcucggucggaacuagcuacaaaugccugugugauccuggcuaucacggucuuuacugcgaagaggaguauaaugaaugucuguccgcucccugcuugaacgccgcaaccugucgagaccucgugaauggguacgagugcguaugucuggccgaauauaagggcacacauugcgaguuauacaaagauccaugugcuaacguuucaugccugaauggagccacuugcgacagugauggccuaaacgggaccuguauuugcgcaccuggauucacaggugaagagugugacaucgauauuaaugagugcgacucuaaccccugucaccauggcgggagcugccucgaucagccaaauggauauaacugucacugcccgcacggcugggugggugcuaauugugaaauccaucugcaauggaaguccgggcacauggccgagucacuuaccaacaugccuagacauagcuuguacaucauuauaggcgcgcugugcgucgccuuuauccucaugcugauuauccuuauagugggaauuuguaggaucucucggaucgaauaccagggcuccagucgucccgcuuaugaggaguucuacaacugccgcagcauugacucugaguucuccaaugcaaucgccucaauuagacacgcuagguuugggaaaaagagucggccagccauguaugacgucagccccauagcauacgaggauuauucgccugacgauaaaccacuggugacuuugaucaagacgaaggaccucuga

SEQ ID NO: 55413 - RNA, 14262 nt, Artificial Sequence
  derived and/or modified sequence opt3 from DNHD1__Homo_sapiens__NP_653267
auggugcccgaggaacggagggucggccugagcuccgacgagaccucuucagauagucucaagagcuggcacuccaucugcguucuugacucuaaagaacagccucuggccugucaacagaagcagcggcaguucgugaaaccaguaacggagucggaacaaccgacuguguuggaguuacugcuagcugagcuccgcacgcuguuuucagcaguccuucaggauagcagucccgccgcguggcgauaccugcacgcuguguuggggcuccugccuccauaucgugaacugcucguuggacacuuagaccugcuucccuucuuggagcagcuguacugcugggccccuugggugcagacccaucuacaccucgaucugcuuggugcaauuguccaagccuuuccacccgacuccucucuguuggauagcgcuucccaugcagacuguugcccucagaagagaaggcuccaccaccggccaccgugucccgccugcccuuucgugcaggcucaguggucacgccaacagguaaaagaagaacuggccacaugguuaagaccacugacucuccccgagcuucagaggugucugggcaucguuggggcgcaaguggcauuggaagaggccgucuggcuagauggacugagucuccugccucuugcucuggccgcagacaucccagugcgguaugaaagcucugauaccgacaacgcugagguggaacccgucggccgcaaggagacacgaucccaguuggauuacgagguuccgagagaaaaggccuuucagaaaucaagcaccgguuucaguccugagacuucuuuucucgacucccaggugaugacagcgcugaagauggaaagguaucuaaagaaaauucauuuccuguaccuaaauguagcccccagccgguauuuucguccauacucgcucaugguggucccucccgacaaagugaacccagagcacuacaucuucucucccuuugggauucugcauguucacccuguggaaggauccgagaccaugacgcuuggcacuuggcaccaucacugcgucuuguggcaacagcugcaguucaucccauuuuucaaguauugucuccugcgcaagucauuuaccugcuggaaaaagaaugugagacuucagggccugcauagguugcaaaaauuucucgagaaccaccuguuacuggcaguaccgcauuucggggcuggacuacuccacauuagucggcugcuucaggaauugcacagcguuuccuggcugccccaggagcucgaucgauguuacgaacuguuagaccugcagacagcccuugcugaggaaaagcauaaagccuugcgccuccugcacagaugccuaaaucugugcacuucuauccucaggcuggugcaugaggauaccuaucacaugcaacagugucuucaggagcggguccagaacugcgaccgcauuagaacaggucaaggcagcaucuacuugcagagggugcagcacaagcaacuggaacagaaauuaaagcaggcagaggccugguggcuccagcuggggaaguuugcucgucuugucgauuauaugauuugucaaucacugaucaguguguuggaagaacagauaaccuccuucguugcgaauauucuccaggcaccucggcagaaaccauuucugagcucucaguuaguguucgacgaucauggacagcugucacacguacccugcgucgagaacaugauccagacgcucacuggcggucugcagagugugaagacaagcgcccuucaaguugugcaguccgcugacuugaaaaccucuucggauagccuguacuccgaagaggaagacgaggaagaggauucaaaggacgaguuuuuaaugccuaaauuccaggggcaaccaagugacgccgucucuauauucuguggacccaaugugggccucguauggccguggaaaucacauccuaucgcaggcauccuggaagugcgagggugcagacuuaggggacaguauuucccacacaacuacaagcagcuggaggaagaucuagacaauaaccccaaaauucagcaagcccucaauauacagcagguucuguuggaggguguccuguguaaggugcaggaauuuugccgcgagcaucacuggaucacuggcauuuacgaguucuuacaauccugggggccucagaaacucgaagauaugcggggaggccccaucaagaacuaugugacacuggucucaagacuuaauguuuggcaggcuagggugagcucuaugccaauagagcuguugaccaaaggugggcuccugcuacuguccugucacgacgugcaggccgaaauggagaguaaacuuaacagcauucgcaaggauauccucgcacauguacaaaacgaaugcuggaaucugucucagcaguugaugacggagcugaccgacuuuaugcacaucuuccgaacaauuaacuccgauauccaugcgauugcucaguguacucaaaaauuaaaugaggccaacgaacaguacgucgagcucgaagaacggauggaguaugugcgugcacugcacgaacuuauaagaaaucauuucucacuguuuagugccgagaacgaggcuuuggacaucagcguuaggcgccaguucggcgagucgccuauucccccaugcccgccucccccacaaccccaccuccugcacugcccucuacuggccccacagcuucucgauaugugggaagcauuucaguucgagaagucccaggcuucugaguuucuguugagcaaacggcaugccaucaugcccaaguuacaacagcugauggcggccgcucucgcagaacuggagggacuucuggccaaggcuuugucaggcccuuucauggacccgacccaggaucagagaaguacagaacaccagcuggugucccuggagaggcaguuucagaauacugucucugaccucagcgaacugcaucacgccuacgcaaucuucaccgaggaugagacaccagugccccuuccuauuugugggacccgaccaauaguucagcaacagcgcaucuggcacuuauaucgggugauuuccgaaaacaucucagaguggaagugcauggcguuugccaaguucagccccgcuauggcccaggagaagacugagggauggcugacggaagcagcuagaaugaguacaacccucgaguugcauucuccuguacugcaacacuguaugaggauucucggugaguuucguuccuaccugccgcuucugacuaaguugggcagccuacauccccagucgcugaauugccagugucucuuacgcgcccuggggcuuggaucacugcagaccaucgaacucuugacacugggccaacuccugaccuauccacuucuagaguucgcagaccggauaaaccaggucuggcagaaugaaaacgagagaauccacgcccaggagacuauuaggcgacugcaacgguacugggaagcucgccaguugagauuacugaauuuuauccuccaugugccuuacgagcccccagcgucugaaaggaguaaacggcaagugcugcgauccccucagugggaggucguugacaaggauagcgguacauucauucuuucugacuauagcaaccugcaagauuccauccaggaaucacuccagguguugaguaaaauacuggccauugaaaagagcggggaccuaaauaaaaucgcacuggaguggguagcuauuaugcacggccucggagcccuucuggaagugugguuaacguuccagcaaaaguggaucuuuuugaacaagguccugcacgagaugaaaauacaguuccccaacgccgaucucaauucuagauuuaaggugauggacgaucaguaccgcacccugaugaggaucuccguugcugacccaauggugcuuucacuggucgugccgagugcagaacguagcccuuauuuccaaggccagcagcuccagcaauugcugcaggccggguccguugaguuagaaggaauuaucaugucucuagagucggugcuguacggugucugcgcgcauuuucccagacucuucuuucuuagcgauucagagcugguagcuuugcuggccgcaagacucgaauccugugaggcccagcugugggugaggcgcugcuucccacacguucaugcugugaguuuucgaucuugucccacuggcgagaaaaacacagacgauugggagagcuccccuaauacccagacacaagucgaagcacuugccgugcucggggcgggaggcgaggagguaaagcugcaggguccauugccccugcacccugacuuaccgaaauggcuagcuucacuggaaaagugccucagacuugcccuggugcacauguugcaggggugugucgcagcccggcuggcuaggggcccaucucucggagaggcccugaagcagcuucccaaacaaaacaaguuauaucugcagcucuacguucagcauuggauugauuuggugcaagcauucccuuggcagugcgugcuggucgcugaagaggugguuuggcgcgccgagauggaagaggcgcuacuggaauggggcacucucgccaugguaagcaugcacaugcguaaacuugaggugcuggucaauuuuaugagagcacagcgggcuagucaagggggacaauccuugcccagcgugaggcagaccucucugcucucagcccuguuaguuauggcugugacgcaucgcgacaucgcacagcuucuggaacagcaccaagucuccgaccucaccgauuuccauugggugcgacagcuaaaguaucaccugggcaguccacacauaauuccuaaaagccccuugcagucgcugaagacaaucgccucuuccgagccaagccucagcccugcagcuugcuggaucgacguacuugguagaaguuuccuguacaacuacgaguauuuggggccgcggcugggaccccucccaucuuuacugccugaaaggcccgcgcuuguccugcuacucgcacuggaggaaguggccuguggcacuguuuuggguccaaauggcguggggaagcgcgcuauugucaacucccuggcccaggcacucggaagacaacuugugaugcugccuugcagcccccagaucgaggcccaguguuuaucaaauuaccugaacggcgcuuugcaagggggagcguggcuccugcuagaaaaaguucaucagcuuccgccaggccugcucagugcccugggucagagguugggggagcugcaccaucucuaugcaccucuuuaccaggaggcuagccggaauaccuccacaauugaucccacucaaccacagcuguuaggaucuagcuuuuucgaaaagcaccacguguccguccgucugggcuaugguugcuugcucgugcugcgcgcccuaucaucugcaguacccgccaaccuucaucugcuccugcgaccuguggcuuuggccuuaccggaccugagacagguugcggagcucacccuucugggcgcagggaugagggaugccuuucagauggcuacgcggcuaaguaaauucuuuucgcuggaacgcgagcucgucagcggacccuugccauguagacugccucuucugaagcaaauacucgaagacacaaucaggaccuuaaaugugacuaaagaggagcccaagugccagaagccucggucccuggccgcuauugaagaggcagccuugcugcgaucuccacucuucucaauccuuaacggccugcaccuacauaaucugagagggcucuugugugcucuguuucccagcgccucccaggugcuugcagaaccuaugacauacaaacugaugaagccauuagucguagaggagcuccagcaagugggacuggaucccaguccggacauuuugggcucucuggaacagcucagccaggcgcuuucacgcgccuccgguauccugcuacuggggccugcuggaaguggcaaaaccacuugcuggcacagccucuucaagauacagaacagguuggccgcaauggaggauaccucuacacaagguugucagccaguugaaaucacgcaucuguaucccuccggcuuaucaccucaggaguuucuuggguggcuggaaggaagcugcuggcaccacggcauuuucccaaaagugcuccgggcugccgggcaauguaacaauaugggacagaagcgucagaccgaggagucgaucggcauucagcauuggaucauaugcgacggugcaucuaacggggccuggcuggauaguauuacuugcuugcuguccgaacucccccaacuuagccugccgucaggacagcagaucgcuagaccucccggcacauuucuacugauggaggucgcggacaccacaggcaucuccccaacugugguuggguguugcgccuuagugugguguggaggugaacagaccuggcaaugcauucucucugcacugauggcuagcuugccuuacgaguacaggcuucagcaccgcacggucgccgaacugaaucauauggccgaggugcucguacccgcaacacugcgguucuugaccugucagggcgugaguucccugcuacagguucacgggcaacaggcugucugcgccggaguggcggaggugacuagcauggcucgaauacuccauucucuucuggacuuacaccugagacucaaagaagagaaggccccaggccccgaagaucugucauauagugacccugucgcacaguccuuuaggagcucuaagucgucauucuugaaccgcagccaaguugauuccgacgaugugccagacaaaugucgggagcaccuucuggccguaaguucuuuccucuuugcucugaucugggguuucggggcacaucuaccgagcagauuuuggcccauuuucgauaccuuuauccgugacuccauuucaagguugaguaauuacccugaaccacccccuucugcccugguguucgaucuccacgucagcccagaggacggaacacuugugcccuuuacuggccaguaucuguccucacauaucaagggcaccuuagggacauuccacccuagcauacagacggagcggcugcucuacguuguggaucuguugcuuucuggaggucagccgguccugcucgcgggcgaagcugccaccgggaaauccgcauuuguagaggugcugguugaaccacaccaucccuauaucuacaguccuauucaccccgccuucagcucgucccaucuacgcuuacuguugucucgaggaauccaaggccagacucaggcuucaccacagccuggucaccaucaagacagcaagcccagucuccuguuucuucuggaggaucuccaccuggccacauccgacccagagaaaucuugccagccgguguuggaaacccuuagacaggcaauggacgggacugucuaugcucacagcacacuggagcuacagacccuccaaccuacggugaacuuccuggccacugucaccgugcccggauacugugaaaggccauuaugcccccggcuguuucgcuuguucacaguucucgcgcuggagucaaugacccaggccacucuucuggaaagacaugugccuauuauccaggcauggcucgagagguucccauccguagagcgagaacgggcuuuggcccguggccuggugagagcaagugucgaggcuugggaagccguuuguaauugcuuuaugcccagcccucuucacccgcauuaccacuucucucugcacucagugucccauuuacuaagcucucuccagcugcugccaaaccgcacaggcaguaggggguuugucgauuaucccaaucaccaagagcauuugcggagagugucgggacuccgcgguaccugccugacaguaaugauggccacuaggaacgugguucgacuuuggcugcacgaagcgcagcggaccuucugugacagauuagauuccccuagggagcgcagcuacugcgcuaagcuccuguugguggucgcacagucaguguuuuguugcggcccagggccccaacaucuuggaaaggaccaccaggagucugaagaggaagaggaagaggagcgugucccugaaguggagagcgaaggcgagcuggcccagugggaggauuucuccaauaguaacucagaaacggaggaagaggaagaaccauauggucuacagguugcucggguaucuaauagcagagacccaucccucacaccgaguauagggccugugagcaggggaaugaaagaguccauuucucacaagauccgccaagaaaaaggcacccgagccucaaacuaccggcugcaggucagaaggagcuuuaagacuugguggcagaaaaagccccagauggaucugaucucgccauugcuccugccugugcuucuguuacauccccaagagaagccauccgaccucguuuucagucaggaacugauucuaggcccuaauucugagacccccaacuuguaucuggaacgccagugggagaaacuugaggaacagcucgcaacaagcgccgcucaacugaagcugucaccgcacuuggcgagaugucauuccauggcccagcacguggcacggcuugucagggugcucgcucguccacgacagcaugggcuguuacugucuggagcccuagguacuggccgccacaccgcaaucacgcucgccaguagcauaugccaagcucacuuuuuccaucugccuuccgggucagaggaagccauuuugcagugucugagagaugcgagcuggcacgcaggaaugcuuucucagcccguagcccuccuggugccaaguggcguugacuuaacaacccugcaucgguugcucgcucuggccacuuccgguagcuuucccgggcaguacacagaggcagaucuugacaggaucggagaacaucugccucgcgagaaccuaggcgucaaacaaaauauuaagaaagagauggugcuccagagauuccaccaacaggugugcucacaucugcacuuguuuuuccugaucggcgauaagcaagcucauaagcagcuuccgucuacccucuuccugcgguuacugcaguuggccacugcuuccauagacagguaugaaccaugggaccaggccgcacucgcgaaagucgcccaacaccaucuggagggggcucagucgguuccccuugaugacggaagcuggaaguacccugaucugcaggccaguauucccucuguggcaaaagcuauggcccuaauccaccucuccgcaacacacuaccaugaacaccuguguccagccuugccucugguaacccccaagacguuucuugacuucuuagauacuuuucugaugcuccaacagcagaccauccugaaaauuaagaacaaggcgcagcgagugcaaaaugcucuagagaacuugcguaugcugaucaaagagcaugguacacacgccaaucucauuuucgaccuugaacagcagcugaaggauagcggcaaaucacucaguauguuucagcaacagcuggagcaguccaaguuauuguauaaacagcaacuggaagagugcagacaccaggaaaaccuuauagagaaucuggcacgccagcgggacgcccuccaggcucaaagggaggccuuccuggaacagaugagcaaggcauuucuagagccacuuucucagcugcaagucgcugauuucgaagagaucagaucauaccgcgccccuccggaaagcgugguucgggugaccgacgcgaugugugaucucuuucaucacgagacagggugggcuuccgccaaacaguugcugugcacugaggacuucuaucaggaauuagucuuuuuccccaaggagaagauuaccgacucugaacugaucaaacuccaucuuauccugaaggcaccaggaauggaugacgccgcuuugagggcagugagucgaccugccgcgucgcuggccgcuuggcucugggcaguacuacacuacggccuggcccauugcagaggucuucccacggaucugcucuugcagcaaguugaggcuacacugacucgggaacaggccagguuaggguauuaccaguuucaggcacaagagacccuggagcacaaccucgcucuugccaaaaugguggaagacgcgcaggccagccacaauugugucgcaaagacacugucccaggcucagugcggccaauaucauaaauggccaaugaaggccgcauugcugaccccuaugcgcgccuggacuacccagcuccagaagcuaaaaggacguuguaugacaguguucggcgauacgcuguuaugcucagcugccauuauauaccuggggcccuucccgccacucagacgacaagagcuuuuggacgaauggcuggcgcuguguaggggauuucaggaggcucucgguccugaugacguggcacaggcccuuaagcggaaacagaagucugucagcauaccucccaaaaacccccuguuggcuacucacagucccuucuccauucugucacuccuaucuagcgaguccgaacaauaccagugggauggcaaucugaagccccaggccaagagugcacauuuagccgggcuucugcuccgcagcccaacccacuauucuucaugcagauggccuuugcugcuggacccguccaacgaggcucucaucuggcuugauccccugccauuggaagagaauaggagcuuugcgccugcccuaacagaaggacggggcaaaggucugaugcgcaaccagaagagagagaguaaaaccgacaugaaggaggaagaugacgagucugaagaguccaaugaagcagaggaccaaacuaaagagcagaaggccgaggagcgaaagaacgaacaggagaaagaacaggaggagaaugaagagaaggaagaggagaaaacagaaucgcaagggagcaagcccgcuuacgagacccagcucccaucauuaccuuaucuguccguucuuucuggcgcagaucccgaacugggaagucagcuccaggaggccgcugccuguggcuugccggugcugcugacgaacguagaacucgggcuaggaugcgaggagcugcaauggcuuuugcagagggaacagcugagcccuccacaagugcagcccgguuucugucucuacuuaucaacuacacugucccuuugcgcgauggagaaaguccugggcugugaacucuugaaggggcugaacgugcuagaccugggacucaauauggagauuuuagaggagcagaugcugcacgagauccuuugccgggaauauccugagcuggaaacccguuggcaggauuugaaaauacgcgcacucgacaccuguaaggccguugaggcugccgaagagagacugcuuacuaugcugcucuuucaaaacccaaagaggcagaaacccgcaaaguucuugcggaauaucgugagagcucagggcaaacugugccaguuacgcgcccauugcgaggaacuggagggucaaaagcuccaggaaaugguccuaugggcgccuuaccgaccagugguauggcacgggauggccaugguuaaagcucugagccagcuucagaacuugcugccccucuuuuguaugucuccggagaauuggcuggcagugacaaagcaagcccuugauaguaugaagccuagggagauuaaccauggcgaagaccuggcuucccaccucuugcagcugcgggcacauuuaaccagacagcuacugggaagcacagucacugcccucggccugacgcaagugccccuuguuggggcuuugggagcccuggcacuccugcaggccaccggcaaagcgucagaguuagaacgucuggcucuuuggccaggucucgccgcaucucccucgacagugcacagcaagccugucuccgauguggcccgcccagcuuggcuggggcccaaagccuggcacgagugcgaaauguuggagcuacugccuccauucguaggacucugugcaagucuggcuggccauucuucagccuggcaggcguaucuuagcuuguccaguacugugcuggguccggcacccggcccugggccagagccccucucucuguuacagaagcugauccuuuggaggguccuccggccugaaugccuagccggagcucuggccgacuuuaccaccagcuugcugggcagaccacucgaugagaauaccuacgcucccacuaugccguucaaacacucccaagcaacgcagccuaugcugauucuuuugccacccccugggcaucccucagccacccugcacccacucacaguuauccagaaguuagcggccaaguaccagcaaggacagaaacagcuacaggugauagcucuaggcagcgaagcaugggacccggucucugugguaguguccacucugagucaagccauguaugagggucauuggcuuguucucgauaacugucaccugaugccucacuggcccaaggaauugcugcagcuccugcuugaguuacuggggcgagcuaaaguggucgccgacuuggagucagaacagcuccuggaccagccagagagcaggaaugugucgaccguucaucgcgauuuucggcuauggcugauuguccccgcagaauccucugccagucuuccugcugugcucacacaacacagcaugccaguguucuggaaccagucacuggaguugggacauguacugaucgacuccgucgaacucgcgcagcaaguguuauacaugcagcccccuacccaggcccugccacuucuguugcuccacggccugcuacugcacagacagcuuuaugguacuaggcuccaagcacaucgcggccguuggucucagguuacacugacacagguguugcagacccaagaucagcugugggcuagcuuaaguaauccgcgggccgcaaugcaggagcucgccgcuuccgucuuuuacgggggaccccugggcgacacugaggauagagaagcgcuuauuagccugacacaggccugccuaucuccuucauccgggagcugggugcaaccacacacaccccagagucucuuggcaacccugaugccucugccagagcuucgagaacucgacgcuauggccgaguguaaggcccagaugcaucuguuacccucuccuccggagcccagguugugcggacugucagaaggcccacaggcuuggcuccugcgccggcaguccagagcacuucuaagcgcccugcagaggucgucuccuguuugggugcccgagagucgcagaggugcucagcucgcggaacggcgauugaggcaacgucugguacaggucaacagacgguuagagucccugcaggaucuucucacacacgugauccgccaggacgaaagcgaugccccauggucagugcuggggccuaaugcaaggcgacccuuggagggaguucuggagacugaagcccucgagcugucucaacuugucggcacgcuacagagagaccuggauugucucuugcagcagcugaaaggcgcuccaccgugcccuagccggcgcugugcagccguggcucaugccuuauggaccgggaggcugccccuuccauggagaccccacgccccugcgggaccacaacccccuuggcacuggcuccggcagcugucccgucgcggucaguugcugguaagguaucucggcgugggggccgacgcuaguucagaugucccggaacgaguguuccaucuaagcgccuucagacacccccggaggcugcuucuggcauuacgcggagaggcugcccucgaccaaaacguuccauccucuaauuuuccuggcaguagagguagcguguccucacagcugcaguacaagcgguuggaaaugaacucuaacccccugcauuucagggucgagaaugggccaaacccuacagugcccgagcgcggacuucuccugauaggcuugcagguucugcacgcggaaugggacccaaucgccggcgcucuacaagauucgccgagcucccagccuaguccccucccaccugugucuauuagcacucaggcacccgggaccucagaccugccagccccugcugaucuuacaguauauuccugccccgucuacaugggagguccguuaggcaccgcaaagcugcagagccgaaauaucgugaugcaccucccacugcccacuaaauugacgccuaacacaugcguucaaagacgugugcaugucuguucuccaccccugaguuga

SEQ ID NO: 55414 - RNA, 537 nt, Artificial Sequence
  derived and/or modified sequence opt3 from DNLZ__Homo_sapiens__NP_001074318
augcugagaaccgcccucaggggcgcuccccggcuucugagccgcgugcagccucgagcaccaugcuugcguagauuaugggggaggggagcccggccggaggucgcgggucgcagaagggcuugggccuggggcuggcggcgcuccucuucagaacaagggcccggaccugcagccgcucugggccgaguugaggcagcccacuaccagcuaguguauacauguaagguaugcgguacuagaaguagcaaaaggaucuccaagcucgcuuaccaucaggggguggucauugugacguguccaggaugccagaaccaccauauaaucgccgacaaucugggcugguucucugaucuuaacggcaaacggaauauugaagagauccugaccgcgcguggggaacaaguucaccgcguggcaggagagggugccuuggagcucguccuggaagcugccggcgcacccacaucgacugcugccccugaggcgggggaagacgagggaccacccucaccuggcaagaccgagccaagcuga

SEQ ID NO: 55415 - RNA, 2556 nt, Artificial Sequence
  derived and/or modified sequence opt3 from DNM1__Homo_sapiens__NP_001005336
augggcaacagagggauggaggaccugaucccccucgugaauaggcuucaggaugccuucagcgcuauuggacaaaacgcagaccuggauuugccucagauagccgucguugguggccaguccgcggggaagucuucaguguuagaaaauuuuguaggacgggacuuccugccacgcggcagugguaucgugacccgacguccgcuaguccuccagcuggugaacgcuacaacugaguacgccgaauuucuucacugcaaagggaagaaauucacggauuuugaggaaguuagacuggagauugaggcagaaaccgacagggugacaggaacuaauaagggcaucagccccgucccuauuaacuugcggguguauuccccacauguacucaaucugacccugguugaucuccccggcaugacaaaagugccugucggggaccaaccacccgauaucgaguuccagauacgcgacauguuaaugcaguuugugaccaaggaaaacugucugauccuugccgugucuccugcuaauucggauuuggcaaacucagacgcccugaaggucgcuaaagagguugauccacagggacaaagaacuauuggugugaucacaaagcuagaccucauggacgagggcaccgaugccagggacguacuggaaaauaaacuucugccguugcggcgcggguacauuggaguggucaaccgaagccagaaggauaucgacggcaaaaaggauauaacggcggcacucgccgcugagagaaaguucuuucugagucaccccuccuauaggcauuuagccgaccggauggguacuccuuaccugcagaaagugcucaaucagcaacuuaccaaccacauucgugauacacugccaggguugcgcaauaagcuacagucucagcugcucagcaucgaaaaagagguugaagaguauaagaacuucagacccgacgauccugcaaggaaaacuaaggcucugcuucaaauggugcagcaguuugccgucgacuucgagaaacggauugaaggauccggcgaucagaucgacaccuacgagcugucaggcggggcgcgaaucaaccgcauuuuucaugaaagauucccauucgaguuggugaagauggaauuugacgagaaggagcucaggcgggaaauaaguuaugccaucaaaaauauucacggaauccgcacaggucuguucacccccgauauggcauuugagacgauaguaaagaaacaaguuaagaaaauuagagaaccgugcuuaaaguguguggacauggucaucagcgagcugaucucuacugugaggcagugcacaaagaaacuacagcaguacccucgucuccgggaagagauggagcgaauugucaccacucacaucagagaaagggagggccgcacaaaggaacaagugaugcugcuuauugauauagaguuggcuuacaugaacaccaaucaugaggacuucaucggguuugccaacgcucagcagcgguccaaucagaugaacaaaaagaaaacgucaggaaaucaagaugaaauucugguuaucagaaagggcuggcucaccaucaacaauauugguauaaugaaagggggcagcaaagaguauugguucgugcugacagccgaaaaccuuaguugguacaaggacgaugaggaaaaagagaagaaauauaugcugucuguagacaauuugaagcucagggaugucgagaagggauuuauguccagcaaacacaucuucgcacuguuuaacacugaacagcgcaauguguacaaggacuaucgacaguuagagcuggccugugaaacccaggaggaaguugauucguggaaggcuucuuuccuacgggcgggcguguaccccgagcgugucggggacaaggagaaagcauccgaaacagaggaaaacggaucagauaguuuuaugcauagcauggacccacaacucgagagacagguggaaacuauuaggaaucugguagacuccuauauggccaucgugaacaagaccguucgcgaucuuaugccuaaaacaauuaugcacuugaugaucaacaauaccaaggaguucauauuuucugagcugcucgcuaaccuguacagcugcggugaccagaauacuuuaauggaagagucagccgaacaagcacagcggagagaugagaugcugaggauguaccacgcccuuaaggaggcuuugaguaucauuggcgacaucaacacgacaaccgucuccacucccaugccacccccuguggaugacagcuggcuccaggugcagucugucccagccgggcgacgcucaccgaccaguagccccacaccucaacggagagcaccagcgguucccccugcuaggccaggaucccguggccccgccccggguccuccacccgcagggucugcccugggcggagcuccucccgugccaucgcgcccuggcgccagccccgauccauucgggccgccuccccaggugccaucccggcccaauagagcaccuccaggaguacccaggauuaccaucucagacccuuga

SEQ ID NO: 55416 - RNA, 2178 nt, Artificial Sequence
  derived and/or modified sequence opt3 from DNM1L__Homo_sapiens__NP_001265392
auggaggcccugauccccgugauuaacaagcuccaggacgucuucaauaccguuggcgcugauauaauccaacuuccucagauugugguaguggggacacagagcuccggaaaaucuucaguccuggaaaguuugguggguagagacuuacugccaaggggcacugggaucguuacgcggcgcccgcuaauucuccagcuggugcacgucagccaagaggauaagcgaaaaaccacaggagaagagaacggcguggaagcagaggagugggguaaguuucuucauacuaaaaauaagcuguacaccgacuucgaugaaauccgucaggagauagaaaacgagacagagagaaucuccgggaauaacaagggaguaucucccgaaccuauucacuugaaaaucuuuucgccaaauguugugaaccucacccuggucgaccugcccggcaugacuaaggugccugugggcgaucagccaaaagacauugagcuccagaucagggaauuaauacugcgguucauuucaaaucccaacagcaucauucuugccgucacagcggcuaauaccgauauggccacgagugaggcauugaagaucucccgcgaaguugacccugaugggagaaggacucuggccgugaucaccaaacuagaccucauggaugcuggaacagacgcaauggacguacugaugggucgggugauuccagucaaacuuggcauaaucggggugguuaaccgcucucaacuggauauuaauaacaagaaaagcgugacugacuccauccgagaugaguaugccuuuuugcagaagaaauacccgucacucgcuaauagaaacggaaccaaguaucuggccaggacauuaaaccggcugcucaugcaucacauacgugacugccuucccgagcugaaaacccgcauuaaugucuuggcggcacaguaccagagucuacugaacagcuauggcgaaccuguggaugacaagucugccacgcuccugcaacuuaucacuaaauucgcuacagaguacuguaauaccaucgaagguacugccaaguauauugagacauccgaacugugcgggggagcaagaaucuguuacauuuuucaugagaccuucggcaggacguuggagucaguagauccacucggcgggcugaacaccauagacaucuuaacagcuauucggaaugccacuggaccccgaccugcgcuguuuguuccagaagugagcuucgagcuacucgucaagcgccagaucaaaagacuggaggaacccagucuuaggugcguggaauugguccacgaggagaugcagcggaucauucaacacuguucuaacuacuccacccaggaacugcuccgcuuuccgaagcugcaugaugccauaguggagguugugacaugccuucugagaaaaagguugccuguaacuaaugaaaugguccacaaccucguggcaaucgagcuggcuuauauuaauaccaagcaucccgacuucgccgaugcuugugguuuaaugaacaauaacaucgaggaacagcgucggaaucgacuggccagagagcuaccaagcgcaguuucgagggacaaaucuuccaaggugccuucagcccucgcucccgcgagucaggaaccaagccccgcagccuccgcugaggccgacggcaaggucgcaucugggggaggcggugugggggauggcguacaagaaccuacaaccggaaacuggcgcggcaugcugaaaacuagcaaggccgaggagcuuuuggcugaagagaaaucaaagccaauuccgaucaugcccgccaguccucagaaagggcacgcagugaaucugcucgacguuccaguccccguggcgcggaagcuguccgcuagagaacagagggauugcgaggugauagaacgcuuaaucaagagcuacuuucugauuguccgaaagaacauccaggacucuguuccuaaggccgugaugcacuuccuugugaaccauguaaaagauacguugcaaucagagcucgucggacagcuguauaagaguagccuacuggacgaucuccugacagaguccgaagacauggcacagcggcguaaagaggccgcugauaugcuuaaggccuugcagggugcaucucaaauuaucgcugaaauaagagagacccaccugugguga

SEQ ID NO: 55417 - RNA, 2613 nt, Artificial Sequence
  derived and/or modified sequence opt3 from DNM2__Homo_sapiens__NP_001005360
augggcaacagagggauggaggaacugaucccccucgugaauaagcugcaggacgccuucagcuccauuggacaaucuugccaccuggauuugccucagauagcugucguugguggccagucagcagggaaaaguagcguguuagagaacuuuguaggaagggacuuccugccacggggcuccgguaucgugacccgccgaccgcuaauucuccagcugaucuuuucuaagacagaacaugccgaguuccuucacuguaaaucgaagaaauuuacugauuucgacgaaguccgucaagagauugaggcggaaacggauagagugaccgggacaaauaagggaaucucacccguuccuauaaaccugaggguguacagcccacaugucuugaaucucacucugaucgaccugcccggcauuaccaaggugccuguaggcgaucagccacccgacaucgaguaucagauuaaagauaugauccuccaguuuauaagucgggaauccucuuuaauucuggcuguuacacccgccaacauggaccuugcaaauagcgaugccuugaagcuggcuaaagagguggacccacaagggcuacgcaccaucggagucauuacuaagcucgaucugauggacgaggguacagacgcaagagaugugcuugaaaacaaacuguugccgcucaggcggggcuacaucgggguggucaaucgcucccagaaggacaucgagggaaagaaagauauucgagccgcucuggccgcggaaagaaaguucuuuuuaucacaccccgcauauaggcauauggccgaccggaugggcaccccucaccuucagaaaacgcucaaccagcaacuuacuaaucacauacgugagagucugccagcuuugcgcagcaagcuacagucucagcugcucucccuggaaaaagagguugaggaauacaagaacuucagacccgaugacccuaccaggaaaacaaaggcccuucugcaaauggugcagcaguuugguguagauuucgagaagcggaucgaagggucaggagaccagguggauacuuuggagcucagcggcggcgcacgaauuaaucgcaucuuucaugaaagauucccauucgagcuggucaaaauggaguuugacgaaaaggauuuaaggcgggagauaaguuaugcuauuaaaaacauccacggggugcgcaccggacuguucacacccgaccuagccuuugaagcgaucguuaagaaacaaguggucaagcucaaggagccgugccugaaauguguggaccuuguaauucaggaauugaucaauaccguuagacagugcacgucuaagcuguccagcuacccuaggcuccgugaggagacugaacggauugugacaaccuauauacgagagagagaagguaggacuaaagaucagauccugcuucugauugacaucgagcaaucguacaucaacacaaaccaugaggauuucauuggcuuugccaaugcacagcagcgcucuacccaguugaacaagaaacgggcuauacccaaucaaggggaaauccucgucauuagaaggggauggcugacgaucaacaauauuuccuuaaugaagggcgguucaaaggaguacugguucgugcugaccgccgaaagucuaagcugguauaaagacgaggaagagaaggagaaaaaguacaugcucccacuggauaaccuuaaaauccgcgacgucgaaaagggguuuauguccaauaagcacguguucgcuauauuuaacacagagcagcgaaauguuuauaaagauuugcggcagaucgaacuggccugugacucucaggaggauguggacagcuggaaggcaucauuccuccgugccggcguauacccugaaaaagaucaagcugagaacgaggacggagcgcaggaaaauacuuuuaguauggauccccagcuggagagacaagucgaaaccauuaggaacuuaguggacuccuauguugcaaucauuaauaagagcauccgcgaccugaugccaaaaacaauaaugcaccuuaugauuaacaauacuaaggccuucauccaucacgaguugcucgcuuaccuguauucuucagccgaucagaguagccuaauggaagaguccgcagaccaggcccagcggagagaugacaugcugaggauguaccaugcucucaaagaggcccugaacauuaucggcgauauaucuaccucgacagugagcacccccgucccuccaccgguggacgauacuuggcuucaauccgcaucaagucacucucccacgccucagcgacgcccaguaagcuccauccaucccccugggcggccacccgcggugagaggaccgacaccugguccacccuugauuccuguucccgucggcgcugccgcaucauuuagcgccccaccuauccccucuaggccagggccgcaguccguguucgcuaacagugaccuguucccugccccuccacagauucccagccguccugugcgcaucccacccggaauaccuccgggcgucccaucucggagacccccugcagcuccauccaggcccaccauuauccgaccugccgaaccgucauuacucgauuga

SEQ ID NO: 55418 - RNA, 2580 nt, Artificial Sequence
  derived and/or modified sequence opt3 from DNM3__Homo_sapiens__NP_001129599
augggcaacagagagauggaggaacugaucccccucgugaauaggcuucaggacgccuucagcgcucuggggcaauccugcuuguuagaacugccucagauugcagucguuggaggucagucugccggcaagucaagugugcuagagaacuuuguagggcgggauuuccucccacgcggaagcggcauagugacccgacguccgcugguccuucagcuggugacauccaaagcggaauacgcugaguuuuugcacuguaaggguaaaaaguucacugacuuugaugagguuagacucgaaaucgaggccgaaacggacagggugaccgggaugaauaaaggaauuucuucgauccccauuaaccugcgggucuauucaccucaugugcugaaucucacauuaaucgaucugccaggcauaacuaagguacccguuggcgaccaaccuccagauaucgaguaccagauucgcgagaugaucaugcaguucauuaccagagaaaacugccuuaucuuggcagugacacccgccaauaccgaccuggcuaacagcgaugcacuaaagcucgccaaagaggucgacccucaggggcugaggacuauaggagugauuacaaaacuugaucugauggacgaagguaccgaugcucgggacguguuggagaauaaacuccugccauuacgccgaggcuaugucgggguugugaacagaagucaaaaggacaucgauggaaagaaggacauuaaggccgcgaugcuggcagaaaggaaauuuuuccucucccacccggccuaccggcauaucgcugaucguaugggcacgccccaccuucagaagguacugaaucagcaguugacuaaccauauccgcgacacccuaccuaauuuuagaaacaaacugcaaggucagcuccugucuauugagcacgagguggaagccuauaagaauuucaaaccagaggaucccacaaggaagacuaaagcacuucugcagaugguccaacaguuugcuguggacuucgaaaagcggauagaggggagcggagaucagguugacaccuuggaacucuccggcggcgccaagaucaaccgaauuuuucacgagcgcuucccuuucgagaucgugaaaauggaauuuaacgagaaggaacugagaagggagauaucauacgcgauuaaaaauauccaugggauccggacaggauuauucaccccagauauggccuuugaagcaauugucaagaaacagaucgugaagcugaagggucccagucuaaaaagcguagaccucguuauucaagagcugauaaacacggugaagaaauguacuaagaaacuugcuaauuucccgcgcuugugcgaggaaacagagagaaucgucgccaaccacauuagggaacgugagggcaagaccaaggaucaggugcugcuccugaucgacauccaggucucuuauauuaauacuaaccaugaggacuuuauaggguucgcuaaugcccagcaacgguccucacaggugcacaaaaagacaaccguuggaaaccaggugauccgaaaaggcuggcuuacgauuagcaauaucgguauuaugaaagggggcaguaagggauacugguuuguacugaccgcagaaucuuuguccugguacaaggaugacgaggaaaaggagaaaaaguauaugcucccucuggauaacuuaaaagucagagacguggaaaagagcuucaugucgucuaaacacaucuuugcccuguucaauacagagcagaggaacguuuacaaggauuaucgcuuucuagagcucgcuugugacucccaagaagauguggacucauggaaagcgagucugcuucgggcaggcgucuaccccgauaagagcguggccgagaaugacgaaaacgggcaggcugagaauuucuccauggauccacaguuggaaagacagguagagacuauaaggaaccugguggacucuuauaugagcaucauuaacaagugcauccgcgaucucauuccuaaaaccaucaugcaucugaugauaaauaacguuaaggacuuuauuaauucagaguuacuggcccaacuuuacaguuccgaagaccagaacacauugauggaggaaagcgcagagcaggcccaacgacgggaugaaaugcuccguauguaucaggcucugaaagaggcccuaggaaucauuggugacaucucuacugcaaccgucucaacacccgcgccacccccuguggaugacaguuggauacagcacagcagaagguccccaccgcccucuccuaccacucagcgccggccaacgcugucggcuccccucgccagaccuacaagcggcagggggccagcacccgccaucccguccccuggaccacauucaggcgcucccccugugcccuuccgaccagguccucugcccccauucccgaguucuagcgauuccuuuggggccccuccccaagucccaucacgccccacccgggcaccuccaagcguucccucuagaaggccuccgccaucccccacucguccuaccauuauccgcccacuugagaguagcuugcuggacuga

SEQ ID NO: 55419 - RNA, 4734 nt, Artificial Sequence
  derived and/or modified sequence opt3 from DNMBP__Homo_sapiens__NP_056036
auggaggccggcagcguggucagagcuaucuucgacuuuugccccuccguuucugaagaacugccucucuucgugggggauauuauagaaguacuugcaguggucgacgaguuuuggcuguugggaaagaaagaagaugugaccggucaguucccaucaaguuuuguugagaucgugacaauuccgagcuuaaaggagggcgaaaggcuguucgucuguaucugcgaguuuacuucccaagaacuagacaaccucccccugcaccggggcgaucuugugauucuggacggaaucccuacggccggcugguugcagggucgcucuuguuggggcgcgcgaggauucuuuccaucgucaugcguacgugagcucugucugagcagucaguccagacaguggcauucucaaagcgcucuguuccagauacccgaguacuccaugggccaggccagggcacucaugggcuuaucagcccagcuggaugaggagcuugacuuucgggaaggggauguuaucaccauuaucggagugccugagccagguugguucgaaggcgaguuggaggggcgcagaggaauuuuucccgaaggcuucgucgagcugcuagguccucucaggacaguggacgaaagugugagcucugggaaucaagaugacugcaucgucaacggagagguugauacuccagugggcgaagaggagauaggcccggacgaagacgaggaggaacccgggaccuauggaguagcucuguaccgguuccaggcacuugaaccuaaugagcuggauuuugaggugggugacaaaauucgcaucuuggccacacucgaagauggcuggcuggagggguccuuaaagggacgaaccggcauuuucccauauagauuugucaaacugugucccgacacuaggguggaagagacaauggcucucccucaggaggguucacuugcccggaucccagaaaccagccuggauugcuuggagaacacgcuagggguugaggaacagcgucacgaaacuuccgaccaugaggcggaggaacccgauuguaucauuucugaggcaccgaccuccccucugggccaccucacaagcgaauacgacacugaucgcaauucguaucaagacgaggauaccgccggagggcccccaagaucuccugggguggaaugggagaugccccuggcuacagacuccccaaccucagaccccacggaggucgugaacggaauaaguagccagccucagguaccauuccauccgaaucuucaaaagucccaguacuauucuacuguugguggcagccacccccacucagaacaguacccugaucuguugccacucgaggccaggacacgggacuacgcaagucugcccccuaagcgaauguauucccaguuaaaaacccugcaaaagccagugcuaccccucuaccgcgggagcucugucucagcuaguagaguggucaaaccgaggcagagcuccccucagcugcauaaccuugccucuuauacuaagaaacaccauacaucgagcguguacuccaucucagaacgguuggagaugaagccaggaccccaggcgcaaggccugguuauggaagccgcaacccacagucagggugaugggucuacggaccucgauagcaagcugacccagcagcuuauugaguuugagaaaucccuggcuggcccuggaacagaacccgacaagaucuugcgccacuucucaauaauggauuuuaauagcgagaaagacauugugagagggucuuccaagcucaucacugaacaagagcugccagagaggcguaaagccuuacggccucccccaccgcgaccuugcacccccguaaguacaagcccacaucugcuagucgaucagaaccucaagcccgcuccuccacuggugguuagacccucuaggccugccccgcuuccacccuccgcacagcagcgcacuaaugccgugucaccuaaauugcugagucggcacagaccaaccugugaaacacucgagaaggaagggcccggacauauggguaggagccuggaccaaaccucgccuugcccguuaguccuggugcgcaucgaggaaauggagcgagaucuugacauguauucccgggcucaggaggaauugaaccucaugcuggaggaaaagcaggaugagucuagccgugcggaaacucuagaggaccugaaauucugcgagucaaauauugaaagucucaacauggagcugcaacagcuuagagaaaugacguugcuguccucucagagcuccucauuaguagcacccagcggcagugugucugccgagaauccagaacagaggaugcucgagaagcgcgcuaaaguuaucgaggaacugcuucaaacagagcgggacuacauuagagaucuggaaauguguauagagaggaucauggucccuaugcagcaggcccaggugcccaacauugacuuugagggguuguucggaaacaugcaaauggugaucaaggucuccaaacagcuccuggcagcccuagaaaucagcgaugcuguuggcccaguguuucugggucaccgagacgagcucgaagggaccuauaagauuuacugccagaaucaugaugaggccauagcacugcuugaaaucuacgagaaggacgagaaaauucagaagcacuugcaagauucgcuggcggacuuaaaaucacucuauaacgaauggggcuguacuaauuacaucaaccugggaucuuuccuuauuaagccugugcagcgcguaaugcgguauccccugcuacucauggagcuguugaauaguaccccagaaucccacccggauaaagucccucugacaaacgcuguguuagccguuaaggagaucaaugugaacauaaaugaauacaagagaaggaaagaccucguccugaaguaucguaaaggcgaugaggacagccuuauggagaagaucucuaaacugaacauucauagcaucauuaagaaguccaaucgcgugucaagucacuugaaacaucucaccggguuugcaccccagaucaaggaugaaguuuucgaggaaacugagaaaaacuuccggaugcaagaaagacugauaaagagcuuuauuagggaccuaucucuguaccuucagcacauccgagaguccgccugcgugaaaguagucgcugccgugucaaugugggacguguguauggagcggggacaccgcgaucucgaacaguucgagagaguccauagguauauuagugaccagcuguuuacaaauuucaaggaacggacggagcgauugguuaucagcccacugaaccaauuacucuccauguuuaccggcccccacaaacuggugcagaagagauucgauaaacuucuggacuuuuacaauugcacugagcgcgcagaaaaguugaaggauaaaaagacacucgaggaacugcagucugcuaggaacaacuacgaggcccuaaaugcgcagcugcuugacgaacucccuaaauuccaucaauaugcccagggucuguuuaccaacuguguacacggguacgcugaggcacauugcgauuucgugcaccaggccuuggagcaguuaaagccacugcucucgcugcuuaaggucgcuggacgugaaggcaaucugauagccaucuuucacgaggaacauagccggguguugcaacagcuacagguuuucacauuuuuccccgagucacugccugcaacuaaaaagccguucgaaagaaaaaccauugacaggcaguccgcgcgcaagccacuccugggucuucccaguuauauguuacaaucugaggagcugcgagccagccucuuggcuagauacccucccgaaaaacuguuucaggccgagcggaacuucaaugcagcucaggaucucgacgugucccugcuugaaggcgaucuggucggggugaucaagaagaaagacccaaugggaucacaaaacaggugguugauugacaauggcguuacgaagggguuuguguauucuagcuuccuaaaaccuuacaacccccgccguagucacuccgaugccagcgucggaucucauucauccaccgagagugaacacggcagcucgucuccaagauuuccucggcagaauagugguagcacacugacuuucaacccgucaaguauggcaguaucuuuuaccuccgggagcugucagaagcagccccaagacgccucaccaccucccaaagagugcgaucagggaacacucagugcuagcuuaaauccauccaacucugagagcuccccuucaaggugucccucugacccggauaguacuucgcagccacgcagcggcgacuccgcggauguggcccgagacguuaagcagccuaccgcaacgcccagaucuuaucggaauuucaggcauccagaaaucguggguuacucaguccccggccgcaacgggcaaagccaggaucuggugaagggaugcgcuagaacagcccaggccccugaggacagguccaccgaaccggauggcagugaggcugaggggaaucagguauacuuugcaguguauacuuucaaagcccggaaccccaacgaacuuucugucagcgcgaaucaaaagcugaaaauacucgaguuuaaggacguuacaggaaacaccgaauggugguuggcugaggugaauggcaaaaaggguuacgugccaucaaacuauauucguaaaacugaauacaccuga

SEQ ID NO: 55420 - RNA, 4899 nt, Artificial Sequence
  derived and/or modified sequence opt3 from DNMT1__Homo_sapiens__NP_001124295
augcccgccagaaccgcuccugcaagggugccaacacuggccgucccggcgaucagccuccccgacgauguucggcgccgacuuaaggaccuggagcgugauuccuugacugaaaaagagugcgugaaggaaaaauuaaaccugcuacacgaguuccuccagacggaaauuaagaaucaacugugugaccuugagaccaaacugagaaaggaggaauugucugaggaaggcuaccucgcuaagguaaaaucacugcugaacaaggaucucaguuuagagaauggggcccaugcauauaacagggaggugaauggacggcuggaaaacgguaaucaggcccgcagcgaggcuagaagggucggcauggcagacgccaacuccccuccaaaaccccuuucuaagccucggacaccacgccgaucgaaaucagauggggaagcuaagagaagcagggaucccccugccagugcgucccaggugacuggaauacgggcagagccaucuccgagcccccguaucacccgcaaguccacaagacagaccacuauuacaucacacuuugccaaaggcccugcuaagaggaaaccacaagaagagagugagcgggccaagagcgacgaaucuaucaaagaggaagacaaggaucaggacgagaaacgacgcagaguuaccuccagggaacggguggcacgccccuugccugcugaggagccagaaagagccaagucagguacgaggacugagaaggaagaggaacgugaugagaaagaggaaaagcggcugcgaagccagaccaaagagcccacaccgaagcagaaacuaaaggaagaaccugacagagaggcgagggccgggguccaagcagacgaagaugaggacggagaugaaaaggacgagaaaaagcaucgcagucagcccaaagaucucgcugccaagcggagaccagaagagaaagagccugaaaaggugaauccccagauuucugacgagaaggaugaagacgagaaagaagagaagaggcgcaaaacuaccccaaaggagcccacagagaaaaagauggcucgagccaagaccguaaugaacuccaaaacgcacccuccaaagugcauccaguguggccaauaccuggaugacccggaucuuaaauauggccagcaucccccugacgcaguugacgagccacagaugcugacuaaugaaaaguugagcauauucgaugccaacgagucgggguuugaaucuuacgaggcucucccccaacacaaacugacaugcuucuccguguauuguaagcacggacauuuaugcccuaucgacaccggucugauugagaaaaauaucgaacucuuuuucucaggcagugcgaagccaauuuacgaugacgaucccagccuugagggaggagucaacggcaagaaucuggguccgaucaacgaaugguggauaacuggguuugacggaggcgagaaagcauugauuggcuucuccacaucuuuugccgaguauauccuaauggauccuagcccagaauacgcucccauuuucgggcugaugcaggagaagaucuacaucucaaaaauugugguggaauuucuccagaguaacuccgacagcaccuaugaggaucugauaaauaagaucgaaacgaccgucccucccucuggacuuaaccugaaucgguucacagaggacucauugcuccgucacgcccaguuuguuguggagcaaguagaaaguuacgaugaggcuggugacagcgaugaacagccaauuuuccugacuccuuguaugagagacuuaaucaaacuggccggcgugacccuagggcagaggcgcgcucaggcccggagacaaacaauaaggcauuccacucgagagaaggaccgcggacccaccaaggcaacaaccacuaaacucgucuaucagauuuucgauacguuuuucgcggaacagaucgagaaggacgaucgggaggacaaagaaaacgcuuuuaagagaaggcguugcggcgugugugagguuugccagcaaccagaaugugguaaaugcaaggccugcaaggauauggugaaauucgggggcucuggacgcucgaagcaggcaugucaggagcggagaugcccgaauauggccaugaaagaagcugacgaugacgaggaggucgaugacaacaucccugaaaugcccagcccaaagaaaaugcaccagggcaagaagaaaaagcaaaauaaaaacaggauuuccugggugggggaggccguaaagacagaugggaaaaagucauacuauaaaaagguuuguaucgacgcagaaacccuggaggugggugauugcgucagugugauucccgacgacucuagcaagccucuuuacuuggcucgagucacugcccugugggaggauuccucaaauggccagauguuucacgcgcauugguucugugccgggaccgacacagugcucggagcuaccagcgauccacuggaacuuuuucugguugacgagugcgaagauaugcaguugucuuauauacacuccaaagugaagguaaucuacaaagcacccagugagaacugggccauggaaggcgguauggacccugagagccuccuggagggggaugacggcaagacuuacuucuaucaauuaugguacgaucaggacuaugcucgguuugaaucuccgccaaaaacacagcccacggaggauaauaaguucaaguuuugugucuccugcgcccgccuggcagaaaugagacagaaagagauuccuagggugcuagaacaacucgaggaccuggacucacggguucuuuacuauagugcgaccaagaacggaaucuuguaccgagugggcgauggggucuaucugccacccgaggccuucacuuuuaauaucaaacucagcucgccugugaagagaccgcgcaaagaacccguagacgaggaucuguacccagaacauuacaggaaguauuccgacuacauuaagggaucuaacuuagaugcuccugagcccuaucguauaggucggaucaaagaaauuuucuguccaaagaaaagcaauggcagaccuaacgagacagacaucaagauuagggugaacaaauucuaccgccccgagaauacccacaagucaacaccagccaguuaucaugcagauaucaaccugcuuuacugguccgacgaagaggcuguugucgauuuuaaggccgugcaggggcgaugcacuguggaauauggagaggacuugccggaguguguccagguuuacucuaugggcgguccuaauagauucuacuuucucgaagcauauaacgccaaaagcaaguccuucgaggaucccccaaaucacgcucggucacccgggaacaaaggcaagggaaaaggcaaggggaagggaaaaccuaagagccaggcgugcgaaccaagugagcccgaaauagagaucaaacugccuaagcuaaggacccuggacguguuuucuggcugcggugggcucuccgagggauuccaccaagccggcauuagcgauacgcugugggcaaucgaaaugugggacccggcugcccaggccuuucgccuuaauaacccagguucgaccguguucacagaggacuguaauauuuugcugaaauuaguaauggcuggcgaaacuaccaacucacgugggcagagacucccccagaagggagaugucgagaugcugugcggcgggccucccugucaaggauuuucuggcaugaaucgguucaacaguaggacauacuccaaauuuaagaauagccuugugguuucuuuccugagcuauugcgacuacuaucgcccacgauuuuucuugcucgaaaacgugagaaauuucgucuccuuuaagcggucaauggugcugaaacuaacucugaggugucucguucgcauggguuaccagugcaccuucggggugcugcaggcaggacaauauggcguagcccagacgagaaggcgggcgaucauacuugcugccgcaccuggugagaaguugccccuguuuccagagccuuuacaugucuucgccccgcgugcuugucagcucagugugguggucgaugacaaaaaguuuguuagcaacauuacacgccugucuuccggccccuuccgaaccaucacugugagagauacaaugucagaccuuccagaaguaaggaacggggcaagugcccuggagauuagcuacaauggagaaccucaguccugguuucaacggcagcuacgcggcgcgcaguaccagcccauccucagagaucacauaugcaaagacaugucugcucugguggccgcaaggaugcggcauaucccauuggccccugggucggauuggcgagaccugcccaacauugaggucagauuaagcgauggaaccauggcucgcaagcucagguauacucaccacgaccggaagaauggccguucauccaguggugcccugagagggguguguucuugcguugaagcaggaaaagcaugugauccggccgcgaggcaauucaacacccuuaucccauggugccugccucauacaggcaaucgccacaaccauugggccgguuuguacggccggcucgagugggacggguuuuucagcacgaccgugacuaaucccgagccaaugggaaagcagggccgaguccugcaccccgaacagcauagagugguuuccgugagggagugcgcacgcucacagggguuuccugacacauaucggcuauucggaaacauucuggauaaacacagacaagucggcaaugcuguaccgcccccacuugccaaggcuaucggucucgaaauaaaacuguguauguuggcaaaggcccgugagucugccagcgcuaagauuaaagaggaagaggcggcaaaggacuga

SEQ ID NO: 55421 - RNA, 2172 nt, Artificial Sequence
  derived and/or modified sequence opt3 from DNMT3A__Homo_sapiens__NP_715640
augggcauccuggagagaguggucaggcggaacgggcgcguugaccgaagccucaaggaugaaugcgacaccgccgagaaaaaggcuaaagugauugcaggaaugaaugccguagaagagaaccagggucccggcgaaucccaaaagguggaggaggcgucuccuccagcuguccagcagccgacagaucccgccucaccuacuguggcaacgaccccagaacccguugggagugacgccggagauaaaaaugcuacaaaggcaggcgacgaugagccugaauacgaggacggucguggguucggaauaggcgagcuuguguggggcaagcugagaggguuuagcugguggccaggaaggaucgucuccugguggaugacuggucggucucgcgccgcugaaggcaccagaugggugaugugguucggggauggaaaauuuucgguaguuuguguggagaaguugaugcccuuaagcucauucugcagugccuuucaccaggcgacauauaacaaacaaccuauguacaggaaggcaauuuaugaaguccuacagguggccuccucucgggcuggcaaacuguucccagugugucaugacagcgaugaguccgacaccgccaaggcagucgaaguucagaauaagccgaugaucgagugggcucucgguggguuucagcccucaggaccuaaaggccuggagccacccgaagaggaaaagaacccuuacaaagagguguauacugauauguggguagaaccagaggccgcggccuacgcacccccgccucccgcuaagaaaccacgcaagaguacagccgagaaaccuaaggugaaggaaauuaucgacgagcgaaccagagaaaggcuugucuaugaggugcggcaaaaaugccguaauauagaagacaucuguauuagcugcggcucucugaacguuacguuggagcacccccucuucgugggaggaaugugucagaauugcaagaacuguuuucuggagugcgcuuaccaguacgaugacgaugguuaucaguccuacuguacuaucugcugcggcgggcgcgaaguccugauguguggaaauaacaauugcuguagaugcuucuguguggagugcguagaccucuuaguuggcccaggugccgcacaagccgcuauuaaagaagaucccuggaacuguuauaugugcgggcauaagggcaccuacggacugcuuaggcggcgagaggacuggccuucacgcuugcagauguuuuucgcgaauaaccacgaucaggaguuugacccaccgaaaguguaucccccugucccagcagaaaagagaaagcccaucagggugcugagccuauucgauggcauagccacagggcuccugguccuuaaagaccuggggauucaaguggaucgguacaucgcuagugagguuugugaagacucuauuacuguggguaugguacgccaucagggcaagaucauguaugucggggacgugagauccguuacccagaaacacauccaggaguggggaccuuucgauuuggugauuggcgguagcccaugcaacgaccucucgauagucaaucccgccaggaaggggcuguacgaaggcacaggacguuuauuuuucgaguuuuaccggcugcuccacgaugcacgaccgaaagagggcgacgauagaccuuucuuuuggcuuuucgaaaacgugguagccaugggggugucugacaagagggauaucucccgcuuucuggagucaaauccaguuaugauugacgcuaaggaagucagugccgcacaucgggcgagauauuucuggggaaacuugcccgguaugaauaggccucuagcuagcaccgugaacgauaaacuggagcuccaagaaugucuggagcacggccgcaucgccaaguuuuccaaagugcgaacgauaacuacacggucuaauagcauuaagcaggggaaagaccagcauuuccccgucuuuaugaacgagaaggaagauauccuuuggugcaccgagauggaacguguuuucggauuuccagugcacuacacugacgugucaaauaugaguagacuggcaaggcagcgcuugcucggccgguccuggagcguaccugucaucagacaccuguucgcccccuuaaaggaguauuucgcuugcguguga

SEQ ID NO: 55422 - RNA, 2187 nt, Artificial Sequence
  derived and/or modified sequence opt3 from DNMT3B__Homo_sapiens__NP_001193984
augaagggcgacaccagacaccugaacggggaggaagaugccggagguagggaggacagcauccucgugaauggcgcuugcuccgaucagucuucagacagucccccuauucuugaagcaauacggacaccagagauccgcgggcgacguagcuccucuagacugucgaaaagggaagucagcucauuguuaaguuacacucaagaucugacgggagacggcgauggugaggacggggauggauccgacaccccgguuaugcccaagcuauuccgggagacacgcacuagaucugaaagcccugccucccucaggcggcgcgcgaccgcuucagccggcacaccauggcccaguccuccaagcucuuaucugaccauugaucuuacugacgauacagaggacacccauggcacgccccaguccucaagcacuccuuacgcacgacuggcccaggacagucagcaagggggaauggaaucuccacagguggaggcugauuccggugacggcgauagcucggaguaucaggacgggaaagaauuuggaaucggcgauuugguaugggguaagauuaaaggguucucuugguggccggcaaugguggucuccuggaaggccaccucaaagagacaggcuaugaguggaaugaggugggugcaaugguuuggcgacggcaaauucagcgagguuuccgccgauaagcucguggcgcuggggcuguuuucucagcacuucaaccucgcaacauuuaauaaauuagucagcuaccggaaggccauguaucaugcucuggaaaaagcccgugugcgcgcaggaaagacuuuccccucaaguccuggugacucccuugaggaucaguugaagccaaugcuggaaugggcucacggcggguuuaaacccaccggaaucgagggccuaaagccuaacaauacacagccagagaacaaaaccagaaggcggacggccgacgauagcgcgacuucugacuacugucccgccccgaagcgacucaaaacaaauugcuauaacaaugguaaggaccgcggggaugaagaccaaucaagagagcagauggcaagugauguagcuaacaauaaaagcucccuggaagacggcugucuuucuugcggaaggaagaacccuguuucguuccauccccuguuugagggcggguugugucagaccugccgggaucgcuuccucgaacuguuuuacauguacgacgaugacggauaucaaagcuacuguacugugugcugugaggguagagaguuacugcucugcuccaauacaucauguuguaggugcuucugcgucgaaugccuugaggugcuggugggcaccgggacggccgcugaagccaaguugcaggagccauggaguuguuauaugugccuaccucagcguugucacggaguccugcggcgaagaaaagauuggaacguuaggcuccaggcauucuuuaccucugacacaggccuggaauacgaggcccccaaacuuuauccagcuauacccgcggcacgccggagaccuaucagggugcugagcuuguucgaugguauugccacuggguaccucguacugaaagaguuaggcaucaaggugggaaaauaugucgcuuccgaagugugcgaggaaucaauugccguuggcaccgugaagcacgaggggaauaucaaguacgucaacgacgugcgcaacauaacaaagaagaauauugaggaauggggaccauuugaucugguaaucgguggcagcccguguaacgaccuaucuaauguuaaccccgcacgaaaagggcucuacgagggaacuggccggcuguucuuugaguucuaucaucuuuugaauuacucccguccuaaggaaggugacgauagaccauuuuucuggauguuugaaaacguggucgccaugaaagugggggacaagagggauauuagucgcuuccuggagugcaaucccgucaugaucgacgcuaucaaggugagcgccgcacaccgggcgagauauuuuuggggcaaccucccuggaaugaauaggauuuucggcuuuccaguucauuacaccgaugugucuaacauggggcgaggagcucgccaaaaacugcuuggccgguccuggucaguacccgucauaagacaccuguucgccccguugaaggacuauuucgcaugugaguga

SEQ ID NO: 55423 - RNA, 1161 nt, Artificial Sequence
  derived and/or modified sequence opt3 from DNMT3L__Homo_sapiens__NP_787063
auggccgcuauccccgcacuggacccugaggccgaaccaagcauggaugugauucucgucggcuccucugagcuuucaaguagcguuuccccggggaccggaagagaccugauagcguacgaagugaaggcuaaccagaggaauaucgaggauauuugcaucuguugcgguucuuugcaaguacacacacagcaucccuuauucgaaggcgggauuugugccccuugcaaagacaaguuucuggaugcacuauuccucuaugacgaugacggauaccagucguauuguucaaucugcuguagcggcgagacucugcuuauaugcgguaacccagauuguacgcggugcuacuguuuugagugcguggacagucuggucgggcccggaaccuccggcaaagugcacgccaugucuaauuggguuugcuauuugugucucccuagcucccgcucaggccugcugcagcgacguagaaaguggaggagucaacucaaggcuuucuacgaucgggaaagcgagaacccauuagaaauguuugagacagugcccgucuggcgcagacagccugugaggguacugucucuuuucgaggacaucaaaaaggaauugacuucccugggguuucuagagucaggaagcgauccaggucagcucaaacauguuguggacgucaccgacacagugcggaaggauguggaagaguggggcccguucgaccuggucuauggggcaaccccuccccuuggacacacuugcgaucgcccacccaguugguaccuguuucaguuccaucgauugcuccaauacgccagaccuaaaccaggcucucccaggccguuuuucuggauguuuguugacaaucugguguuaaacaaggaagaucuggacguagcuucccgguuccucgagauggagccugugacaauucccgauguccacggugggagccuucagaaugccgugcguguuuggucgaacaucccagcgauucgcucuagacacugggcacugguguccgaagaggaauugucacuacuggcccagaauaaacagaguagcaagcucgcugccaaguggccuaccaaacuggucaagaacuguuuccuuccccugagggaguauuuuaaauacuucuccacggaauugacuucuagccucuga

SEQ ID NO: 55424 - RNA, 1458 nt, Artificial Sequence
  derived and/or modified sequence opt3 from DNPEP__Homo_sapiens__NP_036232
augagcggucacucccccaccagaggggccaugcaaguggcuaugaacggaaaggcaaggaaagaggccguccagacagcggcuaaggaacugcucaaauucguuaaucggucuccuucaccauuucaugccguggcagagugccgcaaccgacuucugcaggccgguuucagugaauugaaggagacugaaaaauggaauaucaagccggagagcaaguacuuuaugacgcguaacuccucuaccauuauagcuuucgcaguaggcgggcaguaugugcccggaaauggcuuuucguuaaucggugcccacacagacucaccuugucugagagucaaaaggcggagccgcagaagucaggugggguuccaacagguuggaguggagacuuacggcggcgggauuugguccaccugguuugauagggaccuaacacucgcuggacgggucaucgugaagugcccaaccucuggucgccuggaacagcagcuuguacauguugagcgacccauucugagaaucccucacuuggccauacaucuccaaaggaacaucaaugaaaacuucggcccaaauacugagaugcaccuggugcccauucuggcgacagcaauccaggaggaacucgagaaagggaccccugaaccaggaccguuaaacgccgucgaugagcggcaccauagcgugcugaugucccuuuugugugcucaccugggccuaucacccaaggacauuguggaaauggagcucugccuggccgauacgcagccugcaguccuugguggggcuuaugacgaguuuaucuucgccccacgucuggauaauuugcauaguuguuuuugcgcgcuccaggcccugauagacagcugugcaggacccggcucuuuagcuacugaaccucacguucgcauggugacccuguacgauaacgaggaaguaggcuccgagucagcccaaggggcucagagccuccuuacagaacugguguugagaaggauuagugccucuugccagcacccaacugcauucgaggaggccauccccaaauccuuuaugauuagcgcugacauggcgcaugcaguccacccgaauuaucuagauaagcaugaagagaaccaccggccucuguuccauaagggacccgugaucaaaguuaauucgaagcaacgauacgccucuaacgcuguguccgaagcccucauccgcgaggucgcaaacaaagugaagguaccacugcaggaccuuaugguuagaaaugauaccccuugugguacaaccauuggccccauacuggccucaagguuggggcuccgggugcuggacuuaggaaguccacagcuggcuaugcacagcauccgcgaaauggccugcacgacuggcguccuacagacacucacccuguucaaaggcuuuuucgagcuuuuucccuccuugucucacaaccugcucguggacuga

SEQ ID NO: 55425 - RNA, 1527 nt, Artificial Sequence
  derived and/or modified sequence opt3 from DNTT__Homo_sapiens__NP_001017520
auggaucccccuagagccagccaccuguccccaaggaagaaacggccgcgccagaccggcgcucucauggcaucuucaccccaagacaucaaguuccaggaccuuguggucuuuauucuggagaaaaagauggggacaacucgacgugccuucuugauggaauuagcgagaaggaaaggauuucggguugagaacgaacugagugauagcgugacgcauauaguagcugagaauaacuccgguucugacgugcuagaauggcuccaggcccagaagguccaagugucgucacagccugagcugcuugauguuagcuggcugaucgagugcauucgcgcaggcaagccaguggaaaugaccgggaaacaccaguuggucgugagaagggacuacagugauuccacaaaucccggaccuccaaagacucccccuaucgccguacagaaaauuucucaauaugcuugucagcggcgcaccacacucaacaauugcaaccagaucuucaccgacgcauuugauauacuggccgagaauugugaguuccgagaaaacgaggacagcugcguuacuuuuaugagagcugccuccgugcugaagucacucccauucacaaucauuaguaugaaagauaccgaaggcaucccguguuuagguagcaaggucaaggggauuaucgaggaaauaauugaggacggagaaucuuccgaggugaaagcggugcugaaugaugagagguaccagucauuuaaacuuuucacgagcgucuuuggcguuggcuugaagaccagugaaaagugguuccggaugggguuucguacucugucuaaagugcgcuccgacaagagccuaaaauucacaagaaugcaaaaggcaggauuccucuauuacgaggaccugguaucgugcgugacuagggccgaagcugaggccgucucugugcuuguuaaggaagcagugugggcuuuucugcccgaugccuucgucaccaugacagguggcuuucggcgagggaaaaagaugggacaugacguggauuucuugaucaccuccccuggcucaacggaggacgaggaacagcuccugcagaaaguaaugaacuuaugggagaagaaaggucugcuccuuuauuacgaucugguugaaaguacuuuugagaaguugcgccuaccaagcagaaagguggacgcgcuggaucacuuccaaaaauguuuucucauuuucaagcugcccaggcagcgggucgacuccgaucagucuagcuggcaggaagggaaaacauggaaggccauccgcguggaccuuguccugugcccuuaugagagaagggcauuugcuuugcucggauggaccggcucacguuucgagcgggaucugcgaagauacgccacucaugaaaggaaaaugaucuuagacaaucacgcucuguacgacaagacaaagcgcauuuuucuaaaagccgagagugaagaggagauauucgcacaccucggccuggauuauaucgaaccaugggagcggaacgccuga

SEQ ID NO: 55426 - RNA, 1203 nt, Artificial Sequence
  derived and/or modified sequence opt3 from DOC2A__Homo_sapiens__XP_011544277
augagaggcaggcgcggggaccggaugaccaucaacauucaggagcacauggccauaaaugugugccccggaccuauccgaccaauucgucaaaucagcgauuacuucccgagaggucccggcccugaagggggaggcggugggggaggcgaggcuccagcacaucuggucccccucgcccuugcgccuccagcugcccuguugggcgcaacaacucccgaagacggggccgagguugauuccuaugacucugaugacgcuacggcauuaggaacccuggaauuugaucuacucuacgacagggccucauguacacugcacugcaguauucuucgggcuaagggucugaaaccuauggauuucaacggcuuggccgacccauaugugaagcuccaucugcugccgggggcguguaaagcaaauaagcucaaaacuaagacccagcgcaacacauuaaaucccguauggaacgaggaucugaccuacagcggaaucacugacgaugacauaacacacaaggugcuuagaaucgccgucugcgacgaggauaaauugucccauaaugaauuuauuggcgagaucagggugccucugcggcgccuaaagccaucucagaaaaagcacuucaacauuugucucgaacgacagguuccccuggcuucgccuucaagcaugagugccgcacuuagagguaucuccugcuaucugaaagaguuggagcaagcugaacaggggcagggacuccuggaggaaaggggccggauauuacugucucucagcuacuccucacgucgcagaggccuucugguggggauuuugaggugugcccaccuagcggccauggacgucaauggauauagugauccauacgugaagaccuaccugcggcccgacguagauaagaaaagcaagcauaaaacgugcguuaagaaaaagacucucaacccggaguuuaaugaagaguucuuuuaugagaucgaacugucuacccuugcaacaaaaacucuggaggugaccgucugggacuacgauauugguaaguccaacgacuucaucggcggggugucauugggaccuggcgcucgaggugaagcccgcaagcacuggagcgauugucuccagcaacccgacgcugcccuggagagauggcauacauuaaccagugaacugccuccagcagccggggcucuaucuuccgcguga

SEQ ID NO: 55427 - RNA, 1239 nt, Artificial Sequence
  derived and/or modified sequence opt3 from DOC2B__Homo_sapiens__NP_003576
augacccugagaaggcggggcgagaaggccacaaucagcauucaggaacacauggcuauagacgugugccccgggccuauccgcccaauuaaacaaaucuccgauuacuucccgcgauuuccccguggacucccuccagacgcaggucccagagccgcggcuccuccagaugcccccgcaaggccugccgucgcuggcgcagggcggcgcucuccaucagacggagccagagaggaugacgaagauguugaccagcuuuucggcgcuuaugguaguagcccggggcccuccccuggaccaucucccgccaggccuccagcgaagcccccggaggaugaaccugacgcagauggcuacgagucggacgauuguacugcccugggcacguuggacuuuucauuacuguaugaccaggagaacaaugcucuacauugcaccauuacaaaagccaaggggcucaaacccauggaucacaacggacuggcagacccauacgugaaacuucaucuguugccuggugcuagcaaggccaauaagcuccggacuaagacccugcgcaacacacugaaucccaccuggaacgaaacucucacauauuacggcaucaccgaugaggacaugauacgaaaaacguuaagaaucaguguaugugaugaagacaaguucaggcacaaugaguuuauuggggagacucgggugccacugaaaaaguugaagcccaaccauaccaaaacauucuccaucugccuugaaaagcagcugccugucgauaaaacugaggacaagucucuagaggaacguggacgcauucucaucagccugaaauauuccucacaaaagcagggccuucugguggguauaguuagaugugcgcacuuggccgcaauggaugcuaauggguacagugacccauacgugaaaaccuaucucaggccggaugucgacaaaaagagcaagcacaagacagccgugaaaaagaaaacccugaaccccgaauuuaaugaggaguucugcuacgaaauuaagcauggagacuuagcuaagaaaucucuggagguaacgguuugggauuaugacaucggcaaguccaacgauuuuauuggcggggugguccucggaauccacgccaaaggugaacggcuuaagcauugguucgacugucugaaaaauaaggauaagcgaaucgagcgcuggcacacuuugacaucagaacuaccuggcgcagugcugagcgacuga

SEQ ID NO: 55428 - RNA, 6543 nt, Artificial Sequence
  derived and/or modified sequence opt3 from DOCK10__Homo_sapiens__NP_001277192
augagcuucagaggcaagguguuuaaaagggagcccuccgaguucuggaagaaacggcgcaccguccgacguguuaaccaggaggaaauccacagauuuucuucacaagagaagccuaggcugcucgaaccacuugacuaugagacagugauugaggaacuggagaaaacuuaucggaaugauccguugcaggauuuacuguucuuucccagugaugacuucagcgccgcuacgguuuccugggauauacgcacccuauacucuacagugccugaagacgcagagcauaaggccgagaaccuccuggucaaggaagcgugcaaauuuuauucgucacaguggcacgugguuaauuacaaguaugagcaguacagcggggauaucagacaacuuccuagggcugaauauaaacccgagaagcugccuagucauuccuucgaaauugaccacgaggaugccgacaaagaugaggacacuaccucucauagcuccucaaagggagguggcggggcaggaggcacagguguguuuaagagugggugguuguacaaaggaaacuucaauagcaccgucaacaauacugugacagugcggucuuuuaagaaacgcuacuuccagcucacccagcugccagauaacuccuauaucaugaauuuuuacaaggacgagaaaauuucaaaggagcccaaaggcuguaucuuccuggacagcugcacgggcguugugcagaacaaucgacucagaaaguaugccuucgaauuaaagaugaacgaucugacuuacuuuguccuugcugcagagaccgaaagugacauggaugaguggauacacacauugaauaggauccugcaaauuucuccugaggggccacuacagggacggcguuccacugaacucaccgaccugggucuugauagccuggacaacucggugacaugugagugcaccccggaagagacggauucuuccgaaaauaacuugcacgccgacuucgcuaaauaucucacugagacagaggauaccgugaagacuacacgcaacauggaaagacugaauuuauuuucacuggaccccgauaucgacacccucaaacuucagaagaaagaccuguuggagccugaaagugucauuaagccauucgaggagaaggccgcgaaaaggaucaugauaauuuguaaggcacuaaacagcaaucugcagggcugcguuacggaaaacgagaaugaucccaucaccaacauugaaccauuuuucguguccguagcccucuacgaccugcgggauucucgaaaaaucagcgcugacuuucauguggaucuuaaucacgccgcaguccgccaaaugcuguugggggcuucaguggcccucgagaacggaaauaucgacacaauuacuccaagacagagugaagaaccccauauaaagggccugccggaggaaugguuaaaauucccuaagcaggcgguauuuuccgugagcaacccccacucugagaucguccugguggccaagauugaaaaaguacuaauggguaauaucgcaucaggggcugagccauauauaaagaacccugauaguaauaaauacgcccaaaagauucucaaaagcaacaggcaguucuguuccaagcugggaaaguaccggaugcccuuugcuugggccguucgcucuguguucaaagacaaucagggcaacgucgauagagacucgagguuuagcccacuuuuccgucaggaauccucaaagaucaguaccgaggauuuggugaaacuggucucugacuaucggcgagcagauagaaucagcaagaugcaaacaauucccggcucccucgacaucgccguggacaacguuccucuggagcacccaaauugcgugacuucaucauucauuccgguaaaacccuuuaacaugauggcucagaccgaaccuacagucgagguggaagaguucguuuacgauucuaccaaguauuguaggccauaccgcguguauaaaaaucagauauacaucuaucccaagcaucuuaaguacgacucccagaaaugcuuuaacaaggcgcggaauauuacugucuguaucgaguucaaaaacagugaugaggagagcgcaaagccucugaaaugcaucuacgggaagccaggaggucccuuguuuacgucugccgcuuauacagccgugcuccaccauucccaaaauccggacuucucagaugaaguaaagauugagcugccuacccaguuacacgaaaaacaucacauacuguuuaguuucuaccacgugacuugcgacaucaacgcaaaggccaaugcuaaaaagaaagaggcccuagagaccagcguuggcuaugcauggcucccacugaugaagcaugaucagauugcgucgcaggaauacaacauccccauugcuacaucccuuccucccaauuauuugucuuuucaagacagcgccucagggaagcacggaggcagugauaucaaaugggucgacggugggaagccacuguucaaaguguccaccuuuguggucucuacuguuaacacacaggauccucaugugaaugcauucuuucaggagugucagaagagagaaaaagacaugagccaaucccccacgucaaacuucauaaggagcugcaagaaucuccugaacguggagaagauccacgccauuaugaguuucuuaccaaucauucugaaccagcuuuuuaaaguauugguccagaaugaagaggaugagaucaccacuacagugacccgcguucucacagacauaguggcuaagugucacgaagaacagcuggaccauucuguccaguccuacauuaaauucguguuuaagacucgagccugcaaagaacggaccguucacgaggaacuagcaaagaacgugacgggccugcucaaaagcaaugauucgaccacaguaaagcauguccugaagcacucaugguucuuuuucgcuaucauucuuaaaucuauggcccagcauuugaucgacacuaacaagauacagcugccgcguccucaaagauuucccgagaguuaucagaaugaguuagauaaccucgugauggugcuguccgaccacgucaucuggaaauacaaggaugcgcuugaagagaccaggcgcgccaaucacagcguugcucgguuccugaaaagauguuuuacauucauggacaggggauacguguuuaagaugguaaacaauuauauuucuauguucagcuccggcgauuugaagacucucugccaguacaaauucgacuuucugcaggaagugugucaacaugagcacuucaucccacuaugccugcccauucgaucagcaaacaucccugauccacucacccccagugaaagcacgcaggagcugcaugccucugacaugccugaguauuccgucacaaaugaauuuugucgcaagcacuuccuuauagggauuuugcugcgggaggugggauuugcuuuacaggaagaucaggacguuagacaucucgcccuggcagugcuuaaaaaccugauggcgaagcacucauucgacgauagguaccgugagccgcgcaaacaagcccagaucgcuagucuauauaugccacucuacgguaugcuguuggacaauaugccccggaucuaucugaaggauuuauacccuuuuaccgucaacacuagcaaucagggcuccagagacgaucucucuacaaacgggggauuccaaucgcagaccgccauuaagcacgcaaacagcguggacacuucauuuuccaaagauguucugaauaguaucgcugccuucucuagcauugcaauauccaccgugaaccaugccgacucaagggcuucucuugcgagccuggauaguaauccauccacaaacgaaaagagcucugagaaaacggacaauugcgagaagaucccccgaccuuugucacucauuggcuccacccugcgguuugauaaacuagaccaggccgaaacucgcagucugcuuauguguuuccuccacaucaugaagacaauuagcuacgagacccugaucgcauauuggcagagagcuccgucgcccgaagucucugacuuuuucuccauauuggacguaugccugcaaaacuucagguacuuagguaagcggaauaucauucgaaaaaucgccgccgcuuuuaaguucgugcagagcacacagaacaaugggacucucaaaggcucaaacccaaguugccagaccucuggacugcuuucccaauggaugcauagcacgucaagucacgagggccacaagcagcauagaagccagacacugccuauuauccgcgggaaaaaugcauuguccaaccccaagcuccugcagaugcuagacaauaccaugacuucuaacagcaaugagauagauauuguucaccauguggacaccgaagccaacaucgcgacagaggucugucugacuauccuugaucuccuguccuuguuuacccaaacacaccagaggcaguuacagcaaugcgacugucaaaauucacugaugaagcguguguucgauacguauaugcucuuuuuccagguaaaccaaucugcuaccgcccugaaacauguguuugcaagucuucggcuguucgucugcaaguuuccaucggccuucuuucagggaccugcugacuugugugguagcuucugcuacgaaguucuaaaauguugcaaccacagauccaggucuacucagacagaggcaucagcccugcucuacuuuuucaugcgcaagaauuucgaauuuaacaaacaaaagagcauugugcgaucccaucugcagcuuauaaaagcggugagucaguuaaucgcugaugccggcauugggggaucuagauuccagcacagccuggcaaucaccaauaacuuugccaauggcgacaagcagaugaagaacucaaauuuccccgcugaggucaaagaucucacuaagcggauuaggacaguguugauggccaccgcacaaaugaaagagcacgaaaaggacccagagaugcugguugaucuccaguacucccuggcuaacaguuaugccagcacgccggaacuucgccguacuuggcuggagucuauggcgaaaauccaugccagaaauggugacuuguccgaagcagcuauguguuacauacacaucgccgcucuaauugcagaguaccugaagcggaagggguauuggaaaguagagaagaucugcaccgccucacucuuaagcgaagauacacacccuugugacucgaacucucugcuuaccacucccaguggcggauccauguuuagcaugggcuggccagccuuccugucaauuacacccaauaucaaagaggaaggggcuaugaaggaggacuccggaaugcaggauaccccuuacaacgagaauauacucguggaacaguuguauaugugcgucgaguuucuguggaaaucugaaagguacgagcucauugcggacgugaacaagccaaucaucgcaguuuucgaaaagcaacgcgauuuuaaaaagcugagcgaccuuuauuacgauauucaucgaaguuaucuaaaaguggccgaggucguaaauuccgagaagagacuguucggccgguacuacaggguagcuuuuuauggucagggguucuuugaagaggaagagggaaaagaauacaucuauaaggagcccaaguugacaggcuuaagcgagauaucucagcgccugcucaaacuguacgccgacaaguucggugcagauaacgucaaaauuauccaagacucaaacaaggugaauccuaaagaucuugacccgaaguaugccuacauucagguuacuuaugugaccccauucuuugaagagaaagaaaucgaggauagaaagacggacuucgaaaugcaccauaacauaaauagguuugucuucgagacacccuuuacccugaguggcaagaaacacgggggaguggcugagcagugcaagcggcguacuauucucaccacaucccauuuguucccuuacguuaaaaagcgcauccaggugaucagccaaucuucgacugaacugaaccccauugaggucgcgaucgacgaaaugagcaaaaaggugagcgagcuaaaucagcuguguaccauggaggaaguagauaugauucgacuccagcuuaagcugcagggcuccgugaguguuaaagucaacgccgggccaauggcauacgcuagagccuuuuuagaggaaacgaaugcaaagaaauauccugacaaccaagugaaguugcugaaagagauauucaggcaguuugccgaugcuugcggacaggcccucgacgugaaugaacggcugaucaaggaggaucagcuugaguaccaagaagaacugcgcucucacuauaaggacaugcucagcgaauuguccacagucaugaacgagcagauuaccggcagagaugaccugucaaaaagggguguagaucagacuuguacacgggugaucaguaaggcgacccccgcauuaccaacuguuucuaucagcuccucagccgaaguguga

SEQ ID NO: 55429 - RNA, 6222 nt, Artificial Sequence
  derived and/or modified sequence opt3 from DOCK11__Homo_sapiens__NP_653259
auggccgaggugagaaaguucaccaaaaggcugagcaagcccggcacagcugcagaacuccggcaguccgucucugaggccguucgcgggucagugguacuugaaaaagcgaagguggucgagccucuggacuacgaaaacgugaucgcucaacgaaaaacucagauuuauagugauccauugcgugacuuacugauguuuccgauggaggauauaagcaucuccguuauuggaagacagaggcggacggugcagucuaccguccccgaggacgccgaaaagcgcgcacaaucgcuauucgugaaggagugcaucaaaacauacucaacugauuggcacguaguuaauuauaaguacgaagacuuuagcggugauuucagaaugcucccuuguaaaagucugaggccagagaagauucccaaccauguguuugagaucgacgaagauugcgagaaagacgaagauuccucuagccuuuguucccagaagggcggggucauaaagcagggauggcugcacaaagccaaugugaacucaaccaucacagugaccaugaaggucuucaaacggcgcuauuuuuacuugacucagcucccugacggcaguuauauucugaauagcuacaaggaugagaaaaacucuaaggaauccaaagguugcaucuaccuggacgcuuguauugacguugugcaaugcccaaagaugcgaagacaugcauucgagcucaagauguuagauaaauauucacacuaccuggccgcugagacagaacaggagauggaagaguggcuuaucaccuugaagaaaauaauucagaucaauacggacagccugguacaggaaaagaaagagacuguggagaccgcccaagaugacgaaacaaguucucaggggaaggcggagaacauuauggcaucccuagaaaggagcaugcaucccgagcucaugaaguauggacgggaaacugagcagcugaauaaacuuucgcguggcgauggccgccaaaaccuguuuucuuucgacuccgagguccagagauuggauuuuucagggaucgaaccugacaucaagccauucgaggaaaaauguaauaagagguuucucgugaacugccacgaucugaccuucaauauuuuaggacagauaggugacaacgccaaaggcccgcccacaaauguugagccuuucuuuaucaaccuggcucucuucgaugugaagaacaauuguaagauuagugccgacuuucacgucgaccuuaacccacccagcgugcgggagaugcuguggggguccucuacccaguuggcaagcgauggaucaccuaaaggcaguuccccagaaagcuacauccaugguauagcugagucucaacuacgauauauucagcaggggaucuucucaguaacgaauccccacccggaaaucuuucugguugcccgcauugagaaggugcuccagggaaacaucacucauugcgcggaaccuuacauuaaaaauagugaccccgucaagacagcccaaaaagugcacagaaccgcaaagcaggucuguagcaggcugggccaguaucggaugccauucgcuugggccgcucgcccuauauuuaaggauacucagggcucccuugaccuggaugggagauucucucccuuguacaaacaagacucgagcaagcucuccucagaggauauccugaaauuacugagugaguacaagaaaccagaaaagacaaaacuacagauuauccccggacagcucaacaucaccguggagugcguuccuguggaccugucuaauugcauuacgagcuccuauguaccacuuaagccguuugaaaagaacugucagaauauaaccgucgagguggaagaguucguucccgagaugacaaaauacugcuauccuuuuacuaucuacaagaaccacuuguauguguacccacugcaacucaaauaugauucacagaagaccuucgccaaagcaaggaauauugccgucuguguggaauuucgugacagcgaugagucugacgcuuccgcgcugaagugcaucuacgguaagcccgcaggcaguguauucacaacuaacgccuacgcugugguuagccaucacaaucagaacccugaauucuaugaugagauuaaaaucgaacuuccaauacaucugcaccaaaagcaucacuugcucuuuaccuucuaccacgucucuugugagaucaauacaaaagggaccacuaagaaacaggacacgguggagacacccgugggauuugccugggucccgcuguuaaaggacggccggauuaucaccuucgaacagcagcugccuguuuccgcaaaccuaccacccgguuaucucaaccugaaugaugccgagucacgaagacaaugcaacguggacauuaaguggguggauggggcuaaaccucuuuugaagaucaaaagucaucuggaaagcacuauauacacccaggaccuccacguacauaaguuuuuccaccacugucagcugauucagucgggcuccaaagagguccccggagaguuaaucaaguaucugaagugccuucaugccauggaaauucaagugaugauccaguuuuugccaguuauacucaugcagcuguucagggugcuaacaaauaugacccacgaggaugacgucccuaucaacuguacuauggugcugcuccauauuguuucuaaaugccacgaagagggccuggauagcuaccuucgcucauuuaucaaguauaguuuccggcccgaaaaaccauccgcaccgcaggcgcaauugauucaugagacacuggcuacgaccaugaucgccauauuaaagcagucugcagacuuucucagcauuaauaaacugcuuaaguacuccugguucuuuuucgagaucaucgccaaaucaauggcuacuuaccuguuggaagagaacaagauuaagcucccuagagggcagagguuccccgaaacauaucaccacgugcugcauagccuacugcucgccaucauuccacacguaaccauacgcuacgcagagauccccgaugaaagucgaaaugucaacuauucucuggcuuccuuucuuaaacgguguuugacacugauggaccguggauucauuuuuaauuuaaucaacgauuacauuagcgguuucucgccuaaggacccaaaagugcucgccgaguauaaguuugaguuccugcaaacuaucugcaaucaugaacacuacauaccccuuaaccugccuauggcguuugccaaaccgaagcuacagagagugcaggauucaaaucucgaguauucucugagugacgaauacugcaagcaucacuucuuggucggccuguuacucagggagaccuccaucgcucugcaggacaacuacgaaauucgcuauacggcaaucagcguuauuaaaaaucuucugaucaagcacgccuuugauacccgguaccaacauaaaaaccagcaggcuaagauagcccaguuguaucucccauucguggggcugcuacuggagaacauucaaagacuugcaggaagggacacacucuacucuugugcggccaugcccaauagcgcuucccgagaugaguuuccuugcggcuucacuucaccagccaaccgcgguagucugagcaccgacaaagauacagcauaugggucuuuccagaauggccacggaaucaagcgggaagacuccagaggcucauugauccccgagggggcuacuggauuuccugaucaggguaacaccggcgaaaauacgaggcagaguagcacacguuccucuguaucgcaauacaaccgccuggaccaguaugagauucggagcuuacucauguguuaccuguacauagugaagaugaucucagaggauacccuucugacuuauuggaauaaagucuccccgcaggaauugauuaacauccucauucugcuagaggugugccuguuccauuuuagauacauggggaagaggaauaucgcccgaguucacgacgcauggcuuaguaaacacuucggaauagaucggaagucucagacaaugcccgcccuccgcaacagaagcggcgugaugcaagcuaggcugcagcauuuguccucauuagaaucuagcuuuacccugaaucacaguuccacuaccacagaggcggacaucuuccaucaggcccuccuggaagguaacacggcaaccgaggucagccuuacugugcuggacacaauuucuuuuuucacccaauguuuuaaaacacaguugcuaaauaacgaugggcacaauccacugaugaagaagguuuucgacauccaucucgcuuuucugaaaaacggccagucagaggugucccuuaagcacgucuucgccaguuuacgggccuuuauuagcaaauucccuucggcuuucuuuaagggacgaguaaacaugugcgcagccuucuguuaugaagugcugaaaugcuguacuucuaagaucuccagcaccagaaaugaggcgucagcucucuuguaccugcucaugcgcaacaauuuugaauauacgaagaggaaaacauuccugcguacccaccuucagauaauuaucgccguuagucaacugaucgcagauguggccuugucuggcgggucccgguuucaggagagccuauucauuaucaacaauuuugcuaacucagacagacccaugaaggcaacugccuucccagcggaagucaaagaucugaccaagaggauacgcacagugcucauggcuacugcccagaugaaagagcaugagaaggacccugaaauguuaauugaucugcaguacagucuugcaaaaagcuaugccuccacccccgagcugcgaaagacauggcucgacucuauggcuaagauccacguaaaaaauggagauuuuagcgaagccgcaaugugcuacgugcaugucgcugccuugguugcggaguuccugcacagaaagaaacucuuuccaaacggcuguuccgccuucaagaaaauuacgccgaauaucgacgaagagggugcaaugaaggaggaugcugggaugauggacgugcacuacucagaagaggugcugcuugaacuacuggagcaaugcgucgauggauuguggaaggccgagcgguaugaaauaauuucugagaucaguaaauuaaucgugccuauuuacgaaaagaggcgcgaguuugaaaaacugacccagguuuaucguacucuccauggcgcuuacacaaagauccuggagguaaugcacaccaaaaagagacuucuggguacuuucuuccggguggcauuuuauggccagucguucuuugaggaagaggacgggaaggaauacauuuauaaagagcccaagcucacaggauugagcgaaauaucccugaggcuagucaaacuguacggcgagaaguucgggaccgagaacgugaaaaucauucaggacucugauaagguuaaugccaaggaacucgacccaaaauacgcccauauccaagugacguaugucaagcccuacuuugaugacaaagagcuuacugaacgcaagaccgaguucgaacgaaaccacaauaucucaagauuuguguucgaggcuccuuauacacugagcggaaaaaagcagggcugcauugaggaacaguguaaacggaggaccauauuaacuacauccaacaguuuuccauacguaaagaagcgcauccccauuaauugcgagcaacagaucaacuugaaaccuauugaugucgcgaccgacgaaaucaaggauaaaacagcagagcugcagaagcucuguucuagcacugacguggauaugauacagcugcaacuuaaacugcaggguugcguuucagugcaggucaaugccgggccgcucgcuuaugccagagcauucuugaacgacucccaggccaguaaguacccacccaagaaagugagcgagcugaaggauauguuuaggaaauucauccaagcuuguucuauugcguuagaacuaaacgagcggcugaucaaggaagaccagguugaguaucaugaaggacucaaauccaauuuucgugauauggugaaggagcuuucagacauuauccacgagcagauacugcaggaagacaccaugcacagcccuuggaugucgaacacguugcaugucuucugcgccauuucuggcacaaguuccgaucgcgguuacggcagcccccgauacgcagagguguga

SEQ ID NO: 55430 - RNA, 5598 nt, Artificial Sequence
  derived and/or modified sequence opt3 from DOCK1__Homo_sapiens__NP_001371
augaccagaugggugcccacaaagagggaggaaaaauacggcgucgccuucuauaacuacgacgcucggggggcagaugagcugagccuccagaucggagacacuguucacauucuugaaacguaugaggguugguaccgcggcuauacccugcgaaagaaauccaagaaagggauauuuccugccucuuacauccauuugaaggaagcgauuguggagggaaagggccaacacgagacaguaaucccaggugauuuaccgcugauucaggaagugacuaccacacuacgugaguggucaaccaucuggagacagcucuauguccaggacaauagggaaauguuccggagugugcgccauaugauauacgaucugaucgaguggagaagccaaauucuuuccgggacucugccccaggacgaguugaaagaacucaagaaaaagguuacagcuaaaaucgauuacggaaacaggauucuggaccuggaucucgugguccgggacgaggauggcaauaucuuagacccugaacugaccucuacgauaucgcuuuuucgcgcccacgagauugcaucaaagcagguggaagagcgauugcaggaggaaaagagccaaaaacagaacaucgauauuaauagacaggccaaguucgcugcaacuccaagucuggcccuauuuguaaaccucaaaaauguugugugcaagaucggcgaggacgcugaaguccugaugucccuuuaugaccccguggagucuaaauucaucagcgaaaacuaccuggugaggugguccucaaguggguugccuaaggauauugaccggcuccauaaucugcgugccgucuuuaccgauuuaggaagcaaagaccugaagcgcgagaagauaucuuucguuugucagaucgugagaguagguaggauggagcuccgggauaacaauacacgaaaacuuacuuccggccugcgcagaccauuugggguggcggucauggacgugaccgauauuaucaacggaaagguugacgaugaagacaaacaacacuucauacccuuucagccuguggcaggcgagaaugauuucuugcagacagucauuaacaaggugaucgccgcuaaagaaguaaaucacaagggucaagggcuauggguuacccugaagcuccugccaggagacauccaucagauuaggaaagaguuuccgcaccuuguggaccggacgacugccgucgcacgcaagacaggcuuccccgaaaucauuaugccuggcgaugugagaaacgacauauaugucacccuggugcagggggauuucgacaaaggaucaaagacuacagcuaaaaacguugaggugaccguaagcgucuacgaugaggacgguaagagguuggaacaugugaucuuuccaggcgccggggaugaggcgauuagugaauauaagucuguuaucuacuaucaggugaaacaaccccguugguucgagacggucaagguggccaucccuauugaggacguaaaucggucccaccuccgauuuaccuucagacacaggagcucgcaggauucuaaagacaaguccgaaaaaauauuugcacuggcuuucgugaaguuaaugcgcuacgauggaacaacucugcgggacggcgagcaugaucuaaucguuuacaaggccgaagcuaaaaagcucgaggacgccgcaaccuaucugucacuuccaaguacaaaagccgaauuggaggagaagggucacagcgcuacugggaaauccaugcagucucugggcagcugcaccauuucaaaggacaguuuucagaucuccacacucgucuguagcaccaaacugacucaaaacguggaucuucugggauugcucaaguggagaucuaauacgucacuguuacagcagaaccugaggcagcuaaugaagguggacggcggggaagucguuaaauuccuccaagauacacuggacgcgcuuuuuaauauuaugauggagaacagugaaagcgagaccuucgauacuuugguguuugacgcacugguguucaucauaggacucaucgccgaucgcaaguuucagcauuucaaucccguacuggaaaccuacauuaaaaagcacuucuccgcuacauuagccuauaccaaacugacuaagguccuuaagaacuacguggacggugcagagaaaccgggcguuaaugagcaguuguauaaggccaugaaagcucucgaaucuaucuuuaaguucauugugcgaucgcggauccuguuuaaccagcuauacgagaauaaaggggaagccgauuucgucgagagccugcuccaacuguuucguuccauaaacgacaugaugucaaguaugucugaucagacagugagaguuaagggagcagcgcuuaaguauuugccuacgauugugaaugacguaaaacuggucuucgaucccaaggaauuaagcaaaauguuuaccgaguucauccucaacgugccaaugggccugcuuacuauucagaagcuguacugcuugaucgagauagugcauuccgaccucuuuacacaacacgacuguagggaaauccugcuaccuaugaugaccgaucagcugaaauaccaccucgagcgccaggaagaccuggaggcuugcugucagcuuuugucacauauucuggaggucuuauaucggaaggauguuggucccacacaaagacacgugcagaucauuauggaaaagcuccugaggacuguaaaucgaaccgugaucagcauggggcgcgacucugagcuuauaggcaacuucgucgccugcaugacggcaauucugcggcagauggaagauuaccauuaugcccaccuaaucaaaaccuuuggaaagaugagaacagacgugguugauuuccucauggagacuuuuaucauguucaaaaaccugauuggcaagaauguguacccauucgacugggucaucaugaacauggugcagaauaaaguuuuuuugagggcuauuaaccaauaugccgauaugcugaauaagaaauucuuagaccaggcaaacuuugaacuccagcuguggaauaacuacuuccaccuugcuguggccuuucugacccaggaguccuugcaacucgagaauuucaguagcgcgaagcgugccaagauacugaacaaauauggggauaugcgccggcagaucggauuugaaauuagagacaugugguacaaucuaggucagcauaagaucaaauucauucccgagauggucggcccuauccuggaaaugacacuuauaccagagacugaacucaggaaggcuaccaucccgauuuuuuucgacaugaugcaaugugaguuucacucuacgcgauccuuccagauguucgagaacgaaaucauuacaaaacuggaucaugagguagaagggggacggggcgacgagcaguacaagguguuguuugauaagauccuguuagaacacugccgcaaacauaaguaucucgcaaaaaccggugagacuuucguuaagcugguggucagacuuauggagaggcuguuggacuaccggacaauaaugcacgaugaaaauaaagagaaccgaaugucauguaccgugaauguacucaacuuuuauaaggaaauugagagagaggaaauguacauccgcuaucuguacaagcuaugcgaccugcacaaagagugcgauaacuauacugaagccgcuuacacccuucuccugcaugccaaguuguuaaaauggagugaggacgugugugucgcacaccugacacagagggauggguaccaagcgacgacccagggccagcucaaggaacagcuguaucaagagaucauucauuacuucgacaaaggaaagaugugggaggaagccauagcucuuggcaaggagcuggccgaacaguaugagaaugaaauguuugauuacgagcaguugagcgagcuacugaaaaagcaggcacaauucuaugaaaacaucguuaaagugauucgucccaagccugacuacuuugcugugggguauuacggacagggcuucccaacuuuucuccgggguaaagucuucaucuacagagggaaggaguaugaaaggcgcgaggauuuugaagcccgacugcuuacacaguuccccaaugcagagaagaugaaaaccacaucgccuccaggagacgacauuaagaacucccccggccaguacauccaaugcuuuacugugaaaccgaaguuagaucugccuccaaaauuccacagacccguuucugagcagauaguaagcuucuaucgggugaaugaaguccagagguuugaguacucacgcccuauccguaagggugaaaaaaaccccgacaaugaguucgccaacauguggauugagagaaccaucuauacgacagcuuacaagcucccaggcauuuugcggugguuugaagugaagaguguuuucaugguggagaucuccccucuggaaaaugcgauagagaccaugcaacucacuaacgauaaaauuaauucuaugguccagcagcaucuggacgaucccagccuuccaaucaacccgcuguccauguugcuaaaugggaucguggacccugccguaaugggaggcuuugcaaacuaugaaaaggcuuucuuuaccgauagguaccugcaggagcaccccgaggcccacgaaaaaauugagaagcucaaagacuuaaucgccuggcaaauaccauuccuggcugaagggauucgcauccauggagauaaggucacagaggcacuucgacccuuucacgaaagaauggaggccuguuucaagcagcugaaagagaagguggaaaaagaguacggcguucggauuaugccuucaagccucgacgauaggcgcgguaguagaccaaggucuauggugcgguccuuuacuaugcccagcucgucacguccuuugucugucgcgaguguguccagccugucuagcgacuccaccccgucacgcccagggagugauggauucgcucucgaaccccugcuuccuaagaaaaugcauagccgaucucaggacaagcuagacaaggaugaccuggagaaagaaaagaaagauaagaaaaaggagaagagaaauuccaaacaccaggagaucuuugaaaaggaguucaaaccaacagacauaucauugcaacagagugaagccguuauuuuaagcgagacgaucuccccccugaggccucagcggccgaagucucaggugaugaacgucaucggcucggagcgcagauucagcgugucacccuccaguccaucuagccaacagaccccucccccaguaacuccuagggcaaaacucuccuuuucaaugcagucuagccuggaacuuaacgguaugacaggcgccgauguggcugacguucccccaccgcugccucucaaggggagugucgcagauuauggaaauuugauggagaaccaagaccugcuaggcucccccaccccacccccuccacccccucaccagcggcaucugccgccaccccucccuagcaaaacucccccaccucccccaccuaagacaacccgaaagcagacgucuguggauucagggauugugcaguga

SEQ ID NO: 55431 - RNA, 5493 nt, Artificial Sequence
  derived and/or modified sequence opt3 from DOCK2__Homo_sapiens__NP_004937
auggcccccuggagaaaggcugacaaagagaggcacggcguggcaaucuacaacuuccaggggagcggagccccucaacugucccuccagauuggugaugucguucggauacaggaaaccugcggcgacugguaucgcggguaccuuaucaagcauaaaaugcugcagggaauuuuuccaaagucuuucauccacauuaaagaggugacaguagaaaagcgacguaauacugagaacaucauaccggcggaaauccccuuggcucaagaggugacgaccacauuaugggaguggggcucaauuuggaagcagcuguaugucgccaguaaaaaggaaagauuucuacaggugcagagcaugauguacgaucucauggaguggaggucccaacugcuuucugguacucugccuaaagacgaauugaaggagcucaaacagaagguuaccucgaagaucgauuaugggaauaaaauucuggagcuggaccucaucgugcgggaugaagacggaaacauauuagauccagacaauacaucagucauuagccuguuccaugcacacgaggaagccaccgauaagaucacugagcgcauuaaagaagagaugaguaaggaccagcccgauuacgcuauguauuccagaaucucuagcuccccuacacauucacuuuacguguuuguaaggaacuucguuugucggaucggcgaggacgcagaauuguuuaugagucuguacgacccaaauaaacagaccgugauuagcgagaacuaucuaguccgcuggggcucucgaggguuccccaaggaaauagagaugcucaauaaccugaaagugguguuuacggaucuuggaaauaaggaccugaacagagauaagaucuacuugauuugccaaaucgucaggguugguaaaauggaccucaaggauacuggcgccaaaaaguguacccaggggcugcggcguccuuucggaguggcuguaauggacauaacagauauuaucaaaggcaaggccgaauccgacgaggagaagcagcacuuuaucccauuccacccggugacugcggaaaaugauuuuuuacauucacugcucgguaaagucauugcaagcaagggggacaguggaggccaaggccuuugggugaccaugaaaaugcugguuggggauaucauucagauacgcaaggacuauccccacuugguggacagaacaaccgucguggccaggaaacuaggauucccugagaucauuaugccaggugauguacggaacgacaucuacaucacgcugcuccagggcgauuucgacaaguauaauaagacuacacagcgaaacguugaagugauuaugugcgucugugcugaggaugggaaaacccugcccaacgccauaugcgugggagcaggcgacaagccuaugaaugaauaccgcucugucguguauuaccaaguuaaacagccaagauggauggagacugugaagguagcuguccccaucgaggauaugcagaggauucaucuucgguuuauguuccgccacagauccagccuggaaucgaaagacaagggugagaagaacuuugccaugucuuacgugaaauugaugaaggaagaugggacaacccuccacgacggcuuccaugaucugguuguguuaaaaggagacuccaagaaaauggaggaugcgucagccuaucugacgcuaccgaguuacaggcaccaugucgagaauaagggcgcaacccucagccguuccucuagcucaguggggggacugaguguauccagccgggacguguuuucuaucucaacacuuguuuguaguacuaaauugacccagaacgucggucugcucggccugcuuaaguggcgaaugaagccucaacuguugcaggaaaaucucgagaaacugaagauuguggacggggaagagguggucaaauucuuacaggauacacuggacgcucuauuuaacaucaugauggaacacagccaguccgaugaguaugacauacucguuuucgaugcccugaucuacauuaucggacuuauugcugacagaaaguuucaacauuucaauacuguguuggaggccuauauccagcagcacuuuucugcaacccuggccuacaaaaagcucaugacagugcugaagaccuauuuagauacuucgagcaggggcgaacagugcgagcccauacugcgcacgcuuaaagcuuuggaauacguauucaaguuuauuguccgguccagaacacucuucucacaacuguacgaggguaaagaacagauggaguucgaggaaaguaugaggcgccuauuugagucuaucaacaaucugaugaagagccaguauaaaaccacuauucuccugcaaguggcggcacuuaaguacaucccauccguuuugcacgacguggaaauggucuucgaugccaagcuguuaucacagcuccuguaugaguuuuacaccuguauaccucccgugaaacuucagaagcagaaaguucaaagcaugaacgaaaucgugcagucuaaucuguucaagaaacaggagugccgagacauuuugcucccaguaaucacaaaggagcugaaggaacuacuggagcagaaagaugacaugcaacaucagguccucgaacggaaguauuguguggagcugcuuaacuccauuuuggaggugcugaguuaccaggaugcugccuuuaccuaucaccauauccaggaaauaaugguccaauuacuccguacuguuaauagaacagugauuacgauggggagggaccacauccugaucagccacuucguagcaugcaugaccgccauucuuaaccagaugggcgaccagcauuacucuuuuuacaucgagacuuuccaaacauccucagaacugguggauuuucuaauggagaccuucauuauguuuaaagaccucauaggaaagaaugucuaucccggcgauuggauggcuaugaguauggugcagaaccgcguuuuccugcgggccaucaacaaauuugcagaaacaaugaaucagaaguucuuggagcacacuaacuucgaguuucagcuguggaauaacuacuuccauuuagcgguggcuuuuauuacccaagacagccuccagcuggaacaguucucgcacgccaaauauaauaagauccuuaacaaguacggggauaugagaaggcugauuggauuuuccauccgagacaugugguauaaauugggucagaauaagauaugcuucaucccuggcauggucgggccaauucucgagaugacgcugaucccggaagcagagcuacgcaaagccaccauucccaucuuuuucgauaugaugcugugugaauaccaacggucuggagacuuuaagaaauucgagaacgagauaauucuuaagcucgaucaugaaguggagggcgguagaggggacgaacaguauaugcagcuguuggagagcauccugauggaaugcgcugccgagcacccuacaaucgcaaagucaguugagaauuuugugaacuuagucaaaggccuccuggaaaagcuucuggauuacaggggaguaaugacugacgagaguaaagacaaucguauguccuguaccgugaacuugcucaauuucuacaaggauaacaaucgcgaagagauguauauucgguaccuguauaaacuaagagaccugcaccuugauugcgacaacuacacagaggcugccuauacucuccuguugcauaccugguuacugaaguggucugaugaacagugugcgagccaaguuaugcagacgggccagcagcacccacaaacacauaggcagcucaaggagacccuguacgaaacuauaaucggguauuucgacaaaggaaagaugugggaggaagccauuucccuuugcaaagagcuggcugagcaguacgaaauggagaucuuugauuacgaauugcuaucacaaaaccugauucagcaggcaaaguucuaugagagcaucaugaaaauacuccgacccaagccugacuacuuugccgugggcuauuacggucagggguucccaaguuuucugcggaauaaggucuucaucuaucgcggaaaagaauacgagagaagggaggauuuucaaaugcagcuuaugacacaguuccccaacgcugaaaagaugaauaccacuucugccccgggcgacgaugugaaaaacgcaccuggucaguauauucaauguuuuaccguacagccaguguuagacgagcacccccgguucaagaauaaaccuguccccgaucagaucauuaacuuuuacaaguccaauuacguucagcgauuccauuauagcagaccagugcgcaggggcacaguggacccugaaaacgaguuugcgucgauguggaucgaacguacgucauucgucaccgccuacaagcugcccgggauacuccggugguucgaggugguucacaugucucaaacuacaauuaguccauuggagaaugcuaucgaaaccauguccacagccaacgagaaaauccugaugaugauuaaucaguaucagagcgacgaaacucucccgaucaacccucugucuaugcuucugaauggaauaguagaucccgcagugaugggcggguuugcuaaguacgagaaagccuucuuuaccgaggaauaugucagagaccacccagaggaucaagacaaguugacgcaucuaaaagaucugauugcauggcagauccccuuccucggagccggcauuaagauccacgaaaaaagggugagcgacaacuuacgcccuuuucaugaucgaauggaggaaugcuucaagaaucugaagaugaaaguugagaaggaguacggugugagagaaaugccagacuuugaugaccggagggucgggcgcccccguuccaugcuuagaucauaucggcagaugaguauaauuagccuggcuucuaugaacuccgauuguucaacaccuaguaaaccgaccagcgaguccuucgaccucgaauuggcgucuccaaagacucccaggguggagcaggaagagccuaucucgccaggaagcacccugcccgagguaaaacuccgccgaucaaagaagagaacaaaacgguccagugucguguuugccgaugaaaaggcagcugccgagucugaccugaaaaggcuuagccgcaagcacgaauucauguccgacacuaaccuaucagagcacgccgcuaucccucugaaagcaucuguuuugagccaaaugaguuuugccucccagagcaugccgaccauucccgcguuagcucugucuguggccggcaucccaggucucgaugaagcaaauacaucaccuagacugucccagacguuccuucagcugagugacggcgauaagaagacccucacuaggaaaaaggucaaccaauuuuucaaaacaauguuggccagcaagucggcugaggaggggaaacagauucccgacucucuguccaccgaucuauga

SEQ ID NO: 55432 - RNA, 6093 nt, Artificial Sequence
  derived and/or modified sequence opt3 from DOCK3__Homo_sapiens__NP_004938
auguggacccccacagaagaagaaaaguacggcguggucaucugcuccuucaggggguccguuccucagggacuggugcucgaaauuggugaaacuguacaaauacuugaaaaaugugaaggcugguauagaggggugucuacgaagaaaccaaacgucaagggaaucuuuccggccaauuacauucaccugaaaaaggcuaucgugucaaaccggggccaguaugagaccguugugcccuuggaagacaguauugucacagaggugacugcaaccuuacaggaaugggccagccuguggaagcagcuauacguuaaacacaagguugaucucuucuauaaacugcgccacgugaugaaugagcuuaucgaccugcgacgucaauugcucuccggucaucugacacaggaucaggucagagaggugaagaggcacauaaccgugcggcuggacugggggaacgaacaucucggauuagaucuggucccucgcaaagacuuugagguuguggauucugaccagaucucgguaucagaucuuuacaagaugcacuugagcaguagacaauccgugcagcagucuacuagccaggucgacacaaugaggccacggcacggcgaaaccugccgcaugcccgugccucaucacuucuuucugucccuaaagucauucacguauaauacuauuggcgaggauaccgacguauuuuucagucucuacgauaugcgagaagggaaacaaaucagcgagagauuucuggugaggcuuaacaagaauggagguccacggaaccccgagaaaauugaacguaugugugcgcuguucacagacuugucuuccaaggacaugaaacgcgaucucuacaucgucgcucaugugauaagaauuggcaggaugcuguuaaaugacucaaagaaagggccuccacaucugcacuaucggcgaccguacggaugcgccguacucagcauccuugauguucugcagaguuugacugaggugaaggaagagaaggacuuuguccuaaaaguguauaccuguaacaaugaaucugaguggucccagauucaugagaacaucauccgcaagagcucggcaaaauacucugcccccuccgcuucacacggccugauuauaagucuccaacugcuuagaggugauauggaacagaucaggcgggagaauccuaugauuuucaaccgcgggcuggcaaucacaagaaaguugggauuuccagacgucauaaugcccggcgauauuaggaaugaccucuaucugaccuuagaaaaaggcgauuucgagcgugggggaaagagcgugcagaagaacaucgaaguuacgauguacgugcuguaugccgacggugagauccuaaaagauugcauuucccucggcucuggggagccuaaccggagcucauaccauaguuucguacuguaccacuccaauagcccacgauggggagaaaucauuaaacuucccauaccgaucgacagauuuaggggcucucauuugcgcuucgaguuucggcacuguucaacuaaagacaagggugagaagaagcuguucggguuugcuuucaguacacucaugagagaugacggcaccacucugagcgaugacauucacgagcuuuaugucuacaagugcgaugagaacuccacauuuaauaaccaugcccuguauuugggacucccuuguugcaaagaagacuacaauggcugucccaacaucccaucuucgcugaucuuccagaggagcaccaaggaguccuuuuucauuucaacgcaauuaaguucuaccaaacugacacagaauguggaucuacucgcgcugcuuaaguggaaagcauuuccugaccgcauaauggauguuuuggggcgacugcggcacgugagcggagaagagaucgucaaguuccuccaggacauucuggauacuuuauuugugauccuggacgauaacaccgaaaaguauggucuuuugguauuccagucccucguguucauuaucaaucugcuacgugacauaaaauacuuucauuucagacccguuauggacacauauauccaaaagcacuuugccggcgcucuggccuacaaagagcucauuaggugccugaagugguacauggauugcucagcagagcuuauccgccaggaccacauucaggaagcuaugcgggccuuggaguaucuguucaaauuuaucguccagagcagaauauuauacucuagggcgacuugugggauggaagaggaacaauuccgauccaguauucaggagcucuuucagagcauccgcuucgugcugucucuugauucccggaacucagagacccuguuguuuacacaggccgcacuccugaauaguuucccaaccauuuuugacgaacuacugcaaauguucacugugcaggaggucgcugaauuuguuagaggaacgcucggcagcaugcccucgacagugcauaucggucaguccauggaugugguaaagcugcaaucuauagccaggaccgucgacagccgucuuuucucauucagugagucccgccggaucuugcugccugugguuuuacaccauauucaccuccaucugagacagcagaaagaacuucugaucugcucugggauucuaggcagcaucuuuuccauagugaagacuucaagccucgaggcugaugucauggaggaaguggagaugaugguugaaagucuguuggacgugcuguuacagacccuccugacaauuaugucuaagucccacgcccaagaggcaguaaggggacagcgauguccacagugcaccgccgagaucacuggcgaauaugucagcugucuucugucguugcuccggcagaugugcgauacacacuuccaacaucugcuagacaacuuucagucaaaagaugagcugaaggaguuccuucucaaaaucuuuuguguguuccgcaaucugaugaagaugucuguguuuccgagagacuggauggucaugagguugcugacgaguaacauuaucguuaccacugugcaguacuuauccagcgcucuccacaaaaauuucacagagaccgauuuugacuucaagguauggaacucuuauuuuagccuggcggugcuuuucauuaaccagcccucccugcaauuggaaauaaucacaucagcaaagcggaaaaagauucucgacaaauacggggauaugcgagucaugauggccuaugagcuguucaguauguggcagaaucuaggagagcauaagauccacuuuauuccugguaugaucggcccauuccugggggugacucuuguuccccagccugaagugagaaacauaaugaucccaauuuuucaugacaugauggauugggagcaacgcaaaaauggaaacuucaagcaggucgaagcugagcucaucgacaagcuggauagcauggugucugaaggcaaaggugacgaguccuacagggaguuguuuucauuacugacccaacucuucgggcccuacccgagucugcuugaaaagguugagcaggaaacguggcgugagaccggcauuagcuuugugacauccgucacucggcugauggaaagauugcuagauuauagggacugcaugaaaggagaggagaccgaaaauaagaaaaucggcuguacaguaaaccugaugaauuucuacaagucugagauaaacaaggaagagauguauauucgcuacauccacaaacucugcgauaugcaucugcaggccgagaauuauacugaagcagccuuuacccuuuuacuguacugugagcucuugcagugggaagaccgaccucugagagaguuccuccacuauccaucgcagacggaauggcagcggaaggaggggcugugcaggaaaaucauucacuacuuuaacaagggaaaaagcugggaguucggcauaccccuuugccgcgaacuggcuugucaauacgagucauuguaugauuaccagucccuaaguuggauccguaagauggaagccucuuauuacgacaauauuauggagcagcagagacuggaaccugaguuuuuccggguggguuucuaugggaggaaauuucccuucuuucuccgcaacaaggaguacguuugccgaggacaugacuaugaaagauuagaggcauuccaacagcggaugcugagcgaauuuccacaggcgguggcuaugcagcacccuaaucaccccgaugacgccauccuucaaugugaugcacaguaccugcagauuuacgccgucacaccaaucccggacuauguggauguacuccaaauggacagggugccugaucgcgucaaguccuucuacagaguuaacaaugugaggaaauuucgguaugaccgucccuuccauaagggcccaaaagauaaggagaacgaauuuaaaucauuguggauagagcgcaccacucugacacucacccacucucugcccgguaucagccgaugguucgagguggaaagaagggagcuugucgaagugaguccucuagagaacgcuauucagguuguagagaauaagaaccaggaacugcgguccuugaucagccaguaccaacauaaacaggugcacggcaauauuaacuuacugucuaugugccucaauggggucaucgacgccgcagugaacggaggcauagcucgcuaucaggaggccuuuuucgauaaagacuacauuaauaagcauccaggggaugcggagaagaucacucagcugaaggagcuuaugcaagaacagguucacgugcugggagucggccucgccgugcacgagaaauuuguacaucccgagaugagaccuuugcacaagaagcugaucgaccaguuccagaugaugagggcuucacuauaucaugaguucccgggucuggacaaacucuccccagcauguagugggaccagcacaccccggggaaacguccuugccucgcacucuccuauguccccagagagcauuaagaugacgcaccgacauucacccaugaaucugaugggcaccgguagacacaguucuuccagcuuaucaagucaugcuagcuccgaagccggcaacauggugauguugggggauggaucuaugggcgacgcaccugaggaucuguaccaccauaugcaacucgcguacccgaauccccgcuaucaggggagcguuacuaacguguccguccugucaucuagucaggccucgccaagcuccucuucacuuagcuccacacacagugcuccuucucaaaugaucaccagcgcccccucauccgcaaggggaaguccaagccugccugacaaauaccggcacgcucgugaaaugaugcucuugcugcccacauauagagauaggccaucuuccgccauguacccggcagccauauuagagaauggccagccucccaacuuucagcgcgcucuauuccagcaagugguuggugcgugcaagccauguucagaccccaaucugagcguggccgagaaagggcauuauucgcuccacuuugaugcauuccaucacccucuuggagacacuccacccgcucugccugcccggaccuugcgaaagucuccgcugcacccaauucccgccaguccuacgagcccacagagcggccucgaugguucaaacuccacacugucuggcagcgcuaguuccggggucagcucucuuucagaaaguaacuuuggacauuccagcgaggcaccaccuagaaccgacacuauggauucuaugcccucgcaggccuggaaugcggacgaagaucucgagccaccuuaccugccggugcacuauucauugagcgaauccgcuguacuggacaguaucaaggcccagcccugcaggucucauagcgcaccaggcugugugauuccucaagaccccauggaucccccugccuuacccccgaaaccauaccacccucgccuacccgcucuggagcaugacgaggggguucuccuucgggaagagaccgaaagaccacguggacugcacaggaaggcacccuugccuccgggcuccgccaaagaggagcaggcgcggauggcuugggaacacggucgcggggagcaguga

SEQ ID NO: 55433 - RNA, 5901 nt, Artificial Sequence
  derived and/or modified sequence opt3 from DOCK4__Homo_sapiens__NP_055520
auguggauccccaccgagcacgaaaaguacggcguggucauugccagcuuccgggggacaguuccuuauggacugucccucgagauaggugacacugugcagauccuugaaaagugcgauggcugguacaggggguuugcucugaagaacccaaauauuaaaggaaucuucccgucuucauauguacacuugaagaacgcuugugugaaaaauaagggccaauuugagauggucauucccacggaagacagugugaucaccgagaugacaagcacuuuacgggauugggguaccauguggaagcagcuguacguucgcaacgagggggaccuauuccaccgacucuggcauauaaugaaugaaauccuggaucuucgucggcaagugcuggucggacacuugacacaugacaggaugaaagaugugaagcggcacauuaccgcccgccucgacuggggcaacgagcagcugggccuggaucucguaccuagaaaagaauaugcgaugguugacccagaggauaucuccauuacugaguuauacaggcugauggaacaccggcaucgcaagaaagacacacccgugcaggcuucuucgcaccaucuuuuuguccagaugaagucauugaugugcagcaaucugggggaggaacuagaggugaucuucagucucuuugauuccaaggaaaaccgaccuauaucugagagauucuuucugaggcuuaaucggaacggacugccaaaagcccccgacaagccugagcgucacuguagcuuguucguggaccucgguuccucagaacugcgcaaagauauuuauaucaccguccacauuaucagaaucggcaggaugggggcaggagagaagaaaaaugccugcaguguucaguaccggcgaccauuuggcugugcuguguuaagcauugcagaccugcucacgggugaaacuaaggaugaccuuauacugaaaguauacaugugcaacaccgagucugaaugguaucagauccaugagaauauuaucaagaaguugaacgcccgcuacaaucuaacaggguccaacgcuggacuggccgugucacuccagcugcuucacggcgauauagagcagauuagaagggaauauagcagugucuucucucauggcguguccaucacucggaaacugggguuuagcaacaucauuaugccgggagagaugcgcaaugacuuguacaucaccauugaaagaggugaguucgaaaagggcgggaaaucgguugcgaggaacguggaggucacaauguucauaguggauucuuccggacagacccucaaggacuuuaucucauucggcaguggugagcccccugcaagcgaauaucacuccuuuguacuguaccauaauaacucuccacguuggagcgaguuacugaaacuacccauuccuguugauaaguucagaggggcccacauccgauuugaguucagacacuguucaacgaaggagaaaggcgagaagaaacucuuuggauucaguuuugugccacugaugcaggaagacggcaggacucuucccgaugggacacaugaguugaucguccacaagugcgaagagaauaccaaccugcaagacacuacacgcuaucucaaacugccguucuccaagggaauuuuucuugguaauaacaaucaggcuaugaaggccaccaaagaguccuucuguauaacgucuuuucugugcucaaccaaguugacacagaacggcgacaugcucgaucuguuaaaauggcggacucauccugacaagaucaccgggugucugaguaaacuaaaggagauugauggaagcgagaucgugaaguuccuccaagacacacuggauacucuuuucggcauuuuggacgaaaauucccagaaauacgguucuaaggucuuugauucgcuggugcacaucauaaaccuccugcaggacagcaaauuccaccauuuuaagcccguuauggauaccuacaucgagucccacuucgcaggggcuuuagccuauagagaccugauuaaagugcuuaagugguacguagauaggaucacagaagcggagcgccaggaacauauucaagaggucuugaaagcccaggaguauaucuuuaaguacauagugcagucacgaagacucuucagucuggcaaccggcggacagaaugaagaggaauuucguugcugcauucaagagcuacugaugucuguuagauucuuucucagccaggaauccaagggcucaggggcucugagccagucucaggccguguuccuuuccaguuuuccagcugucuauagcgaguugcugaaauuauucgacgugagggagguagccaaccucgugcaagauacucugggaucucuuccuacgauccugcacguugacgacuccuugcaggcaauuaagcuccaguguaucgguaaaacagucgaaucacagcuguacaccaaucccgauagucgcuauauacuacugccaguggugcuccaucaucugcacauccaucuucaagagcagaaggacuugauuaugugcgcccggauccugagcaacgucuuuuguuuaauuaaaaagaacucguccgaaaagucuguucucgaggagaucgaugugauaguggcuagccugcuugacauucugcuaagaacuauccucgaaaucaccucaaggccccagccuaguuccucugcgaugcgauuccaauuccaggauguaacaggcgaguuugucgcaugccuguugagccuguuacgccagaugaccgaccggcacuaccagcaacuccuggauuccuucaauacuaaagaagaacuuagagacuuucuguugcagauuuucacaguguuuaggauccucauucguccagaaauguucccgaaggauuggacgguuaugcgccugguggccaacaaugucauaaucaccacugugcuauaccugucagacgcacuucggaaaaacuuucucaaugagaacuucgauuauaagauuugggacagcuacuuuuaucuggccguuaucuucauuaaucaguugugucugcaguuagagauguuuacacccaguaaaaagaagaaagugcucgaaaaguacggggauaugagaguaaccaugggaugcgagaucuucucuauguggcaaaaccugggcgaacauaaacuucacuucauaccugcacugaucgguccauuuuuggaggucacacucauuccccagccugaccugaggaaugugaugaucccaauuuuccaugacaugauggauugggaacagcgacgguccgggaacuuuaagcaaguggaggccaaacuaaucgacaagcuggauagccuuaugucggagggcaagggagacgaaacuuaucgcgaacucuucaauucaauacuguugaaaaagauugaaagagagaccuggagggaaucuggcgucaguuuaaucgcuacgguuacccggcugauggagcgacuccuggauuacagagacuguaugaaaaugggggagguggauggaaagaaaaucggcugcacaguaucccuucugaacuuuuauaagacugaauugaauaaagaggaaauguacauucgcuacauacacaagcuauaugaccugcaccucaaggcccaaaacuucaccgaggcagcguacacacugcuuuuauaugaugagcugcucgaauggagcgacaggcccuugcgugaguuucugacuuacccgaugcagaccgaauggcagcggaaagagcaucuccaccugacgaucauucaaaauuucgauagagguaaguguugggaaaacgggaucauucuuugcaggaaaaucgcugagcaguaugagucuuacuaugacuaccgcaaccugagcaagaugcgaaugauggaagccuccuuguacgacaaaauaauggaucagcagagacuagagccugaauuuuuccgggugggauuuuauggcaagaaguucccauuuuuccugaggaauaaagaguucgucugucgcggucaugacuacgaacgucucgaggcauuucaacagagaauguuaaacgaguucccccacgccaucgcuaugcagcacgccaaucagccugaugaaacaauuuuucaagcagaggcucaguaucugcagaucuacgccgugacccccauuccagaaucacaggagguucuucaacgggaaggcgugccugacaacaucaagaguuucuauaaagucaaucauauauggaaguuuagguacgaucgccccuuccacaaagggacuaaggacaaggagaacgaguuuaaaagccuguggguggaacgaacaucucucuauuugguucagucccugccaggaauuucaagaugguucgagguggaaaagcgggaggucguagagaugaguccgcucgaaaaugcgaucgaggugcuggaaaacaaaaaucagcagcuuaagacccuaaucagccaaugccagacuaggcagaugcaaaacauuaauccucugaccaugugcuugaacggcguuaucgaugccgcugugaaugggggagucucccgcuaccaggaggcauuuuucgugaaagaauacauauuaucucaucccgaggacggcgagaagauugccagacugagggaacucaugcuggagcaggcucagauccuugaauuuggucuggccguacacgagaaguucgugccacaagauaugcggccccuccauaaaaaguuggucgaccaguuuuucguuaugaaaucgagccuggggauucaggaguucucagcauguaugcaggcguccccugugcacuuuccaaacggaaguccccgugugugccgcaauucugccccugcuagcgucuccccggauggcacacgagugaucccaagaaggucaccccuaucuuauccugccguuaaccgguacagcaguuccagccugucuucacaagcauccgcugagguaaguaacauaacgggucagagcgagucgucugacgaaguguucaauaugcagccaucccccagcaccucaagucucucuuccacucacagcgccucaccuaacgucacaaguagcgcaccguccucugcccgcgcuagcccccuucuguccgauaagcauaaacacucaagagaaaauucuuguuuaaguccaagggaacggccuugcucggcgauuuaucccaccccaguggagccuagccagcgaauguuguuuaaccauaucggcgacggggcccugcccagauccgacccaaaucucucugcaccggaaaaggcuguuaacccuacacccucaagcuggucccuggauaguggaaaggaggccaaaaauaugucugacagcggcaaacuuaucucaccacccgugccuccacgccccacucaaaccgccuccccugcuaggcacacgacaagugucagcccgucuccagcagggcggagcccccugaaaggaucagugcagagcuucaccccuucgcccguagaguaccacucuccaggccucauuaguaacuccccugucuugagcgguucauauuccucugggaucagcagucugucccguuguagcacuucugaaaccucaggauuugagaaucaggugaacgaacaaagugcccccuuaccaguuccugugccgguccccgugccauccuacggcggugaggagccuguuagaaaggaaagcaaaacacccccaccuuauucuguguacgagaggacucuacgccggcccgucccgcugccacauucgcucucaauuccugugaccagcgaacccccagcgcuucccccuaagccgcuggcugcccgauccagucacuuggagaauggcgcaagaaggacagaucccgggccacgcccucggccccugccuagaaaaguaucucagcucuga

SEQ ID NO: 55434 - RNA, 5613 nt, Artificial Sequence
  derived and/or modified sequence opt3 from DOCK5__Homo_sapiens__NP_079216
auggcacgauggauccccaccaagaggcagaaauacggcguggcuauuuauaacuacaaugcaagccaggaugucgagcugucccuccagauaggggauacaguucacauccuugaaauguaugagggaugguaccgggguuauacucugcagaacaagucuaaaaagggcauuuucccugaaacguacauccauuugaaagaggccaccguggaagacuuagggcagcacgagacaguaauuccaggagagcugccgcuagugcaagaacucacuucaacccugcgcgagugggcggucaucuggcgaaaacuuuaugugaauaacaagcugacauuguuucgucagcuccagcagaugaccuacagucugauagaauggagaagccaaauccuguccggcacucuccccaaagaugaguuagcugagcugaagaaaaagguuacagccaaaauugaccaugguaauaggaugcuuggguuggaucuggugguccgggacgauaacggaaauauccuagacccugaugaaaccucuacgauugcacucuucaaggcccacgagguggcuucgaagcgcaucgaagagaaaauacaggaagagaagucaauucugcagaaccuugaccugagaggccagagcaucuuuaguacuauucauaccuacggcuuguauguaaauuucaaaaacuuuguuugcaauaucggggaggaugcagaacucuucauggcccuguacgacccagaucaauccacauuuaucucugagaacuauuuaauuagguggggaagcaaugguaugcccaaggaaauagagaaacugaacaaucuccaggcuguguucacugaccuuuccucaauggaccugauccggccucgcgucaguuuggugugucagauugugcgagucggccacauggaacuaaaggaggggaaaaagcauaccugcggacugagaaggccauuuggcguugccgugauggauaucacagacauaauucacgguaagguagaugacgaggaaaaacaacacuucauccccuuucagcagaucgcgauggagaccuacauucggcagcgucaacucaucaugagcccucugauuacgucucaugugauaggggaaaacgagccacuuacuuccguccugaacaaggugaucgcagccaaagaaguuaaucacaagggacagggcuugugggugucacucaaacuguuaccgggcgaucugacacagguccagaagaacuucagccaccuaguggaccgcaguaccgcuauugccagaaagaugggguuucccgagaucauccucccuggagauguaaggaaugacauuuauguuacucugauacauggugaguucgauaaaggcaagaaaaagacacccaagaacguggaagucaccaugucugugcacgacgaggaagggaaacuuuuggagaaggcaauccaucccggagcuggcuacgaggguauuuccgaauauaaaagcgucguguacuaccaaguuaagcagccuuguugguaugagacggugaaaguaucgaucgccauugaagaggucacccggugccacauccgauucacauuucgccauagaucuucccaggaaacuagggauaagucagagcgggcguucgggguggccuuuguuaaacugaugaauccagacggcaccacacuccaggacggacgccacgaucugguggucuacaagggcgacaacaagaaaauggaggaugcaaaguucuaucuuacucugcccgggaccaaaauggaaauggaggaaaaggaguugcaagcuaguaaaaaucucgugacauuuaccccgagcaaggacuccacuaaagauucuuuccagauagccacgcugaucuguagcacaaaguuaacccagaacguagaccugcuaggacuccugaauuggagaucaaacagucagaauauuaagcacaaccuuaaaaaguugauggaaguggaugguggcgagaucguuaaauuucugcaagacacucucgaugcucuguucaauauuaugauggagauguccgacagcgaaaccuacgacuuuuuagucuucgacgcccugguguuuaucauaucucuuauuggggauaucaaguuccagcauuuuaacccuguguuggagacauauauuuacaaacacuucucagcaacccucgccuaugucaagcugaguaagguucuaaauuucuacguggcuaacgcggacgacagcuccaaaacugaacugcucuuugcagcccugaaggcucuuaaauacuuguucagguuuaucauacagucucgugugcuguauuuacgguucuacggacaaucgaaggauggcgacgaguuuaacaauagcauccgacaacucuuccuggccuuuaacaugcuuauggauagaccccuggaagaggcaguaaaaauuaagggugccgcuuugaaguaucucccauccaucauuaaugacgucaaacugguguucgauccuguugagcuaucagugcuguuuugcaaguucauccagaguauacccgacaaccagcucgucaggcaaaaacugaauuguaugacaaagauuguggaaucuacgcuuuuucgccagagcgagugccgggaaguuuugcugccauuacucaccgaucagcuguccgggcagcuugacgauaacucaaauaaacccgaccaugaggccagcucucaacugcuauccaacauccucgaggugcuggauagaaaggacguaggcgcaacugcgguccacauccaguugauuauggaaaggcuguuacgccgaaucaaucggacagugauuggaaugaaccgucagaguccucacauaggcagcuucguggcuuguaugaucgcccuccugcagcaaauggaugacucucauuacucccacuauauuucaaccuuuaagacaagacaggacaucauugauuuccuuauggagacuuucaucauguuuaaagaccugauagggaagaaugucuacgcaaaagauuggaugguuaugaacaugacccagaauaggguguucuugcgcgccaucaaccaauuugcugaaguacucacgcgguucuuuauggaccaggccaguuucgagcugcagcuauggaauaacuauuuucaucuggcaguggcuuuccuuacccacgaaagccuccagcuggagacauuuucgcaagccaagagaaacaaaauugucaagaaauacggagauaugaggaaggagaucgguuuccgcauuagagacaugugguacaauuugggcccacauaagaucaaauuuauaccguccaugguggggcccauucuggaaguuacuuuaaccccugagguggaacuccggaaggcgacaaucccaaucuucuucgauaugaugcagugcgaguuuaacuucucuggaaauggcaacuuucacauguucgaaaaugagcugauuacuaaacuugaccaggaggucgaaggugggagaggcgaugagcaguauaaggugcuguuggaaaaacuccugcuagagcacuguaggaagcauaaguaccugagcucaaguggagaaguuuuugcccuucucguguccucucuguuggagaacuuacuggacuaucguaccauaaucaugcaagaugagagcaaagaaaaucgcauguccugcacggucaacguacucaauuucuacaaggagaaaaagcgggaagacauuuauaucagauaccuguauaaacuuagggaccugcaccgagauugcgagaacuacacagaggcugcauacaccuugcuacugcaugccgaacuccugcaguggucagacaagcccugugugccucaccuuuuacagaaggauagcuauuacguuuauacucagcaagagcugaaagaaaagcucuaccaggagauuaucaguuauuuugacaaaggcaagaugugggaaaaagcuauaaaguugucuaaggagcuggccgagacauacgaauccaaaguguucgauuaugaggggcucggaaaucugcuuaagaaacgggccagcuuuuacgaaaacaucauuaaggcgaugcgcccacagcccgaguacuucgccgucggcuauuacggucagggguuuccgucguuccugagaaauaaaaucuuuauuuauaggggaaaggaauacgagcggcgagaggacuucucauugagacuacugacccaauucccuaacgcugaaaagaugacuucuaccacaccacccggcgaggauaucaaaaguuccccuaagcaguauaugcagugcuuuacggugaaacccguaaugagccucccaccuucuuacaaggacaaacccgugccagaacaaauauuaaauuauuaccgcgccaacgagguccagcaguucagguacagccguccguuucggaagggugaaaaagauccugacaacgaguucgcaaccauguggauugagagaacuacauauaccacagcuuacacuuuucccggcauccugaagugguucgaaguuaagcagaucuccaccgaggaaauuucaccacuugagaaugccaucgagacgauggaacugacaaacgagaggauaaguaauugugugcaacagcaugcaugggaucgcagccucucugugcaccccuuguccaugcugcucucagggauugucgacccugccgugaugggaggcuuuaguaacuaugaaaaggcuuucuuuaccgagaaguaccugcaggaacacccagaggaucaggagaaaguugaacuucuaaagcgacugaucgcguugcaaaugcccuuacugacugaggggauuagaauccauggagaaaaacucaccgagcagcugaagccucuucacgaacggcugagcuccugcuucagggagcucaaggagaaaguagaaaagcauuauggcgugauaacauugccgccaaaucugacugagcgcaaacagucucguaccgguucgauuguccuacccuacaucaugagcucaacacugagacggcucuccaucacgagugugaccucuagcguuguguccacuucaucuaacagcagugacaaugccccuuccaggccagggagcgacggaucuauucuugaaccccuguuagagcgccgagcaucauccggcgcuagagucgaagauuugagucugcgggaggagaacagcgaaaauaggaucucgaaguuuaaacgcaaggacuggucucucuccaagagccaggugauugccgagaaagccccugaaccggaucugaugucacccacaagaaaggcucaaaggccaaaaagucuucagcugauggacaaccggcucucuccuuuccacgguuccagcccaccacagucaaccccuuugagucccccaccgcugacuccuaaggcaacacguaccuuaagcucccccucucuacaaacggauggcauagccgcgacuccaguacccccuccacccccuccgaaaagcaagccauaugaggggucccagcgcaauucaaccgagcuggcucccccucuccccguccgaagagaagccaaggcaccaccucccccaccuccgaaagccaggaagucuggaauccccacaagugagccaggcucgcaguga

SEQ ID NO: 55435 - RNA, 6144 nt, Artificial Sequence
  derived and/or modified sequence opt3 from DOCK6__Homo_sapiens__NP_065863
auggccgcuagcgaaagaagggcguucgcccacaagaucaaccggaccguggcggcugaaguccgcaagcagguuucccgagagcguucuggcucaccccauaguuccagaaggugcuccucuucgcugggggugccucucacagaaguuguggagccacuugacuuugaagauguccuguugucacggccgcccgacgccgagccuggaccauuacgcgaucugguggaguuccccgcugacgaucuggaacuccugcuucaaccuagagaguguaggacuacggaaccagguauucccaaggacgagaaacuggaugcccagguucgggcugcaguggagauguacauagaagacugggucaucgugcaccgccgauaucaguacuugagcgccgcuuauaguccuguaaccacagauacucagagagagaggcaaaagggccucccacggcagguuuuugaacaggacgccuccggggaugagcguucuggaccggaagacagcaaugauucccgcagaggcucagguagucccgaggacaccccuaggagcucuggggcguccucaauuuucgaccugcggaaccuggcagccgauagccucuuaccaagucugcuugagcgagcugcccccgaagacguggaucgcagaaaugagacauugaggcggcagcaucgcccuccagcacugcuaacccucuaccccgcuccggacgaagaugaggccgucgaaagaugcucuaggccugagcccccacgugagcacuuuggacaacggauccuggugaaaugucuuucccugaaguucgaaauugagaucgaaccuauauuuggcaucuuggcgcucuaugacgugcgagagaagaaaaagauuagcgaaaacuucuacuuugaucuaaauucggacucuaugaaaggcuuacugagagcccaugggacucaccccgcaaucuccacacucgcuaggucagccauuuucagugucaccuauccaagccccgauaucuuucuuguuauaaagcuggagaaaguguugcagcagggagacauuuccgagugcugugaaccuuacaugguacuaaaggagguggauacggcuaagaacaaagaaaagcuggagaaacuccgccuggccgcagagcaguucugcacucggcuugguagauacaggaugccauuugccuggaccgcuguccaccuggcgaauaucgugucuagcgcaggccaauuggaccgcgacucagauagugaaggggagcgacggccggccuggacagaccguagaaggcgcggaccccaggaucgggcuuccagcggcgacgaugccuguucuuucucagguuucagaccugcaacucucaccguuacaaacuuuuucaagcaggaagccgagaggcugagugacgaagauuuauuuaaauuccuggcugacaugcgacgcccaagcucccuacuccggagacugaggcccgugaccgcccaacuuaagauugauaucucuccugcaccagagaauccccauuuuugcuugucgccggagcugcuccacaucaaaccuuauccagacccccgugggcgcccuacgaaggaaauucuggaguuccccgcgcgggaagucuacgcuccacauacuagcuauagaaaccuucuguacguguauccucacuccuugaauuuuucaaguaggcagggaucuguacgaaaccucgccguucgggugcaguacaugacaggcgaggaucccagccaggcacugccagucauauucggcaaguccucauguagcgaauuuacccgcgaggccuucacuccgguggucuaucacaauaaaucuccugaguuuuacgaagaguucaaguuacaucugcccgcuugcgugacagaaaaccaccaucuacucuuuaccuucuaccacguuuccugucaaccaagacccgggacggcccuggagaccccugugggauucacauggaucccacuuuugcagcaugguaggcugcggacuggccccuuuugccucccuguaagugucgaccagccgccacccagcuauucugugcugaccccugauguugcauuaccagggaugcgauggguggacggacacaaaggcgucuucuccguggaacugacagcuguaucaagugugcacccccaggacccuuaccuugauaaguuuuucacuuugguucauguccucgaggagggugccuuuccguucagacugaaagacaccgugcuaagcgaagggaauguggagcaagaacugcgcgcgucgcucgccgcucugaggcuugcaucccccgagccauuggucgccuuuucucaccauguucuggauaaguuagugcgucucgugauucggccucccaucauaagcggccagauuguaaaccugggaagaggcgcuuucgaggccauggcacacgucgugucacuuguucacaggagucuggaagcggcccaggacgcucgcgggcauugcccacaguuggccgcauaugugcacuacgcuuuucgacucccuggaacagagcccucccugccagauggugccccgccugucaccgugcaagcagccacucuagcuagaggcucugggcggcccgcgagccuguaucucgccagguccaagucaaucagcaguucuaacccagaccuggcaguugcucccggauccguggaugacgaaguaagccgcauccuugccucgaaauugcugcaugaggaauuagcccuccagugggucgugucaucuagugcugugcgugaggcaauucugcagcacgccugguucuuuuuccagcuuauggucaaguccauggcgcugcaucuacuccugggccaaagauuggauacgccucggaaacugagguuuccaggucgcuucuuagacgauaucacagcucucguugggagcgugggccuggagguaauuacccgagugcacaaggacgucgaacuugccgagcaccugaaugcaucuuuggccuucuuucucagcgaucugcuaucccugguggacagaggauucguauuuucacuugugcgggcucauuacaaacaggucgcaacuaggcuccagaguagccccaacccugccgcgcuguugacccugcgcauggaguucacaagaauauuauguucucacgagcauuaugugacccucaaucugccgugcuguccacuuucacccccugcuagccccaguccaagcguuuccucuacuacaucgcaaagcucaacguuuuccagucaggccccugaccccaaggugaccucuauguucgaacugagcggcccauuuaggcagcagcacuucuuggcagggcuccugcuaacugagcuggcccuugcucucgagccugaagccgagggagcauuucuguugcauaagaaagcuaucuccgccguccacucauuacugugcggucacgauacagacccgcgguacgcggaagccaccguaaaggcacguguggcugagcucuaccugccccuucugucuauugcccgcgauacauugccacgacuacaugacuucgcugaaggcccugggcaaagaagcaggcuggcaaguaugcucgauuccgacacugagggagagggcgauaucgccgguaccaucaaccccagcguugccauggcuauugcagggggcccacuggcaccuggaucucgggccucaauaucccagggacccccgacggcuagucgcgccgggugugcacuuagcgccgaaucgucuagaaccuuacuggcuugcgugcucugggucuugaaaaauacagagccagcgcugcuccagaggugggccacugaccugacccuuccucagcugggacgguugcuagaucugcucuauuuaugucuggcagcuuuugaauacaagggcaaaaaggccuucgagcgaaucaacucccuuacauucaagaaaagccuggacaugaaggcaagacucgaggaagccauuuuggguacuaucggggcucgccaagagauggugaggcggucacgugaaagaagucccuuuggaaauccagagaacguaagguggcgcaaaucugugacccacuggaagcagacguccgaucgggucgacaaaacaaaggacgaaauggagcaugaggcccugguugaaggcaaucucgcgaccgaggcaagccugguggugcuugauacucuagaaauuaucguccagacagugaugcugucagaggcccgagaaaguguuuugggugcuguauuaaaagugguccuguauagccucggcuccgcccagucugcucuguuccuucaacacgggcuggcaacccagagagcccucgugagcaaguuucccgaguugcuguucgaggaagacacugagcuaugcgcugaucugugucucaggcuucugcgccacugcggaucccggauaucaaccaucagaacacaugccucugcaaguuuauacuugcugaugcgucagaacuuugaaauuggccacaauuucgcgaggguuaagaugcaagugacgaugucgcucagcucccuggucgggaccacucagaacuuuucugaggaacaucuucggcgcucacugaaaacaauccucaccuaugccgaggaggacaugggauugcgagauagcacauucgcugaacaggugcaggaccugauguuuaauuuacacaugauucuaacugauaccguaaagaugaaagagcaucaagaagacccugagaugcugaucgaucucauguacagaauagccaggggcuaucaggguuccccggaccuucggcugacgugguugcagaacauggcagggaagcacgcugagcugggaaaucacgccgaagcagcccaguguaugguccaugcugcggcccucguggcagaguaccuggcacuucucgaagaucaccgccaucugcccguuggcugcgugaguuuccaaaacauuucuagcaacgucuuggaggaaucagccaucuccgacgauauucugaguccagacgaggaggguuuuugcagcggcaaacacuucacagaauuagggcuagugggacugcucgagcaggccgcaggcuacuuuaccaugggcgggcuuuaugaagcuguuaaugagguguacaagaaccugaucccuauauuggaagcccacagagacuauaagaaacuggcggcuguccauggcaagcuccaggaggccuucacuaaaaucaugcaccagucuuccgguugggagaggguguucgggaccuacuuucgaguaggauucuauggcgcacauuuuggugaucuggacgaacaagaguucguguacaaggaacccucaauuacaaaacuugccgagaucagccaccgguuagaagaguuuuauacugagcguuucggcgaugacguugucgaaauuaucaaggauucgaauccuguggacaagucuaaacuggauagucagaaggcuuacauacagauuaccuacguggagccauauuuugacacauacgaacucaaagauagagucacguauuucgaccgcaacuacggguugaggaccuuucuguucuguacucccuuuacaccugauggacgggcacauggcgagcuaccagagcagcacaagagaaaaacccugcucuccacugaccacgccuuccccuauaucaagacacgcaucaggguaugccaucgagaagagaccgugcuuacgccgguugaaguggcgauugaggauaugcaaaagaaaacucgggaacuggcuuuugccaccgagcaggacccuccagacgcaaagauguugcagaugguccugcaagggagcgugggacccacaguuaaucagggcccucucgagguggcccaggucuuccuggcugaaaucccagaggaucccaaauuauucagacaccauaacaaacuuaggcuguguuuuaaagacuucugcaagaaaugugaagaugcccuccgcaagaauaaggcacuaauugguccggaccagaaagaguaccaccgugaacuggagcggaacuauugcagauugagggaggcucugcaaccucuccuuacccagcgccugccccaguugauggccccaacuccucccgggcugcgaaauucacucaaccgggcguccuuuagaaaggccgauuuauga

SEQ ID NO: 55436 - RNA, 6423 nt, Artificial Sequence
  derived and/or modified sequence opt3 from DOCK7__Homo_sapiens__XP_011540628
auggccgaacggagggcuuucgcacaaaagaucagccggaccguggccgcggaaguccgcaaacaaauuuccggccaguacucugggucaccccagcugcucaagaaucuuaauauuguuggaaacaucagucaccauacuacugugccucugacggaggcuguagacccaguggauuuggaagacuauuuaauuacccacccgcuggccgucgauuccgguccccuacgagaccucaucgaguuuccuccagaugacauugaagugguuuacagcccccgugauugcagaacucuggugucugcagucccugaggagucggaaauggacccacaugugagggauuguauccggucauauacugaggacugggccauaguaauccgcaaauaccacaaacuuggcaccggguucaaucccaacacacuggauaaacagaaggaaagacaaaagggauugccuaaacagguuuuugagagcgacgaggcuccagauggcaauaguuaucaggacgaccaggaugaccucaagaggcgguccaugucuauugaugacaccccgcgcgguagcugggcaugcuccaucuucgaucugaaaaacucacugcccgacgcccucuuaccuaaucugcuugaucgaacuccaaacgaagagauugacagacaaaaugaugaccagaggaagaguaaccggcauaaagaauuguuugcucugcaccccagcccugaugaggaagaaccaaucgagcgucuaucugugcccgacauaccgaaggaacacuucgggcagcgccuccuggucaagugucuuucccugaaauuugagauugaaaucgagccuauuuucgccucauuggcgcucuacgacgugaaggagaagaagaaaaucagcgagaauuuuuauuucgaucugaacagugagcagaugaagggauuacugagaccccaugugcccccugcugccaucacaacccucgcuaggucugccauauuuuccauaacguaccccagccaagacgucuuccuuguuaucaaacuggaaaagguguugcagcagggcgauauuggcgagugcgcagaaccauacaugaucuuuaaggaggcugacgccacuaaaaauaaggaaaaacuagagaagcugaaaucgcaagcggaucaguucugucagcggcucgggaaguaucgaaugcccuucgccuggaccgcaauacaccugaugaacauuguaucuuccgcuggaucacuugagcgcgacaguacagaaguggagaucagcacuggugaaagaaagggcuccuggucugagaggcggaauagcucaaucgucgggcgcagaagucuggagaggaccacauccggagaugacgccugcaacuugaccagcuuucguccugcuacgcucacugugacaaacuucuuuaaacaggaaggcgaucggcugucugacgaggauuuauacaaguuccuggccgacaugcgaagaccaucaaguguucuaaggcgccuccggccgauuaccgcacaacugaaaaucgauauuagccccgccccugaaaauccacauuauugucuuacucccgaguugcuccaggugaagcuguacccugacuccagagucaggccaacacgcgaaauacuggaguuucccgcucgagacguguauguaccgaacaccacguaccggaaucuucuguauaucuacccucagucuuugaacuucgcgaaucgucaggguucggcaagaaacauuaccguuaaagugcaauuuauguacggggaggauccaagcaaugccaugcccgucaucuucggaaaguccucaugcagugaauuuucuaaggaggcuuauacagccguggucuaccacaacaggagcccugacuuccacgaagagaucaaagugaagcuccccgcaacucugaccgaucaucaccauuuacuguuuacauucuaucacguuuccugucagcagaaacagaauacuccacuagaaaccccugugggcuacacauggauucccaugcuccaaaacggccgccugaagaccgggcaguuuugccuuccaguaucauuggagaaaccgccucaggccuauagcguccugucucccgaggugccacuccccggaaugaaguggguugacaaucauaaggguguguucaacgucgaagugguagcuguguccaguauacacacucaggauccuuaccuggacaaauucuuugccuuaguuaaugcacuggaugagcaccuuuucccaguccggaucggcgacaugagaauuauggaaaacaauuuggagaacgaacucaagagcucuaucuccgcgcugaacucaagucaacuagagcccguggugagguuucugcaucuccugcuugauaaauugauucuguuagucauccgaccuccgguuauagcugggcagaucgugaaucucggacaggccagcuucgaggcaauggccucgauuaucaaccgccugcacaagaaucuugaaggcaaccaugaccaacacgguagaaauucccuguuggcuucuuauauucacuacguguuuagacucccaaacacguaccccaauagcucaaguccugggccaggcggacugggcggguccguacauuaugccacaauggcaaggucugcuguccgucccgccagccuaaaccugaaucgcucccggucacucagcaacaguaauccugauaucucuggaaccccgacuucccccgacgaugaggugagaagcauaauugguucgaaaggccuggacaggucaaacucuuggguuaauaccgggggaccaaaggcggccccuuggggcaguaaccccuccccaagcgcugaaucuacacaggcaauggaccgaagcuguaaucggauguccucacacaccgagacaaguagcuuccuucagacauugacgggucgccugccuaccaaaaaguuauuucaugaggaacucgcccugcaguggguggucugcucuggguccgugagagagucagcacuucaacaggccugguucuuuuucgaacugaugguuaagaguauggugcaccaucuauacuuuaacgauaaacucgaggcacccaggaagucccgguucccagaacgauuuauggacgauaucgcggcccugguauccacuauugcuucugacaucgucucgagauuccagaaagauacagagaugguggagcgcuugaacaccagccuggccuucuuuuuaaaugaccuccugucagugauggauaggggcuucgucuuuucccuuauaaagaguugcuauaaacagguuucuagcaagcuguacuccuugccgaacccuucagugcucguaucucugcgucuagacuuccugcggaucauuuguagccacgaacacuaugugacacuuaaucuccccugcagucuguugacuccacccgcauccccuagcccaucugucucauccgcuaccagucaaagcucgggauuuucuacgaacgugcaggaucagaagaucgccaauauguucgagcuguccguucccuuuagacagcaacauuacuuagcaggccucgugcugaccgaacuugccgucauucuggacccugaugcugagggguuguucggacuccacaaaaaggugaucaacaugguucauaaucugcuaagcucacacgacagugacccgagguauucugauccacagauaaaagcgcgcguggccaugcuguaccuuccccucauugguaucaucauggaaacagucccucagcuguacgacuuuacugagacccauaaccaacgaggcagacccauuuguaucgcaacagaugacuaugaguccgaaagcgggucaaugauuagucagacuguagcuauggccauagccggaaccagcgugccacaguugacgcggccuggcuccuucuuacugacaucuaccagcgguaggcagcacacuacauuuuccgcugagucaucucgcagucuccugaucugccuucuguggguuuugaagaaugcagaugaaaccgugcuacaaaaaugguucacugaccugucgguccuccagcugaaccgucuuuuagaucugcucuacuugugugugagcugcuucgaguauaaggggaagaaaguauuugaaagaaugaacucccugaccuucaagaaaucuaaggacaugcgggccaaacucgaggaggcgauucugggcucaaucggagcuaggcaggaaauggugcgccgaagcagaggccagcuugggacauacacgauugccagcccaccagagcggaguccuucuggaagcgcauuuggcucacaagaaaaccugagguggcgcaaggauaugacccacuggagacagaauacugagaaguuggacaaauccagggccgagaucgaacaugaggcucuaauagaugguaaccuggcaacagaagccaaucucaucauuuuagacacccuggagaucgucguucagacagugagugugacugaaagcaaggagucuauucuugggggaguccugaaagugcucuugcacuccauggcguguaaccagucagcuguuuaucugcaacauugcuucgccacccagcgggcacucguaagcaaguuuccggagcugcuuuucgaagaggaaacggagcagugugccgaucuaugccugcguuuguuacgccacuguucgucuaguaucggcacaauacgaucccacgcuagcgccucacuguaccuccugaugagacagaacuuugaaauugguaauaacuucgcaagggugaaaaugcaagucaccaugucccuuucuagccuggugggcacaagucagaauuuuaacgaggaguuccuccggcgcuccuugaagaccauccugacauaugcugaagaggaccuagaacugagagagacuaccuuucccgaccagguucaagaucucguguucaaucuucauaugauccugagcgacacagucaaaaugaaggaacaccaggaggauccagagauguuaauugacuugauguacaggauagccaagggguaccagacgucuccugaucugcggcucaccuggcugcagaacauggcgggaaaacauucagaacgaaguaaucacgccgaggcagcucaaugccuugugcauuccgccgcucugguagcagaauaucucagcauguuggaggacagaaaguaccugcccgucggcugcgugacuuuucagaacaucucuucgaauguuuuagaggaaucagccgugagcgaugacgucguguccccagaugaggaagggauuuguaguggaaaauauuucacagagucuggccuaguuggucugcucgaacaggccgcugcgagcuucuccauggcagggauguacgaggccgugaacgaggucuauaaggugcuuaucccuauucacgaagcuaaucgcgacgccaaaaagcugucaaccauccacggaaaguugcaggaggcauuuaguaaaauaguacaucaaucuacuggcugggaaaggauguucgguacauacuuucgggugggcuucuaugggaccaaguuuggagaucuggacgagcaggaguucguuuacaaagagcccgccaucacgaagcucgcugagauuagccaccgucuggaaggcuuuuacggggagagauucggagaagaugucguggaggugaucaaagacuccaacccggucgacaagugcaaacuugauccaaauaaagcguauauucagaucacuuacguagaaccuuauuuugacaccuacgagaugaaggauaggauaacauauuucgacaaaaacuacaaucuccgccgguuuauguauuguacccccuucacucuggauggccgagcccauggugaguugcacgaacaguuuaagagaaaaacaauucugaccacaucacacgcauucccauacaucaagacuagggugaacguuacccauaaggaggaaaucauuuuaacgcccaucgagguggcuauagaggacaugcagaagaagacacaggaacuagccuucgcaacccaccaggauccugccgacccgaaaaugcugcaaaugguccuccaggggagcgugggaacuaccguuaaucagggcccccuugagguggcucaggucuuucugucugaaauuccauccgauccuaaguuguuccgccaucacaacaaacugcggcucugcuuuaaggacuucacaaagagaugugaggaugcccugcguaaaaacaagagucuuaucggucccgaccaaaaagaauaccagagggaguuagagcggaauuaucaucgccugaaggaagcgcuccagccuuugauuaaccgaaaaaucccacagcuguacaaggcagugcuacccguaacuugccacagagacagcuuuucgaggaugucccugcggaaaauggaucucuga

SEQ ID NO: 55437 - RNA, 6300 nt, Artificial Sequence
  derived and/or modified sequence opt3 from DOCK8__Homo_sapiens__NP_982272
auggccacccugcccagcgcugagagaagggcauucgcccucaagaucaaccgguacuccucugcggaaauucgcaaacaguuuacacuuccuccaaaucugggccaauaucaccgacagucaauaaguacuagcggguucccguccuugcaguuaccccaguuuuacgacccuguggagccagucgauuucgaaggacugcuaaugacgcaucucaacucucuggacguucaacuugcucaggagcugggugauuuuaccgacgaugacuuggaugugguauucacacccaaggaaugccguacucuccagccuucgcugccagaggagggcguggaacuggacccccacgucagagauugugugcagaccuauaucagggaguggcucauuguuaaucggaaaaaccaagggucaccugaaaucugcggauuuaagaaaacaggcagccgcaaggacuuccauaagaccuuaccaaaacagacuuuugagagugagacacuggaauguuccgagccggccgcacaggccggucccagacaccuuaauguguugugcgaugucucugggaagggaccugugaccgcuugugacuucgaucugaggagccuacagccagacaaacggcucgaaaaccugcuucaacagguauccgcagaggacuuugaaaagcagaaugaggaggcccgccgaacgaacagacaagcugaacuguucgccuuguaccccucaguugaugaggaagacgcgguggagauuaggccugucccagaaugccccaaagagcaucucggcaaucggauccuggugaaguuacugacucucaaguuugagauagaaaucgagccgcuuuucgcaaguauugcccuguaugaugugaaagaacguaagaaaaucagcgagaacuuccacugugacuugaauucugaucaguuuaagggcuuccuacgcgcucacaccccuuccgucgccgcaucaagccaggcuagaagugccguuuuuucugugacauaccccuccagcgacauuuaucugguagugaaaaucgaaaagguccuccagcaaggggagauaggagauugcgcggagccauacacugugauuaaagaaucggacgguggcaagucuaaggagaaaaucgaaaagcugaaacuucaggccgaguccuucugucagaggcuggggaaguaccggaugccuuuugcaugggcucccauuucauugaguagcuucuuuaacguuuccacccucgagcgagaagugacagaugucgacucugugguaggacgcagcucaguuggcgagagaaggacccuggcccagagucggcgcuuauccgaaagagcucugagccuagaggaaaaugguguggggucuaacuucaaaacgucaacucucagugucagcuccuuuuucaagcaagagggagauaggcugucugacgaggaccuuuuuaaguucuuggccgauuauaaacguucgagcucccugcagcggcgagugaagucaaucccaggccuccugagacuugaaaucaguacagcacccgagauuauaaauugcugucugaccccugaaauguugccagucaaaccguuucccgagaacaggacucgcccucauaaggaaauccucgaguucccaacacgggagguguacguuccccacaccguguauagaaaccuguuauacguauauccucagaggcugaauuucgucaacaaacuagccucugcucgcaauauuacgaucaagauacaguuuaugugcggcgaagacgcgagcaacgcaaugccagugauuuucgggaaguccucaggacccgaguuucuccaagaaguuuacaccgccgugacauaucauaauaaaagcccggauuucuacgaggaagucaagaucaaacugccugcuaagcuuacugugaaccaccacuugcuguuuaccuucuaccauaucucuugccagcagaaacagggugccuccguagagacacuccugggcuauaguugguuaccaauucugcuuaaugagcgauugcaaacugggagcuacugucuccccguggcacuggaaaagcuaccucccaacuauucuaugcacuccgccgagaagguuccacugcagaauccucccaucaaaugggcugaaggacauaagggcgucuuuaacauugaggugcaggccgugucaaguguccacacccaagacaaucaucucgagaaauucuuuacacugugccacagccuugaaucgcagguuaccuucccaauacggguguuggaucagaagaucuccgagauggcacuggaacacgaguuaaaacucucuauuaucugucugaacagcucacgucuugaaccgcugguguuguuucuccaucugguacuagacaagcuguuccagcucaguguccaaccuauggugaucgcgggucagacugcuaauuuuucccaguucgccuucgagucuguuguggcaauugccaacagccugcacaauuccaaagaucuuucaaaggaccagcaugggagaaacugcuugcuggcuagcuacguccacuauguguuuagguuacccgagguucaacgcgaugugccaaagaguggcgcccccacggcacuccuggacccucggucuuaccacacauauggaagaaccuccgcugccgcgguaagcucgaaacuucugcaggccagggucaugucaucuaguaacccagaucuagcuggcacucauuccgcagccgacgaagaggugaagaauauaaugagcucuaaaaucgcugaucgaaacuguagccgcauguccuacuacugcucagggaguagcgacgcccccucuuccccugcagcgccgcggccagccucaaagaaacacuuccaugaagagcucgcucugcagaugguggucaguaccggaaugguuagagaaacaguguuuaaguaugccugguucuuuuucgaguugcugguaaagagcauggcacagcacgugcauaauauggacaaaagggauuccuuucgucgcacccgguucucugacagauuuauggaugacauuacuacaaucgucaacgugguuacgucggagauugcugccuuacucgugaagccccaaaaagaaaaugagcaggcagaaaagaugaacaucagccuggccuucuuucuuuacgaucuguugucacucauggacagggguuucgucuucaaucugauacgacacuauuguucccagcuaagugcuaaacugucuaaccuuccuacccucaucagcaugcggcuggaguuuuugcgcauucugugcucccacgaacauuacuuaaaucucaaccuguucuuuaugaaugcggauacugccccaacaucacccuguccuucuaucagcagucaaaacuccagcucuugcucauccuuccaggaccagaagauugcaaguauguuugaucuuaccagcgaguauagacagcaacacuuccugacaggcuugcucuuuacugagcuggcugccgcccuagacgcugaaggggagggaaucucgaaggugcagaggaaagcaguuucugccauacauucccugcuuagcucacacgaucucgacccgcggugugugaagcccgaagucaaaguaaagauugcggcucuguacuugccauuagugggcaucauucuggaugcccucccucagcugugcgacuucaccguugcagacacgcgaagauaucgcaccagugguucugaugaggagcaggaaggggccggcgcuaucaaucaaaacguggcacuugccauagcgggaaauaacuuuaaccugaaaacauccggcaucgucuugagcucacuacccuacaagcaguacaauaugcugaacgcugacacuaccaggaaucucaugauuugcuuccuguggaucaugaagaacgccgaucagagucuuauucguaaauggaucgcagacuuaccaagcacacagcugaaucggauacucgauuugcuguuuauuugugugcucugcuucgaguauaaggggaaacaauccucugacaagguaagcacucaggugcugcagaaauccagagaugucaaggccaggcuugaagaggcucuguugcgcggagaaggugcccgaggcgagaugaugagacggagggcaccugggaacgaccgcuuucccggacuaaaugagaaccugcguuggaaaaaggaacagacccauuggagacaagcuaaugagaagcucgauaaaacgaaggccgaauuagaccaggaggcgcugaucucaggcaaccuugccacagaagcacaccugaucauucucgauaugcaggagaauaucauucaagcuucuagugccuuggacuguaaagacucgcugcucggugggguucugcgggugcuugugaacagccuaaauugcgaucaguccaccacuuaccugacacacuguuucgcuaccuugagggcauuaauagccaaguucggcgaccugcucuuugaggaagaggucgaacagugcuucgaucugugucaucaggugcuucaccauugcucuucaagcauggacguuacucgcucccaagccugugcuacccuguaucucuugaugcgauuuaguuucggagcgacaucuaacuuugcaagaguaaaaaugcaggugacgaugagccuggccucacuagucggccgggcuccagauuucaaugaggaacaccugaggcgcucccucagaaccauccuugccuacagugaggaggacacugcaaugcagaugacaccguuuccuacccagguggaagagcuguuaugcaacuugaacagcauucuguaugauacaguuaagaugagggaauuccaagaggaccccgagaugcucauggaucugauguaccggaucgccaagucuuaucaggcuuccccagaccuucgucugacuuggcuccagaauauggcggaaaaacacaccaagaaaaaguguuacacggaggccgcaaugugcuuggugcaugcugccgcacuggucgccgaauacuuaucaaugcuagaggaucacagcuaucugcccguggggucgguaucuuuucagaacauuaguuccaauguccucgaagagagcgugguuucagaggacacacuuuccccugaugaagacggagugugcgcuggccaauacuucaccgagucuggucuggucggguugcuggaacaggccgcggagcucuuuagcacuggaggccuguaugaaaccgugaacgagguuuacaaacuugugaucccaauacucgaggcacaucgcgaauuccgaaagcugacauugacucacaguaagcugcagagagccuuugacuccaucgucaauaaagaucauaagaggauguucgguaccuauuuccgggugggcuuuuucgggagcaaauuuggagacuuagaugagcaagaauucguauacaaggagcccgcuauuacaaaacuaccugaaaucucucaccgccuggaggccuuuuauggccaguguuucggggcugaguuuguggaaguuauuaaggacucaacgccggucgauaagaccaaacucgacccaaacaaggcauacauccagauaacuuucguggagcccuacuuugaugaauaugagaugaaagacagagugacauacuucgagaagaauuuuaaccuuaggcgguucauguauaccacuccuuuuacacuggaaggacgacccagaggcgaguugcacgaacaguaccgcaggaauaccguccugacgacuaugcaugccuucccauauauuaaaacccggaucaguguaauccaaaaggaggaauucgugcucacaccuauugagguugcuauagaggauaugaagaaaaagacccugcagcuugccguggcaaucaaccaggaacccccagacgcgaaaauguuacagaugguccugcaagguuccgugggggccacuguuaaucagggaccucucgagguggcucaggucuuuuuggccgaaauuccggcagaucccaagcuguaccgucaccauaacaaacuaagacugugcuucaaggaguuuaucaugagguguggcgaagcuguggagaaaaauaagcgccucauuacagccgaccagcgggaguaucaacaggaacuuaagaaaaacuacaauaagcugaaagagaacuugcgaccaaugaucgaaagaaagauaccugagcuguacaaacccaucuucaggguagaaagccagaagcgcgauucuuuucaccggucgucauucagaaagugcgagacccagcucagccaagguuccuga

SEQ ID NO: 55438 - RNA, 6207 nt, Artificial Sequence
  derived and/or modified sequence opt3 from DOCK9__Homo_sapiens__NP_001123520
augcaggccgauaagugccgaaccagcuccaggucugugaaaaaggaacuggucaucgaaucaccccuccaguauaaagaugcugcgcagggcgaaguugaagccgaaaguccugggccagugccggcgaagcccaaacuuauugaaccucuggacuaugaaaauguaauugugcagaagaagacacagaucuugaaugauuguuuacgggagaugcugcuauucccauacgacgauuuucaaacugcuauucuccgccgacagggacguuauaucugcagcacgguccccgccaaagcagaagaggaagcccagucccuguucgugaccgaguguauuaagacauacaacucugacuggcaccuuguuaauuauaaauacgaggauuauucgggugaauuuagacagcugccuaacaagguggucaaauuggacaagcucccagugcacguauacgagguugaugaagagguggacaaggaugaagacgcugcaucacugggcagccaaaaagggggaaucacuaagcacggcuggcuguacaaagguaauaugaacagugccauauccgucaccaugaggucuuucaagcggcgcuuuuuccaucucauccaguuaggggauggaagcuauaaucugaacuuuuacaaagacgagaagauuuccaaagagcccaagggcucaaucuuccuugacaguugcaugggcguggugcagaauaacaaggucagaagguuugcuuucgaauugaaaaugcaggauaagagcucuuaucugcuagccgcggacuccgagguugaaauggaggaauggauuacaauccucaauaaaauacugcaacuuaacuuugaggcagccaugcaggagaagcggaauggggauucacacgaagacgaugagcagagcaaacuggaaggaagugguucuggcuuggacuccuaccucccugagcuggcuaagagcgcccgcgaagcagagauuaaguuaaaaucggagucucgagugaagcuguucuaucucgauccagacgcucaaaaacuugauuuuuccucagccgaaccggagguaaagaguuucgaagagaaauucgggaagagaauccuggugaaguguaacgacuugagcuuuaaucuacagugcugugucgcggagaacgaagagggacccaccacuaacguggaaccuuucuuuguuacacugucccucuucgauauuaaauacaauaggaagaucucugccgacuuucauguggaccugaaccacuucagcguccggcagaugcuugcaaccacgucaccagcucugaugaauggcaguggucagucccccagcguguugaaagggauccuccacgaggccgcuaugcaauauccuaagcagggaauauuuucuguaacuugcccacaucccgauauauuccugguugcccguaucgaaaaaguguuacagggcucaauuacccacugugcagagccguacaugaagaguagcgacuccucuaaggucgcccagaaagugcugaagaacgcuaaacaagcgugccagcgccuaggccaguacagaaugccuuuugcaugggccgcuaggacacucuucaaggaugccucggggaaucuggacaaaaacgcacgguuuagcgccaucuaucgacaggauuccaauaaacuuucaaacgacgauauguugaaacugcucgcugacuuccgcaagcccgagaagauggccaaacugccagucauacuuggaaaucuggauauuacuaucgacaacgugaguucugauuuuccuaauuacguuaacagcuccuauauccccaccaagcaauucgaaacauguucaaaaaccccaauuacguucgagguggaagaguuuguacccugcaucccuaagcauacucagccauacacaauuuauaccaaucacuuguacgucuauccgaaauaccucaaguacgacagccagaagucuuucgcaaaagcgagaaacauagcuaucugcauugaauuuaaggauuccgacgaggaggacagucagccccugaaauguaucuaugguaggccuggcgggccaguguucacucggagcgccuuugcagccguuuuacaccaucaccaaaaucccgaguucuacgaugagaucaagauugaacugccuacacagcuacaugagaaacaccaucuccugcuuaccuuuuuccacgugucuugcgacaacuccucaaagggaaguacgaagaaacgcgaugucguggaaacccagguaggcuauagcugguugccacugcucaaggacgguagagugguuacaucggagcaacacauacccgucuccgcuaaccugccgucuggguacuuaggcuaucaggagcugggaaugggcaggcauuacgggccugaaaucaaauggguggauggagguaagccacuuuugaaaauuagcacucaccucgugucaaccgucuauacacaggaccagcaucugcacaacuuuuuccaauacugucagaagacugagaguggcgcccaggcacuagggaacgaacugguuaaguaccucaaaucccugcacgcuauggagggacaugugaugaucgccuuucuucccaccauuuugaaucagcuguuccguguguuaacacgggcgacccaagaggaaguagccgucaacgugacucgaguuaucauacacguggucgcucagugccaugaggaaggccucgagucucaccugagaagcuaugugaaguacgcauauaaagccgaaccuuacguugcuuccgaguauaagacggugcaugaggaacuuacaaaaucaaugaccacuauccugaagcccagcgccgacuuuuugaccaguaauaaacuccugaaguacucuugguucuucuuugacguacuaauuaaguccauggcacagcaccugaucgagaacagcaaagucaagcuccugaggaaucagcgcuucccagcgucguaucaccaugccguggaaacaguggucaacaugcuuaugccucacauuacccaaaaauuucgggauaaucccgaggcuucaaagaacgccaaucauucuuuggcaguuuucaucaaaagauguuuuacuuucauggacagggguuuuguguucaagcagauaaacaauuacauuaguugcuuugcuccaggggauccgaagacacuguucgaauacaaauuugaguucuuacgcguaguguguaaccacgagcauuauaucccucucaaucugcccaugccauucggcaagggacggauucagagauaccaagaccuucagcuggauuauucccuaacggacgaauuuugccguaaccacuuccucgucggccuguugcugagagagguggggaccgccuuacaggaauuuagggagguucgccucaucgcaauaagcgugcugaaaaaccuucugaucaagcacucuuucgacgaucgguacgccagcagaucccaucaggcuaggauugcgacuuuguaucucccccuguuuggacuacugaucgaaaauguccaacgaauuaacgugcgcgacguuucaccuuucccagugaaugccgguaugacagucaaagaugagagucuugcacuccccgcuguaaacccucuggugaccccgcagaagggcagcacauuggacaauucucugcacaaggauuuacucggggccaucuccggaauagccucaccauacacuaccaguacgcccaacauuaauagcguucggaacgcugacuccagaggcucucugaucucgaccgauagcgguaauucacuuccugagaggaacuccgagaagaguaauucucuggacaagcaucagcagagcuccacauuggggaacucagugguccguugugauaaacucgaccaaucugagaucaagagccugcuaaugugcuuucuguauauucuuaaaaguauguccgaugacgcacucuucacuuacuggaauaaggccagcaccucugaacugauggacuuuuucacaaucucagagguguguuugcaccaguuucaguacaugggcaagcgcuauauugcgcggacuggaaugaugcacgcuagauuacagcaacugggcucccucgauaacagucugaccuucaaucauagcuacgggcacucggacgccgauguacuucaucagucucuguuggaggcaaacauagccacggaagugugccuaacagcucuggacacccucucccuguuuacucuugcauucaaaaaccaguuacuggccgaucacggacauaauccacucaugaagaaagucuucgacguuuauuugugcuuucugcagaagcaccaaagcgagacagcgcucaaaaacguguucaccgcucugaggucacuuaucuacaaguuucccaguacuuucuaugaaggccgagccgauaugugugcagcccugugcuacgagauuuugaaguguugcaauucuaaacuauccagcauccggaccgaggcuucacagcugcucuacuuuuuaaugcgcaacaauuucgacuacacagguaagaaaaguuuugugagaacgcaucugcaggucauuaucagcgugucccaacuuauagccgauguuguagggaucggaggcaccagguuccagcagucucugagcauuaucaacaauugugcaaacuccgaccggcucauuaagcauacuucauuuucuagugaugugaaagacuugacaaagcgaaucagaaccguccugauggcuacagcccagaugaaagagcacgagaaugauccugaaaugcucguggaccugcaauacucgcuugcaaagagcuaugccuccacuccggagcuacgcaagaccuggcuggacucuauggcaaggauacauguuaaaaacggugauuugucagaagcugccaugugcuacgugcacgucacggcuuuaguggcagaguaucugacacguaaggaagccguacagugggagcccccacuccugccucacagccauuccgccugucuucggagaaguaggggcggggucuuccgccagggaugcaccgcuuuucgagugauuacucccaauaucgacgaggaagcgucuaugauggaggauguuggcaugcaggacgugcacuucaacgaagauguccugauggagcucuuggaacaaugugcagacgggcuguggaaagccgagagauacgagcuaaucgcugauauuuauaagcugauaaucccaauuuacgaaaaacggagggacuuugagcgccucgcccaucuuuaugauacccugcaccgugcauacagcaaggugacagaaguuaugcauucaggaagacgguuauugggcacuuacuucaggguggccuucuuuggucaggcugcgcaguaucaguucaccgacuccgagacagaugucgagggguuuuucgaagacgaggauggaaaggaauacaucuauaaagagccuaagcugacgccccucagugaaauuagccaacgccugcuuaaacuguacucugacaaguuuggcuccgagaaugugaaaaugauccaggacucagguaagguaaacccaaaggaucucgacagcaaauaugccuacauacaggugacccacguuaucccguucuuugaugagaaggaauugcaagagcgaaaaacugaguucgagagaucgcacaauauucggagguuuauguucgaaaugccuuuuacacagaccggcaagcgccaagggggagucgaggagcagugcaaaagaaggacuauccugacagcaauucauuguuuccccuaugugaagaagcggaucccagugauguaccaacaccauaccgacuuaaaccccauagaagucgcuauugaugagaugucuaaaaagguagccgaacuacgucagcugugcaguuccgcagagguggacaugaucaaacuccagcuuaagcugcagggcagcguuucagugcaagucaaugccgggccuuuggcuuacgcccgcgcguuucuggaugacacgaacacuaaacgauauccagauaacaaggugaaacuccugaaggaaguuuucagacaguucguggaggcaugcggacaggcccuugcugucaaugagaggcucaucaaggaagaccagcuggaguaccaagaagagaugaaagccaacuaucgggagauggcuaaggaauuguccgagauuaugcacgaacagcugggcuga

SEQ ID NO: 55439 - RNA, 909 nt, Artificial Sequence
  derived and/or modified sequence opt3 from DOHH__Homo_sapiens__XP_011526642
auggugaccgagcaggaagucgacgccaucggccaaacacugguugaucccaagcagccucuccaggcuagauucagggcacuuuuuacucugcggggguugggagguccaggcgccauugcguggauaagccaggcuuucgacgaugacuccgccuuacugaaacacgagcuagcauacugccucgggcaaaugcaggaugcccgcgcuaucccgaugcugguggacguacuucaggauacgcgacaggaacccauggugcgucaugaggcaggagaagcccugggcgcuauuggugacccugaggucuuggagauccucaagcaauauucuucagauccagugauugaaguugccgagaccugucagcuggcggugagaaggcuggaauggcuccagcagcacgggggagagcccgcagccggcccuuacuuaagugucgacccagcucccccugccgaggaacgggaugugggccgccugagagaggcacuuuuggacgaaagcaggccacuguuugagcgguaucgcgcuauguucgcccuacgaaacgccgggggagaagaggcggcacucgcucuggccgagggucuucauugcggcuccgcucuguuuagacacgaaguaggguacguuuugggacaacuccagcaugaggccgcagugccgcagcuggccgcugcguuagcaagguguacagaaaaucccaugguccggcacgagugcgccgaagcucugggcgccaucgcacguccugccugucucgcugcccuucaagcacacgcggaugacccagagcgcguggugagagagucuugcgaagucgcucuggacauguaugagcaugaaacugguagggccuuccaguacgcagauggguuggagcagcuacggggagcccccucguga

SEQ ID NO: 55440 - RNA, 1029 nt, Artificial Sequence
  derived and/or modified sequence opt3 from DOK1__Homo_sapiens__NP_001184189
augcuggagaacagccucuacucccccaccugggaaggcucucaguucugggugacaguccagagaacugaggccgcugaaaggugcgggcuucacggaucauauguucugcggguggaggcagaacgcuugacguuacugaccguaggugcccagagucagauccuagagccucuccugagcuggccauacacacuucugcgacguuauggcagagacaaggugauguuuuccuucgaggcggggaggcgguguccgucuggacccggcacuuuuaccuuccagacagcucaagguaaugauauuuuucaggccgucgaaaccgcaauacaucgccagaaagcccaggggaaggcuggacaaggccacgacguguugagagcagauucgcaugagggcgaaguugccgaggggaaacucccuucaccacccggaccucaggagcugcuggacagcccacccgcucucuacgccgaaccuuuagauagucugaggaucgcgccaugcccgucccaggacucucuuuauagcgaucccuuggacuccacuucagcacaggccggugagggcgugcaacggaagaaaccucuguacugggaucuauaugaacacgcucagcagcaacuccugaaggccaaacuuacagacccaaaggaggaucccauuuacgacgaaccugaggggcuggcaccagugcccccgcagggauuguacgaucucccucgcgagcccaaggacgcuugguggugucaggcccgagucaaagaagagggcuaugaacugccauacaacccugcgaccgacgauuaugccguacccccacccagaaguacgaagccuuuacuggcaccaaaaccgcagggucccgcuuucccugagccagggacugccaccggaagcggcaucaagucucauaauuccgcucucuacucacaaguucaaaagagcggcgccagugggucuugggacugcggacuuuccaggguggguacagauaaaacuggcgucaagagcgaagggucgaccuga

SEQ ID NO: 55441 - RNA, 1239 nt, Artificial Sequence
  derived and/or modified sequence opt3 from DOK2__Homo_sapiens__NP_003965
augggcgacggggccgugaagcagggauuccuguaccuccaacagcagcagaccuuugguaaaaaguggagaagguucggcgcuagccuuuaugggggauccgauugcgcacuggcccgguuggaguuacaagaaggccccgagaaaccucgccgaugugaagcggcucguaaggucaucagacugucugacugccuaaggguugccgaggcugguggggaagccucaaguccacgggauacaagcgcauuuuuccucgagacuaaagagcgccuguaccuucuggcagccccggcugccgaaagaggagacugggugcaggcgauuuguuugcucgcauuucccggccagaggaaggagcuguccggcccugaagggaagcagucucggccaugcauggaggagaacgaacuguauucgucagccguaacggugggaccccacaaagaguucgcugucaccaugcgcccuacagaagccagcgagcgaugucaucucagagguaguuacacuuuaagggcaggcgaauccgcucuggagcuuuggggagggccagagcccggcacccaauuguaugauuggccuuaccgguuucugcgucgcuucgguagagacaaggugacauuuucuuucgaagccgggaggcggugcguuagcggagagggcaauuuugaguucgaaacccgacagggcaacgaaauauuucuagcgcucgaggaggccaucuccgcacagaaaaaugcugccccagcuacuccgcagccccaaccugccacaauuccagcaucacugccccgcccugauaguccauauagcagaccccacgacucucuuccgccucccuccccaaccacgccugugcccgccccaaggccccgggggcaggaaggagaguacgcugucccuuucgaugcgguggcacgcucacuggguaagaacuucagaggcaucuuggccguaccaccgcagcuccuggcugaccccuuauacgauagcauugaagagacucugccuccaaggcccgaccauaucuaugaugaaccugaggggguugccgcacucagucuuuacgacucuccacaagagccccguggagaagccuggcggcgacaggcuaccgccgacagagauccggcaggccugcagcacgugcagccugcgggucaagacuuuuccgcuagcggguggcagccaggcacagaguaugauaaugucguguugaaaaagggacccaaguga

SEQ ID NO: 55442 - RNA, 993 nt, Artificial Sequence
  derived and/or modified sequence opt3 from DOK3__Homo_sapiens__NP_001138347
auggacccccuggagaccccuaucaaggauggcauucucuaccagcaacacgugaaauucgggaagaaaugcuggagaaaggucugggcccuucuguaugcuggagguccaagcggcguugcaagguuggaauccugggaggugcgggacgggggauuaggcgccgcgggugaucgcucugcugggccgggacgacguggcgaaagaaggguaauacggcuggccgacugugugucaguccuacccgcagauggcgagaguugcccucgcgacacaggggccuuucuccugacuacgaccgaaagaagccaucuucuggcugcacagcacaggcaggccuggaugggaccaaucugucaguuggcuuuccccgguacaggcgaggccuccucugggucgacugaugcgcaaucaccuaaacggggacucgugccaauggaggaaaacagcauuuacaguuccuggcaggagguuggcgaauuucccguggucgugcagcgcaccgaggcagccacacgaugccagcugaaggguccugcucugcucguauuagggccagacgccauccaacugagagaggcaaagggaacccaggcucuuuauucuuggccguaccauuucuugaggaaauuuggcagcgauaagauucugcuaggcacucccgggguuucccuccugaucuguaaaggagaacggacagacgaugugucagguauaauccuugacgagagucuguugcgugccuauagcgucccuggcgccgggggacacucucgcgugcaggauucccucggcccagugcugagagaacccaccuuccagggugagaggucauuuuuaaagacgagcaugcugcggagucuccuuugcucuuguuccuggcgacauccucgcagccaaccaagaacucaggcgucgugccugcaggggucugacugucccgcaccgcacaggaauaguaccucagcugcccacacauugggcacuuccuga

SEQ ID NO: 55443 - RNA, 981 nt, Artificial Sequence
  derived and/or modified sequence opt3 from DOK4__Homo_sapiens__NP_060580
auggccaccaacuucagcgacaucgugaagcagggcuacgucaaaaugaaguccagaaaacuggggauuuauaggcggugcuggcucguuuuucgcaagucuucaaguaaaggaccccaacgacuugagaaguacccugaugaaaagagcgugugucugcgugguugcccaaaaguaacagagauauccaaugugaagugugucacuagauugccgaaagaaacgaagaggcaggcuguggcaaucauuuucaccgacgauucugcccggacauuuacuugcgacucggaguuagaagcggaggagugguauaaaacccugucaguugaaugucuaggcagccgccucaacgauaucagucugggggagcccgaccuucuggcuccuggagugcagugcgaacagacagauagauucaaugucuuuuugcucccaugucccaaccuggacguguacggcgagugcaagcugcaaauuacccacgagaauaucuaucucugggauauacauaacccuaggguaaaguuaguuuccuggccacuguguucucuucggcgcuacggucgagacgccacuagauucacauuugaagcagggaggaugugcgaugccggagagggcuuguauaccuuccagacgcaggaaggcgagcagaucuaccaacgggugcacagcgcuacucuggcaauugccgaacagcauaaacguguccuacucgagauggagaagaaugugcgccugcuuaacaaagggaccgaacacuacuccuaucccuguacaccuacuaccaugcugccaagaucagcuuacuggcaucacaucacaggaagucagaauauugccgaggcgagcucuuaugccggugaaggcuacggggcagcucaggccuccucagagaccgacuugcucaacagguuuauccuguuaaagccgaaacccagccaaggagauaguucugaagcaaagacgccuucccaguga

SEQ ID NO: 55444 - RNA, 921 nt, Artificial Sequence
  derived and/or modified sequence opt3 from DOK5__Homo_sapiens__NP_060901
auggccagcaacuucaaugacaucgugaagcagggcuacgucagaauuaggucccggcgccuggggauauaucaacgaugcuggcucguuuuuaaaaaggcuucuucaaaaggacccaagcgucuugagaaauucagugaugaaagagcagccuacuuuagguguuaucacaaggugaccgagcugaacaauguaaagaacguggcgcgguugccuaaaagcacaaagaaacaugcuaucgguauuuacuucaaugacgauacuuccaagacguuugccugcgaaucugacuuagaggcagaugaaugguguaaaguccugcagauggagugcgugggcacccgcaucaacgacauuucgcuaggggagccagaucuccuggccacaggaguugaaagagagcagucagaaagguucaauguguaucuuaugccgagccccaaccuggacguccacggcgagugugcuuugcagaucacuuacgaguauauaugccucugggaugugcaaaauccucggguaaagcugaucaguuggccacuguccgcacuccgccgauacgguagagacaccacaugguuuaccuucgaagccgggaggaugugugagacuggagaaggcuuauuuauuuuccagacacgggauggcgaggcuaucuaccagaagguucauucugccgcgcuggcaauugccgaacagcacgagcgucuuuugcaaagcgugaaaaacuccaugcugcagaugaagaugucagagcgcgcugccagucuaagcaccauggucccccucccuagaucugcauauuggcagcauaucacgaggcagcacuccacugggcaacuguaccggcuucaggacgugucaagcccacugaaauugcaccgaaccgaaacauuucccgcuuaucgcagugagcauuga

SEQ ID NO: 55445 - RNA, 996 nt, Artificial Sequence
  derived and/or modified sequence opt3 from DOK6__Homo_sapiens__NP_689934
auggccagcaacuucaaugacaucgugaagcagggcuacgucaaaauuagauccaggaagcuggggauauuucggcgcugcuggcucguuuucaaaaaggcuucuucaaaaggaccccgacgucuugagaaguuuccugaugaaaaggcagccuauuucagaaacuuucacaaagugaccgagcugcauaauaucaagaacauuacaagguugccacgggaaacuaaaaagcacgcgguagcuaucauuuuccaugacgagacgaguaaaaccuuugccugugaaagcgaguuagaggcagaagaguggugcaagcaccuguguauggaaugccuagguacacgccucaaugauaucucccugggcgagccggaccuucuggccgcuggggugcaaagagagcagaacgaaagguucaaugucuacuugaugcccacuccuaaccucgauauauauggagaguguaccaugcagaucacacaugaaaauauuuaccugugggacauccacaacgcaaaggugaaacugguuauguggccacucucuucguuacggcgcuauggccgagauucaaccugguuuacuuucgagagcgguagaaugugcgacacaggggaaggacuguuuaccuuccagacgagggagggcgagaugauuuaccaaaaggugcacagugccacucuugcuaucgccgaacagcaugagcgguugaugcuggaaauggagcagaaagcgcgucuacagaccucccucacagaacccaugacucugucuaagagcauaucccuuccucgcucagcauauuggcaccauauuaccagacaaaauagugucggcgagaucuacagccugcaggggcacggauuugguucuuccaaaaugucaagggcccagacauucccaagcuacgcucccgagcagagugaagaggcccaacagccuuugucucgguccagcucguauggcuucucuuacuccucaagucucauucaguga

SEQ ID NO: 55446 - RNA, 768 nt, Artificial Sequence
  derived and/or modified sequence opt3 from DOK7__Homo_sapiens__NP_001158145
augaccgaggccgcucugguggaaggccaggucaagcucagagacgggaaaaaguggaaauccagguggcuuguucugcggaagcccagcccuguggcagauugcuuguuaaugcugguauacaaagacaagucugagcgcaucaagggacuacgagaacguucaagucucacacuggaggauauuuguggucuugaaccaggccugccguaugagggguuggugcacacucucgccauagucugccugagccaagcgaucaugcugggauucgacucccacgaggcuaugugugccugggaugcaagaauuagguacgcccucggcgaagugcaccgguuucauguuacgguggcucccgguaccaaauuagagucugggccugcaacacugcaccuuugcaacgacgucuuggugcuggcccgcgauaucccacccgcuguaacuggacaguggaagcuaucggaccucagaagguauggcgccguuccuucaggcuucauuuuugaagggggaacccgggguuggcgccugcuuccagugcugggccgagggggagcggaucaguugcccgucagacuccauaggccucggcaucugccacaccagggcccguuaugggcagccgcugguagcacacgucccaaaaguccugggacccuggacuguggaggcgccugcggcccagggucccccggaaauccuacugcuggugaggcagccgagccaccccucacauguggccaagcggggcaguggcgcggauga

SEQ ID NO: 55447 - RNA, 1617 nt, Artificial Sequence
  derived and/or modified sequence opt3 from DOLK__Homo_sapiens__NP_055723
augaccagagagugccccagcccugccccaggcccgggggcuccccuguccggaucugugcucgcagaagccgcggucguuuucgcugugguacuuucaauccacgccacagugugggacagguacaguuggugugcagucgcccuggcugugcaggcauuuuauguucaauacaagugggaucgguuguuacagcaggguagcgccguguuccaguuucgcauguccgcuaacucuggccugcuaccugccucgauggucaugccacuccuggggcuugugaugaaagagcgaugccaaacugcgggaaaucccuucuuugaacguuucggcauuguaguugcagccacggguauggcuguggcccuguuuucaagcgucuuggcacucgggauaaccagaccugugccaacaaacacuugugugauccugggacuggcuggcggcgucauuaucuauauuaugaagcauagucucuccguuggggaggugaucgaaguauuagaggugcugcuuauauucgucuacuugaauaugauccugcuauaucuccugcccaggugcuuuaccccuggagaggcccuucugguguuggguggcauuucuuucguucucaaccagcugaucaaacggagcuuaacacugguggaaucccagggggacccagucgacuuuuuccuccuugugguaguugugggaaugguccugaugggcaucuuuuucucaaccuuguucguguuuauggauagugguacuugggcgagcucuauuuucuuucaccuaaugacauguguccugucccucggggugguucugccguggcuucaucgccugauaagaaggaaucccuugcucuggcuguuacaguuccuguuucaaaccgauacgcggauuuaccuacucgccuauuggucacugcuugcaacuuuggcuugccuggugguacucuaccagaacgccaagcgcagcaguucugaguccaaaaagcaccaggcuccuaccaucgcccgaaaguacuuccaucugauugucguggcaacauauaucccaggaaucauuuuugacagaccccuucuguacguugccgcuacuguguguuuggcggucuucauauuucucgaauaugugagguacuuccggaucaaaccucugggccacaccuuacguagcuuucugucgcuauuccucgaugagcgcgacucuggcccacugauucuuacacacaucuauuugcugcucgggaugucccugcccauaugguuaauuccgagaccuugcacccagaagggaucacuggguggcgcaagggcccuuguacccuacgcugggguguuggccguuggagucggcgauacgguggcaaguaucuuugguagcacuaugggggagauccgguggccaggcaccaaaaagacauucgaaggaacuaugacauccauuuucgcccaaaucauuucuguggcucucauacugaucuuugacagcggcgucgaucuaaauuauucauacgccuggauucuggggaguaucuccaccguuagccuccuggaggcauacacgacccagaucgacaaccuuuugcugccuuuauaucuccugauucuucugauggcguga

SEQ ID NO: 55448 - RNA, 1701 nt, Artificial Sequence
  derived and/or modified sequence opt3 from DONSON__Homo_sapiens__NP_060083
auggcccugagcgugcccggcuacuccccuggguucagaaagccaccggaggucguuaggcuccggcgcaaacgagcucguucuagaggagcagccgcgucacccccuagggaacuuaccgagccagcugcccggcgcgcagcccugguggcugguuugcccuuaagaccuuuuccagcagccggcgggaggggaggcgguagugggggaggccccgcugccgcgcggcgcaacccuuucgcacgacuggacaauagaccaaggguagccgcugaaccgcccgauggcccugcccgggagcagccagaagcacccgugccuuuucuagacagcaaccaagagaaugaucuccugugggaggaaaaguucccagagcguacaacugucacggaacuuccccagaccucccacgugucuuuuucggagccggacaucccuucaagcaaaaguacagagcugcccguugauugguccauuaagacucgccuucucuucaccucuagccagccauuuacaugggcugaccaucugaaagcccaggaagaggcgcaagggcuggugcagcacugcagagccaccgaagucacucucccuaaguccauacaggaucccaaguuaucaagugagcugagguguacauuccagcaaagccuuaucuauugguugcauccagcacugucuuggcuaccccucuuuccucggauuggagcugaccgaaaaauggccgguaagaccuccccauggucaaacgaugcuacgcugcagcacgugcuuaugagcgacuggaguguaucuuucacuucccuguacaauuugcucaaaaccaagcugugcccguauuuuuacguuuguacauaucaguucacuguguuauuucgcgccgcaggccuggccgggagcgaucucaucaccgcucuuauuucgcccacaaccagaggacugagggaagcgaugcggaacgagggcaucgaguucucuuugccucuaauaaaagaauccggucauaagaaggagacggcaucagggacaagucugggauacggcgaggaacaggccaucagcgacgaagaugaggaggaauccuucucuuggcucgaggaaaugggcguccaagacaaaauuaagaaaccagacauccugagcauuaaguugcgcaaagagaagcacgaagugcagauggaucacagacccgagucagugguccugguuaaagggaucaauacuuuuaccuugcucaacuuccugauaaauaguaaguccuuaguggcuacuagcggaccucaggccggucugccacccacacuacucucuccgguagcauuuaggggcgccaccaugcaaaugcugaaggcucguucagugaacgucaaaacgcaggcccuuaguggguaucgggaccaguucagcuuggagauuaccggaccuaucaugccacauucccugcacucucucacaaugcugcuuaagucgagccaguccggcucauuuagugcagugcuguacccccaugaaccuacugcgguuuucaauauuugcuugcaaauggauaaagugcucgacauggaggucgugcacaaggaacugaccaacugugguuuacaccccaauacacuggagcagcuaucucagaucccacuccuggggaaaagcucccuucgaaacguaguuuugagagauuacaucuauaauuggaggucauga

SEQ ID NO: 55449 - RNA, 6897 nt, Artificial Sequence
  derived and/or modified sequence opt3 from DOPEY2__Homo_sapiens__NP_001307643
auggaccccgaggaacaggagcugcucaacgauuaccgguauaggagcuacuccucugugaucgaaaaggcccuucggaauuucgagucaaguagcgaaugggcugaccugauuuccucuuugggcaaguuaaacaaggcacugcaaucgaaucuacgcuauucacuccugccucgacgucuucugauaagcaaaagauuggcccagugccuccacccagcgcugccgagugggguccaccugaaggcucucgagaccuacgagaucauuuuuaaaaucguuggaacuaagugguuagccaaggaucuguuccuuuauuccugugguuuguuuccccugcuagcacacgccgcugugucuguaaggccugugcuccugacucuuuacgaaaaauauuuccugccauugcagaagcuccuguuacccagccugcaggcauuuauugucggccuccuuccugggcuggaggaaggauccgagaucucagaccggacggaugccuugcuacugcgccucagucuggugguuggcaaagagguguucuacaccgcucuuugggguagcguccuggccucuccauccauaagauugcccgcgucaguguuuguaguugggcacaucaacagggacgcaccuggacgggaacaaaaguacaugcucggcacaaaucaccagcugacugucaagagcuuacgcgccagucugcuagauucuaacgugcucgugcagcgaaauaaccuggagauugugcuuuucuuuuucccauuuuauaccugcuuggacuccaaugaaagagcuaucccgcugcucaggagcgauauuguccggauccugucggccgcaacacagacccuucugcgucgcgacaugucuuugaacagaaggcucuacgcuuggcuguuaggcuccgauauaaaggggaauacuguugugcccgagucagaaauuaguaacagcuaugaggaccaauccucuuacuucuuugagaaguauagcaaagaucugcuaguagaaggacucgccgagauccugcaucagaaguucauugacgcggacguggaagaacggcaccacgccuaccuuaaaccuuuccgagucuugaucucacugcucgauaagccagaaaucgguccccaggugguuggcaaucuguuuuuagaggugauucgcgcauucuauaguuacuguagagacgcucugggguccgaucuuaaauugagcuacacacagucuggaaacucacucauaagugccaucaaggagaauaggaacgcuagcgaaauugucaaaaccgugaaccugcuaaucacgucccugucuacugacuuucucugggauuauaugacccggugcuucgaggaauguuuucgcccuguaaagcaaagauacucgguuaggaauagcguguccccacccccgacagucucagagcugugcgcccuuuugguguuccuguuagacgucauaccucucgaacuguauagugaggugcagacucaguaccuuccccaaguucugggcuguuuggugcagccacucgcagaggauauggaagcccugucucuaccugagcugacccaugcucucaagacaugcuuuaaaguacugagcaagguccagaugcccccauccuaucuugacaccgaaucaacgagcgguacuucuucccccgugaaaggggagaacggaaagauuaucuuggagacaaaagcgguuaucccuggcgaugaagacgcaaguuucccaccgcugaaaagcgaggauucuggcauuggguuauccgccucaagucccgaacucagcgagcaucugcgugugccucgggucucgcuugaacgagacgacguguggaagaaaggagguuccaugcagagaaccuuucuguguauccaagagcuaauugcuaauuucgccucuaagaacauauuuggcguacagcucacugcaagcggggaggaaucaaaaagugaggaaccagccggaaagagggaucgcgacggcacacagucccuggcugccaaugauucuagccggaaaaacuccugggagcccaagccuaucaccgugccacaguucaagcaaauguugucagaccuguuuacggcaagagguagccccuucaaaaccaagaguucugaauccccgagcucgucaccuucuaguccagcgaggaaaaaugggggcgagugggauguugagaaggucgugauugacuuaggaggcucccgcgaggaacgacgggaggcuuucgccgcagccugccaucuccugcuugauugugcuacauuucccguguaccugagcgaggaagagacugagcaguugugcgccacccucuuccagcugccuggggcaggagacucuagcuuucccuccuggcuaaaaucacugaugacaaucugcuguugcgucacugauuguuaucuucagaacguugcuaucaguacccuccuggaagugauuaaucacagccaaucuuuggcccuggugauagaggacaagaugaagcguuacaaauccucaggucacaacccauucuuuggcaaguuacagaugguaacagucccucccaucgcgccagggauucucaaagugaucgccgaaaagaccgauuucuaccagagaguugcuagggugcuguggaaucagcuuaacaaagagacucgcgagcaucacgucacgugcguggaacuguuuuaucgguugcauugucucgcaccgacagccaauauuugcgaggacaucauaugucacgcucugcuagauccugacaagggaaccagacuggaagcccuuuucagguuuaguguuaucuggcaucucacucgagagauucaaggcagccgcgugaccucccacaaccggucuuucgacagaucgcuguuuguagucuuggauagcuuagcaugcacagacggugcgaucggggccgcugcccagggcuggcuggugagggcacucucacugggagauguggcucguauucuugaacccguccuguugcuacugcuccagccaaaaacccaacgcacuuccauccacugucugaagcaggagaauagugccgacgaucuucaucggugguucaacagaaagaaaacaucuuuuagggaggcaugcgccguucccgaaccucaggagagcggcuccgaggaacacuuaccacugucacaguucacgaccguggaccgagaagcuauaugggcggagguagagaaggaacccgagaaauacccucucagaggggaauugucugaggaggaacugccguauuacguggagcucccagaucgcacugcccauggagcacccgacagcagugaacacacagaguccgcugauaccagcucuugucacacagacucagaaaacacuuccaguuucagcucgccuucucaugaucugcaagagcuuuccaaugaggaaaacugcugcgccccaauucccauggguggcagagccuauccuaagaggagcgcucuguuggcagccuuucagucagagaguuucaaagcgggggcuaagcuaucucugguccggguggacuccgauaagacccaggccagcgaaucauuuaguagcgacgaggaagcagaccucgaguuacaggcccugacgaccucccgacuucugaaacaacagagagagcgccaggaagcuguugaggcacucuucaagcacaucuugcuguaccuccagccguaugauucuaggcgugugcuguacgccuuuagcguccuugaagcggugcuaaaaacaaaucccaaggaguucauugaagcuguuucccggacuucaauggacaccucuaguacagcccaucugaacuugaucucgaauuuacuggcaagacaccaagaggcccucauaggacagagcuuuuacggcaaacugcagacucaagugccaaacgucuguccucauucccuucugcucgaguugcugaccuaucuaugccugucuuuccucaggucauacuaucccuguuaccuuaagguaagccaccgcgauauccuggguaaucgagacgugcagguuaaguccguggaagucuuaauuagaaucaugaugcaguuggugaguguagcuaaaucuagcgaggggaagaacguggaauuuauucacucacugcuccagcggugcaaaguccaagaguucguucugcuuucccugagugccagcauguauacgucucagaagagguacggccucgcaacagcucaucacggacgcgccuugccagaagauucccuguuugaggagucauuaaucaaucuaggccaggaccagauauggagcgaacauccucugcaaauugagcuccuuaaacugcuacaggugcugaucgugcucgaacaccaucuggggcgugcgcacgaggaggccgaaaaccagcccgaucuuucgagagaguggcagcgggcacucaauuuccaacaggcuaucucugcccugcaguauguccagccacacccguugaccagucaaggacuguuaguguccgcuguuguaaggggccuacagccugcauacgguuacgggaugcaucccgccugggugagccuggucacucacucacucccauauuucggaaagucccuuggcuggacagugacccccuuuguugugcagauuuguaagaaccuggacgauuuggucaaacaauacgaaucugagagcgugaagcugaguguauccacuaccagcaaacgcgaaaauaucucuccugacuauccacucacacugcuugaggguuuaacgaccauuucacauuucugccugcucgagcaggccaaccagaauaagaaaacuauggcugcgggcgaucccgcaaacuugcgaaacgccagaaaugcuauacuggaggaauugccucggacagucaacaccauggcccugcucuggaaugugcuuaggaaggaagagacacagaaacgcccgguugaccuguugggggcaacuaagggaaguuccagcguguacuuuaagaccacgaaaacaaucagacaaaagauucuggacuuccucaacccacugaccgcccacuuaggcguccagcuuacugcugcgguggccgcaguuuggucuaggaaaaaggcucagcggcacucgaaaaugaagaucauucccaccgccucagcaagccagcugacacucguggaucuagucugugcccuguccacuuugcaaaccgacacacugcuccaucuugugaaggaaguagugaaacguccuccccagguuaaagggggagaugagaagaguccacuggucgacaucccuguguugcaguuuugcuaugcuuuccugcagcgccuccccgugccagccuuacaagagaauuuuucuagccugcuuggcguccugaaggaauccguacagcuaaaccucgcgccuccggguuacuuccuguugcugucaaugcucaaugauuuugugacgcgaacccccaaccuugagaauaaaaaggaccagaaggaucugcaagaaauaacucagaaaaucuuagaggcaguugggaacauugccggaaguucucuggaacagacaagcugguuguccagaaaucucgaggugaaggcucagccacaagccucacuggaggaaagcgacgcugaggaagaucuauaugacgcagccgcugccucugcaauggucuccaguagcgcgccuucgguguacuccguucaggcccuuucucugcucgcugaggugcuggccucauugcuggauauggucuacaggagcgacgagaaagaaaaggcagugccccucaucagucggcuucuguauuacguauucccauauuuacgcaaccacuccgcuuacaaugccccuucuuuuagagcaggcgcccagcuguugagcucacucuccgguuaugcuuacaccaaaagggcguggcggaaggaggugcuggaacuauuccuugaucccgccuuuuuccagauggacacaaguuguguucauuggaaaagcauuaucgaccaucugcucacacaugagaaaaccauguucaaggaucugaugaacaugcaaucuucauccuugaaauuauuuagcucuuucgaacagaaggcaaugcugcucaaacgacaggcuuuugccgucuucaguggcgagcuugaccaguaucaccuguaccuaccgcugauacaagagagacucacggauaauuugcgcguggggcagacuucgauuguggccgcacagauguuucuguucuuuaggguccuucugcuccggaucuccccacagcacuuaaccagccuguggccuaucaugguuucagaauugauucaaacauucacccagcuggaggaagaccucaaggaugaggacgaaucucuucguagcacuaacaaggugaacagaacaaaaguauccgugcccgaugcuaauggaccaagugucggcgagauaccccagucagagcugauccuauaccugucugccugcaaguuucucgacaccgcguugagcuucccuccggauaaaaugccccuguuucaaauuuauaggugggcuuucaucccagaaguggacacagaggggccugccuuucuuuccgauguugaagagaaccaucaggaauguaagccccacacugugcgcauucuggaguuacucaaacugaaguucggagagaucaguagcuccgacgaaauaaccaugaaaucugaguucccuuugcugcggcagcauucagucagcucgauccgacagcucaugccauuuuucaugacgcuuaauggcgcauuuaagacacaaagacagcugcccgccgauuccccugguaccccauuccuagacuuucccguaacugacaguccgaggauucugaagcagcucgaagagugcaucgaguacgauuucuuggaacacccugagugcuga

SEQ ID NO: 55450 - RNA, 4614 nt, Artificial Sequence
  derived and/or modified sequence opt3 from DOT1L__Homo_sapiens__NP_115871
augggcgagaagcuggaacucagacuuaaaagccccgugggggccgagccugcuguguacccauggccgcugcccguuuaugacaagcaccaugaugcagcccacgaaaucauugagaccauaaggugggugugcgaagagaucccugacuugaaauuagcgauggagaacuacguacugauugauuaugacacaaaguccuucgaaucuaugcagcggcuaugugauaaauacaaucgcgcuaucgacucaauucaucaacucuggaagggaacuacgcagccaaugaagcugaacacccgacccaguacaggucuucugcgucacaucuugcaacagguguauaaucauagcgucacugauccugagaaacucaacaauuacgaaccauuuucccccgagguguauggcgagaccucuuucgaccugguugcccagaugauagaugaaaucaagaugacagacgaugaccuguuuguggaucucgggucgggagucggccaggugguauuacagguugcagccgcuaccaacugcaaacaccacuacgguguggagaaggcagacauuccugccaaauacgcugaaacuauggacagagaguucaggaaguggaugaagugguaugggaaaaagcaugccgaauacacacuggagcggggagauuuucuuucagaggaauggcgcgagagaaucgcgaauaccagcgucauuuucgugaacaauuuugcauucggcccagaaguggaccaccaguugaaagagagguuugccaacaugaaggaaggcgggcggaucgucaguuccaaaccguucgcuccccugaauuuucgcauaaacucucgaaaucuaagcgauauuggaacgaucaugagaguuguggagcucuccccucugaaggguucaguaaguuggacuggcaaaccagugagcuauuaccuucauaccauugacaggacaauccuggagaacuauuucucuuccuugaagaaucccaagcuccgggaggagcaagaagccgcacgucgcagacagcagagggagucaaaaagcaacgcugccacuccuaccaaggggccagaaggaaaagucgcgggccccgccgaugcaccgauggacaguggugcugaggaggaaaaggccggggcugccacagugaaaaagccuucucccuccaaggcacggaaaaagaaacugaacaagaaaggacgaaagauggccggccgcaagagaggcaggcccaaaaagaugaauaccgcuaacccugagcggaaacccaagaaaaaucagacggcguuagaugcacugcacgcccaaacuguuagccagacagcugccucgucuccacaggacgcauaccgcuccccacacucaccuuuuuaucaacucccaccgagugugcagagacauagccccaacccucuucuggucgccccaacucccccugcuuugcagaagcuacuggaauccuucaagauccaguaccuccaauuccuggccuacaccaaaacaccacaguauaaggcaucucuucaggagcuguuggggcaggagaaagaaaagaaugcgcaacuccugggagcugcccagcaguuacugagccacugucaggcacaaaaagaggaaauuaggcgucuauuucagcagaagcucgaugagcugggugugaaagcccuuaccuacaacgacuugauacaggcucaaaaggaaaucucagcccauaaucagcagcugcgggagcaaagugagcagcucgaacaggauaaccgagcacugagaggccagucccuucaacuguugaaggcuaggugcgaggaacuccagcuggacugggccacguuaagccuggagaaacuacucaaggaaaaacaggcgcugaagucucagauuucagagaaacaacgccacugucuugaguugcagaucaguauaguagaacuggaaaagagccagcggcagcaagaacuccugcaguuaaaguccugcguucccccggacgaugcccugucucuucauuugagagggaaaggagcucucggcagggagcuggaaccugacgcaucgcgccuacaccuggagcucgauuguaccaaguucagccugccacaccuuuccucaaugagucccgaguugucuaugaauggucaggccgcuggguaugaacugugcggcguguuaagccgaccuuccucaaaacaaaacacaccccaguaccucgccagcccacuggaccaggaggucgugccuuguacucccucucaugucggacggccacgucuugaaaagcuguccggcuuggcagcgccggauuauaccagacucaguccugccaaaauugugcugaggcgccaccuaagccaggaccauacaguucccgggcggccagcugccucugagcugcacuccagagcagagcacacuaaggaaaauggacuccccuaccaaucaccuagugugccagguagcaugaagcugucgccccaggauccuaggccgcuuuccccaggcgcuuugcagcuggccggggagaaaucuagcgaaaagggauuacgagagcgcgcauauggcucaaguggugaacucaucaccucccugcccaucucuauuccucuuagcacaguacagccaaacaaacugcccgucuccaucccucuagccucagugguucucccgagccgggcugagagagcgaggaguacccccucuccagugcugcaaccucgugaccccuccagcacuuuggagaagcagauuggggccaaugcacauggcgcuggaucgcgcucacuggccuuagccccagcuggcuuuucuuacgcagggagugucgccauauccggagcgcucgcugguagcccugccucucugacgcccggcgcagaaccagccacacuugaugagagcuccucaagugggagccuguucgcuaccgugggaucucgguccucaacuccgcagcacccuuugcuccuggcacagcccagaaacagucuaccagccagccccgcgcaucaacuguccucuucgccuaggcuuggcggugcugcccaggggccacuccccgaagcaagcaaaggcgaccugccuucagauuccggauuuagugacccggagucugaagccaagcgacggaucguauucaccauuacaaccggcgcugggagcgccaagcaguccccaucaucuaaacacagccccuugacugcaagugcucgcggagauugcgugccuucccauggccaggacagcagaaggcggggucgaagaaagcgcgccucugcggggacacccucacuguccgccggaguuaguccaaaaaggcgugcauuaccuagcgucgcuggccucuuuacgcaacccucggguucuccacugaaucuuaacuccauggugagcaacaucaaucagccucuggagaucaccgccauuucaaguccggagacuucuuugaaguccagccccgugccauaccaggaccacgaucaaccucccguccucaaaaaggaacggccacugucacagacaaacggcgcucacuauaguccucuaaccagcgacgaggaacccggguccgaggaugaaccgucuagcgcaagaauagagaggaaaaucgccacaauuucccuggagucaaagucuccaccuaagacucuugaaaauggaggcgggcucgccggacgcaaacccgcuccagcgggcgagcccguuaacaguucgaaguggaaaagcaccuucuccccuaucucugacauuggucuggcaaagucagccgauagcccguugcaggcuuccagugccuuaucucagaauagccuguuuacguuccgacccgcacucgaggagccaucagccgacgcuaaacuggcggcccauccuagaaagggguuucccggaucccuuaguggcgcagauggucugagcccuggcaccaacccagcuaauggguguacauucggaggcggguuggccgcagaccuaucucugcacuccuuuucagauggagccagccucccccauaagggcccugaggcugccggucugucgucuccacuuaguuuccccucccaacgggggaaagaaggaagcgacgcgaacccguucuuaucaaagaggcagcuggauggccucgcagguuugaaaggcgaggggucccgcggaaaggaagccggcgaagggggacugccucucugcggcccaacugacaaaacaccccugcuuucugguaaggcugccaaggcucgugauagagaaguggaccugaaaaaugggcacaacuuguuuaucagcgcagccgcugugccuccaggaagucuacuguccggccccggccucgccccggcagcgagcucugccgggggagcugccucaagugcacagacccaucgguccuucuuagguccuuuucccccaggcccucaguucgcucuggggcccaugagccuucaagccaaucugggaucuguagcaggcucgucaguccuccagagcuuguuuuccagugugccagccgcugcgggucugguucacgugucuagcgccgcaacuaggcucaccaacucccacgcuauggggucauucaguggagucgccggcggcacggucgggggaaauuga

SEQ ID NO: 55451 - RNA, 1227 nt, Artificial Sequence
  derived and/or modified sequence opt3 from DPAGT1__Homo_sapiens__NP_001373
augugggccuucagcgagcugcccaugccucuccuuaucaaccugauuguguccuuguuaggcuuugucgcuaccguuacacugauaccagcauucagagggcacuuuaucgccgcgaggcuaugcggacaggaccucaauaagacuucucggcaacagauuccggaaucacagggugugaucaguggcgcuguauuccugauuauccuguuuuguuucauacccuuuccuuuccuuaacugcuuugugaaagagcaguguaaggccuucccacaucacgaauuugucgcauugaucggggcccuccuggcuauuugcuguaugaucuuccugggauuugcagaugacgugcucaauuuacgcuggcgacauaaacugcuuuugcccacggccgcuagccugccucuacucaugguuuacuucaccaacuucggcaauacaacuauuguggucccaaagcccuuucguccuauccugggucuucaccuggauuuggggauacucuauuacguguauaugggacuguuagccguauucugcaccaacgcgauuaauauccuggcaggcauuaacggccucgaggccgggcaaucccuuguuaucucugcuucgaucauuguguuuaaucuggucgaauuggagggagacuguagagaugaccauguguucucacuauacuuuaugauaccauucuuuuucacaacccugggucuccuguaucacaacugguacccgagcaggguguuugucggcgauacuuucugcuauuuugccgggaugacauucgcaguugugggaauccuuggccacuuuaguaaaaccaugcuguuguucuucaugccccagguauuuaauuuccucuacucccugccucaguuacugcauauuaucccauguccccggcaccgcauaccuagacuaaacauuaagacggguaagcucgagaugucuuacagcaaauuuaagacuaaaucccugucauuccuugggaccuuuaucuugaagguggcugaaagucugcagcucgucacagugcaucaaagcgagacugaagacggagaguucaccgagugcaauaacaugacacugaucaaucuucuguugaaaguucucggcccaauucacgaaaggaaccugaccuuacugcuacuccugcuucagaucuugggcucugccauuacguuuuccauacgguaucagcuggugcgccucuucuacgaugucuga

SEQ ID NO: 55452 - RNA, 612 nt, Artificial Sequence
  derived and/or modified sequence opt3 from DPCD__Homo_sapiens__NP_056263
auggccgugaccggcuggcuggagagccucagaacagcucagaagacugcacuucugcaagacgggaggcggaaaguccacuacuuguuccccgauggaaaggaaauggccgaggaauaugacgagaaaacguccgaauuacugguucgcaaguggcgagugaaaucugcgcuaggugcuaugggccaguggcagcucgagguaggggauccugccccacugggagcaggcaaccuugguccggagcugaucaaggaaucaaaugccaaccccauuuuuaugcguaaggacaccaaaaugaguuuccaguggagaauaaggaauuugccuuacccaaaggauguguauagcgucuccguggaccaaaaagagcggugcaucauuguucgcacaacuaacaagaaauacuauaagaaguuuucuauccccgaucucgacagacaucagcugccucuggaugacgcucucuuaucguucgcacacgccaauuguacccugauuaucucauaccagaaaccaaaggaaguggucguggcugagagcgagcuucagaaagaauugaagaaaguaaagacagcccauaguaacgauggggacugcaaaacccaauga

SEQ ID NO: 55453 - RNA, 4182 nt, Artificial Sequence
  derived and/or modified sequence opt3 from DPCR1__Homo_sapiens__NP_543146
auggcccagcccgugcacagccugugcuccgcuuucggccuccaauguugccuucuguuuuuguuagcaucuuggggagccggggcgaccacauuccaggaguaccagaagacuggugaacugucaacgagugaccauaucuuuccucuaaccccaggccucgucuauagcauuccguucgaucacauaguucugcauuccgggcagagacccccugagcuuccaaaaucuacagaaauccacgagcaaaagaggcauuguaacacuacccggcacucgaaacccacagacaagccuaccggaaauucaaaaacuauugaucacaagagcaguacagacaaccaugaagcuccacccaccuccgaggaaaauucuagcaaccagggcaaggauccuaugauccgcaaucagcgauccguggacccagccgauucaacgacuacccacaaagaaagugcagguaagaaacauauuacaccggcccccaagagcaaaaucaacugccguaagucuacuaccgggaaguccacaguaaccagaaaaucagacaagacgggaaggccucuggagaaaagcaugaguacuuuggauaagacaucuaccuccagccacaaaacuacaaccucguuucacaauucuggcaacucccagacgaagcaaaaaucaaccaguuucccagaaaagauaacagcugcaagcaagacuaccuacaaaacaacuggcacccccgaggaguccgaaaagacagaggacucucggaccacuguggccagcgauaaacuccugacgaagacaaccaaaaauauccaggaaacuauuucagcuaacgagcugacccagagucucgccgaaccuacagagcaugggggacgcaccgcgaaugagaacaauacuccaucccccgcagaaccgacagagaacagagaaaggacggccaaugagaacaccacuuuaagcccugcugaacccaucgagaaccgggagcgcacagccaaugaaaacaccgcaccauuuccugcuggucccacagagaaucgagaaaugacugccaacgagaauaccacgcuguucccagcggaacccaccgagcacggcgagagaacagccaacgaaaauacuaccccuucuccagcagagccgacagaacauggggagaggacugcuaacgagaauaccacgcccaguccugccgaaccaacagagcacggagaacggacccccuuugcuaacgacaagacuacaucaagcuccgccgagucuaccgaacauggcgagcguacuccucuugcaaaugagaacaccacaccaucgcccgccgaaccgacggagaaucgcgaaagaaccgcuaacgagaauacuacaccuagcccagcgggucccaccgaaaacagggagacaacugcaaacgagaagaccacguuguccccugucgaacccacagagaaucgggaaaccacugccaacgagaaaaccacaccaaguccugcugaacccacugagaaugggcagcgaaccccauucgccaacgagaagacaacgucaucuagcgcagaaccgaccgagcacggagaacgcacuccucuggccaaugagaacacaacccccuccccagcugagcccacugaaaauagagagaggacagccaacgagaaaaccacgccuucaccagcagagcccacugaaaauggcgaucggaccccucuagcgaacgagaagacaaccccgagccucgcugagccaacugaaaauggccaacgcacacccuuugccaacgagaaaaccacaucuuccagugcagaaccuacugagcacgaagagagaaccccacuggccaaugagaacacgacacccagcccugcugaaccgaccgagaauagggaacguacugccaacgagaacaccacacccucuccagcagggccuacugaaaaucgggagaugaccgcuaacgagaagacgacacuuuuccccgccgaaccaaccgagaaucgagaaagaacugcgaacgagaagacaaccuccaguccugccgagcccacugaaaauggacagaggacaccauuugcuaacgagaaaaccacgucaagcucggcagaaccgacugagcauggugaacgcaccccucuggccaaugagaacacaaccuugucccccgcugagccaacagaaaaucgggagagaacugccaacgaaaagaccacgcccuucccugcagagccaacagaaaauagggagcgcacugcgaacgagaauaccacacccucuccugcccagccgaccgaaaacggcgaccgaacuccacucgcuaaugagaaaaccacacccagccuggccgaaccuacggagaacgggaagcggacucccuucgcaaacgagaaaaccacaucaaguuccgcugaaccaaccgagcacgccgaacguacuccuuuagcaaaugagaacacaaccucuagccccgccgaaccaacggagaauagagagaggacugcuaacgaaaagacaacccaauuuccugcggagccgaccgaaaaucgcgaguccacugccaacgaaaagacaacccccuucccagcagagccuacagagaaucgggaauggacugcuaacgagaauacgacccugucacccgccgaaccaacagagcaugaagagaugacuccucucgccaacgagaaaaccacacuuagccccgcugaaccgaccgagaauggagaaagaacuccauuuacgaacgagaagaccacaccuaguucugcagaacccacugagcacggcgagaggaccccacuggccaaugaaauuacaacccccucccgagcggagccuacugaacacggugagcgcaucgcuaacgagaaagccacaccgagccccgcaaagccaacggaacauggggagaccacugugaaugaagacacaaccccuucgucagccgagcccaccgaaaacggcgagcggacaccuuuggcuaaugagaacacuacgaccucuccaacagaaaguacugagcacggagaaagaaccgcaaacgagaaaacaacccccuccccugccgaaccaacugagcauggcgagaggacgcccagcgcgaaugaaaagacaauaccgucuccugcuaaaccaaccgagcacgaagagaugacucccagcgccaacgaaaauaccacaccuuccccaguuaagcccacugagcauggggagaagaccacacuagcaaacgagaaaauuacgcugucaccggaaggaccuaccgaacacggugccaagacuacaagugcuaaugagaaaaucacccccagccucgccaagccaacugagcacggcgaacguacaaccucuccuaacgauaaaauuacguccucagcagcugagaguaccgaacaucgcgaccgggccacaagcgcgaaugugaucacucccgccccagcagagcccaucaagcacgcuaagagaaccacacuggcccaugagaaaaugacucaggucaccgaaaaguccacagagcacccugagaaaaccacuucuacgacagaaaagaccacuaggaccccagaaaaaccgacacuuuauucggagaagacgauuuguaccaaggggaaaaacacucccgugccugaaaagccaacagagaaucugggaaacaccacuuugacaaccgagacaauaaaagcucccguaaagagcacugaaaauccugagaaaaccgcagccguuacgaagaccaucaagccaucagugaaagucacaggcgauaagucccucacuaccacaaguucucaucugaacaaaacugaagugacccaccaggugcccacggguagcuucacauuaauuaccucccgaacuaagcugucaucuaucacaagcgaggccaccgggaaugaaagucacccuuaccuaaacaaagacggcucccagaagggaauacaugcuggccaaaugggggagaaugauagcuuuccggcgugggcaauugucaucguugugcucguagccgugauccugcuuuuggucuuccugggacucauuuuucuggugucuuauaugaugcggacucgcagaacccuuacacagaacacgcaguacaacgacgcugaggaugaagguggcccaaauucauaucccguuuaccugauggagcagcaaaacuuggggaugggacagaucccuucccccagguga

SEQ ID NO: 55454 - RNA, 1236 nt, Artificial Sequence
  derived and/or modified sequence opt3 from DPEP1__Homo_sapiens__NP_001121613
auguggagcggcugguggcuguggccccucguggccgucugcaccgcugacuucuuuagagaugaggcagaaaggaucaugcgggacuccccuguuauugaugggcacaacgaccuuccauggcagcuguuggauauguucaauaaccgcuuacaagacgagcgagccaaucugacaacucuagcgggaacgcauaccaacauaccgaagcuccgugcugguuuugugggcgggcaguucuggucuguauacacacccugugauacucagaauaaagacgccgugagaaggacccuggaacagauggaugucgugcaccggaugugccgcauguauccugagacauuucuuuacguuaccucaagugcaggaaucagacaagccuucagggaaggcaagguggcuagccugauuggugucgaagggggacauuccaucgacucuucguugggcgugcuccgggcacuguaucagcugggcaugcgcuaccucacuuuaacacacucauguaacaccccaugggccgauaauuggcugguagacacgggggauagcgagccccagagucagggacuuuccccuuuuggucaacgaguugugaaagaguugaacagacugggcguccuaauugaccucgcucaugugucuguggccacuaugaaggcgacccugcagcuuagcagggcaccagucaucuucucccacucaagugccuauagcguuugcgcuucucggcguaaugugcccgacgauguacugcgcuuggugaaacagacagacucccucgucauggugaacuuuuacaauaacuauauaucauguacuaauaaggccaaccugagccagguugcagaucacuuagaccauaucaaggagguggcuggggccagagcggucggauucggcggugauuuugacggggugccuaggguaccagaaggacuggaggauguuaguaaauacccggaccucauugccgagcuucugcggcgaaauuggaccgaagcagaggugaagggcgcuuuggccgauaaccuacugcgcgucuucgaagcuguggagcaagccucuaaccucacacaggcacccgaagaggagccuaucccacuggaccagcuuggcggguccugcagaacccacuacggauauagcucgggugccucuucccugcauaggcacuggggcuugcuccuggcuucauuagcgccccugguccuaugucucagucugcuuuga

SEQ ID NO: 55455 - RNA, 1461 nt, Artificial Sequence
  derived and/or modified sequence opt3 from DPEP2__Homo_sapiens__NP_071750
augcagcccagcggccuggaggggccuggaaccuucgguagauggccacuccuuucccuguuguuacugcuacuccugcuucaaccggugacaugcgccuacacuacgcccggcccuccaagggcucugaccacauugggggcaccccgggcccacacuaugccuggaaccuaugcgccaucuacaacccucucaagucccagcacucagggccugcaggaacaggcucgcgcccugaugcgagacuuuccucucgucgauggucauaacgacuuaccacugguucuucgucaaguguaccagaagggguugcaggauguaaaucugagaaacuucuccuauggacagacaucucuagacaggcuccgggauggccuggugggcgcacaauuuuggucggccuacgucccgugucagacccaggaccgcgaugcucuuagacugacguuggagcagaucgaccucauuaggcggaugugcgcaucauauagcgaacuggaguuagugacuuccgccaaagcucugaaugauacccaaaagcucgccugucuuauagggguugaaggaggucacucccuggacaacucuuugagcauccuacgcacauucuacaugcugggcgugcgauaucucacucugacccauacaugcaauacccccugggcggaguccucagcaaaagggguccacaguuuuuacaacaauauuagcggacuuacggauuucggcgagaaggugguagccgaaaugaacagacuggguaugaugguugacuugucucauguguccgaugcugucgccaggcgggcacucgaggugucacaggcuccugugaucuuuagccacagugccgcgcguggggucuguaauucugcccgcaacguuccagacgacauucugcaguuacugaaaaagaauggaggcgugguaauggugucccuaagcaugggcgucauccaaugcaaccccucggcaaaugugucuacuguugcugaucacuucgaccauauaaaggccgugaucggguccaaauuuauuggaaucgguggcgauuacgacggggcuggaaaguucccucagggccucgaagaugucucaacauauccagugcugauugaggagcuuuugaguagagguuggagcgaagaggaacugcaggggguacucaggggcaaccugcuucggguuuuucgacagguggagaaaguccaagaagagaauaaguggcagaguccccuggaggacaaauucccggaugaacaguugucuagcucaugucacagugaccucucccgccugagacagaggcagagcuuaaccucuggacaagagcugacugaaaucccuauacauuggacagccaagcuacccgcaaaguggucagugagugagagcuccccacacauggccccuguccucgcugugguugcgaccuuucccgugcugauucuuugguuguga

SEQ ID NO: 55456 - RNA, 1542 nt, Artificial Sequence
  derived and/or modified sequence opt3 from DPEP3__Homo_sapiens__NP_071752
augaucagaacuccccugagcgccuccgcucacaggcuccuucugccuggcucucgggggcgcccaccgcgaaacaugcagcccacaggacgugaggguucaagagcauugaguaggcgguacuuacgcagacugcuacuccugcuucuguugcuccugcugaggcaaccugugacucgggccgaaacgaccccaggcgcgccccgcgcucucagcacauuaggguccccuucucuguucacuaccccaggaguccccucggcccuuacaaccccuggcuugacuacaccagguaccccgaagacgcuggaccuacgagggagagcacaggcccucaugaggucauuuccccugguugauggacauaaugaccuuccucaggugcugcggcagcguuauaaaaacguauugcaagaugugaaucuccgcaacuucagccacggccagaccagucuggacagauuaagggauggccuggucggggcucaguuuugguccgcaucugugagcugccagucccaagaccagaccgccguucggcucgcucuugagcagauugaucugauacaucgaaugugugccucauacagugaauuggagcuagugacaagcgcggaaggacucaauucuucccagaagcuggcaugccugaucggugucgagggcgggcacucacuugacagcagucugucuguguugcgcuccuucuauguacucggaguuagauaccugacuuuaaccuuuacauguagcaccccaugggccgagucgucuacgaaauucaggcaucacauguauacuaacguguccggccugacaucauuuggugaaaaggucguggaggaacuaaaucggcucgggaugaugauugaucugaguuacgcuagcgacacccuuauccgcagaguguuggaggucucccaagcccccguuauuuucucucacagcgcagcuagggccgugugcgauaaccugcucaauguaccugacgauauccugcagcuucugaaaaagaacggaggcauagugauggucacuuugucaaugggcgugcuccaguguaaucuguuagcgaacguuaguacaguggccgaccauuuugaccacauccgugcagucauuggguccgaguucaucggaauugguggcaauuaugaugggaccggacgguuuccacaaggccuggaagacgugagcacguaccccguacuaaucgaggaacuccugucucgaucauggagugaggaggaacuucaggguguuuugagagggaaccugcucaggguguuccgccaggucgagaaggugcgggaagagagcagagcucaguccccggucgaagccgaguuuccuuacggccaacugucuaccucgugccauagccacuuagugccccagaauggacaccaggcuacacaucuggaaguuacuaaacagccaaccaacagggugccuuggcgcuccucaaacgccagucccuaucuuguaccaggcuuggucgcagccgcuacaauacccacuuucacccaauggcucuguuga

SEQ ID NO: 55457 - RNA, 1245 nt, Artificial Sequence
  derived and/or modified sequence opt3 from DPF1__Homo_sapiens__NP_001128627
augggcgggcugagcgccagacccaccgcuggaaggacagacccugcagguacuugcuggggccaggauccaggguccaagauggccacggugaucccgggaccccucucucuuggcgaggacuucuaccgggaagcgauugagcacugucgcucauauaacgcucgacugugcgccgaacguaguuugagauuaccuuuucuggauagccaaaccggugucgcacagaauaacuguuacauauggauggagaaaacacauagggggccaggacuagcccccggccagaucuauacuuacccugcucggugcuggcgcaagaaaagaaggcucaauauucuggaagacccacggcuucgccccugugaguauaagaucgauugcgaggcaccucugaaaaaggaaggcggguugccagagggaccgguucucgaagcccugcugugugcugagaccggugagaagaaaauugaacucaaggaggaagagacaaucauggacugccagaaacaacaguuacuggaguucccccacgaucuugaaguggaggacuuggaagaugacauaccucgaagaaagaacagggccaaaggcaaggcguacgggaucggaggccugcggaagcgucaggauaccgcaucccuagaggaccgcgauaaaccauauguaugugacauuugcgguaagagauacaaaaauaggcccgggcucucuuaccauuauacucacacacaucuggccgaagaggaaggagaggagaacgcugaacggcacgcccuuccuuuucaccgaaagaauaaccauaaacaguucuacaaggagcuggcaugggugccagaagcucaacgcaaacacaccgccaagaaggcgcccgacggcacggucaucccgaauggcuauugugauuuuugccucgggggaucgaaaaagacugguugcccugaggacuugauuucaugugccgauugcggcagaagcgggcaucccaguugucugcaguucaccgugaacaugacagcagcuguuaggacuuaccgguggcagugcaucgaauguaaauccugcucuuuauguggaaccagcgagaaugacgaucagcugcucuuuugcgacgauugugaccgcggcuaucacauguacugccuuuccccaccuauggccgagcccccagaagguucauggaguugucaccugugcuugagacaucuaaaggagaaagcuagcgccuauauaacacugaccuga

SEQ ID NO: 55458 - RNA, 1137 nt, Artificial Sequence
  derived and/or modified sequence opt3 from DPF3__Homo_sapiens__NP_001267471
auggccacugugauccacaacccccugaaggcucucggcgaccaguucuacaaagaggcaauugaacauugcagaagcuauaauuccaggcuuugugccgagcggucuguccgccugccuuuucuggauucacaaacagggguugcgcagaacaauugcuacauauggauggaaaagcgacaccguggaccagguuuagcuccgggccagcuguauacuuaccccgccagauguuggaggaaaaagcggcgccuacauccuccagaggaccccaaacucagacugcuugaaaucaagccugagguggagcugccauugaagaaagauggguucacgagugaaagcaccacacucgaggcacugcugaggggagaaggcguagagaagaaaguggacgcccgggaggaagaguccauucaggaaauccaacgcguccucgagaacgaugaaaauguggaggaggguaacgaagaggaagacuuagaggaagauauucccaagcgaaagaauagaacuagggggcgggcucguggaucugcaggcggccgcagaaggcacgacgccgcuucgcaggaggaucaugacaaaccuuauguuugcgauaucugugggaagcgguacaaaaaccgaccaggacugucauaucacuacgcccacacccaucuugcgagcgaggaaggugacgaggcacaggaucaggaaacacgcaguccgcccaaucacagaaacgagaaucauaggccucaaaagggcccagacgggaccgugauacccaacaauuacugcgacuuuuguuugggaggcuccaacaugaauaaaaagucuggucggccugaagaguuggucagcugcgccgauugugggcgcuccggacacccaacuugccuacaguucacacucaacaugaccgaggcugugaaaacguauaaguggcaguguaucgaaugcaaaucaugcauucuguguggcaccagugagaacgacgaucagcuucuguuuugcgacgauugugacagaggcuaccacauguauugcuugaaucccccgguagccgaaccucccgaggggagcuggucuugucaucucugcugggagcuguuaaaggaaaaggcauccgcuuucggaugucaagccuga

SEQ ID NO: 55459 - RNA, 1332 nt, Artificial Sequence
  derived and/or modified sequence opt3 from DPH1__Homo_sapiens__NP_001374
augagaaggcaggucauggccgcucuggugguuagcggcgcagccgagcaagggggacgggacggucccggccgcgggcgagcgccucguggaagaguggcuaaccagaucccaccggaaauucucaagaauccccagcuucaggccgcaauaaggguacugccuuccaacuacaauuucgagaucccaaaaaccauuuggcggauccaacaggcccaggcuaagaaaguggcauugcagaugcccgaaggcuuacugcuauuugccugcacaauugucgauauccucgagcgcuucacugaagcugaggugaugguuaugggugacgugacguauggggccuguugcgucgaugacuuuaccgcgagagcacugggagccgauuuccuugugcacuacggccauucuugucugauaccuauggacacaucagcucaagauuuuaggguauuguauguuuucguggacauccggauugauacuacccaccuccuggacagucugcgccucacauuuccacccgccaccgcauuagcucuggucagcacuauccaguucguguccacacuucaggccgcggcccaggaguugaaggcagaauaccgagugucugucccucaaugcaaaccacugucgccgggcgagauucuaggguguaccucacccagacucagcaaggaaguugaggcugugguauaucugggagaugguagguuucaucuugagagugugaugaucgccaacccuaaugucccagcuuaccgguaugaccccuacuccaaggugcugucucgugaacacuacgaucaucagcgcaugcaggccgcaagacaagaggccauagcuacggcgaggagcgcaaaauccuggggcuugauucucgggacucugggacggcagggcucaccuaagaucuuagaacaccuggagagucgacuccgcgcccuuggucugagcuucguuagauugcuacugucugaaauuuuuccauccaaacucucacugcuucccgagguggacgucugggugcagguagcuugcccgaggcugagcaucgacugggggaccgccuucccuaagcccuugcucacaccauaugaggcagccguugcucugcgggauaucaguuggcagcaaccuuaccccauggacuuuuaugccggaucuuccuuaggcccauggacugugaaccacggccaggaucgcagaccccaugcaccugggaggccagcgcguggaaaaguccaggaagguagcgcucggccgcccucggccguggcaugugaggacugcucuugucgagaugaaaaggucgccccucuggcuccauga

SEQ ID NO: 55460 - RNA, 174 nt, Artificial Sequence
  derived and/or modified sequence opt3 from DPH3__Homo_sapiens__NP_001040899
auggccguguuccacgacgaggucgaaaucgaggauuuucaguacgacgaagauagcgagaccuauuucuaccccugcccuuguggcgacaacuuuuccauuacaaaggaucaauucguuugcggggaaacugugccagcuccgucugcaaauaaagagcugguaaaguguuga

SEQ ID NO: 55461 - RNA, 498 nt, Artificial Sequence
  derived and/or modified sequence opt3 from DPH6__Homo_sapiens__NP_001135444
augagaguggccgcucugaucagcggcgggaaggacuccugcuacaacaugaugcaguguauugcagccggacaccaaauagucgcgcucgcuaaucuuaggcccgccgagaaccagguugguucugaugaacuggacucauauauguaccagaccgugggccaucacgcaaucgauuuguaugccgaggcuauggcauuaccucuguaccggcgcacaauucgagggcguagucuagacacuagacagguauauacgaaaugcgaaggagaugagguggaagaccucuacgagcugcuuaagcuggucaaaggcaucaccaggaugacauugcucgccgaguaugaugcucugaaucugcaagacuuccauaugcaccucaagguggguagccaggccauuguuuaccggacuccaaacgaauuauguacccauuccaaauuugauaagcacacauucccgcccuuuaucucugagauagcgaagugcgaaguguga

SEQ ID NO: 55462 - RNA, 1359 nt, Artificial Sequence
  derived and/or modified sequence opt3 from DPH7__Homo_sapiens__NP_620133
augaugggcugcuucgcccugcagaccguggacacagagcucacugcugauagcgucgaaugguguccccuucaagggugcagacaccuguuggcauguggaacguaccaguuaaggcggccugaggaccgcccagccgguccgcagaacaagggcgggauggaaguuaaagagccccaggugcgacugggacgucuauuucucuauuccuucaaugauaacaauucuauccauccucugguagaagugcaaagaaaggacaccucagcgauucuugauaugaaauggugccacauaccagucgcuggccaugcccuguugggucucgcagacgccagugggagcauccagcugcugaggcucguggaguccgagaagucucacguuuuagaaccccugucgucacuugcuuuggaggaacagugucuggcacuaagccucgauuggaguacaggaaaaacuggccgggccggcgaccagccucugaagauuaucuccucugauagcaccgggcaacuucaucuguugauggugaacgagacacgcccaagacuccagaaggucgcuuccuggcaggcccaccaguuugaggcguggauugcagccuucaauuacuggcaccccgaaaucguguauucaggaggugacgauggccuguuaagggggugggacacccggguaccuggaaaauuucuguucacaaguaagcgccauacuaugggcguuugcagcauacaaucuuccccacaccgagagcauauccucgcuaccgguucauacgaugaacacauucuucugugggacacgagaaacaugaaacagccguuggccgacacucccgugcaagggggagucuggaggaucaaguggcacccuuuucaucaccaucuacugcucgcagcuuguaugcacagcggcuucaaaauucugaauugccagaaggccauggaggaacggcaggaggcgaccgugcuuacaagucauacucugccagauucuuugguguauggcgccgacugguccuggcuccuguuucguagcuuacagcgcgcacccucguggucuuucccuuccaaccuggggaccaagacagcugaucuaaaaggagccucagagcucccaacccccugucacgaaugcagagaggacaaugauggugaaggccacgcuaggccgcagagugggaugaagccucugacggagggaaugcggaaaaacggcacuuggcuucaagccacagcagccaccacucgagacuguggugucaaucccgaagaggcugauagcgcguuuuccuugcuggcaacaugcucuuucuacgaccaugcccuccaccugugggagugggaagggaacuga

SEQ ID NO: 55463 - RNA, 783 nt, Artificial Sequence
  derived and/or modified sequence opt3 from DPM1__Homo_sapiens__NP_003850
auggccagccuggagguguccagaucucccaggcggucacgccgagaacucgagguccguaguccuagacagaacaaguacagcguucuucugccaaccuauaaugaaagggagaacuugccguuaaucguguggcugcuaguaaaauccuucucugaaucgggcauuaauuacgagauaaucauuaucgacgaugggucacccgacggaacacgggauguggcugagcaacucgaaaagauuuaugguagcgaccgcauccugcuuagaccuagggagaaaaagcugggcuuggggacugcauacauacacggaaugaaacaugccacgggcaacuauaucauuaucauggaugcggaccucagucaccauccaaaguuuauucccgaguucauccggaagcagaaagaagguaauuuugauauagucuccgggacccgcuacaagggaaacggcggcguguaugggugggaccugaaacgaaagauuaucucuagaggagcuaauuuccugacacagauucucuuaaggccuggugccagcgaucugacuggcuccuuucggcuuuaccguaaagagguuuuggaaaagcugaucgagaagugcgugucaaaaggguacgucuuccagauggaaaugaucgugcgcgcaagacaacuaaacuauaccauuggagagguaccaauaaguuuuguugacaggguguacggcgaaagcaagcucggugggaaugagaucgucucuuuccugaaaggacuucugacauuguuugccaccacuuga

SEQ ID NO: 55464 - RNA, 255 nt, Artificial Sequence
  derived and/or modified sequence opt3 from DPM2__Homo_sapiens__NP_003854
auggccacaggcacagaccagguggucgggcugggacucguugcugugagccuuaucauuuucacuuacuauacggcauggguaauacuguugcccuuuaucgauucccaacacgugauucauaaguacuucuuaccuagagccuaugcggucgcuaucccacuggccgcaggucuacuccugcuucuguuugugggcuuguucauuucuuacguuaugcucaaaaccaagagggugaccaaaaaggcccaguga

SEQ ID NO: 55465 - RNA, 369 nt, Artificial Sequence
  derived and/or modified sequence opt3 from DPM3__Homo_sapiens__NP_061846
augcugagcgugggcgggcucagacuuucccuggucagguucucuuuucuuuuacugcggggagcccuacuccccucacuggcuguuaccaugacaaaguuggcacaguggcugugggguuuggccauccucggcaguacuuggguggcgcugacgaccggggcucugggacucgaguuaccucugagcugccaagaaguacuuuggccauugccggccuaccugcuaguguccgcaggcuguuaugcccucgguacagucggguaccgcguggcuacuuuccacgacugcgaggaugcagcccgagaacugcagucucagauucaggaggcucgugccgaccuugcgagaaggggacugcgguuuuga

SEQ ID NO: 55466 - RNA, 2403 nt, Artificial Sequence
  derived and/or modified sequence opt3 from DPP10__Homo_sapiens__NP_001171505
augaccgccgcuaagcaggagccccaaccuacaccaggcgcaagagccagccaggcgcagccggcugaccaggaacugggguccaacucucccccucaaaggaauuggaaaggaaucgccauugcacuccuugugauacuggucguuugcucauugaucacuaugagugugauuuuacugacgccagaugagcuaaccaacagcuccgaaacacggcucucucuggaggaccuuuuccgcaaggauuuuguacugcacgaccccgaagcccgauggaucaaugauacugacguggucuacaaaucggagaacggucaugugauuaaguugaauaucgagaccaacgcuacaacccuccugcuggaaaauacuacauucguuaccuuuaaagcaucacgucacagcgugaguccugaucucaaguaugucuuacuggccuacgacgugaagcagauauuccauuauuccuacacggcuucuuauguaaucuacaacauucacacuagagagguuugggaacuuaauccacccgagguggaggauagcgucuugcaguaugccgcguggggcgugcaggggcaacagcugaucuacauuuuugaaaacaauaucuacuaucagccugacauaaaauccucaagucuaaggcucaccagcucuggaaaggaggaaauuaucuucaacggcauugcagauuggcuguacgaggaagaacuucugcauucccacaucgcccacugguggucaccagacggugagcgguuggcuuuucucaugaucaaugauagccuggugccgacaauggucauuccccgcuucacuggggccuuauauccuaaaggaaagcaguacccauaucccaaagcaggccaaguuaacccuaccauaaagcuguacgugguaaaucucuauggcccaacacauacccuugaacugaugcccccggacaguuuuaagucuagagaguacuacaucacgauggugaaaugggucuccaacacuaagacagugguuaggugguugaaccgggcucagaauauuagcauccuaaccgugugugaaacuacaaccggggccugcucgaaaaaguaugagaugacgucugacaccuggcugucccagcaaaacgaggagccugucuucucacgcgauggaaguaaauuuuucaugacagugcccguaaagcaggguggccgaggggaguuucaccauauagcgauguuccucauucagagcaaauccgaacagaucacuguuagacaccugaccucuggaaauugggaggugaucaagauucuugccuacgacgaaacaacucaaaagaucuauuuccugagcaccgagucaaguccaaggggccggcaguuguacuccgcaagcacagaaggucuccugaaccgucaguguauuucuugcaauuuuaugaaagagcaguguaccuauuucgaugcuucauuuaguccuaugaaccaacacuucuuacuguuuugcgaggggccccgcgucccaguggucagccuacauuccacugacaaucccgccaaguacuucauacucgaaucuaacucgaugcugaaagaggcuauccuuaagaaaaagauuggaaagccugaaaucaaaaucuugcacauugaugacuaugagcugccacuccagcugagccuuccgaaggauuuuauggacagaaaucaguacgcccuguugcucauaauggaugaggaacccggcggccagcuggugacggacaaauuccauaucgauugggacuccguuuuaauugacauggauaacgugaucguagcaagguuugacgggcggggaucagguuuccaaggccugaagauucuacaggagauccaccgacgccucgggagugucgaagugaaagaucagauaacagccguuaaguuucugcuuaaguugccuuacaucgacucuaaaagacugagcauuuucggaaagggcuaugguggguacaucgcuuccaugauucucaaaucagaugagaagcuguuuaaauguggcagcguggucgcgccaaucaccgacuuaaagcuguaugcaucugccuucuccgaaagguaccuuggaaugcccaguaaggaggagagcacuuaucaggcugccucuguguugcauaauguacacggccucaaagaagagaacauacugauuauccacgggaccgcagauacaaaggugcauuuccaacacuccgccgaacuaauuaaacaucugaucaaggcuggaguuaauuacaccaugcaggucuauccugacgagggucacaacgugucagagaaaaguaaguaccaccucuacagcacuauacugaaauuuuucucggauugccuuaaggaagagaucuccguguugccacaggaacccgaggaagacgaguga

SEQ ID NO: 55467 - RNA, 2124 nt, Artificial Sequence
  derived and/or modified sequence opt3 from DPP3__Homo_sapiens__NP_001243599
auggccgacacccaguacauccugcccaacgauauuggcgugagcucccucgacugcagagaggcuuucaggcuucugucuccuacagaacgguuguaugcauaccacuuaucacgcgccgcgugguaugggggacuggcuguccuacuccaaacgaguccagaggccccguacauauaugcacugcuuagccgacuguuucgugcccaggaucccgaccaguugagacagcaugcucucgcagaaggucugacugaggaagaguaccaagagaagcuggaaaggguuauccucggcuccgaggccgcucagcagcacccugaagaggugcggggguuauggcagaccuguggagagcugauguucucucuugaaccacgcuugagacaucugggccuagguaaagaggggauuacaacuuauuuuucgggaaauugcaccauggaagaugccaagcucgcgcaagacuuccuggauucacagaaccuuagcgcauacaauacaaggcuguuuaaagagguagacggcgaaggcaagcccuacuaugaggugcgguuggccaguguccucggguccgagccuucucuggauagcgaagugaccuccaaauuaaagucauacgaguuccgcggaaguccauuucagguuacucgaggugacuaugcucccauccugcagaagguggucgaacaacucgagaaagccaaggcauacgcugccaacagccaccagggccagaugcuugcgcaauauauugaaucuuucacacagggguccaucgaggcccauaaaagaggaucaagguuuuggauacaggauaagggcccuaucguggagagcuacauugguuucaucgaaaguuaucgggacccauuugggucucguggagaguucgaaggcuuuguagcaguugugaauaaagcuauguccgccaaguucgagcgccuggucgcuagcgccgaacaguugcuaaaggagcugccguggcccccuaccuucgagaaagauaaguuucucacgccagacuucacuucgcuggacgugcuuaccuuugcaggcucugggauucccgccggaaucaacauaccuaauuacgaugaccugagacaaacagaagguuucaaaaacguguccuugggcaauguccucgcuguugcguacgcaacucagagggagaagcugaccuuuuuagaagaggaugacaaagaucuguauauucuauggaaggggccaucauucgacgugcagguaggacuccacgagcugcuuggccacgguagugggaaauuguuugugcaggaugaaaagggcgccuucaacuuugaccaagagacagucaucaaucccgaaaccggagagcagauucagagcugguaccgguccggcgaaacgugggauucuaaguucagcacuaucgcuucaaguuaugaggagugucgagccgaauccguggggcuguaccucugccugcauccgcagguucuugagaucuuuggauucgaaggugcagacgccgaggaugugauuuaugucaacuggcugaauauggugcgcgcuggcuugcucgcccuggaauuuuacacaccugaggcauucaacuggagacaagcgcacaugcaggcuagguucguaauauuacggguucugcuagaggccggggaaggacucgugaccaucacucccacaaccggcagcgacggucgcccagacgcaagagucaggcuggaucguucuaaaauucggucaguggggaagccugcccuugagcgauuuuugagaaggcugcagguccucaaaaguacgggcgacguggcuggaggccgcgcccuguaugaaggguacgcaaccguuacagaugcucccccagaguguuucuuaacucugcgggacaccgugcuuuugagaaaggaaagcaggaaacucaucguacagcccaauacacgccuggagggauccgauguccaacuacuggaguacgaagccucugcggccggucucauacgaucguuuagcgagcgguucccugaagacggcccagagcuggaggaaauucuuacucaguuggcuaccgcagaugcccguuuuuggaaggggccguccgaggcucccucaggacaggccuga

SEQ ID NO: 55468 - RNA, 2301 nt, Artificial Sequence
  derived and/or modified sequence opt3 from DPP4__Homo_sapiens__NP_001926
augaagacccccuggaaagugcugcucggccuucugggggccgcugcauuggucacaaucauuacuguuccugugguauuacugaacaagggaacggacgaugccaccgcggacagcagaaaaacauacacucuaaccgauuaucucaagaauacauacaggcugaaacuuuauucccugcgguggauaucugaccacgaguacuuguauaagcaggaaaacaauauccucguguucaacgcugaguacgguaauucaagugucuuucuggaaaacagcaccuucgaugaguuuggccauuccauuaaugacuauucuaucucgccagaugggcaauucauucugcucgaauacaacuacgugaagcaguggcgccacucauauacugccagcuacgacaucuaugauuuaaauaaacgacagcugauaacagaggagcguaucccgaacaauacccaguggguuacguggagucccgugggacauaaacuugcauacgucuggaacaaugacauuuaugugaagaucgaaccuaacuugccauccuacagaauuacuuggaccggcaaggaggauaucauauauaaugguauuacagacuggguauacgaagaggagguguuuucugccuacagcgcucugugguggucccccaacgggacuuuccuagcauaugcccaauuuaacgauaccgaagugccucucaucgaguacucauucuauagugacgaaagccugcaguacccaaaaacagucagggugcccuauccuaaggcuggagccgugaauccaaccgucaaguuuuucguugugaacacggacucucuuuccucaguaacuaaugcgacaagcauucagaucaccgcaccggccaguaugcugaucggcgaucacuacuugugcgacgugacuugggcuacacaggagcggauuucucuccaauggcugcgcagaauacagaacuauuccgucauggauaucugugacuacgaugaaagcucggggagguggaauugcuuaguggcccggcagcauauugagaugucuaccacgggcuggguuggacgcuuucgacccuccgagccucacuucacccuggacgguaacucauuuuacaaaaucauaaguaaugaagagggcuauagacacauuuguuacuuccagaucgauaagaaagacugcacauucaucacuaaggggaccugggaagugauuggaaucgaggcacucacaagcgauuaucuuuacuauauuuccaacgaauacaaaggcaugccaggugggaggaaucuguauaagauacaauugucugacuacacuaaagucaccugucuaagcugcgagcugaaccccgagcggugucaguacuauucagugaguuuuuccaaggaagcuaaguacuaucagcuccguugcagcggaccuggccugccacuuuacacacugcauucuucaguaaaugauaaaggcuugcgcguucucgaggacaacagugcccuggacaagauguuacaaaaugugcagaugcccagcaaaaagcuggauuucaucauucuaaacgaaaccaaauuuugguaucagaugauccucccgccucacuucgacaaguccaagaaauacccccugcuuuuggaugucuaugcggggccauguucucagaaggccgacacuguguuuagacugaauugggcaacguaccucgcuucgacagagaacaucauugucgccagcuucgauggaagggguuccggcuaccaaggggacaaaauaaugcaugcuaucaaccggcgacugggaaccuuugaaguggaggaucagauugaggccgcacgccaguucucaaagaugggcuuuguugacaauaaaagaaucgccauuugggguuggaguuaugggggcuacgugacuucuaugguacuuggaagcggcuccggggucuucaagugcggaaucgcuguggcgccuguuucaaggugggaauauuacgauagcguguauaccgagcgguacaugggucugcccacaccagaagacaacuuggaucacuaucgcaauucuaccgucauguccagagcagagaacuuuaagcagguugaguaccuccugauacacggcacugccgacgauaauguacauuuccaacagagugcucagaucagcaaagccuuaguggacguuggggucgacuuucaggcaaugugguacacagaugaagaccacggaauugccucuuccacggcucaucaacacaucuauacccauaugucacacuucauuaagcaguguuucagucugcccuga

SEQ ID NO: 55469 - RNA, 2406 nt, Artificial Sequence
  derived and/or modified sequence opt3 from DPP6__Homo_sapiens__NP_001034439
augaaggagaaagccaugaucaagaccgcuaaaaugcagggcaaugugauggaacuggucgggagcaaucccccucaaagaaacuggaagggaauugcaauagcccuccuuguuauccuggugauuugcuccuugaucguaacaucugugauuuuacugacuccagcggaggacaauucacuaagucagaaaaagaaggucacgguggaagaucucuucagcgaggacuuuaaaauccacgauccggaagcuaaguggauauccgacaccgaguucaucuacagggagcagaaagguacaguucggcuguggaacguggaaacuaauaccucuacaguccuuauugagggcaagaaaaucgaaucgcugcgcgccauucgauaugagaucucacccgaucgugaguacgcauuguuuagcuauaacguggaaccuauauaccagcauaguuauaccggguacuauguacucuccaagauuccacacggagacccccaaucucuggauccuccagagguuagcaaugccaagcugcaguacgcuggcuggggucccaaagggcagcagcucaucuucauuuuugaaaacaauaucuacuauugugcacaugugggaaagcaagccaucagagucguguccacuggcaaagagggcgugauuuacaacggguuaucagacuggcuguaugaagaggagauacuuaagacacacaucgcucauugguggaguccugauggaaccagguuggccuacgcggcaauuaaugacagccgggucccaaucauggaacugccgacguauacugguucuauauaccccaccguuaaaccuuaucacuacccaaaggccggcuccgagaaccccucaauuagccuacacgugaucgggcucaauggaccuacacaugaucuggaaaugaugccacccgacgauccgcgcaugagagaguacuauaucacuaugguaaaaugggcuaccaguacaaagguggccgucaccuggcuuaacagggcacagaaugugucuauucugacguugugcgacgcuacuacaggcguuuguaccaagaaacacgaagacgaguccgaggccuggcuccaucggcagaacgaagaaccuguguucagcaaggauggucgcaaauuuuucuuuauccgagcgauuccccaagggggaagaggcaaguucuaccacauaacugucucgucuucccagccaaacucaaguaaugacaacauccagagcauuacauccggcgauugggacgugaccaaaauccuggccuaugaugaaaaggggaauaagaucuacuuuuuaucuacggaggaccugccuaggcggcgucagcucuauagcgcaaacaccguaggaaauuucaaccgccaaugccuuucaugugaucugguugaaaauugcacauacuuuagugcuuccuucagccacucuauggacuucuuuuugcuaaaaugugagggucccggcgugccaauggucacugugcauaacaccacagauaagaaaaagauguucgaccuggagacuaaugaacacgucaaaaaggccauuaacgauagacagaugcccaagguggaguauagggacauagaaaucgacgauuacaaucucccuaugcagauucugaaaccagcuaccuuuacagacaccacucauuacccgcuucuguugguuguggaugggacgcccggaucacagaguguagccgagaaguucgaggucagcugggaaacagugaugguuuccucucacggcgcaguggucgugaaaugcgacggucgggggucgggcuuucaaggaaccaagcuccugcaugagguacgacgcagauuaggccugcuagaagagaaagaucagauggaagccgugaggacuaugcucaaggagcaguauaucgaccggacccgcguugcugucuucgggaaggauuacggagguuaucugagcacauacauucuuccugcgaaaggcgagaaccaggggcaaaccuuuacuuguggauccgcauugucaccaaucacagacuucaagcuguaugccagugcuuuuucugaaagauaccucggccugcacggucuugauaauagggccuaugagaugacgaaaguggcacaccgugugagcgcccuggaggagcagcaguucuugauaauccaucccaccgcugacgaaaagauucacuuucagcauacugccgagcucaucacacaacugauucgggggaaagcaaacuacuccuuacagaucuacccugaugagucacacuauuucaccucuagcucccugaagcagcaccuauaccgaaguauaauuaacuuuuucgucgaaugcuucagaauccaggacaaacuccugacaguuacugcgaaggaggaugaagaggaagacuga

SEQ ID NO: 55470 - RNA, 1479 nt, Artificial Sequence
  derived and/or modified sequence opt3 from DPP7__Homo_sapiens__NP_037511
augggcagcgcccccugggcuccugugcugcuccuugcacugggguugagaggauuacaggccggugcgaggcgggcuccagacccgggcuuccaagagcgcuuuuuccagcagcgacuggaucacuuuaacuucgaacguuuugggaauaagaccuucccccagagauuucuagucuccgacagguucuggguucggggagagggcccuaucuuuuucuacacagguaacgaaggggaugugugggccuuugcaaauaacucugccuucguagcugagcucgcagccgaacgcggagcucugcuuguguuugccgagcauagauauuacggcaaaucacugccauucggcgcgcaaaguacucagagggggcacacggaguugcucaccgucgaacaggcacuggccgacuucgcugagcugcuccgggccuuacgccgagaucugggagcacaggacgcucccgccauugcguuugguggcagcuaugggggaaugcuuuccgccuacuugagaaugaaguauccucaucugguggcaggcgcucuagccgcuucugccccaguucucgcaguggccggucugggggauucgaaucaauucuuuagggacgucacagcugauuucgaaggacagucacccaaaugcacucagggcgugcgggaggcguuucgucagauaaaggaccuuuuccugcaaggcgcauacgauaccguacgcugggaguuugggacaugucagccuuugagcgacgaaaaagaucucacccagcuguucauguuugccagaaacgcuuucacuguuuuagccaugauggacuauccauacccgacagacuuucugggaccccucccugcaaauccagugaaggucgguugcgauaggcuucugagugaggcccaacggaucaccggcuugcgagcucuagccgggcugguguacaacgcauccggaucugaacacuguuaugacauuuaccgccucuaucauagcugcgcggaucccacgggcugugguacugggccugacgcuagagccugggauuaccaggcaugcaccgagaucaaucugacauucgccuccaacaaugugacugacauguuuccagaucuucccuucaccgacgaacugaggcagcgguauuguuuggauacauggggcgucuggccgcgcccugacuggcuccugaccucauucuggggaggcgauuuaagagcugccaguaacauuaucuuuagcaaugggaaccuggaccccugggcaggagguggcauaaggcguaaucuaucugcuuccguuaucgccgugacgauucaagggggagcgcaccaccucgaccugcgggccucacauccagaggauccugcuagcguaguggaggcacgaaaacuugaagccacuaucauuggcgagugggucaaggcugccagaagggaacagcagcccgcauugcgcggugggccacggcugagucucuga

SEQ ID NO: 55471 - RNA, 2349 nt, Artificial Sequence
  derived and/or modified sequence opt3 from DPP8__Homo_sapiens__NP_060213
auggccgcugcaauggagacugaacagcugggcguggagaucuucgaaacagccgacugcgaggaaaacauugagagccaagauagacccaagcucgagccuuuuuacgucgaaagguauuccuggucucagcuuaaaaagcuguuggcggacacucggaaauaccacggguauaugauggcuaaggccccacaugauuucauguuuguuaaacgcaaugacccggauggaccccacucagaccgaauauacuauuuagcaaugaguggugagaaccgugaaaauacgcuguucuacagcgagaucccuaagaccauuaacagagccgcugugcuaaugcucuccuggaagccacugcuugaucuguuucaggcaacauuggacuauggcauguacucuagggaggaagaacuccugcgggaacgcaaaagaaucgggacuguaggaauugccucguacgauuaucaucagggcucagguaccuuccuguuucaagcugggagcggaaucuaccacgugaaggacggcggcccccagggguucacacagcagccucucaggccaaauuuagucgagaccaguugucccaacauacggauggauccuaaacugugcccagccgacccggauuggaucgcguuuauucauuccaaugacaucuggauuucuaacaucgugacucgcgaggagcgaagacuuacauauguucacaaugaguuggcaaacauggaagaggacgccaggagcgcuggaguggccaccuucguccugcaagaagaguuugaucgguacuccgguuauugguggugucccaaggcagaaacgacuccuucaggcgggaaaauacuacguauucucuacgaggagaaugacgaaagugagguggaaaucauucacguaaccagcccaaugcuggagacacgcagagcugauucuuucagguaucccaagacuggaaccgccaacccuaagguuacauuuaaaauguccgaaaucaugaucgacgcggagggccggauuauagaugugaucgacaaggagcuuauucagccauucgaaauccuguucgagggugucgaauacauagcccgagcaggguggacccccgagggaaaauacgcuuggucaauuuugcucgaucgcagccagacgagacugcagaucguguuaaucaguccggagcuguuuauuccuguggaagacgaugucauggagaggcaacggcucaucgaaucuguucccgacuccgugacuccacuuauuauauaugaggaaacaaccgauaucuggauuaauauccaugacaucuuccacguauuuccucagagccaugaggaggaaauugaguucauauuugccucggaaugcaagacuggcuuccgccaccuguacaaaaucacaucuauuuugaaggaguccaaauauaagagaucaaguggcgggcuacccgcuccaagcgacuuuaagugucccaucaaagaagagauugccaucaccuccggagagugggaagugcuggguaggcacggcucuaacauacaggucgaugaggugcgucggcucguuuacuucgaagggacgaaggacagcccucuggagcaucaccuuuauguggucucauacgugaauccaggagaaguaacccgacugacagauagaggcuauagucauuccugcuguaucagccaacacugcgacuuuuucauuucuaaauacucaaaccagaagaacccgcauuguguuaguuuguacaaacucagcucccccgaggaugacccuacuugcaagaccaaggaguuuugggcaacaauccuggauucugccgguccauuacccgacuauacuccuccagaaauuuucucguuugagagcaccacaggguucacccuguacggcaugcuauauaaaccccacgaucuccagccgggaaagaaauacccuacugugcuguucaucuauggcgggccacaggucgcuauagcgggagcacccgugacgcuuuggaucuuuuacgacacagguuauaccgaaagguacaugggccacccugaucaaaaugagcagggguacuauuugggauccgucgccaugcaggcugagaaguuccccucagaaccaaaccgccugcuccugcuucauggcuuucuggacgagaaugugcacuucgcccauaccaguauuuugcucucuuuucugguucgggcagguaaaccuuacgauuuacagauuuauccccaagaaagacacagcaucagggugccagaguccggggaacacuacgagcugcaucuacuccacuaucugcaggagaaccuuggcucacgcauagccgcuuugaagguaaucuga

SEQ ID NO: 55472 - RNA, 2679 nt, Artificial Sequence
  derived and/or modified sequence opt3 from DPP9__Homo_sapiens__XP_005259730
augagaaaggugaaaaagcugaggcucgacaaagagaacaccggcagcuggcgguccuucucucuuaauucagaaggggccgagcgcauggcuacaacuggaacgcccaccgcagaucgaggugacgccgcggcuacagaugacccugccgcacguuuucagguccaaaagcacaguugggauggccugagaagcaucauucauggguccaggaaauacucuggauugauaguuaacaaggccccacacgacuuccaguuugugcagaagacugaugaaucgggcccgcauucacaccgguuauauuaccuggguaugcccuaugggagccgcgagaauagucuacucuacuccgaaaucccuaaaaagguaagaaaagaggcucugcuucuguugucuuggaagcagaugcucgaccauuuccaagcaaccccacaccacggaguguauagcagggaggaggaacugcugcgggaacgcaaacgacucggcgucuuuggcauuacauccuacgauuuccauucagagaguggguuauuucuguuccaggccagcaacucucuuuuucacugcagagacggagguaagaauggcuucauggugucccccaugaagccuuuggagaucaaaacccaguguucagggccaaggauggaucccaagauuugcccugcugacccagccuuuuucagcuuuaucaacaauagugaucuguggguugcgaacauagaaacuggagaggaacggcgucuaacauucugucaucagggccucucuaaugugcuggacgacccgaaauccgccggugucgcaaccuucgugauccaagaggaauuugaucgcuucacgggguauugguggugccccacugcuagcugggagggaucggagggccuuaagacccugagaauuuuguacgaagagguagacgaaucugagguugaagugauccacgucccuuccccagcccucgaggagaggaaaacagauucauaccgguauccccgaacuggcaguaagaacccuaaaauugcacugaaguuagcugaauuucagaccgacagccaggggaagaucguguccacacaggagaaagaacuggugcaaccauucucuagccucuuucccaaggucgaguacauagcccgcgcgggauggaccagagaugguaaauaugccugggcaauguuccuugacaggccgcagcaguggcugcaauugguucuacugccucccgcucucuuuauuccaucaacggaaaaugaggagcagcggcuggccagugcucgcgccgugccuagaaacguacagcccuacguggucuaugaagaggugacuaauguuuggaucaacgugcacgauauuuucuacccauuuccccaguccgaaggcgaggacgagcuuuguuuccugagggcaaaugaaugcaagacaggguuuugucauuuguauaaagucaccgccgugcucaagagccaaggauacgauuggucugagccuuucucaccaggcgaagacgaguuuaagugcccgaucaaagaagagaucgcucugacaaguggugagugggaaguauuagcgcgucacgggagcaagauuuggguuaacgaggaaacuaaacugguguacuuccagggcaccaaggauacgccccuagagcaucaccucuaugucguguccuacgaagcagccggagagauaguccggcugaccacaccuggcuucucucauucguguagcaugucccagaacuuugacauguucgugucacacuauaguucuguuagcacuccacccugcgugcacguauacaaacuuuccgggccugacgaugacccauugcauaagcagccccgauuuugggcuucaaugauggaggccgcaagcuguccgccugauuaugucccacccgaaaucuuccacuuucauaccagaucugacgugaggcuguacggaaugauuuauaagccucacgcccuccaacccgguaaaaagcacccaacaguucuguucguguacggcgggccucagguccagcuugugaauaacuccuuuaaaggaaucaaguaccugcgcuugaauacucucgcuagucugggcuaugccguagugguuauagauggucgggggagcugccagagaggcuuaagguucgagggagcacugaaaaaccaaaugggccaggucgaaauugaggaccagguggaagggcuacaguuuguggcggagaaguacggauucaucgaucucucucgcgucgcuauccaugguugguccuauggcggguuucugucacuuaugggauugauucacaagccccaaguuuucaaaguggccaucgcaggcgccccagugaccguauggauggcuuacgacacagguuauaccgagcgauacauggaugucccggaaaauaaccagcauggguaugaggccggcaguguggcacugcacguugaaaagcucccuaaugagcccaaccggcuguuaauucugcauggauuucuugacgagaaugugcacuucuuccacacuaacuuuuuggucagccagcucauacgugcuggcaaaccauaccaacugcagaucuaccccaaugaaagacauucgauuaggugcccugaguccggggaacacuaugaggugacgcuacugcauuuccuccaggaauaccuguga

SEQ ID NO: 55473 - RNA, 897 nt, Artificial Sequence
  derived and/or modified sequence opt3 from DPPA2__Homo_sapiens__NP_620170
augagcgacgccaaccuggauuccucuaagaaaaauuuccucgagggcgaaguggacgaugaggaaucagucauccuuacccugguucccgugaaggacgaugcuaacauggagcagauggaaccuaguguaagcuccacaucugacgugaaauuggagaagccgaaaaaguacaauccagggcacuuacugcaaacuaacgagcaguuuacggcaccccagaaggccagaugcaaaauuccugcgcuaccacuccccaccauacugccuccaaucaauaaggucuguagggauacacuucgggacuggugccagcaacugggauugucgacuaacgguaaaaagauugaaguguaucuccgccugcaucgacacgcuuaccccgagcagcgucaggauaugccugaaaugucacaggagaccagacugcaaagguguagccggaaacgcaaggccguuacaaagagagcaaggcuccagcggaguuaugagaugaaugaacgcgccgaggaaaccaacacuguggaggucaucacauccgcuccaggcgcaauguuagccucuugggcucgaauugccgcgagagcagugcagccgaaagcccugaauagcugcuccauccccguaucaguugaggcuuuccuuaugcaggccaguggggugagguggugugucgugcauggacgguugcugagcgcagacaccaagggcugggugcgucuacaauuucacgcuggucaggccugggucccuacgacucaucgcagaaugauaucucucuuccugcuuccagcgugcaucuuucccuccccugggauugaagauaacaugcuguguccagacugcgccaaaaggaauaagaaaaugaugaagcgguugaugaccguugagaaauga

SEQ ID NO: 55474 - RNA, 480 nt, Artificial Sequence
  derived and/or modified sequence opt3 from DPPA3__Homo_sapiens__NP_954980
auggaccccagccaguucaacccuaccuacaucccaggcuccccgcaaaugcugacagaggaaaauucuagagaugacucaggggccagucagauuagcuccgagacucucauaaagaaccuuucuaaucugacgaucaacgcuucgucagaaagcgugagucccuuguccgaggcauuacugaggcgggaaucugucggagccgcgguucuacgcgagauugaggaugaauggcucuauagccgacguggugugagaacccugcuuuccguacagagggagaaaauggcucggcugcgcuacauguugcucggcggggugagaacacacgaaaggcggccuacuaauaaggagccaaaaggagucaagaaagagucacgccccuuuaagugcccuuguaguuucugcgugagcaacggcugggacccaucugaaaaugcccgaaucgguaaccaggauaccaagccccugcaaccuuga

SEQ ID NO: 55475 - RNA, 915 nt, Artificial Sequence
  derived and/or modified sequence opt3 from DPPA4__Homo_sapiens__NP_060659
augcugagaggcagcgccuccucuaccucaauggagaaggcuaaagggaaggaauggacaaguacugagaaaagcagggaagaggaccagcaagcauccaaccagcccaauucuaucgcccucccuggaacgucggcgaagcggaccaaagaaaagaugucaauuaaggguagcaaagugcuuugcccaaagaaaaaggcugagcacacagauaacccgcgcccccagaaaaagauaccuaucccaccccugccuaguaaguugccacccgucaauuuaauucaucgagacauccugcgugccuggugucagcaacuaaaacucuccucuaagggccagaaacuggaugcauacaagagacuuugcgccuucgcuuauccuaaccagaaagacuuuccaagcacugcaaaggaggccaaaauuaggaagucccugcagaagaaauugaagguugaaaaaggggagaccucacuccaaaguagcgaaacacacccgcccgagguggcucugccuccaguaggagagcccccugcccuggaaaauucuaccgcgcucuuagagggcgugaacacugucgugguuacaaccuccgcaccagaagcccugcuugcuucaugggcccggaucagcgcacgcgcuagaacgcccgaggccguggaaaguccgcaggaggcgucuggugucagguggugugugguacaugggaaguccuugccugccgauacugacggauggguucaucugcaguuccacgcaggccaggcuugggugcccgagaaacaagaaggccgggucagcgcccuauuucuccugccagcuucgaauuucccucccccacaccuugaggauaacaugcugugccccaagugugugcaccgcaauaagguguugauaaaaucucuccagugggaauga

SEQ ID NO: 55476 - RNA, 606 nt, Artificial Sequence
  derived and/or modified sequence opt3 from DPT__Homo_sapiens__NP_001928
auggaccugagccuccuuugggugcuguugcccuuagucaccauggccuggggccaguacggggauuauggauacccuuaucaacaguaccacgacuauuccgaugacgguuggguuaaccugaauagacagggcuucucuuaccagugcccacaaggacaggugaucguagcugugaggucaauuuuuaguaagaaagaggggagcgaucggcaguggaacuaugcauguaugccgacaccccagucccuaggcgaaccuacugagugcuggugggaagagauaaaucgcgccgguauggaaugguaccaaacguguucuaacaaugggcucgucgcgggauuccagucgcgauacuuugagucagugcuggaccgugaguggcaguucuauugcuguagauacagcaagaggugcccauauaguuguuggcuuaccacagaauaccccggccauuauggcgaggaaauggauaugaucuccuacaacuaugacuacuacauucgcggggcuacuaccacauuuucugccguugagcgggauagacaguggaaauucaucaugugcaggaugaccgaguaugacugugaauuugcaaauguguga

SEQ ID NO: 55477 - RNA, 2277 nt, Artificial Sequence
  derived and/or modified sequence opt3 from DPY19L2__Homo_sapiens__NP_776173
augagaaagcagggcgugagcuccaaaaggcugcaaucuucagggcggagucagagcaagggacgccgaggugccucccucgcucgugagcccgaagucgaggaagagauggaaaaaucugcacuuggcgggggaaagcugccuagaggcucguggaggucaagcccaggucggauccagaguuugaaagagcgcaagggguuagagcuggaaguuguggccaagaccuuccuacucggaccguuucaguucguaagaaacucccuggcgcaacuuagggagaaagugcaggaacugcaggcucggcgcuuuucuagccgaacaacuuugggcauugccgucuucguggcaauacuccacuggcugcaucugguuacgcucuuugagaaugacagacacuucucccauuuaucaagucuggagagggaaaugaccuuucggacagagaugggccuuuacuauagcuacuucaagacuaucauugaagcccccucuuucuuggaggggcuguggaugaucaugaacgaucgucuaaccgaauauccucucauuaucaaugcuauaaaacgcuuccaccuguacccagaggugaucauugcauccugguauugcacauuuaugggaaucaugaaccuuuucggucuggagaccaagacuuguuggaaugucacaagaauugaacccuugaacgaggugcagucaugcgaaggccucggggacccugccuguuuuuacguaggaguuaucuucauacugaauggcuuaaugaugggucuguucuuuauguauggggcuuaccucagcggaacccaacuuggcggccugauuacgguguugugcuucuuuuucaaccauggggaggccacuagggucauguggaccccaccccuacgggaaaguuuuucuuacccuuuccuggugcuccagauguguauccugacacuuauucugcgaacuuccagcaaugaucgcagaccauuuaucgcguugugccucucgaacguggcauucaugcugccguggcaguuugcccaguucaucuuauuuacccaaauugcuucucuguuccccauguaugucguuggauacauagagccuuccaaauuucagaagaucauuuauaugaauaugaucucagugacacuaaguuucauacucauguucgguaacagcauguaccuguccucuuauuacagcucaagucuuuugaugaccugggccauuauccugaagaggaaugagauccagaaacucggcguauccaagcugaacuuuuggcuuauucaagggagcgcauggugguguggaacgaucauucugaaauucuugacuucuaagauacucggcgugucagaccacauccggcugagugauuuaauugcugcccgcauccugagauauacagacuuugauacccuaaucuacacuugcgcgccagaauuugacuuuauggagaaagccacaccccucagguacaccaagacgcugcuuuugccugucgugaugguuauuaccuguuucauauuuaaaaagacagugcgugauaucagcuauguccuggcaacuaauauuuaccuccggaagcagcuguuagaacacuccgagcuggcuuuccauacccuucaguugcucguguuuacagcccuggcuauccuaauuaugcgacugaaaauguuccucacuccacacaugugcguaauggccucucugaucuguucgagacagcuuuuugguugguuguucaggcgcguucgguuugaaaaggugauauucgggauccugaccgucaugagcauucaaggcuaugcaaacuuaagaaaccagugguccaucauuggagaguucaauaaccucccccaggaggaacugcuucaguggaucaaauacucaacaaccagugacgccguguuugcuggcgcgaugccgacuauggcaucuauaaagcugagcacguugcauccuauugucaaucacccccacuaugaggaugccgaccucagggcucgcacaaaaaucguguacuccaccuauucacgaaagagcgccaaggaaguucgggauaaacugcuagagcugcaugugaacuacuacguacucgaggaagcauggugcgucgugcguacuaagccagggugcucuaugcuggagauuugggacguugaagacccuuccaaugccgcuaaucccccacuuuguaguguguugcuggaggaugccagacccuauuucaccacagucuuucaaaacagcguguacaggguauuaaaagugaacuga

SEQ ID NO: 55478 - RNA, 2151 nt, Artificial Sequence
  derived and/or modified sequence opt3 from DPY19L3__Homo_sapiens__XP_011524828
augaugagcaucagacagaggcgggagauucgcgccaccgaaguguccgaggacuuccccgcucaagaagagaacgucaagcuggaaaauaaacucccuucuggcugcacaucacgacgucuuuggaagauacugaguuugacuaucgggggaacgauugcauuauguaucggucugcuaaccagcguuuaccucgccacacugcacgagaacgaucuuugguuuuccaauauuaaagagguggaaagagagaucucuuucaggacugaaugcggccuguauuacucguauuacaagcagauguugcaggcgccaacccucguacagggguuucauggacugauauaugacaacaaaacagagucaaugaagaccaucaaucugcuccaacggaugaacauuuaccaggagguguucuuaagcauccuguaucgcguccuuccgauucagaaguacuuggaacccguguacuuuuauaucuacacucuguucggccuacaggcuauauauguuacagcccucuacauuaccaguuggcugcuuuccgguacguggcugucuggguugcucgcagccuuuugguaugugacuaauagaaucgauaccacaagggucgaguucacuauuccucugcgggaaaacugggcuuuaccauuuuucgcaauccaaaucgccgcuauuaccuacuuucugcgccccaaucuccagccucuuagcgagcgacugacauugcuagccauauucaucuccaccuuucuguucucacucacguggcaguucaaccaguuuaugaugcugaugcaagcgcuugugcuguucacuuuggacagucucgauaugcugccagcaguaaaagccacaugguuauauggcauucagaucaccagccugcuacucguuuguauacugcaguuuuucaauucuaugauucuuggauccuugcugaucucauuuaaccucagcguguucaucgcuagaaagcugcagaaaaaucuuaagacuggcaguuuucugaacagguuggggaaacuccuguuacaccuguucaugguccuaugccucacacuguuucuuaauaacauuaucaagaagauuuugaaccugaaaucugacgaacauauauucaaguuucucaaagccaaguucggacugggugcaacccgggauuuugacgcuaauuuauaccugugugaggaggccuucggccuuuugcccuucaacacguuugggcgucucuccgauacccugcuauucuacgcguauaucuuugugcugagcauuacagugaucgucgccuucguuguggcauuucacaaucucucggacucuacuaaccaacaguccguaggaaaaauggaaaagggcaccguggaucugaaaccugagacagcuuacaaucuuauccauacuauuuuguucgguuuucuggccuuaucaaccaugcgcaugaaguaucucuggacaagucacaugugcgucuucgcuagcuuugggcuguguuccccagaaauaugggagcuucuguugaagucugugcaccucuacaacccgaaaagaaucugcauuaugagguauagcguucccauccugauucuacuguaccucuguuauaaguucuggccuggaaugauggacgaacugucagagcuucgggaguuuuacgauccagacaccguggaauugaugaauuggaucaacaguaauacuccccgaaaagccgucuucgcaggcuccaugcagcuguuagccggcgugaagcucugcacggggcgcacacugaccaaccauccucacuacgaggacagcucucuuagagaaaggacucgggcuguauaucaaauauacgcgaaacgcgcaccagaggaaguucaugcccugcuaagaucauuuggaaccgauuaugugauccucgaggacaguauuuguuacgagaggcgucaccggcgagguugcagacugagggauuugcuggacaucgcuaauggccacaugauggaugggcccggagaaaacgacccggauuuaaagccugccgaccauccccgcuucugcgaggaaauuaagcggaaucucccaccuuaugucgcauacuucacaagaguguuucagaacaaaaccuuccacgucuauaagcugagcaggaauaaauga

SEQ ID NO: 55479 - RNA, 300 nt, Artificial Sequence
  derived and/or modified sequence opt3 from DPY30__Homo_sapiens__NP_115963
auggagcccgaacagaugcuggagggccaaacccagguggccgaaaacccucacagcgaguacgggcucacagacaaugucgaaagaaucguugagaacgagaagauuaaugcugaaaaauccucuaagcagaaaguggaucuucagucacugccaacuagggcauauuuggaccaaacgguagugccgauauuacugcagggacuagccguccucgcgaaggagcggcccccuaacccaaucgaguuccuggcuaguuaccuucugaaaaauaaggcccaguuugaagaucgcaacuga

SEQ ID NO: 55480 - RNA, 1560 nt, Artificial Sequence
  derived and/or modified sequence opt3 from DPYS__Homo_sapiens__NP_001376
auggccgcucccagcagacugcucaucaggggcgggcggguggucaacgacgauuucuccgagguugcagacgugcuuguagaagauggagugguccgcgcccugggucacgacuuguuaccuccaggcggggcgccggcuggacugcgagugcuagaugccgcaggcaagcucguucugcccggugggauugacacccauacacacaugcaguuuccuuucaugggaucucguucaauagaugacuuucaucaaggcacuaaagccgcucuuaguggcgggacgaccaugaucauugauuucgcaaucccacagaagggagguagccugauugaggccuuugaaacauggagauccugggcugaccccaaagugugcugugauuacucuuugcacgucgccgugacuugguggucggaccagguaaaggaggaaaugaaaauccucguucaggauaagggcgugaauagcuucaagauguuuauggcguauaaagaccuguacauggucaccgaccuggagcucuaugaggcauucucaaggugcaaggaaauaggggccaucgcucaagugcaugccgagaacggagauuuaauugcagaaggcgcuaaaaagaugcuggcccuugguaucacagggccugagggacacgaguugugucggccagaagcgguggaggccgaagcaacccugcgcgcuauuacuaucgccagugcugucaauugcccccuauacauaguucacgugauguccaaaucugccgcaaagguaauugccgacgcuagaagggauggcaagguggucuauggcgagccuaucgcggcaagccucgggacagacggaacccauuacuggaacaaagaauggcaccaugccgcucaccacgugauggguccaccgcugcggcccgauccuuccacgccagacuuucuuaugaaucuguuggccaacgaugaccucacuaccacaggcacugauaauuguaccuucaacacaugccagaaggcacuggggaaagacgauuuuaccaagauucccaauggaguuaacggcguggaggaccgcaugucagucaucugggagaaaggugugcauagugggaagauggacgaaaaucgauucguagccguuacgagcacuaacgcugccaaaaucuuuaauuuauauccuagaaagggcaggauugcagugggaucugaugcggacauagucaucugggauccaaagggcacacggaccauuuccgcuaaaacucaccaucaggccgugaacuucaauaucuucgaggggauggucugucacggagugccccugguuacaauaucacgugguaaggugguauacgaagcaggcgucuuuagcgugaccgccggggacggaaaauucauuccgcgcaagccuuuugcugaguacaucuauaaaagaaucaagcagagggaucggacgugcacccccacaccaguugaacgagccccuuacaagggcgagguggcaacucucaaaagucgcgucaccaaggaggacgcuacagccgguacuagaaaacaagcgcaucccuga

SEQ ID NO: 55481 - RNA, 2034 nt, Artificial Sequence
  derived and/or modified sequence opt3 from DPYSL2__Homo_sapiens__NP_001184222
auggccgagagaaagcagagcggcaaagcugcagaagacgaggaagugcccgccuucuuuaagaaccugggguccggaucuccuaaaccaaggcaaaaguucugcgguauguuuuguccggucgagggcucaagugaaaauaaaaccaucgauuucgacagccucuccguugggcggggaucuggccaggugguagcgcagcagcgcgauguggcucaccuuggucccgacccucaaccacccuacucgcgacaggggcguagagccggaggcgagccuucagucgagagcggcaggaagguggaaauucggcgcgcaagugggaaggaggcccugcagaacauaaaugaucaguccgacagauuguuaaucaaaggagguaagauuguuaacgaugaccaaucuuuuuaugcugauaucuacauggaagacggccugauuaaacagaucggggagaaucuaauagugccaggaggcgucaagacaaucgaggcacauagcaggauggugauucccggugggaucgauguacacacucgguuccagaugccugaccagggaaugacguccgccgaugacuuuuuccaaggcaccaaagcugcccucgcgggcgggacaacuaugauuaucgaccauguugugccagaaccgggaaccucacugcuugcagccuuugaucaguggcgcgagugggcugacaguaagagcugcugugauuauucucugcacgucgacauauccgaauggcauaaggguauucaggaggaaauggaggccuuggugaaagaucacggcgugaacucauuccucgucuacauggcauuuaaggaccgauuccaacugacagauugccagaucuaugagguucugagcgugauuagagacaucggggcuaucgcccagguacacgcggaaaauggagauauuauagccgaggaacagcaaaggauccucgacuuaggcauuaccggucccgaggggcaugugcugagucggccugaagaggucgaggcagaagcugugaaccgugccaucacuauagcuaaucagacaaacuguccacuuuacauuaccaaaguuaugucuaaguccagcgccgaggugaucgcacaggcccgcaaaaagggcacggucguguauggagaacccaucacugcuucguugggcaccgaugggucucacuacugguccaaaaauugggcgaaggcagccgcuuuuguaacaucaccuccacugagucccgacccgacuaccccugacuuccuaaacagccuccuguccugcggagaucuucagguuacagguucugcccauuguaccuucaauacggcacaaaaggccgugggcaaagacaacuuuacucugauucccgaggggacaaauggaaccgaagagagaaugagcgucaucugggauaaggcuguggucacuggcaaaauggacgagaaccaguucguggccguuacaucaaccaacgcagcgaagguguuuaauuuguacccaaggaaaggucggauugcuguagggagugaugccgaccucgucauaugggauccugacuccgugaagacgaucagcgcaaagacccacaacucuucacuggaauauaauauuuucgagggcauggaaugccgaggaagucccuuaguugugaucagccagggcaaaaucguccuggaggaugggacacuccacgugacugagggauccggucgcuacauuccaagaaagcccuuuccugacuucguauauaaaaggauaaaggcccggucucgccuugcugaacugagaggcgugccaaggggguuguacgauggaccgguuugugaggucucggugacccccaaaacagugacuccugccagcuccgcaaagaccucaccagcuaagcagcaagcgcccccuguccguaaccuacaucagaguggcuuuucucugagcggugcccagaucgacgauaauauuccacggcgaacaacccagagaaucguugccccgcccgggggcagggcuaacauuacuucccucggauga

SEQ ID NO: 55482 - RNA, 2055 nt, Artificial Sequence
  derived and/or modified sequence opt3 from DPYSL3__Homo_sapiens__NP_001184223
auggccagcggcagaagggggugggacuccucucacgaggaugaccugcccguguaccucgcucggccuggaaccacagaucaggucccacgccaaaaguaugguggcauguucugcaacguugaaggggcauuugagucaaaaacucuugacuucgaugcccugagugugggacagcgaggcgcgaagacgccgcguagcggucagggguccgacagaggaucuggcucgaggcccggcaucgaaggggauaccccucggcgcggacaggguagagaggaaucaagggagccagcucccgccagcccugcaccagccggcguagagauucggagugcuacagggaaagaaguguugcaaaauuuaggacccaaggacaaauccgaucgccugcuaauaaagggcggucgaaucgucaacgacgaucagucuuuuuacgcagacauuuauauggaggaugggcucaucaagcagauuggagacaaucugaucgugccuggcggcguuaaaacuauagaagccaacgggaagauggugaucccaggagguauugacguccauacccacuuccagaugccguacaaaggcaugacaaccguggaugacuuuuuccaagggacuaaggcugcccuugcgggaggcacaaccaugaucauugaucauguaguucccgagccugagagcucccugacggaagcauaugagaaauggagagaaugggccgacgguaagucauguugcgauuacgcuuugcacguggacaucacucauuggaaugauagugucaagcaggaggugcagaaccucauaaaagacaagggggugaauagcuuuauggucuauauggccuacaaagaucuguaccagguuucuaacaccgaacuguaugagauuuucacaugucucggcgaguuaggagcaaucgcucaagugcacgccgaaaauggcgacauuaucgcgcaggagcagacuaggaugcuggaaauggggaucaccggaccagagggucacguacuuucccggcccgaagaguuggaggccgaagcaguguuucgugcuauuacaauagccucacaaaccaacugcccucuguacgucacgaaggugaugagcaaaagugcugccgaucuaaucucucaggcacgcaagaaaggcaauguuguguucggggagccaauuacugccucccucggaaucgacggcacacauuauuggagcaagaacugggcuaaggcggcagccuuugucaccucgcccccgcugucuccugaccccacuacaccagauuacauaaauucccuucuggcuucaggugacuugcagcucagugggagcgcccacuguaccuucuccacggcacagaaagccauuggcaaggauaacuuuaccgcuaucccugaaggaacaaauggcguggaggaaagaaugucuguaaucugggacaaagccguugcaacugggaagauggaugagaaccaauucguggcggucaccagcacaaacgcugccaaaauuuucaaucuguaucccaggaagggacggaucucaguggguagugacuccgauuuagucauuugggacccagaugcagugaagauaguuagcgccaaaaaccaucagucugcugccgaguacaauaucuuugaaggcauggagcugcgaggggcaccccucgugguaauuugccagggaaagaucaugcuugaagacggcaaccugcacgucacucagggugcugggcgcuucaucccuuguucaccauuuagugauuauguguacaaaagaauuaaggccaggcggaaaauggcggacuugcacgccguuccgcgcggcauguacgauggacccguguucgaccuaaccacaaccccuaagggcgggacuccagcuggaagcgcaagaggcucccccacgaggccuaauccacccguccguaaccugcaucaaucugguuuuucgcucagcgggacacagguggacgagggaguacgguccgccucaaagcgaauaguggcuccgccuggcgguagaaguaauaucaccucucugagcuga

SEQ ID NO: 55483 - RNA, 1719 nt, Artificial Sequence
  derived and/or modified sequence opt3 from DPYSL4__Homo_sapiens__NP_006417
augagcuuccagggcaagaaauccauccccagaauuaccucugacaggcugcucauacgcgggggacggaucgugaacgaugaccaaucauuuuacgccgauguccacguugaggacggucuuauuaagcagaucggcgaaaaucugauugugccugggggaaucaaaacaauagaugcucauggcuugaugguauuaccaggugggguggacguccacacucgacugcagaugccggugcuaggaaugacgcccgcagaugacuucugccagggcaccaaggccgcgcucgcuggcgggacaacuaugauccuggaucauguuuuuccugacaccggagugagucuucuggccgcauaugagcaauggcgugaaagagccgauagcgcugcauguugcgacuacuccuugcacgucgauauuacaagguggcaugagucuaucaaagaagaacucgaggcccuggugaaggaaaaggguguaaacucguuccugguuuuuauggcuuauaaagaccggugucagugcucagacagccagauguacgagauuuucaguaucauacgcgaucucggcgccuuagcacaggugcacgcggaaaauggggacauugucgaggaggaacaaaagagacugcuugaguugggaaucaccggcccagaaggucacgugcugucccaucccgaggaaguggaggccgaggcugucuauagggccguuacuauugcaaaacaggcuaacuguccucuauacgugacaaagguaaugucuaaaggggccgcggaugccaucgcacaggcuaagcggcgcggaguggucguguuuggcgaaccaaucaccgccagccucggcacggacgggucccacuauuggucaaagaauugggcuaaagccgcagccuucguuaccagucccccugugaacccagauccgacuacagcugaccaucugacuugccuucugagcucuggagauuugcaggucaccgguuccgcgcacuguacauuuaccacggcacaaaaggccgugggcaaagacaauuucgcucucauucccgaggggacuaacggaauagaggagcgaaugucaaugguaugggaaaagugcguugccagcggcaaaauggaugagaaugaguuuguggcagucacaaguaccaacgccgcuaagaucuucaauuuuuacccuagaaaagguaggguggccgucgggucugacgcagaucuggugauuuggaacccaaaggcgacuaagaucauauccgcuaaaacacacaauuuaaacguugaauacaauauuuucgagggcguggaaugucggggagcccccgcaguagucaucagccagggccguguggcccuggaggacgggaagauguucguuaccccuggagcuggucgcuuugugccaagaaaaacguuccccgacuuugucuauaagaggaucaaagcccggaaccgacucgcagaaauucauggcgugccgcgcgggcuuuacgauggaccuguacacgaggugaugguucccgcuaagccaggcucgggugccccugcgagagccucuugccccgggaagaucuccgucccacccgugaggaaccugcaucagucaggcuucaguuugagcggaucccaagcugacgaucacauugcacggcgcaccgcccagaaaauaauggcuccuccaggcgggagaucuaauaucacaagccuaucauga

SEQ ID NO: 55484 - RNA, 1695 nt, Artificial Sequence
  derived and/or modified sequence opt3 from DPYSL5__Homo_sapiens__NP_001240652
augcuggccaacagcgcuuccgugcgcauccucauuaagggcgggaaagucguuaaugacgauugcacccacgaggcagacguguacauagaaaacggaaucauucagcagguagguagggagcuuaugauccccggcggggccaaggugauugaugcgacaggaaaacuggucaucccuggcgguauagacacuucuacgcauuuccaccagaccuuuaugaaugcuacauguguggaugacuucuaucaugggacuaaggccgcauugguuggaggcaccacaaugaucauuggccacguguuaccagauaaagaaaccucacuggucgacgccuacgagaagugccgggggcuagcugauccgaagguguguugcgacuaugcacuccauguaggaaucacuuggugggcccccaaaguuaaggcugaaauggagacacuggugcgcgagaaaggugucaacaguuuucagauguucaugaccuacaaggaucuuuauaugcugcgagacagcgaauuguaccaggugcuccacgccuguaaagauauuggcgcgaucgcacgugugcacgccgagaauggggaacuggucgcugagggagccaaggaggcacuggaccucggcauaacggguccugaagggauugagaucuccagaccagaagaguuagaagcugaggccacucauaggguuauuaccaucgcgaaccggacacacugccccaucuaucuggugaauguaucuucgauuucagccggagacgugauagcagcugccaagaugcaaggcaaagucgugcuugcugagacuaccacagcccaugcaaccuugacgggccugcacuacuaccaccaggauuggagccaugccgcugcguauguuacugugccuccacuacgccucgacacaaacaccaguacuuaccugaugucccuucuggcaaaugauacauugaacaucgucgccucugaccacagacccuuuaccacgaagcagaaagcuauggggaaggaagauuucaccaaaauuccucauggagugagcgguguacaggacaggauguccguuaucugggagcggggcguggucgggggaaagauggaugaaaaucgcuuuguggccgucacaucaaguaacgcagccaaacuccugaauuuauauccacgaaagggcagaauaauuccgggugcugacgccgaugugguugugugggaccccgaggcaacuaagaccaucagcgcgucuacacaaguacaagggggcgauuucaaccuguacgaaaauaugaggugucacggagucccucucgugacuaucucccggggccguguuguguaugagaacggggucuuuaugugcgcugagggaaccgguaaauucuguccacuucgcucauuucccgacacaguguacaagaaacugguacagagagaaaagaccuugaaagugaggggcguugaccggacuccuuaucuaggggaugucgccguggugguccauccaggaaagaaggagaugggcacgccccuggcagacacaccgacccgaccuguuacucgccacggugggaugagagaucuccacgaaagcaguuucucucuguccggcagccagauugacgaucaugugcccaaaagggccucggcucggauccuugccccaccuggaggcagaucuuccgggauuugguga

SEQ ID NO: 55485 - RNA, 717 nt, Artificial Sequence
  derived and/or modified sequence opt3 from DRAM1__Homo_sapiens__NP_060840
augcugugcuuccucagaggcauggccuuugugcccuuccuucuggucaccuggagcuccgcugcauuuaucauuucuuacguuguggccguauugucagggcacgugaacccuuucuuaccauauauaagugacacaggaacuacgccgcccgagagcgguaucuuuggcuucaugauuaauuuuuccgcguuccugggggcugccaccauguacacaagguauaagaucguccagaaacaaaaccagacuuguuacuuuucuaccccuguguucaaucuaguuucgcucgugcugggacuugucggcugcuuugguauggggauuguggcaaacuuccaggaacuggccguaccaguugugcaugauggaggcgcuuugcucgcauuugucuguggcgugguguauacacugcugcagucaaucauaagcuacaagaguugcccccaauggaacucccucucuaccugucacauccggauggucauuagcgccguuuccugcgcugccgugaucccuaugauuguaugugcgucauuaaucaguauaacuaaacuggaguggaauccacgcgaaaaggacuauguguaccaugucgugagcgcaauuugcgaguggacaguugccuucggguucaucuuuuacuuccuuaccuuuauucaggauuuccagucugugacguugcgaaucuccacugaaaucaauggagacauuuga

SEQ ID NO: 55486 - RNA, 618 nt, Artificial Sequence
  derived and/or modified sequence opt3 from DRAP1__Homo_sapiens__NP_006433
augcccagcaagaaaaagaaauacaacgccagauucccuccagcuaggaucaagaaaauuaugcagaccgacgaggaaauaggcaagguggcagccgcggucccgguuaucauuucccgggcucuggagcucuuucuugaaucucuguugaagaaagccugccaagugacacagucacgcaaugcaaagacuaugacgaccagucacuuaaaacaguguaucgagcuggaacagcaauucgauuuucuaaaggaccucguagccagcgugcccgauaugcagggggacggagaggauaaccauauggacggugauaaaggcgcucgacgugggagaaagccuggauccggcgguaggaagaaugggggaaugggcacaaaaucuaaggacaaaaagcugucgggcacugauucagagcaggaagacgagagcgaagauaccgacacagauggggaggaggaaaccagucagccacccccucaagcaucccacccaucugcccauuuccagagcccucccacuccauuucuuccguucgcuuccacacugcccuugccuccagcgcccccuggaccaucagcccccgacgaggaagacgaggaagauuaugacaguuga

SEQ ID NO: 55487 - RNA, 2223 nt, Artificial Sequence
  derived and/or modified sequence opt3 from DRC1__Homo_sapiens__NP_659475
augaaucccccuggcagccuggaggcccucgacccaaauguggaugaacaccuuuccacccagauccuggcuccgucuguccauucagacaacagucaagagaggauucaggcaagacgguugcgcauagccgcgcgauuagaagcucguagaagggaggcccugggggaauaccuagauggaaagaaagagagcgaggaagaccaguccaagucuuauaaacagaaggaggaaucgcggcucaaacuggcaaaacuucuguugugcgguacagagcucguuacuaauauccaaguggccauugauauccgcgagauucacagaaggguagaagaggaagagaucaagcggcagcgcauagaaaagcuggagaacgaggugaagacgucacaggacaaauucgaugaaaucaccagcaagugggaggaaggcaaacagaagcgaaucccccaagagcugugggaaaugcucaauacacagcaguuacauugugcugggcugcuugaggacaagaacaaauugauuagugagcugcagcaagaacuaaagacuaaagaugaccaguacgucaaggaucucaaaaagcaguccgacgauauuugccugcuucuggagagaauggaagaacaagugaaaaauguuaugaagaccuuuagggaagaguuguauaacaucgagaaggcauucgaaguggagcggcaggaacuccuggccucuaauaaaaagaaaugggagcaggcuuuacaggcccacaacgcgaaggagcuggaauaccucaauaaccguaugaaaaaggucgaggacuaugaaaagcaacuuaaucgccagagaauaugggacugugaggaauacaacaugauuaaaaucaagcuggagcaggaugugcagauuuuggagcaacagcuacagcagaggaaagcaaucuaucaacugaaucaggaaaagcucgaguacaaccugcagguacuuaaaaagcgggacgaagagagcacaguuaucaagucccagcaaaaacgaaagauuaaccgccugcaugauauauugaauaaccucagaucaaaauacgccaagcagaucaaacaguuucaagaagagaaucagagucugaccagcgacuauaagagguuagugaugcaguucaaggagcugcagaaagcuaugcggcacuuugcccuaauugaugacgaaaaguucugggagaucuggcucaugaacgaagaggaagcaaaagaucugauagcucgcgccuuugacgucgauagaauuauccacacucaucaccuuggauugccuugggcggccccagacuucugguuucugaauaacgugggccccaucucucaacagccucagaaguccgcaacacagauuguggaggagaugcucaugaggucagaagaggaagaggcugaggaagccgcugccgagccagaaagcuaccuggaucuucccaaacaaaucagugagaagaccacgaaacguauucugauguugcucugcgacgaaucugguuuccugauagaguccaaguuacugagccuacuccugccucuugagcagaaugaauguuauuugcugcggcucgacgcaaucuuuucggcccuggggauugagucugaagaugacuuauacaagcuggucaacuucuuucuuaaauaucgagcucauagauuguccucaagucuccagaucaagccaugcagccaggcguccauggagaaagcaucuauggaagagacuagcaccaggucagagcuggaacuagccgagcaaacagaaauggagggagaaaaggaggagagucugguugaaggcgagaaagaagaggaggaagagacuccgcccuccccuugggugauccacccaaaugauguacucaagauucuggaggcuuucgugaugggccuuaagaaaccccgcgacagccgggccccuuugagaguccagaagaacgugagggauaauucuaaagacucagaguacuggcaggcacugaccacaguuauaccaaguagcaagcaaaacuuaugggaugcccucuauaccgcucuggaaaaauaccaccuugugcugacgcagcgcgccaaguugcuccuggagaacuccucucuagagcagcagaacacugaacugcaagcacuccugcagcaguaccuuaauucgaagaucaacagcgaguugcaggucccgcccacacaagugcugcgaguaccuaccaaauga

SEQ ID NO: 55488 - RNA, 1341 nt, Artificial Sequence
  derived and/or modified sequence opt3 from DRD1__Homo_sapiens__NP_000785
augagaacccugaacacaagcgccauggacggcacugggcucguggucgagagggauuucuccguucggauccuuacggcuugcuuucugucuuuguuaauucugucaacccuacucggaaauacacuggugugugcagccguaauacgcuuccgacaccuucguaguaaggugacuaacuuuuucgucaucagccuggcgguguccgacuugcucguugcugugcuggucaugcccuggaaagccguggcagaaauugccgguuuuuggccuuucggcucuuuuugcaauaucuggguagcuuucgauauuauguguucgaccgcaucaauccugaaccucugcguuauaagcguggacagauacugggccaucaguuccccauuuagguaugagcggaagaugacaccgaaagcugccuucauuuuaaucucugucgcguggacccugagcgugcuuauuuccuuuauccccgugcaguugucauggcauaaggcaaaaccuacaaguccaagcgaugggaaugccacuucucuggcugaaaccauagacaacugugauuccucacuaagccgcacguacgccauuaguucuuccgucaucagcuucuauauucccguugcaaucaugaucgugacuuacaccagaauuuauaggauagcucaaaagcagauccggcgcauugccgcgcucgagcgagccgcaguacacgcuaagaauugccagacaacuaccggaaacggcaaaccuguggaauguucgcagccagagucuuccuuuaagaugucauucaaaagagagacaaagguccugaaaacccuuagugugaucauggguguuuucgugugcuguuggcugcccuuuuucauauugaauugcauucucccuuuuugugggagcggagaaacgcaaccauucugcaucgacuccaacacuuuugaugucuucgugugguuuggcugggccaauucuagccugaacccgaucauuuacgcuuucaaugccgacuuuaggaaggcauucucaacauuacugggcugcuaucggcucugucccgccaccaacaaugcuaucgagacuguaaguauuaacaacaauggggcggcaauguuuuccagccaucacgaaccucguggaucuauaucaaaggagugcaaccuuguuuaccugaucccacaugccguggguaguagcgaggauuugaaaaaggaagaggcugccggcauugcacgcccccuagaaaaacuguccccugcccucucugucauccuggacuacgauacagacgugucgcuugagaagauccagccaauuacccagaaugggcagcaccccacguga

SEQ ID NO: 55489 - RNA, 1332 nt, Artificial Sequence
  derived and/or modified sequence opt3 from DRD2__Homo_sapiens__NP_000786
auggacccccugaaccucagcugguacgaugacgaucuugagagacagaauugguccaggccuuucaacggcucugacgggaaggccgaucggccacacuauaauuacuaugcuacccuguugacauuacugaucgcagugauugucuuuggaaacguucuagugugcauggccguaucacgcgaaaaagcgcuccaaacuacgaccaauuaccugauagugagucuugcugucgccgaccuguugguggcaacacucguuaugccguggguggucuaucuggaggugguaggugaauggaaguucagccgaauccauugugauauuuuuguuacucuggacgugaugaugugcaccgccuccauccucaacuuaugugcuauuucuaucgaucguuacacagcagucgccaugcccaugcuguauaauaccagauacucgucaaaaaggcgggugacugugaugauaagcaucgucuggguucuuaguuucacaauuuccugcccuuugcuguuuggccuaaacaaugcugaccagaacgaguguaucauugccaauccagcguucgugguauacucuagcaucguguccuuuuauguccccuucauagugacccuccugguuuacauuaagaucuauauugugcuucgcagaaggcggaaacgcgucaacacgaagcgaucaaguagagcauuuagggcccaucugcgggcuccuuugaaggggaauugcacucacccagaagauaugaaacucuguaccgugaucaugaaaagcaacggaucuuuccccguaaaucgucgcagaguugaggccgcaaggcgggcucaggagcuggaaauggagauguuauccucaacaagcccuccagaacgaacucgcuacaguccgauucccccuucucaccaucagcugacccucccagaccccucccaccacggccuucauagcacaccugauucgccagccaaacccgagaagaacggucacgcgaaagaccauccgaagaucgccaagauauuugagauccaaaccaugccuaacgggaaaacgagaacuucucugaagacaauguccaggcggaaauugucacagcagaaggaaaagaaggcaacccagaugcuagcuauugugcugggagucuucaucauaugcuggcuccccuuuuucauuacucacauccugaauauccacugugacugcaacauuccaccugugcuuuauagugccuucacauggcugggcuacgucaauagcgcugugaaccccaucauuuauaccacguuuaauauagaguuccgcaaagccuuuuugaagauccuccauuguuga

SEQ ID NO: 55490 - RNA, 1203 nt, Artificial Sequence
  derived and/or modified sequence opt3 from DRD3__Homo_sapiens__NP_001269492
auggccagccugucccagcucucuggccaccuuaacuauaccugcggggcugaaaauucaacaggagcaagucaagccagaccccaugcguacuacgcucugagcuauugugccuugaucuuagcaauuguguucgguaacggccuggucugcauggccguucuaaaggagagggcucuccagacuacgaccaauuaccuggugguaucccuugcaguggccgaccuguuggucgcuacacucgugaugccuuggguuguguaucuggaggucacugggggaguguggaacuuuucucggauauguugcgauguauucguuacccuggacgugaugauguguacagccucgauccucaauuuaugcgcgauuucaaucgaucgcuacaccgcagucgugaugccagugcacuaucagcauggcacuggucagagcaguugucgacgugucgcccugaugauuacagcuguuugggugcuugccuuugcaguauccugcccguugcuguucggguuuaacaccacgggagaccccacuguguguucuaucagcaauccugauuucgucauauacuccucagugguuaguuuuuaccuaccauucggcgugaccguccucguguaugcuagaaucuacguaguucugaaacaaaggcggcgcaagaggauucuuacaagacagaacagccagugcaauucugugcggcccggcuuuccucagcaaacucuguccccagaccccgcccacuuggaacucaaacgcuauuacucaaucugucaggauaccgcguuagggggaccugguuuccaggagcgaggcggggaacugaagagagaggagaaaacaaggaacagccugaguccaaccauugccccgaagcucucucuugaaguccggaagcuguccaauggacguuugagcacgucgcuaaaacugggcccccuccagccucgcggugugccacugagagagaagaaagcaacucaaauggucgcuaucgugcuuggggccuuuauaguuugcuggcugcccuucuuuuugacacaugugcucaacacccacugccagacuugucacguaucuccugaacuguauuccgcuacaaccugguuaggauacgucaauucagcccugaacccagugauuuauacgaccuucaauaucgaguucaggaaggcauuucuaaaaauucucaguugcuga

SEQ ID NO: 55491 - RNA, 1260 nt, Artificial Sequence
  derived and/or modified sequence opt3 from DRD4__Homo_sapiens__NP_000788
augggcaacagaagcaccgccgacgcugaugggcugcucgcaggaaggggucccgccgcgggcgcuuccgccggggcaucugccggacuugcuggccagggugcagccgcucuggucgggggaguguuguuaaucggcgccguucuggcgggcaauagucuagugugcguaucaguggcaacagagcgggcccuccaaacuccuacgaacagcuucauugucucccuggcugccgcagaccuucuguuggcucuccuggugcugccacucuuuguuuacucugaagugcaagggggagccugguuacugucgccgcgccuuugugaugcguugauggccauggacgucaugcugugcaccgcaucaauauucaaucuaugugcuaucagcguggaucgauuuguagccguugcugugccccuccguuauaacagacaggguggcaguaggcggcagcugcuucugauuggggccacaugguugcucuccgcagccgucgcugcgccugugcugugcggauuaaaugacgugcgcggcagagauccagcagucuguaggcuggaggaccgggauuacguuguguauucuagcguaugcuccuucuuucuccccuguccucuuaugcuguugcuauacugggccacuuuccgcggucugcagcgaugggaaguggcuagaagggccaagcuccacgggcgggcaccacgucgccccucaggaccuggcccaccgagucccaccccuccagcccccagacugccucaggacccaugcggccccgauugugcuccgccugcccccgggcuuccaaggggaccuugcggucccgacugugcaccagcggcucccagccugccucaggauccaugcggcccggacugcgcacccccugccccaggguugcccccugacccauguggaucuaacugcgcucccccggaugccguccgggccgcagcucucccuccacagacacccccucaaacccgacgcagaaggcgggccaaaaucacuggccgcgagagaaaggcgaugagggugcugcccguuguggucggugccuuuuuacuguguuggacaccauucuuugugguacauauuacccaggcucuaugcccugcauguuccguucccccacgucucgugucagccgucacguggcugggguaugugaauagcgcucuuaacccggucaucuacacuguguucaaugccgaauuucggaacguuuuccgaaaagcauugagagcgugcuguuga

SEQ ID NO: 55492 - RNA, 1434 nt, Artificial Sequence
  derived and/or modified sequence opt3 from DRD5__Homo_sapiens__NP_000789
augcugcccccuggcagcaacgggaccgccuacccaggacaguucgcucucuaucaacagcuugcacaggguaaugccgugggcggguccgcgggagcuccgccccugggcccuucucaggucguuacagccugcuuguuaacucugcuaaucauuuggacgcuccuggguaacgugcuuguaugugcagccauagugagaucaaggcaucugcgggcuaauaugaccaacgucuuuaucgugaguuuggcaguuagcgaccucuucguggcccugcuggucaugccauggaaggcuguggccgagguagcgggguacuggcccuuuggagcauucugcgauguuuggguggccuuugacauuauguguuccacagcuucuauccucaauuuaugcgucauuucgguggaucgcuauugggccaucucacgaccuuuccguuacaaaagaaagaugacucaaaggauggcacuggugauggucggccuugcuuggaccuugagcauacugaucaguuuuauuccaguucagcuaaacuggcaccgggaccaggccgcguccuggggcgggcucgaucugcccaauaaccuugccaauuggacaccuugggaagaggacuucugggaaccagaugugaacgcagagaauugugacucuagccugaaccgcaccuaugcuaucuccucaaguuugauuagcuuuuacaucccgguagccauaaugauugugacuuauacaagaaucuacaggauugcucagguccaaauccggcgcaucucuucccucgaacgagccgcagagcacgcccagucaugcagaagcagugcugcgugugcacccgauaccucucugagggccuccauuaaaaaggagacgaaaguguuaaagacucugagcguuauaaugggaguguucgucugcuguuggcucccauuuuucauccuuaauugcauggugccuuuuuguucgggucaucccgaaggcccuccagcuggguuccccugcguaucugagaccacauucgacguuuuugugugguucggaugggccaacuccucacugaauccggucauuuacgcauuuaacgccgauuuccagaagguguuugcucaguugcuaggcugcagucacuucuguagccggacuccugucgaaaccgugaacaucuccaaugagcugauaucuuauaaccaagacauuguuuuucauaaagagaucgccgcagcguacauccacaugaugcccaaugcugugacaccagguaaccgugaaguagauaaugacgaggaagaggggccuuucgaccgcauguuucagauuuaucagaccagccccgauggagacccagucgccgaaucagugugggagcucgauugcgagggcgaaaucagucuggacaagauuacgcccuucacuccuaacggcuuucacuga

SEQ ID NO: 55493 - RNA, 1104 nt, Artificial Sequence
  derived and/or modified sequence opt3 from DRG1__Homo_sapiens__NP_004138
augagcuccacccuggccaagaucgcugagauugaagcagagauggccagaacacagaaaaacaaggcgacugcucaccaucucggccuucugaaagccagguuggcaaaguuacggcgcgaacugauaacgcccaaagggggagguggcgggggaccuggcgaggguuucgacguggccaagaccggggaugcucgaaucggauuugucggcuucccaucuguuggcaagucaacacuacucaguaaucuggcagggguguacagcgaaguagccgcuuaugaguuuacuacccuuacaaccgugccgggagucauucguuacaaaggugccaagauccaacuguuggaccuccccggcauuaucgagggggcgaaagauggaaagggcagagguaggcaagugauagcaguugcccggacuugcaaccugauccugauugugcucgacgucuuaaaaccucuggggcacaagaagaucauugaaaaugagcuugaaggauucggcauccgcuugaacuccaaaccacccaauauaggcuuuaagaaaaaggauaaagggggaauuaaccugacagcuaccuguccucagucugagcuagacgccgagacggugaagucgauccucgcagaauauaaaauucauaaugcugauguaacucugagaucagacgccaccgcggaugaccuuaucgauguuguggaggguaacagggucuacaucccaugcauuuaugugcugaauaagauagaccagaucagcauugaagaguuggauaucauauacaaggugccccacugugucccuauuagugcccaucaccgguggaacuucgacgaccuccuggagaaaaucugggauuauuuaaagcugguucgcaucuacacaaaaccaaagggccagcucccggacuacacuucccccgugguacuuccuuauucucgaaccacaguggaagauuuuugcaugaaaauucacaagaaucugaucaaggaguucaaauacgcauuggucugggggcuaagcgugaagcauaacccacagaaaguuggaaaggaccacacccuggaagaugaggacgugauucagauagucaaaaaguga

SEQ ID NO: 55494 - RNA, 792 nt, Artificial Sequence
  derived and/or modified sequence opt3 from DRGX__Homo_sapiens__NP_001263380
auguucuacuuucacugucccccucagcuggaaggcaccgccacauucgggaaccauagcuccggagacuuugaugacgguuuccucagaaggaagcaacggcgcaaucgaacuacguuuacccuucagcagcuggaggcuuuggaagcaguguucgcccagacacacuauccagaugucuuuacucgugaagaguuagcgaugaaaaucaaccugaccgaagcuagaguucaagugugguuccagaauaggcgggccaaguggcgcaaaacagagagaggcgcaucugaccaggagccgggggccaaggaacccauggcugagguaaccccuccacccgugaggaacauuaauucaccuccacccggagaucaggcacggaguaaaaaggaagcccuagaggcucaacagagccucggccgcacugucgguccugccgggccauuuuucccguccugccugcccggaacacuucugaacaccgcgacguacgcacaggccuugucucauguggcuucgcucaagggcggcccucugugcucauguugcguuccagaccccauggggcugagcuuucucccuacuuauggaugucagaguaaucgaaccgccuccguggcaacauuaagaaugaaagcuagggagcacucugaagccguccugcaaagcgcgaaccuuuugccauccacuucaaguagccccgguccgguggccaagccugcacccccagauggcucucaggagaaaaccuccccuacaaaggaacagucagaggcugagaaaagcguauga

SEQ ID NO: 55495 - RNA, 4014 nt, Artificial Sequence
  derived and/or modified sequence opt3 from DROSHA__Homo_sapiens__NP_001093882
augaugcagggcaauaccugccacagaaugagcuuccaucccgggaggggauguccucggggucgcggcgggcacggagcccgaccauccgcuccgucuuuucguccccaaaaccugagacuccuucauccucagcagccacccgugcaguaccaauaugagccuccaucagcacccaguacaacuuucagcaacuccccugccccaaauuuucugccgcccaggccugacuucgucccauuucccccuccaaugcccccgucugcgcagggcccuuugcccccaugcccuauccggcccccauuccccaaccaccagaugcgccauccuuuuccaguuccgcccuguuucccuccaaugcccccuccaaugcccugcccgaauaacccuccagugcccggugcuccucccgggcagggaacguuuccauucaugaugccucccccaucgaugccgcacccucccccacccccuguaaugccacaacaggugaauuaccaguaucccccuggcuacucacaccauaacuuuccgccacccagcuucaauaguuuucagaacaauccuuccucuuucuuaccaagcgccaacaauuccucaaguccccacuucagacaucugccuccguauccccuaccaaaggcaccuagcgaaaggcggucucccgagcgccucaaacacuacgaugaccaccgacauagagaucacucccauggcaggggagaacggcaccguucacuggaccgcagagagagggggcggagcccagaucgacgcagacaagacaguagguaucggucugauuacgaccgcgguagaaccccuuccaggcaucguagcuacgaacggucgcgagagagagagagggaacgccaccggcacagagauaacaggcgcucucccucccuugagcgaucauauaagaaagaauacaagcggaguggcagccguuccccaucuagagagaaaaagagggcccgcugggaggaagagaaggaccgguggagcgauaaucagucaagugggaaagacaagaacuauacauccauuaaagaaaaggagccggaagagacuaugccugauaaaaacgaggaagaggaagaggaacuguugaagcccgucuggauaagauguacccauagcgagaauuacuauucuucagacccaauggaccaggugggagauaguacaguugugggcaccagcaggcuccgagaccuguacgauaaguuugaggaagaacuggguucccgccaagaaaaagcuaaggcagcccggcccccuugggagccacccaaaacuaagcucgacgaagauuuagagucuucgagcgaguccgaaugcgagucagacgaagauaguacauguucuagcuccucagacagcgaggucuucgaugugaucgcugagauuaaaagaaagaaagcccacccugacaggcugcaugaugaacuuugguauaacgacccggggcagaugaaugacggaccauugugcaaguguucugcgaaggcacgucgcaccggcauccggcacuccauuuaccccggcgaggaagccaucaaaccuugcagacccaugacgaacaaugcugggaggcuguuucacuaccgaauaacuguaaguccaccuaccaacuuccuaacagaucggcccacuguuaucgaguaugacgaucaugaauacauuuuugagggauucagcauguuugcccacgcaccacucaccaauaucccucuguguaaggugauucgcuucaacaucgacuauacaauacauuuuauugaggaaaugaugccggagaauuucugcgucaaaggucuugaacuguuuucuuuguuccucuuuagagauauccuggaguuauacgacuggaaccugaagggcccccucuucgaagauuccccaccuugcugucccagguuccacuuuaugccacgguucgugcgauuucuuccugacgggggaaaagaggugcugucaaugcaucagauuuugcuauaucugcucagaugcaguaaggcucugguccccgaggaagagaucgccaauaugcuucagugggaggagcuggaauggcaaaaguacgcggaggaguguaaaggcaugaucguuaccaacccggguacgaagccaagcucggugcgcauugaucaguuggacagggaacaguucaauccugauguaauaacuuuucccaucauugugcacuucgggauccguccagcccagcucuccuaugcaggcgacccccaauaccagaaacuguggaagucuuacgucaaauuacggcaccuucuagcuaacagcccuaaggugaagcagacagauaaacagaagcucgcccaaagagaggaagcucugcagaaaauaaggcagaagaauaccaugcgccgagagguuacuguggagcuuucaagucagggauuuuggaaaacaggcauuagauccgacgucugccaacaugccaugauguugccggugcugacccaccauauccgguaucaccagugucucaugcaucuggacaagcugaucggguacacguuccaggauaggugccuguugcaacucgcaaugacccaccccucucaccaucugaacuuuggaaugaacccagaccacgcccgcaauagcuuauccaacugugguauucgucagccuaaguauggcgauagaaaaguacaucacaugcacaugcggaagaaagggaucaauacacugauuaacauaaugucaaggcuaggacaggacgaucccacuccuagccgcaucaaucauaacgaacgacucgaguuccugggcgacgcuguuguggaauuucuuaccaguguccacuuguacuaucuguucccaucucucgaggaaggugggcuggcgacauacagaacugcaauugugcagaaucaacauuuagccaugcuggcuaagaaacuugaguuggaucgguuuaugcucuaugcccacggccccgaccugugcagggaguccgaucuacgccaugcaauggccaacuguuucgaagcucugaucggagccgucuaccucgagggcagccuggaagaggcaaagcagcuuuucgggagauugcuguuuaaugacccugauuuaagggaaguguggcucaacuacccacugcacccccuucagcugcaggagccgaauaccgaccggcaauugaucgagacaucgccuguucuccagaaacugaccgaguucgaagaagcgauuggagugauauuuacucacguacgucuacuggcucgcgccuucacgcuccgaacagucgguuuuaaccaucugacccuuggccacaaucagagaauggaguucuugggggauucaaucaugcagcugguggcaacugaauauuuauuuauucauuucccagaccaccacgagggacaucucacccugcuuaggucuagucugguuaacaaucggacacaagccaagguggcugaggaacuaggcaugcaggaguacgccaucaccaacgacaagacuaaacgccccgucgcacucagaacaaagacgcuggcugauuugcuggaauccuuuauugccgcguuauauaucgacaaagaucucgaguacgugcacaccuucaugaacguaugcuuuuucccuaggcugaaggaguucauacuuaaucaggacuggaacgauccaaaaagccaacugcagcaguguugcuugacucuccggacagaagguaaggagcccgacaucccgcuguauaagacccuacagacaguggggccuucucaugcccgaacuuacaccguugcugucuauuuuaaaggcgaaagaauuggaugcggcaaggggcccagcauccaacaggcagagaugggagccgcuauggaugcccuggaaaaauacaauuucccacagauggcacaccagaagcgcuuuauugagaggaaauaccggcaagagcuuaaggaaaugcguugggagagagaacaucaggagagggaaccugacgagacggaggauaucaagaaauga

SEQ ID NO: 55496 - RNA, 2640 nt, Artificial Sequence
  derived and/or modified sequence opt3 from DRP2__Homo_sapiens__NP_001164655
augaaccugugcuggaaugagaucaagaaaaagagccacaaccucagagccaggcuugaggcuuucuccgaccauucuggcaaacugcaguugcccuuacaagagauuauagauuggcugucacagaaggacgaagaacuaagugcacagcucccucugcagggggauguggcccuuguccaacaggaaaaagagacccacgcggcuuuuauggaggaaguuaagagccggggaccauacaucuauuccgugcuggagucugcccaggcauucuugucgcagcauccguuugaggaacucgaggaaccccacucagagagcaaggacacaaguccuaaacaacgcauucagaaucugucccgauucguauggaagcaggccacuguggcuucugaacugugggagaaacucacggcacguugugucgaucagcauagacacaucgaaaggaccuuagagcaacugcuugagauucagggugccauggaagaguugagcacaacucugucccaggcugaaggcgugcgggccaccugggagccaaucggggaccuauuuauagauucacuccccgaacacauccaagcgauuaagcuguucaaagaggaguuuaguccuaugaaggacggaguuaagcuggugaacgaucuugcacaucaguuggccaucagcgacguccaccucucuauggaaaauucccaggcucuggagcagauuaacgugcgcuggaaacaauuacaggccucaguaagcgaaagacugaagcagcuccaggaugcacauagggacuucggcccagguagucaacacuuucuuucuuccagcguucaggugcccugggagcgggcuaucucgccuaauaaagucccauacuauauaaaccaccaggcccagacaaccugcugggaucauccgaagaugacugaacuguaccaaacauuggcggaccuaaauaacauuaaauucucugccuaucgcaccgcaaugaagcugcgaagagugcagaaagcucucaggcuggaccuugugacgcugacuaccgccuuggagaucuuuaaugagcacgaucuccaggcuuccgaacaugucauggacguuguggagguaauucacugucugacagccuuauacgaacggcuggaggaggaacgugggauccuagugaacgucccccucugcguggauaugucacugaauuggcuuuugaacguuuucgacaguggacgcagcggcaagaugagagcacuguccuuuaagacuggcaucgccugucucugcgggaccgaggugaaagaaaagcugcaguaucuuuucucucaagucgcuaauagcggaucacagugugaucagaggcaucuggguguguugcuccacgaggcgauucaaguaccucggcagcugggcgaaguugcagccuucgggggaaguaacguggagccauccguccgaagcugcuuucgcuucucuacaggcaaacccgugauagaggcuucacaguuuuuagaaugggucaaccuggagccucagaguaugguguggcuagccguucuccacagagugaccaucgcagaacaaguaaagcaucagacgaaauguagcauuugcaggcaguguccaaucaaggguuuccgguaccgcucccugaagcaguuuaaugucgacauaugccaaacuugcuuccuuacagggagagccucuaaaggaaacaaguugcacuaccccauuauggaguauuacaccccgacuacaucgagcgaaaauaugagggauuuugcuaccacgcugaaaaacaaguuccguuccaaacauuauuuuucaaagcacccucagcggggcuaccuccccgugcagaguguucuggaggccgacuauucugagaccccagcaagcuccccuauguggccccacgcggauacacauucacgaaucgaacacuucgcuagcagauuagccgagauggaaucucagaauuguuccuuuuucaacgacagucugagcccagaugacucuaucgacgaggaucaauaccuuuugaggcauuccucacccauuacugaccgcgaaccugcauuuggccagcaggccccaugcaguguggcuaccgagagcaagggggagcuccaaaagauccuggcccaccuagaagaugagaaucggauucugcagggagaacucagaaggcugaaguggcagcaugaggaggcagcugaagccccgucgcuugcggacgguuccacagaggccgcuacugaucaccgcaacgaagaguugcuggcagaagcccgaauauuacggcagcacaaaucucgucucgagaccagaaugcaaauccuggaggaccauaauaagcagcuugaaagccagcugcagagguugcgcgagcuccugcuacaacccccuacagaaucagauggcaguggguccgcuggaucuagccuggccuccucaccacagcagagcgagggcagucacccccgggaaaaaggucagaccacuccugacacggaggcagcggaugacgucgggucuaagucccaagaugugagccucugucuggaggacauuauggaaaaacuuagacaugccuucccaucgguaaggucaucugaugugacagcuaacaccuugcuggccaguuga

SEQ ID NO: 55497 - RNA, 2523 nt, Artificial Sequence
  derived and/or modified sequence opt3 from DSC1__Homo_sapiens__NP_004939
auggcccuggcuagcgcagcccccggcuccaucuucugcaagcagcuccuuuuuagccuguugguguuaacccugcuaugugacgcgugccaaaaagucuaccucagaguuccuucacaucugcaggcugagacacuuguggggaagguaaaccuggaagaguguuugaaaagugccagccucauuagguccucugauccagcauuccggauacuggaagacggaucgaucuauacuacgcacgaucugauucucucaagcgagcgcaagaguuuuuccaucuucuuaucugacggucagcgacgugaacagcaagagauuaaagugguccugagcgccagagagaauaaguccccgaagaaaaggcacaccaaggauacagcucuuaaacggucaaagcgcagaugggcacccaucccugccaguuugauggaaaacagccugggcccauuuccccagcaugugcagcagauacaaucugacgcugcccagaauuacacuaucuucuauuccauuucagggccuggaguugauaaagagccauuuaaccuauucuacaucgaaaaggacaccggcgauaucuuuugcacaaggagcauugaccgggagaaguaugagcaguucgcgcucuacgguuaugcaaccacugccgauggguacgcucccgaauacccucugccacuuauaauuaaaaucgaggacgauaaugacaacgccccguauuuugaacaccgcgugacaauuuucaccguccccgagaauugucgaaguggaacgucugugggcaagguaacugcaaccgaccuggaugaaccugacacauugcauacuagacucaaauacaagauccugcagcaaaucccagaucaccccaaacacuuuuccauucauccugacaccggcguuauaacaaccacgacuccauucuuagauagggagaagugcgacacauaucagcugaucauggaggugcgggauaugggagggcagcccuucggucucuuuaacaccggcacuauuacaaucagccuugaagacgagaaugauaacccgccuucguucaccgaaacgucuuacgucaccgagguggaagagaaucguauagacguggagauucugcgcaugaaaguccaagaucaggacuugcccaacacaccacacuccaaggcuguuuauaagauccuacaggggaaugaaaacggaaauuuuaucauuucaacugacccuaacaccaacgagggcgugcuguguguagugaaaccccucaauuacgaagucaacagacaggugauccugcaaguuggugugauuaaugaggcccaguucaguaaggcggccagcucccagacaccaacuaugugcaccacaaccgucacugugaaaauaaucgauucugacgaagggcccgagugucauccuccaguaaagguuauucagagccaagauggauuuccggcaggccaggagcuucugggcuauaaggcuuuggaccccgaaaucucaaguggggagggacucagguaccagaagcugggugaugaagacaacugguucgagaucaaucagcacacgggcgauuuacggacacugaaggugcuagaccgagaguccaaauuugucaagaacaaucaauacaacauuagcguggucgccguggaugcuguugggcgcucuugcaccggaacucucgugguacaccuggacgauuauaaugaccaugccccucagauagauaaagaagucaccaucugucagaacaaugaggacuucgcagugcuuaagccaguugaccccgauggcccugaaaacgguccacccuuucaguucuuuuuggacaauucagccaguaaaaacuggaauauugaggaaaaggaugggaagacagcuauccugagacaaaggcagaaccucgacuacaacuauuacagcgugccgauucagaucaaagaucggcacggccuggucgcgacccauaugcuuacugugcgcguaugcgacugcuccacaccuucugaguguagaaugaaggauaaaucgacgagggacgugcguccaaauguuauacugggacggugggcaaucuuggccaugguccucggcagcgugcuguuacugugcauucuauucaccuguuuuugcgugacugcuaagcgaacagucaaaaaguguuuccccgaggauaucgcccaacagaaccucauuguuuccaauaccgaagggccuggagaggaagugacagaggcaaacaucagacugcccaugcagacuucaaauauaugcgacaccaguaugucuguggguacgguaggcgggcagggaauuaagacccaacagagcuucgaaauggucaaaggcgguuauacacuugauuccaacaaagggggcggacaccagacuuuggagucagugaaaggcguugggcagggagacaccgguagguacgccuauacagauuggcaaucuuuuacucagccacgccugggcgaggaaucuauccgggggcauacccucauuaagaauuga

SEQ ID NO: 55498 - RNA, 2544 nt, Artificial Sequence
  derived and/or modified sequence opt3 from DSC2__Homo_sapiens__NP_004940
auggaggccgcuagacccagcggcuccuggaacggggcacugugcaggcuccuucuguugaccuuagccauccugauuuucgcgucugacgcuuguaagaaugugacacuacacgucccuucaaaacucgaugccgaaaagcugguuggacgggugaaccuuaaagagugcuuuacugcagccaaucugauacauaguagcgacccagauuuccagaucuuggaagacgguuccguauacacgaccaacacaauucuccugucuucggagaagcgcucauuuacuauccugcucagcaauaccgaaaaccaagagaaaaagaagauuuucguguuuuuagagcaccagacaaaaguccugaagaaacgacauaccaaggaaaaagugcuucguagagcuaagaggcggugggcaccgauccccuguaguauguuggagaauagucugggcccuuucccacuauuucuccagcagguucaaucugauacugcccagaacuauacaauauacuauagcauccgcgggcccggaguggaccaggaaccuagaaaucuguucuacgucgagagggauaccggcaaccuuuauugcacgcggccaguggaccgcgagcaguacgaauccuuugagauuaucgcuuucgccacuacccccgaugguuauacaccugaacugccauugccgcucauuaucaagauagaggacgaaaaugauaacuaccccauuuuuacugaggagaccuacacauucaccaucuuugaaaauugucgaguagggacgacuguuggacaagugugcgcgacagacaaagaugagccugacaccaugcacacuagacugaaguauucaauuaucggccaggucccacccaguccuacauuauucagcaugcauccaaccacgggcgugaucaccacaacuucuucccagcuggacagggaacucauugauaaauaccagcuuaagauaaaagugcaagacauggaugggcaguauuucggacugcagaccacaucaacuuguaucauuaacaucgacgaugucaaugaccacuugcccaccuuuacacggaccagcuacguuacuuccguggaggaaaacacgguagauguggagauacuacgugucacaguggaggacaaggaucugguuaacaccgcaaauuggcgcgccaacuauacuauucucaaagguaaugaaaacggcaauuucaagaucgugaccgacgcuaagacaaacgaggggguccugugcgugguaaaaccgcuuaauuacgaagagaagcaacagaugauccugcagauuggaguugugaacgaagccccuuuuucuagagaggcaucccccaggagcgcuaugucgaccgccacugucacagugaaugucgaggaucaggacgaaggcccagaguguaacccucccauccaaacggugcggaugaaagaaaaugcggagguugguaccacuucuaacggguauaaggccuacgacccagagacacgauccucaaguggcauucgcuacaaaaaguugaccgaucccacaggaugggugacuauagacgaaaauaccggcagcaucaagguauucagaucccucgauagggaggcagaaacgauuaaaaacgggaucuauaauaucaccguccuggcuucugaccagggaggucggacaugcacuggcaccuuagggauuauacugcaggaugugaacgacaacagcccuuuuaucccaaagaaaacaguuauuaucuguaagccgacuaugucaagugccgagauuguggcugucgaucccgacgaaccuauccacggaccacccuucgauuuuucccuagagagcucuaccucagaggugcagcgcauguggagacucaaagccauaaaugacacggcagccaggcugaguuaccaaaacgauccuccauucggcagcuauguagugcccaucacaguucgugaccggcuugguauguccucugucaccucguuggaugugacucugugcgacugcauuacagaaaaugacuguacccaucgaguggauccgagaaucgggggcggaggcguccagcucgggaagugggcuauucuggcgauccuucugggaauagcauugcucuuuugcauucuguucacuuuaguuuguggugccagcggcaccuccaagcagccuaaagugaucccagacgaucuggcucagcaaaaccuaauugugucaaauacagaggcccccggggacgauaagguauacagugcaaacggauuuacgacccagacugucggcgccucugcucagggugugugcgggacaguuggcagcggaaucaaaaauggcgggcaggaaaccauagagauggugaagggaggucaccaaacauccgaaucauguaggggcgccgggcaucaccacacucucgacagcugccgcggaggccauaccgaggucgauaacugucgguauacguacucugaguggcacuccuucacacagccuagacugggugaagagaguaucagggggcauacccuuauuaaaaauuga

SEQ ID NO: 55499 - RNA, 2691 nt, Artificial Sequence
  derived and/or modified sequence opt3 from DSC3__Homo_sapiens__NP_001932
auggccgcugcaggccccagaaggagcgugcggggagccgucugccugcaccuccuucugaccuugguuaucuucucccgcgcgggggaggcuuguaagaaagugauuuuaaacguaccuucuaagcuggaagccgacaaaauaaucggucgagugaaucuagaggaaugcuuucguucagcagaucucauuagaaguagcgacccagauuucaggguccugaacgacggcuccguguacacagcccgggcuguugcacuuucugauaagaaacgcucguuuacuaucuggcugucagacaagagaaagcagacgcaaaaagaggugaccgucuugcucgaacaucagaagaaagugagcaagacaaggcacacucgggagaccguacugcgccgagccaaaagaaggugggcuccgauucccuguaguaugcaggagaacucccuggggccuuucccacucuuuuuacagcaaguugaaucugaugccgcgcagaacuauacaguguucuacagcaucuccggacggggcgucgacaaggagccccugaauuuguuuuauauagaacgugauaccgguaaccuuuucugcacucgcccuguggacagagaggaguacgauguguuugaccugaucgcauaugccucaacagcugauggguacagugccgaccuaccacucccccugccuauuagggucgaagacgagaaugauaaccauccaguuuucaccgaagcaaucuauaauuuugaggugcuugaaagcucucggccgggaacgacuguaggcguggucugugcuaccgaccgagaugagcccgacacaaugcacacucgccugaaguacuccauuuugcagcagaccccuagaucaccaggccucuucagcgugcaucccaguacagggguuaucaccacggugucucacuaccuggauagggaggucguggacaaauauuccuuaauaaugaagguacaagauauggacggacaguuuuucggucugauuggcacuagcacaugcaucauuaccguuacugauucgaacgacaaugccccuacauuccggcagaacgcguacgaagccuuuguggaggaaaaugcauucaacgucgagauccuccgcaucccaauugaagauaaagaccuuauaaauaccgcuaacuggagagugaacuuuacgauccugaaggggaaugagaacggacacuucaaaauuucuaccgacaaggagacaaaugaaggcgucuuguccgugguuaaaccccuaaacuaugaggaaaaucgucaggugaaccuggagaucgguguaaauaacgaagccccguuugcuagggauauaccucgggucacugcccucaaucgagcacuggugaccguucaugugagagaccuugaugaggggcccgaguguacaccagccgcucaauacgucaggauuaaggaaaaccuggcggugggaucaaagaucaauggcuauaaagcauacgacccugagaaccgcaauggcaacggguugcgguauaagaaacuccacgaucccaagggauggaucacuauugacgaaaucagugguagcauuauaaccuccaaaauccuggauagagagguagagacaccaaagaaugaauuauacaacauuaccgugcuggccaucgacaaggaugacaggucuugcacuggcacgcuagcuguuaacaucgaggaugucaaugacaaucccccugaaauucuccaggaguacguggugauauguaaaccaaagaugggguauacagauauccuggccgucgacccggacgaacccguucauggagcaccuuucuacuuuagccuuccaaauaccucacccgagauuagucgcuuguggucccugacuaaagugaacgauaccgccgcucgacucagcuaucagaagaaugccggcuuccaagaguacacaaucccuauuaccgugaaagaccgggcaggucaggcggcuacuaagcugcuucguguaaaccugugcgaauguacacacccaacgcagugcagagccaccucuaggucaacuggggucaucuugggcaagugggcaauacucgccauccuguuaggaauugcucugcuauuuagugugcuccugacacuuguuugcggcguguucggggccaccaaaggaaagcgcuuucccgaggauuuggcacagcaaaaucugaucauuagcaacacagaagcuccgggugacgaucgggucuguuccgccaauggcuucaugacucagaccacgaacaauucuucgcagggguuuugcggaaccaugggcagcgguaugaaaaacgggggccaggagacaaucgaaaugaugaagggaggcaaucaaacucucgaguccuguagaggggcgggacaccaucacacccuggacucaugcagggguggccauacagagguggauaacugucgauauacuuacagugaauggcacucuuucacccagccucgcuuaggggagaaacugcaucggugcaaucagaacgaagacagaaugccaagccaggauuauguucuuacguacaacuacgagggaaggggcucccccgccgguucagugggguguugcagcgaaaagcaagaggaggacggcuuggauuuccucaauaaccuggaaccuaaguuuauaacacuagcugaggcauguaccaaacguuga

SEQ ID NO: 55500 - RNA, 6039 nt, Artificial Sequence
  derived and/or modified sequence opt3 from DSCAM__Homo_sapiens__NP_001380
auguggauccuggcccucagccuuuuccaguccuuugcuaacguguucucugaggaccugcacucaaguuuguacuuugucaaugcauccuuacaagagguuguguucgccuccaccacaggaacucugguacccugcccugcggcugggauuccaccggugacgcuaaggugguaucucgccaccggggaggaaauauacgauguccccgguaucaggcacgugcacccuaacggcacacugcagauuuuuccauuucccccuucuucguucucaacucuuauccaugacaauaccuauuacuguacagcagagaacccaagcgggaagauucggagucaggauguucacaucaaagccgugcugcgcgaacccuauaccguccgaguggaggaccagaagacuaugcguggaaauguagcuguuuucaaaugcauaaucccuuccucuguggaggcauacauuacagucgugagcugggaaaaggauaccguguccuuggucucaggaaguagauuucucaucacgagcacuggugcccuguauauuaaagacguucaaaacgaggaugggcuguacaauuacagguguaucacccggcaucgcuauacaggagaaacuagacagucuaacuccgcuagacucuucgugucagacccagccaauagcgcgccgaguauauuagauggcuuugaccaccggaaggcaauggccggccagcgcguagagcugcccugcaaggcucuugggcacccugagccagauuaccgaugguugaaagacaacaugccccuggaacuaucuggaagauuccagaagaccgugacaggucuccugauugagaauaucaggccuuccgauagcggcucguaugucugugaagugucuaaccgguacgggaccgccaaaguuauuggacgucuuuaugugaagcaaccacugaaagcaacgaucagcccccgcaaggucaagucaagugugggcagccagguauccuugucuugcagcguuacugguacagaggaccaggaacucucaugguacagaaauggggagauccugaacccgggcaaaaaugugaggauuaccggcauaaaccaugagaacuuaaucauggaccacauggucaagagugauggcggggcuuaucaguguuuugugcggaaagacaagcuguccgcccaagauuacguccaggugguucucgaagacggaacuccuaaaauuaucagcgcguucucugagaaggugguaucacccgccgaaccagucagucuuaugugcaaugugaaagguacaccucugcccaccauaacguggaccuuggaugacgauccaauucuaaagggcgggagccaucgaaucucccagaugaucacaucugagggaaacguugugucguaccugaauauuagcuccucacaaguccgcgacggcgguguguauagauguacugcaaacaauagugcugggguagugcucuaccaggccaggaucaacguucggggccccgcuucuauucgcccuaugaagaauauaaccgccaucgcaggaagagauacauauauucacugcagggucaucggcuacccauauuacagcaucaaaugguauaagaacuccaaucugcuuccguucaaccaccgucagguggccuuugaaaauaacgggacucugaaauugucagacgugcagaaggaggucgaugagggagaauacaccuguaauguucucgugcaaccccagcugagcacaucucaguccgugcauguaaccgucaaagugccuccauucauucagcccuuugaguucccucgguuuaguauaggucaacgaguuuucaucccaugcguggucgugagcggcgacuuacccauuacuaucacguggcagaaggacgggagaccgauuccuggaucucugggcguuacaaucgauaacauagacuuuaccuccucacuaaggaucaguaaucucagccugaugcacaacgguaacuacacuugcauugcucgcaaugaagcggcagccguggagcaucagucgcagcuuaucguacgggucccacccaaguucguggugcaaccuagagaucaggacgggauuuauggcaaagcugucaucuugaacuguuccgccgaaggauaccccguuccaaccauaguguggaaguuuucuaaaggcgcagggguaccucaguuccagcccauugcccugaauggaaggauccaagugcucagcaacgguucacugcuuauuaagcacgucguggaggaggauaguggcuauuaccugugcaaaguuuccaaugacgugggggcugaugucucuaagagcauguauuugacagugaagaucccagccaugauaaccuccuacccgaacacuacacucgcaacgcagggacagaaaaaggaaaugucauguaccgcgcauggcgagaaaccuaucauuguucgcugggaaaaggaggaccgaaucauuaaucccgagauggcucgguaucuggugagcacuaaagaagucggugaggaaguaaucaguacauuacaaauacugccaaccgugcgugaggauucuggguuuuucuccugccacgccauuaacagcuacggcgaagacagaggaaucauccagcuaacaguucaggagcccccugauccacccgagauugaaaucaaggacgugaaggcaaggacuauuacccuccgcuggacgaugggcuuugauggaaauucgccuauaaccggauacgacaucgaguguaaaaacaagucagacucuugggauagugcccagcggacaaaagacgucuccccgcaacugaauagcgcuacuauuaucgauauucacccaucuagcaccuauuccaucagaauguacgccaagaacaggauaggcaaaucagaacccaguaaugagcuuacaaucacugcagacgaagcugccccugaugguccaccccaggaggugcauuuggagccuauuagcucucaguccauccgaguaaccuggaaggcgccgaaaaagcaucugcagaacgggauuauccgcggauaucaaauaggcuaccgggaauauucaacggguggcaauuuccaguucaacauuaucaguguggacacaagcggggauuccgaggucuacacccucgacaaccugaauaaguuuacucaguauggauuaguugugcaggccugcaacagagcuggcacagggcccucuucgcaagaaaucauuaccacuacccuggaggaugugccaagcuacccucccgaaaauguccaggcaauagccacaucaccagaguccaucaguauuucuuggagcacgcuuuccaaagaggcuuugaacggaauccuccagggcuucagggugauuuacugggccaaucugauggacggugaacuaggggagaucaagaacauaaccacuacacaaccuucacuggaacucgauggacuggagaaauauaccaauuacucuauccagguucuugcauuuacacgugcgggcgacgguguacgcagcgagcagauuuucacucggaccaaggaagaugugcccggcccaccggccggggucaaagcugccgcagcuagugccuccaugguguuuguuagcugguugccuccccugaaguuaaacggaaucauuagaaaguauacgguguucuguucucauccauaccccacagucaucucagaguuugaagcauccccugacaguuucagcuauaggauaccaaaucucucgcgaaaccggcaguacucuguguggguagucgccgugaccuccgcuggccgcgggaauagcucagagauuaucacuguugaaccccuggcgaaagccccugcaagaauccuuaccuuuaguggaacagugacuaccccguggaugaaggacauuguccugccaugcaaagcugugggcgaucccucuccugccguuaaguggaugaaagacuccaacgguacacccagcuuggugacgaucgaugggaggcggucaauauucaguaauggcagcuuuauuauccgaaccgucaaggccgaggacuccggcuauuacucuuguauugcuaacaauaacugggguagcgaugagaucauacucaaccugcaagugcagguaccaccugaccagcccagacuaacuguguccaagacaaccucaucuaguauuacucugucguggcucccaggcgauaaugggggaagcuccauccgcggcuacauccugcaguauucugaagacaacucagagcaaugggggagcuucccuauuuccccgagugaaaggucuuaccgucuugagaauuugaaaugcggaacaugguauaaguuuacccugacggcacagaacggcguuggucccgggcggaucagcgaaauuauagaggccaaaacuuuaggaaaggagccacaguucucaaaagaacaggaacucuucgcguccaucaauaccacaagagucaggcugaaccuuauuggcuggaaugauggcggguguccuaucaccaguuuuacucuggaauaccgccccuucggaacaaccguguggacaacugcucaacgaaccagccuaucuaaguccuauauccucuacgaccugcaggaggccacgugguaugaauugcagaugagagugugcaacucagcagguugcgccgagaagcaggcuaauuuugcaacacugaacuacgauggcagcaccauuccaccuuuaauaaaaucggucguacaaaaugaggaagggcucacuaccaacgagggacugaagaugcuugugacaaucucuuguauucugguuggcguguugcuccuguucguccuacugcuugugguucggaggcgccguagagaacagcggcucaaaaggcugcgcgacgccaagaguuuggcggagaugcugauguccaaaaauacucgaaccagcgacacguuaucaaagcagcaacagacacucagaaugcacaucgauauuccccgggcucagcugcuuaucgaggaaagggacaccauggagacuauagaugaccgcuccacagugcuguugaccgaugccgacuuuggugaagcagccaaacagaagucucucacugucacacacaccgugcauuaccaaagcguaagucaggcuacggggccgcugguggauguuuccgacgccagaccaggaacuaacccuaccacaaggcggaaugcaaaggcuggccccaccgcccguaaccgcuaugcgagccaguggacacuaaaucgaccacaccccacuaucucugcccauacccugacgacagauuggagacuuccuacuccgagggcagcuggcucagucgacaaagagagugauuccuacagcgugucucccucgcaggacaccgaucgggcccgcucaagcaugguguccacagaaagugcuucuagcaccuaugaggagcucgcaagagccuacgaacacgccaagauggaggaacaacugaggcaugcuaaauucacuauuaccgagugcuuuaucuccgacacaucaagugaacaguugacggcggggacuaacgaguauaccgacucuuuaacaagcuccaccccaucagagagcggaauuugucgguucacugcaucuccucccaagccucaggaugguggccgagucaugaacauggccguuccaaaagcucacagacccggggaccugauccaccucccuccauaccugcgcauggauuuucuucugaauaggggaggccccgguacaucccgggacuugagucuagggcaggccugccuggaaccgcaaaagagccguacccucaagagaccuacggugcuggagccaauacccauggaagcagccucguccgcuucuucaacuagggagggacagagcuggcagccuggcgcgguagccacacuuccacaacgcgaaggcgcagaguuagggcaggcugccaaaaugaguuccucucaggagagccugcucgauucacggggacauuugaaggguaacaaucccuaugcaaaauccuacacccugguguga

SEQ ID NO: 55501 - RNA, 6342 nt, Artificial Sequence
  derived and/or modified sequence opt3 from DSCAML1__Homo_sapiens__NP_065744
augaccggcgccggggagcccagaagggaggagccuccaccgcagcccagcgcugggcugcggucccgcgaaucuggugcaccuucagccggcgggugggagcgagcggaacguggaagaggcgcugccgcaaggccagccacuggucccccuccacggcgcaucgggccccucuacggaauguggcuugugacuuuccuguuguuacuggacagucuacacaaggcuagaccugaggaugucggcacgagccucuauuuuguuaacgacucccugcaacaggugaccuucucuucgucagugggcguggucgugccaugcccggcagccgggagccccagugcugcccuuaggugguaccuggcgacaggagaugacauuuaugauguuccucauauacggcacgugcaugcaaaugguacuuugcagcucuacccauuuucccccucugccuucaacagcuuuauccacgacaaugauuauuucuguaccgcugagaacgccgcaggcaaaauucgcuccccuaauauccgagucaaggcuguguuuagagaaccauacacagugaggguugaggaccagcggucaaugcgugggaacguggccgucuucaaaugccugauucccaguagcgugcaagaauaugugucugucguuuccugggagaaggauaccgugucaaucauaccggagcaucgcuuuuucaucacuuaccacggaggccuguacauuagcgacguacagaaagaagaugcgcucaguacauauagauguaucaccaagcacaaguacucuggugagacgaggcaguccaauggggcccgguuaagcgugacugacccugcagaaucgauucccaccauccuggauggauuucauucucaggaggucugggcuggccacacaguggaacuuccaugcacugccuccggcuauccuauacccgcuauucgaugguugaaagacgggcgcccacugcccgccgacucaagauggaccaagaggaucacaggacuaaccauuagugaucuccggacggaggacagcgguacuuacaucugugagguuacaaacaccuucggcuccgcagaagccacugggauccugauggugauugauccucuucaugucacacugacccccaaaaaguugaaaacgggaauaggcucuaccgugauccucagcugcgcucugacagguucaccggaguuuacuauucgcugguauagaaauaccgaauuaguacugcccgacgaggcgaucaguauaagggggcucuccaacgaaacacuucugauuacuagcgcacaaaagucucacucaggcgccuaccaguguuucgcuacccguaaggcccagacagcacaggauuucgccaucaucgcuuuggaggacggaaccccucggauuguuaguagcuuuuccgagaaaguggucaauccaggcgaacaauucucucuaaugugcgccgcaaagggggcgcccccuccaacugugacgugggcucuggaugacgagcccaucguccgagauggaucgcacagaacaaaccaguauaccaugagcgacgguacuaccauuucccauaugaaugugacaggcccgcagauaagggaugggggaguuuaccgcuguaccgcccggaaccucgugggcucagcagaauaccaagccagaaucaauguaagggguccuccaaguauucgcgcuaugcgaaacaucacugccgucgcagggcgggacacacugaucaacugccgugugauuggcuaucccuacuauucuauaaaaugguacaaggacgcacuucuguugccugauaaucacagacagguuguguuugagaacggaacgcucaaacugaccgacguccagaagggcauggaugaaggggaguauuuauguagcgugcugauccagccccaacuauccauuucacagagcguacauguggccguuaaagucccaccucucauccagcccuucgaguuuccaccggcgucuauuggacagcugcuuuacaucccuugcgugguguccaguggugacaugcccauaaggaucacuuggcgcaaggauggccaagucauuaucagcgggucuggaguuacaauugaauccaaggaguucaugucaaguuugcagaucagcucggugucccugaaacacaauggcaacuauaccugcauagccucuaaugcugcagccacagugagccgggaaagacagcucauuguaagggucccaccccgauuugugguucagccuaacaaucaagacgguaucuacgggaaggcuggcgugcugaacuguucagucgauggauacccacccccuaaagugauguggaagcaugccaaaggcagugggaauccgcagcaguaucacccaguuccccuuacuggacgcauucagauccugccuaacuccucuuugcucauacggcacgugcuggaggaggacaucggcuacuauuuaugccaagcaagcaaugguguagggaccgauauuuccaagucaauguuccugacggucaagaucccagcgaugauuaccagccaucccaacacaacuaucgccauaaaaggacacgcuaaggaacuaaauuguaccgccagaggcgagaggccuauuaucauccguugggaaaaaggugacacagugauugauccggaccgcgugaugcgguacgcaaucgcuacuaaggauaacggcgacgaggucguuaguacccucaaacugaagcccgccgacagaggggauucuguguuuuucuccugccaugcaauuaauagcuauggagaagacaggggccuuauacaguugacgguacaggagccaccugaucccccagagcuggaaauccgagaggugaaggcccggucgaugaaccuccgcuggacacaaagauuugacgggaacucaauuaucaccggauucgauauugaauacaaaaauaagucugacaguugggauuuuaaacaguccacuaggaacaucagcccuacaauaaaucaggcuaacaucgucgaccugcaccccgcgucuguguauagcauucggauguacuccuucaauaagaucggccgaucagagccaaguaaagaauuaaccauuagcacugaggaggccgcaccggaugguccucccauggacguuacccugcagccagugacaucucaauccauccaggucacguggaaggcucccaagaaagaacuucagaacggggugauaagaggauaccagauuggcuaucgcgaaaauucaccugguaguaacggccaauacagcaucguugaaaugaaggccaccggggauuccgagguguauacuuuggacaaucucaaaaaguucgcccaguacggagucguagugcaggcuuuuaacagggcaggcacagggccaucuucgagcgaaaucaaugccaccacacuggaggauguucccucacagccuccggagaacgugcgugcgcuauccauuacaagugacgucgcugugauaucuuggagcgaaccaccccgguccacccugaauggaguacucaaaggcuauagagugaucuucuggucacuguacgucgacggugaguggggagaaaugcaaaacauuacgacaaccagggagcgcguugagcuucgaggaauggaaaaguuuacuaauuauucuguacagguguuggccuacacccaggcaggcgauggugucagaagcagugugcuguacauccaaacaaaagaggacguuccuggcccaccagccgggauuaaggcuguaccuuccagcgcaucuucaguggucguguccugguuacccccaacuaagccuaacggaguuauccggaaauauaccauauucuguaguagcccgggcucggggcagcccgccccaucugaauacgagacauccccugaacagcucuuuuauaggaucgcgcaccugaaccgcggacagcaauaccuucuguggguggcugccgucacgagcgcaggccgugguaauucaagugagaaggugaccauugagcccgccgggaaagcuccagccaagaucauuucuuucggaggcacuguaacaaccccuuggaugaaagaugucagauugcccugcaacuccgugggcgacccggcaccagcuguuaaguggacuaaggauagcgaagacucagccaucccugugaguauggaugggcaucggcucauacacacaaauggaacccugcuacugagggcggucaaagccgaggacagcgguuauuacacguguacugcaaccaacacaggcggguuugauaccauuaucgugaaucuccugguucaggugcccccagaccagccccgccuuacugucuccaagacaucugcuagcuccaucaccuugacauggauuccuggagauaacggcgguucaucuauccgaggguucgugcugcaguauaguguagacaauucggaagaguggaaagacguguuuauaagcuccucugaaagaucauucaaguuagauagccucaaaugcggaacuugguacaagguuaagcuggccgcuaaaaacuccgucggcaguggccggauuucugagaucauugaggcaaagacccaugggagggaaccgagcuuuucaaaagaccaacaccuuuucacgcauaucaauuccacacacgcccgccugaaccuacagggauggaauaacgguggcugucccauaaccgccauugugcucgaguacagaccaaaggggacuugggcuuggcagggacugagggcgaauaguagcggcgaaguguuuuugaccgagcugcgggaagcaacaugguaugaguuacguaugcgcgccugcaacucugcugguugugggaaugagacugcccaguucgcaacccucgauuacgacggauccacgaucccucccaucaaaucagcccaaggcgaaggcgaugacgucaagaagcuguucacaauugggugcccuguaauccuugcuacccugggaguggcguugcucuuuauuguuagaaagaaaagaaaagagaagaggcugaaacggcuacgcgaugccaagagccuggcagaaaugcuuauaucgaaaaacaacagaucuuucgacacuccagugaagggucccccucagggcccaaggcuccacaucgauauuccccggguccagcuguugaucgaggacaaggaggggaucaaacagcugggagaugacaaggcuacaauuccggugaccgaugccgaauuuagucaagcaguuaauccucaguccuucugcacuggcgugagcuuacaucacccaacacucauacagucaaccgguccccugaucgacauguccgacauucgaccugggacgaacccagucucucgcaaaaauguaaagagcgcccauaguacucgaaacagguauuccagccaauggacccuuacaaaaugucaggcuucuacccccgcccggacacugacuucagauuggcguaccguaggaagucagcacggcgugacgguuacagaguccgacagcuacucugcgucguugucacaggauacugacaagggcagaaauagcauggucuccaccgaaagugcaucuagcacauaugaggaacucgccagggcuuacgagcaugccaagcuggaggaacaacuacagcacgcuaaauuugagaucaccgaaugcuucauuuccgauucaaguucugaccagaugacuaccgggacaaacgagaaugcagauagcaugacguccaugucaacuccgagcgaaccuggaaucugucgcuuuaccgccucucccccaaagccucaggacgcugaucgggguaaaaacguggccgugcccauaccacaccgagcaaauaaguccgacuauugcaaccugccccuuuacgcgaaaagugaggccuucuuuagaaaggcugauggcagggagccuuguccagucguuccgccccgcgaagccagcauccggaaucucgcaagaacauaccauacccaagcucgucaccugacuuuggacccugccucgaaguccuuagggcugccacaucccggagcuccugccgcugcgucuacagccacccucccacagaggacgcuggcaaugcccgcuccuccggccggcacugccccacccgcaccuggucccacaccagcugagccucccaccgccccaucagcggcuccgccugcccccagcaccgaaccaccccgggcagggggaccucacacuaaaaugggcggcagucgcgauucccuucuggagaugucuacaagcggggugggacgaucacagaagcagggugccggcgcuuauuccaaaaguuacaccuugguauga

SEQ ID NO: 55502 - RNA, 1182 nt, Artificial Sequence
  derived and/or modified sequence opt3 from DSCC1__Homo_sapiens__NP_076999
augaagagaaccagggacgagguggaugccacacugcagaucgcuaaacucaacgcagccgaacuucugcccgcgguccacugcuugggcuucgggccuggagcuagcggugccgcagccggcgacuuuuguuuacuggagcuagaaccaacucucugccaacagcuggaggaugggcauucccuuguuauucggggagacaaggaugaacaggcugugcuguguucuaaagacaagacguacgauuugaaaauagcagacaccucaaauaugcuccuguucaucccgggcugcaagacacccgaucagcugaagaaagaggacagucacuguaacauuauccauacugagauuuuugguuucagcaauaacuauugggaacuccgccgacguagaccuaaguuaaagaaacugaaaaaguugcuuauggagaauccauacgaagggcccgauucccaaaaggagaaagacucuaacucgucaaaguauaccacagaggaucugcuagaccagauccaggccagcgaagaggaaauaaugacccagcuccaaguacugaaugcuugcaaaaucggaggcuacuggaggauucuugaguuugacuaugaaaugaagcuguugaaccacgugacucagcucgucgauagugaguccuggucuuucggcaaagugccucugaauacauguuuacaggagcuggggccacucgaacccgaggaaaugaucgagcauugccuuaaguguuacgguaaaaaguauguugacgaaggagagguguacuuugagcuggaugccgacaagauuugccgggcggcagcccgcauguugcuacagaacgcugucaaauucaaucuggccgaauuucaagagguguggcagcagagcguaccugaaggcaugguuaccucccucgaucaacugaaggggcuugcacugguggacagacacucaaggccagagaucauauucuugcucaaagucgaugaccugccggaagauaaccaggagcgguuuaauaguuuauucagccugcgcgagaaguggacggaagaggacauugcucccuacauccaggaucuauguggagaaaaacagacuauuggcgcccuccugaccaaguauucucacuccucaaugcaaaacggugugaagguguacaauagccgaagaccuaucaguuga

SEQ ID NO: 55503 - RNA, 357 nt, Artificial Sequence
  derived and/or modified sequence opt3 from DSCR4__Homo_sapiens__NP_005858
augagccugaucauucucaccagagacgaugagcccaggauauucacaccugacuccgaugccgcuucuccagcacuucacucaacgaguccgcugcccgacccugccagcgcguccccauugcaucgggaagagaagaucuuacccaaagugugcaacauugucucuugucugucguuuucacuaccugcuagcccaacugauaguggccucgccucccccaccaucauuacacgcgaagggcagcaauucugggcaaagugccugaucuggaaauaccagcuuuaucugcacggauugcauaagaaaucugacggucgacgugauaagcagauaagcgccuccccuucaacuuga

SEQ ID NO: 55504 - RNA, 2877 nt, Artificial Sequence
  derived and/or modified sequence opt3 from DSE__Homo_sapiens__NP_037484
augagaacccacacaaggggcgcccccagcguguucuuuaucuaccugcucugcuucgucuccgcuuauauuacugacgagaacccugaaguuaugauaccauuuacgaaugcaaacuacgauucucauccgaugcuuuauuucucacgggccgagguggcggaacugcaguugcgcgcugccaguagccacgagcauaucgcagcccgauuaaccgaagcuguacacacaaugcuguccucuccccuagaguaccucccuccaugggaccccaaggauuauucggcacguuggaaugagauuuuugggaacaaucugggagcccuugcuauguucugugugcuguacccugaaaacaucgaggccagagacauggcgaaagauuauauggaaaggauggcagcccaaccaucaugguuggucaaggacgcucccugggaugaggugccucucgcccauagccugguugguuuugcaacugcuuacgacuuccuguacaauuaucucaguaaaacccagcaggagaaguuuuuagaagugauugccaacgcguccggcuacauguaugagacaucuuaccggcgcggguggggauuccaguaucugcacaaucaccaaccaaccaacugcauggcccuuuugacuggcagccugguccuaaugaaucaggguuaccuccaggaagcauaucuguggacaaaacaggugcuuaccaucauggagaagucccugguauugcucagagaaguuacggaugggucacuguacgagggaguggcuuacggcaguuauacuaccaggagcuuauuucaauacauguuccugguccagcggcauuuuaacauaaaucacuucggccauccguggcucaagcagcacuucgccuuuauguaucgcacaauccuucccggguuccagcgaacuguggcuauugccgacucuaacuacaauugguuuuauggaccugagucccaacugguguucuuggauaaauuugucaugagaaacgguucaggcaacuggcuagcagaccagaucaggcggaaucguguuguggaagggccaggaacccccagcaagggccagcgcugguguacacugcacaccgaguuccucugguacgaugguagucugaaaucuguaccuccacccgacuuugggacgccgacucuucauuauuucgaagacuggggaguggucacauacggcuccgcccugccugcugagauuaacagaucguuuuugagcuucaagucuggcaaacucgggggaagggcgaucuacgauauagugcaccggaauaaguauaaggacuggauuaaagguuggcgaaacuuuaaugcaggccaugaacaccccgaucaaaacuccuucaccuuugccccaaaugggguuccuuucaucacugaggcucuguacggacccaaguauacauucuuuaacaauguguuaauguucucaccagccgucaguaaaagcugcuuuucccccugggugggccagguaaccgaggacuguucuagcaaguggucaaaauacaagcaugaucuggcagccaguugccagggucgcguuguggcugccgaagagaaaaacggggucguguucauuagaggcgaaggagucggcgcauauaauccucagcuaaaccucaagaaugugcaaaggaaccugauccuuuugcacccacagcugcuccugcuuguugaccagauccaccugggggaggaauccccguuggagacggcggcuagcuuuuuccauaauguggauguacccuuugaggaaaccgucguggacggaguucacggugccuucauucggcagcgcgauggccucuacaagauguauuggauggacgauacaggguacucugagaaagcaacuuuugccucagugaccuacccuagaggauauccauacaacggcacaaacuaugucaaugugacuaugcaucugaggagucccauaacccgugcugccuacuuauucaucgguccuagcauugacguacaauccuuuacagugcacggggacucucagcagcuggauguuuucaucgcaaccucgaagcacgcuuaugccacuuaccuauggacgggcgaagcgacaggacagagcgccuuugcucaagucauagcagaccggcauaaaauucucuucgaucgaaacuccgccaucaagucaaguaucgugccagaggugaaagacuaugcugccauugucgagcagaaucugcagcacuucaagcccguuuuucagcuuuuggaaaagcaaauccugucuagagugaggaacaccgcgagcuuccgcaaaacugcagagcggcuccugagauuuuccgauaagaggcagaccgaagaggccauugaccgcauauucgcuaucucacagcaacagcagcagcaaagcaaaucuaagaaaaaucgacgggccggcaagcguuacaaguuuguggaugcaguaccggacauuuucgcucagaucgaagucaacgagaaaaagaucagacagaaagcccagauuuuagcacaaaaggagcugccuauagaugaagacgaggaaaugaaagaucuuuuggacuuugccgaugugacauacgagaagcauaagaaugggggacucaucaaagguagguucggccaggcucgcaugguuaccacuacacacucccgggcgccaagucugagcgccucuuauacgagacuauuucugauucucaacaucgcaauuuucuuugugaugcuggcuaugcagcuuaccuacuuccagagggcccaauccuugcaugggcagcgaugucuguaugccgucuuacucaucgacucaugcauacugcuuuggcuguacaguagcuguucgcagucccaaugcuga

SEQ ID NO: 55505 - RNA, 3669 nt, Artificial Sequence
  derived and/or modified sequence opt3 from DSEL__Homo_sapiens__NP_115536
augcccaagggcggggccccuccauggaucauggcucugauguucaccggacaccuccuuuuucuggcauuguuaauguucgccuuuagcacauucgaggaauccgugucuaacuacucagagugggcggucuuuacugacgauauugaccaguucaaaacgcaaaagguucaggauuuuagaccgaaucagaaacugaagaaaaguaugcuacaucccagccucuauuucgacgcuggugaaauacaggccaugaggcaaaagucccgggcaucucaucugcaccuuuuucgcgccauccgaucggcugugaccguaaugcugucaaacccuacauacuauuugccacccccuaagcacgcagauuucgccgcuaaauggaaugagauuuacggcaacaaucucccaccccuggcccuguauugccucuuauguccugaagacaagguggcguuugaguucguccuggaguacauggaucguauggugggguauaaagacuggcuuguugaaaacgcaccaggagaugaggugccgaucggccauagcuugacugguuuugccaccgcuuucgacuuccuguacaaucuacucgauaaccacagaaggcagaaguaccuggaaaagauuugggucaucacagaggagauguaugaauacaguaaggugcgguccugggggaagcagcuucugcacaaucaucaggccaccaacaugauagcauugcucacuggagcucugguaacaggcguugacaaaggcucuaaggccaauaucuggaaacaagcgguggucgaugugauggagaagaccauguuuuuacugaaccacauuguggacgggagccucgacgaaggagucgccuaugguuccuacacggcaaaaucaguuacucaguauguguuccuugcucagcgccauuuuaauaucaacaaucuggauaacaacugguugaagaugcacuucugguuuuacuaugccacccuacugcccggcuuccagagaacaguagggauugcugacaguaauuacaacugguuuuacggaccugagagccaacucguguuccuggauaaauuuauccuuaagaauggcgccgguaacuggcuggcacagcagauaaggaagcaccggccaaaagacgggcccauggucccuucuacugcccaacgcugguccaccuugcauacagaauauauuugguacgauccacagcucacgccccagccgccugcugacuauggaaccgcgaagauccacacuuuccccaauuggggcgugguuacauacggcgcagggcugccaaacacccagacuaauacauuugugucauucaaaagcggaaaguuagguggccgagccgucuaugauauugugcauuuucaaccuuacaguuggaucgacggguggagaucuuucaaccccggacacgagcauccagaucaaaauuccuucaccuuugcucccaacggccagguauucguuagcgaggcccuguaugguccuaaacuaucgcaccucaauaacgugcuggucuuugcaccaucuccguccucacagugcaauaagcccugggaagggcagcuuggcgagugugcccagugguugaaguggacgggagaagaggugggcgacgcugccggggaaaucauuaccgcaagucagcacggagagauggucuucgugagcggugaggcgguuuccgcuuacucuagcgccaugaggcugaaaucaguguaccgggcacuccugcuucugaacagucagacauugcucguagucgaucauauagaacgucaagaggacuccccuaucaauagcgugucugccuuuuuccacaaccuggacauugauuuuaaguauaucccauacaaauucaugaaccgcuauaauggcgcuaugauggacguuugggaugcccauuacaagauguuuugguucgaccaccacgggaacucacccauggcaaguauacaggaagcugagcaggccgcggaauuuaaaaagagauggacucaguucgugaaugucaccuuucaaauggagccuacaauuacuaggaucgccuauguguucuacggaccauauaucaacguaagcuccugccgguucauugauucuucgaaucccggcuuacagaucagccugaacgugaauaacaccgagcauguugucuccauugugacagacuaccacaaucuaaagacccgauuuaacuaccucgguuucgggggcuuugcuucaguggcagaucagggacaaauaacucgcuucggccuggggacgcaggccaucgucaaaccgguuagacaugacaggauuaucuuuccuuucggauuuaaguucaauaucgcugugggucuuauuuuguguauaagucuggugauccucacauuucaguggcgguucuaucugucuuuucgcaaauuaaugagauggauucugauccuuguaauugccuugugguucaucgaacuccuggaugucuggucaaccugcucccagccaauaugugcaaaguggacuaggaccgaggcggaaggcagcaaaaagagccuaucuuccgaggggcaccauauggaccugcccgaugugguuaucacaagucucccuggaagcggcgccgagauucugaagcaacuuuucuuuaacucuuccgacuucuuguacauccgugugcccaccgcuuauauugauaucccagaaacugagcuggaaauagacucauuugucgacgccugcgaguggaaagugagugauauucggagcggucacuuccgauuacucagaggguggcugcagucgcuuguucaggacacaaagcugcacuugcagaauauccaucuccacgaaccuaacaggggcaaacuggcacaauacuuugcuaugaauaaggauaaaaagcgcaaauucaagcggagagagucccuacccgagcagaggucucagaugaagggagccuuugaccgcgaugcagaauauauucgagcccugcggcgucaucucguguacuauccaagcgcuagaccgguacugucacuuaguuccggcucuuggacguugaaacugcacuucuuucaggaggucuuaggggcgagcaugagggcccucuacaucgugcgcgacccucgggcauggauauacuccaugcuguauaacucaaagcccagccuuuacagucugaaaaacgugccagaacaucuagcuaaacucuucaaaaucgagggaggcaaggguaaguguaaucugaacucuggguaugccuuugaauacgagcccuugagaaaagagcuguccaagagcaaaucgaaugccgucucauuacucucucaccuguggcuugcuaacaccgcagccgcgcugaggauuaauacugauuugcucccuacaaguuaucaacugguuaaguucgaagacaucgugcacuuuccacagaaaaccacagagcgaauuuucgcuuuccuaggaaucccccuguccccugccagccuuaaccagauacucuuugcaacuucuaccaaucuguucuacuugccguaugaaggcgagauuagcccaacgaacaccaauguauggaagcaaaaccugccccgcgaugaaaucaaguuaaucgagaauauuugcuggacacucauggaccggcuggguuacccuaaauuuauggauuga

SEQ ID NO: 55506 - RNA, 3150 nt, Artificial Sequence
  derived and/or modified sequence opt3 from DSG1__Homo_sapiens__NP_001933
auggacuggagcuucuuuagaguggucgccaugcuguucaucuuucucguugugguagaggugaacuccgaguucaggauucagguccgggauuacaauaccaagaacggcacaauaaaauggcacucuauccgccgacaaaagcgugaauggauuaaauuugcugcagccugcagagaaggggaggacaauucaaagaggaaccccaucgcgaaaauucauagugauugugcugccaaucaacaggugacuuaucggaucagcggaguugguauagaccagccuccauacggcaucuucgugauuaaccagaagacgggggaaaucaauauuaccuccaucgucgaucgcgaggugacaccguuuuucauaauuuauugcagagcacuuaacucuaugggacaggaccuggagaggcccuuggaauuacggguacgcguucuggauaucaaugacaacccuccaguguuuucgauggccacuuucgcuggccagauugaggaaaauucaaacgcaaauacccuagucaugauccucaacgccacagaugcugacgagcccaauaaccugaacagcaagaucgccuuuaaaauuauacgacaggagccuagugauuccccaauguucaucauuaauagaaacaccggugaaaucaggacuaugaauaacuuucuugaccgggagcaauacgggcaguaugcgcuggcagugcguggaucugaucgcgacggcggcgccgacgggaugagcgcugaaugugagugcaauauaaagauuuuggaugugaacgacaauauccccuacauggaacaguccucauauacaaucgagauucaggagaacacccucaauaguaaccugcuggaaaucagagucauugaucucgacgaggaguucagcgccaauuggauggcaguuauauucuuuaucucuggaaacgaagguaauugguucgaaauugagaugaacgagaggacgaaugugggcaucuuaaaaguagugaagccucuggauuacgaagcuaugcaaucccuucaguugucaaucgggguccggaacaaagccgaguuucaccauagcauuaugagucaguacaagcugaaggcgucugccauauccgugacuguucuaaacgugaucgaaggaccagucuuccgaccgggcagcaaaaccuaugugguaacagguaauauggggucgaacgacaagguuggagauuuuguggcaacugaccucgauaccggccgccccucuacaaccgucagauacgugaugggcaauaacccugcugaccugcuugccgucgauuccaggacggggaaacugacuuugaagaauaaagugacaaaggagcaauauaacaugcucggagguaaauaccagggcaccauucugucaaucgacgacaauuuacagcggacuuguacagggaccauuaacaucaauauacagaguuucggaaacgaugaccgcacgaauaccgaaccaaacacaaagaucacuaccaauacaggcagacaagagagcacuuccucuaccaacuaugauacaagcaccacuucaacggacaguucccagguuuacagcucugagcccgguaauggggcuaaggaucugcucucagacaacgugcacuuuggcccugccggaauuggccuucugaucaugggguucuugguacuaggacuggucccauuucucaugauuugcugugauugcgguggcgcacccaggagugccgcuggguucgaaccggugccugaguguagcgacggagcgauccauuccugggcaguugaaggcccccagccagagccucgugauauaacaaccgugauuccccagaucccacccgacaacgccaauauuaucgagugcauagauaacucuggugucuauacuaaugaauacgggggccgggagaugcaagaccugggaggcggggaacgaaugaccggauuugagcuuacagaaggugugaaaaccucgggcaugccugagaucugucaggaguacagcgggacucugagaaggaacuccaugcgcgaaugccgggagggaggcuugaauaugaacuucauggaaucauauuuuugccagaaggcuuacgccuaugcagaugaggacgaagguagaccaaguaaugacugucuccugauuuacgauaucgaggggguaggcucuccggccggaagcgugggcugcuguuccuucauuggggaggacuuagaugacucauuccuggauacacuaggacccaaauuuaagaaacucgcugacaucagccugggcaaggaaucuuauccugaucuugacccauccuggcccccucagaguacggagccaguuugcuugccccaagaaaccgagccggucgugagcggucacccuccaauaucuccccacuucgggacuacaaccgugauuuccgaaucaacauacccuaguggacccggcguccugcauccaaagccuauccucgauccccuggguuauggcaacguuacugugaccgagagcuacacgaccucggacacacuuaaaccauccgugcacguacaugauaauaggccggccucuaacgucgugguuacugagcgcguggucgggccuaucagcggagcagaccugcacggcauguuggaaaugcccgaucuccgagacgggucaaaugugauuguuaccgagcgggugaucgcgccaaguuccucucugcccacuagcuuaacaauucaccauccucgugaauccucaaacguagucgugaccgagagagugauacagccaacgagcggaaugaucggcagucugucuaugcaccccgagcuagcuaaugcccauaacgucauuguuacagaaagggugguauccggugcaggggugaccggaaucagcggcacuacagguauuucgggcgggaucggaucaucuggccucgucgggaccaguaugggagccggcuccggugcucugagcggggccggaauaucuggcgguggcaucgggcuuagcuccuugggaggcacugcaucaauugggcacaugcgcaguagcucugaccaucacuuuaaucagaccaucggauccgcuucaccuaguacagcccggagcagaauuacgaaguacuccaccgugcaguauucuaaauga

SEQ ID NO: 55507 - RNA, 3357 nt, Artificial Sequence
  derived and/or modified sequence opt3 from DSG2__Homo_sapiens__NP_001934
auggccagaagccccggcagggcuuacgcacugcuccuucuguugaucugcuucaacgugggguccggauuacaucugcagguccuaucuacccggaaugagaacaagcuccugccuaaacacccacaccuuguucgccaaaagcgagccuggauuacagcgccgguggcucugcgugaaggugaggacuugagcaaaaagaaucccauagccaaaauccauagugaucucgcagaagagagaggccugaagauuacuuauaaguacacggggaaaggaaucaccgaaccuccauuuggcauuuucguauuuaacaaggacacaggugagcugaaugugacuagcauccucgauagggaggaaacccccuucuuuuuacugacaggguaugcccuugacgcucggggaaacaaugucgagaaaccuuuggaacugcgcauaaaggugcuagauaucaacgacaaugagccaguuuucacccaggauguguuugucggcuccguggaggaacucucugcagcccacacucugguaaugaaaauuaacgcuacagacgccgaugagcccaauacccuuaacucgaagaucucauacagaauuguuagccuggaaccugcguauccaccgguguucuacuugaauaaggacacgggcgagaucuauacuaccagugucacacucgauagggaagaacauuccucuuacacucugaccguggaggcacgggacgggaacggagaagugacagauaaacccgucaagcaggcccagguucaaauacgcauuuuagacgugaaugacaacaucccuguaguggagaacaaaguccuggaagguaugguggaggaaaaucagguuaacguggaggucacccgaauuaagguguuugaugcugacgagaucggcagcgauaauuggcucgccaacuucacguuugcauccgggaaugaaggaggcuacuuccacaucgagacugacgcucagacaaacgaagguauuguaacccuuauaaaagagguugauuaugaagagaugaagaaucuggacuuuucagugaucgucgccaacaaagcggccuuccacaagaguauuagaagcaaguacaaaccaacucccaucccuauaaaggugaaagucaagaaugugaaagaggggauucauuucaagucuuccguuaucucaaucuaugugagcgaaaguauggauaggucuuccaagggacagauuaucggcaacuuucaagcauucgacgaggauacaggcuugccagcucacgcccgguacguaaaacuagaagaccgugauaauuggauuagcgucgacucggugaccucugagauaaagcuggcuaaacuccccgacuuugagucccgcuauguucagaacgggacguacaccgugaagaucgucgccauuucagaagauuauccgagaaaaacaaucacuggaaccgugcugaucaauguagaggacauuaacgauaauuguccuacacuuauagaacccgugcagacuaucugccaugacgcagaguacguuaacgucaccgccgaagaucuggacggucacccaaacaguggcccuuucagcuuuuccgugauugauaagcccccagggauggcugagaaguggaaaaucgcgaggcaggagucuacaagcguguugcuccaacagucagaaaagaaacugggacggagugagauucaguucuuaaucuccgacaaucaaggcuuuagcugucccgaaaagcagguccugacccuaacuguuugcgagugucuccacgguucugggugccgagaagcacagcaugauucauacgugggccugggaccugccgcuauagcccuuaugaucuuggcauuccugcuccugcuucuggugccauugcuccuguuaaugugucacugcggcaaaggggccaagggauuuacgccgauucccgguacaaucgagaugcugcauccuuggaacaaugagggcgcuccacccgaagacaagguagucccuaguuuccuaccaguggaucaagggggaagccucguuggccgcaacggugucgggggcauggccaaagaggcaaccaugaagggauccucuucggcgagcauugugaaaggccagcacgaaauguccgagauggacgggagaugggaggagcauaggucacugcuuaguggacgggcuacucaguuuaccggugccacaggcgcaaucaugaccacugagacaacgaagaccgcccgcgcuacuggggccucuagagauauggcaggagcucaggccgcggccguggcuuugaaugaagaguuccugaggaacuauuuuacagacaaagcagccagcuacaccgaagaggacgagaaucacacagcuaaggauugucuccugguuuauucccaggaagagacugaaucauuaaacgccagcauaggcugcuguucuuucauugagggugaacuggacgaucguuuccuugacgauuuggggcucaaauuuaagacccuggcagaggugugccuaggccaaaagaucgacauuaauaaagagaucgaacagcggcagaagcccgcgacggagaccuccaugaacacagccagucacagccugugcgaacagacuaugguaaauucugagaacaccuacuccucaggaaguagcuucccggucccuaaaucgcuccaagaagcuaaugccgagaaggugacacaggagauagugacugaacgauccgucucuagcagacaggcacagaaaguugcuaccccacugcccgauccuauggccucaaggaacgugaucgcaacggagacaaguuauguaaccggcuccacuaugcccccaacaaccgugauucuugggccuucucaaccccagagcuugaucgucacugaacgcguguacgccccagcuuccacccugguugaccagccguaugcgaaugagggaacaguggucgugacggaacggguuauucaaccucauggcggugggucaaaccccuuagagggaacccagcaccuccaggaugugccauacgucaugguaagagagagggaaucauuucuggcccccaguucuggcgugcagccuacucuugcaaugccaaacaucgcuguuggucaaaaugugacagucaccgagcgcgugcuggcccccgccuccacauugcagagcucguaccagauaccuacugaaaacucaaugaccgcucgaaauacgacaguaucuggcgcaggggugccgggaccacuccccgacuucggccuggaggagagugggcauuccaacagcaccauuacuaccucuagcacacgggucacuaagcacuccaccguucagcacucauauaguuga

SEQ ID NO: 55508 - RNA, 3000 nt, Artificial Sequence
  derived and/or modified sequence opt3 from DSG3__Homo_sapiens__NP_001935
augaugggccuguuccccagaaccacaggggcccucgcuaucuuuguggucguuauucuugugcacggagagcugaggauagaaacuaagggucaguacgacgaggaagagaugacgaugcaacaggcaaaacggcgccagaagcgagaauggguaaaauucgccaagccuugccgugagggcgaggauaacagcaaaagaaauccaaucgcgaagauuaccuccgacuaucaggcuacacaaaagaucacuuacaggauuucuggggugggaaucgaucagccgcccuuuggcauauucgucguggacaaaaacaccggugauaucaauauuacagccaucguugaccgggaagagaccccuucauuuuugauuacuugucgcgcauuaaacgcccaggggcuggauguggaaaagccacuaauccucacagucaaaauacuggacauuaaugauaaucccccuguguucagucagcaaaucuuuaugggagagauugaggaaaauagcgcuuccaacucucuuguaaugauccugaaugcaaccgacgccgaugagccaaaccauuugaacucgaagaucgcuuucaaaauuguuucacaggaacccgccggcacgccuauguuucuccugagcagaaacacuggcgaggugaggacccugacaaauagucucgaccgggaacaggcguccucuuaucgcuuagucgugagcggggcagauaaggacggagagggucuguccacucagugcgaguguaacauaaaggugaaagacgucaaugauaacuucccaauguuucgagacucacaauacagugccagaaucgaagagaacauucuuagcucugaauugcugagguuccagguuaccgaucuagacgaggaauauacagauaauuggcucgcuguguacuuuuucaccuccggcaacgaggggaauugguucgagauccagacggacccgcggacuaacgaaggaauacugaagguagugaaagcccuugauuaugagcaacugcagucagucaaguugagcauugcagugaaaaauaaggcugaauuucaccagaguguuaucucucguuaccgcgugcaguccacacccgucaccauccaagugauuaacguaagagagggcaucgccuucaggccugcgagcaaaacuuuuacaguucagaaggguauuucgucuaagaaacucguggacuacauacuggggaccuaucaggccaucgaugaagacacgaauaaggcagcuuccaacgucaaauacgugaugggacggaaugauggcggcuauuuaaugauugacucaaagaccgccgagaucaaauucgucaagaacaugaaucgagacaguacauuuaucgugaacaagacuauuaccgcugagguucuggccauagaugaauacacagggaaaacuagcaccggaacaguguauguacgcgucccagacuucaaugauaacugccccaccgcagugcucgagaaggacgccguuuguuccucuagcccuucaguggucgugagugcuagaacucuuaauaacagguacacggguccauauacauuugcgcuggaagaucagcccguaaaauugccggcagugugguccaucaccacucuaaacgccaccagcgcucugcuccgggcccaagagcagauuccucccggcguuuaccauaucucucugguccuuacagacucacagaauaaccgcugcgagaugccaagaagucugaccuuggaagugugucagugcgauaauagggggauuuguggaacuagcuacccuacaacgucccccggcacccguuauggucggccacacucugggcgacucggccccgcagccaucggacuguuacugcuaggccuccugcuuuugcugcucgcuccucugcuucuguugacuugcgacuguggggccggaucgacagguggcgugaccgggggauucauaccagucccggauggcagcgaggguacaauccaucaaugggggauugaaggcgcacaccccgaggacaaggaaaucacuaacauuugcguuccuccagugaccgcgaauggagcugauuuuauggaguccucagaggugugcacgaacaccuacgccagaggcacagcaguagaagggaccaguggaauggagaugacuacaaaacucggugccgcuacugaaucuggcggggccgcaggauucgcuaccggcacggucagcggugccgcguccggguuuggcgccgcuacaggagugggcaucuguucaagcgggcagucuggaaccaugaggacucgccacuccacaggcgguaccaauaaggacuaugcagauggggccauaaguaugaacuuccuggacagcuacuuuucucagaaggcuuucgccugcgcagaggaagacgauggacaggaggcgaaugacuguuuacugauuuaugauaacgagggcgccgacgcuacugguucccccguuggcucaguggggugcuguaguuucaucgccgaugaccuagaugacagcuuucucgauucgcugggaccuaaauucaagaaacuugcagaaauuuccuugggcgucgacggggagggaaaggaagugcaaccacccucuaaagauagcggcuacgguaucgagucaugcgggcauccgauagaaguucagcagaccggauuugugaagugucaaacacugaguggcucccagggugcuucugcccucagcacguccggcucaguacagccugcagucagcaucccagacccccugcagcacgggaauuauuuagugaccgagacuuacagugccucuggaucccuggugcaaccuagcacagcuggcuucgauccccuuuugacccagaacgucauuguuacagagcgggugaucugcccaauuucgucaguaccugggaaucucgcgggacccacucagcugagaggcucucauaccaugcuauguacggaagacccaugcaguaggcugaucuga

SEQ ID NO: 55509 - RNA, 3180 nt, Artificial Sequence
  derived and/or modified sequence opt3 from DSG4__Homo_sapiens__NP_001127925
auggacuggcuguucuuuagaaacaucugccuccuuauuauacugaugguggucauggagguuaauagcgaguucaucguggaaguaaaggaauuugauauugagaacggcaccacaaaauggcagacugugaggcggcaaaagcgcgaauggaucaaauucgccgcugcaugucgagagggggaggacaauuccaagcguaaccccauugccaaaaucagaucugauugcgaaucaaaucagaagauaacguacaggaucaguggagucgguauugaccggccuccauauggcguguuuaccaucaacccgcgcacaggggagauuaauaucacuagcguuguggauagagaaauaacccccuuguucuuaauuuacuguagggcgcugaacucccggggagaggaccuagagcgcccucucgaacugcgagucaaggugauggauaucaaugacaacgcuccaguauuuucucagucgguuuauacagccucaauugaggaaaauagcgaugcaaacacccuuguggucaaacugugcgccacugacgcugaugaggaaaaucacuugaacaguaagaucgcauacaaaaucgugucccaggagcccucuggcgccccuauguucauucucaauagauauacaggugagguguguaccaugagcuccuuucuggacagggaacaacauucaauguacaaccuggucguucgggggagugaucgugacggagcugccgacggccucagcucugagugcgauugucgcauaaagguguuagacguaaacgauaauuucccaacgcuggagaaaacuuccuauucagcgagcaucgaagaaaacugccuuaguucugaguugauuagacugcaggcaaucgaccuagaugaggaaggcaccgacaauuggcucgcccaguaccugauacuuuccgggaacgauggaaauugguuugacauucagacagauccccaaacuaacgaggguauccugaagguggucaagauguuggacuacgaacaggcuccuaauauccagcucagcauuggcgugaaaaaccaggccgauuuccacuauucgguugcaucucaauuucagaugcauccaaccccggugaggauccaggucguggacguacgggaggggcccgcuuuccacccuuccacaauggccuucucaguucgagaaggaauuaagggcaguagccuguuaaauuacgugcuggguaccuauacggcgauagaccucgauacugggaacccagccacagacguccgcuacaucauuggacaugaugcaggcuccuggcuuaaaaucgacucuagaaccggcgagauccaauuuagcagggaguucgauaagaaaucaaaguauauuauaaaugggaucuacacugcugaaauucuggccaucgacgauggaagugguaaaacagcuaccggcacgauuuguaucgaggugcccgacauaaacgauuauugcccuaauaucuuuccagaacggcgcaccauuuguaucgacucccccagcgucuugauuucugugaacgagcacucauacgggaguccguucacauuuugcguuguggaugagccucccggaaucgccgacaugugggauguaagaagcacuaaugcaaccuccgccauacuaacagcuaagcagguccugucuccaggcuucuacgaaauuccuauccucgugaaggacucguauaacagggcgugcgagcuggcacagaugguucagcuuuacgccugugacugcgaugacaaccacaugugucuggauagcggugcugccgggauuuauacugaagacaucaccggcgauacauacggacccgugaccgaggaccaagcaggcgucuccaaugugggguugggaccagccgguauaggcaugaugguacucgggauccuguuacugauucuagcuccccuccugcuuuugcugugcuguugcaaacagcgucagccugaaggacucggcacucgguuugccccagugccggaggguggggagggcguuaugcagucauggcgaaucgaaggagcacaucccgaggauagacuguucagugcguaugcacuuccuggcgggggagguacggccgacggcgggggaucuguccuggguaggugugcauugcaagccacaccagcucuccugaaccagcaucccccuuuuagcgaaauuuacaccaauacuuaugccgcuggcgggaccguggagggcggaguguccggcgucgaauuaaacacagggaugggaaccgcuguuggccugauggccgcgggugccgcuggggcaucaggagccgcucgcaagcggagcucuacuaugggcacacuaagagauuacgccgacgcagauaucaauauggcguuccucgacuccuacuuuagugagaaagccuaugcuuacgccgaugaggacgaagguaggccagcaaacgacugccugcuuauauaugaucacgagggcguggggagccccgugggaucuauuggcuguugcuccuggaucguagacgauuuggacgaaucauguauggagacgcuggauccgaaguuccgcacccucgcugaaaucugccugaauacugagauugagccuuuuccaagucaccaggccugcauccccauuagcacagacuuaccucugcuugggcccaacuacuucgucaaugaaucguccggauugaccccaucugagguggaguuccaggaagagauggcagccagcgaaccuguugugcacggcgauauaaucgucacagagacuuaugguaacgcugaccccugugugcaaccaaccacgauuaucuuugauccgcagcucgcgccuaauguugugguaaccgaagccgucauggcacccguguacgacauucaggggaacaucugcgugccagcugagcuggccgauuauaauaacgucauauacgccgaacgaguucuagcuucacccggagugccugacaugaguaauuccucuacaacugagggcuguauggguccaguaaugagcggcaacauccugguggggcccgagauucaggucaugcaaaugauguccccugaccucccgaucggacagaccgugggcucaacaagcccaaugaccagucggcaucguguuacuagauacucuaacauucacuauacgcagcaauga

SEQ ID NO: 55510 - RNA, 6819 nt, Artificial Sequence
  derived and/or modified sequence opt3 from DSP__Homo_sapiens__NP_001008844
augagcugcaacggagggucccaccccagaaucaauacccugggaaggaugauucgggccgaaucugguccugaccuccgcuacgaagugacuucaggcgggggaggcacaagucgaauguauuacagccguagaggugucaucacggaucagaacuccgacggguauugucaaaccggaacaaugucuaggcaucagaaucagaacacuauccaggagcuucugcaaaauugcucggauuguuugaugcgggcugaauuaauuguucagccagaacugaaguacggcgacggcauccagcuaacccgcucaagagaacucgaugagugcuucgcacaggccaacgaccaaauggagauucuggauagccuuaucagggaaaugcggcagauggggcagccgugugacgcguaucagaaacgccuguugcaacuccaggagcagaugcgagcucuguacaaggccauaagugugcccagaguuaggcgggcauccucuaaaggagguggcggguauacaugccaaagcggauccggcugggaugaauuuaccaagcacgugacuucagagugucuggguuggaugcgucagcagcgcgccgagauggacauggucgcuuggggaguggaucucgcaaguguugaacagcauaucaauagccacagagggauucacaacucuaucggcgacuacagguggcaauuagauaaaauuaaggccgaccugcgggagaaguccgcuaucuaccagcuugaagaggaauaugagaauuugcugaaagccucauucgagcgaauggaccaccuacgccagcuccagaacauaauucaagcgacaagcagagaaaucauguggauuaaugauugcgaggaagaggaacugcuuuacgacuggagugauaagaacaccaauaucgcacagaaacaggaggccuuuucuaucaggaugucccagcuggaggugaaggaaaaagaguugaacaagcucaagcaagaaagcgaccagcuggucuuaaaucagcacccugcuucggauaaaauugaggccuauauggacacgcugcagacucaauggucuuggauacuccagaucaccaaguguauugaugugcaucuuaaagaaaacgcagcuuacuuccaguuuuucgaggaggcccaauccacagaagcguaucugaagggcuugcaggacucaauccggaaaaaguacccaugcgauaaaaacaugccccuacagcaucugcucgagcagauaaaggaacuggagaaggagcgcgagaagauucuugaguauaagagacaaguacagaaucugguuaacaaaaguaagaaaaucgugcaguugaagccuaggaauccagacuaccguagcaacaagcccaucauucuccgggcccugugugauuacaaacaggaccaaaagaucguccauaaaggggacgaaugcauuuuaaaggauaauaacgagcgauccaaaugguaugugacuggaccugguggcguggacaugcuggucccaucuguugggcuaauaaucccgcccccuaauccacucgcaguggaucugagcugcaagauugaacaguacuaugaggcuauccuugccuuguggaaccagcuguacaucaauaugaagucacucguaaguuggcacuauuguaugauugacauagagaaaaucagagcuaugaccauugccaagcugaaaacaaugaggcaggaagauuacaugaagaccaucgcagaccuugagcugcacuaucaagaauuuauucgcaacucccagggaagcgagauguucggcgaugacgauaaacggaagauccagucucaauuuacggacgcccagaagcauuaccagacuuuggugauacagcuccccgguuacccucaacaccagacagucaccacuacagaaaucacccaucacgggacgugccaggaugugaaucauaacaaaguuauugagaccaauagagagaacgacaagcaggaaacauggaugcugauggaguuacagaaaauaaggcgccaaauugaacacugugagggccgaaugacucugaagaaucuaccacucgcugaucagggaucaagucaccauaucaccgugaaaauaaacgaacugaaaagcguccagaacgacucccaagcgauugcagaggugcuuaaucaguugaaagacaugcuggccaacuuccggggcucugagaaguauugcuaccuccagaaugaaguauuugggcuguuccagaaguuagagaacaucaauggaguuacagaugguuaucugaacucgcuuuguacugugcgugcuuugcuccaagccauucugcagaccgaagacaugcuaaaagucuacgaggcaagacugacagaggaagagaccgugugccucgaucuggacaaggucgaagccuauagguguggccuuaaaaagaucaaaaaugauuugaaccugaaaaagagcuuacucgcuacuaugaaaacggagcugcagaaggcccaacagauacacucccagacaucacagcaauacccccuuuaugaccuggauuuggggaaauuuggagaaaaggugacccagcucacugaccgcuggcagcggaucgauaaacagauugacuucagacugugggaucuagagaagcaaaucaagcagcugaggaauuaccgagacaacuaccaggcauucugcaaauggcucuaugaugcgaagcgccggcaggacagucuggagucuaugaaauuuggcgacagcaauaccguuaugagauuccuuaacgaacaaaagaauuugcauuccgagauuucagguaaaagggauaagagcgaagaggugcagaagaucgcugaacugugugccaacucuauaaaagacuacgaguuacagcucgcauccuauacaagugggcuggagacccuucugaauauuccgaucaagcguacuaugauccaaagcccuucuggcguaauucuacaggaagccgcugauguccacgcccgcuacaucgagcuccugacacgguccggagacuauuacagauuuuugucagaaaugcugaaaaguuuagaggaucucaagcugaaaaacacgaagauugaagugcuugaggaggaacugagguuggcacgagacgcuaacagcgagaauugcaacaaaaauaaguuccucgaucagaaccugcagaaguaucaagccgaauguucgcaguuuaaagcgaagcuagccucccuggaggagcuuaaacggcaggcugaacucgacggcaagucugcaaaacagaaucuggauaagugcuacgggcaaauaaaggaguugaacgagaagaucacccgccugacuuacgagauugaagacgagaagagaaggcggaaaagcguugaggaucgauucgaccagcagaagaaugacuaugaucaguuacaaaaagccagacagugcgaaaaggagaaccucggauggcagaagcuggaaucagagaaagcuaucaaggaaaaagaguacgagauugaacgccuuagggugcuguugcaggaggaagguacacguaagcgggaguaugaaaaugagcucgccaaagcaaguaacagaauccaagaguccaagaaucaguguacccaggucgugcaagaaagggagucucugcuaguaaagauaaaagugcuggaacaggacaaggcgcgccuucagcgacucgaggaugagcugaacagagccaaaagcacauuggaagcugagacucggguuaagcagagguuagaaugcgagaaacaacagauccagaaugaccugaaccaguggaagacccaauacucccgcaaggaagaggccauucguaaaaucgagucagaaagagaaaagagcgaacgggagaaaaauagucucaggucugaaauugagcgccugcaggcagagaucaagcgaauagaagagagaugucggaggaaacuugaagauuccacgcgcgagacccagagccagcuggaaacagagagaucgagguaucaacgggagauugacaaguugcgucagcgccccuacggcucacaccgagaaacucagaccgagugcgaauggacagucgauacuucuaagcuaguguuugacgggcugagaaagaaggugaccgcuaugcaacucuaugagugucagcugaucgauaaaacgacacuugacaaguuacugaaaggaaagaaaagugucgaggaaguugccuccgagauccagccauuccucaggggcgcagguagcauugccggggcuucugcgagcccuaaggaaaaguacuccuugguggaggccaaacggaagaaacugauaucacccgaaaguaccgugaugcuccuggaggcacaggcugccacuggcggaaucauugauccacaucgcaacgagaaacuuacaguagacagcgccaucgcuagagaucugauugacuuugacgauaggcaacagaucuacgcagccgaaaaagcgauaaccggcuucgacgaucccuuuucugggaagacugucuccgugucagaggcuaucaagaaaaacuugauugaccgggaaaccggaaugcgacuacuggaggcccagaucgcaaguggcgguguuguggauccugucaauagcguguuccucccaaaggacguugccuuagcuagagggcugauugaucgcgaccuuuauaggucccugaacgauccgcgggacucucagaaaaauuuuguggaucccguaacaaagaaaaaggucucguacgugcaacucaaggaacguugcagaaucgagccucacacgggauugcugcuccugagcgugcagaaaaggucaauguccuuccagggcauacgccagccagucaccguuacugagcuuguggacagugguauucuacggcccucuacaguaaacgaacuggagagcggccaaaucuccuaugaugaagugggggagcgaaucaaggacuucuugcagggaucaucuuguauugcaggcaucuacaaugaaaccacaaaacagaaguuagggauauaugaggccaugaaaauuggacuggucagaccuggcacugcgcucgagcugcuugaagcucaagccgcaaccgguuuuaucguggacccaguuagcaaccugaggcuccccguggaggaagccuacaagcgcggguuggucggaauugaguucaaagagaagcugcuaagugcugaacgggccgugacgggcuauaaugauccggagacagguaacaucauaucccuguuucaggcaaugaauaaggaacucauugagaaaggccaugggaucagacuucuggaagcucagaucgccaccggaggcauuaucgacccuaaggagagccaccguuuaccaguugauauugcguacaaaaggggguacuucaacgaggaauugucugagauacugucagaccccuccgaugacacuaagggauuuuucgauccuaauaccgaagagaaccucacauaucugcagcuuaaagaacggugcaucaaggacgaggagacuggccugugucucuugccccugaaggagaaaaagaaacaagugcagaccagucagaagaauacauuacgcaaacgaagagucguaauuguggauccagagacgaacaaggaaaugagcguucaggaggccuacaagaaaggucuaaucgacuaugaaaccuuuaaggagcugugcgagcaagaaugugagugggaagagaucacuauuacagggucggauggaucuaccagggugguccucguggaccggaaaacuggcucccaguacgacauacaggaugcaaucgacaagggucuuguagaucgcaaauucuuugaccaguauagaagcggcucacugaguuugacacaauucgcugauaugauuucucugaagaauggggugggaaccuccagcucaaugggcaguggggucagcgacgauguauuuuccucuagcaggcaugaguccgugucaaagaucucuacgauuaguucggugcgaaaccucacuauccggagcuccucuuucucagacacccuggaagagagcuccccuauagccgcuaucuuugauacagaaaaucuugagaaaauuaguaucaccgaaggaauugagcguggcaucgucgacucuauaacuggucagagacuccuggaggcacaggccugcacagggggaauuauccaccccaccacaggccagaaguugagccugcaagaugccgugucacagggcguuauugaccaggauauggcuacucgcuuaaaaccagcgcaaaaggcauucaucggguucgaaggaguaaaagguaagaaaaagauguccgccgcugaggccgugaaggaaaaauggcuaccguacgaggcaggccagagguuucuggaguuccaguaucucaccgggggacuugucgacccugaagugcacggccggauaaguacggaggaagccaucagaaaggguuuuauugacgggcgcgcugcgcagaggcugcaagauacaagcucuuacgccaaaaucuugaccugccccaagacuaaacugaagauuuccuacaaggacgcaaucaaccgaucaaugguugaggauauaaccggacuccggcugcuugaagcugccagcgugucgucuaaaggcuuaccaagucccuauaacauguccagcgcaccuggcucaagauccgggucuaggagcggaagucgcuccgguagccguucuggcucacggaguggguccagaaggggcagcuucgacgccacaggcaauucuucguacucauauagcuacuccuuuaguucuagcuccauuggucauuga

SEQ ID NO: 55511 - RNA, 3906 nt, Artificial Sequence
  derived and/or modified sequence opt3 from DSPP__Homo_sapiens__NP_055023
augaagaucauuaccuacuucugcauaugggccguggcuugggcaaucccggucccucagagcaaaccacuggagagacacguugaaaaguccaugaaccuccaucuucuggccaggucuaaugugucaguacaagacgaguugaacgcgaguggcacaauuaaagaaagcgggguguuaguccacgagggagaucggggucgccaggaaaauacucaggacggccauaagggggagggaaacggcuccaaaugggcugaggugggugggaagucuuuuucgacguauucaacccuggccaaugaagagggaaacaucgaaggcuggaauggcgauacagggaaggcagagacuuacggacacgacgguauucauggcaaagaggaaaacaucaccgccaaugggauacagggacaaguuagcaucauugauaacgcuggcgcaacaaaucgaaguaacaccaaugguaacacugacaagaauacacagaacggggaugugggagacgccggccacaacgaggaugucgcugugguacaggaagacggcccgcagguugccggguccaauaacucuaccgauaaugaggacgaaaucauugagaacagcugucguaaugagggaaacacguccgaaaucacuccccaaauaaauucaaaaagaaacgguaccaaggaggcggaagugacaccuggcacuggggaggaugcaggacuagacaauagugacggcagcccaucugguaacggggccgaugaagacgaggaugagggcuccggagacgaugaagacgaggaagcuggcaaugggaaagauucaagcaacaauaguaagggacaggagggucaggaccacggcaaggaagaugaccaugauucuuccauugggcagaacagcgacucgaaagaguauuacgaccccgagggaaaggaagauccucacaaugaggucgacggcgauaaaaccucuaaguccgaagagaacucagccgguaucccagaggacaacgggagucaaaggauugaagauacacagaaacucaaucaucgggagagcaagcgcguggaaaacagaaucaccaaagaguccgaaacgcacgcagugggcaagucucaggacaagggaaucgagauuaaaggccccagcucagggaauaggaacauaacuaaggaggucggaaaagguaaugaaggcaaggaggauaaagggcaacacggaaugauccugggcaaggguaacguuaagacacagggggaagugguaaauauugagggcccuggacagaaaagugaaccaggcaacaagguggggcauuccaauaccggaagcgacucuaacucagauggcuaugacaguuacgauuucgacgauaaaagcaugcagggugacgaccccaauuccucugaugagucgaacgggaaugacgaugcuaacagcgaguccgacaauaacucaaguucucggggagaugccagcuauaacuccgacgaaucaaaggauaauggcaacgguagcgacucuaaaggcgcggaggaugacgauuccgacaguacuagcgauacaaauaacucugacuccaaugggaacggaaauaacggcaaugacgauaacgacaagucagauagugggaagggaaaaagcgacucguccgauucugacagcucagauaguuccaauucuagcgacuccucagauagcagugacucugauuccagcgacucgaacucaucuagugacuccgauagcucugacagcgauuccucagacaguagcgauucugacuccucagauaguagcaauuccucugacucgagcgauucauccgacaguucugauagcuccgacucaucugauagcagugacuccaagagcgacucuucaaaauccgaaagugauagcucggacucugauuccaagagcgacucaagugauucuaacuccagcgacucaagugauaauagcgacuccucugauagcuccaacucaucuaacaguucggacagcuccgauucuucagacagcuccgauaguucuagcucauccgacaguagcaauucuuccgacucaagcgauucgucugacaguuccaacagcucagaguccucugauagcagugacuccagcgauucugacucaagugauuccagcgacucuucaaauucgaacagcuccgauagugacucuagcaauuccucagauaguucugacagcuccaacucaagcgacucuuccgauaguagcgacucguccaauucuucagauagcagugacuccucugauagcucaaacuccagugacagcucugauucauccgacagcucugauaguucggacuccagcaauucaucugauagcaacgacuccaguaauucaucugauagcuccgacaguagcaacuccucugacucaagcaauucguccgauaguucugacagcucagauuccucugacagugauagcuccaacucaagcgacucuaguaauuccagcgauucaucugacuccucgaacagcagugauucuuccgacagcucagauaguuccgacggcagcgacucugauucaagcaaucgcuccgacucuaguaacucgagcgauuccucagacucuagcgauaguuccaacucaucugacagcuccgauaguagcgacucuaaugaaucauccaacagcagugauucuuccgacucgagcaauucauccgauucugacaguagcgauucauccaacagcucugacaguuccgacagcucaaauucuucggauagcuccgagaguucuaacucaagcgacaauuccaacaguucugauagcuccaauucaagcgacucuuccgauaguucagacagcucgaacuccucugauaguagcaauucauccgacucuagcaacaguuccgauagcucugacucaaauuccagcgauaguucugacucauccaacagcucggauucuagugacuccagcgacucaucugauagcuccgacaguucagauagcuccaauucuagugacagcuccgauucaucugacucgagcgauuccaguaacucuagcgacucauccaacagcucugauaguuccaauucaagcgacucuucggauuccagugacagcucagacucuuccgauagcagugacucauccgauagcucugacaguagcaacuccucugauucaagcgacuccucggauucuagugacagcucagauuccucugacagcuccgauaguucagacagcucugaguccagugauagcucagacucuuccaauucgagcgacaguuccgauucuucagacagcuccgauucuagcgacaguucagauuccagcgacucuagugauuccagcgacucaucgaacucuagcgauuccagugacucaucugauagcuccgacaguagcgauucuuccaauucaagcgacucguccgacucuagugaaucaagcgauuccucugacagcagugauucauccgacagcucugauuccagugacagcucagauucuuccgacagcucggauaguucuaacucauccgacagcucugauagcuccgacaguucagacagcuccgauucuagugacucaagcgauuccucugacucgagcgauuccagugacucaucugauagcuccgacaguucugauagcucagacuccagcgauucuucagacaguuccgauagcaaugagucgucugacuccagcgacucaagugauucuuccgacagcucaaacaguuccgauagcucugacucgagcgauuccucagacucuaccagugauagcaaugacgaauccgauucucaaucaaaaagcgguaacgggaauaacaauggaagugacuccgauucugacagcgagggcuccgauucaaaccacaguacgagcgacgacuga

SEQ ID NO: 55512 - RNA, 7950 nt, Artificial Sequence
  derived and/or modified sequence opt3 from DST__Homo_sapiens__NP_001714
augcacagcuccucuuacucauaucggaguagcgacuccguguucucuaacaccacuucgacuagaacgucacuggauagcaaugagaaccuccuucugguccauugcggacccaccuugaucaauaguuguauuuccuuugggucugagagcuucgacggacaccgguuagagaugcugcagcagauagccaaccgcguucagcgagauuccgugaucugcgaagacaaguuaauucucgcugguaaugcacugcagucagauaguaaacgucuugagagcggcguacaguuucaaaacgaagccgagaucgcgggguacauucuggagugugaaaauuugcucagacagcaugugaucgacguccagauacugaucgauggaaaguauuaccaggcugaccaacuggugcagaggguugccaaacuccgggaugagauuauggcauuacgcaacgaauguucuuccguguauucaaagggcagaauccugacaacugagcagaccaaacuuaugauuagcgguaucacacagagucuaaauucuggguucgcccaaacccugcacccuuccuugacuagcggacucacacagucgcugaccccaucucuuacguccucaaguaugacuagcggccuguccucuggcaugaccagcagguugacaccgucagucacucccgcuuacaccccuggguuuccaaguggacucgugcccaacuucuccagcgguguagagccuaauucucugcagacauuaaagcugaugcaaauacggaagccacuccuuaaaucaagucuguuggaccagaaccuaaccgaagaggaaauuaauaugaaguuuguucaggaucugcucaacuggguggacgagaugcagguccaacuggaucgcacggaauggggcagcgaccuucccuccguggagucucaucuggagaaucacaaaaacgugcaccgagcaaucgaagaguucgaaucgagcuugaaggaggccaaaauuuccgaaauccagaugacugcuccucucaagcugacauaugccgagaaguuacauagacuggagucacaguacgcgaaacuacucaacaccaguaggaaucaggaacggcaccuggacacucuucauaacuuugucucucgugcaacaaaugaguugaucuggcugaacgaaaaggaggaagaggagguugccuacgauuggagcgaacgcaauaccaacauugcuaggaagaaggacuaucacgccgagcucaugagggaacuggaucaaaaagaggagaauauaaaguccgugcaggaaaucgcagagcagcuucuguuggaaaaccacccagcucggcucacgauugaggccuaccgagcggccaugcagacccaauggucauggauccugcaguuaugccagugcguagaacagcauauaaaagagaauacagcauauuucgaguuuuucaacgacgcuaaggaagccacugauuaccugcgcaaucuaaaggacgcuauucaaagaaaauauagcugugauaggucuuccaguauccacaagcucgaggaccuggugcaggaaagcauggaggaaaaagaggagcuuuugcaguacaagucuaccaucgccaaccugauggggaaagcaaagacaauuauccaacucaagccgagaaauuccgauugcccccugaaaacuucaauuccuauaaaggccaucugugacuaucgccagauugaaaucaccaucuacaaagaugacgagugcgucuuagcuaacaauagucauagagcgaaguggaaagugauuagcccaacaggaaacgaagcaaugguucccucgguguguuuuaccgucccuccacccaacaaggaggccguggaccuggcuaauaggauagaacagcaguaccaaaacguacuuacuuuguggcacgagucccauaucaauaugaagucuguugugagcuggcacuaucucauuaacgagaucgaucguauucgggccucaaaugucgcaaguaucaaaacgaugcugccgggcgaacaccaacaggugcuauccaaccugcagucucgauucgaggacuuccucgaagauagccaagagucccaggucuuuucagguagcgacauaacacagcuggagaaggaagugaauguuugcaaacaguacuaucaagagcuuuugaagagugccgaaagagaggaacaggaggagucuguguacaaccuguauaucuccgaaguaaggaauauucgcuuacggcucgagaacugcgaagauagacugaucaggcagauucgcaccccucuugagcgagacgaucugcaugaaagcgucuuccggaucacugagcaagagaaauugaagaaggaacucgagcgucugaaagacgaucuagggaccauaacaaauaagugugaagaguuuuucucgcaggcugccgcaucaucuagugugcccacccugagauccgaacucaacguugugcugcagaauaugaaccaggucuacagcaugucuagcacuuauauugacaaacuuaagacagugaauuugguacugaaaaacacgcaagcggcugaggccuuagugaagcucuacgagaccaaacugugcgaagaggaagcaguuaucgccgauaagaacaauauugagaaccuuaucuccacucugaagcaguggaggucagaggucgacgaaaaacgccagguguuucacgcucuagaggaugaacuccagaaggccaaagcaauaagugacgagauguucaagacauacaaagaacgggaccuggauuuugacuggcauaaggagaaggcugaucaauugguggagagauggcagaauguccacguucagaucgacaacaggcugcgagauuuagaaggaauuggcaaaagccucaaguauuaccgcgacaccuaucacccacuggaugacuggauccagcaaguggagacaacucagcggaaaauucaggaaaaucagccugagaacucuaagacccuugccacgcaacugaaucagcagaaaauguugguguccgaaaucgagaugaagcaaucaaagauggaugagugucagaaauacgcggaacaguauagugccaccguaaaggacuacgagcuccagacaaugacuuauagagcuauggucgauagccaacagaaaucccccgugaagaggcgucgcaugcagucuucggcagaccugauaauucaggaguucauggaucuacggaccagauacacagcccugguuacucuuaugacccaauacaucaaauuugcuggcgacagccucaagaggcuggaggaagaggagaucaagcgaugcaaagaaacgucagagcauggggccuauuccgacuugcugcagcggcagaaggcaacaguguuagaaaacaguaaacucaccggaaagauuucugagcuggagcgcauggucgcggaacuuaaaaagcagaaaagcagaguggaggaggaacugccaaagguuagggaagccgcugagaaugaguugcggaagcaacagcgaaacguggaagauaucucccuccagaaaauuagagccgagucagaagcaaagcaauaccgcagggagcuggaaacuauaguacgugagaaagaggcugccgaacgggagcuagaaagagucaggcagcugacaaucgaggcagaagccaagcgcgcugcgguggaggagaaucuucucaacuuccgaaaucagcuggaagagaacaccuuuacuagacggaccuuggaagaccacuuaaaaaggaaggaucugucucucaaugaccuggagcagcaaaagaacaaacuuauggaggaacugcgccguaagagagauaacgaggaagaguugcuaaaacugauuaagcagauggaaaaagaccucgccuuccagaaacagguggcagagaagcaacugaaagagaagcagaaaaucgaacuugaggcucggaggaagauuacagaaauccaguauacgugucgcgagaaugccuuacccgucugcccuauaacccaggccacuagcugucgagcuguuacaggucugcaacaggaacaugauaaacagaaggcagaggagcucaagcagcaaguggacgaauugaccgccgcgaacagaaaagcugagcaggauaugcgggaacugacauacgagcucaaugcccugcagcuugaaaagacaaguuccgaggagaaagcaaggcuguugaaggacaaacuagaugaaaccaacaauacgcugcgcugccucaaguuagagcuggaaagaaaggaccaagccgagaaaggcuauagccagcagcuuagggagcuggggcggcagcucaaccaaacaaccggaaaggcugaagaggcaaugcaggaagccucugacuugaaaaagaucaaacguaauuaccagcuggagcucgaaucacugaaccacgagaagggcaaacuucagcgcgagguagaucgaauuacuagagcgcaugcuguggccgaaaagaauauccaacaccuaaacucccagauucacaguuuuagggacgagaaggaacuggagcgguugcagaucugucagcgcaaaagcgaucauuuaaaggaacaauucgagaaaucgcacgagcagcugcuccagaauauaaaggcagaaaaagagaacaaugacaagauucaaagacugaacgaagaacuugaaaagucuaaugagugcgccgagaugcugaaacagaaggucgaagaacucaccaggcagaacaaugaaacaaaauugaugaugcagcggauccaagcugaguccgagaacaucgugcuggaaaagcagacuauucagcagcgaugugaggcccuaaaaauacaagcagaugguuucaaggaccagcugagaagcaccaacgaacaucuccacaagcagacaaaaacggagcaggauuuucaacgcaagaucaaaugccuugaagaggaccuggcuaagucacagaauuuaguuagugaguucaaacagaagugcgaucaacagaacauuaucauucagaauaccaagaaagaagugaggaacuugaaugccgagcugaacgcgucuaaggaagagaaacggcguggggaacagaagguccaacuccagcaggcccaggugcaagagcugaauaacagacuuaaaaagguucaggacgagcugcaucucaaaacuaucgaagaacagaugacacacaggaagaugguguuguuucaggaagaguccggcaaguucaaacaaagcgcagaagaguuucgcaagaaaauggagaagcugauggaaucaaaagucauaaccgagaaugauaucaguggcauucgguuagacuucguaagccuacagcaggaaaacucccgagcucaggagaaugccaagcugugugagacuaacaucaaggaacucgagagacaacuucagcaguauagggaacaaaugcagcagggccagcacauggaggcuaaucauuaccaaaaaugccagaagcuggaagaugaguugauugcacagaaacgcgagguggaaaaccugaagcagaaaauggaccaacagaucaaggagcacgaacaucagcucguucugcuucagugugagauacaaaagaaaucuacagccaaggacugcaccuuuaaaccagauuucgaaaugacggugaaggagugucagcacagcggggagcucuccucacggaauacuggacaucugcacccgacccccagaucuccuuugcugcguuggacacaggaaccacaacccuuagaggaaaaauggcagcacagggucguggagcagauuccuaaggaaguacaguuucaaccacccggugccccgcuagagaaggagaaaagucagcagugcuacucggaauauuucagccagaccuccacugagcugcaaaucacauuugacgaaaccaacccuaucacacggcucucugagauugagaagauccgcgaucaggcucuuaacaauucacgaccacccgugagauaccaggacaacgcgugugaaauggagcuggucaaaguuuugacuccucuggaaauagcaaagaauaaacaguaugauaugcauaccgaggugacgacacucaagcaagagaaaaaccccgugccaagcgccgaagaguggaugcuggaaggcugcagggcuuccgggggacuuaagaagggcgacuuccuaaagaagggucuggagccugaaaccuuucagaauuucgauggggaccacgccuguaguguccgggaugacgaguucaaauuucagggccuccgccauacugugaccgcaagacaguugguugaagccaagcugcuagauaugaggacaauugagcaacugcgacucggacuuaaaacuguagaggaagugcagaagacccugaacaaguucuugacgaaagcuacaucuaucgcgggccuguaccucgagagcaccaaggagaaaauuucauuugccuccgcagcugagcggaucauaauugacaagauggucgcccuggcauucuuagaagcccaggcugccacuggguuuaucaucgaucccauuaguggacaaacauauagcguggaggacgcgguucuuaaagguguggucgacccagaguuccguaucagacugcucgaagcagagaaggccgcugugggcuacucuuauuccucaaagacccuaagcguauuucaggccauggaaaaucgcaugcuggauaggcagaaagggaagcacauuuuggaggcucagauagcaucgggaggcgucaucgacccggugcgggguauuagaguuccucccgagaucgcccugcaacaggggcuccuuaacaaugcuauccugcaguucuugcacgaaccaucuaguaacacucgcguguuucccaauccuaacaauaaacaggcccuguacuacuccgagcucuuaaggaugugcgucuucgauguggaaagccaauguuuucuguucccauucggcgagcgaaacauuucaaaucuuaacguuaagaaaacacaucggauauccguggucgacaccaagacgggaucugaacugacuguguaugaggcauuucagagaaaccuaaucgaaaagagcauuuaccucgaacugaguggccagcaguaucaauggaaagaggcgauguucuuugaauccuacgggcacagcucucauauguugaccgauacaaagaccggacugcacuucaauaucaacgaggccauugaacagggcacaaucgacaaagcucucguaaagaaauaucaggagggucuuauaacucugaccgaguuagccgauucacuguugaguaggcucgugcccaagaaggaccugcacuccccuguugcaggguacuggcuaacggcuagcggagaacgcaucucuguccuuaaagccucgcgucggaaucugguggauagaauuacagcacucaggugccuggaggcccaagugucaacuggcgguaucauugacccguugaccggcaagaaauaucgcgucgcugaagcgcugcaucgagggcucguagaugagggauuugcccagcagcuucggcagugcgaacuggugaucacaggcauagggcacccaauuaccaacaagaugaugagcguuguggaggcagucaaugcuaacaucauuaauaaagagaugggaaucagauguuuagaguuccaauaccugacuggcgguuugauagagccccaggugcauuccaggcucaguaucgaagaggcccugcagguugggauuaucgacgugcuaauugccaccaaacuuaaagaccagaagucuuacguccgcaacaucauaugcccucaaacaaagagaaaacugacguauaaggaggcacucgaaaaagcugauuuugacuuccacacuggacugaaguuguuagaggugagcgaaccacugaugaccggcauuuccucacucuacuauaguucuuga

SEQ ID NO: 55513 - RNA, 498 nt, Artificial Sequence
  derived and/or modified sequence opt3 from DSTN__Homo_sapiens__XP_011527445
auggccagcggcgugcaggucgcugacgagguuugcagaaucuucuacgauaugaaggugaggaaauguuccacccccgaagagauuaagaaacggaagaaagcaguaauauuuugccugucugccgacaagaaguguaucauuguggaagaggggaaagaaauccucgucggagauguggguguuacaauuacugacccuuucaagcacuuugugggcaugcuuccagagaaagauugccgcuaugcgcuguacgacgcuucauucgagacgaaggaaagucgaaaagaggaauugauguuuuucuuaugggccccggagcuggcaccccuaaagagcaagaugaucuaugccuccucuaaagaugcuauaaagaaaaaguuucaagggaucaaacaugagugucaggcaaacggaccugaagaccucaaucgugccugcauugcugagaagcugggcgguucgcuuaucgucgccuucgaaggguguccaguguga

SEQ ID NO: 55514 - RNA, 2790 nt, Artificial Sequence
  derived and/or modified sequence opt3 from DSTYK__Homo_sapiens__NP_056190
auggagggcgacggggugcccuggggaagcgaaccugucuccgguccaggcccgggaggaggcgguaugaucagagagcugugcaggggguucggacgguaccgccgauaucucggccgucuuagacagaaccugagggaaacccaaaaguuuuuccgggauauuaaauguucucacaaucauacaugcuugucaaguuuaacuggcgggggaggugccgagcgcggccccgcuggggacguugcagaaacgggacugcaggccggccagcuaagcuguauauccuuuccuccaaaggaggagaaauaccuccagcaaaucguggauugccugcccuguauucuuauccugggucaggacugcaacguaaagugucaguugcucaaucugcugcucggggugcaggucuuaccuaccacaaaacugggaucugaagagucgugcaaacuuagaagguugcgguucacuuauggcacccaaacacgcgugucacuggcgcuaccaggccaguacgaacucguucacacccugguggcucaucaggggaacugggagacuauucccgaggaagaucuugagguccaggaaaauaacgaggacgccgcacacgugcuggccgaauuggagguaacaaugcaucacgcucuccugcaagagguugauguggucguggcaccuugucagggauuacgaccaaccguggacguccugggugaucucguuaaugacuuucuuccggugaucacguaugcccugcacaaggaugaauugagcgagagagacgaacaggagcuacaagaaauaaggaaauacuucaguuuucccguauucuuuuucaaggugccuaaacugggcuccgagaucauugauucuagcacucggcguauggaguccgaacgcucaccacucuauagacagcugaucgaccuuggguaccugaguagcucucauuggaacugcggagcucccggccaggacaccaaggcccaguccauguuggucgagcaaucagaaaaacucaggcaccugagcacauuuagucaucagguguuacagacucggcugguugaugcggcaaaggcccuaaaucucgugcacugucacugccuggacauuuucaucaaccaggcuuuugauaugcaacgagaccuucagauaaccccuaagcgcuuggaguacacaagaaagaaggaaaaugagcuguaugagucucucaugaacauugccaauaggaaacaggaagagaugaaggauaugaucgucgaaacccugaacacgaugaaagaggagcuucuggacgaugcaacuaauauggaguucaaggacgugauuguaccagaaaacggugaacccguugggacacgggagaucaaaugcuguauccgccagauucaagaauugauaaucuccagacucaaccaggcuguggccaauaagcugauuagcucggucgauuacuuaagggagucuuucgugggcacccuggagcguugccuacagucccucgaaaagucacaggacgucagugugcauaucacuagcaacuaucugaaacaaauacuuaaugcggccuaccacguugaggugacauuucauuccggaucuagcguaacccggauguugugggaacagauuaagcagaucauccaacgaauuacgugggucucaccgccugcaaucacccuggaguggaaaagaaagguggcucaggaagccauugagagucucuccgcuagcaaacuggccaagucuauauguucacaguucaggacacgcuuaaacaguagccacgaggcauuugccgcuucccugcggcagcuugaagcgggccauucugggagauuggagaagacugaagaucucuggcugaggguucgcaaagaccacgcaccccgacuagcccggcugucgcucgagagcugcucccugcaagacgugcuuuugcaccguaagccaaaacugggacaggaauuagguagaggccaguauggggucguguaccucugugauaauuggggaggccauuucccuugcgcucugaagucaguagugcccccagacgagaaacacuggaacgaucuugcccuggaguuucauuauaugaggaguuugcccaagcacgaacgccucguugaccugcacgguucugucaucgauuacaauuacgggggcggaagcuccauugcagugcuacugaucauggagcggcuccauagagaccuguauaccggccuuaaggccggguugacacuggaaacuagguuacagaucgcucucgauguggucgaggggauucgauuccugcacucacaaggucuuguucaucgcgacauaaaacugaagaacgugcuacucgauaaacagaaucgggccaagaucaccgaccugggcuuuuguaaaccugaggcaaugaugagcgggucuauugugggaacaccaauccacauggcgccggaauuguucaccggcaaguacgauaacuccguagacgucuaugcuuuugguauucuguucugguacaucugcagugggagcgugaaguuacccgaggccuuugaaagaugugcaucuaaagaucaucucuggaauaacguuaggcguggcgcccgcccugagcggcugccaguguucgacgaagagugcuggcagcuuauggaggcuuguugggacggagauccccugaagagaccuuugcucggcauaguccagccaaugcugcaagggaucaugaauaggcuaugcaaauccaacucagaacagcccaaucgaggacuggacgauaguacuuga

SEQ ID NO: 55515 - RNA, 630 nt, Artificial Sequence
  derived and/or modified sequence opt3 from DTD1__Homo_sapiens__NP_543010
augaaggccgugguccagagaguuaccagggcuagcgugacaguaggcggggagcaaaucuccgcaauuggacgggguauaugcgugcugcucggcaucucucuugaagacacucagaaagagcuggaacacaugguccgcaagauuuugaacuuacgaguguucgaggaugaaucagggaaacauuggaguaagagcguuauggacaaacaguacgagauccugugugugucccaguuuacgcuacaaugcguccucaagggaaauaagcccgauuuccaccuggccaugccuaccgagcaggcggaaggcuuuuauaacucuuuccuugagcagcugcguaaaacauacagaccagaauugauuaaggacgguaaauuuggggcuuauaugcaagugcauauccagaaugauggaccgguaacuauagagcucgagucgcccgccccuggcaccgcaacaucagacccaaagcagcugagcaaacuggaaaagcagcagcaaaggaaggagaaaacccgggccaagggccccagugaauccucuaaagagcgcaacacuccuagaaaggaagauaggagcgcuuccucaggggcagagggagacguuaguagcgagcgggaaccauga

SEQ ID NO: 55516 - RNA, 1851 nt, Artificial Sequence
  derived and/or modified sequence opt3 from DTHD1__Homo_sapiens__NP_001130008
augugccuggagaagagauaccucgacgugcuuagcgaugucaccggcccccagguuuccuguuauaucacagccccuucuuacgugcugcaacaguuggaaugcaggauuauaaaccacaugucaaguuuaaucguaggggacaaugaggaacuggugagcaacgucauuacuaucgaguguuccgauaaagaaaagcgggugccauucccgauuggaaucgcuauacccuuuacggcacgcuaucgagguaauuaccgugacaucaugguuaaagugugcgauauuaaccuacagucuucguaucucaauccuaacucacuggagggcaugaaagggggauacaagggcaccugugccagcgucaagguguauaaacuugguaucuucaguguaguuuccugccugaagaaggagucuuuuacagugacuaaaaagggguuggcgcucaaaagcuccauggacucaagaauuagucugaauuacccacccggagucuucaccagcccugugcuggugcagcucaagauccaaccagucgaucccgcuuuaguugcccaucugaaggcacagcaggacacauuuuacucugugcaguccaccucaccucuuauacacauucaacauccaagcacuuauccguuccagaaacccguaacauuguuucugccuuguaguccauaccuagauaagaacaaucucggcucugaaaucgaccacaaaaggcgggccuccgcuaccauuaaccgcaucacgcccagcuauuucaauagaacuaagaucgcaucgauuaggaaaccucggaagaacgccucugagugccugaaacuucugggcuuucgcucccaggauucagggugguguggauuggacgauguggucaagaccauacagaguggucucgugagcguugaacuguacgagcauuuagagcgauucaucgugcugcaccucuccucuacaauggacaauagccaccuugucacuuuugugaagucacuggaagaggcuauguugaguaccacagccugcauuguacuaucccaucaaaaagacaacccacacagaaucgcgguucuggugguccccagcaaggaucucucucaggugcugaaagaccuucaucuggaaggcuucgggggaccgccugagcccucaaggcacuuucagguccgggaaggcgagcaauugcuccugcguuucaccgguaauauauucgcaaguagcaacgggaaggauuauggaaaagacuacacguuaauuuuucaccuucagcgcaagccaagacuagagcuccagaucaaggaaguggaugaguucggcaacuauuccuguccucauuacaaaggcacuaucguuguguacaagguacccaaagggaagauugucccaaaucugaaccagucucuugugaucaaugaaaaccacucgcaauugcccauuugcaaacugccucucaagcugccaaagcauaaaaagcugauaaauaggccgcagagcacaaaacggguuuccaaggaccccguggaggcccugugggauaacuugcuccacuggcuggcugaagaguuaucagaggaaaaugccgagagucugucuagcacccuaccucuccgacgcuccacuauccagcugauuaaacuuaagaacccagacgauuugacagaacagauccaugaguuucugugcuucuggaagaaaucacuccccaccuuuacggacaagcugagauuacuggcaaggcaccuucggaaaaucggacgcagcgauuuggcugaggaacucaaguucaaaugggagaauaaggucuuuaccgaaccucaacaguguuucgacguggccccagaguga

SEQ ID NO: 55517 - RNA, 1380 nt, Artificial Sequence
  derived and/or modified sequence opt3 from DTL__Homo_sapiens__NP_001273158
augggcuacagcucccugauccucgacucuaccgggucaacacuuuucgccaacugcacugaugacaauauuuauauguuuaacaugacgggacugaagaccagucccguggcuauauucaauggucaccagaacagcacauuuuacgucaaauccucuuugucgccugaugaccaauucuuaguuucaggcagcagugaugaggcagccuauaucuggaagguguccacuccauggcagccgcccaccguacugcuagggcauucucaggaagugacaagcgucuguuggugcccuuccgacuuuaccaaaauugcgacuuguucagaugacaauacacucaagaucuggagacugaacaggggacuugaggaaaaaccaggcggugauaagcugaguaccguggggugggcuagccagaagaaaaaggagucucggcccggauugguuacggugacuuccucacaaagcaccccugccaaagcaccacgcgucaagugcaaucccaguaacucuuccccuagcucggccgcuugugcaccaucuugcgccggcgaccucccgcugcccuccaauacaccuacuuucucaauuaaaaccaguccagcuaaggcccgaagccccaucaaccguagaggcuccgugucuagcguaucaccuaagccacccaguuccuuuaaaaugagcauaaggaauuggguuacacggaccccgucuucaaguccucccaucacgccuccagcgagcgaaacuaagauuaugaguccccgcaaagcacugaucccagugucucagaagucgagccaggccgaggcuuguuccgagucaagaaacagggucaaacggcgccucgauaguucuugcuuagaaagcgugaagcagaaaugugugaaguccugcaauugugucacagagcuggacgggcaaguugaaaaccuucacuuggaucugugcugccuagccggaaaucaggaggaccucucaaaggacagccugggucccaccaaaucuuccaagauugagggcgcagggacuuccaucagcgaaccuccaucuccgauaucccccuacgcuucagagaguuguggaacacuuccucugccauugcgacccugcggcgaagguagcgagaugguggggaaagaaaacucguccccugagaacaagaauuggcuccuggccauggcggccaaaagaaaggcagagaacccaucucccaggagcccgucaagucagaccccuaauucccggcgucagucuggaaagacguuaccaagccccguaaccauuacaccuuccucaaugcgcaaaaucuguacuuauuuccauagaaagagccaagaagauuuuugcggccccgagcacaguaccgaacuguga

SEQ ID NO: 55518 - RNA, 1116 nt, Artificial Sequence
  derived and/or modified sequence opt3 from DTNA__Homo_sapiens__NP_001121647
augaucgaggacagcggcaagagagggaacaccauggccgaaaggcggcagcuguucgcugagaugcgcgcacaagaucucgaccguauucgacuuuccacauacagaacugccugcaaacugagguuugugcagaagaaauguaauuugcacuuagucgauauauggaacguuaucgaagcgcugcgggagaaugcucuaaacaaucucgaccccaacacggaacugaaugugucucgccuugaggccguacugucaaccauuuucuaucaguugaacaagagaaugccuacaacucaucagauccacguggagcaaaguauuagccuccugcugaauuuucucuuagcagccuucgauccagaaggacaugguaaaaucuccgucuuugcugugaagauggcacuggccacccuuugcggcgggaagauaauggacaaauugagguacaucuucucuaugauuucggauucaagcggaguuaugguguauggccgguacgaccaguuucugcgcgagguccuaaagcucccgacagcuguguucgaaggucccaguuuuggguauaccgagcaguccgcccgaucuuguuucagccagcaaaagaagguaacucugaacggauuucuugauacacugauguccgacccuccaccccagugcuugguuuggcucccucuguuacacagacuggcgaauguggagaacgucuuccauccaguggaauguucauacugccacagugagagcaugaugggcuuuagguaucggugucagcagugccacaauuaccaacucugucaggauugcuucuggcguggccaugcagggggaucucacuccaaccagcaucaaaugaaagaauacaccucauggaaaagccccgccaagaaacuuacgaaugcucugaguaagucuuuguccugugccagcucgcgcgagccucuacacccaauguucccggaccagcccgaaaaaccucugaaccucgcacacaucgugccacccagaccugucacuucuaugaacgauacccuguuuucccauucaguuccaaguagcgguucccccuucauuacaaggucuagcgacggcgcuuuugggggaugcguguga

SEQ ID NO: 55519 - RNA, 1863 nt, Artificial Sequence
  derived and/or modified sequence opt3 from DTNB__Homo_sapiens__NP_001243232
augaucgaggaaagcggcaacaagagaaaaaccauggccgagaagaggcagcuguucauugaaaugcgggcucaaaauuuugacgugauacgccucuccacauaccgaacugcaugcaaacuucguuucguccagaagagauguaaccugcacuugguugauaucuggaauaugauugaggccuuuagggacaacggguuaaauacgcuggaucauaccacagaaaucucugugucacggcuagagacuguaauuaguagcaucuauuaccagcucaacaaacgccugcccuccacccaccagauaucuguggagcaaucgaucucacuucuguugaauuucaugauugcggcuuaugacagcgaaggaagagguaagcucacagucuuuagugugaaggccaugcuggcaaccaugugcggcgggaaaaugcuggauaagcucagguacguuuucucccagaugucugacagcaacggauuaaugaucuuuuccaaauucgaucaguuucugaaggaggugcuuaaauugccuacugccgucuucgaaggcccaucauuugguuauacagagcauagugugcggaccuguuucccgcagcaacgcaagauuaugcugaauauguuucuagacacgaugauggcugaucccccuccacagugccucguauggcugccccuuaugcaccgacuggcacauguugagaacguguuccacccugucgaauguagcuacugcagaugugagucuaugaugggguucagguaucggugccagcagugucacaauuaccaauugugccagaacuguuuuuggcguggacaugccggcggcccacacuccaaucagcaucaaaugaaggaacacucaagcuggaaaagucccgcuaagaaacucucucacgccaucuccaagagccuggggugcgugccuacucgcgagccaccgcaucccguguucccugaacagccagagaaacccuuagaccuggcgcacauagucccuccaagaccccucaccaacaugaaugauacaaugguuucgcauaugucuuccggagugccgacuccuaccaagaggcuucaguacucacaggacauucccagucaccuggcagaugagcaugccuugaucgcuagcuauguagcccggcuacaacacugcgcacgagugcuggacuccccaucucgccucgacgaggaacacagacugauugcuagguacgccgcgcggcuugccgcagaagcugguaacgucacacgcccucccaccgaucugagcuuuaacuucgacgccaauaaacagcagagacaguugaucgcugagcucgaaaacaagaauagggagauccugcaagagauucagcguuuacggcuggaacaugagcaggccucacagccaacgcccgaaaaggcacaacagaacccuacucuacucgccgagcugcgacuuuugagacagaggaaagaugaacuggagcagcgcaugagugcucuccaagagucccggagagaacugauggugcagcuugaggaacugaugaaguugcucaaagcgcaggcaacaggcagcccacacaccucuccgacucaugggggaggcaggcccaugccuaugccaguucgcucaacaagugccgguagcacccccacgcacuguccucaagacucccugucuggggugggaggcgauguccaggaggcuuuugcccagggcacccgacggaauuuacguaacgaccugcuaguggcagccgauucgauaacaaauacuaugagcucccucguaaaggagcugcacucagcugaagagggggccgaagaggaagaggagaaaaugcagaacggaaaggacagagguuga

SEQ ID NO: 55520 - RNA, 813 nt, Artificial Sequence
  derived and/or modified sequence opt3 from DTNBP1__Homo_sapiens__NP_001258596
augcugagcgcccacugggagaagaaaaagaccucccucguggaacuucaggagcaacugcagcaguugcccgcuuuaaucgcagaccuggaaucuaugacagccaaccuaacucaucucgaggcgucauucgaagaggucgagaauaaccugcuucaccuggaagauuugugcggccagugugagcucgaaagaugcaaacauaugcaaagucagcagcuggagaauuacaagaaaaacaagaggaaggagcuggaaacguuuaaagcugagcucgacgccgaacacgcacagaagguuuuagagauggaacauacccaacagaugaaacugaaggagcggcagaaauucuuugaggaagccuuccagcaagauauggagcaguaucuuagcacaggguacuugcagauugcugaacgccgagagccuauaggauccaugucuucgauggaagugaauguagacaugcuggagcaaauggaucuaauggacaucucagaucaggaggcacucgacguguuucugaacagcgguggcgaagagaauacuguccuuaguccagcccuggggccggaauccucuaccugucagaacgagauuacacuccaggugcccaauccuagcgaauugcgugcuaagccacccuccucaaguucuaccugcacugauagcgccacaagagacaucuccgagggaggcgagucaccuguugugcaaagcgaugaagaggaaguccagguggacaccgcgcuggcaacgagucacacugauagggaggccaccccagacgguggggaggacucugauuccuga

SEQ ID NO: 55521 - RNA, 1863 nt, Artificial Sequence
  derived and/or modified sequence opt3 from DTX1__Homo_sapiens__XP_011536311
augagcagacccggccacgggggacugaugccugugaacggucucggcuucccaccgcagaaugucgccaggguugugguaugggaguggcuuaacgaacauucccgguggcgccccuacaccgcuacagugugccaccauaucgagaauguccugaaggaagacgcacgagggucugugguuuugggacaaguggaugcccaguuagucccuuauauuauagaccugcagucaaugcaccaguuucgucaagauacuggcacgaugagaccagugaggcggaacuucuacgaccccaguagcgcgccugguaaagggaucguaugggagugggaaaaugauggaggcgcuuggaccgccuaugacauggauauuuguaucacaauucagaacgcauacgagaagcagcauccauggcuagaccucuccucucugggcuuuugcuaucuuaucuacuucaauucgaugucacagaugaaccgccaaacuagaaggcggcgccgacugagaaggcgguuggaucucgccuauccccugaccguugggagcauaccuaaaagucaguccuggccagugggagcuucuagcggucagccguguuccugccagcaaugucugcucgucaauucaacacgugcagccaguaacgcuaucuuagccagccagcgcagaaaggcgcccccugcaccaccccugccuccacccccgccucccggcgggccaccuggagcccuugcugugaggcccucugccaccuuuacuggcgcagcuuugugggccgcgccagccgcaggucccgcugagccugccccaccgcccggggcuccuccacggucccccggagccccuggcggcgcacgaacaccagggcagaauaaccugaaucgccccggaccgcaaagaaccacgucagugagcgccagggcuaguauuccuccagguguccccgcgcuaccuguuaaaaaccucaauggcacugggcccgugcacccagcacuggccggaaugaccggcauccuucugugcgcugccgguuugccuguaugucucacacgggcacccaagccaauucugcacccgccucccgugucuaaguccgacgucaaaccagugcccgggguuccuggcgugugccgcaagacuaaaaagaaacauuuaaagaaaagcaaaaacccagaagaugucgugagaagguacaugcagaagguuaaaaaucccccugacgaggauuguaccaucugcauggaacgucugguaacagccucgggauacgagggcgugcuccggcacaaggggguccgaccggagcuugugggaagacuggguagguguggccauauguaucacuugcuaugccuggucgcuauguacucuaacgggaacaaagacggaucccuccagugcccaaccuguaaggccauauauggcgaaaagacggguacucagcccccugggaagauggaguuccaccugauuccacauucacuucccggcuuuccugacacacaaaccauccgcauuguguacgauaucccgacuggaauccagggccccgaacacccaaauccugggaagaaauucacagcacggggauuucccagacauugcuaucugccaaacaaugagaaggguaggaaaguuuugcgccuccugauuaccgcgugggaacgacgguuaauauucacgaucggcaccaguaacacaacuggggagagcgacaccgugguauggaaugagauucaccauaagacagaauuuggauccaaccugacuggccacgguuacccugaugcuucuuaucuagacaauguccucgccgagcugaccgcacagggggugagcgaagccgcugccaaagcauga

SEQ ID NO: 55522 - RNA, 1869 nt, Artificial Sequence
  derived and/or modified sequence opt3 from DTX2__Homo_sapiens__NP_001096064
auggccauggcucccagcccuucccuggugcaggucuacaccucuccagcagccguugcggugugggaguggcaagacggccucgggacauggcacccguauucagcuacuguaugcaguuucaucgaacagcaguuugugcagcaaaagggacagagauucggucuuggcagccuggcccauuccauucccuuggggcaggcagauccuucuuuagccccauacauaaucgaccugcccucguggacgcaguuuaggcaagauaccggaacaaugcgggcuguccgccgacaccuauucccucagcauucagcaccaggccguggugugguuugggaguggcucagcgacgaugggaguuggacugccuaugaagccuccgugugugacuaccuggagcagcaggucgccagaggaaaccaacuuguggaucuggcgcccuugggcuauaauuacaccguaaacuauacaacccacacucagacaaauaaaaccucuagcuuuugcagguccguucggcgccaggcaggcccuccauacccggugacgacuauuaucgcucccccugggcauaccggagucgcuuguucaugccaccaaugucucagugguagcagaacaggcccagugucugggagguaccggcacuccaugacuaaccugcccgccuauccugugccacagcaucccccgcaccgcaccgcaucagucuucggaacacaucaggcuuuugccccuuacaauaagcccagccugaguggcgcgcgaucugccccaagacucaacaccacgaaugcauggggugcugccccucccuccuuagggagccagccacuguauaggucgucucuuucccacuugggaccccaacaucugccuccaggcucaaguacuagcggcgcuguuuccgccucucuaccgagcgggcccucaaguuccccuggaagcgugccagcaacaguacccaugcagaugccuaaaccaucucgggugcagcaggcccucgcugguaugaccucaguccugaugagugcgauuggccuucccgugugccugagccgugcaccgcaaccuacuuccccacccgccucucgcuuggcuagcaagucgcacggguccguuaaaagacucaggaagaugucagugaagggagccacaccuaaacccgaaccagagccugagcaggucaucaagaacuacaccgaggaacugaaagugcccccagacgaagauuguauaaucugcauggagaaguuaaguacggcaucuggcuauagcgacguaaccgauuccaaagccauugguucacuggcuguugggcaccucacaaaguguagccaugccuuccaccuucugugcuugcuagcaauguacuguaauggcaacaaggacggaucucugcagugcccguccugcaaaacuaucuauggcgagaagaccgggacacagccucaaggaaaaauggaagugcuccgguuucagaugagucugcccggucaugaggauuguggcacuauucuuaucgucuacagcauaccacacgggauucagggacccgaacacccuaauccaggcaagcccuucaccgcgcgagguuuuccucgccagugcuaccugccggacaacgcucaagggagaaaaguguuggagcuccugaaggucgccuggaaaaggcgguuaaucuucacagugggcaccucuuccacuacgggagaaacagacaccguuguguggaaugagauucaucacaagacugagauggaucgcaacaucaccggccauggguauccagaccccaauuaccugcagaacguacuagcagaacucgccgcucagggagucacagaggauugucuggaacaacaguga

SEQ ID NO: 55523 - RNA, 1053 nt, Artificial Sequence
  derived and/or modified sequence opt3 from DTX3__Homo_sapiens__NP_001273174
augcccauccugagcuccucuggcucaaagauggccgcuugcgggggaaccuguaaaaacaaggugacagucaguaaaccuguuugggacuuccucagcaaggagacuccagcaagacuugccaggcugcgggaggaacaccgcguguccauuuugauagauggugaaacgucugacaucuacguauuacagcugucgccgcaagggcccccuccagcgcccccuaaugggcuauaucucgcucgaaaagcccugaagggacuucugaaggaggcagaaaaagaguugaagaaagcccagcgucagggcgagcucauggguugccuggcucugggcggaggcggcgaacauccagagaugcacagagcagggcccccuccacucagggccgcuccguuacugcccccuggagcccggggucuuccacccccuccacccccguugccucccccacugccuccccgccuaagagaagaggcggaggaacaggagucaaccuguccaauuugccucggcgaaauccaaaacgcaaagacacuggagaaauguaggcauagcuuuugcgaaggguguauuacucgggcccuucaggugaagaaggcuugccccauguguggacgcuucuacggccagcuggucgguaaucagccucaaaacgggcgaauguuggugaguaaagaugccacccuccuguuaccauccuaugagaaguacggaacaaucguuauacaguauguguuuccgcccggcguccagggcgcagagcacccuaauccaggggugagauaccccggaaccacuaggguagcuuaucugccugacugcccagaagguaacaaaguucucacacuuuuccggaaggccuuugaucagcgucugaccuucacgaucggcacuucuaugaccacagggcgccccaaugugauuacuuggaacgacauccaucacaaaaccagcuguacaggaggcccgcaauuguuugguuacccugauccaaccuaccuaacgagaguccaggaggaacugagggcgaaggggauuacugacgauuga

SEQ ID NO: 55524 - RNA, 1542 nt, Artificial Sequence
  derived and/or modified sequence opt3 from DTX4__Homo_sapiens__NP_001287656
auggaggugggcaucaccauucagcacgccuacgaaaagcaacaucccuggauagaccugacaagcaucggguucuccuaugucauugauuuuaacacuaugggacagaucaauagacagacgcagaggcaacggcgcguucgacguagacucgaccuuauuuacccuauggugaccgguacacugccaaaagcucagucuuggccgguaucacccggcccugcaacuuccccacccaugagcccuugcuccuguccacagugcguguuggucaugucugugaaggccgcgguugugaacgggucgaccggacccuuacagcugccugucacaaggaaaaauaugccaccgcccggcgugguaaagcuaccuccacuccccgguucaggggcuaaaccucuggauagcaccggaacuauccggggcccacuuaagacagcccccagucaaguuauacgcagacaggcauccucuaugccgaccggcacgacuauggggagcccugccagucccccaggaccuaacucaaagaccgguaggguggcucuggcaacauugaaucggacuaaccuccagcgccuggccaucgcucagagucgaguccugauugccagcggcgugcccaccgugccagucaaaaaucucaacgggucuucccccguuaauccugcguuagcaggaaucacaggcauucugaugucagccgcuggucuuccaguguguuugaccagaccgcccaagcugguacuacacccuccacccgugagcaaaagugagaucaagucuauaccuggggucuccaacacgagcaggaaaacuacaaagaagcaagccaaaaagggaaaaaccccagaagaggugcucaagaaauaucugcagaagguucggcaucccccggacgaagauugcacuauuuguauggagcgucuuacagcaccuucgggcuacaaaggcccacagcccaccgugaagccugaccuggucgggaaguugucucgcugcggacacguguaucauaucuacugucucguagcuauguauaauaacgguaauaaagauggcucccugcaaugccccacguguaagaccauuuacgggguuaaaacaggaacucagccaccuggcaagauggaguaccacuuaaucccccacucacugccaggucauccggacugcaaaaccaucagaauuauauauaguaucccucccgggauucagggcccagaacaccccaacccuggaaagagcuucuccgccaggggcuuuccacggcauuguuaccuccccgauucugagaaggggcgaaaagugcuuaagcuguugcuagucgcgugggaccgcagacugaucuucgccauaggaacaagcucaacuaccggugaaagugauacagugauuuggaaugagguccaccacaaaaccgaguuuggcuccaaccucacugggcauggauauccugacgcaaacuaccuggauaaugugcuugcugaacuggccgcucagggcaucagcgaggacucuacggcccaagaaaaggacuga

SEQ ID NO: 55525 - RNA, 639 nt, Artificial Sequence
  derived and/or modified sequence opt3 from DTYMK__Homo_sapiens__NP_036277
auggccgcuagaaggggcgcacugaucgugcucgagggggucgaccgggccggaaagagcacccagucccgcaaacuuguugaagcgcugugcgcugccggucaccgagcagaguuguuacguuuccccgaaagaucuacagagauuggcaagcugcuaucaaguuaccuccagaaaaagagcgauguggaagaccauuccguacaccuucuguuuucugccaacaggugggagcaagugccucugauaaaagagaaguugucgcagggggucacucucgugguugaucgguaugcuuucucaggaguggcauuuacgggcgccaaggaaaauuucagccuggacugguguaaacagccagaugucggucugccgaagcccgaccucguguuauuucugcaacuucaguuggcugaugccgcgaaacgcggggcauucggacaugagagauacgaaaacggcgccuuucaggagagggcucugcggugcuuccaccagcuaaugaaggacaccacacucaauuggaaaaugguagaugccaguaaguccaucgaggcaguucaugaagacauucgcgugcugucugaggaugcuauccgaacugccaccgaaaagccucuuggcgagcuguggaaauga

SEQ ID NO: 55526 - RNA, 4656 nt, Artificial Sequence
  derived and/or modified sequence opt3 from DUOX1__Homo_sapiens__NP_787954
augggcuucugccuggcccucgcuuggacccuucuggugggggcauggacacccuugggagcccagaacccuaucagcugggagguccaaagauuugacgguugguacaauaacuuaauggaacacagguggggcuccaaggggucucggcugcagcgccuaguuccagcgucauaugcugauggaguguaccagccgcucggcgagccccaucugccuaauccacgagaccuuaguaacacuauuagccguggucccgccgggcuggcauccuugagaaauaggacgguacucggaguguucuuuggcuaucacguccugucugaucuggugucgguugaaaccccuggcuguccagccgaguuccucaacauacggauucccccuggggacccaauguuugauccggaccagcgcggagauguggucuuacccuuccaaagaucaaggugggacccugaaacaggucggagcccaaguaauccccgcgauccugcuaaccaggugacuggcuggcuggacggguccgcaauuuacggaucuagccauuccuggucagaugcccuucgaaguuuuagcagaggccaguuggcuucugguccagaccccgccuucccgagggauucccagaauccucugcuaaugugggcggcacccgacccagccaccgggcaaaacggaccucggggccucuaugcuuuuggcgccgagcgugggaaucgcgagcccuuccugcaggcacuuggacuguugugguuuagauaccacaaccucugggcucagaggcuggcccggcagcauccagacugggaagaugaggaauuauuccaacacgcgcgaaaacgcguaaucgccacauaucagaauauugcaguuuacgaguggcugcccucauuucuccagaagacccuuccugaguacacugguuauagaccauuccuggacccgagcaucaguucugaguucguggcugccuccgaacaauuuuugagcacaaugguucccccuggcguguacaugaggaacgcuucgugccacuuccagggggugauaaaucggaacucuuccgucucacgcgcccuaagaguuuguaacaguuauuggagcagggaacauccaucccugcagucugcagaggauguggacgcccuccugcuuggaauggcuagccagaucgcggaacgugaggaucacguacugguggaggacguccgggauuuuuggcccggcccuuugaaauucucacgaaccgaccaucucgcaaguugccugcaaagagguagggauuuagggcugccauccuacacgaaggcccgcgcugcccuaggccucagccccauuacucgguggcaggacaucaauccggcacugucuagaucaaacgauaccgugcuugaagccacagcugccuuguauaaucaggaccugaguuggcucgagcugcuuccuggaggccuguuggaaagccacagggacccagggccccucuuuuccacuauuguucuggagcaguucgugcgcuuacgagauggagaccgguacugguuugaaaacacccguaauggucuguucucuaaaaaggagaucgaggaaauaagaaacacaacccuacaagauguccucguggcaguaauuaauaucgacccuucggcgcugcagcccaacguuuuuguguggcacaagggcgauccauguccucagcccaggcagcuuagcacggagggguugccagcuugcgccccguccgucgugcgcgacuauuucgaaggaucaggcuuugguuucggggucacuauuggcacacuguguugcuuuccucucgugagucuguuaucugcauggaucguugcccggcugagaaugaggaauuucaaacgacuucaaggacaggaucgccagagcaucguguccgagaaguugguaggcgggauggaagcucucgaguggcagggacauaaagagcccugucggccaguccugguguaccuacaacccggucagauuagaguuguggacggcaggcugaccguccuccguacuauacagcugcaaccuccacagaaggugaacuucguacuuucaagcaaucgcgggcggagaacauugcuguuaaaaauccccaaggaauacgaucucgugcugcuuuuuaaccuggaggaagagaggcaggccuugguugagaaucuccgaggagcacugaaggaaucuggccuauccauucaggagugggaacugcgggagcaagaacucaugcgcgcugccgucaccagagagcagaggcggcaucugcuugagacguucuuucgacacuuguucagucaggugcuggacaucaaccaggcggaugccgguaccuuaccucucgacagcucucaaaaagugagagaagcucugacaugcgagcuuucccgcgcagaauuugccgagucacuggggcuaaagccgcaggauauguucgucgaaaguauguuuagccucgcugacaaagacggcaauggauaucugucguucagggaguuuuuggauauacugguuguguucaugaagggcuccccagaggaaaaaucucguuuaauguuucggauguacgacuucgaugggaacggacucauuagcaaggacgaguuuaucagaaugcugaggucauucaucgaaauuaguaacaauugucuuuccaaagcccagcuggcagaggugguagaaucuauguuccgcgagagcggcuuucaggauaaggaggaauugacuugggaggacuuccacuuuaugcuccgagaucauaacuccgaacugagauucacccaacuaugcgucaaggguguggagguucccgaggugaucaaagaccugugccggagggcgucauauauuagccaggauaugauauguccuaguccacgcgucucugcccguugcuccagaagcgacaucgaaacagagcuuacuccccagcggcuccaauguccuauggauaccgacccgccccaggaaauuaggcgccgauuugggaagaaagugacaucguuccagccacuguuguuuaccgaggcucacagagaaaaguuccagcggucaugccugcaccaaacuguucagcaguuuaaaagguucaucgagaauuaccgcagacauaucggauguguggccguauuuuaugcaauugcuggcgguuuauuccucgagagggccuacuauuacgcauucgccgcucaccauacgggcauaacagauaccacucgggucgggaucauucugucucguggaaccgcggccaguaucuccuuuauguucagcuacauucuucugacaaugugccgcaacuugaucaccuuucuccgagaaacuuuccugaauagauaugugccuuuugacgcagcuguggacuuccacaggcuaauagccucuacagccaucguccugacgguucuucacagcgugggccauguagugaacgucuaccucuuuuccauuucaccccugaguguguugagcuguuuauucccagggcuguuucacgaugacggaucugagcucccucagaaguauuacuggugguucuuucaaaccguucccggccugacuggugugguccuucuguugauccuagcuauuauguauguguucgcaucccaucacuuucggcgcagaucauucaggggguucuggcugacacaucaccucuacauccugcuuuauguuuuacugauaauucacggaaguuuugcccucauccaguugccacgguuccauaucuuuuuccuggugccggcgaucauauacggcggugauaagcucgucagccugucccgaaagaaaguagaaaucucugugguuaaagcugagcuucugccuucgggcgugacccacuugagauuucagcgcccccagggguucgaauacaagagcggacaaugggucaggauugccugccuagcacugggcacaacugaguaucauccauuuacccucacgucagccccucacgaggacaccuuaucccugcauauccgggcugcagggccuuggacaacucgucuuagagaaauuuacagugccccaaccggagauaggugugcgcgcuaucccaaacuguaccucgacggcccuuucggugaggggcaccaggaauggcacaaguuugaggugucuguauuggugggaggcgguaucggcgucacaccguucgcuagcauacugaaggaucucguuuuuaaauccucagugucuugccagguguucuguaagaaaauuuauuuuaucugggucacucggacccagcgacaauucgaauggcuggccgacaucauuagagagguggaggaaaaugaucaucaggaccuuguuagcguacacaucuacauuacgcagcuagcagagaaguucgaucugaggacaaccauguuguauauaugcgaacgccauuuucaaaaaguguuaaaccggagucuguucacugggcucagauccaucacacacuuuggacguccacccuucgagcccuuuuucaauagccugcaggagguccacccccaggugaggaagauuggcgucuuuucuugcgggccaccuggaaugaccaagaacguggaaaaagccugucagcuuaucaaucggcaagaccgcacucauuucucacaccauuacgagaacuuuuga

SEQ ID NO: 55527 - RNA, 4647 nt, Artificial Sequence
  derived and/or modified sequence opt3 from DUOX2__Homo_sapiens__NP_054799
augcugagagccaggcccgaggcucucaugcuucugggcgcauuguuaaccgggagccugggaccuuccgguaaccaggacgcccuaucucucccaugggaagugcaacgguacgauggcugguucaauaaccugcgccaccaugagcgaggggcggucggaugccgucuucagagaaggguuccggcuaauuaugccgacggcguguaccaggcacuggaggaaccccaguugccuaacccacggcgccucucaaaugccgcuacaagagguaucgcagggcugcccagucugcacaacaggacuguacucggaguguuuuucggcuaucaugucuuaagcgaugugguuuccguggaaacgccuggcuguccagccgaguuucugaauauucggauacccccuggggacccagucuucgauccggaccaacgcggagaugugguacuucccuuucagcgaucuagaugggacccugagaccgguaggucgccaucaaacccccgggauuuggcuaaucagguuacaggcuggcuggacgggagcgccaucuacggaaguucccacucuuggagcgaugcgcuacguuccuucucaggcggucagcucgcaagugggccugacccagccuuuccccgcgauagccaaaacccgcugcuuaugugggcugccccugaccccgcaacuggacagaauggcccaagaggccuguaugcuuucggggccgaaaggggaaaccgggagcccuuuuugcaggcgcucggucuguuaugguuccgauaccauaaucugugggcccagcgccucgcaagacaacaccccgacugggaagaugaggagcuuuuucagcacgcuaggaagcgggugauugccaccuaucagaacaucgcugucuacgaauggcugccaucuuucuugcagaaaacacuacccgaguacaccggcuaucgcccuuuucuggacccauccauuucaccggaguucgugguggccagcgaacaauucuuuaguacuauggucccuccugggguuuacaugagaaaugcaucuugccauuucaggaaggugcucaacaaaggauuucaguccagccaggcccugcguguauguaacaauuauuggauccgggaaaacccaaaucuuaacucgacacaagaggugaaugagcuguugcucggcauggcuucucagauauccgaacuggaggauaacaucgucguggaagacuuacgagauuacuggcccgguccugggaaguucucaagaaccgacuauguugcgaguagcauucagaggggccgcgauaugggacugccauccuacucucaggcacuacucgccuuuggccuggacaucccccggaauuggagcgaucuuaacccgaauguggacccucaagucuuggaggcuacggccgcacuguauaaccaggaucucucacagcuggaacuucuguuagggggacuccuggagagucacggugacccaggccccuuauucuccgccauugugcuggaccaguuuguaagacuaagggauggggaccgcuacugguucgagaauacucgaaacggacucuuuagcaaaaaggaaaucgaggauauacggaauaccacacugcgugacguucuuguggcugucauuaacaucgauccuucugccuugcaacccaauguguucgucuggcauaagggcgcaccaugcccucagcccaaacagcugacuaccgacggucucccacagugugcgccgcugacaguguuagacuuuuucgaagggucaaguccuggcuuugcuauuaccaucaucgcccugugcugucuucccuugguuagccuccugcuauccggagugguagcauacuucagaggcagggagcacaagaaacugcaaaagaaacucaaggaaucugucaagaaagaggccgcuaaggauggggugccagccauggaguggcccggaccuaaagaacgcucgagcccaauuauaauccagcugcuuuccgaucggugcuugcagguucugaacagacacuuaacggugcucagggucgugcaacugcagccccuucagcagguaaaccugauuuugucaaauaaccgagguugucgcacucuccugcuaaagaucccuaaagaguaugaccuggugcuccuguucaguucugaagaggagcggggcgcauuuguucaacagcuuugggauuucugcgucagaugggcuuuggggcugcauguggccgaaaugagcgagaaggaauuauuuaggaaagcggugacaaagcagcagcgugagcgcauacucgaaauuuucuuucggcaccuguucgcccaaguccuugacaucaaucaggcugaugcaggaacccugccgcuagacuccucacagaagguuagagaggcccucacuugugagcugagcagggcugaauuugccgagucuuugggccugaaaccacaggacauguucguggaauccauguuuaguuuagcagauaaggacgguaacggguaccucagcuuccgagaguuucuggauauccuugugguauucaugaaaggcucucccgaagacaagucccggcugauguuuacaauguaugauuuggacgagaauggauuccucucaaaagaugaguucuuuaccaugaugcgcaguuucauugaaaucagcaacaauugccugucgaaggcgcaacuagccgaggucguggaauccauguuuagagagucuggcuuccaggacaaggaggaacugacgugggaggauuuucauuucaugcuuagggaccacgauagcgaacuccgguuuacccagcugugcguuaaagggggaggcggugggggaaacggcauucgagacauauucaagcaaaauaucucauguagagugaguuuuauuacacgcacuccuggugagaggucccauccacagggcuuggggcccccugcuccggaagcccccgagcugggaggcccaggguugaaaaagcguuucggcaaaaaggcagcugucccuacaccccggcucuacaccgaggcccugcaggaaaagaugcagagaggauuucuugcacaaaaacugcagcaguauaagagguucguggagaacuaccgccgacacaucguuugcguggccaucuucucugcuauuuguguaggugucuuugcggauagagccuauuacuacggguucgcaagcccaccuuccgacauagcucagacuaccuuggugggaaucauucucucacggggcacagccgccagcgugaguuuuauguucucuuauauccugcuaaccaugugcaggaaucugauuacuuuucuucgcgaaacguuccucaaccguuacguccccuuugacgcugcaguugauuuccacagauggaucgccauggcggcugugguacuggccauauugcauuccgcaggucacgccgugaaugucuauaucuuuagcgugucgccauuaucacugcucgcuuguauuuucccgaacguuuuugugaaugacggcucuaaacugccucaaaaguucuacuggugguuuuuccagacaguccccgggaugaccggagugcuucuguugcuaguucuggcaaucauguauguguucgccagucaucacuuucggaggcgcuccuuccgaggcuuuuggcucacucaccaucuguacauucuuuuauaugcgcugcucaucauacacgggagcuacgcuuugauucagcugccaaccuuccauaucuacuuucucguccccgccauuaucuauggaggcgauaaacugguaucucuuagcagaaagaagguggagauauccguugugaaagcagaacuguugccuucaggugucacauaccuacaguuccaacggccacagggguuugaguauaagaguggacagugggugaggaucgccugccuggcucucggcaccacugaguaccaccccuucacauuaacgagcgccccucaugaagacacccugucucuucacauucgcgcaguagguccguggacuacaagacugagggagaucuauuccucaccaaaaggcaacgggugugcuggauaccccaagcucuauuuggauggcccuuuuggggaaggacaccaggaguggcauaaauucgaagugaguguccugguuggcggugggauuggagugacccccuuugccagcauccucaaggaccugguguucaaauccucucuuggcucgcaaaugcuaugcaagaagauauacuuuauuugggucacacggacucagcgucaguucgaguggcuggcggauaucauccaagagguggaagagaacgaccaccaggauuugguuagcguacauauuuacgugacccaguuagccgaaaaauucgaccugcgcacgaccaugcucuauaucugugagcgacacuuucagaagguccugaauagaucacuuuucacaggccugagguccauuacucauuuugggcggccaccuuucgaacccuuuuucaacagucuccaagaggugcacccacagguucgcaaaauaggaguguuuucuugcgguccuccgggcaugaccaagaaugucgagaaagcaugucaguuggugaacagacaggauagggcucacuucaugcaucacuacgaaaauuuuuga

SEQ ID NO: 55528 - RNA, 1452 nt, Artificial Sequence
  derived and/or modified sequence opt3 from DUOXA1__Homo_sapiens__NP_001263193
auggccacccugggccacacauuccccuuuuacgcugggccuaagccaacuuucccgauggacacgacccucgcaagcaucauuaugauauuucuuacagcccuggcgacuuucaucgugauuuugcccggaaucagagguaaaaccagguuauuuuggcugcuacgggucguuacaucccucuucauuggcgcugccauccuggcagugaacuuuucuucagaguggaguguaggccaggugagcaccaauacuuccuauaaggccuucucuucggaauggauaucagcugauaucggacuucaagucggccuggguggggugaacauuacauugaccggaacgccuguucagcagcucaaugagacuaucaacuacaaugaagaguuuaccuggcgccugggcgaaaacuaugcagaggaguacgccaaagcucuggaaaagggccucccagaccccguguuauaucuggccgagaaauucacaccucgaagcccaugcgggcuuuaccgucaguauagauuggcgggacauuacaccagugcaaugcugugggucgccuuucuauguuggcuccuggcuaaugugaugcuuuccaugcccguacugguuuacgguggcuauauguugcucgccacugggauuuuccaacuguuagcacugcucuuuuucucuauggcuacaagccuuaccuccccuugcccacugcacuugggagccucagugcuacauacgcaccauggcccggcguucuggaucacucugacaaccggucuccuguguguccuucugggguuggccauggcaguggcucacaggaugcagccccaccggcucaaggccuuuuucaaccagaguguggaugaagacccuaugcuggaguggagcccagaggaaggaggcuuacugucuccccgcuacagauccauggcugauucaccuaagagccaggacauaccacuaagugaggccucuuccacuaaagcauauuacaggccccggcgccucagccuggucccggccgauguucgaggccuugcuccugcggcauugucggcccugcccggggcucuccuggcccaagcauggagagcccuucugccaggauugaggugcccuaaggcugguaaagaaucucggcucgggcccccacauucccccuggcguuuugggccugagggaugugaggaacgcugggccgagcacacaggcgacucaccaagaccgcugaggggucgggggaccggccgauuauggcgcuggggaaguaaggaaagaagggcaugcggcgugcgggcgaugcugccccgccuaguaagcaauuccgggcucaaaagaccuucuugucuggaucuuccaaagugcugggacuauaggcgugaugcucgggccuucuuucauuugcuggagcccacgccuugugugaccagccgacacacaccacucauuuga

SEQ ID NO: 55529 - RNA, 963 nt, Artificial Sequence
  derived and/or modified sequence opt3 from DUOXA2__Homo_sapiens__NP_997464
augacccuguggaacggcgugcuccccuucuacccucagccaaggcacgccgcuggguuuagcgucccgcuucugaucguuauuuugguguucuuagcacuggccgcguccuuucuacucauacugcccggaaucaggggucauucucggugguucuggcuuguacgcgugcuguugucacucuuuauuggcgcugagaucgucgccgugcacuucagugcagaaugguuuguugggacagugaauacuaacacgagcuauaaggccuucuccgcugcacgagucaccgcccgugugagacugcugguaggacucgagggcauuaauaucacauuaacugguaccccuguucaucaacugaacgaaacaauagacuacaaugagcaguuuaccuggaggcuuaaagaaaacuaugcugccgaguacgcgaaugcauuggagaaggggcugccagaucccgugcuauaucucgccgaaaaauucacuccuucuucgccaugcggacuguaccaccaguaucaucuugcuggccacuacgccucagcaacacugugggucgcuuuuuguuucugguugcucagcaacgugcuguuaaguacccccgccccucuguacggcgggcucgcgcuucugacgacuggagccuuugcauuguucgguguguucgcucuagccuccaucucuagcgucccacugugcccgcuccggcugggcuccucagcucuuaccacacaguauggggccgcauuuuggguuacucuggccaccggaguguugugucucuuccugggcggugcuguagugaguuuacaauacguccgccccagcgcgcugagaacacuacucgaccagucugcaaaggauugcucccaggagagagggggaucaccucugauucuuggcgacccauugcacaaacaggccgcucugcccgaucucaaguguaucaccacgaaucuguga

SEQ ID NO: 55530 - RNA, 663 nt, Artificial Sequence
  derived and/or modified sequence opt3 from DUPD1__Homo_sapiens__NP_001003892
augaccagcggcgaggugaagacaucccugaaaaacgccuacucuucagcuaagagacucagucccaaaauggaagaggaaggggaggaagaggacuauugcacuccuggagcauucgagcuugaaaggcuguuuuggaaggguagcccacaguacacgcacgucaaugagguuuggccgaaauuguauaucggcgaugaagccaccgcguuagaccgguaccgccugcaaaaggcuggguucacacaugugcuaaacgccgcacacggacgauggaauguagauacuggccccgacuauuaccgugauauggacauucaguaucaugguguggaggccgaugaccucccuaccuuugaucuguccgucuucuuuuacccagcugcagccuucauagacagagcucuuucugaugaccacucgaagauccuggugcauuguguuauggggaggucacggagcgccacauuggugcucgcguaccugaugauucacaaagauaugacccuggucgacgcaauccaacagguggccaagaaccgcugcguacuccccaauagaggauuuuuaaaacagcugagggagcuugacaagcaguugguucagcagcggcgccgaagucaaagacaggauggcgaagaggaagacggcagggagcuguga

SEQ ID NO: 55531 - RNA, 1482 nt, Artificial Sequence
  derived and/or modified sequence opt3 from DUS2__Homo_sapiens__NP_001258691
augauccugaacagccucucccuuugcuaccacaauaagcugauuuuggcccccauggugagagucggcaccuuaccuaugaggcugcuagcucucgacuauggggcagauauaguuuacugugaggaacugaucgaccuuaaaaugauucagugcaagcgggugguaaacgaggugcugucuacagucgauuucguggccccagacgaucgcguuguguuucgaacuugugaacgugagcaaaauagagucguguuccagaugggaacgucagacgcggaaagggcuuuggccguagcacggcucguugagaacgauguggccgguaucgacgucaauaugggcugcccgaaacaguauaguaccaaagggggaaugggcgcugcacugcugagcgaucccgacaagauugagaagauccucuccacauuagugaaggguacucgcagaccugugaccuguaaaauaaggauccugccaucucuugaagauacauugucgcuggucaagcggauugagcgcaccgggaucgccgcuauugccguucauggacgaaaaagagaagagaggccccagcacccugugucaugcgagguaaucaaggcgauagcagacacucuaagcauuccagugaucgccaacggcggcagucaugaucacauucaacaguacuccgacaucgaagacuuucggcaggcuacagccgcaucuagcgucaugguggcucgugccgcgauguggaaucccuccaucuuccucaaagaggggcugcgcccucuugaagagguuaugcagaaguauauuagauacgccgugcaauaugauaaccauuacaccaauacgaaguacugucugugccagauguugagggaacagcucgagucaccacagggacggcuguuacacgcagcucaaaguagccgagagauaugugaagccuuuggucugggcgcuuucuaugaggaaacuacccaggagcucgacgcccagcaagcacgccuuucugccaaaacauccgaacagacuggggagccggcugaggauaccucaggagucaucaagauggcggugaaauuugacagaagggcauaccccgcccagauuacaccuaagaugugccuguuggaauggugucggcgcgagaaacuagcucagccaguauaugaaaccguucaaagaccccuggauaggcuuuucagcaguaucgugacggucgccgagcagaaguaccagucuacucugugggacaaauccaagaagcucgcagaacaggccgcugccauagugugccugcguagccaaggcuugccugagggucggcucggggaggaaucgccaucucugcacaaacgaaagagagaggcacccgaucaggacccgggaggcccuagggcgcaggaauuagcucagcccggcgaucugugcaaaaagccauuugucgcccuaggguccggagaggagucaccucucgaagguugguga

SEQ ID NO: 55532 - RNA, 1449 nt, Artificial Sequence
  derived and/or modified sequence opt3 from DUSP10__Homo_sapiens__NP_009138
augcccccuagcccacuggacgauagaguggucguugcccucuccaggccggugcggccccaggaccuuaaccugugcuuggauucuucauacuuaggcagugcuaauccugggagcaacucccacccacccguaaucgcaaccacaguggucucucugaaggccgcgaaucuaacuuauaugccuucgucaagcggaagugcucgcucccucaacugugguugcucuagcgccuccuguugcacgguggcaaccuacgacaaagauaaucaagcccagacacaggcuauugcagccggcacuaccacaaccgcuauagggacuucaacaaccuguccagccaaccagaugguuaauaacaaugagaacacgggaagucugagccccucuuccggcguggguucaccugucagcgggacuccaaagcaacuugcgaguaucaaaauuaucuauccgaaugaccuggcaaagaaaaugaccaagugcucuaagucccauuugcccagccagggaccugugauuaucgauugucgaccauucauggaauacaacaaaucgcacauacagggcgccguacauaucaauugcgcugacaagauuucucguagaaggcuccagcaaggcaaaaucacaguucuggaucugauuuccugucgggaggggaaggacucauuuaaacgcaucuucaguaaggaaauaauuguguaugaugagaacacuaaugaacccagcagagucaugccuucccagccacuccacaucguguuagagucucugaagagggagggaaaagaaccccuuguguugaaggguggccugagcucauuuaaacagaaccaugagaaccuaugcgacaauagucuccagcugcaagaaugucgggaggucgggggaggcgccuccgcagcuagcucucuucugccgcagccuauucccaccacaccagauaucgagaacgccgaauugaccccuauccuccccuuccuguuuuuagguaaugagcaggacgcgcaagaccuggauacgaugcagcgccucaacauuggguacguuauaaaugugacuacacaccuuccacuguaucacuacgaaaagggauuguucaacuacaaacgacuacccgccaccgacucaaauaagcagaaccugagacaguauuuugaggaagcauucgaguuuaucgaggaagcucaucaaugcggcaaaggccuccugauucacugccaggccgggguaaguaggagcgcuacuaucgugauagccuaccuuaugaagcauacacggaugaccaugacggaugcauauaaguucgucaaaggaaagcguccuauuaucuccccaaaucugaacuuuaugggucaguugcucgaguucgaagaggaccugaauaacggcgugaccccgcgcaucuuaacacccaaacugauggggguugaaacuguggucuga

SEQ ID NO: 55533 - RNA, 1134 nt, Artificial Sequence
  derived and/or modified sequence opt3 from DUSP11__Homo_sapiens__NP_003575
augagaaacagcgagacccuggaaaggggcgucgggggaugccggguguucuccugucucgguucuuaccccggcaucgagggggccggacuugcucuguuggcagacuuagcccugggcggucgccuacucgggacacacaugucacaguggcaucacccucgaaguggauggggccguagaagggauuuuagcggccgguccucugcgaagaaaaagggcggaaaucauauuccagaacgcuggaaagacuaucugccgguuggucaaagaaugcccggcacuagguucauagcuuuuaaggugccucuucagaaaucguucgagaagaagcuggccccagaagagugcuuuucacccuuggaucucuucaacaaaauccgggagcagaaugaggaacuggggcugauuaucgaccucacguacacccagcgcuauuacaagccugaagauuuaccagagacaguacccuaucugaaaauuuuuacugugggacaccaagucccugacgaugagaccaucuucaaguuuaaacaugcagugaacggcuuccuuaaggaaaauaaggacaacgauaaauugauagguguucacuguacacacgggcugaaucgaaccggauaccuaaucugcagauaucucauugacguggagggcgucaggccagaugacgccaucgaacuguuuaaccggugucguggccauugccuugagcgccagaauuacauugaagaucugcagaacgggccgaucagaaagaauuggaacagcagugugcccagguccucugacuucgaggacagcgcucacuugaugcagccuguacauaauaaaccaguuaagcaaggaccccgguacaaccuccaccagauacagggucacuccgcaccucgacauuuucacacucagacacaaucacugcagcagagugugcgcaaauucagcgagaauccacaugucuaucaaagacaccauuuacccccgccugggcccccaggggaagauuacucucacaggcgguauuccuggaacgugaagccuaacgccucacgcgcugcccaggacagaaggcguugguaccccuauaauuacagccggcugaguuauccagcguguugggaguggacccaguga

SEQ ID NO: 55534 - RNA, 1023 nt, Artificial Sequence
  derived and/or modified sequence opt3 from DUSP12__Homo_sapiens__NP_009171
augcuggaggcccccggcccuagcgacgggugcgaacucuccaacccaucugcuucaagagugaguugugcaggacagaugcuugagguccaaccgggucuguacuucggcggggccgcggcuguugccgaacccgaucacuugagggaggcaggaaucaccgccguguuaacaguagacagcgaggaaccuuccuuuaaggcuggcccagguguggaggaucuguggcggcuauucguccccgcacucgacaaaccugaaacugaucugcuuucucaucuggaccgcugcguggccuuuauugggcaggcucgagccgagggacgugcgguuuuggugcacugucaugcaggcgucucgagaucaguggccauaaucacggcuuuccucaugaagaccgaucagcugccauuugaaaaagccuaugagaagcugcagauucucaaacccgaggcaaagaugaaugaaggcuucgaguggcaauuaaagcuguaccaggcuaugggguaugaaguagacacaagcagugccaucuacaaacaguauaggcuucagaagguuacugagaaauacccugaauugcaaaaccugccacaggagcuauuugcgguggauccgaccacagucucccagggacucaaggacgaggugcuguauaaaugccggaagugucgcagaucucuuuucaggagcuccucaauucuggaucaccgggaagguaguggccccaucgccuuugcacauaagcgcaugaccccuagcucuauguugacuacagggcgacaggcucaaugcaccuccuacuucauagagccagugcaguggauggaaucagcccuccugggagucauggacggccaguuacugugucccaaaugcagcgcuaagcucgguaguuuuaauugguacggggagcaauguucuugcggaagauggaucacgccugccuuccagauucacaaaaacaggguugaugaaaugaagauccuuccagugcugggcucccagacuggcaaaauuuga

SEQ ID NO: 55535 - RNA, 567 nt, Artificial Sequence
  derived and/or modified sequence opt3 from DUSP13__Homo_sapiens__NP_001007272
auggccgagaccagccugcccgaacucggcggggaggacaaggcuacaccuugcccauccauccuugaacuggaggaauuguuaagggcaggaaaaucuucauguaguaggguggaugaggucuggccgaaccuguucauuggugacgccgcgacugcuaauaaccgguuugagcuauggaagcucggcauaacgcacguucugaaugccgcacauaaagggcuuuacugccagggaggccccgauuucuaugguagcuccgugucuuaccuggggguaccugcccacgacuugccagauuuugacaucucggcuuauuucucaagcgcagccgauuuuauucaucgcgcucucaacacccccggagccaaggugcugguccacugugugguuggcgugagucgauccgcgacacugguccucgcauacuuaaugcugcaucaacgucuuucuuugagacaggccgugaucacuguaaggcagcaccgguggguuuucccuaaucgcggcuuucugcaccagcuaugcagacucgaccaacagcugagaggggcuggacagagcuga

SEQ ID NO: 55536 - RNA, 597 nt, Artificial Sequence
  derived and/or modified sequence opt3 from DUSP14__Homo_sapiens__NP_008957
augagcuccagaggccacucuacccugcccaggacacucauggccccucggaugaucucagagggggacauuggagguauagcucagaucacgaguagccuuuuccugggccgcggguccguggcaucuaaccgacauuuguuacaagcccguggaauuacuugcaucgucaaugcgaccauugaaaucccaaacuuuaauuggccgcaguucgaguacguuaaggugccccuggcugauaugccucacgccccaauaggccuauauuuugacacaguagcagauaaaauccauucggugucaagaaagcacggugccacucucguccauugugcugcaggggugagcaggagugccacccugugcauugcuuaccuuaugaaauuccacaacguuugucuguuggaagccuauaauugggugaaggcgcggcgccccgucaucagaccuaacgugggauuuuggaggcagcucauugacuacgagcggcagcuguucggcaaauccacaguaaagaugguucaaaccccauauggcaucgugcccgaugucuacgaaaaggagucucgccaccugaugccuuauugggggauauga

SEQ ID NO: 55537 - RNA, 708 nt, Artificial Sequence
  derived and/or modified sequence opt3 from DUSP15__Homo_sapiens__NP_542178
augggcaacgggaugaccaaggugcugcccggacucuaccuugguaauuucaucgacgccaaagaucuggaccaguugggcagaaacaagauuacacacauaaucagcauucaugaguccccucaaccauuacugcaggauaucacuuaucuaaggauuccggucgcugacacgcccgaaguuccuaucaaaaagcacuuuaaagagugcauaaauuucauccauuguugccggcucaacgggggaaauugucuggugcacugcuuugcaggcauuucucgcucaaccacaaucguaacugccuacgugaugaccgucacaggucuuggguggcgagaugugcuggaagcgauuaaggcuacccguccaaucgccaaccccaauccuggauucagacagcaguuggaggaauuuggcugggcaaguagccaaaagcucaggcggcagcuggaggagcgcuucggcgaauccccauuuagagacgaggaggaacugagggcccucuuaccccuguguaaacggugccgccaggggucugcuacuucggcaucaagcgccggaccucauagugcugccuccgaggguacaguucagcgacuugugccaagaaccccgagggaagcgcaccggcccuugccucugcuagcacgugucaagcaaacguucucuugucucccacgcugccugagcagaaaaggcgggaaguga

SEQ ID NO: 55538 - RNA, 1554 nt, Artificial Sequence
  derived and/or modified sequence opt3 from DUSP16__Homo_sapiens__XP_005253545
augcugccccucagccuucagaccguguucucccuguacuuuugggucaacuggagaagggccucuacauuguucacuugcuuacaagagcugaugcagcagaauggcaucggguauguucuaaacgcuucaaauacguguccuaagccagacuuuauuccggaaagucacuuccuccgggugcccguaaacgauagcuuuugcgagaaaauacugccuuggcuugacaaguccguggauuucaucgaaaaagcaaaggccucuaauggauguguccuggugcauugcuuggcggguauuucgcgcucagcuaccaucgccauugcauacaucaugaaacgaauggacaugagccucgaugaggccuaucguuuuguuaaggaaaagagaccaacaauaagucccaacuucaauuuucugggccagcugcucgacuacgagaaaaagaucaaaaaccaaacuggggcuuccggaccuaagucuaaauuaaagcugcuucacuuggagaagccaaaugaacccgugccugcagucagcgagggcggucagaaauccgaaaccccacugucaccgcccugugccgauagugcuacaagcgaggccgcggggcagaggccugugcauccagcaucuguacccuccguuccuucagugcagccaagccuacucgaggacaguccccugguccaagcccuuucuggacugcacuuguccgcugaucggcucgaagacagcaacaagcugaaacgcucguucucuuuagauauuaaguccgugucauauagugccagcauggcagcuucccugcauggcuuuucuagcucagaggacgcccucgaauacuauaaaccgaguaccacucuugauggcacaaauaagcugugccaguucuccccugugcaggaguugagcgaacagacccccgagacgucuccagacaaagaggaagcgucaaucccuaagaagcuacaaacugccagacccagugacagccaguccaaaaggcugcacucuguccggaccucgagcuccgggacagcacagcgcucacuccugaguccacuucaccgaucuggaagcguugaggauaacuaccauacuuccuuucuguucgguuugucaaccagccaacagcaccucacaaagucugcuggccugggguuaaaaggauggcauuccgacauucuggcuccccagaccaguacgccuagccuaacuucuuccugguacuucgccacagaaucaagucacuuuuauagcgccucggcaaucuacggcgguuccgccucuuauagcgcuuacucauguagucagcucccaaccugcggggaucaaguguauuccguaagaaggcggcagaagccgucugaccgugcggauagccgcagauccuggcacgaggaaucacccuucgagaaacaguuuaagaggcggagcugucagauggaguucggagaaaguauaaugucugagaaucgaucccgcgaggaacugggcaaggugggcagccaaucgucauuuucugggaguauggaaauuaucgaggucuccuga

SEQ ID NO: 55539 - RNA, 567 nt, Artificial Sequence
  derived and/or modified sequence opt3 from DUSP18__Homo_sapiens__NP_001291723
augaccgcccccagcugcgcuuucccugugcaguuuagacaaccauccgucucuggccugucacagaucacaaagagucucuacauuagcaacgggguugcagccaauaacaaacuuaugcuguccucuaaucagauaacuauggugaucaacguaucgguggaggucgugaauacguuguaugaagacauucaguacaugcaaguuccgguggcggauucacccaacagcagguuaugugacuucuuugauccuaucgcugaccacauucauagugucgagaugaagcagggacggacccugcuacacugcgccgccggugugucccgcucugcagcucucugucuggcauaucuuaugaaauaccaugccaugagccuguuggaugcucacacauggacuaaguccugccgaccaaucauacgucccaauucaggcuucugggaacagcucauccauuaugaguuucagcuguucgggaaaaacaccguacacaugguuaguagcccugugggaaugauuccagacaucuacgaaaaggaggucagacugaugauuccccucuga

SEQ ID NO: 55540 - RNA, 1104 nt, Artificial Sequence
  derived and/or modified sequence opt3 from DUSP1__Homo_sapiens__NP_004408
auggugauggaggucggcacccuggacgccgggggacucagagcacuucugggugaaagggcugcccagugcuuguuacuggauugucggagcuucuuugcguucaacgcuggccacaucgccggguccguuaaugugcgcuuuucuacaauuguacgacguagagcaaagggagccaugggccuagagcauauagugcccaacgcugaacucaggggucggcugcuugcaggggccuaccacgcugucgugcuguuggacgagcgcucagccgcgcucgauggagcaaaaagagacggcacucuggcccuggcugccggcgcacucugcagggaagcucgggccgcgcaaguuuucuuuuuaaaagggggauaugaggccuucagugcaagcuguccugagcugugcuccaagcagucuacgccaaugggucuuucguugccgcugucaaccagcgugcccgauagugcugaauccggcuguucuagcugcuccacaccucuauacgaccaagggggaccagucgagauccuccccuuucuguaucuuggcucagccuaccaugcuagucgcaaggauaugcuggacgccuuggguauuacugcacucaucaaugugagcgccaacuguccuaaucacuucgaagggcauuaucaguacaaaucuauuccaguagaggauaaccacaaggcugacaucuccucaugguuuaaugaggcgauagauuucaucgacagcauuaagaacgcaggaggccgaguuuuugugcacugccaggccggcaucaguagaucugcuaccauuugucuggccuauuuaaugaggacaaaucgggucaaacuggaugaagcauucgaguuugugaagcagcgucgcuccaucauaagccccaacuucucguucauggggcagcuccuucaguuugaaucucaagugcuggccccucauugcuccgcugaggccggaucaccagcaauggcggucuuggacagagguaccaguacuacaaccguuuucaauuuuccggugagcauucccguacacuccacgaacucugcucuaagcuaccugcagucaccuaucacuaccaguccauccuguuga

SEQ ID NO: 55541 - RNA, 573 nt, Artificial Sequence
  derived and/or modified sequence opt3 from DUSP21__Homo_sapiens__NP_071359
augaccgccagcgcuuccucuuucucaaguagccagggcgugcaacagcccuccaucuacucuuuuucgcagauuacaagaucacuguuccucagcaacggggucgcagccaaugacaaacuucuguugaguuccaacaggauaacugcgaucguuaaugcuucuguggagguagugaacgucuuuuucgaagguauucaguauaucaaggugccuguuacggaugcccgggacagccgcuuauacgauuucuucgacccaauugcagaucugauccacaccauagacaugcgacaaggacguacacuacuccauugcauggccggcguguccagaucagcuagucugugucuugcauaucugaugaaguaccacagcaugucuuugcucgaugcccauacuuggaccaaauccaggcggccgaucauucgccccaauaacggguuuugggagcagcugaucaauuaugaauuuaagcuguuuaacaauaacacagucagaaugauuaauucaccugugggaaacaucccagacauauacgagaaagaucucaggaugaugauuagcauguga

SEQ ID NO: 55542 - RNA, 618 nt, Artificial Sequence
  derived and/or modified sequence opt3 from DUSP22__Homo_sapiens__NP_001273484
augggcaacgggaugaauaagauccugcccggacucuacauugguaacuucaaagacgccagagaugcugagcagcuuagcaagaauaaagugacccacauacuguccguccaugacucugcaaggccuauguuggaaggcguuaaguauuuaugcaucccagccgcggauucaccgagucaaaaccugacacggcacuuuaaagagagcauuaaguucauccaugaaugucgccuacgaggggaguccugccucgugcacugucuggcuggaguaucucguucggugacucuugucauugccuacaucaugacggugaccgacuuuggcugggaagaugcacugcauacaguuagagccgguaggucaugcgcuaaucccaacgugggguuccagcggcaguugcaggaguuugagaagcacgaaguccaccaauaucgccaguggcucaaagaggaauacggagagagcccucugcaggacgcagaggaagccaagaauauacugggcaaauauaaggagcagggcagaacugaaccacaacccggggcuaggcgguggaguuccuucccugcccucgcgccauuaaccuacgauaacuauacaaccgagacuuga

SEQ ID NO: 55543 - RNA, 453 nt, Artificial Sequence
  derived and/or modified sequence opt3 from DUSP23__Homo_sapiens__NP_060293
augggcgugcagcccccuaacuucagcuggguccugccagggagacucgccggacuugcucugccgagguugcccgcacacuaccaauuuuuacuggaccuagguguucggcaucucgugucccugaccgagcgcggcccuccacacucugauucaugccccgggcuuacacugcaucgauugcguaucccugacuucuguccacccgccccugaucagauugacagauuuguacagauaguggaugaagcgaaugcuaggggagaggccgucggcgugcacugcgcacucgguuucgggcggacuggaacgaugcuggccuguuaucugguuaaggaacgcggccucgcugcaggcgacgccaucgcugagauuagaagguuacggccagggaguaucgaaaccuacgagcaggagaaagccguguuucaauucuaucagcgcacaaaguga

SEQ ID NO: 55544 - RNA, 3477 nt, Artificial Sequence
  derived and/or modified sequence opt3 from DUSP27__Homo_sapiens__XP_005245660
auggccaccagaaaggacacagaggaagaacaggugguccccagcgaagaggaugaagcuaacguuagggcagugcaagcccacuaccugcgguccccuucuccaucacaguauaguaugguaagcgacgcggagacugaguccaucuucauggaaccgauucaucucucuucggcuauagccgcaaaacagaucauuaaugaggaacuuaagcccccuggcgugcgcgccgaugcugagugcccagggaugcuggagucagcagaacaguuguuagucgaggaccuguacaaccgagugcgugagaaaauggaugacacgagccuauauaauacccccuguguucucgaucugcaaagagcccuugugcaggacaggcaggaggcuccuuggaacgaagucgaugagguguggccaaauguauuuaucgccgagaagaguguugcggugaacaaaggacggcugaagcgcuuggguauuacacacauccucaaugcagcccauggcacuggggucuacaccggacccgaguucuauacaggccuggagauacaguaccuggguguggaaguggacgauuuuccugaggucgacaucucccaacacuucagaaaggcuucugaauuucucgaugaggccuuacugaccuauagggggaaaguucuugugagcuccgagaugggaauuucacggagugcaguauugguggucgcuuaccugaugaucuuccauaacauggccauucuagaagcgcucaugacugugcgcaagaaacgagccaucuacccaaaugagggcuuucugaagcagcuuagagaacugaacgagaaauugauggaagagagggaggaagacuauggccgggaagggggaagcgcagaagcugaggagggugaaggcacagggucuaugcucggagcccguguucacgcucugaccguggaggaagaggacgauuccgccucacacuuaagcggcaguucucuggguaaggcaacgcaggccuccaagccgcucacucuuauagacgaagaggaggaagagaaacuguacgaacaguggaagaaagggcaaggauugcuaagcgauaaggucccccaggacggcggcggguggcgcucggcuucuuccggacaggguggcgaggaacuggaggaugaggacguggaaagaauuauccaagaguggcagucaaggaaugaacgguaucaggcggagggguaccgacgcuggggaagagaagaggagaaagaagaggaaagugaugcaggcagcuccguagguaggcggcgcagaacccucucugagagcucagccugggagaguguuuccagccaugacauuugggugcugaagcagcaacuugaacugaacaggccugaucacgggcgucggagacgagcugacucuaugucaagugagagcacaugggaugccuggaaugaaagguugcucgagaucgaaaaagaggcaucccgccgguaucaugccaagucuaagagagaggaagcugccgacaggucgagcgaggcaggcucccgcguccgagaagacgaugaggacucagugggaagugaagcgucuagcuucuacaacuuuugcucccggaauaaagauaagcugacugcuuuagagcguuggaaaaucaagagaauacaguucggcuuucacaaaaaggaccugggggccggagauucaagcggugagccaggcgcagaagaggccgucggggaaaagaaccccucugacgugucccuaaccgcuuaucaggccuggaaacucaagcaccagaaaaagguuggaagugagaacaaagaagaggugguagagcugagcaagggcgaagauucugcacuugcuaagaaaaggcaacgccgguuggagcugcucgaaagauccaggcagacacuggaggagucacagaguauggccagcugggaagcggacucguccaccgccucugguagcauuccucuuucagcuuucuggagugcagauccauccgucucugccgacggggauacgacuagcgugcuguccacacagucacaucgaagccacuugagucaagcugccucuaauaucgcaggcuguuccaccagcaaccccacuacaccgcucccuaaucugcccguuggaccaggcgacaccauuucgaucgcgucaauacagaacuggauugccaauguggucucugagacguuagcucagaagcagaacgaaaugcugcuacucagucgcuccccuagcguggccucuaugaaagcaguacccgcugccagcugccugggggaugaccaaguguccaugcuuucaggacauaguaguucuuccuuggguggcugucugcucccacagucacaggcacggcccaguagcgacaugcaauccguucugucuugcaauaccacauuaucgagcccugccgagucauguagauccaaggucagggggacuagcaaaccaaucuuuucucuguucgcugauaacguggaccuuaaggaauugggacguaaggagaaagagaugcagauggaacuccgcgagaagaugagcgaauacaaaauggagaagcuggcguccgauaauaaacggucaucucuauucaagaaaaagaaggugaaagaagacgaggaugacggcgucggugauggggacgaggauaccgacagcgccaucggcaguuuuagauacuccagcaggucuaacucacagaagccggaaacagauacuugcuccagucuggcaguuugugaccacuaugcuagcggaucgcgagugggcaaagagauggauucuuccauuaauaaguggcucagcgggcugcggaccgaagagaaacccccuuuccagucagacuggaguggaucuucccgcggcaaguacacaagaagcucacuuuugagggaaaccgagaguaagagcuccucuuauaaauuuagcaagucccaaucagaggaacaggacacuucuaguuaccaugaggccaacgguaauucggugcggagcacgucccgauucucuucaagcuccacaagagaagggcgcgagaugcacaaauuuaguaggucuaccuauaacgagacuagcucaucccgugaagagaguccagaacccuacuucuuucggagaaccccugagagcucugaaagggaggaguccccagaaccccagcgcccgaauugggcccgaucaagagauugggaggacguagaagagagcucgaagucugauuucagugaauuuggagcuaaacggaaguucacacaguccuuuaugaggagcgaggaggaaggcgagaaggaacgcaccgagaaccgugaagaggguagauucgcaucaggccggaggucccaauaucgccgaucuacugacagagaggaagaggaagagauggaugacgaggccaucauugcggcuuggcggaggcgccaggaagagacaagaacgaaacugcagaagaggcgggaagauuga

SEQ ID NO: 55545 - RNA, 531 nt, Artificial Sequence
  derived and/or modified sequence opt3 from DUSP28__Homo_sapiens__NP_001028747
augggccccgccgaggcugggagaaggggagcagccagcccugugccaccgccccugguccggguugcgccuucccucuuccuugguucugcucgcgccgcaggcgccgaggaacagcuggcucgagcaggggugaccuugugcguaaacgugucacgucaacagccaggacccagagccccuggcgucgcugaauuaagggugccaguuuuugacgaucccgccgaggaccugcuagcgcaccucgaaccuacaugugcagccauggaggcugccgugcgggcugguggggcuugccuggucuacuguaagaauggacgcaguagaagcgccgcggugugcacugccuaucuuaugaggcaucggggccuguccuuggcaaaagcauuccagaugguaaagucugcccgcccaguugcugagccgaaccccggcuuuuggucgcagcuccaaaaauacgaagaggcccugcaggcacagucaugucugcagggggaaccuccagcccucggauuaggucccgaggcuuga

SEQ ID NO: 55546 - RNA, 945 nt, Artificial Sequence
  derived and/or modified sequence opt3 from DUSP2__Homo_sapiens__NP_004409
augggccuggaggccgcuagggaacucgagugcgcagcccuugggacccuguugagggacccccgggaagcggagcgcacauuacugcuagauugucgaccuuuccucgcuuuuugccguagacacgugagggccgcacggccagucccguggaacgcccugcuucgcagaagggcucggggacccccugcagccguucuggcuuguuugcucccagaccgcgcccugcgaacuagacuggugaggggugaacucgcgcgggcaguaguguuagaugagggcagcgccuccgucgcugagcugcgucccgacucuccugcccaugugcuuuuggcagcucugcuacacgaaacgcgcgccgggccaaccgcgguuuacuuccucagaggaggcuuugaugguuuccaggggugcugucccgaccugugcucagaggccccugcaccagcccuuccgcccacaggagauaagaccaguaggagcgacucccgggcuccuguguaugaucaaggcggcccagucgaaauccugcccuacuuguuucucgggucuuguucgcauucaagcgaccugcagggauuacaggcuugcgguauuacugccgugcugaauguaagugcauccuguccuaaccacuucgagggccucuuucgauauaaaucuauaccaguugaggauaaucagaugguggaaaucagcgccugguuccaagaggcuauuggguuuaucgacugggucaagaacuccggaggccgcgugcuugugcauugccaggcggguauuucaagaagugcaacaaucugucuggccuacuugaugcagagcaggcggguccgccuagaugaggcuuucgacuuuguuaaacagagaagaggggugauaucucccaauuucuccuuuaugggacaacugcuccaguucgaaacccagguacugugccacuga

SEQ ID NO: 55547 - RNA, 558 nt, Artificial Sequence
  derived and/or modified sequence opt3 from DUSP3__Homo_sapiens__NP_004081
augagcggcuccuucgagcugucugugcaggaccucaacgaucuucugucagacgggaguggaugcuacagcuugcccucccaaccuuguaaugaagucaccccaagaaucuauguugguaacgccucuguggcucaggauauuccgaaguuacagaaacugggcauaacacacguacuaaaugcagccgaggggaggucguuuaugcaugugaacacuaaugcgaacuucuacaaggacucaggaaucacguaucucggcauuaaagcuaaugauacccaggaauuuaaccugagcgccuacuucgagcgggcagccgacuuuaucgaucaagcucuugcacagaagaauggucgcguccuggugcacugccgagaaggguauagucguucccccacauugguuauugccuaccucaugaugagacagaaaauggacgugaagucugcucugagcaucgucaggcagaaccgggagauaggaccuaaugauggcuuccuggcccaacucugucaguuaaacgaccgccuggcgaaggagggcaaacuuaagccauga

SEQ ID NO: 55548 - RNA, 1185 nt, Artificial Sequence
  derived and/or modified sequence opt3 from DUSP4__Homo_sapiens__NP_001385
auggugaccauggaggaacugagagagauggacugcagcguccucaagaggcuuaugaaccgggaugaaaauggcgggggagccgguggcuccgggucucacggaacacugggcuugcccucaggugggaaauguuuacugcuagacugccgcccuuuccucgcucauagugcaggauacauccugggcagcguuaacgugcgauguaauacuauuguacguagaagggccaagggcuccgugucucuugagcagauacugccagcggaagaggagguccgggcucgcuugagaucggggcucuauucagccgugaucguuuacgaugaaaggagcccgcgggcagagagucugcgcgaagacuccacggugucucuggucgugcaagcccuccgaagaaacgcugagaggaccgauauuugcuuacugaaaggagguuaugagcgguuuagcuccgaauaccccgaguucuguucaaagacaaaagcacuugccgcuaucccuccacccguaccuccaagugccacugaacccuuggaccugggcugcagcucuugugggaccccucuacacgaucagggaggcccaguugagauucucccguuucuguaucuugguuccgcguaccaugcagcccgucgcgacaugcuggaugcuuuggggaucacagcccuccugaaugugucaagcgacugccccaaccacuucgaaggacauuaucaguacaaguguauaccugucgaggauaaucacaaggcagacaucaguucuugguuuauggaggcuauugaauacaucgaugccgugaaagacugcagaggcaggguguuaguccacugucaggcgggcauuucccggagcgccaccaucugccuggcauaucucaugaugaagaaacgaguucgccuugaggaggcuuucgaauuugugaagcaaagaaggucgauaauuucuccaaacuucuccuuuauggggcagcuguugcaguucgaaucacagguacuagccacaaguugcgcugccgaggcagccagccccuccggaccucugcgggagcgcgguaaaacuccagcuacccccacgucucaauuuguguucagcuuuccggucucagugggcguucauagugcgccuuccagccuccccuaccugcacucuccaaucacuaccucaccuaguuguuga

SEQ ID NO: 55549 - RNA, 1155 nt, Artificial Sequence
  derived and/or modified sequence opt3 from DUSP5__Homo_sapiens__NP_004410
augaaggugaccagccuggacggcagacagcucaggaaaaugcuucggaaggaggccgcugcacgcugcgucguucuggauugucgacccuacuuggccuucgcggcuuccaacgugcgugggucuuuaaauguaaaccuaaauucagugguccugagaagggcccggggaggugcagugagugcccgcuauguucucccugacgaagcugcaagagccaggcugcuucaagagggcgggggaggcguggcugccgucgugguacuggaucaggguagccggcacuggcagaaauugcgcgaagaguccgcggcacgaguugugcucacaucucugcuggccugccucccagcugggccgagagucuacuuuuuaaagggaggcuaugaaacuuucuacucggaguaucccgaguguugcguggacgugaaaccuaucucacaggaaaagauugagagcgaaagggcccugauaagucaauguggcaagccagucguuaacguguccuaccggcccgcauaugaucaagggggaccuguagagauccuuccauuuuuguaccuggguucugcuuaccaugccagcaaaugcgaguuccuagcgaaucuccacauuacggcccugcuuaacgugucccgucgcaccucagaagcaugugcuacacaucugcacuauaaguggauccccgucgaggacagucauacugccgauauuagcucucacuuucaggaagcuaucgacuucauagauugcgugagagagaaaggcgggaagguuuuggugcacugugaagccggaaucuccaggucaccuaccauuugcauggcauaccucaugaaaacaaagcaguuucggcugaaggaggccuucgacuauaucaaacagcgacgcagcauggucaguccaaauuuuggcuucaugggucaguuacugcaguacgagucugaaauucucccguccacccccaacccucagccacccagcugucaaggggaggcugcgggaucgucucuuaucggccaucugcagacuuuguccccugauaugcagggcgcauauugcacauuuccagccucagugcuagcucccguaccgacccacaguacgguuagcgaacuguccagaucuccuguggccacugcaaccagcugcuga

SEQ ID NO: 55550 - RNA, 1146 nt, Artificial Sequence
  derived and/or modified sequence opt3 from DUSP6__Homo_sapiens__NP_001937
augaucgacacccugagacccgugccuuucgccagcgagauggcuauuuccaagacagucgcauggcucaacgaacagcuugagcugggcaaugaaagguuguuacugauggauugccggccacaagagcuauacgaaucuucacacauagagagugccaucaacguugcgauuccggggaucaugcuccgccgacugcagaaaggaaaucuucccgugcgugcucuguuuacuagaggugaggacagggaucgguucacgcgcagauguggcaccgacacaguaguguuguaugaugaaagcuccucugacuggaacgagaauacugggggagaaucgguccucggccugcugcucaagaaauuaaaggaugaggguugcagggccuuuuaccuggaagggggauucucaaaauuucaggcagaguucagccuucauugugagaccaacuuggacggcaguugcuccucuagcuccccuccacugcccgugcuaggccucgggggacugcggauuucaagugauucuagcuccgacaucgaaucagaucuugaccgcgauccuaauagcgccacagacagugacgguucuccacuguccaacagccagcccucguuuccuguugagauauugccauuccucuaucugggcugugcuaaggauucuaccaauuuagacgugcuggaagaguuugggaucaaguacauucucaacgucacuccgaaucuucccaaccuguucgagaaugcaggagaauuuaaauauaagcaaaucccuauuuccgaucacuggucacagaacuugagucaguucuuuccagaggccaucagcuucauagacgaagcucgaggcaaaaauugcggugugcuaguacauugucuggccgggauuuccagaucuguuacagugaccgucgcguaccucaugcagaagcugaaccuuagcaugaacgaugcauaugacaucgugaaaaugaagaagucaaauauuagucccaacuucaauuuuaugggacaacuguuggauuucgagaggacgcucggccuguccagcccuugcgacaaccgggugccagcccagcaguuauacuuuacuacccccucuaaucagaacgucuaccaaguugauucacugcagaguacauga

SEQ ID NO: 55551 - RNA, 1260 nt, Artificial Sequence
  derived and/or modified sequence opt3 from DUSP7__Homo_sapiens__NP_001938
augaagaaccagcugagagggcccccugccagggcucacaugagcaccuccggcgcagccgcggcuggagguacacgggccggcucugagccaggggcaggaucaggcaguggugccgggacuggagcuggcgcagccacgggcgcuggggccaugccgugcaaaagcgcggaauggcuccaagaggaacuugaggcacgcggaggugccucccuguuguuacuggacugucgaccccaugaacuauucgagucuucgcacaucgagaccgcuauuaaucucgccauaccuggccugaugcuucguagacugaggaaggggaacuugccaauccggucaauuauccccaaucaugcagauaaagaacgcuuugcuacaagaugcaaggccgcgacugugcuccuguacgacgaggccaccgcagaauggcagccugagccaggagcucccgccagcguccugggccucuuacugcagaaacuuagggaugacgguugucaggcuuauuacuugcaagggggauucaacaaguuucagacagaguauagugaacacugcgagaccaauguugauuccucuagcuccccuucaaguagcccaccgacuucugugcugggccuaggcgggcuccggauuuccucagacuguagcgauggagaaagugaccgcgagcugcccucuuccgccacagaaagcgaugguucgccuguaccaucuucccagcccgcauucccugugcagauccuuccauaccuguauuugggcugcgccaaggacucaaccaaccucgauguccuggggaaauacggaauaaaguauaucuuaaaugugacgcccaaccugccgaaugcuuuugagcauggcggugaguucacuuacaaacaaauuccuaucagugaccacuggagccagaaccucucccaguuuuuccccgaagcgauuucuuuuaucgaugaggcacgaagcaagaaaugugggguucuugugcacugccuggccggcauaucaagaagugucaccgugacaguagcuuacuugaugcagaagaugaaucuaucccugaacgacgccuaugacuucguuaagaggaaaaagagcaauauuucuccaaacuuuaauuucaugggacaacuccuggauuuugaacggacucuuggccugucaaguccuugugacaaccaugcaagcuccgagcaguuguacuucucuacccccacaaaccacaaucucuucccacugaacaccuuagaaucgacguga

SEQ ID NO: 55552 - RNA, 1878 nt, Artificial Sequence
  derived and/or modified sequence opt3 from DUSP8__Homo_sapiens__XP_011518235
auggccggcgacagacugcccaggaaggugauggaugcuaaaaagcucgcaagccuucugcgggguggaccugguggcccauuggucaucgacucccgcucuuucguugaguacaacucauggcacguguuaaguagcguaaauauuugcuguuccaaacuggugaagcgacgucuacagcaagggaaagucaccauagccgaacucauccagccggcggcuagaucucagguggaggccacagaaccccaggauguuguggucuaugaccaaucgacuagggaugcaucagugcuggccgcugacagcuuucuuaguauucuguuguccaagcucgauggaugcuucgacucuguagcaauccugacgggcgguuuugccaccuucagcuccuguuuuccugggcugugcgagggaaagccagcugcccucuuacccaugucacugagucagccuugucuuccaguucccagcgugggcuugacacggauucugccucaucuauaccucggcucucagaaagauguccugaacaaggaccuuaugacucagaaugggaucuccuaugugcugaacgcgucaaauagcugcccaaaaccggauuucauaugugaaagucgcuuuaugagagugcccaucaacgacaauuacugcgagaaguugcucccuuggcuggauaaaucuauugaguucaucgacaaggcaaaguuauccagcugucaagucauuguucacugccuggccggaaucucgaggucugcuaccauagccauugcauauaucaugaaaacaauggguauguccucagacgaugcuuaccgguuugugaaggaccgccgaccaaguauuagccccaacuucaauuuucucggccagcuucuggaauaugagagauccuugaaacuacuggccgcgcuccagggggauccuggaaccccaucuggcacucccgaaccgccucccagcccagccgcaggggcuccucugcccaggcuuccacccccuacaucagagagugccgcuaccgggaacgccgcagcccgggagggaggccuguccgcuggcggggaaccaccggcgcccccuacgccacccgcaacuagcgccuugcagcaaggacuccguggucugcauuuaucuucagaccgccugcaggauaccaauagacuaaagaggaguuucagccucgacaucaaauccgcuuacgccccuucucggcgaccagauggccccgggccgccugacccaggagaggcacccaagcuguguaaacuugauucgccuagcggcgccgcuuugggucuguccucacccaguccagacucuccugaugccgcacccgaagcgcgcccaagaccgaggcggcgcccuagacccccagcugggagccccgccagguccccugcacacucacucggccugaacuuuggagacgccgcucgucagacaccacggcauggccuuagcgcccugucugcacccggguugccuggaccgggucaaccagcuggccccggggccugggcgccuccacucgacucccccggaacuccuaguccggauggccccuggugcuucagcccagagggugcccagggggcuggcggaguacuguucgcaccuuuuggccgagccggggcucccggaccagguggcgggucugacuuaagaaggcgcgaagccgcacgggcggagccuagagaugccaggaccggauggcccgaggaaccagcuccggagacacaguucaagcgccgauccugccagauggaauuugaggaaggcaugguggagggucgggcccguggggaggaacuggcagcucuaggcaagcaagccucauucaguggaagcgucgaggugaucgaaguuucguga

SEQ ID NO: 55553 - RNA, 1248 nt, Artificial Sequence
  derived and/or modified sequence opt3 from DUSP9__Homo_sapiens__XP_011529425
auggaggccgcucaggugggccccaaggggagacaacugccuggaaaacacgucguugcaccagugguacagaggguggguagccgguccccgauggaaggccucgggcgcucuugccuuuggcugcgacgugaguugucacccccuagaccaagguuacugcuacucgacugucggagucgcgaacuguacgagagcgccagaaucggaggcgcgcuuuccgucgcucugcccgccuugcuccugaggcggcugcgccgagguucucucucggugagagcauuacugccugggccaccccuucagccuccaccgcccgccccuguuuugcuguaugaucagggaggcggcaggcggcgucgcggggaagcugaggcagaggccgaagagugggaagcugagucagugcuaggaacccuccugcaaaagcugagagaggaagguuaccuugccuauuacuugcagggcggguucagcagguuucaggcggagugcccacaucucugugaaacaagucuggcaggacgggccggcuccucuauggcucccgucccugguccagugcccguaguuggguuaggaagccugugccucggcuccgacuguucagaugccgagagugaagcagaccgagauagcaugucuugcggccuugacuccgagggggcuacuccgccucccgugggacugcgcgccucauucccaguccagauuuugccuaaccuauaucuggguagcgcgagagauagugccaaucucgagucucuggcaaaacuuggcauaagguacauccugaacgugacgcccaauuugccaaacuuuuucgaaaagaauggggacuuucacuauaaacaaauucccaucuccgaucauuggagccagaaccucucgcgguucuuuccugaggcuauugaguucaucgacgaagcccugucucagaauuguggaguguuaguccacugccuggcuggcguuucccgcucagugaccguaacaguggccuaccuaaugcagaagcuccaucugagucuuaacgaugcauacgacuuggucaagaggaaaaagagcaauauauccccaaacuuuaauuucaugggucaacugcucgauuuugaaagaucucugcgucuugaggagcggcacagccaggaacaggggucaggcggacaagccagugcugcguccaacccgcccagcuucuuuacuaccccuacaucugacggcgcauucgagcuggccccaaccuga

SEQ ID NO: 55554 - RNA, 759 nt, Artificial Sequence
  derived and/or modified sequence opt3 from DUT__Homo_sapiens__NP_001020419
augacaccccugugcccuagaccagcccucuguuaccacuuccuuaccagccuguugagguccgcuaugcagaacgcacggggcgcccgccaacgagcggaggcugccguguuaucugggccgggacccccucugggucgugcagcccagcauggcaucccaagaccccuaucaagugcugggaggcucagccagggaugccggggcgcauccacugucggugccgcuggguggaagggagaacugccuaaagccggcggcucuccagcgcccgggccugagacgccagcaauuucgccgucaaagcgcgccagacccgcugaaguuggagguaugcagcuuagguuugcccggcugagcgagcacgcaaccgcuccuacacgcggcagugcccgagcggccggguaugacuuguacuccgcauaugauuacacuauaccacccauggaaaaagcugugguaaagaccgacauccaaauugcccucccuucuggauguuauggcagaguggcuccaaggagcggucuggccgcaaaacauuucaucgaugucggggccggagugauugacgaggauuaccggggcaauguuggcgugguccuguuuaacuucgggaaggagaaguuugaagugaaaaagggagaccguaucgcucagcucauaugcgagcgcaucuucuaucccgaaauugaggagguacaggcguuagaugacacagaaagagguuccggcggguuuggaucaaccggcaaaaauuga

SEQ ID NO: 55555 - RNA, 483 nt, Artificial Sequence
  derived and/or modified sequence opt3 from DUX4__Homo_sapiens__XP_011529816
auggcccugcccaccccuagcgacuccacacucccagcugaggcaagaggcagggggcggcgccgacgucuuguguggacuccgucucagucagaagcccugagagcgugcuucgagaggaaccccuacccuggaaucgcuacgcgggaacgcuuggcccaagcaauugguauaccagagcccagaguccagaucugguuucagaaugaaaggagucggcaguuacgccaacaccgaagagagagcaggccuuggccaggccggcgugggcccccugagggacgcagaaagaggaccgccguuacaggcucccagacugcucugcuacuccgggcauucgaaaaagaucgauuuccagguauugccgcucgcgaggaacuggccagagagaccgggcuuccggagucuaggauccagauuugguuccagaaccggcgcgcgagacaucccggacaaggcggcagggccccugcacagguguga

SEQ ID NO: 55556 - RNA, 2211 nt, Artificial Sequence
  derived and/or modified sequence opt3 from DVL2__Homo_sapiens__NP_004413
auggccggcagcuccaccgggggagguggcgugggggagacaaaggucaucuaccaccuggacgaagaggaaacucccuaucucguuaaaauuccugugccagcugagagaauaacgcuuggagauuucaagucuguacugcagaggccggcaggcgccaaauacuuuuucaagucaauggaccaagauuuugguguggucaaagaagagaucagugacgauaacgcgcgguugcccugcuucaaugggcgcgugguuagcugguuaguguccucugacaacccucagccagagauggcucccccuguccaugaaccacgagccgagcuggcacccccugccccaccgcuacccccucucccacccgaacguaccucgggaauuggcgauucaagaccucccagcuuucaccccaaugugaguuccucucaugagaaccuggagccggaaacagagacugaaagcguaguuucccuuaggcgggagcgcccuagaaggcgggacucaagugaacacggcgcugggggacaucgcaccgguggccccagccgacuggagagacacuuggcaggguaugagucuuccucaacacucaugaccagcgaacuggagaguacuucucugggagauuccgacgaagaggauacaaugagcagguucucgucuuccaccgaacagucaagugccagccggcucuuaaagcgucaccgcagaaggcggaagcagcgaccaccucgccuggagagaacguccucuuuuagcucagugacugacaguaccaugucccuuaauaucauuacagucacuuugaacauggagaaauacaauuuccugggcaucagcauagugggucaaucuaacgaaaggggagaugggggcaucuauauuggcucaaucaugaaagggggagcuguggccgcggacggucggauugagcccggcgacaugcuacuccaggucaaugauaugaacuuugaaaauaugaguaacgacgaugcaguucgcgugcugagagacaucguacauaagccagggcccauagugcuuaccgucgccaaguguugggauccuagcccacaggcuuacuucacacugccgaggaaugagcccauucagccuaucgacccagccgcaugggugucccacucugcugccuugaccggaacguuucccgcguauccuggcucgagcuccaugucaacuauuacaagugguucuagccucccagaugggugcgaaggccguggacuguccguucauaccgacauggccucagugacuaaagcaauggcugcccccgagagcggcuuagagguccgggaucgaauguggcugaagaucacaaucccgaacgcuuuccucgggucugacgugguagauuggcuuuaccaccacguugaaggauuuccugagagaagggaagcccgcaaguacgcauccggucuguugaaagccggccuaauucggcauaccgugaauaagauaacguucagugagcaauguuauuacgucuucggggaccugagcggaggcugcgagucuuaucucgugaaccugucccuuaacgacaaugaugguucaaguggggcuagcgaccaggauacccuggcgccauugcccggcgcaacaccuuggccccuccugccaacuuuuucguaccaguauccugccccacacccauacuccccgcagccucccccauaucaugaauuaucuagcuacaccuacggaggcgggucagcuaguucccaacacucugagggaagcagauccucagguagcacaaggagugacggcggggccggacgcacuggccgacccgaggaacgggcaccugaaucuaaauccgguagcgggucggagucagagccaucuagucguggcggaucccugagaaggggcggggaagccagcggaaccucugauggcggucccccuccgagccgcggguccacaggaggcgcuccaaaccuacgggcccaucccggucuccacccuuauggcccacccccugggauggcacugccguacaaucccaugauggucgugaugaugccaccucccccaccucccguuccaccggcggugcagccucccggagcuccacccguaagagaccuuggcucagucccuccagaguugaccgccaguaggcagagcuuccacauggcaauggggaaccccucugaauuuuucguggauguuauguga

SEQ ID NO: 55557 - RNA, 2151 nt, Artificial Sequence
  derived and/or modified sequence opt3 from DVL3__Homo_sapiens__NP_004414
augggcgagaccaagaucauuuaccaccuggacgggcaggaaacacccuaucucgugaaacuuccucugccagccgagagagucacuuuggcugauuucaagggaguuuuacaaaggccgagcuacaaauuuuucuuuaaguccauggacgaugacuucggugugguaaaagaagagauaucugaugacaacgcaaagcugcccugcuuuaauggccggguggucucauggcuagugagugccgaagggagccauccugauccagcgcccuucugugcugacaacccuuccgagcucccacccccuauggagcgcacgggaggcaucggugauucucgaccaccgucguuucacccccaugccgggggaggcucacaggaaaaucuggacaacgauaccgagacagacagccuuguuagugcacagcgugaaagaccuaggcggcgcgauggcccagagcacgccacuagacugaaugggaccgcuaagggagagaggcggcgcgaacccgguggcuaugacuccucuagcacauugauguccucagagcucgaaaccacaaguuucuuugacagcgaugaggacgauucuacuucccgauucucaagcaguaccgaacagucuuccgcaagcagacugaugaggcggcauaaacgucgcagaaggaagcaaaaagugucgcggauugagcgaucuuccucauuuaguagcaucacggacuccacuaugucucugaacauuaucaccgucacacucaauauggagaaguacaacuucuuagggauaagcaucgugggacagucaaaugaacgcggcgauggugggauuuauaucggaaguauuaugaaaggcggcgccguagcugccgacgggagaaucgagccuggagauaugcugcuucagguuaacgaaauaaauuuugagaacauguccaaugacgaugcggugagggucuugcgggaaauugugcacaagccaggucccaucacucugaccguggcaaagugcugggacccgagcccucgcggcuguuucacacuacccagaucugagccaauuaggccuaucgaucccgccgcuugggucucacacaccgccgcaaugacggggacuuucccagcuuacggaaugagucccagccucuccacaaucaccucuacuucgagcuccauuacaucaaguauaccugacaccgagcgucuggacgauuuucaucuuucuauccacagcgacauggccgcgauuguuaaagccauggcauccccagaaucaggccuggaggugcgggaucgaaugugguugaagaucacgauaccgaacgcuuucauugguagcgacguaguggauuggcucuaucauaaugucgaaggguuuaccgacagaagggaggcccgcaaauacgcuucuaaccuguuaaaggccggcuucauccggcacacagugaacaaaaucacuuuuuccgaacagugcuacuauauuuucggagaucuguguggcaauauggcaaaccucagucuucacgaccaugaugggagcucuggagccuccgaccaagauacccuggcucccuugccucacccaggugcggcacccuggccuauggccuuuccauaccaguaucccccgccuccacaucccuacaauccucaccccggcuucccagagcuaggguauucauacggaggcgguagugcuagcucgcagcauuccgaggggucuagaagcucaggcaguaacagguccggaucugaccgccgaaaggaaaaagauccuaaggccggcgacagcaaguccgggggaucagguagcgagagugaccacacaacucggucuucccugcguggccccagagaaagggcaccaagcgagcgcucggggccggccgcuucagagcacucucaucggagucaccauucccucgccagcucucugagaagccaccacacccauccuuccuauggacccccaggcguucccccucuuuacgguccacccaugcugaugaugccuccgccacccgcagcgauggggccuccaggcgcucccccuggaagggauuuggccucagugccgcccgaacucacagcaagucgacagagcuuucgcauggccaugggcaauccaucugaguucuuugucgacgugauguga

SEQ ID NO: 55558 - RNA, 1191 nt, Artificial Sequence
  derived and/or modified sequence opt3 from DXO__Homo_sapiens__XP_006715068
auggaccccagaggcaccaagaggggcgccgagaaaacagaaguggcugagccucggaacaagcugccacgcccggcacccagccucccuacugauccagcccuuuacuccggacccuucccuuuuuaucgacguccaucugaacuggguugcuucucauuggacgcgcagagacaauaccacggcgaugcuagggccuuacgguauuacagucccccuccaacgaaugggccgggacccaacuuugaccugcgcgauggcuauccugacagauaccagccaagggaugaggaaguccaggagcggcuagaccaucuccuguguuggcuucuggagcaccgcggucgauuggaagggggacccggcuggcucgcagaggccaucguuaccuggagaggccaucugacaaaacugcucacuaccccuuaugaaaggcaggagggguggcaauuagcugcaagccgguuccagggaacacuguaccuuuccgagguggaaaccccaaaugcccgugcucagcgcuuggccagacccccgcugcuaagggagcucauguacauggguuauaaguuugaacaguacaugugcgcggauaaaccugggucuucgcccgacccaucaggggagguaaacacuaauguggcauucuguagcguccugcggagucgacuuggaucccacccucuguuguuuucuggcgaaguggauugcacagacccccaagccccaagcacccagcccccuacguguuauguugagcucaagacuuccaaggagaugcauucaccaggucaguggcgcaguuucuacagacacaaacuguuaaaguggugggcucagagcuuucugccgggggugcccaacgucguggccggauucaggaauccugauggcuuuguaucuucccucaaaaccuucccaacaaugaagauguuugaauauguucggaacgaccgcgacggcuggaaucccucagugugcaugaacuucugugcagcuuuccuuagcuuugcccaaaguacugucgugcaggaugacccuagacuggugcacuuguucucuugggagccagggggacccgucaccguuuccgugcaucaggaugcgccguacgccuuucuaccuauuugguauguagaagcaaugacacaagaccugccaucgcccccuaaaacccccagcccaaaguga

SEQ ID NO: 55559 - RNA, 2010 nt, Artificial Sequence
  derived and/or modified sequence opt3 from DYM__Homo_sapiens__NP_060123
augggcagcaacuccucuagaaucggggaccugcccaagaaugaguaccucaaaaagcugucaggaaccgaaaguauuagcgagaacgauccuuucuggaaucagcuuuuguccuuuucuuucccagccccgacaucgucaagcgaauuaaaacugcuagaggaagcuacuauaagugugugcaggucccucgucgagaacaauccccggacggguaaccugggcgcacuuaucaagguuuuucugucucgcaccaaagaguugaagcucagcgccgaaugucaaaaucacauuuucaucuggcagacacauaacgcgcuguuuauuaucugcugucugcucaagguguucauaugccagauguccgaggaagaguuacagcugcacuuuacuuaugaggaaaaaucaccugggaauuacaguagcgacucugaggaucuuuuggaagaacugcuauguugccucaugcaacugaucaccgacauuccacuucuggauaucacauaugaaauuuccguagaggcuaucucaaccaugguggucuucuugagcugucagcucuuucauaaggaggugcugcgacagaguauaucucacaaauacuuaaugcguggacccugccugccuuauacuuccaagcucguuaaaacacuucuguacaacuucauuagacaggaaaagccacccccuccaggcgcccauguguuuccgcaacagagcgacggugggggauugcuauauggccuggcaucgggcgucgccaccgggcucuggacgguguucacucugggagguguaggcucuaaggcugcagccucccccgagcuuucaaguccucuggcuaaucagagcuugcuccuguuacugguucuagccaaccucaccgaugcguccgacgcaccaaaucccuacaggcaggccaucaugucuuuuaaaaacacacaagauagcucaccuuucccaaguuccauuccccacgcuuuccagaucaauuuuaacagccuguacacugcccuuugugaacagcaaaccucugaccaggcaacauugcugcucuauacccugcuucaccagaacucaaauauccggacguacaugcuggcucgcacugauauggagaacuuggugcucccgauucuggaaauauuauaucaugucgaggagagaaauagucaccauguguacauggcccugaucauucuacucauccugacagaagacgauggguucaacaggagcauacacgaggugauucuuaagaauaucaccugguauuccgaacgggucuugacugagaucucucugggaucgcuccugauuuuaguugugauccgcacaauucaguacaacaugacccgaacgagagacaaauaucugcacaccaauugccuugcggccuuggcaaacaugagcgcucaauuuaggucccuccaucaguacgccgcucagcggauaaucucacuguucagucuacugucuaagaaacacaauaagguacucgaacaggccacacaaagccugcguggcucccuuucaagcaacgacgugccuuugcccgauuacgcacaggaccugaaugucauugaggaggugauccgcaugauguuagaaaucauuaacucuugucucacuaauucccugcaucacaacccaaaucuuguuuaugcccuguuguacaaaagagaucucuuugagcaguucaggacccauccuaguuuucaggacauaaugcaaaacaucgaucuggugauuagcuucuuuucuucccggcuacugcaggcuggugcggaacucucagucgagcgagugcuggagaucauuaagcaggggguaguugcacuucccaaggaccgcuugaaaaaguucccagaacugaaauuuaaguauguggaggaggagcagcccgaagaguucuuuaucccuuacgucuggaguuuaguguauaacagcgccgucggacucuacuggaauccacaagauauacagcuguucacaauggacucggauuga

SEQ ID NO: 55560 - RNA, 633 nt, Artificial Sequence
  derived and/or modified sequence opt3 from DYNAP__Homo_sapiens__NP_775900
augguggccgacaucaagggcaacgagcagauugaaaaauacagcuggagagaggcuugcgauaccggguccucuaggauggaccggaagcacggaaaauauauacugaaugucgaacauucagagaaccaacccccuaucacacacccaaaugaucaggaagcacauaguagcauuuguuggugccucccguccaacgacaucacuucugauguuucgcccaaucuuacggguguguguguaaacccuggcauucuggcccacucacgcugcuugcagagcgagaguuguaauacccaggugaaggaguacugccgaaacgacugguccauguggaaagucuucuuagcgugucugcuagcuugcgugaucaugacagccauagggguucucaucauuugucuggugaauaacaagggaucugcaaauagcuccaucgucauucaacuuucaacuaacgauggcgaaugcgugaccguaaagccagguacacccaguccugccuguccacccaccaugacuacaaccagcacgguuccugcuucuacugcaaccgaguccacaacuucaaccgccacagcugccaccacgagcacugaaccaaucacaguggcgccgaccgaccaucuguga

SEQ ID NO: 55561 - RNA, 13941 nt, Artificial Sequence
  derived and/or modified sequence opt3 from DYNC1H1__Homo_sapiens__NP_001367
augagcgaacccggcgggggagguggcgaagacggguccgccggacuggaggugucugcuguccagaacguugccgaugugucagugcuccaaaagcaccuuagaaaacuggugccuuuguuacuggaagacggcggugaggccccagcggcucuagaagccgcacucgaggagaagagugcccuggaacagaugaggaaauuccuuagcgauccgcagguccauacagugcugguugagcgguccacauugaaggaagacgugggggaugagggagaggaagagaaagaauuuaucucuuacaauauuaacauagacauccacuauggcgucaagagcaauucacucgcuuucauuaagcgcacucccgugaucgaugcagacaaaccuguaagcagucagcugcgaguucugacgcucuccgaggauucuccauacgaaaccuuacauagcuuuauuuccaacgccguggcucccuucuuuaagucauauauccgugagaguggcaaagccgacagagauggggacaagauggcgccuagcgucgagaaaaagauagcagaacuggagaugggacuuuugcaucugcaacagaauaucgaaauuccagagaucucucuacccauucauccuaugaucacaaacguggccaagcagugcuacgaaaggggugagaaaccaaaggugacugauuucggcgacaaagucgaggacccgaccuuucucaaucagcugcaauccgggguuaaccgguggauacgcgaaauucagaaggugacaaaacuugauagagaccccgcuucaggaaccgcccugcaggagaucagcuucugguugaaucucgaaagggcacuguaucggauucaggagaagcgcgaaaguccugagguauuacugacucucgauauccuuaaacacggcaagcgauuucacgcuacagugucuuucgacaccgauacgggucugaagcaagccuuggagacugucaacgacuacaauccacuaaugaaagauuuuccccugaacgaccuccuguccgcgaccgaacuugauaagaucagacaggcccugguggcaauuuucacacauuugaggaaaauacggaauacuaaguauccuauccagcgugcucuccgccugguugaggccauuagcagagacuuaucgucucaacugcuaaaagugcucgggaccaggaagcugaugcacgucgcuuacgaagaguuugagaaggugaugguagccuguuucgaaguuuuccagacaugggaugacgaguacgaaaaacuucagguguugcugcgggacaucgucaagcgaaaacgcgaggaaaaccucaagaugguguggagaauaaauccagcacauaggaaacugcaggcccggcuugaucaaaugcgcaaguuuagaaggcagcacgagcagcugcgugcugucauugugcggguuuugcgaccccaggugaccgcgguagcacaacagaaccagggagaggucccggaaccucaggacaugaagguggccgagguucucuucgaugcugccgacgcaaacgccaucgaagaggugaaucuggcuuaugaaaacgucaaagagguggauggcuuagacguauccaaggagggcacggaagccugggaggcagcgaugaaaagauacgaugaaaggaucgaccgcguggagacucggauuacagcuagacugagggaucaacuagggaccgccaagaaugcaaacgaaauguuucgcaucuucucacgauuuaaugcccucuucguucggccccacauucguggagcuauaagagaguaucagacucagcugauccagagggucaaagacgauauugagagucuucaugacaaguuuaaggugcaauacccacagagccaggccugcaaaaugucccacgugcgcgauuugccucccgucucugguagcaucaucugggcaaagcaaauugaccggcagcugacagcuuauaugaaaagaguugaagacgugcucggcaaggggugggagaaccauguggaaggacagaaacugaagcaggauggcgacucauucaggaugaaauuaaauacccaagagauauuugaugacugggcccgaaagguacagcagcgcaaccugggugucagugggcggaucuucacgauugaguccaccagagugaggggccguacaggaaauguucuuaaguugaaagugaacuuucucccagaaaucauuacucugagcaaggagguccgcaaucuaaaauggcugggcuuccgggugccccucgcgaucguuaacaaggcccaccaggcuaaucaacuguacccuuuugcaauaucucuuaucgaaucagugagaaccuaugagaggacaugugaaaaaguagaggagcgaaacacuauuaguuugcuggucgccggguuaaagaaggaagugcaggcucucaucgccgagggaauugcacuggugugggaaagcuacaaacuugauccauacguccagcggcuggcggagaccguuuucaauuuccaggaaaagguggacgauuugcucaucauagaggagaaaauugaccuggaaguacgcucccuagagacaugcauguaugaucauaagaccuuuucugaaauccugaacagagugcaaaaagccgucgacgaucucaaccugcacucguacagcaaucuuccgauuugggugaacaaguuggacauggagaucgaaaggauacuggguguucgguuacaggcuggccuccgagccuggacucaggugcugcuugggcaagcagaggauaaggcugaggucgacauggacacggaugccccacaagugucccacaaaccuggaggcgaaccaaagaucaaaaauguugugcaugagcugagaauuacaaaccaggucaucuaucuaaaucccccuauugaagagugucgcuacaagcucuaucaggagauguucgcauggaaaaugguagugcugucauugccaaggauccaaagucagcguuaccagguuggugugcacuaugaacugaccgaggaagagaaguuuuaccggaacgccuuaacuagaaugcccgacgggccggucgcucucgaagagucuuacagcgcggugaugggcauaguauccgagguggaacaguaugucaagguuuggcugcaauaccagugccuuugggauaugcaggccgagaauauuuauaacaggcugggagaagacuugaauaaauggcaggcacuccuggugcaaauccgcaaggcucgaggcaccuucgauaacgccgagaccaagaaggaauuugggccuguggucaucgacuacggaaaagugcagucaaagguuaaucuaaaauaugauagcuggcauaaggagguacugucuaaguucggucagaugcuuggcuccaacaugaccgaguuucacagucagauuagcaaaucuagacaagaacucgagcagcacuccguggacacugccucaacaagugaugcugucacguucaucaccuacgugcagagccugaagcggaaaauuaagcaauuugaaaaacagguugaguuguauaggaaugggcagcgccuguuagaaaagcagcguuuccaauuuccacccucguggcucuacauagacaacaucgagggagaguggggcgcauucaaugauauuaugagacggaaggacuccgccauccagcaacagguggcgaaccugcaaaugaaaauuguccaggaagacagggcuguggagucucgcacuacagaucuucugaccgacugggaaaagacaaaaccuguaacugguaacuugcgacccgaggaggcccuccaggcacugaccaucuacgaagggaaguuuggcagacuaaaagaugaccgggagaagugugccaaggcuaaagaagcacuggagcuuacggauaccggacuccugagcggcucagaagagaggguccagguggccuuggaggaauuacaagaccugaaggggguuuggagugagcucuccaaagugugggaacagauagaucagaugaaggagcaaccaugggucucugugcagccucgcaaacugagacagaaucuugacgcgcuguugaaccagcuaaagagcuuccccgcuaggcugcggcaauaugccuccuacgaguucguucagcgucuccugaagggauauaugaaaaucaauaugcuugugauugaguuaaagucagaggcacugaaagaucgccauuggaagcagcucaugaaacgauugcacgucaacugggugguaagcgaacugacacucggccagaucugggacguggaucugcaaaagaaugaggccauuguuaaggacguccuucugguggcucagggugaaauggccuuggaggaauuucuaaaacagaucagagagguguggaacacuuacgagcuggaucucgucaauuaucagaacaagugcagguuaauacgggggugggacgaccuguucaauaaaguaaaggaacauauuaacagugugucugcaaugaaacuuuccccauacuauaagguuuuugaggaagaugcucugagcugggaggacaaacucaaucgcaucauggccuuguucgauguguggaucgacguccaaagaagguggguguaccuggagggaauuuuuaccggcucggcggauauaaagcaccuccugccgguugaaacacagcgguuccagucaaucucuacugaguuucuugcccuaaugaagaaagugaguaaguccccucuggucauggacguguugaacauucaggguguacaaagaucguuagaaagacuggcagaucuccugggcaaaauccagaaggcucuuggggaguaccuggaacgcgagaggucuagcuucccccgguuuuauuucgugggagacgaggaucucuuggaaauuaucggcaauuccaaaaacguugccaagcugcagaagcauuuuaaaaagauguucgcuggggucucaaguauaauccuaaaugaggacaacagcguggugcugggaauuucuucccgugaaggcgaggaagucauguucaaaaccccaguuucaaucacggagcaccccaagauuaacgaguggcucacacuuguggaaaaagagaugagaguaacccuggcaaaguuauuggccgaaagugugacugaggucgaaaucuuugguaaggccacaagcauagauccuaauaccuacauuacuuggaucgacaaauaucaagcucagcuggugguucucuccgcgcagaucgcauggucugagaacguggagaccgcccugucgagcaugggagggggcggugaugcugccccacuucacucaguccuguccaauguagaagugacacucaacguuuuggcagacagugugcugauggagcagcccccuuuaaggcgccggaagcuagaacaucugauuacggagcucguccaccaacgagacgugaccagaucucuuaucaaaagcaagauagauaaugccaaauccuucgaguggcugucacagaugagguuuuacuucgacccgaagcagacugaugucuugcagcaacugucuauucagauggcuaacgcgaaguuuaauuauggcuucgaauaccucggggugcaggacaaacugguucagacaccacuuaccgaucgcuguuaucucacaaugacucaagcccuggaggcacgguugggaggcagccccuuugggccugcuggaaccggcaagacggaaagugugaaagcccugggucaucaguuagggagauucguccucguguuuaacugcgacgagacauucgauuuucaggcaaugggacguaucuucgucggccugugucaaguuggugccuggggcugcuuugacgaguucaauaggcucgaggagcggaugcuuuccgcugugagccagcagguccagugcauucaagaagcccugcgcgagcacucuaacccaaauuacgauaagaccucagcgcccaucacuugugaauugcugaacaaacaggugaagguauccccugacauggcaauauucauuaccaugaauccgggguacgccggacgaaguaaccuccccgauaaucugaagaaacuuuuucgaagccuagcuaugacaaaaccagacaggcagcugaucgcccaggugaugcucuauucgcaaggcuuccggacugcugagguuuuggcaaacaaaaucgugccauuuuucaagcugugcgacgaacagcuaucuucccagagccauuacgauuuugggcugcgcgcccucaaaucaguccuugugagugcuggaaaugucaagagagagaggauucagaaaaucaagcgagagaaggaagaacggggcgaagccguggacgagggugaaauugcagagaaccugcccgagcaagaaauauugauccagucuguuugugagaccaugguaccaaaacugguggcggaagauauuccucuccuguucuccuuacuuagcgacgucuuucccggggugcaguaucaccguggagagaugacagcccugagagaggaacucaagaaaguuugccaagagauguaccuaacguauggcgauggcgaagagguagggggaaugugggucgaaaaggugcugcaguuguaccagaucacccagaucaaccacggucugaugaugguaggcccaucagggaguggaaaaagcauggcuuggcgcgugcuccuuaaggcccuggagagguuggagggcguugaaggugucgcacauauuauagacccgaaggcuaucuccaaagaucaccuguaugggacucucgacccuaauacacgggaguggaccgauggauuauucacucaugugcugagaaagauuaucgacucugugcgcggcgaacuucagaagagacaguggauugucuuugauggcgacguugaucccgaguggguggaaaaccugaauagcguacuagacgacaacaagcuccugacauugccaaauggggagcgacugucccuacccccuaacgugcggaucauguucgagguccaggaucuuaaauacgccacccuggcaacggugucaagauguggaaugguuugguuuucugaagacguguuaaguacugauaugauauucaauaacuuucuggccagguugcgcucgaucccacucgacgagggugaagaugaggcucagcgucggagaaagggcaaggaagacgagggggaggaagcggccagccccaugcugcaaauucagagggaugcagcuaccaucaugcagccuuacuucacauccaauggauuaguaaccaaagcccuugagcacgccuuccagcuggaacacauuauggaccucacucgccugcgaugcuugggcucucuguuuucaaugcuccaucaagcaugucggaacguggcucaguauaaugccaaccacccggauuucccaaugcagaucgagcagcuugagagauacauacaaagguaucugguauacgcgauuuuauggagccuguccggugacagucgcuugaagaugagagcugaacucggggaguauauccggaggauuacaaccguuccccugccuacagcccccaauaucccaauaaucgauuacgaagugucuauuagcggagaguggucaccuuggcaggcaaaagucccccagaucgaaguggagacucauaagguggccgcuccagacgucguugugccuacccuagacacgguacgucacgaggcacuucuguauacauggcucgccgaacauaaaccgcugguguugugcggacccccuggcuccgggaagaccaugacuuuauuuagugcgcugcgagcucucccugauauggaggucgugggacuuaacuucagcucugccaccacacccgaacugcuacugaaaacuuuugaccacuacugugaguaccgcagaaccccaaaugguguugugcucgcaccuguccaauugggcaaguggcuggugcuuuucugcgaugaaauuaaccugcccgacauggauaaguaugggacgcagcggguaaucuccuuuauaaggcagaugguugagcacggaggcuucuaccgcacaucagaccagaccugggugaaacucgagaggauucaauuugucggugccuguaacccgccaacugauccugggcggaagcccuuaagccauagguuccugcgacacgugccaguuguguaugucgacuaccccggaccugcuucguugacacagaucuauggcaccuuuaaucgugccaugcugagacucaucccgucucuucgcacuuacgcagaaccccugacagcugccaugguggaguucuauaccaugagucaggaacgguuuacgcaggauacucaaccacauuacauuuacuccccuagggagaugaccagauggguacgcggcaucuucgaagcgcuacggccccuggagacacucccuguggagggguugauaaggauuugggcccacgaagcacugcgacuuuuccaggacagacuggucgaggaugaagaacggagguggaccgacgagaacaucgauacaguugcuuuaaaacacuuuccaaauauugaccgcgaaaaggccaugagccgucccauccucuauucaaacuggcuguccaaagacuacauaccuguggaucaggaggaauugagagacuaugucaaggcacgacugaagguguucuacgaggaagaacucgauguaccacuugugcuguuuaaugagguucuagaccaugugcugaggaucgaucggauuuuccgccagccccaaggacaccucuugcugaucggugucucuggcgcugggaaaacuaccuuaagcagauuuguggccuggaugaacggacuuaguguuuaucagauuaagguccauaggaaauacacgggcgaagacuucgaugaggaccugcggacagugcuccgcagauccgguugcaagaaugagaagaucgccuuuauuauggaugagagcaacgugcuggacucuggguucuuggaacgaaugaauacucugcucgcgaacggagagguaccgggccuuuuugagggcgaugaauaugcuacccugaugacacagugcaaggagggggcacaaaaggaaggacuaaugcuggacucacacgaggaauuauacaaaugguucaccagucaggucaucaggaaucuccaugugguuuuuacuaugaacccuuccagcgagggucugaaggaucgggccgcuaccucuccagccuuguucaaucguugugugcuuaacugguuuggcgacuggucgacagaggcacuguaccaggucgggaaagaguucacgucaaagauggaccucgagaaacccaauuauauagugccugauuacaugccaguuguguaugacaagcugccccagccgccuagccaccgcgaagccauuguaaacuccugcgucuucgugcaccaaacuuugcaucaggcuaacgcgagacuggccaagaggggaggccggaccauggcaaucacacccagacacuaccuagauuuuaucaaucauuaugcuaaccucuuccacgagaaacgcagugagcuugaagaacagcagaugcaccugaauguggguuuacgaaagauuaaagaaaccguugaccaagucgaggaacugaggcgggaucucagaauaaagucucaggagcuggaggugaaaaacgccgcagccaaugacaaguugaagaaaaugguaaaggaucagcaggaagcugagaaaaagaaagugaugagccaagaaauccaggagcagcuucauaagcagcaagaagucauugccgacaaacagauguccgugaaggaggaucuggacaagguugagccagcggugaucgaagcacagaacgccgucaaaucaauuaagaaacaacaccucguggagguucguaguauggcuaauccucccgccgcagugaagcuggcucuagaaucuaucuguuugcugcucggggagagcacuacagauuggaaacagauacgcuccaucauuaugagggaaaacuuuaucccaaccauuguaaauuucucagccgaggagaucagcgacgcuauacgggaaaagaugaagaaaaacuacaugucuaaucccuccuauaacuacgagauugucaauagagccagucuugcaugcggcccuauggugaagugggcgaucgcccagcugaacuacgcugacauguuaaaacgaguugaaccacugaggaaugagcuccagaagcuggaggaugacgccaaagauaaccaacagaaggcaaacgaaguggagcagaugauccgcgacuuggaagcuagcauugcccgguauaaggaggaauacgcaguccuuauaucggaggcccaggcgaucaaagcugaucuggccgcaguggaggccaagguaaauagauccacggcucuccugaaaucucuaucagccgaaagggagcgcugggaaaagacuagcgagacauuuaaaaaccaaaugaguaccauugcaggagacuguuuacuguccgcugccuucaucgcguaugcuggcuacuuugaucagcagaugcgucagaauuuguucaccacuuggucucaucaccuccaacaggccaacauucaguuucggacagacaucgcaagaaccgaauaucugagcaaugccgaugagcgacuuagguggcaggcuucaucccugccggcagacgaucucugcacagagaacgccauaaugcugaagcgcuucaaucgguaccccuugaucauugacccuagugggcaggcgacugaauuuaucaugaacgaguauaaggauagaaaaauuacgaggaccagcuuccuugacgacgccuuucgcaagaaucuggaaucugcucuaagauucggaaacccacuccuggugcaggaugucgagucauacgaccccguuuuaaauccugugcugaaccgggaagugcgaaggacagguggccgugucuugaucacucucggggaucaggacauugaucugucccccagcuucgugauauuucuuucuaccagagaccccacaguugaguucccuccggaucuguguagucggguaaccuuugugaauuucacugucacgcgcucgucccuccaaagccagugcuugaacgaggugcugaaagcagaaaggccagacguugaugagaagcgaucagaccuucugaaauuacagggagaauuucagcuaagacuccggcaacuggagaagucucuguugcaggcccucaaugaggugaaaggccgcauccuggaugacgauaccauuaucacaacucuugaaaaccugaagagggaggcugccgaagucaccagaaagguggaggaaacagacaucguaaugcaggagguggagaccgucagccagcaauacuuaccccucuccacugcauguaguucaauuuauuucacaauggaaucucugaaacagauacacuuuuuguaccaguauagccuucaauucuuucuggacaucuaccacaacguucuauaugagaauccuaaccucaagggugugacggaucacacccagcggcuguccauuaucacuaaagaccuguuccaggucgcuuuuaaucguguggcccgcgggauguugcaucaggaucacauuacauucgcgaugcuccuggccaggaucaaacuuaaaggcaccguuggagaacccaccuacgacgcagaguuucaacauuuccugcgaggcaacgaaauaguguuaagugcugggagcacaccaagaauccagggacucacuguagagcaggccgaggcagugguccggcuguccugccuaccugccuucaaggauuugauugcuaaggugcaggccgacgaacaauuugguaucuggcuggauucuucaagccccgagcagacgguuccauaucuuuggucggaagagaccccggcgacaccuauuggccaggcuauccacaggcuccugcugauacaggcauuccgccccgacagauugcuugccauggcucauauguuugucuccacuaaucucggggaaaguuucaugucuauuauggagcaaccacuggauuuaacccacaucgugggaacagaggugaaacccaacaccccuguacugauguguagcgucccaggcuacgacgccucaggucacguggaagaucuagcagccgagcagaauacucagauuacguccaucgcuauagggucugcggaaggcuuuaaccaggccgacaaggcaaucaauacagccguuaaaaguggacggugggugaugcucaagaacguccaucuggcucccggcugguugaugcaacuggagaagaaacuucacagccuccagccucaugcaugcuucaggcuguuuuuaaccauggagauuaauccgaaagugccaguuaaccuguugcgcgccgggcgaaucuucguguuugaacccccuccaggagucaaagcuaauaugcucagaacuuucuccucaauucccgugagccguaucugcaagucuccuaacgagcgggccaggcuguacuuucuucuggcgugguuccacgcaauaauucaggaacgccuaagauaugcaccccucggcuggaguaaaaaguacgaguucggugaauccgaccugcggagcgcuugugauaccguagacacaugguuggaugacacugccaaagggaggcaaaauaucucaccagauaagaucccguggucugcacugaagacccuuauggcucaguccauuuauggaggccgaguggacaacgaguuugaucagagacuccugaacacauucuuagagcgccuguuuacgacccggucguucgacagcgaauuuaaauuggccugcaagguugauggucacaaagacauccagaugccugauggcauaaggcgugaggaguucguccaauggguggagcuccugcccgacacucagacaccaaguuggcuugggcugccuaauaacgcggaaagagugcuacucaccacucagggagucgauaugauuucuaagaugcugaaaaugcagauguuggaggacgaggacgaucuggccuacgcugaaacagagaagaaaacccgcacggacuccaccagcgauggcaggcccgcauggaugcggacacuucauacuaccgccucaaauugguuacaccugaucccacaaacacucagucaucugaagcgaacuguugaaaacauuaaggacccucuauuuagauucuuugagcgcgaagugaaaaugggggcuaaguugcugcaggauguaaggcaggaccucgcagaugugguccaggugugugagggcaaaaagaaacaaaccaauuaucuucggacacugaucaacgagcucguuaagggcauacugcccagauccuggagccacuacaccgugccggccgguaugacugucauccaguggguaucugacuucucagaacguauuaagcaguuacaaaauaucagcuuggcugccgcauccgggggagccaaagagcugaagaacauucaugugugccuuggcggucuguuuguuccagaagcguauaucacggcuacacgccaguacguggcccaggcaaauucuuggagucucgaggagcugugucuagaagucaacgugaccacuucgcagggcgccacccuugaugcuugcagcuucggggugacaggacugaaacuccaaggcgccacguguaauaacaauaaguugucccugucaaacgcaauuucuaccgcuuuaccucugacucagcucaggugggucaaacagacaaauaccgagaagaaggccagcguugugacucuucccguauaccugaacuuuacacgggcggacuugaucuucaccguggauuucgaaauagcaacaaaagaggacccacgaaguuuuuaugaaagaggggucgccguucugugcacugaguga

SEQ ID NO: 55562 - RNA, 1827 nt, Artificial Sequence
  derived and/or modified sequence opt3 from DYNC1I1__Homo_sapiens__NP_001129029
augagcgacaaguccgaucugaaagccgagcucgaaagaaagaaacagaggcuugcucaaauccgggaggaaaagaaacgcaaggaggaggaacgaaagaaaaaggaggcagacaugcagcagaaaaaggaacccgugcaggaugacucugaucuggaccguaaaagaagggagaccgaagccuuguuacaaucaauuggcauaaguccugagccaccgcugguccccacaccuaugagcccauccucuaagucgguuucaacucccagcgaggcggggagucaggauuccggagaccuagguccucucacgcggcgcagacugcacaaacuuggcgugucuaagguaacccagguggauuuccugccaagggaagucgugagcuacuccaaggagacacagacucccuuggcuacccaucaaucagaagaggacgaagaggaugaggaaaugguugagaguaaaguggggcaggacagcgaacucgagaaccaggauaagaaacaggaagucaaggaggccccuccacgggagcugacagaagaggaaaaacaacagauccugcacucugaggaauuucucauuuucuuugaccgcaccauccgagugauugagagagcauuagccgaggacuccgauaucuucuuugacuauucaggaagggaacuggaggaaaaggauggcgacguacaggcuggugcaaaucuuagcuucaaccggcaauuuuacgaugagcauuggaguaagcaccguguugugacuugcauggacuggucuuugcaguauccggagcugauggucgccuccuacaauaacaaugaagaugcuccccaugagccugacgggguggcccuaguguggaacaugaaauucaagaaaacaaccccagaauaugucuuucacugucagagcucgguuaugucugugugcuucgcgcgcuuucaccccaaucucguagugggaggcacguacuccggccagauaguccugugggauaacagaucacauaggcggacuccugugcaacgaaccccacuuagugcagccgcucacacacaucccguuuauugugugaaugucguggggacucagaacgcccacaaucugaucaccguaagcacagacggaaagaugugcuccuggucuuuggauaugcucagcaccccgcaggagucaauggaacugguuuacaacaaaaguaagccuguggcagucacggguauggcuuuccccacuggcgacgugaauaacuuugucgugggguccgaggagggaacaguuuacaccgccugucgccacggcagcaaggcggguauuggggaaguguucgagggacaucagggcccaguaacuggcaucaauugccacauggccgucgggccuauugacuucucucauuuauuugugacaucaaguuucgauuggaccguuaaacuguggacgaccaagcacaacaaaccccucuauagcuuugaagacaacgcagauuacguguaugacgucaugugguccccagugcaucccgcucuuuucgccuguguagauggaauggguagacuggacuuguggaaucuaaacaaugauacagaggugccuacugcuucuguugccaucgaaggcgcaucggcccugaacaggguccggugggcucaagcggggaaggagguggcagugggagacagcgagggccgcauaugggucuacgauguuggugaacucgccgugccacacaaugacgaguggaccagauuugcuaggacacugguggaaauucgugccaaccgggcagauuccgaggaagaggggacuguagagcuuucagccuga

SEQ ID NO: 55563 - RNA, 1893 nt, Artificial Sequence
  derived and/or modified sequence opt3 from DYNC1I2__Homo_sapiens__NP_001258715
augagcgacaaguccgagcugaaagccgaacucgagagaaagaaacagaggcuugcucaaauccgggaagagaagaaacgcaaggaagaggagcgaaagaaaaaggaaaccgaucagaaaaaggaggcaguggcccccguccaggaagagucugaccuggagaaaaagcguagagaagcggaggcuuuguuacagucaaugggccugacaccugaaaguccaauugccgagcaaccgcuaaggguugugacugcagauacgugccucuuccacuaccugguacccccuccaaugagccccuccucuaagucggugucaaccccuagcgaagccgggagucaggacuccggagauggugcugucggcucucggcgcgggccaauaaaacuuggaauggcaaagaucacacagguggacuuucccccuagagagauuguuacuuauaccaaagagacacagaccccagugauggcccaaccgaaggaagaugaggaagaggacgaugacgucguggcucccaaaccuccaaucgaacccgaggaggaaaagacucugaaaaaggaugaggaaaacgacagcaaggccccuccacaugaguugacagaagaggagaaacagcagauucuccacuccgaagaguuccugucauuuuucgaucauaguaccaggaucguagaacgggcgcugagcgagcagauaaauaucuuuuucgacuacucuggccgcgaccucgaggauaaggaaggugagauucaagcaggggccaaauuaucccugaaccgacaguuuuucgacgaaagauggucaaagcacaggguugugagcugucuugauuggaguucucaguaucccgaguugcuggucgcuuccuacaauaacaaugaagacgccccgcaugagccugauggaguggcucuaguguggaacaugaaauauaagaagacgacucccgaguacgucuuucacugccaaagcgcaguuaugucggccaccuucgcgaaauuucacccaaaucucgugguaggcggcacauauucugggcagaucgugcugugggacaaccgguccaauaagcguacuccuguccagcgcacaccccuuucagccgcagcucauacccacccaguguacuguguuaacguggucggaacccagaaugcccauaaccugauuaguaucagcacggaugguaaaauaugcuccuggucuuuggacaugcucagccacccccaagauucaauggaacuggugcacaagcagaguaaagcuguagccguuacuuccaugagcuucccugugggcgacgucaauaacuuuguggucgggucugaggaaggaucaguguacacagcauguagacauggcaguaaggccgguauuagcgagauguucgaagggcaccagggaccaaucaccggcauucauugccacgcugcgguuggcgcaguggauuucucccauuuauuuguaacuucuucguucgacuggacagucaagcuguggaccacgaaaaauaacaagccgcucuauagcuuugaggacaacgccgauuacguguaugacguuauguggucccccacccacccugcucuuuucgccuguguggaugggaugggaaggcuggacuuguggaaucuaaacaaugauacagaggucccaacugcaucaaucaguguggaagguaaccccgcccugaaucggguacgauggacccacucuggccgcgagaucgcugugggggacagcgaaggacagauuguuauauacgaugucggcgagcaaaucgccgugccuagaaacgacgaaugggcaagguuuggucggacacucgcggagauuaaugcuaaccgcgccgaugcagaggaagaggccgcuacuagaaucccagccuga

SEQ ID NO: 55564 - RNA, 1572 nt, Artificial Sequence
  derived and/or modified sequence opt3 from DYNC1LI1__Homo_sapiens__NP_057225
auggccgcugugggcagagucgggagcuucggauccucucccccuggucugucaaguaccuacacaggcgggccacucggaaacgagaucgcaagcggcaaugguggggccgcggcuggagacgaugaagacggccagaaccuuugguccugcauucugucugagguuucgacuaggucacggagcaaguugccggccggcaaaaauguguuacugcuaggggaagauggagcagguaagacgagucucauacgcaaaauccaaggcauugaggaauauaagaaagggcgaggacuggaguaccuuuaucugaacguacacgacgaggaucgugacgaucagaccagauguaauguguggaucuuggacggcgaucucuaccauaagggucugcugaaguuuucccucgacgccgucucuuuaaaagauacacuggugaugcuuguuguggacaugagcaagcccuggacugcuuuggauucccugcagaaaugggcaucagucgugagggaacacguagacaagcuaaaaauuccuccagaggaaaugaagcagauggagcaaaagcucauccgggacuuccaggaguauguugaacccggggaggauuuuccugccaguccacagcgcagaaacaccgcuagccaggaagacaaagaugacucugugguccugccccuuggagccgauacacugacccauaauuugggcauaccugugcucguggucugcacuaagugugacgcgaucuccguucuggagaaagaacacgauuacagggacgagcauuucgauuuuauucaaucacacauccggaaguucugcuuacaguauggcgcagcccugauuuacacaagcgugaaagagaacaagaauaucgaccucguauacaaauauauagugcagaaacuuuacggguuuccauauaagauuccggcugucgugguugaaaaggaugccguguucauccccgcaggaugggacaacgacaagaaaauugguauccugcacgagaauuuucagaccuugaaggcugaagauaacuucgaggacaucauuacgaaaccuccaguccgcaaguuugugcaugaaaaggagauaauggccgaggaugaccaaguauuccuaaugaaacugcagagucuccuggcgaagcagcccccuacugccgcaggccgaccaguugaugcuucucccagagugccugggggauccccgaggacccccaaucggagcgucucgucuaacguggccuccgucucaccaaucccugcuggcaguaaaaagauugaccccaauaugaaagccggugcaacaagcgaaggggugcuugccaacuuuuucaacucccuguugucuaagaagacuggcagcccaggaggccccgggguuucaggagguaguccugcuggcggggcgggaggcgguuccagcgggcucccaccgucuaccaaaaagucaggccaaaaacccgugcuggauguacacgcagaguuagaccguaucacacgcaagccugucaccgugaguccaacgacucccacaagcccuaccgaaggagaggccuccuga

SEQ ID NO: 55565 - RNA, 12945 nt, Artificial Sequence
  derived and/or modified sequence opt3 from DYNC2H1__Homo_sapiens__NP_001073932
auggccaacggcaccgcugacgugcgaaagcuguucaucuuuacuacuacgcagaauuacuucgggcucaugagcgaacuuugggaucaaccccuguugugcaacuguuuagaaauuaauaacuuucuggacgaugggaaucagauguuacucaggguccagcgguccgacgcagguauuucuuucucaaacaccaucgaauuuggcgauacaaaggacaagguucugguguucuuuaaacuucgcccugaaguaauuacugaugagaaucugcacgacaacaucuuggugagcagcaugcucgaauccccaauuucuucgcuguaucaggccguccgacaaguguucgcgccgaugcugcucaaggaucaggaguggucacguaauuuugaccccaaguuacagaaccugcuuagcgaguuggaagcugggcugggaaucguucugagaaggagugauaccaaucucacaaagcugaaguucaaggaggacgauacccggggcauacuuacuccuuccgacgaauuucaguucuggaucgagcaagcccaucgcgguaacaagcagauuucuaaagagagagcaaauuacuuuaaggaacuguucgagacaaucgccagggaguucuauaacuuggacagccucucccuguuagagguggucgaucugguggaaaccacgcaggacguaguugaugacguguggcggcagacugagcacgaucauuacccagagucacgcaugcuccaccuucuggacauuaucgggggaaguuuuggccgauucguccagaagaaguugggcacccuuaaucugugggaagaucccuauuaccucgugaaggagagccugaaagcugggauaucuauuugcgaacagugggugaucgucuguaaccaucuuacaggacagguuuggcaaagauaugugccucacccauggaagaacgagaaauacuuucccgaaacucuggacaaguuggguaaaaggcucgaggagguacuggcaauucggaccauccacgaaaaguucuuauacuuucugccugccuccgaggagaagauaauuugccuaacacguguguucgagccauuuaccggccucaauccgguccaguauaaccccuacacggaaccucuguggaaggcugccgugucacaguaugagaagauaaucgcgccagcagagcagaaaauugccgggaaacuuaaaaauuacaucagcgaaauacaagauaguccccagcaguugcugcaggcuuuccucaaguauaaagagcugguuaagcgcccuacuauuucuaaggaacuuaugcuggagagagagacauugcucgccaggcugguggacuccaucaaagauuuucgguuagacuucgaaaaccgaugucgcggaaucccaggcgacgcaagcgguccccugucggggaagaaucuaucugaggucgugaacuccauuguauggguuagacaacucgaacugaaaguggaugacaccaucaagauugcugaggcccuuuugucagaucugccgggauuuaggugcuuccaucagagugcgaaagaccuccuggaucaguuaaagcuguacgaacaggagcaauuugacgauuggagccgggacauacaguccggccuuucugauagccgcucaggcuuguguaucgaggccaguuccagaauuauggaacucgacagcaaugaugggcugcuaaagguccacuauucugacaggcuggugauccuccugcgugagguccggcagcuuucagcauugggauucgugaucccugcuaaaauucagcaaguugccaacauagcucagaaguucugcaaacaggccaucauucugaagcaaguggcacauuuuuacaauaguaucgaucagcagaugauucagagccaacgacccaugauguuacaguccgcccucgcuuucgaacagaucaucaagaacucuaaggcggguucgggcgggaagucccagaucacuugggacaauccaaaagagcuggaaggauacauucaaaaacuucagaacgcagccgagagacuggcuacagagaauaggaaauugcgcaaguggcacaccacguuuugugaaaaaguagucgugcucaugaacaucgaccugcuacggcagcagcaaagauggaaggauggccugcaggagcucaggaccggucuggccacaguugaagcacagggguuccaagccuccgacaugcacgcuuggaaacagcauuggaaucaccagcuuuauaaggccuuggagcaucaguaccaaaugggccuggaagcauuaaacgagaaccucccugagauuaauaucgaucugacuuauaagcagggacgccuucaguuucgacccccauucgaagagauacgggcgaaauacuaucgugaaaugaagagauuuauuggcauccccaaccaguucaaaggggugggagaggcuggugacgagucaauuuuuaguaucaugauagauaggaaugccucuggcuuccugaccaucuuuagcaaggcagaagaccuauuccgccggcucuccgccguccugcaccaacauaaagaguggauugugaucgggcagguagauauggaggcuuugguggagaagcaccuguuuacaguucacgacugggaaaagaacuucaaagccuuaaagauuaaaggaaaggaggucgagagacucccuucagcagugaaaguggauugccugaauaucaacuguaauccagucaagacuguuauagacgaucuuauucagaagcuguucgacuugcucgugcugagccucaagaagucuauccaggcucaucugcacgaaaucgauaccuuugugacagaggccauggaaguacuuaccauuaugccgcaauccgucgaggaaaucggcgacgcgaaccuccaguacaguaaacugcaggagaggaagcccgagauuuugccucuguuccaggaagccgaggacaaaaaucgauuacuccgcacuguggcuggugggggccuggaaacgauaagcaaccuuaaggcaaagugggauaaauuugagcugaugauggaaucucaucaauugaugaucaaggaccagauugagguuaugaaaggaaaugugaagucccggcuccagaucuauuaccaagagcuggaaaaauucaaggccagaugggaucagcuaaaaccaggcgacgaugucauugagacagggcagcacaacacccuggacaagucagcuaaacuuaucaaagaaaagaaaauagaguuugaugaccucgaggugacuaggaagaaacugguugaugacugccaccauuuccguuuggaagaacccaauuuuaguuuagccagcucgaucuccaaggauauugaaucuugcgcacagaucugggcguucuacgaggaauuucaacagggauuccaggagauggccaacgaggacuggauuaccuuucgcacaaagaccuaucuguucgaagaguuccucaugaauuggcacgaccggcugagaaaaguggaagaacauagcguaaugacugucaaacuucagucagaaguggauaaauacaagaucgugauaccuauucugaaauaugucaggggugagcacuugaguccagaccauuggcuagaucuguuucgacuccugggccuuccccgggggacauccuuagagaagcugcuauucggagacuugcugcgcguugcugauacgaucguggccaaggcagcugaccucaaagaucugaacucuagagcccaaggcgaaguaaccaucagggaggcacuucgggaacuggacuuguggggugugggggccgucuuuacucuaauugauuacgaggacagccagucccgaacaaugaagcugauaaaagauuggaaggacaucgugaaccagguuggcgauaauagaugucucuuacagucacugaaagacagcccguauuacaagggauucgaagacaaggugaguauuugggagcgcaaacuugcugagcuggaugaauaucuccaaaacuugaaucacauccagaggaagugggucuaccuggagccuauuuuuggccguggggcgcucccaaaagaacagacccgguucaacagaguggacgaggauuuuaggucuaucaugacagacauaaagaaagauaaucgcguuacuacccugacgacccacgccggaauccgaaacucccuucuaacaauucuggaccaauugcagagaugccaaaagagcuuaaaugaguuccuggaagagaagcggucggcauuucccagguucuacuuuaucggcgaugacgaucuccuggaaauucuuggucagucaacuaacccuucugugauccaaagucaucugaagaaacucuucgcugggauaaauuccgucuguuuugacgagaaaagcaagcacauuaccgccaugaaaucuuuggaaggagagguagugcccuucaagaacaaaguuccacugagcaauaacguggagacauggcuaaaugaucuggcccucgaaaugaagaagacucuugagcagcuguuaaaagaaugcgucaccacgggccgcuccucacagggugcuguggacccuaguuuguuccccagccagauccugugucucgcagagcaaaucaaguuuacagaagauguagagaacgccauuaaagaccauucucugcaccagaucgagacccagcuugugaauaagcuggaacaguauacuaacauagacacauccucagaggauccaggcaacaccgaaagugggauucucgaguugaaacugaaggcguuaauccuagacauuauccauaauauagaugucguuaagcaacugaaccagauucaggugcacacuaccgaagacugggcuuggaaaaagcagcuccguuucuacaugaaaagcgaucacacaugcugugugcaaauggucgacuccgaguuucaguauacguacgaguaucagggaaaugccucuaaacuuguguacaccccgcugacugauaaaugcuauuugacacugacccaagcaaugaagaugggccucgggggaaacccuuacggccccgccgguacagggaagacugaaucgguuaaagcucugggaggccuucucgguagacagguacugguguucaauugugacgagggcaucgaugucaagagcauggggcggaucuuugugggauugguuaaaugcggcgcauggggguguuucgacgaauuuaacaggcuggaggagucaguguuauccgccgucaguaugcagauucagaccauccaagaugcgcuaaagaaucaucgcacggugugcgaacugcucggaaaagagguagaagucaacucuaauagcggcauuuucauaacaaugaacccagcugguaagggguacggaggccgacagaaacuucccgacaaucugaaacaguuguuuagaccuguggccaugucccacccagacaacgagcugaucgcagaaguuauucucuauucagaggguuucaaggaugccaaagugcugucucggaaacuugucgcuaucuuuaauuuaagcagggagcugcucacuccccaacaacauuacgacuggggcuugcgcgcccugaaaaccgugcuaagagggaguggaaaccugcucaggcagcuuaauaaguccggcaccacacagaacgcaaaugaaagccacaucguugugcaggcucugcgguugaacacuaugucuaaauucaccuuuacagauugcacgcguuucgacgcccugauuaaggaugucuucccugggauagagcucaaggaaguggaguaugacgaacugucagcggccuuaaaacaaguauuugaggaggcaaacuacgaaaucauuccgaaucagaucaagaaagcucuugagcuguaugaacagcucugucaacgcaugggagugguuauugucggcccauccggugccgggaagaguacccuauggcgaaugcugagagcugcauugugcaaaacuggaaagguggugaagcaguacacaaugaaccccaaagccaugccuagguaucagcugcucggccacaucgauauggacacccgggaguggagcgauggcguccuuacuaauucggcccgccagguagugagagaaccacaagacguuucuuccuggauaaucugugauggggacauugaucccgaguggaucgagagccugaacucaguguuggacgacaauaggcugcucacaaugccuaguggagaacggauucaguucgguccgaacgucaauuuuguguucgagacccaugauuuaucuugcgcuucccccgcgacgaucagccgaaugggcaugauauuucugucagacgaagagacugaucuuaacagucugauuaagagcuggcuaagaaaucagccagcagaguaccgcaacaaucucgaaaacuggaucggggacuacuucgagaaagcccugcaguggguuuugaagcaaaaugauuauguggucgaaaccucccuggugggaacaguaaugaacggccucucucaccuucaugguuguagggaccacgaugaguuuauuaucaaucugauacggggguuaggaggcaaccugaacaugaaaagccguuuggaguucaccaaggagguguuucauugggcuagagaguccccucccgacuuccacaagccaauggauacuuacuaugacucaacaaggggccgccucgccaccuacguucugaaaaagccugaagaucuaacagcagacgacuuuucuaaugggcuuacucugcccgucauccagaccccagauaugcagcggggacucgacuauuucaaaccguggcugaguucggauacgaagcagccuuuuauuuuggugggucccgagggcugcgggaaaggaaugcugcuccgauacgccuucagccaacuuagauccacacagaucgcuaccgugcacuguucugcgcagacuaccucaaggcaucuguuacaaaagcugagccagacaugcauggucauuuccacuaacaccggccgcguuuaucggccaaaggacugugaaagauuggugcucuaccugaaagauaucaaucuacccaaacuugacaaaugggguacgaguacacugguagccuuccuccaacaggugcugaccuaccaaggguuuuaugaugagaacuuggaaugggucggauuagagaauauacagauuguggcaucuaugagcgcuggcggccgucuggggaggcacaagcucacuacacgguucaccucaaucguucgccuuugcuccaucgacuacccugagcgagaacagcugcagacuauuuauggagccuaccuagagccagugcugcauaaaaaccucaagaaucacaguaucugggguaguucuuccaaaauauauuugcuggcaggcucaaugguccaaguauacgaacaggugagagccaaguuuacaguugaugacuauagccacuacuucuuuacccccuguauucuuacgcagugggugcugggacucuucagguacgauuuagagggaggcucgucuaaccauccucuggacuaugucuuggaaaucguggcuuacgaggcccggcgccuguuuagagauaagauugucggugcgaaagagcuccaccuuuucgacaucauacugacaagcguguuucagggggacuggggauccgauauccuagacaauaugagcgauucauucuauguuaccuggggcgcaaggcauaacuccggcgcccgagcugccccggggcaaccacugcccccucacggaaagccccucgguaaauugaauagcacagaccugaaggaugugauuaaaaagggccuuauccauuacgggcgggacaaccagaaucuggauauuuuacucuuucacgaaguacuggaguauaugagccguaucgacagaguguugaguuucccaggaggcucccugcuccuugcuggucgcagcggggucggaaggcggaccauuacaucucugguuucacacaugcauggcgcagugcuauuuaguccuaagaucuccagaggcuacgaacugaaacaguucaagaacgaucucaaacacgucuugcagcuggccgggauagaggcucaacaggugguauuacuucuggaggacuaucaguucgugcaucccacuuuucucgaaaugauuaauagccuguugucuucgggagagguuccaggucuguacacccucgaagaacuugaaccucugcuacugccguuaaaggaucaagccucacaggacggcuucuuugggcccguguucaacuacuuuacguaucgcauccagcagaaccuccacaucguccugauuauggauagcgcaaauuccaacuucaugauaaauugcgagaguaacccagcguugcacaaaaagugccaagugcuuuggauggagggauggucuaauagcuccaugaagaaaaucccugaaaugcuguuuucagagacaggcgguggggaaaaguacaacgacaaaaagaggaaagaggaaaagaagaaaaauagugucgaccccgauuuccucaagucuuuucuguugauucaugagagcuguaaagccuauggcgcuacuccaucccgauacaugaccuuccugcacguguauucagccaucaguucuuccaagaaaaaggagcuacucaagcggcagagucaucuucaggcaggaguuagcaaacugaacgaagcuaaggccuuaguagacgagcugaauagaaaagcaggcgaacagucggugcuccugaagacaaaacaagaugaggccgacgcugcguugcagaugauuaccgucuccaugcaggaugccucugaacagaagacugagcuugagaggcugaaacaccgcaucgcagaagaggugguuaagauagaagaacguaagaacaaaaucgacgaugagcucaaggaagugcaaccucuggucaaugaggcuaaacuagccguggggaacauuaagcccgaaucauugagcgagauccggagucugagaaugccgccagacguaauuagggauauccucgaaggagugcuucgccugauggguauauuugacaccuccuggguuucuaugaagucuuucuuagccaagcgaggcguccgggaggauauugcaacauuugacgcuagaaauaucucaaaggagaucagggaauccguggaggaacuacucuucaaaaacaaggggaguuucgacccuaaaaaugccaagcgcgcgagcacggcugccgcaccccuggccgcuugggugaaagcaaacauucaguacucucaugucuuggagagaauacacccacuugaaacugagcaggccggacuggagucaaaccucaagaagaccgaagaucggaaaaggaagcuggaggaacuauuaaauuccguuggccaaaaagugagcgagcugaaggaaaaauuucagucucguacaagugaggcggcuaaguuggaggccgaaguaucgaaggcacaggagaccaucaaagccgcugaagugcucauuaaccagcuggaccgagagcacaagcgcuggaaugcccaagucguggagaucacugaagaacuugcaacacugcccaaaagagcucagcucgccgcggccuucauuaccuaucuguccgcagcuccugagagcuugcggaagacgugccuugaggaauggacuaaaucagccggucuggagaaguuugaucuaaggcgcuuccucuguacagagucugaacagcugaucuggaaaagcgagggguuaccguccgacgaucugaguauagaaaacgcauugguuauccuccagauuaucggccugaagucauggucuagagugugccccuuucuuauugacccaagcucccaagcuaccgaguggcugaagacccaucucaaagauagucgguuggaagucaucaaucagcaggacagcaacuucauuacugcccuggagcuugccgugagguuuggaaagacacugauaauccaggagauggauggcguagaaccuguuuuauacccccuacuccgacgugaccugguggcgcaagggccuagauacgucgugcagauuggagauaaaaucaucgacuauaaugaggaguuccgccuguuuuuguccacccggaacccaaaucccuucauuccuccagaugcugcaucuauagugacagaggucaacuuuacuacgaccaggucaggucucagaggccagcugcuugcccugacaauccagcacgaaaagcccgacuuagaggagcagaagacuaagcuccugcagcaggaagaggacaagaaaauucaauuggcuaaacuugaagagagccugcuagagacccucgccacaucgcaggggaauauccuggaaaacaaagaucugauugaguccuugaaucagaccaaggcaaguucugcccucauccaggaaagccugaaagagucauacaaacuucaaauaucccuggaccaggaacgcgaugcuuauuuaccgcucgcggagucugccaguaagauguacuucaucauuagcgaccuguccaaaaucaacaauauguaucgguuuucacuagcagcuuucuugaggcuguuccagcgagcccuucagaacaagcaagauagcgagaacacugaacagagaauacagucucucaucaguucccugcagcauaugguuuacgaguauauaugucggugccuguuuaaagcagaccaauugauguucgcccuucacuuugugaggggaaugcauccugaacucuuccaggagaaugaaugggauacguuuaccggcguaguggucggugacaugcugcgcaaggcugauagccagcagaagauucgugaccaguuaccaucauggaucgaucaggagagaucuugggccguggcgacacugaagauugcacuacccucccucuaccagacucuguguuucgaggacgccgcuuuguggcgaaccuacuauaacaauucgaugugcgaacaagaguuuccuagcauccuggccaagaaaguuagucuuuuccagcagauacucgugguccaggcacugaggccagaucgguuacaaucugcuauggcccuguuugcuuguaagacauuggggcucaaagaagugagcccccugccgcuuaaccugaagcgccuauacaaagagacccucgaaaucgagccuauucugaucauuaucagccccggcgccgacccaucacaggaguugcaggaacuggcaaaugcggagagaaguggagaaugcuaucaccagguagccaugggccaagggcaggcugaccuugccauacagaugcucaaggagugugcaaggaacggagauuggcugugccuaaagaaucugcacuugguuguguccuggcucccuguccuggagaaggaacuuaacacucugcaacccaaggacacauuccggcuauggcucacggcugaggugcauccaaauuuuacccccauucuguugcagagcucucugaaaaucacuuacgaaucaccuccaggccuuaagaaaaacuuaaugcgcacauaugagagcuggaccccggaacagaucuccaagaaagauaauacccacagagcccaugcacuguucucucucgccugguuccacgcggcuugccaggagcgaaggaacuacauuccccaagguuggacaaaguuuuaugaguucagucugucggaccuacgggccggguacaauaucauagaucguuuguuugacggagcaaaggauguucagugggaguucgugcacggccugcucgagaacgccauuuacgguggccgcaucgacaauuauuuugaucuuagaguccugcagagcuaccucaaacaguucuuuaacuccucagugauugacguauucaaccaaaggaauaagaaaucuaucuuuccuuauagcgugagucugccacaguccuguucaauauuagauuaccgggcugucaucgaaaagauucccgaggacgacaaaccuucuuucuuuggguugccagccaacaucgcaagaagcucccagcgcaugauuaguagccagguuaucucucaacugaggauucuuggaagaucaaucacugcuggcuccaaguucgaucgggaaauauggagcaaugagcugagucccgugcucaaccuguggaagaaacuaaaucagaacucuaaucuuauccaucagaaggucccuccgccaaacgacagacaggggucccccauucugucguuuaucauucucgagcaauucaaugccauacguuuggugcagagcguacaccagucacuggcggcuuuauccaaagugauccgcggaacgacccugcucucuagugaaguucaaaaacuugccagcgcacuguugaaccagaaaugcccucuggccuggcagucaaagugggagggccccgaagauccacuccaguaucuaaggggucugguggcucgggcacuugccauucaaaauugggucgacaaggcggagaaacaggcccugcucuccgaaacauuggaucugagcgaguuauuccauccugacacuuuucugaacgcucucagacaggagaccgcacgagccguggggaggucuguugauagucuuaaguucgucgcuuccuggaaaggacgccugcaggaagccaaguugcaaaucaaaauuagcggccugcuccuagaggguuguucauuugacggcaaucagcugucugaaaaccaguuagauucgcccagcguguccagugugcugccaugcuucaugggguggaucccgcaggacgcauguggaccuuacucucccgaugagugcauaucacucccaguauauacaagcgcugagcgggacagagucgugaccaauaucgauguucccuguggcgggaaccaagaccaguggauucagugcggagccgcgcuauuuuugaagaaccaauga

SEQ ID NO: 55566 - RNA, 270 nt, Artificial Sequence
  derived and/or modified sequence opt3 from DYNLL1__Homo_sapiens__NP_001032584
augugcgacagaaaggccgugaucaaaaacgcugauaugagcgaggaaaugcagcaagacuccgucgagugugcaacccaggcccuggaaaaguacaauauugagaaagauauagcggcucacaucaagaaagaguucgacaagaaguauaaccccacauggcauugcauuguuggcaggaauuuugggucuuacgugacucacgaaacgaaacauuucaucuauuuuuaccucggacagguagccauucuucuguucaagucagguuga

SEQ ID NO: 55567 - RNA, 270 nt, Artificial Sequence
  derived and/or modified sequence opt3 from DYNLL2__Homo_sapiens__NP_542408
augagcgacagaaaggccgugaucaaaaacgcugauauguccgaggacaugcagcaagaugcagucgacugcgccacccaggcgauggaaaaguacaauauugagaaagauauagcugccuauaucaagaaagaguucgacaagaaguacaaccccacauggcacuguauuguuggcaggaauuuugggucuuaugugacucaugaaacgaaacacuucaucuacuuuuaucugggacagguagcaauucuccuuuucaagucagguuga

SEQ ID NO: 55568 - RNA, 312 nt, Artificial Sequence
  derived and/or modified sequence opt3 from DYNLRB1__Homo_sapiens__NP_001268658
augaacagccagagaaggggcccccacuccugccugaagaccgccccuaaagcuaagccauuccauugggaggcacucgccgcguaccuucuggacacaucuaucccgauuaaaucaacuauggauaaucccacgaccacacaauaugcuaguuugaugcacagcuuuauauuaaaggcccgguccacugugcgcgacaucgauccucagaacgaccugaccuuccuacguauucgaucuaaaaagaaugaaaucauggucgcaccagauaaggacuacuuucucauuguuauccagaaccccacagaguga

SEQ ID NO: 55569 - RNA, 300 nt, Artificial Sequence
  derived and/or modified sequence opt3 from DYNLT1__Homo_sapiens__NP_001278531
auggaggacuaccaggccgcugaagaggcaaucgaaagcgccauuggcgggaacgcguaucaacacuccaaggugaaucaguggaccacaaacgucguugagcagacucugucucagcucacgaaacuuggaaagcccuucaaauacauagugaccugcguaaucaugcaaaagaauggugcuggccugcauacagccucaaguuguuuuugggauagcuccacugacgggucuugcaccgugagaugggaaaacaaaacaauguauuguauugucucggcauucggauugucaaucuga

SEQ ID NO: 55570 - RNA, 351 nt, Artificial Sequence
  derived and/or modified sequence opt3 from DYNLT3__Homo_sapiens__NP_006511
auggaggaauaccacagacauugcgacgaggugggcuucaacgccgaagaggcucacaauaucgucaaggaauguguugauggggugcugggaggugaggacuauaaccauaauaacauuaaucaguggaccgcaagcauaguagagcaaucccucacacaccuugugaaacugggcaaggccuacaaauauaucgucacuugcgcggugguucagaagucugcuuacggguuucauacggccucaaguuguuucugggauaccacaagcgacggaacuugcaccgugaggugggaaaaccggacaaugaauuguauugucaacguguuugcaaucgccauuguauuguga

SEQ ID NO: 55571 - RNA, 2292 nt, Artificial Sequence
  derived and/or modified sequence opt3 from DYRK1A__Homo_sapiens__NP_001387
augcacaccggcggggagacaagcgccugcaagcccuccucugugagacuggcuccuucauucaguuuucaugcagccggacuccagauggcgggucaaaugccacacagccaucaguacuccgacaggcggcagccgaacaucucugaucagcaagucucggcucuuucauauagcgaccagauucagcagccccugacuaaucaaguuaugccugauauagugauguugcagcgccgaaugccacagacguuccgugaccccgccaccgcaccuuuaagaaaacugaguguagaucuaaucaagacauacaaacacauuaacgaaguguauuacgccaagaaaaagaggcggcaucagcaaggccagggggacgauuccucucacaagaaagagcgcaaggucuauaaugacggauacgaugacgauaacuaugacuacaucgugaaaaauggcgaaaaguggauggauagauacgagauugacagccucaucgguaaaggguccuuuggacagguugugaaggcuuaugacagggucgaacaagaguggguggcaauaaagaucauuaaaaacaagaaagccuuccugaaucaggcucagaucgagguacggcuucuggaauugaugaacaagcacgauacugagaugaaauacuauauuguucaucucaagcgccacuuuauguuccgaaaucaucugugucugguguuugaaaugcucucauacaacuuauaugaccugcuuagaaauaccaacuucaggggcgucaguuugaaucugacacggaaauuugcccagcaaaugugcaccgcgcuacucuuccuggcaacuccagagcuuagcaucauacacugugaucugaagcccgagaacauuuugcucugcaauccuaagcguucugccaucaaaauuguggacuuuggcuccucaugucagcuggggcagcgcaucuaccaguauauccaaagcagauucuacaggaguccagaaguguuacugggaaugccguacgaucucgcuauugacauguggucucuugguugcauacuggucgagaugcacacaggcgaacccuuguuuuccggggccaacgagguugaucagaugaacaagaucguggaaguacuagggauuccuccagcacauauccuggaccaggcucccaaagcccggaaguucuucgagaaacucccugauggcaccuggaaucugaagaagacgaaagacgguaagcgagaguauaaaccacccgggacucgcaaacuucacaacauacugggaguggaaaccggcggcccgggaggaagaagggcgggugagagcggccauacagucgccgauuacuugaaguuuaaggaccucauucugcggauguuagacuaugauccuaagacucgcauccagcccuacuaugcacugcaacacucguucuuuaaaaagaccgcugacgaagggacaaauaccucuaacuccgugucaacgaguccagccauggagcagagccaguccucuggaacuacaagcucaaccaguuccagcucuggcgguucaagugggacuagcaauuccggcagagcuaggucugauccuacacaucagcaccgucacucgggaggccauuucaccgccgcaguucaagccauggacugugaaacgcacagcccccaggugcggcagcaauuuccagcuccccuagggugguccggaaccgaggcgccuacacaggucacuguggagacccauccaguacaggaaacaacuuuccacguugcaccgcagcaaaacgcccuccaccaucaccaugguaauucaagucaccaucaccaccaucaccaucaccaucaccaccaucacggccagcaggcucuggggaaccgaaccagacccaggguguacaauucuccuacaaacagcuccucaacccaggauagcauggaggucggacauucucaccacuccaugacuagccuuaguucuuccacgacaucaaguagcaccucguccucuagcacuggcaaucaagguaaccaggccuaucagaaucgcccaguggcagccaacaccuuggacuuugggcagaauggcgcuauggaugucaaccugacaguguacucaaacccccggcaagaaaccggaaucgccggccauccuacuuaccaguucagugcaaauacagggccagcgcacuauaugacggagggacaucucaccaugagacagggugcugacagggaagagucccccaugacuggcguuugcgugcaacagucuccgguagccagcuccuga

SEQ ID NO: 55572 - RNA, 1890 nt, Artificial Sequence
  derived and/or modified sequence opt3 from DYRK1B__Homo_sapiens__NP_004705
auggccgugcccccuggccacgggccauucagcggauuuccggguccccaggagcauacccaaguccugccugacguuagacuccuuccaaggcggcugcccuuggcuuuccgcgaugcaacauccgccccuuuacgaaagcugucuguggaccuaaucaaaacuuacaagcacauuaacgaaguauauuacgcgaaaaagaaacguagagcucagcaggccccaccccaggauucaaguaauaagaaggagaaaaaggugcucaaccauggcuaugacgaugacaaucacgauuacauagucaggagcggggaacgguggcuggagcgcuaugaaaucgacucccuuauuggaaaaggcucuuuuggucaagugguuaaggcauacgaucaucagacgcaggagcugguggccaucaaaauuaucaagaacaagaaggcuuucuugaaucaggcacaaauagagcucagacugcuggaacucaugaaccagcacgacaccgagaugaaauauuacaucguccacuuaaaaaggcauuuuauguuccggaaucaccugugccuuguguuugaauugcugucguacaaccuauaugaucuccugcgcaauacacauuuccgagggguaucacuuaaccugacuagaaaguuggcccagcagcucuguaccgcucuguuauuucuggccacaccugagcucagcauuauccacugcgaccuuaaaccagagaauauucuguuguguaacccgaagaggagugcgaucaaaauaguugauuucggauccucuugccaacuaggccagcggauuuaccaguauauccaaagccguuuuuaccgcucccccgaagugcugcucggcaccccuuaugaccuggcaauugacauguggucacuuggguguauccuggucgagaugcacacuggagaaccauuguucagugguagcaaugagguggaucagaugaacagaaucguggaaguccucggcauucccccugccgcuaugcuggaccaggccccaaaggcaaggaaguacuuugagcgguuacccgggggaggcuggacacugcgacgcaccaaagagcuaagaaaggauuaucaggguccggggacgaggcggcuccaagaaguucugggagugcagacuggcggcccugggggacgcagagcuggugagcccggccauucuccagccgacuaccuuagguuccaggauuugguacugcguaugcucgaauacgagccugcggcccggauaucaccccugggggcacuucagcacggauucuuucgaagaaccgcugacgaagccacaaauacuggcccagcugguuccagcgccaguaccucucccgcaccucuggauacaugcccauccagcucgaccgccucuuccaucucaaguagcgggggcuccucuggaagcucaagugacaacaggacguaucgcuacuccaaccgguauuguggcgggccgggacccccuauuacugauugcgagaugaauagcccacaagugcccccuucucagccauugagacccugggcugguggcgacgucccgcauaaaacacaccaggcgccugcaucagccaguagccucccagggaccggagcucagcugcccccucaacccagguacuuaggccgcccaccuucccccacuucuccaccgccucccgagcugauggaugugucgcuaguuggugggccagccgacuguagcccuccccauccagcacccgccccucagcacccggcugccuccgcacuccgaacacggaugaccggcggacguccaccccugccuccacccgacgauccugcgacgcuuggcccgcacuuggggcugagaggagugccccagucaaccgcugccaguucuuga

SEQ ID NO: 55573 - RNA, 1587 nt, Artificial Sequence
  derived and/or modified sequence opt3 from DYRK2__Homo_sapiens__NP_003574
augaacgaccaucugcacgugggcagccacgcccaugggcagauccaaguccagcaguuauucgaggauaauuccaacaagagaaccguucuuacaacucagcccaauggacugacgaccguggguaaaacaggcuugccuguagugccagaaaggcaauuagacucuauucaccggcgccaggggucaaguacuagccugaaguccauggagggaaugggcaaagucaaggcuaccccgaugacacccgaacaggcaaugaaacaguacaugcaaaagcuaaccgccuuugagcaucacgaaauauucucuuauccugagaucuacuuucucggucugaacgcgaagaaacgacaggggaugacuggaggcccaaauaacggcggguaugaugacgaucagggaucguacgugcagguuccccacgaccauguggcuuaucguuacgagguccuuaaggugauugguaaaggcucauucgggcaaguaguuaaggccuaugaucacaaagugcaucagcacgucgcacugaagauggugagaaaugaaaagagguuucaccggcaggccgcugaggaaauccgcauuuuggagcaucucagaaaacaagacaaggauaacacaaugaaugugauccacaugcuggagaacuucaccuuuaggaaucauauaugcaugacguucgaacugcucagcaugaacuuauacgagcugaucaaaaagaauaaauuucagggauucagucuuccuuugguccggaaguuugcacacuccauucugcagugucuagacgcccuccauaaaaaccgcaucauucacugcgaucugaagccagaaaauauccuucugaagcagcaaggccgaucugguauaaaaguuauugacuucgggagcuccuguuacgagcaccagagaguguauacuuacauccagucaagguuuuaucgggcucccgaaguaauuuugggagcccguuacggcaugccuaucgauauguggagucucggcugcauccuggcggaguuacugaccggguauccacuccuuccgggagaggacgaaggugaccagcuggcauguaugauugaguugcuaggcaugcccagccaaaagcugcucgaugccucuaaacgcgcuaagaacuucguguccucaaaaggguacccuagauauugcacagucacuacccugagcgacggaagugugguucuuaacggcgguaggucucggcgagggaagcugcgcggcccacccgaauccagagaguggggaaaugccuugaagggcugugaugacccucucuuccuggauuuucucaaacagugccuggaaugggacccagcagugaggaugacacccgggcaggcucuacggcauccguggcuccgcagaaggcugccuaagcccccaaccggagagaaaacgagcgucaagcguauaacugagucgacaggugccaucaccucuauuuccaaacuuccucccccaucaaguagcgcguccaaguugcggacuaaccuggcccagaugacagaugcaaauggcaacauccaacagcgaaccgugcuccccaagcugguaucuuga

SEQ ID NO: 55574 - RNA, 1707 nt, Artificial Sequence
  derived and/or modified sequence opt3 from DYRK3__Homo_sapiens__NP_001004023
augaaguggaaagagaagcugggcgacgggguguacgauaccuucaugaugaucgacgaaacaaaaugucccccuugcagcaacguccucugcaauccauccgagccgcccccuccaagaaggcuuaacaugacuacggaacaguuuaccggagaucacacacaacauuuccuggacgguggcgagaugaagguugaacaguuguuucaggaguucgggaaucggaaaucuaacacuauucagucagauggaauaagugacagcgagaaguguucccccaccgugucucaaggcaagucgucagauugcuuaaauacaguaaaaagcaacaguuccucuaaggccccuaaaguggucccacugacccccgaacaggcucuaaagcaguauaaacaccaucucacugcauacgagaagcuggaaaucauuaauuauccugagaucuacuuuguggguccaaacgccaagaaacgccacgggguuauuggaggcccgaauaacggcggguaugacgaugcggacggagcuuacauccaugugccccgagaucaccuugccuaucguuacgagguccugaagauaaucgguaaaggcagcuucggacagguggcaagaguauacgaccacaaguugaggcaauauguugcccucaaaauggugcggaaugaaaagcgcuuucauagacaggcugcagaggaaauuaggauccuggagcaccugaaaaagcaggauaagacaggguccaugaacgucauucauaugcucgaaucauucaccuuucggaaucacguguguauggccuucgaguuacugaguaucgaccuuuacgaguugauuaaaaagaacaaauuucagggcuucagcgugcaacugguccgcaaguuugcucagucuauacuacagucccucgacgcccugcacaaaaauaagaucauucauugcgaucuuaagccugaaaacauccuguugaaacaccauggucgaucaagcacgaagguuaucgacuucgggaguucuuguuucgaguaucaaaaacucuacacuuauauucaguccagauuuuacagggcgccagaaauaauccugggaagccgguauucgacccccauugauaucuggucuuucggcugcauauuagcagagcugcucacaggccagccucuuuuuccaggggaagacgagggagaucagcuggccuguaugauggaguugcuagguaugcccccgccuaagcugcucgaacaauccaaacgugcuaaguacuucauuaacucaaagggcaucccccgcuacugcagugugacuacccaggccgacgggagaguagugcuggucggaggcaggagccggcgagguaaaaagcgcgggccaccuggcuccaaagauuggggaacagcacuuaagggcugugacgauuaucuguuuaucgaguucuugaaaagaugccuccacugggaccccucugcuaggcugaccccagcccaggcguuacggcaucccuggauuagcaagucagugccucgcccacugacgacuaucgauaagguuagugggaaaagaguggucaauccggccuccgcauuucagggacuagguagcaagcugcccccugugguaggcauugcuaacaaacucaaggccaaucuuaugucugaaacaaacgggucaauaccauugugcaguguucugcccaaacucaucagcuga

SEQ ID NO: 55575 - RNA, 6246 nt, Artificial Sequence
  derived and/or modified sequence opt3 from DYSF__Homo_sapiens__NP_001123927
augcugugcugucuccuugugcgcgccagcaaccugcccuccgcuaagaaagacaggcggucugauccugucgcaucauugaccuuccgcggaguuaagaaacgaacuaaggugaucaaaaauagugugaacccaguguggaaugagggguuugaaugggacuuaaagggcauuccgcuggaucaggguagcgagcuacacgucgugguuaaggaccaugaaacuaugggccguaacagauuccucggggaggccaaagugccccugagggaaguccuugcgacgccuucccugucugcuucguuuaaugccccauugcucgauaccaagaaacaacccaccggagcaucacuggugcugcagguaagcuacacuccucucccaggcgccguucccuuauucccuccaccgacaccccuggagccuaguccaacacuucccgacuuggauguggucgcugacaccgguggggaggaagauacugaggaccagggacugacaggcgaugaagcagagccuuuucuagaccaguccggcgggccaggagcccccaccacgccgcggaagcucccuucuagacccccaccucacuaucccgguauuaaaagaaagaggagcgcuccaacuucccggaagcugcuuucagauaaaccccaagacuuccagauccgcguacaggugauugagggccgacagcugccuggggucaacaucaagccaguugugaaaguaaccgccgcgggacaaacaaagagaacuaggauucauaaaggcaauaguccguuguuuaacgaaacccucuucuuuaaucuguucgacagccccggugaguuauuugaugaaccuaucuucauaacaguggucgacucucggucccugcguaccgaugcacuccuuggggaguuucgcauggacgugggaacgaucuacagagaaccaaggcacgccuaucugcggaagugguugcuacugucagaucccgacgauuucagcgcuggcgcccgaggcuaccucaaaacaagucugugcguucuugggccuggagacgaggcaccacuggagcgcaaggaucccucugaagacaaggaggauauugaauccaacuugcucagaccgacagguguggcucugaggggcgcccauuucuguuuaaaagucuuucgggcggaggaccugccucagauggacgaugccgugauggacaauguaaagcagaucuucggguuugaaagcaacaaaaagaaucuaguugauccauucguggaggucucguuugcaggaaaaaugcucugcucuaagauucuggagaagaccgcuaacccccaguggaaucaaaacaucacucuuccugccauguuccccuccaugugugagaagaugcgcauaagaauuaucgacugggauagguugacacacaacgacauuguggcuaccacguaucugucaaugaguaagaucagcgccccaggcggugagaucgaagaggaaccugcaggggccgucaaacccuccaaggcuucugaucucgacgauuaccugggcuuucuuccaaccuucggaccgugcuauauuaaucuguacggcagcccucgugaguuuacaggguuccccgacccauacacugaguugaacaccggaaaaggugaaggcguggcguaucgggggcgacuccuguuaucacuggagacaaagcuaguugaacacagugagcagaagguggaggaucuccccgcagacgauauacugagaguagaaaaauaccuuaggcgccggaaguauuccuuguuugccgcuuucuacagcgccacuaugcugcaggacgucgacgaugcaauccaauuugaggugucuauuggaaauuauggcaacaaauucgacaugaccugucucccucuggccucaacaacccaguacaguagagcuguuuucgaugguugccauuauuacuacuuaccaugggggaaugugaagcccgucgugguacugagcuccuauugggaagacaucucucacaggauagagacucagaaccagcuuuugggcauugccgaucgccucgaagcaggacuggagcaagugcaucuagcgcugaaagcucaguguucgacggaggacguugauagccucgucgcccagcugacagacgaacuuaucgcaggcugcucccagccuuugggggauauccacgagaccccgucagccacucaccuggaccaauacuuauaucagcuccgaacccaucaccugagucagauuacagaagcugcccuugcacugaaguugggacauucugagcucccagcugcccuggaacaggcggaggauuggcuacugcggcuccgugcccuggcugaggaaccccaaaauagccuuccugacaucgugauuuggauguugcagggugauaagagaguggcauaccagagggucccagcccaccagguucuguuuucccgccggggcgcuaacuauugugggaaaaauugcggaaaguuacaaaccauauuccucaaauaccccauggagaaggugccuggcgccagaaugccggugcagaucaggguaaaacugugguuuggucuuucagucgacgaaaaggaguucaaccaguuugcagaagggaaacugagcguguucgcggagacuuaugagaaugaaacaaagcuagcccucguuggcaacuggggaacgaccggccugacuuaccccaaguuuucugacgugacagggaaaauuaaguugccaaaagauuccuuccgaccuagugcuggauggaccugggccggcgacugguuugucugccccgagaagacacuguuacaugauauggacgcaggucaccucagcuucguggaagagguuuuugagaaucaaacucgccugccagggggacaguggaucuacaugucugauaacuauaccgacgugaauggcgaaaaaguacuuccuaaggaugacaucgaguguccccuggguuggaagugggaagaugaggaaugguccacggacuugaaccgggcugucgaugagcagggcugggaguacucaauuaccauaccaccggaaagaaaaccuaagcacugggugcccgccgagaaaauguauuacacacauaggcgucgccggugggugagacucaggcgacgggaccugagucagauggaagcacuaaagcgccacagacaagccgaggcugaaggggagggaugggaguaugcgagccuguucggcuggaaauuucaucuugaauacaggaagacugacgccuuccggcgaagacgcuggaggcgucggauggagccacucgaaaagaccgggcccgcagcugucuucgcccuggagggagccuugggcgguguuauggaugacaaaucggaagauuccaugucugugagcacacugucauuugggguaaacagaccuacuaucaguugcauuuucgacuauggaaauagguaccacuuacgcuguuacauguaucaggcucgagaucucgcagccauggacaaggauuccuuuucugacccauacgcgaucgugagcuuccugcaccagucccagaaaaccgucgugguuaagaacacgcuuaaucccacaugggaucaaacccugauauuuuaugagaucgagauauucggcgaaccugcuacuguggccgagcagccgccaucaaucgucguggaauuguacgaccaugauacauauggugcagacgaguuuaugggcagaugcauuugucagcccagccucgagcggaugccuaggcuggccugguucccccuaacccgcgggagucagccaucuggagaacugcuugcuuccuuugagcucauccaacgugaaaaaccugcaauucaccauauccccggcuucgagguucaggaaacuagcagaauacuggaugagucggaggacaccgacuugccauacccuccgccccagcgggaagccaacauuuauauggugccacaaaauaucaagccugcguuacagaggacagcuauugagauccuggccugggggcuccgcaacaugaagucauaccagcuggcaaauauaucuagucccucccuugucguagaaugcggaggccagacggugcaaagcuguguuauccgaaaccugcggaaaaauccaaacuuugauauuugcaccuuguucauggaggugaugcuaccuagagaagaacuguacugucccccgaucacugucaaggugauugacaauaggcaguucggucgcagaccaguaguggggcagugcacaaucaggucucucgagagcuuucugugugauccuuauuccgccgaaucacccaguccacagggaggccccgacgaugucagccuuuuaucuccuggugaggacguucugauagauauugacgauaaagaaccgcucauccccauccaagaggaagaguucauugacuggugguccaaguuuuucgcuucaaucggcgagcgggaaaaaugcgggaguuacuuggagaaggauuuugacacccugaaaguguaugauacacagcucgaaaacguggaggccuucgagggacugagcgacuuuugcaauacuuucaaacuuuaccguggcaagacccaggaagagacggaagacccauccgucauuggggaguuuaaaggacuguucaagauauauccuuugcccgaagauccugcaaucccaaugcccccucgccaguuucaccaacuagcugcccagggcccacaggagugucuggugcgaauuuacaucguuagagcguucggucuccagcccaaagacccgaacgggaagugcgauccuuauauuaaaaucucuauaggaaagaagucgguaagcgaccaagauaauuacaucccauguacauuagagcccguguuuggcaaaauguucgaacugaccugcacucuuccucuggagaaggaccucaaaauuaccuuguacgauuaugaccugcucucaaaggaugagaaaaucggcgagacagucguggaccuggaaaacaggcuucuauccaaguucggggcccgguguggacugccacagacuuacugcguuaguggucccaaccaguggcgcgaucaauugagaccgucucaguuacugcaucucuuuugucagcagcacagggugaaggcaccugucuaucggaccgaccgagugauguuccaagacaaagaguacagcauugaggaaaucgaggcuggcagaauacccaauccacaccuggggccuguagaagaacgccuugcccugcauguccuccagcagcagggauuggugcccgaacacguugaguccaggccacuguauucaccccuacaaccugauauugagcagggcaagcugcagauguggguggaccucuuuccaaaagcucuuggucggccggggcccccuuucaacaucacaccacguagagcaaggcgcuuuuuccugcggugcaucauuuggaauacgcgagaugucauauuagacgauuugucucugaccggagaaaagaugagcgacaucuacgugaaaggcuggaugauuggcuuugaggaacauaagcagaagacugauguucacuauagaagucucgggggagaggguaacuucaauuggagguuuaucuuccccuuugacuaccugccugccgagcaaguguguacaauugccaaaaaggaugcuuucuggcgccuugacaaaaccgaauccaagaucccagcgcgggucguguuucagauaugggauaacgacaaauucagcuucgaugacuuucugggcucucuccaguuggaccugaauagaaugcccaagccugcaaagacugccaaaaagugcucauuagaucaacuagacgaugcuuuccauccggagugguuuguaucccuguucgaacagaaaacagugaaggggugguggccauguguugccgaggaaggagagaaaaagauccucgcaggcaaacuugagaugacccuggaaauugucgccgagagugaacacgaggaacgucccgcuggucaggggagggacgagccuaacaugaaucccaaguuggaggauccacggcgcccugacacgagcuuucugugguucacuucgcccuacaagaccaugaaauuuauccucuggcgaagauucaggugggcgauuauccuguuuauaauucuuuucauccuccuguuguuucuggccaucuucauuuaugcauuuccaaacuacgcugccaugaaguuagugaaaccguucucuuga

SEQ ID NO: 55576 - RNA, 1131 nt, Artificial Sequence
  derived and/or modified sequence opt3 from DYX1C1__Homo_sapiens__NP_001028731
augccccuccaggugagcgacuacuccuggcaacagaccaagacagccgucuuccugucucuuccucugaaaggcguuugcgugagagauacugacguauuuuguacggagaacuauuugaaggugaauuucccaccguuuuuauucgaggcuuuucuguacgcacccaucgaugacgagucaaguaaagccaagauugggaacgauaccauagucuucacacuauauaaaaaggaagcggcuaugugggagacucucagcgugaccggaguugacaaggaaaugaugcagaggauccgggagaaauccauucugcaggcccaagagcgcgcaaaggaagccacagaggcuaaagcagccgcuaagcgagaagaucagaaauacgcccuuucugugaugaugaagaucgaggaggaagaacguaagaaaauugaagacaugaaggagaaugaaagaaucaaagcgaccaaggcacuggaggccuggaaagaguaucagaggaaggcugaggaacagaaaaagauacaacgggaagagaaguugugccagaaagaaaagcagaucaaagaggagcgcaagaaaauuaaguacaagucgcucacuagaaaccuggccucaaggaaucuggcaccuaaaggucggaacagcgaaaauaucuuuacagagaagcucaaagaagauaguauuccagcuccccgcuccgucggcucuaucaagauaaacuucaccccucgaguguuuccaacggccuuaagagagagccagguagcggaagaggaggaauggcugcacaaacaagccgaggcaaggcgggcuaugaauacugacauugccgaacuuugugauuugaaggaggaggaaaagaaccccgaguggcugaaagacaaggggaauaaacuauucgcuaccgaaaacuaucucgccgcaaucaaugccuacaaccuggcuauucgucuuaauaacaagaugccucuguuguaccucaaccgcgcggcaugccaucugaaauuaaagaaucugcacaaggccaucgaggauuccucaaaggcuuauagaaucaugaaaaggcaucuccggcuuauucacccaacaaaacuguacaaguugaugcuacgacgcuuuggaauguga

SEQ ID NO: 55577 - RNA, 2547 nt, Artificial Sequence
  derived and/or modified sequence opt3 from DZIP1__Homo_sapiens__NP_055749
augcaggccgaggcugcagacugguucagcuccaugcccuuucaaaagcacguguacuauccucuggccucuggcccagaagggccggaugucgcgguugcugccgcagccgcuggagcagccucaauggcuugcgcgcccccuagugccgcaagcgguccacuccccuucuuucaguucagaccuaggcuugaguccguggacuggcggcgccugucugccaucgauguagacaaaguggcuggcgccgucgauguguugaccuuacaggaaaacauuaugaauauaacauuuuguaagcuggaggacgaaaaaugcccacauugucagucggggguugaucccgugcuacucaagcugauccgacuugcacaauucacuauugaguaccuguugcacucacaggaguuucucacgagccagcugcauacccuggaggaacgucucagauuaagucacugcgacggagaacaguccaaaaagcugcuuacaaagcaagcuggcgagaucaaaacuuugaaggaggaauguaaaaggcggaagaaaaugauuucuacccagcagcugaugaucgaggccaaggcgaacuauuaccagugccauuucugugauaaggccuuuaugaaucaagcauuccuacagagccacauacagcgcagacacacagaagagaacucccauuuugaauaucagaaaaaugcucaaaucgagaagcucaggucagagauugucgugcugaaagaggaacuucagcugacccggagugaauuggaggccgcucaccaugccagcgcaguacgcuucucuaaggaauacgagaugcagaaaacuaaggaggaagacuuucucaaacuguucgaucgauggaaggaggaagagaaggaaaaauuaguugacgagauggagaaggugaaagaaauguucaugaaggaguuuaaagaacugacauccaagaacucagcccucgaguaucaacuuagcgagauccagaagaguaauaugcagauuaaaucuaacaucgguacccugaaggaugcucacgaguucaaagaagacagauccccuuacccacaggacuuucacaaugucaugcaauugcuagauagccaggaaucgaaguggacggcgagggugcaggcaauacaucaggagcacaaaaaggaaaaggggcggcugcucucucauauugagaaacugcguacuuccaugaucgacgaucuuaacgccucaaauguguucuacaagaaacgcauugaggaacugggacaaagauugcaggagcagaacgaacucaucaucacccagaggcaacagauuaaggacuuuacaugcaauccgcugaacaguauaagcgagcccaaagucaaugcuccugccuuacacacucuggaaaccaaguccucucuaccaaugguucaugagcaggcauucagcucacacauccucgagcccauugaggaacugagugaagaggaaaagggccgggagaacgagcaaaaacuuaacaauaacaagaugcacuugcgaaaagcccugaaguccaauagcucucucacaaaaggccugcgcaccaugguggaacagaaccuuauggagaagcuggaaacguuggggaucaaugcugauauaagaggaauuucaagugaccagcuccauaggguacugaaaagcguggaguccgagcggcacaagcaggaacgcgagaucccuaacuuucaucaaaucagagaguucuuagaacaccaggucucuuguaagauugaagagaaagcccugcuaucgagcgaucagugcuccgugucacagauggacacucucaguacaggugagguuccaaagaugauccaacugcccucuaaaaauaggcagcuuauucgucagaaggcagugagcaccgaucggacuuccgucccgaaaauaaagaagaacgugauggaagacccuuuuccccgaaaaucaagcacaaucaccacgccaccuuucucuuccgaggaggaacaggaagaugacgacuugauuagagcguaugcuagucccggcccacugcccguaccuccaccgcaaaauaaggggagcuuuggcaaaaacaccguuaagucugaugccgacggaacagaggguuccgagaucgaagauacugacgauucacccaaaccugcagggguggccgucaagaccccaacagagaagguggagaaaauguucccccacaggaagaaugucaacaaaccugugggaggcacuaauguuccagaaauguuuaucaagaaagaggaacuccaggagcugaagugugcugacguggaagaugaggacugggauauuaguagcuuagaagaggagauaucgcugggcaagaaauccgggaaggaacagaaagagcccccgccugccaagaacgaaccacauuucgcacacguacuuaaugcuuggggagccuucaaccccaaagguccuaagggcgagggguugcaagaaaacgagucuagcacccucaaaucaagucuggucacagugaccgacugguccgauacuucugacguuuga

SEQ ID NO: 55578 - RNA, 1314 nt, Artificial Sequence
  derived and/or modified sequence opt3 from E2F1__Homo_sapiens__NP_005216
auggcccuggcuggcgcacccgccgggggaccuugcgcgccagcucucgaggcccuucugggugcaggcgccuugagauuacuggacagcucccagaucgugauuauaucugcugcacaagaugccucagcuccgcccgccccuaccgggccagcggcacccgccgcuggaccuugugacccagaucuacuccuguucgccacaccccaggcaccuaggccaacuccgagugcuccccggccugcccuuggccgcccacccgucaagcgacgucuggacuuggaaacggaucaccaguaccucgcggagagcuccgguccugccagagggaggggacggcauccaggcaaaggcguuaagucucccggggaaaaaucgcgcuaugagaccucacugaaccugacaacuaagagauuucucgaauuacugagccacagugcagacggagugguagaucuuaauugggcugccgagguguugaaaguccagaagaggcggaucuacgacauuaccaacgugcuggaggguauccaacuaauugcuaagaaauccaagaaucauauccaguggcucggcucucacacaaccguuggggugggaggccgccuggaaggucuuacucaggaucugcgacaguugcaagagagcgaacagcagcucgaccaucugaugaacauaugcacaacccaguuaagacugcucuccgaggauacggacucacaaaggcuugccuaugucacuugucaggaucugcggaguaucgcagacccggccgagcagauggugaugguaauuaaagcuccucccgaaacccaauugcaggcgguugacagcucugagaauuuccagaucucccuaaagucaaaacaggggccaauugauguguuucugugcccugaagagacagucggaggcaucagccccggcaagacuccaagucaagaagugaccucugaggaggaaaaccgugcaacagacuccgccaccauagugucgcccccuccaagcucuccgcccuccucacucacgacugauccuagucagagccugcuuucccuggagcaggaaccauugcucucucgcauggggagccugagagcucccgucgacgaggauagguuaucaccucugguugccgcagacagucuacucgaacacgugcgggaggauuucuccggacugcuuccagaggaauuuauuagcuugucucccccgcacgaggcccuggacuaccauuucggucucgaagagggcgaagggauccgagaucuguuugacugugauuucggagaccuuacaccucuggacuuuuga

SEQ ID NO: 55579 - RNA, 1005 nt, Artificial Sequence
  derived and/or modified sequence opt3 from E2F3__Homo_sapiens__NP_001230005
augccccugcagcaacaggccaagagaaggcucgagcuuggcgaaagcgggcaccaguaccuguccgacggauugaaaaccccuaaggguaaaggccgggcugcauuacgcucuccagauucaccgaagaaaaagacacgauaugacacgagucuggggcuacucacuaagaaauucauccagcugcuuagccaaucccccgauggagugcuggacuugaacaaggccgcggagguccucaaaguucagaagcguagaauuuacgauauaaccaaugugcuggaaggcauccaucugauuaaaaagaagucuaaaaacaauguacaguggauggguugcucgcucucagaggacgggggaauguuagcucagugucaaggccugagcaaggaagugacagagcuuagucaggaggagaaaaaguuggaugaacugauccaguccugcacucuagaccucaaacugcuuaccgaagauucugagaaccagaggcuggccuaugucacauaccaagacauucggaagaucagcggcuugaaagaucagaccgugauaguugugaaggcaccuccagagacucgccucgaaguccccgacuccaucgagucacugcagauucacuuagccaguacacaagggccuaucgaaguguaucuguguccagaggaaaccgagacgcauagccccaugaagacuaauaaccaggaucacaauggaaacauuccuaaaccagcuucuaaggaccucgcauccaccaauucaggucauagcgacugcaguguaucuaugggcaaccuuuccccgcuggccagccccgcuaauuugcuacagcagacagaggaucaaaucccuucgaaccuggaagggccauuuguuaaucuccugcccccucuucugcaggaggacuacuugcucucucugggagaagaggaaggcauauccgauuuauucgacgccuaugaucuggagaaacuaccacucguggaggacuuuauguguucauga

SEQ ID NO: 55580 - RNA, 1242 nt, Artificial Sequence
  derived and/or modified sequence opt3 from E2F4__Homo_sapiens__NP_001941
auggccgaggccggcccccaggcaccuccaccgcccgggaccccuagcagacacgaaaagucccugggacuccuuacaacuaaauucgugucucuguugcaagaggccaaggacggugucuuagaucugaaacuagcggcugacacgcucgccguuaggcagaagcggcgcaucuacgauauuaccaacgugcuggaaggcauagggcuuaucgagaaaaagucaaagaauaguauucaguggaaaggaguaggcccagguugcaacacacgagaaaucgcagacaagcugauugaguugaaagccgagaucgaagaacuccagcaacgugaacaggagcuggaucagcauaagguguggguccagcaaagcauaagaaaugugacugaggacguucagaacuccugucuggcuuaugugacccacgaagauaucuguaggugcuuugcaggggacacacucuuagccauucgggcucccucuggaaccucgcuggaggucccuaucccagaaggccuuaauggccagaaaaaguaccagauucauuugaagucagugagcgggcccaucgagguacugcuaguuaacaaagaagccuggaguuccccuccaguggcggucccggugcccccuccagaggaucuccugcaaucucccagcgcaguguccacuccuccaccccuuccgaagccugcccuggcucagucacaggaggccagucgccccaauagcccacaauugacaccuaccgcaguccccggaucugcugaaguucaggguauggccggcccagcggccgagauaacgguguccgggggacccggcacugacucaaaagauagcggugaacucaguucucugccuuuagggccaaccacacuggacacuagaccgcuccaguccagcgcacuucuggauucgucuuccucaaguagcuccucuagcucaaguuccagcaacucuaauucaaguagcuccucuggacccaacccuucgaccagcuucgagccaauuaaggcugaccccacaggcguauuggaacuaccuaaagagcuguccgagaucuuugacccaaccagggaaugcaugucaagugagcuccuggaggagcuuaugucuagcgaaguguucgcuccccuguugcggcucuccccgccuccaggcgaucacgacuauauuuacaaucuggaugagucagagggggucugugacuuauuugaugugcccguucugaaccuauga

SEQ ID NO: 55581 - RNA, 1038 nt, Artificial Sequence
  derived and/or modified sequence opt3 from E2F5__Homo_sapiens__NP_001077057
auggccgcugcagagcccgccagcuccggccagcaagcgccugcugggcagggacagggucagagaccaccgccccaaccuccacaggcccaggcaccccagccuccacccccuccacaacugggcggggccggaggcgguucuucaaggcacgaaaagagucucgggcuucugaccacaaaauucgugagcuuguuacaggaggcuaaggacggaguccuggaucuaaaagcagccgcugacacucucgccguucggcagaagcgccgaaucuacgauauuacgaacgugcuggaaggcauagaccuuaucgagaaaaaguccaaaaauucuauucaguggaagggcguaggggcgggaugcaacaccaaggaagugaucgaucgucugagauauuugaaagcagagauugaggaccucgaacugaaggagagggaacuggaucaacagaaacucugguuacagcaaucgaucaagaaugucauggacgauucaauaaacaaucgguuuagcuacgugacacaugaggacaucuguaacugcuucaauggugauacucugcuugccauucaggcuccgaguggcacccaguuggagguucccaucccugaaauggggcagaacggacaaaagaaauaucagauuaaucugaagucccacucuggcccaauccaugugcuacucauaaacaaagagagcuccucaaguaagcccgucguguuuccuguaccacccccggacgaucugacacagccuagcucucagucccuuacccccguuacuccacaaaaaucaagcauggccacacagaaucugccugaacagcacgugagugagcgcucucaggcauugcaacagaccuccgcuacggacauuagcucggguucuaucuccggggacauuaucgaugaacucaugucaagugacgucuucccccuguuaagacugagcccaacucccgccgaugacuacaacuuuaaucucgaugacaacgagggagugugugaucuuuucgacgugcagauccugaauuauuga

SEQ ID NO: 55582 - RNA, 750 nt, Artificial Sequence
  derived and/or modified sequence opt3 from E2F6__Homo_sapiens__NP_001265204
augaaccccagcccuuccaagaucagaauuaaucuggaggacaacgugcaguacgucucuaugaggaaagcccucaagguuaaacggccacgcuucgaugugucacuuguauaucugacccgaaaguuuauggacuuggugcguagugcuccgggcgggauauuagaucugaauaaagucgcaacaaagcuaggagugagaaagaggcggguuuacgacaucacuaacgugcucgaugguauugaccuggucgagaaaaagagcaaaaaucacauccgcuggauuggcuccgaucuuucuaacuucggggccgugccccaacagaagaaacugcaggaagaauugucggaccucucagcgauggaggaugcucuggacgaacugaucaaggauugcgcccagcaacucuuugaguuaacggacgauaaggagaaugaaagacuggcauauguaaccuaccaggacauacauagcauccaggccuuccacgagcagauuguuaucgcugugaaagccccugcagaaacaaggcuugacgucccagcuccccgggaggauaguauuacugugcauauccgcuccaccaacggaccuauagacguguauuugugugaggucgaacaaggccagacaucuaauaagcgaagcgaggguguugggaccuccucaagugaaagcacucacccagagggacccgaagaggaggaaaacccucagcagucugaggaacugcuagagguguccaauuga

SEQ ID NO: 55583 - RNA, 2736 nt, Artificial Sequence
  derived and/or modified sequence opt3 from E2F7__Homo_sapiens__NP_976328
auggaggugaacugccugacccucaaggaccuuaucagccccagacagccuaggcuggauuucgccgucgaagacggcgagaaugcucaaaaagaaaacauuuuuguugaucggucccgcauggcaccaaagacaccgaucaaaaaugagcccauagacuugucuaagcagaaaaaguucacuccugaacgaaacccaauuacgcccgugaaguuuguagaucgucagcaggccgagccuuggaccccaacagcgaauuuaaaaaugcugaucucagcugccagucccgacauuagagauagggagaagaaaaaggggcuauuccggccuaucgaaaacaaagacgaugcauuuacugacagccuccaacuggauguggucggagacuccgccguggaugaguucgaaaagcagcgcccaucuagaaagcagaaaucgcuuggucuguugugucagaaguuucucgcuagguacccgucauauccccugagcaccgagaaaacaaccauaagucuggacgagguugcagugucccucggcgucgaacggcgccgaaucuacgacauugugaauguauuagagucucugcaccuuguuagcagaguggccaagaaccaauauggguggcauggaaggcacuccuugccuaaaacucugcggaaucuacagcgucucggcgaagaacagaaguacgaagaacagauggcuuaucugcaacagaaagagcuugaucugaucgacuacaaguucggugaacgcaagaaagauggggacccagauucacaggagcaacaguugcucgacuuuagugaacccgauugcccuucuagcuccgccaacucaagaaaggacaaaagccugaggauuaugagucagaaguucgucauguuauuucuggugucuaaaacaaagaucgugacccucgaugucgcggcaaagauacuuauugaggaaucccaggacgccccagaucauagcaaauucaagacgaaaguucggcgacuguaugacaucgcuaauguguugacuucgcuagcccugauuaagaaaguacacgugaccgaggagcgcggaagaaagcccgcauuuaaguggaucggcccggucgacuucucuuccucagaugaggagcucguggacguuagugcuagcgugcugccugaacuuaaaagggagacauacggccaaauccaggucugugccaagcagaaacuggcgcggcauggguccuucaacacugugcaggccucugaacgcauucaaagaaagguaaauagcgagcccucaaguccauacagggaggaacagggauccgguggcuauagcuuggagauagggucucucgcagcuguuuaccgucagaaaaucgaagauaacucacagggaaaggccuuugcuaguaagcggguggucccucccagcuccucucuggacccaguggcccccuucccugucuuaucgguggauccagaguauugcguuaauccgcuggcacaccccguguuuagcguagcccaaaccgaccuacaggcuuucuccaugcagaacggccucaacggucaggucgaugugucacuggcgagugcagccucugcuguugagagccuuaaaccugccuugcuggcagggcaaccacucguguacguccccuccgccucacuguuuaugcuuuauggaagccugcaggaaggcccugcuucuggcuccgggagugagcgagacgauagaagcucugaagccccagcaacaguggaguuguccucagcgcccagugcucagaagaggcucugugaggagcgcaaaccgcaagaggaagacgagccugccaccaagcggcagagcagagaauacgaggauggaccacugucguuaguaaugcccaaaaagccuuccgacucuacggaucuggcaagccccaaaacuauggguaauagggccucaauuccacuaaaggacauccacgugaacggccagcucccugcugccgaagagauaagugggaaggcaacagcuaauucccugguuucuagcgaguggggaaaccccucccgcaauaccgacgucgaaaaaccaucaaaggagaacgaaagcacuaaagagccgagucuuuugcaguaucugugcgugcaaucuccugccggccucaaugguuucaacgugcuguuauccgggagccagacacccccaaccgucggccccucgucaggacagcugccuucuuuuaguguuccauguauggugcuucccuccccuccguugggcccauuccccgugcucuacagcccugcgaugccagggcccguaucuagcacgcugggagcccuaccuaauaccgguccggucaacuuuucccugcccggccucgggucaauugcucagcugcuugugggaccaacagcaguugugaauccuaagaguagcacuuugcccucugccgauccacaacugcagucccagccuucauuaaaccucagucccgucaugagccgaucccauucugugguucagcaaccagaaucgccgguguacguaggccacccugucagcguggugaaacugcaucagucacccgucccaguuacccccaaguccauccagcggacacaccgugagacuuucuuuaagaccccugguagucuuggggacccagugcugaaaagaagggagcgcaaucaaucucggaacacaagcuccgcucagagaagguuggaaauccccucaggcggagccgauuga

SEQ ID NO: 55584 - RNA, 2604 nt, Artificial Sequence
  derived and/or modified sequence opt3 from E2F8__Homo_sapiens__NP_078956
auggagaacgaaaaggagaaucuguucugcgaaccccacaaaagaggccucaugaagaccccucuuaaagagagcacaacugccaacaucgugcuggcugaaauucagccagacuuugggccguugacgacccccacaaagccuaaagagggaucccaaggugagccauggacucccaccgcaaauuuaaagaugcugauaucugccgucucaccugaaaucaggaaccgggaucagaagcgcggccuauucgacaaucgaagugggcucccagaggcgaaagauuguauucaugaacaccugagcggagacgaguuugagaagucccagcccucucguaaagaaaagucgcuuggccuguugugccauaaauuccucgcuagauacccuaacuauccaaauccggccguuaacaaugauaucugucuggacgagguggcagaagaacugaacguagaaaggcggcgcauuuacgauaucgugaauguccucgagucauuacacauggugagcagacuggccaagaacagguauacauggcauggucggcacaaucuuaacaagaccuuggggacucugaaaaguauaggagaggaaaauaaguacgcugagcagaucaugaugauuaaaaagaaagaauaugagcaagaauuugacuucaucaaguccuacucuauugaggaucacaucauaaaaagcaacacaggccccaacggccauccugacaugugcuuuguugagcuaccagggguggaguuccgcgcagccuccgucaauucacgaaaggauaagagucucagagugaugagccagaaauuuguaaugcuguuccuuguuucuacuccccagauugugucccuggaggucgcugccaagaucuugauuggagaagaccacguggaggaucucgacaaaucaaaguuuaaaacgaagaucaggcggcuguaugacaucgcgaacguguuaagcagucuggaucucauuaagaaaguccauguuacugaggaacguggucgcaagccugcauucaaauggaccggcccagagauaucucccaauacauccgggagcucgccggugauccacuuuacuccuucugaccuugaaguaagaagguccucaaaggagaacugugccaaaaaucuguucaguacccggggaaagcccaacuucacacgacaccccagcuugauuaagcuagugaaauccaucgaaucugaucgcagaaagauaaauagcgcuccuucaagucccauuaaaaccaacaaggccgaguccagccaaaauucugcaccauuucccucaaaaauggcucagcuggccgcgaucugcaagaugcagcucgaggaacagaguagcgaguccaggcagaaggucaaagugcaacuggcccggucuggcccuuguaagccaguugcaccgcuugacccaccugugaacgcugaaauggagcugacggccccaucguugauccagccccucgguauggucccucugauuccaagccccuuauccucagcugugccgcugauccuaccucaggccccaagugggcccucuuacgcaauuuaccuccaaccuacucaggcccaucagagcguaacacccccacagggacuguccccuaccguuugcacuacacacucaagcaaagcuaccggcucuaaggauuccacggacgcgaccacagaaaaagcagccaaugauaccaguaaggcuagcgccucuacccgccccggcucccuuuugccagcaccggagagacaaggggccaaaucaaggacacgugagccugcuggagaacgggguaguaagcgagccagcaugcuggaggacucgggcuccaagaaaaaguucaaagaagaucucaaggggcuggagaacgugucugcaacucuuuuucccagcggauaucugauaccauugacccaguguucaagucucggcgcggaauccauccugucugguaaagagaauagcuccgcuuuaucacccaaccauagaauuuacagcaguccuaucgccggggucaucccagugacaucuuccgagcugaccgcagucaauuuccccagcuuucacgugacuccucuaaagcucaugguuucgccgacgucaguggccgcuguaccagucggcaacucucccgcccuggcaaguucccauccugugccaauucagaaccccagcucugcuauaguuaauuucacacuucagcacuugggacugaucagcccuaacgugcaacucuccgccucaccgggcagugggauuguccccgugagcccaaggaucgaaucuguaaauguggcgccugagaacgccggaacccagcagggucgcgcuacuaauuaugacucccccguuccaggccagucacaaccuaacgggcagagugucgcagugaccggagcccagcagcccgugccagucacaccgaagggcagccaacugguugcugaauccuuuuuccggaccccuggugggcccacuaaaccaacaucuucgagcugcauggauuuugagggcgccaauaagacgucauuaggaacccuguucgugccccagagaaaacuugaaguguccacugaggacguacacuga

SEQ ID NO: 55585 - RNA, 2355 nt, Artificial Sequence
  derived and/or modified sequence opt3 from E4F1__Homo_sapiens__NP_004415
auggagggcgccauggcugugagagucaccgcagcccacacagcggaagcucaggccgaggcagggagggaagccggagagggugcuguugcagccguggcugccgcgcuggcacccagcggcuuccucgggcuuccugccccauuuuccgaagaggacgaggaugacguacaucggugcggacgcugucaagcugaguucacugcccuggaagauuuugugcagcacaagauccagaaagcaugccagcgagcuccgcccgaagccuugccugcgacgccagccaccacagcauuacugggccaagaggucgugcccgcugccccugguccagaggaacccauuacuguugcucauauaguggucgaggccgcaucucuagccgcugacaucucacacgcgagugaucucgugggaggaggccauauuaaggaaguaaucguugcagccgaggcugaacugggcgacggggagauggccgaggcaccuggaagcccacaccagcagggucuuggccuggccggggaaggagagcaggcucaagugaaauugcucgucaacaaggauggccguuacgugugugcccugugccacaaaaccuucaagacagguuccauucugaaggcacauauggugacccacucuucgagaaaagaccaugaauguaagcucugcggggcgucauuuaggacuaaagggagcuuaauccggcaccaccgcagacauacagaugagaggccguauaaguguaguaaaugcggcaaguccuuccgggaaucuggcgcucugacccgccaccuuaagagcuugacgcccuguacugagaaaauacgauuuuccgucucaaaggacguugugguaaguaaagaggaugccagagcagggagcggagccggugcugccggccuggggaccgcaacaucuuccgugacuggagaaccuaucgagaccucaccagucauucaucuagugacagacgcuaagggcaccguuauccacgaagugcauguccagaugcaggagcucagccuggguaugaaagcccuugcgcccgaaccuccagugagucaggagcugcccugcuccuccgaggggagcagggaaaauuugcuccaccaagccaugcagaacucgggcauuguacuggagcgggcugcaggagaagagggcgccuuagagccggcuccugccgcagggucuucuccccagccacuggcgguugccgcuccucaacuccccgugcuugaaguccagccacuggagacucagguggccucagaagcaagugcugucccccguacgcacccuuguccacagugcagcgagacauucccgaccgccgcaacuuuggaagcccauaagcgcggacacacaggucccagaccuuuugcuugcgcgcaauguggcaaagccuucccaaaggcauaccuacugaagaaacaucaggaggugcacguuagggagcggcgauuucgcugcggggauuguggaaagcucuauaaaaccaucgcucacgugagaggccauaggcggguacacuccgacgaacgccccuacccuugcccaaagugugguaaaagauauaagacgaagaaugcccagcagguccauuucaggacccaccuggaggaaaaaccccaugugugccaauuuuguucucguggguuccgggagaagggcagccuuguucgacacgugagacaccauacaggagaaaaaccguucaagugcuacaaauguggcaggggguuugccgagcacggaacucugaaccgccauuugcggaccaaggguggcugccuccuggaggucgaagaguuacuggugucagaagacaguccugcugcagccacaacuguacuaaccgaggauccacacacagugcucguugaguucuccagcgucguggcggacacccaggaauauauaauugaggcuacugccgaugacgcagaaacgucugaggccacagaaaucauugaggggacccagacugagguggauucacauaucaugaaggucguucagcaaaucgugcaccaggcuagugcaggacaccagauuauagugcagaauguaaccauggacgaagagacagcccugggccccgaagcggcugccgcagauaccaucacuauugccacaccugagagccuuacggaacaagucgcuaugaccuuggccuccgcaaucucugaggguacugugcuggcugccagagcggggacaucgggcaccgagcaggccacaguuacuauggugagcuccgaagacauagagauucucgaacaugcaggagagcuggucaucgcuucacccgaaggccagcuugaggugcaaaccguuaucguguga

SEQ ID NO: 55586 - RNA, 807 nt, Artificial Sequence
  derived and/or modified sequence opt3 from EAF1__Homo_sapiens__NP_149074
augaacggcaccgccaauccccugcucgacagagaggaacacugccuuaggcugggggagagcuucgaaaagcggccucgcgcuuccuuucauacaauccgauacgauuucaaaccagcaucuauugacacuucaugugagggagaauuacagguggguaagggcgaugaggucacgauaaccuugccgcacauccccgggaguacaccuccaaugacuguuuuuaaaggaaacaagcgucccuaucaaaaagacugcgugcugauuaucaaucaugauaccggcgaguacguacuagaaaagcucagcuccucuauucaggugaagaaaacaagagccgaggguucgucaaagauccaggcgaggauggaacagcaaccuacccggccaccccagacuagccagccuccaccgcccccuccacccaugccuuuccgcgcuccaacaaaacccccggucgggccuaagaccaguccccugaaagacaacccauccccugagccccagcuugaugacauaaagagagagcugagggccgaaguggauaucauugagcaaaugucuagcuccucaggaaguucuagcuccgacucagaaagcaguucuggcuccgaugacgauagcucgucuuccggcggggaggacaauggaccagcaucacccccucagccaagucaccagcagccguauaacagccggcccgccguugcuaaugguacgucccgcccucaaggcucuaaccaguugaugaauacucuccgaaacgaccugcagcugagcgaaucagggagugauuccgacgauuga

SEQ ID NO: 55587 - RNA, 783 nt, Artificial Sequence
  derived and/or modified sequence opt3 from EAF2__Homo_sapiens__NP_060926
augaacagcgccgcuggcuucucccaccuggacagaagggagcgggugcucaaacuuggggaaucuuuugagaagcagccccgcugcgcauuccauaccguccgauacgauuuuaagccugccucaaucgacacaaguagcgaaggauaucuggagguuggugaaggcgagcaagugacuauuacguugccaaauauagagggguccaccccgcccguaacaguguucaaaggaucuaagaaaccuuacuuaaaggaauguauccugauuaucaaccacgauacuggcgagugccgucuagaaaagcucucgucaaauauuaccgucaaaaagacaagaguggaggguagcaguaaaauccaguauaggaaggagcagcagcaacagcagauguggaacuccgcgcggaccccaaaucugguuaaacauucucccagcgaagacaagauguccccugcuucaccaauagaugacaucgagcgcgaacuuaaggccgaggcaagucugauggaucagaugagcucuugugacuccucaagcgauaguaaaucuuccagcucgucuuccucagaagacaguagcuccgauucugaggacgaggauugcaagagcucaacaagugacacugggaacuguguguccggacaccccaccaugacgcaauacaggauuccugacaucgaugccagccauaauagauuucgggacaacucuggcuugcucaugaauacucugcgcaacgaucugcagcucucagaaaguggcagcgacuccgaugacuga

SEQ ID NO: 55588 - RNA, 1572 nt, Artificial Sequence
  derived and/or modified sequence opt3 from EARS2__Homo_sapiens__NP_001077083
auggccgcucugcucagaaggcuucugcagcgggagcgccccagcgcagccuccggccgaccuguggggcguagagaagcgaacuugggaaccgacgcuggugucgccguuagggugcgguucgcaccaucuccgacaggcuuuuuacaccuugggggacuacgcacugcccucuacaauuauaucuucgcuaagaaauaccaaggcucauuuauucugagacuugaggauacggaccagaccaggguagugcccggugcagccgaaaacauagaggauaugcuggaaugggcugggaucccuccagacgagaguccccggcgcggaggcccugccggcccauaucagcagagccaacgauuggagcucuacgcgcaggcaacagaagcccugcugaagacuggggcugccuaucccugcuucuguuccccucagagacucgaguuacugaaaaaggaagcacuuaggaaucaucagaccccacgguacgauaaccguugccgcaauaugucucaagagcaggucgcucagaaauuggccaaggacccgaagcccgcgauuagauuuaggcuggaacaggugguuccugccuuccaagaucuaguguauggauggaaccggcacgaagucgcaucgguggagggugacccaguaaucaugaaaucagauggcuuucccacauaccaucucgcuuguguuguggacgaucaccauauggggauuagccacguccugcgaggaagugaauggcuuguguccaccgccaagcaccuguugcucuaccaggcucugggcuggcagccuccacauuucgcccacuuaccccugcuccuuaaucgcgacgguucuaaacugagcaagagacaaggggauguguuuuuggagcauuucgcagccgacggauuucuaccggacucccugcucgauaucauaacuaacugcggcucaggcuucgcugaaaaucagauggggaggacacugccugagcuuaucacccaguuuaaccugacgcaggucacuugucacagugcguugcucgaccuggagaaauuacccgaguucaaucggcugcaccuacaacgccucguuagcaacgagucucagagaaggcagcuggugggaaagcugcagguauugguggaagaggcauucgguugccaacugcagaaucgugauguccucaacccaguguauguugaacggauucugcuucugcgacagggccauaucuguagauugcaggaccucguguccccugucuacucauaucuguggaccaggcccgccguggggcgcgcucaauuagaugccauuagcgagaagguagacguuaucgcaaaacgggugcugggacuacucgagagaaguucuaugucccugacacaggauaugcuuaauggcgaauugaagaaacugagcgagggucucgaagggacuaaguacucgaacgucaugaaacuguuaaggauggcccugucuggccagcagcaaggaccacccguggcugagaugaugcuugccuugggcccuaaggaaguccgcgagcgaauacagaaagugguuuccucauga

SEQ ID NO: 55589 - RNA, 642 nt, Artificial Sequence
  derived and/or modified sequence opt3 from EBAG9__Homo_sapiens__NP_001265867
auggccaucacccaguucagacuguuuaaguucugcacaugucucgcuacuguguuuagcuuccuuaaaaggcugauuugccgguccggccgcgggcgaaaguugucuggagaccaaauaacguuacccaccacagucgauuacucaaguguuccuaaacagacugacguggaggaauggaccagcugggaugaggacgcaccaacauccguaaagaucgaagguggcaacgggaauguggccacccagcagaacucucuggagcaacuagaaccggauuauuuuaaagacaugacucccacaauucguaagacccagaagaucgucauuaaaaagagagagccucucaauuucggaaucccagauggcucgacggguuuuucaagcaggcuggcggcuacucaggaccuucccuucauacaccagaguuccgagcugggggauuuggacaccuggcaagaaaacacaaaugccugggaggaagaggaggaugcagccuggcaggcugaagaggugcuccggcagcagaaacuggcagaccgcgaaaagagagccgcugagcaacagaggaaaaagauggaaaaggaggcccagcggcugaugaaaaaggagcaaaacaaaaucggaguuaagcucucuuga

SEQ ID NO: 55590 - RNA, 1776 nt, Artificial Sequence
  derived and/or modified sequence opt3 from EBF1__Homo_sapiens__NP_076870
auguucggcauccaggagagcauucagagauccgggucuucaaugaaggaggaaccccugggaagugguaugaacgccgugaggaccuggaugcagggcgcugggguccucgacgcaaauacagccgcgcagagcggaguuggccuugcucgggcccacuuugaaaaacagccuccauccaaccugcgcaagucuaauuucuuucauuucguguuggcauuauacgaucgacaaggucagccgguagagauagaacguacugccuuugugggguucgucgagaaagagaaggaagcuaacucggagaaaacgaauaacggaauccacuauagacugcagcuacucuacucaaauggcauuaggaccgaacaggacuuuuaugugcggcugaucgauagcaugacaaagcaagcaauuguuuacgagggccaggacaagaaccccgagaugugccgcgugcuucugacucaugaaaucauguguaguagaugcugugauaaaaaguccugcgggaauaggaacgagaccccuucugacccagucauaaucgaucgguucuuuuugaaauucuuucucaaguguaaucagaacugccugaaaaaugccggaaacccccgcgacaugcgaagauuccaggugguaguuagcacaaccgugaaugucgauggucacgugcuggcuguguccgacaacauguuuguccauaacaauucaaagcacggcaggcgggcccgucgccucgauccuagugaagggacuccaagcuauuuagagcacgcgacacccuguauuaaggcaaucucuccuuccgaaggauggaccacgggcggugccacuguuauuaucauaggggacaacuucuucgauggacugcaagugauuuuuggcaccaugcuuguauggucagaguugaucacaccacaugcuauuagagugcagacuccgcccaggcacaucccuggcgucguggagguuacccugagcuacaaaaguaagcaguucugcaaagggacaccaggacgguuuaucuauaccgcccuaaaugaacccacgauugacuacgguuuccaacgacuccagaaggugauaccucgccauccaggcgaccccgagagacugccgaaagaagucauccuuaagagggcagcugaucugguggaggccuuguacgggaugccucacaacaaucaggaaauuauccucaaacgggcggccgacauagcagaggcucuguauucuguaccccgcaaccacaaucaguuaccagcccuggcuaacacuuccguucaugccggaaugaugggcgugaauagcuuuucgggucaacucgcagucaacgugucugaggccucccaggcuacaaaucagggguucaccagaaacucaaguagcgucuccccucacggcuacgugcccucuacuacaccacagcaaaccaauuauaacagcguuacgaccucaaugaauggauacggcagugcggcaauguccaaccuugggggaagccccacauuucugaacgguucugccgcuaauucaccuuaugccauugugccaaguagcccgacuauggcauccucuaccucguugcccagcaacuguuccucaaguucuggcaucuucagcuuuuccccugccaauaugguaucagcugucaagcaaaagagcgccuucgcaccagugguuaggccccagacaucuccuccacccacuugcaccuccacaaacgggaauagucuacaggcgaucagcggaaugauugugccgccuauguga

SEQ ID NO: 55591 - RNA, 1728 nt, Artificial Sequence
  derived and/or modified sequence opt3 from EBF2__Homo_sapiens__NP_073150
auguucggcauccaggacacccuggggagaggacccacacucaaggagaaaagccuuggugccgaaauggauuccgugaggucuuggguccggaacguuggcgugguagacgcuaauguggcagcccaaucaggggucgcgcugagucgcgcucacuuugagaagcagccuccaagcaacuugcgaaaauccaauuucuuucauuucguguuagcccuguacgaucgucagggacagccgguugaaauugagagaacugcauuuguggacuucgucgaaaacgauaaggagcaaggcaaugagaaaacgaacaaugguacccacuauaagcuacagcuccuguacucuaacggggugaggacagaacaggaccuuuauguacggcugauagauucgguuacuaagcagcccaucgccuacgagggacaaaauaaaaacccugaaaugugccgcguguugcucacccaugaggucauguguucaagaugcugugagaagaaaagcugcggcaauaggaacgaaacaccaagugaccccgugauuaucgaucgguuuuuccugaaguuuuuccugaaauguaaucagaacugccucaagaccgcuggcaauccucgcgacaugcgaagauuucagguggucuuauccacuacaguuaacguggaugggcacguacuggcagugucugacaacauguucguccauaauaacagcaagcacggaaggcgggcccgucgccuugauccauccgaggcuacccccuguauuaaagccaucucaccuagugaagguuggacgacuggcggggcgauggugauaaucauuggagacaacuuuuucgacggcuugcagguuguguucgguaccaugcuggucuggagcgagcuaaucacaccacacgcaauuagagugcaaacuccgcccaggcauaucccugggguaguugaagugacccucucuuauaaguccaaacaguuuugcaagggagccccaggccgguucauauacacagcucugaaugagcccaccauugauuauggcuuucagcgacuucaaaaagucaucccucgccacccaggggaccccgagagacuggccaaggaaauguugcucaaaagggcagcugaucugguggaggccuuauacggaacgccgcauaauaaccaggacauuauccugaagcgggcggccgauaucgcagaagcucucuacucagucccucgcaaucccagccagcuuccagcccugaguucuuccccugcucacagcgguaugaugggcauuaacucguaugggucucaguugggaguguccauaucagagaguacucaaggcaauaaccaggguuacaucagaaauacaagcuccauuucucccaggggguauagcucaaguuccaccccacagcagagcaacuacucuacuucaaguaauagcaugaacggcuauuccaauguucccauggccaaccuaggagugccuggcucuccaggguuccugaacggaucgccgacagguagccccuacggcaucauguccucaaguccuaccguagggucuagcuccacgucaagcauacucccauuuucuuccagugucuuccccgcagugaagcagaaaagcgccuuugcuccuguuauucguccacaaggaucucccuccccggcguguucaaguggcaaugguaacggguuccgggcaaugaccggccugguggucccuccaauguga

SEQ ID NO: 55592 - RNA, 1656 nt, Artificial Sequence
  derived and/or modified sequence opt3 from EBF3__Homo_sapiens__NP_001005463
auguucggcauccaggagaacauucccagagggggaaccacaaugaaggaagaaccucuggguagcggcaugaauccagugagguccuggaugcacacugccggggucguugacgcuaacacggcagcccaaucuggagugggccucgcgcgggcucauuuugaaaaacagccgcccucaaaucuucgcaagaguaacuucuuucacuucguacuggccuuguacgaucgacagggucagccuguggagauagaacguaccgcauuugucgacuucguggagaaagagaaggaaccaaauaacgagaaaacaaauaacgggauccauuauaaguuacaacugcuauacagcaauggaguuagaacugaacaggaucucuaugugaggcugauugacuccaugaccaagcaggccaucgucuacgagggccaggauaaaaaccccgagaugugccgggugcuucugacacacgaaauuauguguucucgcugcugugacaagaaaucgugcggcaauagaaacgagaccccuucagauccaguaaucauagacagguuuuucuugaaguuuuuccucaaauguaaucaaaacugccugaagaaugcugggaacccccgggauaugcgccgauuucagguuguggucagcacuacagugaacguggacggacauguccuggcaguuagugauaauauguucgugcacaacaauuccaagcacgguagaagggcccggcgucucgacccuucugaagcuaccccauguaucaaagccauuagcccguccgagggcuggacgacugggggagcgaccguaaucauuaucggcgauaacuuuuucgacgguuuacagguggucuucgggacaaugcugguguggucagaacuuauaacuccccaugcaauucgcguucagaccccuccaagacacauccccggaguggucgaggugacauugaguuauaagagcaaacaauuuugcaagggcgccccuggcagguucguauacaccgcucugaaugagccaacgauugacuauggguuucagcggcuacagaaaguuaucccccgacauccgggagauccugaacgccuccccaaggaggugcugcuuaaaagagccgcagaccuggucgaggcuuuguacgguaugccacacaacaaucaagagaucauucucaagagggccgcggauauagccgaagcacuguacucugugccucggaaccacaaucagauccccacuuuaggcaacaauccagcucauacagggaugaugggagucaacuccuucucaagccagcuggccgugaauguuagugagaccucucaggcuaacgaccaagugggcuauucccgcaauacuagcucgguaucucccagagguuacgucccuuccucaacaccacagcagaguaacuauaacaccgugagcacguccaugaauggguacggcucuggagccauggcaagccucggcguuccggggucacccggauuucuuaacgguaguuccgccaauagcccuuauggcaugaagcagaaaucugcuuucgcgccaguggucaggccccaagcaucaccuccacccaguuguaccagcgccaacgggaauggacugcaggcuauguccggcuuggugguaccgccuauguga

SEQ ID NO: 55593 - RNA, 1797 nt, Artificial Sequence
  derived and/or modified sequence opt3 from EBF4__Homo_sapiens__NP_001103984
auggacgcccugcccagaagcggccucaaccuuaaggaggaaccucuguugccagcuggguuaggauccgugaggucuuggaugcagggugcaggcauccuggaugccucaaccgcggcucaaaguggggucggacuagcccgggcacacuucgagaaacagccgcccagcaaucuccgcaaguccaacuuuuuccauuuuguucuggccauguacgaccgacagggccagccuguggaaguagagcguacagcuuucauugauuuuguggaaaaagacagagagccaggugcagagaagacuaauaacgggauacacuauaggcuucggcuggucuacaauaacggauugcgcacggaacaagaucucuaugugagacugaucgacucuaugucgaaacaggccauuaucuacgagggccaggauaagaaucccgaaaugugcaggguucugcucacccaugagauuauguguucacggugcugugaccgcaagagcugcggcaaccgaaaugagacaccuagugauccagugaucauagacagauucuuuuuaaaauucuuucugaaguguaaccagaauugccuuaaaaacgcugggaaucccagggauaugcggcguuuccaagucgugguauccacuaccguuucuguggacggacacgucuuggccgugagcgauaacauguuugugcauaauaacuccaagcacggucgcagagcgaggcggcuggacccuucagaagcagccacaccauguaucaaagcuauuaguccgggcgagggguggaccacuggaggcgccacagucaucguuauuggugacaacuucuuugaugggcuacaggugguauucggaaaugugcucgucuggagcgaacugaucacgccccacgcaauacgagugcagaccccuccacgccauauucccggcguuguggaggucacucuuucuuauaaguccaagcaguucugcaaaggcuguccugggagauuuguguacaccgcucugaacgaaccaacaaucgacuauggauuccaaagguugcagaagguaauuccccggcacccgggugauccugagcgccuccccaaagagguucuguuaaagagagccgcggaccuggccgaagcacucuacggcgugccagggucaaaucaggagcuucuguugaaaagggcugccgaugucgcugaagcccuauacagcacuccucgugcacccggaccacuggcuccccucgccccuagucauccacacccggcgguggucggcaucaacgcauuuucuuccccucuggccaucgcugugggugacgccacccccgggccagagcccggcuaugcacggagcugcucgucugccuccccucgaggauucgcuccaucacccggcagucaacagagcggguacggagguggccuuggggccggacugggcgguuauggggcaccgggcguugcgggauugggcgugccuggguccccaucuuuucucaauggaagcacagcuaccucacccuucgccauuaugccuaguagucccccacuggcagccgcuagcucuaugucauuaccugccgcagcucccacgacuuccguauuuagcuucuccccagucaacaugauaucugccgugaagcagagaucggcguuugccccgguucugaggccucccagcuccccaccccaggcuuguccucgcgcacacggugaaggccuaccagaucaaucauucgaggacagugauaaauuucauucucccgcccgggggcuccagggacuggcuuacagcuga

SEQ ID NO: 55594 - RNA, 690 nt, Artificial Sequence
  derived and/or modified sequence opt3 from EBI3__Homo_sapiens__NP_005746
augacaccccagcugcuccuugcccugguguugugggcuagcugcccuccauguuccggcagaaaggggccgcccgcagccuuaacccugccuaggguccaaugccgggcgucucgcuacccaaucgcuguugacuguucauggacucuacccccugccccaaacaguacgagccccguguccuucauugcaaccuaucgacucggaauggccgcucguggucacucuuggccuugccugcagcagacaccaacuucgaccucauguacaauaaccgauguacagcuuuuuagcauggcaccguacgugcugaaugucacugccgugcaucccuggggcaguuccucuagcuucguuccuuuuaucacagagcacauuaucaaaccagaucccccugaaggggugagauuguccccacucgcugagaggcaacugcagguccagugggaacccccgggaucauggccuuuccccgagauuuuuagucugaaguauuggauccgguacaaacgccagggcgccgcgagauuccauaggguggguccaauagaagcaaccagcuuuauccuccgggccguacgcccucgagcuagauauuacguucaaguggccgcacaggacuuaacggacuauggggagcugucugauuggucccuucccgcuacugccaccaugucauugggaaaguga

SEQ ID NO: 55595 - RNA, 693 nt, Artificial Sequence
  derived and/or modified sequence opt3 from EBP__Homo_sapiens__NP_006570
augaccacaaacgccggcccccugcacccuuacuggccacagcaucucagacuugacaauuucgugccgaacgauaggcccacuuggcacauccuggcuggguuguuuagcgucacgggaguuuuagugguaaccacauggcugcuauccggucgggcagccguggucccucucggcacuuggcgccgacugucucuuugcugguucgcgguguguggguuuauucaucugguuauagagggaugguucguguuguauuacgaagaccuccugggcgaucaggcuuuucugucacaacucuggaaggaguaugccaaaggugacagucguuacaucuuaggggauaauuucaccgucugcauggaaacaauuaccgcaugucuguggggaccacuuagcuugugggugguaaucgccuuucugagacagcacccccuaagguucauucuccagcugguuguguccgucggccaaaucuauggcgacgugcuuuacuuucugacugagcaucgggauggguuccagcacggagaauugggucacccucucuauuuuugguucuacuuuguguucaugaacgcucugugguuaguccugccaggcguucucgugcuugacgcaguaaagcaucugacacacgcccagucuaccuuggaugcuaaagccacgaaggcgaaaucgaagaagaauuga

SEQ ID NO: 55596 - RNA, 405 nt, Artificial Sequence
  derived and/or modified sequence opt3 from EBPL__Homo_sapiens__NP_001265565
augggcgccgagugggaacugggggcugaggcaggagguagccuccuucugugcgccgcguuguuagcugccggcugugcacuggggcuaagacucggaaggggccagggugccgcugaccgcggggcacugaucuggcuuugcuacgaugcccuggugcacuucgcuuuggaaggacccuuugucuaucucucccugguuggcaacguggccaauucugacggccugauugcgucacucuggaaggaguacgggaaagcagaugcccgguggguauauuucgacccuaccauagugagugucgaaaucuuaacaguggcucuggauggaagccuugccuuguuucugauuuacgcaaucguuaaggagaaauauuaccgagaccguguggcuuggggugaguga

SEQ ID NO: 55597 - RNA, 2034 nt, Artificial Sequence
  derived and/or modified sequence opt3 from ECD__Homo_sapiens__NP_001129224
auggaggaaaccaugaagcuggccacaauggaggacacuguggaauacugccucuuccuuauccccgaugagagcagagacuccgauaaacacaaggaaauucugcagaaauauauagagaggaucauuacgcgguuugcuccuauguuggucccauacaucuggcaaaaccagccguucaauuuaaaguauaaacccggcaaagggggaguuccugcacauauguuuggugugaccaaguucggcgacaacauugaggaugaaugguuuaucguauacgugauaaaacagaucacaaaggaguucccagaacuggucgcccgcauugaggacaaugauggggaguuucuacucaucgaagcggcugacuuccugcccaaauggcuugauccugagaacucuacuaaucgaguguuuuucugucacggagaacugugcauuaucccagcaccccguaagucaggcgccgagaguugguugccuaccacaccaccgaccauaccccaggcccucaacauuaucacugcucauagcgaaaagauucuggcauccgagucuaucagagccgcuguuaauaggcggauccgcgguuauccugagaagauucaagccucgcugcacagagcgcauuguuuucucccagcagggauaguggccgucuuaaagcagaggccccggcugguggcugccgcaguacaggcuuucuaccuucgcgacccuaucgauuugcgagccugcagaguuuuuaaaacauuccugccagaaaccaggauuaugacgucagugacuuucaccaagugucuauaugcgcagcucguccaacagcgguuugugcccgaccgucgcagcggauacagacugccgccucccagugauccacaguacagggcccacgagcuuggcaugaaacuggcacacggcuucgaaaucuugugcuccaaguguucuccucauuuuagcgacugcaaaaagucccucgugacagcuucaccccugugggccaguuucuuagagagccugaaaaagaacgacuauuuuaaggggcucauagaaggaucugcucaguaccgggagcgacuugagauggccgaaaauuauuuccaacuguccgucgauuggccagagcgcuuggaaguucaguggagagaccccggucuacugcaggcaccuccaccgggcuuuacucccuucauuugucucucacugcuuagcaccugggauaacaguucucuggccauguccccuggggaggaaaucuugacacuccugcaaaccaucccauuugacauugaggaucugaaaaaggaggcugcgaauuuacccccugaagacgaugaccaguggcuagaucucagcccagaccagcuggaucagcuuuugcaagaggcagugggcaaaaaggaaucggagucuguauccaaagaggaaaaggagcagaacuacgaccugacggaagugucagagaguaugaaggccuucaucagcaaagucuccacucacaagggagcugaacuccccagggagccgucugaggccccuauuacauuugacgcagauagcuuccugaauuauuuugacaaaauacuugguccacggcccaacgaaucagauagugacgaucuggacgaugaggacuucgaaugcuuggauuccgacgaugaccucgauuucgagacccaugaaccuggggaggaggccagccugaagggaacuuuagacaaucugaaaucuuacauggcucagauggaccaggaacuagcccacacauguaucucaaagaguuuuaccacgcgcaaccaaguggagcccguuagccagaccacagauaacaauuccgacgaagaggauucuggcacuggcgaaucggugauggcaccagucgacguggaucucaaccugguaagcaauauucuugaguccuauucaagucaggcgggguuggcuggaccugccucuaaccugcuccagagcauggguguucaacugcccgacaauaccgaucacagaccaacauccaagccgacuaaaaacuga

SEQ ID NO: 55598 - RNA, 2211 nt, Artificial Sequence
  derived and/or modified sequence opt3 from ECE2__Homo_sapiens__NP_001032401
augaacguggcccugcaggagcucggcgcugggagcaaugucggauuccaaaaggguaccagacagcuucugggcuccaggacacaguuggaauuaguucuggcaggggccucucuacuccuggcggcccuucuguugggaugccucguggcucugggcguacaguaccaccgggaccccucacauaguacuugucugacggaggcaugcauccgcguggccgguaaaauucucgaaagccuggaucgaggggucuccccuugugaggacuuuuaucaauucucuugcggaggcuggauacguagaaacccacugccggauggcaggucgcgguggaauaccuuuaacucacuuugggaccagaaucaggcuaucuugaagcaucugcuagaaaacacaacuuucaauagcaguuccgaggcagagcagaaaacccaacgcuuuuaccucucuuguuuacagguggaaagaauugaggaacuuggggcccagccccugagggauuugaucgagaagauuggagguuggaacaucacaggcccuugggaccaggauaauuucauggagguucucaaagcuguggccgggaccuaucgggcgacuccauuuuucacagucuacauaagcgcagacuccaagucaaguaacagcaaugugauccaaguagaucagucuggacuguuuuuacccucccgcgacuauuaccugaaccgaaccgccaaugaaaagguucucacggcuuaucuugauuacauggaggaacugggcauguugcuaggugggagaccuacuucaaccagggagcagaugcaacaggugcuggaacucgagauucagcuggccaacaucacagucccacaggaccaacggcgugaugaggagaaaauuuaccacaagaugagcaucagugaacuucaggcacuggcucccucuauggacugguuggaguuccucuccuuucuguuaagcccucuggaacuaucggacucugaaccagugguggucuauggaauggauuaccuccagcagguuuccgagcugauaaaucgcacugagccgucaauucuuaacaacuauuugaucuggaaucuggugcagaaaaccacaaguagccucgacagaagguucgaauccgcccaagagaagcugcuugaaacccuguacggcacgaaaaagucuugcguaccccgguggcagacuuguauuagcaacacagaugacgcguugggcuuugcccucgggucacuguucgugaaggcaaccuucgaucgacagaguaaagagaucgcugaaggaaugaucuccgagauucgcacugccuuugaggaggcuuuaggucaacuggucuggauggacgaaaagacaagacaggccgcaaaagaaaaggccgaugcuauauaugacaugaucggcuucccugauuuuauucuagagccaaaagagcucgacgauguguacgacggguaugaaaucagcgaggacucuuucuuucagaauaugcugaaccuuuacaauuucucagcgaagguuauggcagaucaguugaggaaacccccuagucgggaccaauggagcaugaccccacagacggugaacgccuacuaucugcccaccaagaaugaaauagucuuuccggcuggcauucuccaggccccuuucuacgcacgcaaccaccccaaggcccugaauuuuggagguaucggggugguaaugggccaugaguuaacacacgcuuucgaugaccaaggaagagaauaugauaaagagggcaaccugaggccaugguggcagaaugagucccuugccgcauuucguaaccacacugcgugcauggaggaacaguacaaucaguaucaaguuaacggggaacgguugaauggacgacagacccucggugagaacaucgcugacaacggcgggcugaaggccgcauacaaugccuauaaggcuuggcuaagaaaacauggagaggaacagcagcugccugccgugggccucacaaaccaccaacuguucuuugucgguuucgcacaggugugguguucugucaggacucccgagucgagccaugaagggcuugugaccgauccacacucccccgcucgcuuccggguuuugggcacacugucaaauaguagagacuuuuuaaggcacuucggaugcccugugggcucuccaaugaacccggggcagcucugugagguaugguga

SEQ ID NO: 55599 - RNA, 2322 nt, Artificial Sequence
  derived and/or modified sequence opt3 from ECEL1__Homo_sapiens__NP_001277716
auggagcccccuuacagccugaccgcccacuaugacgaauuucaggaggugaaguacgucuccagaugcggcgcugggggagcaaggggugccucucucccaccgggcuuuccccuuggggcggcucggucagccacaggagcacgcaguggccugccucgauggaaccguagagaaguuuguuuguuaagcggucugguguucgccgcugggcuaugcgcaauccucgccgcuaugcuggcccuuaaauaucugggaccaguagcggcaggcggcggggccugucccgagggaugcccugaaaggaaggcuuuugcccgggcagcucgcuucuuggccgcgaaucucgaugccuccauugacccaugucaagauuuuuacucuuucgcaugcgguggcuggcugagaaggcaugcuauacccgacgauaaacugacuuaugggacgaucgccgcuauuggagagcagaacgaggaacggcuccgccgauuacuggccagaccuggcggugggccaggaggcgcagcccagaggaaggugcgggcuuucuuccguucgugucuugacaugcgcgagaucgaaagauugggcccgaggcccaugcuggaggucauugaggauugcgggggaugggaccuagguggcgcggaagaacggccugggguggcagcccgaugggaucucaaucgccugcuuuacaaagcucagggaguuuauucagccgcagcccuguuuagcuugaccgugagucucgacgauagaaacuccucuagguacgucauccggauagaccaagauggccugacauuaccagaacgcacucuguaccucgcucaggacgaggacagcgaaaagauccuugccgcauauagaguguucauggagaggguacuguccuugcuaggugcggaugcuguugagcagaaggcccaggaaauucugcaaguggagcagcagcucgcaaauaucaccgucucagaacacgacgaucugcgucgggacgugaguagcauguacaacaaagugacacuugggcagcugcaaaagauuacuccccauuugcgauggaaauggcuccuggaucagaucuuucaggaggacuucucugaagaggaggaagucguuuuacuggccaccgauuauaugcaacaggugucccagcuaauaagaucaacaccucacaggguacuccauaauuaccugguguggcgcgucgugguugugcuuagcgagcacuugaguccacccuuucgggaagcucugcacgagcucgcccaggaaauggagggcucugacaagccgcaagagcuggcaagagucugucuuggacaggcuaacaggcauuucggcauggcccugggggcguuguucgugcacgaacauuuuuccgccgcuagcaaagcaaagguacagcagcucguugaggauauuaaguauauccugggacaacgcuuagaggagcuggacuggauggaugccgagacccgagcugccgcacgggcgaaacuacaguacaugauggugauggucgguuauccugacuuccuccugaagcccgacgccguggauaaagaauacgaguuugaaguccacgagaagacguacuucaaaaauauucuuaacucgauccguuuuucuauccaguuguccgugaagaaaauuagacaggaaguugacaaguggcugcucccaccucaagcucugaaugccuauuacuuacccaacaagaaucagaugguguucccagcaggcauacugcagcccacucuuuaugauccugacuuuccacagucauugaacuacgggggaaucggcaccauuaucggucacgagcucacacauggguaugaugacuggggcggacaauacgauaggaguggcaaucugcuacacugguggacugaggcuagcuauucccgcuuccugcggaaagccgaaugcauaguaagacucuacgacaacuuuaccgucuacaaccagagggugaaugggaagcauacacugggagagaacauugcagauauggguggccuuaaauuggccuaucacgcuuaccagaaguggguucgagaacaugggccggagcacccccugccucgcuuaaaauauacccacgaccaacucuucuuuaucgcguucgcccagaauugguguaucaagcggagaucucagagcauuuaccuucaggugcugacggauaagcaugcaccagaacacuauaggguccugggaucagugagucaauuugaggaguucggccgugcuuuccauugccccaaagacuccccuaugaacccagcccacaagugcagcguaugguga

SEQ ID NO: 55600 - RNA, 681 nt, Artificial Sequence
  derived and/or modified sequence opt3 from ECHDC1__Homo_sapiens__NP_001099014
augaugcugcagcuccuugagaaggugaucgaacuggagaacuggaccgaaggcaaaggguugauugucagaggagccaagaauacauucagcuccgguucugacuuaaacgcuguuaaaucacugggcacucccgaggaugggauggcagugugcauguuuaugcaaaauacgcuaaccagguucaugcggcucccucugauaaguguagcccuugugcagggaugggcgcugggcgguggggcugaauuuacaacugccugugacuuccgcuugaugaccccagagagcaagauccgauuuguccacaaagagaugggaauuaucccguccuggggcggcacaacccgucucguggaaauuaucgggucuagacaggcacugaagguucugucgggagcccucaaguuagauagcaaaaacgcucugaauauagguaugguggaggaaguccuucagucaagugacgagacuaaguccuuggaggaagcacaagaguggcugaaacaguucauccaggggcccccugaagugauuagggcccuaaagaaaucuguaugcagcggccgggagcucuaccuggaagaggcccuucagaacgagcgcgaucuguugggaacaguuuggggcgguccagcuaaucucgaagcgaucgcaaagaaggggaaauuuaacaaguga

SEQ ID NO: 55601 - RNA, 912 nt, Artificial Sequence
  derived and/or modified sequence opt3 from ECHDC3__Homo_sapiens__NP_078969
auggccgcuguggcaguccugagagccuucggcgcgagcgggcccaugugccucaggcggggaccuugggcucagcuuccagcccgcuuuuguucccgagacccggccggugcaggccguagagagucugaacccaggccuaccucagcucggcaacuggaugggauccgcaacauuguuuugaguaauccaaagaaaagaaacacauuaagccuggcaaugcuaaagucccuccagucugacauacugcacgaugccgacucgaaugaucuuaaagugaucauuaucucagcugagggacccguauucagcaguggccaugaccugaaggaauugacugaggaacaggguagggauuaccacgccgagguguuucagacgugcuccaaagucaugaugcauauucggaaccacccugugccaguuaucgcgauggugaaugggcucgcaaccgccgcuggaugucaacuggucgccucuugcgacauagcaguggcuagcgauaaguccucauucgccacacccggcguaaacguuggccuguuuuguaguacuccugggguggcgcucgcccgcgcagucccacgaaagguggcuuuagagaugcuguucaccggagaaccgaucagcgcccaggaggcucuuuugcauggucugcuaucuaaagugguccccgaagccgagcuccaggaggaaacaaugagaauugcaaggaagaucgccucccugucacggccuguugugagccuuggcaaagcuaccuuuuauaagcagcugccacaagacuuggggacugcguacuaucucacaagucaggcaaugguagauaaucuggccuuacgugacggacaggagggcauuaccgcuuuccugcagaaacgcaagcccguguggucucacgaaccugucuga

SEQ ID NO: 55602 - RNA, 873 nt, Artificial Sequence
  derived and/or modified sequence opt3 from ECHS1__Homo_sapiens__NP_004083
auggccgcucugagagugcuccuuagcugcgucaggggcccccugcggccuccaguucgcuguccggcauggcgacccuucgccuccggggcgaacuuugaguacaucauugcugaaaagcgugguaaaaauaacaccgugggauugauacaguuaaauagaccuaaggcccugaacgcacuaugcgacggccucaucgaugagcugaaucaagcccuuaaaacauucgaagaggacccagcuguaggggcaauugugcugacuggaggcgauaaggccuuugcugccggugcggacaucaaagaaaugcagaacuugucuuuccaggauuguuauucaaguaaguuucucaagcacugggaccaucugacgcaggucaaaaagcccgugauugcagccguuaauggguacgcuuucggaggcggcugcgagcuggccaugaugugugauaucauauaugcaggggagaaagcucaauuugcccagccugaaauccucauuggaaccaucccaggugcgggcgggacacagagguuaacucgggccgugggaaagagccuggcaauggagaugguccuuaccggcgaccgcauuuccgcucaggaugccaaacaagcugguuuggugucuaagaucugccccguagaaacacugguugaggaggccauacagugugcagaaaagauugccucgaacucaaaaaucguggucgcuauggcgaaggagagcgugaaugcagccuucgaaaugacccuaacugaggggaguaaacucgaaaagaaacuguuuuacuccacauucgcuaccgacgauagaaaggagggaaugacggccuuuguggagaaaaggaaggcaaacuucaaggaccaguga

SEQ ID NO: 55603 - RNA, 858 nt, Artificial Sequence
  derived and/or modified sequence opt3 from ECI1__Homo_sapiens__NP_001171500
auggcccugguggcuagcgucagaguucccgcaagggugcuccuucgggccggcgcgcgccugccuggggcugccuugggacgaaccgagcgugcagccgguggcggggacggagcuagaagguucggcucccagcggguauuaguggaaccagaugccggugcaggggucgcugugaugaaguuuaaaaacccgcccguuaauucucugucacuagaguuccucacagaacuggugaucagucuugagaagcuggaaaacgacaagagcuuucgcggagucauuuugacuuccgauagaccuggcguguucucugccggccucgaccugacggagaugugcgggaggucgccagcgcacuacgcaggauauuggaaagccguacaagagcuguggcuccgguuauaccagucaaaucugguucuugugagcgcuauaaacggugccugucccgcaggcgggugcuuggucgcucugaccugugauuaucgcauccuagccgacaauccucgacucaaagauacacuggaaaacacuauuggacauagagcggccgagagggcacuucagcugggcuugcucuuuccacccgcugaagccuuacagguggguaucguggaccaagucguuccugaggaacaggugcagaguaccgcucuguccgccauugcacaguggauggccaucccagaucacgcucggcaacugacaaaggcgaugaugcguaaggcaaccgccucucgccucguaacucagagagacgcugaugugcagaauuucgucagcuuuauauccaaagacucaauccagaagagucuucaaauguaccuggagagguugaaagaggaaaagggguga

SEQ ID NO: 55604 - RNA, 1095 nt, Artificial Sequence
  derived and/or modified sequence opt3 from ECI2__Homo_sapiens__NP_006108
augaacagaaccgccaugagggcuagccagaaggacuucgaaaauuccaugaaccaagugaaacugcucaagaaagaucccggcaaugaggucaaacuuaaacuguacgcauuguauaagcaggccacagaggggccuugcaacaugccaaagccgggaguuuuugacuuaaucaauaaagcgaagugggaugcuuggaacgcccuggguucucuacccaaagaagcagcccggcagaauuacguggaccucguaucaagucugagcccuucccuugagucuucgucacagguggaaccaggcacugaucgcaagagcacgggguucgagacccuggucgugacaagugaggacggaauuacuaaaauaauguuuaaccgacccaagaagaaaaaugcuaucaacaccgaaauguaucacgagauuaugcgugcauugaaggccgcuuccaaagaugacucuaucauuacaguucucaccggcaauggugauuacuauagcuccgggaacgaccugacuaauuucacagauaucccuccaggaggcguggaagagaaggccaaaaacaaugcgguccugcucagagaguuugugggcuguuucauagacuuucccaagccuuuaaucgcaguaguuaacgggccagccgugggaauuucagucacccugcuugguuuguucgaugcuguguacgccagugacagggcaacguuucauacuccguucagccaccugggccaaucucccgaagggugcuccucauauaccuuuccuaaaaucaugagcccagcuaaggccacagagaugcuaauuuucggaaagaaacucacugcgggcgaagccugugcacagggucuggugaccgaggucuuucccgacaguacauuccagaaggaaguuuggacccggcuuaaggcuuucgccaagcugccuccaaacgcuuugcgcaucucuaaagaggugauaagaaagagggagcgggaaaagcuccaugccguaaaugcagaggaaugcaacgugcugcaggggcgcugguuauccgaugaguguacgaaugccgucgugaacuuucugagccgaaaaucgaagcucuga

SEQ ID NO: 55605 - RNA, 618 nt, Artificial Sequence
  derived and/or modified sequence opt3 from ECSCR__Homo_sapiens__NP_001071161
augggcaccgccggggcuaugcagcugugcugggugauccucggauuccuucuguuuagaggucacaacagccaacccacaaugacucagacguccucuucacagggcggguugggaggcuuaagucugaccacagagccugucagcuccaauccagguuacauuccgucuucggaagcaaacaggcccucacaucuaagcaguacugggaccccuggagccggcguuccauccucuggccgggacgggggaacaagccgcgauaccuuccagacugugcccccuaauuccacaaccaugucacucaguaugcgagaggacgcgacgauacugccaagccccacuucugaaaccguacuuacaguggcugccuuuggugucaucuccuucauugugauccugguuguggucgugauuaucuugguaggcguugugucacuccguuuuaaguguagaaaaagcaaggagagugaagauccucaaaaaccagggucuuccggacugagcgagucgugcucuacugcaaacggcgagaaggacuccauaacccugaucucaaugaaaaauauuaacaugaauaacgguaagcagagucucagcgccgaaaaggucuuauga

SEQ ID NO: 55606 - RNA, 891 nt, Artificial Sequence
  derived and/or modified sequence opt3 from ECSIT__Homo_sapiens__NP_001135936
augagcugggugcaggccacccugcucgcuagaggccuuugcagggcauggggagggacauguggugccgcgcugacuggcacguccaucucucaagucccccggcgcuugccucgaggguuacacugcucagcugccgcacauaguagcgagcagucccugguuccaucuccgcccgaaccucgucagagaccaaccaaggcccuagugcccuucgaggaccucuuuggacaggcuccuggcggugaaagggauaaagcaucguuccugcaaacaguacagaaguuugccgagcacucagugcggaaacgcgggcauauugacuucauauaccuugcucugagaaagaugagggaauauggagucgagcgggauuuggccguguacaaccagcuccugaauaucuuuccaaaagagguuuuccgcccccgaaacauuauccagagaauuuuugugcacuauccuaggcaacaggaauguggcaucgcgguccuggagcagauggaaaaucauggcgugaugccaaacaaggagacugaguuccucuuaauacagaucuuugggcguaagagcuacccgaugcugaaacuuguacgguugaagcugugguucccccgcuuuaugaauguuaacccuuucccagugcccagagaccuaccucaagauccagucgaacucgcaauguuuggacugaggcacauggagcccgaccuuagugcccgggugaccauuuaucaggugccgcugccuaaagauuccacaggugcugccgaucccccacagccucacaucgucggcucugggcgagacgcaggaggcguugaacccuugcucccagacgcugccggucccggggugugcgaggaauggcugggacaauuacgcguauga

SEQ ID NO: 55607 - RNA, 2745 nt, Artificial Sequence
  derived and/or modified sequence opt3 from ECT2__Homo_sapiens__NP_001245244
auggccgagaacagcgugcugaccuccacaacuggcagaacgucucucgcugacucaaguaucuucgauagcaaggucaccgaaauuuccaaagagaaucuucugauagggucuacaucguacguugaagaggaaaugccccagaucgagacuagggugauuuugguacaagaggcaggaaagcaggaagaguuaaucaaagcccugaagaccauuaaaaucauggaagugccugucauaaagaucaaggagucaugcccagguaaaagcgacgagaagcuaauuaaaagugugaucaacauggauauuaagguuggcuuugugaaaauggaauccgucgaggaauuugaggggcucgacucuccggaauuugagaauguguucguaguuacagauuuucaggacagcguguucaacgaucuguauaaggcggacugucgggucaucggacccccuguggugcuuaauugcucccagaagggcgagccacugcccuuuucaugucgcccuuuguacugcaccaguaugaugaaccucguccuguguuucacugguuuucguaaaaaggaggagcugguucgacucgugacauuaguacaccauaugggaggagugauaagaaaagauuucaauagcaaggucacccaccugguggcuaacugcacgcaaggcgaaaaauuuaggguugccgugucucuuggcacuccaauuaugaagcccgaguggaucuauaaagcaugggaacggcgcaaugagcaggacuucuacgccgcugucgaugacuuuagaaacgaguucaaggugccuccauuccaggauuguauuuuguccuuucugggguucucagacgaagagaagaccaauauggaagagaugacagaaaugcagggagguaaauaucuaccgcucggcgacgagaggugcacucaucugguaguugaggaaaacaucgugaaggaucuucccuuugagccuagcaaaaagcuguacgucgugaaacaagaaugguucugggggaguauccagauggacgcacgggccggagagaccauguauuuguacgagaaggcuaauacaccagaacucaagaaaucugucuccaugcugagcuuaaacacccccaauucgaaccgcaagcgaagaaggcugaaagagacgcucgcccagcuuucucgggaaacugauguguccccuuuuccaccccguaagcgcccgucagcggagcacagucugagcauuggcuccuugcuagacauaucuaacacaccugaaagcucaaucaauuacggugauacccccaaaaguuguacuaaguccagcaagucuucaacaccaguuccuaguaaacagagcgcaagauggcaaguggccaaggagcuguaucagaccgaguccaacuacguaaauauucucgcuacgaucauacagcuguuccaagucccccuugaagaggaagggcagaggggaggcccaauucuggcccccgaggaaaucaaaaccaucuuuggcucuauuccugacaucuucgaugugcauacaaagauuaaagacgauuuggaggaccucauaguuaacugggaugagucuaagagcaucggggacauuuuucugaaguauuccaaagacuuagugaagacuuacccaccguucgucaauuucuucgaaaugucaaaagagaccaucaucaagugcgaaaaacagaagccccgguuucacgcauuccugaaaauuaaccaggcuaagccugaguguggacgacaaagucuaguggaacuccugauacgcccaguacagagacuucccucuguggccuugcugcucaaugaucugaagaaacacacagcggacgagaacccugauaagagcacucuugagaaagccaucgguucccugaaggaaguuaugacccauauuaaugaggacaaaaggaagacagaagcacagaagcagaucuucgaugucguguaugagguggacggcugcccagcuaacuugcucucaagccaccggucucugguccaacgcguugagaccauuuccuuaggggaacaucccugcgauagaggagaacaggugacucuguuucuauucaaugacugucucgaaaucgccaggaaacgucacaaggugauaggcacguuucggaguccgcacggucagacacgaccuccagcuagccugaaacauauccaccuuaugcccuugucucagauuaagaaaguacuggauaucagagagaccgaagacugccauaacgccuucgcacuccuggucaggccucccacugagcaagccaauguguuacuguccuuucagaugaccucagaugagcuuccaaaggaaaacugguugaagaugcucugucgccacguugcuaauacaauuugcaaagcggacgcagagaaccugaucuacaccgccgauccugaaaguuucgaggugaacacuaaggacauggacagcacacuaucgcgggcuuccagagccauuaaaaagacgucuaaaaaggucaccagggcauuuagcuucucaaagacucccaaacgcgcccugcgacgggcucucaugacaagucauggguccguggaaggccguucuccaagcuccaaugauaagcacguuaugucaagacugagcaguaccucuucccuugccgggauaccgagcccuucguuggugucacugcccucguuuuucgagaggcgcagucacacauuaucccggagcacuacccaucucaucuga

SEQ ID NO: 55608 - RNA, 894 nt, Artificial Sequence
  derived and/or modified sequence opt3 from EDA2R__Homo_sapiens__NP_001186616
auggacugccaggagaacgaauacugggaucaauggggcagaugugugaccugccagaggugugggcccggacaggagcugagcaaggacugcgguuauggcgaagggggagaugccuacuguacagcuugcccuccacggcgcuauaaauccucuuggggccaccaucgaugucagucaugcaucacuugugcagucauuaaucguguucaaaaggugaacugcacggccaccaguaaugcgguauguggugacugccucccgagauucuacaggaaaacacggauagggggacuucaggaucaggagugcauccccuguacuaagcagaccccuacaagcgaagugcaaugcgcuuuucagcuguccuuggucgaggccgacgcaccaaccgugcccccucaggaggccacuuuaguugcucuggugucuucgcuacucgucguguucacacuggcauuucuuggccuguucuuuuuguauuguaaacaguucuuuaaccgccacugccaaagaggcgggcuccugcaguucgaagccgauaagaccgcuaaggaggaaucacuguuuccaguacccccuagcaaagagacgagugccgagucccagguuucugaaaauauuuuccaaacucagccacucaacccgaucuuagaggacgauuguagcuccaccucaggauuucccacacaggaaaguuucacuauggcgagcugcaccucugagucccauucacacugggugcauagcccuauugaauguacagagcuggaccuucagaaguuuaguucuuccgcaagcuacaccggugccgagacguugggcgggaauacugucgaaucgacaggagauaggcuggagcuaaacgugccauucgaagugcccucuccuuga

SEQ ID NO: 55609 - RNA, 1170 nt, Artificial Sequence
  derived and/or modified sequence opt3 from EDA__Homo_sapiens__NP_001005609
augggcuaccccgagguggaaagaagggagcugcucccugccgcugcaccacgggaacgcgggagccagggaugcgguuguggcggggccccggcgcgagcuggagagggcaacuccugccuucuguucuugggcuuuuucggguuaucucuggcccuacaccuccugacucuuuguugcuaucuggaauugcguucagagcucagaagggagcggggagcagaaagucgccugggcggcagcgggacacccggaacuuccgguacgcugucuucgcucggcggguuagacccugauucaccaaucaccagccaucugggacaacccaguccuaagcagcagccacuugagcccggcgaagccgcuuugcacuccgacucucaggauggucaucaaauggcacugcuaaacuuuuucuuuccugacgagaaaccauacagcgaggaagaguccagaaggguccggcgcaauaagcgaucaaaaaguaaugaaggggccgauggaccgguuaagaacaaaaagaagggcaaaaaggcuggucccccugggccaaauggacccccugguccacccggcccgccugggccccagggaccaccuggcauucccgguauaccagggauccccggcacaacugugaugggaccuccaggcccgcccgggccuccaggaccccaggguccuccaggccuccaggggcccagcggagccgcggacaaagcaggcaccagagagaaccaaccggccguagugcaucugcagggucaggggucugcuauucaggucaagaaugaucuuuccggcggagugcugaacgacuggucaaggaucacaaugaauccuaaaguuuucaaguugcacccacggagcggcgaacucgaggugcuggucgaugggaccuauuuuauuuacagucaaguguauuacaucaacuucacugacuuugccucuuaugagguaguuguggaugaaaagcccuucuuacaguguacacguuccauagagaccggaaaaacgaauuacaacacuugcuacaccgcuggugucugucugcucaaggcacgccagaaaaucgccgugaagauggugcacgcggacauuagcaucaauaugucgaaacacacaaccuuuuucggcgccauuagacuuggggaagcuccugcaucuuga

SEQ ID NO: 55610 - RNA, 618 nt, Artificial Sequence
  derived and/or modified sequence opt3 from EDARADD__Homo_sapiens__NP_542776
auggccagccccgacgauccucugagagcugaccacauggugaaggagccagucgaagauaccgacccguccacacucucuuucaacaugucagauaaauaccccauccaggacacugagcuuccuaaggcagaagagugcgauacgauuacccugaauuguccaaggaacagugacaugaaaaaucaaggcgaagagaacggguuucccgauagcacaggagacccuuugccagagauauccaaggauaauucuugcaaagaaaacuguacuugcucgucauguuuacugcgggcccccaccaucagcgaccuacucaaugaucaggaccugcuugacguuauucgcaucaagcuggauccuugccauccaacagugaagaacuggcgaaauuucgcgaguaaaugggguauguccuaugacgaguuguguuuucucgaacagcguccgcagucucccacccuggaguuccugcucagaaacagccaaaggacuguaggccaguuaauggagcugugccggcuuuaccaccgcgcugauguggaaaaggucuugagaagguggguggacgaggaauggccuaaacgggagcgcggggauccaucccgacauuuuuga

SEQ ID NO: 55611 - RNA, 1347 nt, Artificial Sequence
  derived and/or modified sequence opt3 from EDAR__Homo_sapiens__NP_071731
auggcccacgugggcgacugcacccagacacccuggcugccuguccucguugugagccuuauguguuccgcuagagcagaguacucuaacugcggggaaaaugaguauuacaaccaaacuacgggacugugucaggaaugcccaccguguggucccggcgaggaaccuuauuugucaugcggguacggaaccaaggaugaggacuauggcuguguaccaugccccgccgagaaauucaguaaggguggguaccagaucuguaggcggcauaaagauugcgaaggauuuuuccgcgcgacaguguuaacuccuggcgacauggagaaugaugcugaauguggcccaugccugcccggguauuacaugcuagagaaccgaccucguaauauuuacggaauggucugcuauagcugucuccuggccccaccgaacaccaaggagugcgugggugcaacauccggcgccucugcuaauuuucccgggaccucgggaucaagcacucuuaguccuuuccagcacgcacauaaagaacuguccggccaaggucacuuggccacagcucucauaaucgccaugucuaccauuuuuaucauggcgauugcaaucguucugauaaucauguucuacauucugaagacgaagccaagcgcccccgcuuguugcacuucccauccugggaaaucaguggaggcccaggucaguaaggacgaagagaaaaaggaagcaccagauaacgugguaauguuuagcgagaaagacgaguucgaaaagcucaccgcuacacccgccaagccgacuaaaucugagaaugaugcguccucagaaaacgagcaguuacugagcagaaguguugacucugaugaggaaccugcccccgacaagcagggauccccagagcuuuguuugcugagccuagugcaccucgcaagggaaaaaucggcuaccucuaauaaguccgccggcauccaaucacggcgcaaaaagauucuggaugucuaugcuaacgugugcggcguggucgaggggcuuaguccuacagaacugcccuuugacuguuuggagaaaaccagcagaaugcucuccucuacguacaauagcgaaaaggccguugugaagacuuggaggcaccuggcagagucauucggauuaaaacgggacgagaucgguggcaugacagaugggaugcagcuguuugaccgcauaaguaccgccggauauuccauuccagaacuccuuacuaagcugguacagaucgagcgauuggaugcuguggaaagccuaugcgcggacauucuggagugggcaggcgucgugcccccugccucucagccacaugcugccucauga

SEQ ID NO: 55612 - RNA, 4206 nt, Artificial Sequence
  derived and/or modified sequence opt3 from EDC4__Homo_sapiens__NP_055144
auggccagcugcgcuuccaucgacauugaggaugcaacccagcaccugagagacauacucaagcuagauaggcccgccggcgggccuucugcggaaucaccacggccgaguagcgcuuacaacggagaccugaaugguuuguuagugcccgauccucuguguuccggcgacucuacaucggccaacaaaacugggcuacgcacgaugccacccaucaaucuccaagagaagcaggucauuugccugucaggagaugacagcaguaccuguaucggcauucuugcaaaagaaguugagaucguggccuccucugauagcuccauaucaaguaaggcucgagguagcaacaaaguaaagauccagccuguggcaaaguaugacugggaacagaaauacuauuacgggaaucugauugccgucucuaacuccuucuuggcuuaugccauccgugcggcaaauaacggaucagccauggugagaguuauuagcgugaguacaucugagaggacucuccugaagggcuuuaccggcuccgucgcugaucuggccuucgcacaucucaauagcccacaauuagcuugccuggacgaggccgggaaccuuuuuguguggcgguuggcgcugguaaauggaaaaauccaggaagagauacuuguucacauucgccagcccgaagguacaccucucaaccauuucagaaggaucauuugguguccauuuaucccggaggagucggaagauugcugugaggaaucuucccccaccguggcccugcuucacgaggaccgggcagaagucugggaccuggauauguugcgcucaagucauagcacuuggccuguggacgugucccagaucaagcaaggcuucauugucguuaaagggcacucuacaugccucagcgagggagcucugucaccagauggcaccguguuagccacggcuagucacgacgguuacguaaaguuuuggcagauauauaucgaggggcaggaugaaccccgaugucugcaugaguggaagccucacgacggaagaccacucuccugccuucuguucugugauaaucauaaaaagcaggaccccgaugugccguuuuggagguucuugauuacuggcgccgaccaaaaccgggaacuaaaaauguggugcaccgucagcuggacaugccugcagacuauccguuuuucuccugauauauucucaagugugagcguucccccaucccucaaggugugucuggaccuuucugcagaguaccugauuuugucggacguccagcgcaaagugcucuacguaauggaacuguuacaaaaucaggaggagggccacgccugcuuuagcuccaucucagaguuccugcuaacccacccuguucucaguuucgggauccagguggucucuagauguaggcugcggcauacagaggugcuucccgcugaagaggaaaacgauagcuugggagcggacgguacccacggcgcaggggccauggaguccgcugccggaguccugauuaagcucuuuugcgugcauacgaaagcacugcaggauguucaaauccgauuccagccacagcuuaaccccgacgugguagccccucugccaacucacacagcucaugaggauuuuaccuucggcgaaucacgcccggaguuggguagcgaagggcucggcucugccgcacacggaucccagcccgaccugagaaggauugucgaguuaccugcgccagcugauuuucugagucuaagcucugagacuaagcccaagcucaugacaccugacgccuucaugaccccauccgcaucacugcaacagauaacggccagucccagcucguccucuagcggcucaaguuccucuagcuccucaagcaguucuucccuuaccgcugugagcgccaugucgucaacaucugcaguugauccgaguuugacucggccuccagaagaacugacccucucccccaaacugcaguuagacgggagccugacaaugucuagcuccggaucacuucaggcuaguccucgcgguuugcuccccggccugcuaccagccccugcggauaagcugacucccaaagggccaggacaagugccgaccgccacaagcgcucucucucuggaacuucaggaggucgaaccuuugggccugccccaggcauccccaucaagaaccaggagucccgacgugaucagcuccgccucuacugcuuuaucgcaggauauuccugagaucgccagcgaggcacucucacgugguuuuggguccagugcgccagaaggccuggagcccgacucuauggccagcgcugccuccgcacuucaccuguugucaccucggccgcgaccaggacccgaacucggcccucaacuggggcuagacggagguccaggcgauggggacagacauaauacgcccucucugcucgaggcugcccugacacaggaagcaagcaccccugauagucagguauggccgacugcccccgacaucaccagggagacauguuccacccuugcugagagcccacgcaacggauugcaagaaaagcacaaaucucuggcguuccaucggccucccuaucacuuacuccagcagagagauucacaggacgccuccgcagagcaaagugaucacgacgaugaaguggcuagccuggccucggccucuggcgguuuugggacuaagguuccagcuccuaggcuucccgcaaaggacuggaaaacaaagggcuccccacgcacgagcccgaaacugaagcgaaaaucaaagaaggaugacggagaugccgcgaugggcagucggcuaaccgagcaucaggucgcugaaccucccgaggacuggccagcccucauuuggcagcagcaacgugagcuggcagaauugagacacucucaggaggaacuguuacagaggcucugcacucagcuggaggggcuucaauccacagugaccggacauguggagcgcgcccuggaaacacggcacgagcaggaacagagaagguuggagcgagcucucgcagaaggccaacagcgcggugggcagcugcaggagcaacuaacucagcagcugagccaggcccuuucaagugcggucgcuggacggcucgagagaagcauaagggacgaaaucaaaaagaccguucccccuugugugucccguucucuggagccaauggccggccaauugagcaauuccguggcaacgaaacugaccgccguagaagguucaaugaaggagaacauuucuaaauuacucaagaguaagaaucugacagaugcuaucgcccgcgcagcugccgacacucuucagggccccaugcaggcggccuaccgggaagcauuccagucggucgugcugccugcuuuugagaaaagcugccaagccauguuccagcagauuaacgauuccuuuagauuggggacccaggaguaucuccaacagcuggaaucucauaugaagucaaggaaagcucgagagcaggaagcacgggagccgguucuagcccaacugcgcggacuugugagcacacuccaguccgccacugaacagauggcugcgaccgucgcaggcagugugagagccgagguucagcaccaacugcacguggcuguagggucuuugcaggagagcaucuuagcccagguccagaggauagugaagggagaagugucagucgcacugaaagagcaacaggccgcuguuacguccaguaucaugcaggcgaugcggagcgccgcaggcacaccagugcccucugcucaucucgacugucaggcccaacaggcacacauucugcagcuucugcaacagggucauuugaaucaggccuuccagcaagcucuaaccgccgcggaucugaaccucguacuguacgugugcgaaacugucgacccugcacagguguucgggcagcccccauguccucuuucccagcccguuuuacugucacucauccaacaguuggccagcgaucugggaacacgaaccgaccucaagcugucguaucuugaggaggcugugaugcaccuggaucauucugacccaauuacuagagaucacaugggcagugucauggcccaggugcgccagaaauuguuucaauuccuacaggcugaaccucacaauucccuggguaaggcagccaggcgucucagcuuaaugcugcauggccuuguuaccccgucacugcccuga

SEQ ID NO: 55613 - RNA, 1974 nt, Artificial Sequence
  derived and/or modified sequence opt3 from EDEM1__Homo_sapiens__NP_055489
augcaguggagagcccuggugcucggccuuguccuguugagguuagggcugcacggaguucuauggcucguguucggucugggccccagcaugggguuuuaccaacgguucccucuuuccuuuggauuccagcgccugcgaucuccagacggcccggcuucacccaccagugguccuguagggcguccaggaggcgugagcggccccuccugguugcagccuccagggacaggagcagcccagucucccagaaaggcgccuaggcggccagguccgggcaugugcgggcccgcuaacuggggauauguccucggcggucgcgggagaggaccugaugaguacgagaaaagguauucgggcgccuuuccaccccaacugcgggcacagaugcgcgaccuggcccgaggcauguucguguuuggguacgauaauuauauggcucaugcauucccucaggacgaacucaacccaauccacuguagaggaaggggucccgaucggggcgacccgucaaauuuaaacauuaaugauguucuggggaacuacagccuuacuuugguggacgcccuggauacgcuagcuauaaugggaaauaguuccgaauuucagaaggccgucaaacucgugaucaacaccguaucuuucgacaaggauagcacaguucaaguguuugaggcgacuauucguguccugggcucccuucugucagcacaucgcaucauuaccgacaguaaacagccuuucggugauaugacaaucaaggacuaugacaaugaauugcucuacauggcccacgaucuggcugugagauuacugcccgccuuugagaacaccaagacugggauaccauacccuagggugaaucucaaaacaggcguucccccagacaccaacaaugagacgugcacugcaggagcuggcagccuucuggucgaguucgggaucuugucucggcuacugggagauuccaccuucgaauggguggcccgacgcgcgguaaaggcccucuggaaccugagaucaaaugacacaggucuucugggcaacguggucaacauucagacugggcauugggugggaaaacagagcggcuugggugcagggcucgauaguuuuuaugaauaccuguuaaagucuuauauccuguucggcgagaaagaggaccuagaaauguuuaaugcugccuaccaauccauucagaacuaucucaggcggggacgcgaggcuuguaaugaaggcgagggggaucccccucuguacguuaacgugaauauguucagcggacagcuuaugaacaccuggaucgacucguugcaagccuuuuucccaggucugcagguccucauaggcgauguggaagacgcaauuugccugcacgccuuuuauuacgcuaucuggaagagauacggggcgcuuccggagagguauaauuggcagcugcaggcacccgauguauuguucuacccucuccguccagagcugguugaaucuacauauuuacuguaccaagccaccaagaaccccuuuuaucuacacgugggaauggacauucuccagucccuggagaaauacacgaaggucaaauguggcuaugcuacucuucaucacgugaucgacaagucaacagaagaucggauggagaguuucuuuuugagcgaaaccugcaaauaccuguaccuccuguucgacgaggauaauccuguccauaaguccgguacucgauauauguuuacaaccgaggggcacaucgugucuguugacgaacacuuaagagagcugccauggaaagaguucuucagcgaagaaggcggacaggaucagggcgggaagucagugcauaggcccaagccgcacgagcuuaaaguaauuaacaguuccagcaauuguaaccgcgucccugacgagcggagauacucuuugccacucaagucaauauauaugaggcaaaucgaucagauggugggacugauuuga

SEQ ID NO: 55614 - RNA, 1413 nt, Artificial Sequence
  derived and/or modified sequence opt3 from EDIL3__Homo_sapiens__NP_001265571
augaagagaagcguggccgucuggcugcucguuggccuuucccugggggugccccaguucggaaaaggugacaucugcgauccuaacccaugugagaauggcgggauuugcuugccgggauuagcugacggcucuuuuucaugugaaugccccgaugguuucaccgacccuaacuguaguagcguaguggaggucgggccaugcacacccaauccuugucacaacggaggcacuugcgaaauauccgaggcauacaggggcgauacguuuaucggguauguguguaagugcccacggggauucaaugguauucauugucaacacaacaucaaugaaugcgagguugagcccugcaaaaacggcgggauuuguaccgaccugguggccaauuacucuugcgaauguccuggagaguuuaugggccgcaacugccaguauaaguguucggguccacuagggaucgaaggaggcauaaucucaaaucagcagauuacagcgagcaguacucaucgagcucucuucggccugcaaaaaugguacccguauuacgcccgucuuaacaagaaggggcugaucaaugcauggaccgccgcugagaacgauagauggcccuggauucagaucaauuugcagaggaaaaugcgggucacaggagugauaacccagggugcaaagcgcauuggcuccccugaguauaucaaaucuuacaagauugccuacagcaacgacgggaaaacuugggcuauguauaagguaaagggaacaaacgaagauaugguuuuuagaggcaauaucgacaacaauaccccauacgccaacuccuucacgcccccuaucaaagcgcaauaugugaggcucuacccacaggucugccggcgccacuguacucugcgaauggagcugcucgguugcgaauuaucaggguguagugagccccugggcaugaaaagcggacauauucaggauuaucagauaaccgcaucuuccaucuuuagaacacuuaauauggacauguucacuugggaaccgaggaaggcccgguuggauaagcaaggcaaagugaacgcuuggaccucagggcacaaugaccagagccaguggcugcaaguggaccuacucgucccuacaaagguuaccggaauuaucacgcagggugccaaagauuuuggccacgugcaguucguagggaguuacaagcuggcauauucuaacgacggagagcauuggacuguguaccaggaugagaagcaacguaaagacaaggucuuucagggcaauuucgauaacgacacacaccgcaaaaaugugauagaucccccaauuuacgcuagacauaucaggauccuuccuugguccugguauggucggauuacccugcgaagcgaauugcucgggugcacugaggaagaguga

SEQ ID NO: 55615 - RNA, 639 nt, Artificial Sequence
  derived and/or modified sequence opt3 from EDN1__Homo_sapiens__NP_001946
auggacuaccugcucaugaucuucagccuucuguuuguggccugccagggcgcucccgagaccgcagucuugggggccgaauuauccgcgguuggagagaacgguggcgaaaagccuacaccaucuccgcccuggagacugaggcggucaaaacgcuguaguugcagcucccuaauggauaaggaguguguguauuucugccaccucgacauuauauggguaaauacuccugaacauguggucccauacgggcugggaucuccccgaucgaaacgugcucuugagaaccuguugccuacgaaggccaccgauagagagaauaggugucaaugcgcaucacagaaagacaagaaguguuggaacuuuugccaggccggcaaagaacuccgggcugaggauaucauggaaaaggacuggaauaaccacaaaaaggguaaagauuguagcaagcuggggaagaaaugcauuuaucagcaacuggugcgcggaagaaagaucaggcggaguuccgaggagcaucuccgccagacacgaucugaaacuaugagaaauagcguuaaauccucauuccacgacccaaaguuaaaaggcaagcccaguagggagcgguacgugacccauaaccgugcacacugguga

SEQ ID NO: 55616 - RNA, 579 nt, Artificial Sequence
  derived and/or modified sequence opt3 from EDN3__Homo_sapiens__NP_001289385
auggagcccggccuguggcuccuuuucgggcugaccgugacaagcgccgcuggauuugucccuugcucccagucuggugacgcaggcagaaggggaguuucacaagccccaacugcggcucggagugaaggggauugugaggaaacgguggccggcccgggugaggaaaccguagcagggcccggagagggcacaguggccccuacugcuuugcagggcccaagccccggguccccuggacaggagcaggcagccgaaggugcuccagagcaccaucgcucucgacguugcaccuguuucacauacaaggacaaagaaugcgucuauuacugucacuuagauaucauuuggauaaacacccccgagcaaacugugccuuauggccugucgaauuacagagggucauuuaggggaaagcggagcgccggcccacuaccggguaaccuccagcugagucaucgcccccaccuuagaugcgcguguguugggagguaugacaaagcaugccugcauuucuguacacagaccuuggaugugucccggcucaagucucgcacgaauaaagccagccgacuguga

SEQ ID NO: 55617 - RNA, 957 nt, Artificial Sequence
  derived and/or modified sequence opt3 from EDNRA__Homo_sapiens__NP_001159527
auggagacccugugccucagagccagcuucuggcuugcucuggugggcugugucaucuccgacaaccccgaaagguacucuacaaauuugucaaaccacguugaugacuuuacuacguuccgggggaccgaguuaaguuuucuggugacaacucaucagccuaccaaucuaguacucccaagcaacggauccaugcacaauuauugcccgcaacagacaaagauuaccucugcauucaaauacauaaacacugugaucucguguacaauuuuuaucgucgguauggugggcaaugccacccugcuucgcauuaucuaucagaacaagugcaugcgaaaugggcccaacgcgcugauagcuucauuggcccucggagaucugaucuacguugugauugaccugccuaucaaugucuucaaauuuuaucaggaugugaaggacugguggcucuuuggcuuuuacuucuguaugccauuaguaugcacggcaauuuucuauacucugaugaccugugaaaugcuuaaccguagaaaugguagcuugaggaucgcccugagugagcaucuaaaacaacggcgcgaaguugcuaagacaguguucugccucgucgugauauuugcacuguguugguucccccuucaccuguccagaauuuugaagaaaacuguguacaacgagauggauaagaauaggugcgagcuccugucuuucuuacugcucauggacuacaucgggauuaaccuugccaccaugaacagcuguaucaauccuaucgcucuguauuuugucuccaaaaaguucaaaaacugcuuucagucaugcuuguguugcuguugcuaccagaguaagagccuaaugacaucuguuccaaugaauggaaccuccauucaguggaagaaccaugaucaaaauaaccacaauacggaccggucaagccacaaagauaguaugaacuga

SEQ ID NO: 55618 - RNA, 1329 nt, Artificial Sequence
  derived and/or modified sequence opt3 from EDNRB__Homo_sapiens__NP_000106
augcagcccccuccaagccugugcggccgcgcccucguggcucuuguccuggcauguggguuguccaggaucuggggagaggaacgggguuucccgcccgaccgcgccaccccuuuacugcaaacagcggagauuaugacuccacccacgaagacccuauggccuaaaggcucuaacgcuucacucgcccgaagucuggcaccagccgaaguucccaagggggaucguacagcuggaagcccuccaagaacuauauccccgcccccuugccagggcccaaucgagauuaaagaaaccuuuaaguacaucaauacagugguaucuugucuuguguucguccuggguauuaucgggaacucgaccuugcucaggauaaucuauaaaaauaagugcaugcggaacggacccaauauucugaucgcaucacuggcccucggcgacuuacugcacauugugaucgauauaccuauuaacguuuacaaacuuuuggcugaggacuggccauuuggcgccgagauguguaagcuggugcccuucauccagaaggcgagcgucgggauuacugugcuaagucucugcgcacuguccaucgaucgcuauagagccguagcuucuuggagcaggaucaaaggaauugguguuccgaaguggacagccguggaaauaguccuuaucugggugguguccgucguucuggcagugccugaggcuauuggcuuugacaucauaaccauggauuacaaagggucauauuugcggauuugucuccugcaucccguacagaagacggccuucaugcaauuuuacaagacugcgaaagacuggugguuauucaguuuuuauuucugccugccacucgccaucaccgcauuuuucuacacacuuaugacuugugaaaugcugcgcaagaaaagcggaaugcagaucgcuuugaaugaucaccuaaagcagcgaagagagguggccaaaaccgucuuuugccuggugcucguuuucgcucuguguuggcuuccucugcauuugucuaggauucucaagcugacauuauacaaccagaaugaccccaaccggugcgagcugcuauccuuccuccuggugcuugauuauaucggcauuaauauggccucauugaacagcugcauaaauccaaucgcacuguaccucgucaguaaacguuuuaagaacuguuucaagucuugccuguguugcuggugucaauccuuugaagagaaacagagccuugaagagaagcagucgugccugaaauucaaggccaaugaccacgguuaugauaacuuuagaucuuccaacaaauacucaaguagcuga

SEQ ID NO: 55619 - RNA, 4236 nt, Artificial Sequence
  derived and/or modified sequence opt3 from EEA1__Homo_sapiens__NP_003557
augcugagaaggauccuccagcggacccccggccgcguggggagccaaggauccgaccuugauucuucagccacaccuauuaacacugucgacguuaauaacgagaguagcuccgaagguuucauaugcccacaguguaugaagucucugggcucggcugaugaguuguuuaaacacuacgaagcagugcaugacgccgggaaugauucaggacacggcggugagagcaacuuagcgcugaagcgagacgauguaacgcuacuccgucaggaagugcaggaccugcaagcuagucuuaaagaggagaagugguauuccgaggagcugaaaaaggaauuggagaaguaccaggggcuccagcagcaagaggccaaaccggauggacuggucaccgacucuagcgcagaacugcagucccucgagcagcaguuagaagaggcccaaacagaaaauuucaacaucaagcagaugaaagaucuguuugagcagaaggcugcacaacuugccacugagauugcugacaucaaaucaaaguaugaugaagagagaaguuugagggaagccgcggagcagaaggugacccggcugacagaggagcuaaauaaagaggcaaccguuauucaggaccucaagacugaacugcuucagcgccccggcaucgaggacguggccguccugaaaaaggaauuggugcaaguacagacacucauggauaacaugacccuggagagagaaagggagagcgagaaauuaaaggacgaaugcaaaaagcugcagucucaguacgcuuccucagaggccacgauaagccaacuccggagugaacuugcaaagggcccucaggagguugcuguguauguccaggagcugcagaaauugaagucuuccgugaaugaacuaacucaaaagaaccagacccugacagagaaucuccugaagaaagaacaggauuacacuaaacuugaggaaaagcauaacgaggagagcgugucgaaaaagaauauccaggccacccugcaccaaaaagacuuggauugucagcagcuccaaucucgccuguccgcgucagaaacaaguuuacaucgaauccacgucgagcugagcgaaaagggggaggccacccagaaacuaaaggaggaacucuccgagguugaaacgaaguaucagcaccugaaagcagaguucaagcagcuucaacagcagagagaagagaaagaacagcauggauugcaacugcagucugagauuaaccagcuccacagcaagcugcuugagacugaaaggcagcugggugaggcucauggccgguugaaagaacaacgucagcucucaagugagaagcugauggacaaggagcagcaaguggccgauuuacagcugaaacuaucccgccucgaggaacagcugaaggaaaaaguaacaaauagcaccgagcuucagcaccaauuggacaagacuaaacagcagcaccaggaacaacaggcucugcagcagucuacaaccgccaagcucagagaggcacaaaacgaucuggaacagguguuaaggcagauuggggacaaagaucagaagauccaaaaccuggaagcccuuuugcagaagucaaaagagaauauaagucuccuggaaaaggagcgggaagaccuauacgcuaaaauucaggcgggagagggcgagacggcaguccugaaccaacuccaggaaaagaaucauacccugcaggaacaggugacacaacuuacugaaaaauugaagaaccagagcgagucccacaagcaggcccaggaaaaucugcaugaccaaguucaggagcagaaagcucacuuacgagccgcacaggaucgcgugcucucucuggagaccucggucaacgaacuuaauagccaacugaacgaguccaaggaaaaagugucacaguuggacauccagauuaaggccaaaacagagcuccugcuaagugcugaggccgcaaagacugcgcaaagagcugaucugcagaaucaucucgacaccgcccagaacgcacugcaggauaagcaacaggaacuuaauaaaaucacaacccaguuggaccagguaacugccaagcugcaagauaaacaggagcacugcucucaguuagaaagccaccucaaggaguacaaagaaaaguaucugucccuugagcagaagacggaggaacuggagggucaaaucaaaaagcuagaagcugacucacucgagguuaaagccagcaaggaacaggcacugcaggauuugcagcaacagaggcagcugaacacagacuuagagcuccgggcuaccgagcugucuaaacaacuugaaauggagaaggaaauuguguccaguacucgccuggauuugcagaaaaagagcgaggcccucgaaucuauaaagcagaaacugaccaagcaggaggaggaaaaacaaauccuaaagcaggacuuugagacacugucccaggaaaccaaaauucagcaugaggagcuuaauaacagaauccaaacuacagucacggaacuccagaaggugaagauggagaaagaagcgcugaugaccgaguugucaacugucaaggauaaacugaguaaggugagcgacucgcucaaaaauuccaagucugaauuugagaaggagaaccagaaagggaaggccgcuauauuagaccuggagaaaacauguaaggaacuuaaacaccagcugcaaguucagauggaaaacaccuugaaggagcagaaggaacucaaaaagagccuggagaaagagaaggaagcaucacaucaacuaaaacuggagcuuaauaguaugcaggaacagcucauucaggcccaaaacacacugaagcagaaugagaaggaggaacagcaguugcaaggaaacaucaaugaguuaaaacaguccucugaacagaagaaaaagcagaucgaggcucugcaaggcgaacucaaaauugccgugcugcagaagacugagcuugagaacaaacugcagcaacaguugacccaggcagcgcaggaacuagccgcugagaaggaaaagaucagcguacugcaaaauaacuacgagaaaucccaggaaacguuuaagcagcuccagucagauuucuauggcagggagagcgagcugcuugccacccgucaagacuuaaaaagugucgaagagaagcugucucucgcacaggaagauuugauuuccaaucggaaccagauagggaaucagaacaaacugauccaagagcucaagacagcuaaggccacucuggaacaggacagcgccaaaaaggagcagcagcuucaagagcgaugcaaagcacugcaggauauucagaaggaaaaaucguugaaggagaaggagcuagugaaugaaaaaucaaagcuggcugaaaucgaggagaucaaauguagacaagaaaaggagauuaccaaacucaacgaagaguuaaagucucacaagcuggagaguauaaaagaaaucacaaaucuuaaggacgcgaaacagcugcucauucagcagaaguuggagcugcaaggaaaagccgauucccucaaggcagcuguugaacaggagaaaaggaaccagcagauccugaaggaccaagugaagaaagaagaggaggaacuuaagaaagaguuuauugaaaaggaggccaaacuacacagcgaaaucaaggagaaggaggucgguaugaaaaagcaugaagagaacgaagccaaacugacuaugcagauaaccgcuuugaaugagaacuuaggcacggugaagaaagaauggcagucuagccagcgccggguauccgagcuggagaagcaaacagaugaccucagaggggaaaucgcagugcuggaggccaccguucagaauaaccaggaugaaaggcgcgcgcuucuggagcgaugccucaagggagagggcgaaauugagaaauugcaaacuaagguccuggaacuacagcggaaacuggacaauacaaccgcugccgugcaggagcucggucgugaaaaccagucacuucaaaucaagcacacucaggcacugaauagaaaaugggccgaggauaacgaggugcagaauuguauggcuugcgggaagggcuucagugucaccguuaggcgccaucacugucggcagugcggaaacauuuucugcgcagaauguagcgccaagaaugcguuaacaccaucuuccaaaaagcccgugagagugugcgacgcuuguuucaacgacuugcaaggcuga

SEQ ID NO: 55620 - RNA, 1326 nt, Artificial Sequence
  derived and/or modified sequence opt3 from EED__Homo_sapiens__NP_003788
augagcgagagagaaguguccaccgcccccgcuggcacagacaugccugcagccaagaaacagaagcugucuucagaugagaacaguaauccagaccucagcggggaugaaaacgacgaugcggucuccaucgagucuggaacuaauacggaaaggccggacacccccacaaacacuccuaaugcuccaggucggaaaucguggggcaaggggaaauggaagucaaagaaaugcaaguacagcuucaaauguguuaacagucuuaaggaggaucacaaucaaccccuguuuggagugcaguucaacuggcauuccaaagagggcgacccuuugguauuugccaccguggguucuaaucgcgucacauuauaugaaugccacagccagggggagauucgacugcuacaguccuacguggaugcagacgccgaugaaaacuucuauaccugugcuuggacuuacgacucaaauacaagucauccacuccuggcaguugccggaagccguggcauaaucagaauuaucaaccccauuaccaugcaaugcaucaagcacuaugugggccaugggaaugcuauaaacgagcuuaaguuucacccuagggauccaaaucuguugcucucugucuccaaagaccacgcccugcggcuguggaacauccagacggacacucucguggcgauuuucggagguguagagggccaucgcgaugaaguuuuaucagcagacuacgaucugcuuggggagaagaucaugagcuguggaauggaccacaguuugaaacuguggagaauuaacucuaagaggaugaugaaugccaucaaagaauccuaugauuacaacccgaauaagaccaaccggcccuuuauaagccagaaaauucauuucccugacuuuucgacacgcgauauccaccgaaauuacguggacugcgucagauggcuaggcgaucucauucugucuaaguccugugagaacgcuaucgugugcuggaagccagguaaaauggaagacgauaucgacaagauuaaacccucagagaguaaugugacuauacuugggagguucgacuauagccagugugauaucugguacaugcgguuuuccauggacuucuggcaaaagaugcuggccuugggaaaccaggucggcaaacucuauguuugggaucuggagguggaagacccucacaaggcaaagugcaccacauuaacccaucacaaauguggcgcugccauucgucagacgucuuuuagccgcgauucaaguauccugauagcgguaugcgacgaugccuccauuuggagaugggacaggcuccgguga

SEQ ID NO: 55621 - RNA, 1389 nt, Artificial Sequence
  derived and/or modified sequence opt3 from EEF1A1__Homo_sapiens__XP_011533816
augggcaaggagaaaacccacaucaacauuguggucauagggcauguugacagcggaaaguccacaacuacgggucaccugaucuacaaaugcggcgggauugauaagagaaccaucgaaaaauucgagaaggaagccgcugagaugggaaagggcucuuuuaaauacgcaugggugcucgacaaacuuaaagccgaaagggagcgggguauuacaaucgauauaucacuguggaaguucgagacgaguaaauacuauguaaccaucauugacgcgcccgggcaucgcgauuuuaucaagaauaugauuacaggaaccagccaggcugacugugccguguugaucgucgcagccggcgugggcgaguucgaagcugggauauccaagaacggacaaacucgagaacacgcauuacuggccuacacacuagguguuaaacagcucauugugggcgucaauaagauggauucuaccgagccuccauauucgcagaaacguuacgaggaaaucgugaaggagguaucaacguauauuaaaaagaucggguacaacccggacacuguugcuuuugugcccaucagcggauggaauggcgauaacaugcuggaaccuagugccaauaugccaugguucaaagguuggaaggucaccagaaaggacgggaacgcguccggaacaacucuucuggaggcauuggauugcauucugcccccuaccaggccaacagacaaaccccuccggcugccucuccaggauguguacaagauaggcggcaucgggaccgugccagucggacgcguugaaacggguguguuaaaaccgggcaugguagugacuuuugcccccgucaaugugacaaccgagguuaagucuguggagaugcaucacgaagcucugagcgaggcccuuccuggggacaacgucggauucaaugugaaaaacguauccguuaaggacgugagaaggggcaaugucgcuggugauucaaagaacgacccacccauggaagcagccggguuuacugcgcaagugauuaucuugaaucacccuggccagauaagugccggauaugcaccaguccuggauugucauacagcucacauugccugcaaauucgcugagcuaaaggaaaagaucgaccggcgcagcggcaagaaacucgaggaugggcccaaguuucugaagucuggagacgccgcaaucguggauaugguuccggguaaaccuauguguguggaguccuucucagacuaucccccacuuggccgauuugccguaagagauaugaggcagaccgucgcuguggggguuauuaaggcgguggacaaaaaggcagccggagcuggcaaagucacuaagagcgcccagaaggcacaaaaagccaaguga

SEQ ID NO: 55622 - RNA, 1392 nt, Artificial Sequence
  derived and/or modified sequence opt3 from EEF1A2__Homo_sapiens__NP_001949
augggcaaggagaaaacccacaucaacauuguggucauagggcauguugacagcggaaaguccacaacuacgggucaccugaucuacaaaugcggcgggauugauaagagaaccaucgaaaaauucgagaaggaagccgcugagaugggaaagggcucuuuuaaauaugcaugggugcucgacaaacuuaaagccgaaagggagcgggguauuacaaucgauauaucacuguggaaguucgagacuaccaaauacuauaucacaauuaucgacgcgcccgggcaucgcgauuuuauuaagaauaugaucaccggaacaagucaggcugacugugccguauugauaguggcagccggcgucggcgaguucgaagcugggauuagcaagaacggacaaacucgagaacacgcauuacuggccuacacccuaggugugaaacagcucaucguuggcgugaauaagauggauuccacggagccugcuuauucugagaaacguuacgacgaaauugucaaggaggugucggccuauaucaaaaagaucggguacaacccagcgacuguaccguuuguucccauuucaggauggcauggcgauaauaugcuggaaccuagcccaaacaugcccugguucaaagguuggaagguggagagaaaggaagggaaugcaaguggagucucccuucuggaggccuuggacaccauacucccuccaacaaggcccacugauaaaccucugcggcugccacuccaggacguguacaagaucggcggcauugggaccgugccggucggacgcguugagacagguaucuuaagacccggcauggugguaaccuuugcuccugugaacauaacgacugaagucaaaucuguggagaugcaccacgaagcccugagcgaggcacuuccaggggauaauguuggauucaacgugaagaaugucuccgugaaagacauuaggcggggcaacguaugcggugacucaaagagugaucccccucaggaagcugcccaauuuacaagccagguuaucaucuugaaucauccagggcagauuucugcgggcuauucccccgugaucgacugucacaccgcccauauugcaugcaaguucgcugagcugaaagagaagauagaucgccgaucaggaaagaagcuagaagacaacccgaaaagccucaagaguggcgaugccgcuaucgucgagauggugccugggaagcccaugugugucgaaucuuuuucccaguacccaccucugggaagauucgccgugagggacaugcggcaaacuguugcaguggguguaauuaaaaaugucgagaagaaaagcggcggggccggaaaggugacaaaaucggcucagaaggcgcagaaggcaggcaaauga

SEQ ID NO: 55623 - RNA, 678 nt, Artificial Sequence
  derived and/or modified sequence opt3 from EEF1B2__Homo_sapiens__NP_001032752
augggcuucggggaccugaaaagccccgccggacuccaggugcuuaacgauuaccuggcugacaaguccuauaucgaggguuacgucccuucucaagcagauguugccguguuugaagcgguaucaaguccaccgcccgcugacuugugccacgccuuaagaugguauaaucauauuaagagcuacgagaaagaaaaggcaucccugccuggcgugaaaaaggcccuagggaaguauggaccagcugaugucgaggacaccacaggcucuggugcaacugauucgaaagacgaugacgauauagaccucuucgggucagaugacgaagaggagagcgaagaggccaagaggcugcgggaagaacgccuugcucaguacgagaguaaaaaggccaaaaagcccgcgcugguggcaaaguccucuaucuugcucgacguuaaaccuugggaugacgaaacggauauggccaagcuggaggaaugugugcgaagcauucaggcugacggacuggucuggggcuccucaaaacucgugccaguaggcuaugggaucaagaaauuacagauucaaugcguuguggaggaugacaaggucggaaccgauaugcuggaggagcagaucacagccuuugaggacuacgugcagaguauggauguggcagcuuucaacaaaauauga

SEQ ID NO: 55624 - RNA, 1944 nt, Artificial Sequence
  derived and/or modified sequence opt3 from EEF1D__Homo_sapiens__NP_001123525
augagaagcggcaaggccuccugcacccuggagacagugugggaagacaaacacaaguacgaggaagcugagaggcgguucuaugaacaugaggcaacucaggccgcggcuucugcccaacagcuccccgcagaggggccugccaugaacggaccaggucaggaugacccggaagaugcugacgaggcagaagcccccgauggcgggucacgccgagacccucguaaaagucaggauagcagaaagccacuucagaaaaagaggaagcggucccccaaaucuggacugggcccugcugacuuggccuuacugggucuaucggcggagcgcgucuggcucgauaagucacuguuugaccaggcagagagcaguuacagacagaaacuugccgauguugcugcccaggcagcuuggccacccgcccuggcgccuuggggguuguguacgcacggaaaucaaguggccugccaucacguaaccuggggcaucugggugaacaaguccucuuucgaccaggcagaaagggcuuuugucgaguggagccaggcccuccugcuggcuccagaaggcucccggcgccaggggacaccgaauacuggacaacagguggccguucccgaucucgcacaucagccuucaccacccgugaacggucaaccuccauuaggcagucugcaggcccuuguccgagaggugugguuggaaaaacccagauaugacgcugcggagaggggguucuacgaggcacuguuugacggacacccgccuggcaagguacggcuacaggaacgugccggucucgcugagggggcccgcagaggaaggcgggaucgacgcggcagaaauauucugggcaacaagagggcagggcuucggcgcgccgacggagaagcucccagcgcccugccauauuguuacuucuugcagaaagaugcagaggcgccuuggcucucuaagcccgcuuaugacuccgccgaaugcagacaccaugcagccgaggcucugaggguugccugguguuuagaggcagcuucacugagccaccguccagguccccggaguggccucucuguguccagccuucgaccuaauagaaaaauggccaccaacuuucuggcgcaugaaaagauaugguucgauaaauuuaaguacgacgaugccgagaggcgcuucuacgaacaaaugaaugggccagucgcuggagcaucgcggcaggagaacggcgccucugugaucuugagagacauugcuagggcccgcgaaaauauccagaaaucccuagcagguucaagugggccgggcgcgagcuccggaacaucuggcgaucacggggagcuggugguccgaauugccagccucgagguugaaaaccagucacugcggggagugguacaagagcuucagcaggcuaucaguaagcuggaagcccguuugaaugugcucgagaaguccagccccggucacagagcaaccgcuccucagacucaacaugucucuccaaugaggcaaguggagcccccugccaaaaagccagcaacacccgccgaagacgaugaggacgacgauauagaccuguuuggcucagauaacgaagaggaagacaaagaggcugcgcaguuacgcgaggaacggcugagacaguaugccgagaagaaagcaaagaagccggcucuaguugccaaaaguagcauccuccuggaugugaagccuugggacgaugaaaccgacauggcccaacuugaggcuugcgucagguccauucaguuggaugggcugguguggggagcaucuaaacucguaccaguuggcuacgguauccgaaagcugcagauucaauguguggucgaagacgauaaaguggggacggaccuucuggaggaggaaaucacuaaguucgaggaacacguccagucgguggauauagccgcguuuaauaagauuuga

SEQ ID NO: 55625 - RNA, 420 nt, Artificial Sequence
  derived and/or modified sequence opt3 from EEF1E1__Homo_sapiens__NP_001129122
auggccgcugcagccgagcugagccuccuugaaaagucccugggcuugucuaaagggaacaaguacucagcgcagggagagagacaaauccccguguuacagaccaauaacgguccuagucugacaggccuaacuacgauugcugcccaccucgucaaacaggcaaauaaggaauaucugcuugggagcaccgccgaggaaaaagcuauaguucagcaauggcuggaguacagggugacacagguagacggacauuccucuaagaacgauauccacacuuugcucaaggaccucaauucguaucuggaggauaaaguguaccugaccggcuauaacuucacauuagcagacauucugcuuuacuaugguuugcaucgguuuaucauucgcaagcugcgacacaccgaagucgggaauuga

SEQ ID NO: 55626 - RNA, 1314 nt, Artificial Sequence
  derived and/or modified sequence opt3 from EEF1G__Homo_sapiens__NP_001395
auggccgcuggcacccuguacacauaucccgagaacuggagagcauucaaggcccucaucgcggcucaguacagcggggcccaagugaggguccuuuccgcaccuccacacuuucauuucggacagacuaaucggacgccggaauuucugcgcaaauuccccgccgguaagguuccugcuuuugagggcgacgauggguucugcguguuugaaucuaacgcaauugccuauuacguaucaaaugaggaauugcgaggaaguaccccagaggcugccgcacaggugguccagugggugagcuucgcggacuccgauauaguucccccugccucuacauggguguuuccaacuuuaggcaucaugcaccauaacaaacaagcuaccgagaaugccaaggaagagguccguaggauucugggucuacucgacgcauaucugaaaacaagaaccuuccuugugggggaacggguaacucuggcugauaucacaguuguguguaccuugcucuggcuguacaagcagguccuggagcccucguuucgccaggccuucccuaacacgaauagaugguuucucacuugcauuaaccagccacaauucagggcgguguuaggagaggugaagcugugugagaaaauggcccaguucgacgcaaagaaauuugcugagacccagccgaagaaagauacaccccggaaggaaaagggcucacgcgaggaaaaacagaagccucaagccgagcgaaaagaggaaaagaaagcugccgcaccagcccccgaggaagagauggacgaaugcgagcaggcucuugcggcagagccuaaggccaaagauccauucgcucacuugcccaagagcacuuuuguccuggacgaguucaagagaaaauauaguaaugaagauacccuauccguugcccucccguacuuuugggaacauuucgacaaggauggcuggucucugugguacagcgaguauagguuuccugaagaacuuacacagaccuucauguccuguaaccugaucacggggauguuucaacgguuggacaaacuccguaagaaugcauucgccucagugauacuguuuggaacuaacaauaguagcucuaucuccgguguauggguguuccgcggccaggaguuagcuuuuccccugucaccagacuggcaggucgauuacgaaagcuauacauggagaaaacucgacccugggagugaggaaacccagacucuugugagggaguacuucucuugggagggagccuuccaacacguuggcaaggcauuuaaccaggguaagauuuucaaauga

SEQ ID NO: 55627 - RNA, 2577 nt, Artificial Sequence
  derived and/or modified sequence opt3 from EEF2__Homo_sapiens__NP_001952
auggugaacuucaccgucgaccagaucagagccauuauggauaagaaggcuaauauaaggaacaugagcguuaucgcacacguggaccauggcaaguccacacugacugauucucucguaugcaaagccgggauuaucgcgucagcucgggccggagagacgcgcuuuaccgacacacgaaaggaugaacaagagcguuguauuacuaucaaaaguaccgcaauaagccuuuucuacgaacuguccgagaaugacuugaacuuuaucaagcagucuaaggauggugccggcuucuuaauuaaucugaucgacucgcccgggcacguggauuuuucaagcgaagucacagcugcacuaagagugaccgacggagcccucguuguggucgauugcgugaguggcguauguguucagacugagacagugcugaggcaggcuauugccgagcggaucaaaccuguccuuaugaugaacaagauggaccgcgcgcuguuggaacuccaacuggagccagaggaacuguaucagaccuuccagagaauaguggagaaugugaacgucauuaucuccacguacggugaaggggagucuggaccgaugggcaauauuaugaucgaucccguucucggcacugugggguuuggaagcgguuuacauggcugggcauucacccugaaacaguuugccgaaauguauguagcuaaguucgccgcaaaaggggagggacaacuuggcccugcugaaagggccaagaagguggaggacaugaugaaaaaguuguggggugaccgguacuuugauccagcgaacgggaaauucuccaagucagccacaagucccgagggaaagaagcugccucgcacuuuuugccagcuaauccucgacccaauuuucaaagucuucgaugcaauaaugaauuuuaagaaggaagagaccgcuaaacugaucgaaaaacuugacauuaaacuggauagcgaggacaaggauaaagaaggcaagcccuugcucaaggccgugaugcgaagauggcugccugcuggcgacgccuuacugcagaugaucacaauacaccucccaucuccgguuaccgcacagaaauauaggugugagcuucuguacgaggggcccccugaugacgaagccgcuaugggaauuaaguccugcgauccaaaaggucccuugaugauguauaucucaaagauggugccuacgagcgacaaaggccgguucuacgcguuugggcgugucuucagugggcuagugucuacuggccugaagguacgcaucauggguccaaacuacacacccgggaagaaagaggaccucuaucugaagccgauucaaagaaccauccuuaugaugggcagguacguugaaccuauugaggaugugcccuguggaaauauagucggccuggugggggucgaccaguuuuuggugaaaacuggaacaaucaccacguucgaacaugcacacaacaugcggguuaugaaguuuuccgugagcccaguaguccgaguggccguugaggcuaaaaauccugccgaucuccccaagcugguggaggguuuaaagcgccuggcaaaaucggacccaaugguccagugcauuaucgaagagucuggcgaacacaucauugccggggcuggagagcuacaucucgagauaugucugaaggaucuugaagaggaccacgccugcauccccauuaaaaaguccgauccugugguaucauauagagaaaccgugagugaggaaagcaacguuuugugucuguccaaaucuccaaacaagcauaauaggcucuacaugaaagcacggccguuccccgacggccuggcggaggauaucgacaagggugaggucagcgcucgccaagaacuuaagcagagagccagguaucuggcagagaaauacgaaugggauguggccgaggcucguaagauuuggugcuuugggccugacggcacaggaccaaacaucuugacugauauaaccaaaggcgugcaguaucucaaugaaaucaaggacucagucguugccggguuccagugggcaacaaaagagggagcucugugcgaggaaaacaugcggggugugcgauuugacgugcacgauguaacuuuacacgccgacgcgauucauagaggcgggggacaaaucauucccaccgccaggcgcugucuguacgcuaguguccuaacagcacagccucggcucauggagccaaucuaccugguggaaauacagugccccgagcagguugugggcgguauuuaugggguccuuaauagaaagaggggccacguguucgaagagucccaaguugccggaaccccgauguuugugguaaaggcuuacuugccugucaacgagagcuucggcuucacugccgaucugcgcucuaauacgggaggacaggcauuuccacaguguguguucgaccauuggcagauccuccccggcgauccuuuugacaacucaagucgacccagccaaguggucgcggaaacacggaaacguaagggucugaaagaggggauuccagccuuagauaauuuccuggacaaacuuuga

SEQ ID NO: 55628 - RNA, 1791 nt, Artificial Sequence
  derived and/or modified sequence opt3 from EEFSEC__Homo_sapiens__NP_068756
auggccggcagaagggugaacgucaauguuggggugcugggacacaucgacagcgguaagaccgcucucgcacgggcccuuuccacaacugcgucuacggcugccuucgauaaacagccccaaucacgcgagcgaggcauuacccuggacuugggguuuaguugcuucagcguaccuuuaccagcacgucugagauccucucuaccggaauuucaggccgcucccgaggcagaaccugagccaggagaaccccuccuucaggugacacuggucgauuguccuggccaugccucgcugauaaggacuaucauugguggggcucagaucauugacuugaugaugcucgugaucgauguuaccaagggaaugcaaacacagucagccgagugccuggugauaggccagaucgcgugucagaaacuggucgugguacucaacaagauugacuuacugccagagggcaaacggcaagcagccaucgauaagaugaccaagaaaaugcagaagacucuugaaaauacaaaauuccgcggggcucccauuaucccuguugccgcaaagccaggagguccggaggcucccgaaaccgaggccccucagggcauaccagaguugauugaacugcuaacgagccagaucaguauucccacuagagacccuuccgggccauuucucaugucuguggaucacugcuucagcaucaaaggacaaggcaccgucaugacagguacuauccuguccgggucaauuagucuuggagacagcguggagauacccgcgcugaagguggucaagaaaguuaagucuaugcagauguuucauaugccgaucaccuccgccaugcagggcgauagguugggcauuugugugacacaauucgacccuaaacuccuggaacggggguuaguaugcgcacccgagucacugcacaccgugcaugcugcccucaucagcgucgaaaagauaccauacuuucgcggaccucuucagacgaaagcuaaguuccacauuacugugggucacgagacaguuaugggccgacugauguuuuucagucccgccccagauaacuuugaccaggagcccaucuuggacucuuucaauuucucccaggaauaucuauuucaagagcaguaccugagcaaagaucucaccccugcagugacugacaacgaugaagccgacaagaaggcugggcaggcgacagagggacauuguccaagacagcaaugggcacuggucgaguucgaaaaaccggugaccugccccaggcuuugucugguaaucggcucgcgguuggaugccgacauucacacgaauaccugccgucucgcuuuucaugguauccuguuacacgggcuggaggaucgcaacuaugccgacucuuuccuaccuagacucaagguuuacaaacugaagcacaaacauggccuuguggaaagggcaauggaugacuauuccgucauuggacggucauuguuuaagaaggagacaaauauacagcuguucgugggccucaaaguccaccugaguacuggggaacuuggaaucauugauagcgccuuuggucaguccggcaaguucaaaauccauaucccagggggacugucucccgagagcaagaaaauuuugaccccugcucucaagaagcgagcccgcgcaggcagaggugaagcgacaaggcaggaggagucagcugaacggagugagccaucccaacacgugguucugagcuuaacuuuuaaacgcuacguguucgacacccauaagagaaugguacagucucccuga

SEQ ID NO: 55629 - RNA, 429 nt, Artificial Sequence
  derived and/or modified sequence opt3 from EFCAB11__Homo_sapiens__NP_001271195
auguucuuuagcgaggccagagcuaggucccggaccugggaagcaucucccucagagcaccgcaaguggguggaagucuucaaagccugcgacgaggaucauaagggcuaccugagucgagaagacuuuaaaacagcgguugugauguuguucggguauaagccuagcaaaaucgagguagauuccgugaugucuucgauuaacccaaauacuucaggaauacuucuggaggguuuucucaacaucguccguaagaagaaagaagcucagagauacaggaaugaggugcggcacauuuucacggccuuugacaccuauuaccgcggcuucuuaacacuggaagauuuuaagaaagcauucagacaaguugccccgaagcuacccgagaggacugugcucgaggucuuucgggggaucuucagcgcuuga

SEQ ID NO: 55630 - RNA, 480 nt, Artificial Sequence
  derived and/or modified sequence opt3 from EFCAB1__Homo_sapiens__XP_005251361
augaacagaaagaaacugcagaagcucaccgacacacuuacuaaaaauugcaagcaccuguucaggggcuuugauaaagacaacgaugggugugugaaugucuuggaguggauccauggauuaagccuguuccuacgggguucccucgaagagaagaugaaguacugcuuugaaguuuucgaccugaacggcgauggguuuauuucuaaagaggaaauguuccacaugcuuaaaaauucacuguugaagcaacccagugaggaggacccugaugaaggaauaaaggaccucguggagaucacgcugaaaaagauggaucaugaccacgauggcaagcugagcuuugccgacuaugaacucgcuguacgcgaggagaccuuacugcuugaagcauucgguccauguuugccggaucccaaaucccagauggaguuugaagcccagguguucaaggacccuaacgaguuuaaugacauguga

SEQ ID NO: 55631 - RNA, 1482 nt, Artificial Sequence
  derived and/or modified sequence opt3 from EFEMP1__Homo_sapiens__NP_001034438
augcugaaggcccucuuccuuaccaugcugacauuggcuuuagugaaaagccaggacacugaggaaacgaucaccuacacacaaugcacugauggcuaugagugggaccccgucagacagcaguguaaggauauugacgaaugcgauauaguuccugacgcauguaaagggggaaugaagugcgugaaccacuacgguggcuaucugugucuaccaaaaaccgcccagaucauuguaaauaacgagcaaccgcagcaggaaacacagcccgcggaggggaccuccggagcuacuacaggcguggucgccgcaucuucaauggccaccaguggugugcucccugggggaggcuuuguugcuagcgcagccgcuguggccggcccagagaugcaaacggggaggaauaacuucgucauccggcgcaaucccgcggauccucagcguauuccauccaaccccucucaucgaauccagugcgcagccggauacgaacagucggagcacaaugugugucaagacauagaugaaugcacugcugguacccauaacuguagagccgaccagguaugcaucaaucugaggggcucauuugcaugucagugcccuccaggguaucaaaagcggggagagcagugcguugauauugacgaguguacaaucccgcccuacugccaccagcgcugugugaacacuccuggcagcuucuauugccaguguaguccagguuuucaacuugcugccaauaacuauaccugcgucgauauuaaugaaugugacgcguccaaccagugcgcccagcaguguuacaauauccuggggucuuucauaugccaauguaaccagggauacgaguugagcuccgacagacucaacugcgaagauauugacgagugcaggacaucaaguuaccugugucaguaucagugcgugaaugaacccggcaaguuuagcuguaugugcccucaaggcuaccaggugguccggucucgcaccugucaggauaucaacgagugcgagacgacuaaugaaugucgagaggacgaaaugugcuggaacuaucaugggggauucagauguuacccaaggaaucccugccaggauccguauauucugacaccugagaaccgguguguuugccccguguccaaugcaaugugccgugaacucccacaaucaaucguauacaaauacaugagcauccgcagugacagaucugugccuuccgauauuuuucagauacaggcuaccacuaucuaugccaacacaauuaauaccuucaggaucaagagcgguaacgagaauggcgaguuuuacuuacggcaaacgucgcccgucucugcuaugcuggugcuuguuaaauccuugucagggccacgagaacacauaguggaccuggagaugcuaaccgucaguagcauuggaacauuccgcacuuccucugugcucagacugaccaucaucguaggccccuuuagcuucuga

SEQ ID NO: 55632 - RNA, 1332 nt, Artificial Sequence
  derived and/or modified sequence opt3 from EFEMP2__Homo_sapiens__NP_058634
augcugcccugcgccagcugucucccuggcucccuucuguugugggcuuuacugcuacuccugcuugggucugcaucaccacaggacagugaggaaccggauagcuacaccgagugcacagacggauaugaaugggaucccgacucccaacacuguagagaugugaacgagugccugacuaucccugaagccuguaagggugagaugaaaugcauuaaucauuacggcggguauuugugucucccaaggucugcggcugucauaaacgaccugcacggagagggucccccuccacccguuccuccagcccagcauccgaaucccugcccuccaggcuacgaacccgaugaccaggauucguguguggacguagaugagugcgcacaggcccugcacgacugucggccuucacaagauugccauaaccucccagggagcuaucagugcacgugucccgacggauaccgcaagaucggcccggaaugcguggacauugaugagugucgauaucguuacugccagcacagaugugucaauuuaccuggcaguuucaggugccagugugagcccggguuucaacugggaccaaacaaucgguccugcguggacguuaacgaaugugauaugggugcuccuugcgagcagcgcuguuucaauucuuacggcaccuuucuuugcagaugccaccagggguaugaauugcauagggacggauucagcuguuccgauaucgacgagugcucauacaguagcuaucugugucaguaccggugcauuaacgaacccggccgcuuuucuugucacugcccacaagguuaucagcuacucgcaacacgacugugucaggauaucgacgagugcgaguccggggcccaucaauguucagaagcucagacuugcgugaauuuccacggaggcuacagaugugucgauaccaacaggugcguggagcccuauauacagguaagcgaaaaucggugccuuuguccugccaguaacccacugugccgugagcagccgucuuccaucguucaccgcuacaugacaauuaccagcgaaagaucggugcccgcggacgucuuucaaauccaggcaacuucuguguacccuggcgccuauaaugcuuuccagauuagggccgggaacucccagggagauuuuuacauccggcaaauaaacaaugugucagcaauguugguccucgcucgaccaguuacagguccccgcgaguaugugcuggacuuagagaugguaaccaugaacagucugaugagcuacagagccuccucugugcucaggcuuacggucuucgugggcgcguauacuuuuuga

SEQ ID NO: 55633 - RNA, 2502 nt, Artificial Sequence
  derived and/or modified sequence opt3 from EFHB__Homo_sapiens__NP_653316
augaacauggagaucggccacccccaugaagggaaggacgaucugggagacaaaagagugauuauggguaccaaguucccuauggagcucggcauaagggucgggcuuggaaaagaagauagccggugcggcgaguccccaguugugucuaauaagugugaaggucgcauggccccgcccgagacaaaauuuccucugucaaagggguuggagaugggauuagaacgacagaacaucagucguacuguaaugcaaagaggcagccugggcguggacuccgucucugcuucgcaggggacgaagccaucacuacuccccggaaggaugggucuggagaaugaaagccuucuggcaggcuacacccacgagcggauuauccagccuccauuggggcgcgugugcggaaguucccaggccgcgggcucuagaagggcuccccucgccagcgguccugaggggguugaagaacuggugggaaaaccagcauucgucauggaaccgcggcaagagauggaaaaggaguccacaugugugcugaugaaacccaacacugagauuaagcucccuguagaaguugauaucggcuuaacccaggccgagggcccagacgaaaccaaaaauacagagccccagauggggcuggugauagaaccuccacagugccaauuugcucagcagcaugagcagcgcaaggaggcaggaaacaucgaaucaggugucgagcccccggaucgaauuagaccuaucuauaguggcaaguucuuugacaggacucccuguuggccaagcgccgggaaagugauuccugugggauaccgggucgcuacaugccuuaccgaaaaguugccccgucugaucacgccacccgaggccaaaaaguauuucaauuuucgcuacccuccagcgggcguugaaagaguguucuaugguagggcaaacgauccgcaaauagcccccuaccuaacucacgggauucggucuaaaaucuccguacucgcuaauacccugauuaacccucagccaaucacaacuuuucagcaaaagaucaaagacaagaaggagucaauuuaucuuagcaaucgacgcgcuccccugggcaaaagucaugaucaggcaccuggauugccaaagggcauggacaccacaaacaccacguucgggacugcugugauaaaagaguacucugccaaggaugucgugaaucccccgaaauccuacgaagagguuuuuaaggaaggaaacgagggucacgaccucuauguggucagccacaaugacuacuaugcgggcgaggccaagaacagaaaauacaacccuucgucuuuccauagguguuccguguaugggguaccaacaccccacuuuaaugauggacgggcaauggcuaagucacuguacugguuacaugaacugcagaugaaacgcggcgccaaguucguuaguaaaagagcugacgauuucaaggagaaguuucagcacaaacucgguagggugcuugacccuaucgccgaaaccaugaacgugcccccagauugcacuuucggggcaugucugcguccugaggaauauggcgucggagacuugauucacaaucggcuacccgaugaguaccugcgaggcaaggacagacaaagggcccucaucgcugcgguccgccaucaccugaaaaaggugaacuaccagaaauuugauacacuucuggcagccuuccggcauuaugacaagaagggggauggaaugauagacaaagacgaguugcaggaagccugcgaucaggccaaucucagccuggacgauaaguuacuggaccaacuauuugauuacugugacguugauaacgacgguuucauuaauuaucucgaguuugcaaacuuccugaauuggaaagauaagaugcuuuugaaagaauacgaggaaagagugaucaucaagggcaggaaaccagacugcguaaacccgaccgaggccaaugucgaggaaccugagcagacgcugcucauuaagcccgaagauaucgugcugaaggaggcuggguccaccgagaaaacacuucgcacucuguugcgaccaucugacaagguuagcaacuauuacaaaaccacaucaagugagauuaaugccauagugggagcaauccccuccacuugcuauccuauuuguggcgucccaaccauccggagcgauauccccgcgccucguauuagaaggauaucugaccgcacaaacuacggugaggaagggucagcuuacagucuccuguauccgaccaucuuugcccggaagggcguguucgagagagacuuuuucaaaacuaggagcaaggaagagauugcagagaucuuaugcaauauuggaguaaagcuguccgaugaagaguuugaaaacguguggaaccuagccucuaaaaagcaccaucgaggcgagguuugugucgaaaauauccgcaacgugcucgacgagcugcggcacgcugauagaauaaaaugcaagacgcuuauguga

SEQ ID NO: 55634 - RNA, 1866 nt, Artificial Sequence
  derived and/or modified sequence opt3 from EFHC1__Homo_sapiens__NP_001165891
augcugaagaccgccuuccacagaagccagacacucuccuacaggaacggcuaugcuaucgugcggcgccccacugucgggauuggaggugaccgacuucaauuuaaucagcugucucaggcagaguuggaugaauuagccucaaaagcgccuguucugacguacggccagccaaagcaagcuccgcccgccgacuucauaccugcacauguggccuuugauaaaaagguacuaaaauucgacgcuuauuuucaggaggaugugccaaugaguaccgaggagcaguaccguaucagacaggucaacauuuauuacuaucucgaagacgauagcauguccgugaucgagcccguuguggaaaauucugggauucugcaaggaaaacuuaucaagaggcagcggcuggcaaagaacgaccgcggcgaucacuaccauuggaaggacuugaauagagguauaaacaucacaauuuacgggaaaacuuucagggucguggauugcgaccaguuuacccagguauuccucgaaucgcaaggaaucgagcugaauccuccagaaaagauggcccuggaucccuauacagagcuccggaaacagccuuuacgcaaguacguuaccccaucagacuuugaccagcugaagcaauuccuuacuuuugauaaacagguguugcgauucuaugcuauuugggacgauacagacagcauguacggcgaguguagaaccuauaucauacacuacuaucugauggaugacacggucgaaauuagggaggugcaugaacggaacgauggccgugacccguuuccccuacucaugaaucgccagagagugccuaagguccugguugagaacgccaaaaauuucccacagugcgugcuugaaaucagugaucaagagguacuggagugguacacugcgaaggacuucauuguggggaaauccuugaccauccucggaaggacauuuuucaucuacgauugugaccccuuuacucggcgauauuacaaggaaaaauucgguauuaccgaccugccucgcauagaugucucuaagagagagccacccccggugaagcaggaauuaccucccuauaacggcuuugggcugguugaggacagcgcacagaauugcuucgcccucaucccaaaagcuccuaagaaagaugugauuaagaugcuugucaacgacaauaaagugcugagguacuuggccguacuagaaucccccaucccagaggauaaggaccggcgcuuuguuuucucauauuuucuggcaacagauaugauaaguauuuucgagcccccugugagaaacagcggaaucaucggcgguaaguaccucgggaggaccaaagucgugaagccauauucuacggucgacaacccgguguacuacggacccuccgacuuuuucauuggcgcuguuaucgaaguguuuggccaccguuucauuauacuggauacugaugaguauguacuuaaauacauggaaucaaaugccgcgcaguauagcccugaggcccuggcaaguauccaaaaccacguccggaagcgagaagcuccagcccccgaggcugagucuaaacagacagaaaaggacccuggggugcaggaguuggaagcccucauugauaccauccagaagcaacugaaagaccauuccuguaaggacaauaucagagaggcauuccagauuuacgauaaagaggccagcggauauguugacagggauauguuuuucaagauaugcgaaucguuaaacgugccagucgacgauucucuggugaaagagcuaauccgcauguguucccacggugaaggcaagauuaauuacuauaacuuuguacgggcuuucucaaauuga

SEQ ID NO: 55635 - RNA, 2250 nt, Artificial Sequence
  derived and/or modified sequence opt3 from EFHC2__Homo_sapiens__NP_079460
auggcccugccccuccuuccuggcaacagcuucaauagaaacguggggaaggagaaauuucacaagucccagcauuggggauucugcaauaacgucaugaugcugguuucugacgaaaaaccagguaucggcggggagccguuguuaggacaaaagauuaaacccaaguguucaauauacccuaagggcgaugguagugacgugccaagcuggguagcuuuugauaaacaggugcuguccuucgacgcauaucuagaagaggaaguccucgauaagucucagaccaauuacaggauccgguauuacaaaauuuauuuuuaccccgaggacgauacaauccaggugaacgagccugaaguuaaaaauucggggcugcuucaaggaacuucaauucgccgacaccguaucacgcugccacccccugacgaggaucaguucuauaccguguaccauuuuaacgucggcacagaagugguauucuacggcagaacuuuuaaaauauaugacugcgaugccuucaccaggaauuucuugcggaagaucgggguuaaggugaacccaccgguccagugucccgaggacccuuacaugaaaauucgcagagaggugguggaacacgucgagccacucaggcccuaugaaagccuggauacacugaagcaguuccuccaauaccauggaaaaaucuuaugcuuuuucugucugugggacgacaguguuuccauguucggugaucggcgcgagcuuauuuugcacuauuuucugugcgacgauaccaucgaaauaaaggagcuacucccucacucuagcggccgagacgcgcugaaaauguuccuuagaagguccaagcugccaaagaauugucccccgcggguguaccagccugggcagauuacugaucgugcuguauugaacucauauggagacuuuaucaagaaucaggccgauggcuaccucuucgaccgcuacaagcuggguaaaguggaucaagaguuuuauaaggacagugauuuaagccugggggucacaauuaacguguggggaagaaaaguucuccuuuacgacugcgacgaguucaccaagucuuauuacaaauccaaguauggcaucgaaaauuuuacgucagugagcuguaagcccccaaguccucccccaaaaaucgaaaggaaguuucccccuuacaacggcuuugggucugaggaagauucccugcggaacugcauugacuugaaaccaacuccgcaucgacgcaauuucaagaaauuuauggagaaggauagcuauggaucgaagucuaacauacuaagauucuuugcaaaacuggucaccgacaaguguguggaucucgacaggauguucguaaucuccuacuaccugggugaugacacaauuucaguuuucgagcccaucgaacggaauaguggcauagccgggggaauguuucuuaaacgcagcagagugaagaaaccuggccaggaggucuucaaguccgaacugucugaguauauuaaggcugaagaguuguacaucggugugacugucaacgugaauggguaucucuuuaggcuguuaaacgcagaugaguacacccugaauuauauggaacagaacacagacaaauacccauucagcaaucuaaagcucgcccugcaaaaacuuaagcaggaggaaggcaaaucacgugaguugaagcagguuuuuaaagcugccgauaguaagcacaccaacaugguggacuauaauacguuccgggauauccugaugucccucacuguaggaaaccuggcggagcaggaauuugucacaauugcacgacauuacagagugcccgaggggaccugcagcgacauggacuuccuuaucgcccuggcucacgaaaaguuuaaaaagaauauguucgagaacuuugauacuuucauuuacucuugcguuuaugaagacagggagaaaaagaauguguugccuacaaaagauauaaagcgccucuguaagucaagucggcugccauuaagcgacgaucugcuagagucccuccugucuagauuugaagacucggagaaacaaaucgauuacaagagcuucuucuccgcccuuaacuggaggaaaaaccccgucccggaauugcagccugcaucauaucugaaggagcgcugcgaagacguguggcucggcaugccaagucccauuccugcuaaauacaucgauuauuggaccuuucugaaggacgccuucggauuagaggaggaauga

SEQ ID NO: 55636 - RNA, 432 nt, Artificial Sequence
  derived and/or modified sequence opt3 from EFHD1__Homo_sapiens__NP_001230181
augggcgagcugcaguacgacgccgggagagauggauucaucgaccucauggaacuuaagcugaugauggagaaauugggugcuccccaaacccacuuaggccuaaagagcaugauuaaagaaguggaugaggacuuugaugggaagcuguccuucagggaauuucuccugauauuccauaaagcagccgcgggagagcuucaggaggacucuggccugauggcuuuggccaagcucucagaaaucgaugucgcacuggaggguguuaagggggccaaaaacuuuuucgaagcuaaggugcaggcacugaguagcgccuccaaauuugaggcugagcucaaggccgaacaggacgagcggaaacgcgaagaggaggaacgacguuuaagacaagcggcauuccagaagcugaaggccaauuuuaacacauga

SEQ ID NO: 55637 - RNA, 618 nt, Artificial Sequence
  derived and/or modified sequence opt3 from EFNA1__Homo_sapiens__NP_004419
auggaguuccugugggcuccccuccuuggccugugcuguagcuuggccgcagccgacagacacaccguguuuuggaacuccucuaauccuaaguucaggaacgaagauuacacaauccauguccaguuaaaugacuauguugauauuauaugcccacacuacgaggaccauucaguggcggaugcugccauggaacaauauauccuguaccuaguagagcacgaagaguaucagcucugucagccgcagaguaaagaccaagugcgguggcagugcaaccgccccagcgcaaagcaugggccugagaaacuguccgaaaaguuucagcgauucacuccauuuacgcuuggaaaagaguucaaggaaggucacucuuacuauuacauuucgaagcccauccaccagcaugaggaucguugucugagauugaaagucaccgugucaggcaagauuacacacagcccucaagcccaugacaauccacaggagaaaaggcucgcugcagaugaccccgaaguucgggugcugcacaguaucgggcacuccgccgcuccucgccuguuuccacucgccuggacugucuuacugcuuccguugcugcuacuccagacccccuga

SEQ ID NO: 55638 - RNA, 642 nt, Artificial Sequence
  derived and/or modified sequence opt3 from EFNA2__Homo_sapiens__NP_001396
auggcccccgcucagagaccucugcucccacuucuguuguuacugcuaccgcugcccccuccacccuucgcaagggccgaggacgcggcucgggccaacagcgaucgcuacgcaguguauuggaaucgauccaacccucguuuucacgccggcgcuggggacgauggagguggcuacaccgucgaaguuucuaucaaugacuaucucgauauuuacugcccacauuauggggcaccccuuccuccagccgagagaauggaacacuacgugcuguauaugguaaacggagagggccaugcuucaugugaccacaggcaacgggguuucaagcgcugggaaugcaauagaccggccgcgcccgggggaccuuugaaauuuagugagaaguuccagcucuuuacaccauucagccugggcuuugaguucaggcccggccaugaauacuacuauauauccgcaacuccuccaaacgccguggaucggcccugucugcgccucaaagucuacgugcgaccgacgaaugagaccuuauaugaagcuccugagcccaucuuuacaucuaacaauucgugcucaagcccagggggauguagacuguuccuuaguacuauuccuguuuuguggacccugcuagguuccuga

SEQ ID NO: 55639 - RNA, 717 nt, Artificial Sequence
  derived and/or modified sequence opt3 from EFNA3__Homo_sapiens__NP_004943
auggccgcugcaccccugcuccuucuguuguuacuggugccugucccacuacucccgcugcuugcccagggccccgggggagcgcuggguaacagacacgcuguuuacuggaauagcuccaaccaacauuugaggcgggagggcuauaccgugcagguaaaugugaacgacuaccucgauaucuauugcccucacuacaauucuucaggggucggaccaggcgccggucccgggccuggaggcggcgcagaacaguaugugcuguacaugguuagucgcaacggguaucgaacauguaaugccagccagggauucaagcguugggagugcaacagaccacaugcuccccacuccccuauuaaauuuucugaaaaguuccaaagguacucggcauuuucacuggguuacgaguuccaugccggccacgaauauuacuauauaagcacuccaacgcacaaucuccauuggaaauguuuacggaugaagguguuugucugcugugcuaguaccucccacucuggggagaaaccggugcccacacugccucaguucacuaugggaccaaacguaaagaucaauguucuugaggacuuugaaggcgagaacccccaggugccuaaguuggagaaaagcauuuccgguaccucaccaaagcgcgaacaucugccccuagccgucgggaucgcguucuuucucaugacauuccuggcaaguuga

SEQ ID NO: 55640 - RNA, 606 nt, Artificial Sequence
  derived and/or modified sequence opt3 from EFNA4__Homo_sapiens__NP_005218
augagacugcucccccuucugaggaccguguugugggccgcuuucuuaggcagcccucugcgcgggggauccucucuacggcacgucguuuacuggaacucaaguaauccacgacuccugcguggugacgcagugguagagcuuggccugaacgauuauuuggacaucgugugcccgcauuacgaagggcccggaccuccagagggccccgaaacauuugcccucuauauggucgauuggccugguuacgagagcugucaggcggaagggccaagagcuuauaagaggugggugugcucccugcccuucggacacguucaauuuucugagaaaauucagcgguucacuccuuuuucgcugggcuucgaguuucucccaggcgaaacguacuauuacauaucagugccgacccccgagagcagugggcaguguuuacgccugcaggucuccgugugcuguaaggaaagaaaaucugagagcgcccauccuguaggauccccaggugagucaggcacaaguggguggaggggaggcgacacucccagcccucuuugcuugcugcuacuccugcuucuguugauccuccggcuguuacgcauucuguga

SEQ ID NO: 55641 - RNA, 687 nt, Artificial Sequence
  derived and/or modified sequence opt3 from EFNA5__Homo_sapiens__NP_001953
augcugcacguggagaugcucacccuugucuuccugguuuuguggaugugcguguuuagccaggaccccggcuccaaggccguagcugauagauacgcaguguauuggaacucuucaaauccuagguuccaacgcggggacuaccauaucgaugucuguauuaacgacuauuuagauguguuuugcccacacuacgaagacaguguuccggaggauaaaacagaacgguaugugcuguacauggucaauuucgacggauauagcgccugugaucauacuuccaaggguuuuaaacgaugggagugcaaccguccccacucuccuaauggcccacuaaaguucucggaaaaauuucagcuguucacgcccuuuucacugggguucgaguuuagaccuggaagggaguacuucuacauaagcagugcgaucccagacaacggccggcgcuccugucuuaagcugaagguguuuguaagacccaccaauucuugcaugaaaacaauugguguucaugauaggguguucgacgucaacgauaagguggaaaauagcuuggagccugcugacgacacugugcacgaauccgccgagccaucacgcggggagaacgcagcccagaccccgcggauccccagucgacuccuggcuauucuccucuucuuacuggcaaugcuuuugacacuguga

SEQ ID NO: 55642 - RNA, 1041 nt, Artificial Sequence
  derived and/or modified sequence opt3 from EFNB1__Homo_sapiens__NP_004420
auggccagacccggccagagguggcuggggaaguggcucguggcuauggucguuugggcacuuugccggcuggccaccccuuuggcgaaaaacuuagagccagugagcugguccucucugaauccgaaguuccuaucaggaaaaggucucguaaucuaccccaagauuggcgacaaacuggauauaaucuguccucgcgcugaagccgggcgaccauaugaguacuauaaacuuuaccuggugcgucccgaacaagcagccgcuugcaguacagucuuggacccuaacgugcucguuacuuguaauagaccagagcaggaaauuagguuuacgaucaaguuccaggaguuuagccccaacuauaugggacuggaguucaaaaagcaccaugauuacuauauuaccuccacaucuaauggcucgcuggaaggucucgagaaccgggaagggggagugugccgcacuagaaccaugaaaaucauaaugaaggucggccaggacccuaaugcagugacaccagagcaauuaaccacuucaaggccgagcaaagaggccgauaacacaguaaagauggcuacccaggcccccggcagucgggggucccugggagacucugaugguaagcacgaaacgguuaaucaggaggaaaagagcggcccuggggcguccggaggcucaaguggugacccagauggguuuuucaacagcaagguggcacuuuuugccgcugucggagccggcugugugaucuucuugcugauuaucauuuuucuaacugugcuccugcuuaaacugcgcaagcgacauagaaaacacacccagcaaagggcagcugccuugucucucuccacacuggcgucacccaagggcgggagcggaacugccgguaccgagccuagugacaucauaauuccauuacggacaaccgaaaauaacuacugcccccauuacgagaaagucucuggcgauuaugggcacccgguuuacaucgugcaggagaugccuccccaguccccagcaaauauuuauuacaagguauga

SEQ ID NO: 55643 - RNA, 1002 nt, Artificial Sequence
  derived and/or modified sequence opt3 from EFNB2__Homo_sapiens__NP_004084
auggccgugagaagggacagcgucuggaaguacugcuggggcguucugauggugcucugucggaccgcuaucuccaaaucuauuguacuugagcccauauauuggaacucaaguaauagcaaguuccugccugggcagggauugguguuauacccacaaaucggugauaaacuggacauuaucugcccgaaggucgauuccaaaacagugggccaguaugaauacuauaagguuuacaugguggacaaggaucaggcagaccgcuguacuauuaaaaaggagaacacgccccuacucaauugcgccaaaccugaucaggacaucaaguuuaccauaaaauuccaagaauuuucuccaaaccugugggggcuugaguuccagaagaauaaggauuauuacaucauuucgacaucaaacggaagccuggaaggcuuggacaaucaggaggguggggucugucagacucgagcgaugaaaauccucaugaaggugggacaagaugcuaguuccgccggcucuacccguaacaaagaccccacaagaaggccugagcuggaagcaggcaccaaugggcggagcuccacuacaucaccauuuguaaagcccaacccuggaaguagcaccgaugguaauucugccggccacuccgggaacaauauucugggaucagagguugcucucuucgcaggcaucgccagcgguugcauaauuuuuaucgugauuaucaucacguuagucgugcugcuuuugaaauaccgcagaaggcaucggaagcacaguccacagcauacuaccacacugucucuauccacucucgcuaccccgaaacgcagcgggaacaauaacggaucggaacccucugacauuauaaucccucugcgaacagccgacuccguguucuguccacacuaugagaaggucucaggcgauuacggccaucccguuuauauugugcaggagaugccuccacagagucccgcgaacaucuacuauaagguauga

SEQ ID NO: 55644 - RNA, 1023 nt, Artificial Sequence
  derived and/or modified sequence opt3 from EFNB3__Homo_sapiens__NP_001397
auggggcccccucacagcggcccaggaggugugagagucggcgcccugcuccuucuggggguuuugggauuaguguccggccugucucuagagccgguauacuggaacucagcuaauaagagguuccaggcagaagguggguaugugcucuacccccaaaucggagaccggcuggaucuucugugcccucgcgcccgaccacccggcccucauaguagcccaaacuaugaguuuuacaaauuguaucucgucggcggggcgcagggacguagaugugaagcucccccugccccaaaucugcuguuaaccugcgacaggccggaucucgaccugcgguucacaauuaaguuucaggaguacucccccaaccuuuggggucacgaguuccgcucucaucacgauuauuacauaaucgcaacuucggacggcacgagagaaggguuggagucacugcagggaggcgugugucuaaccagggguaugaaaguucuccugcggguggggcaaagcccucgcggaggcgccgucccacgaaagcccgugagugaaaugccuauggagagagauaggggcgcugcacauucccuugaaccagggaaagagaaucugcccggagacccgacaucuaacgccacuagccggggugcugagggcccuuugcccccaccuuccaugcccgccguagcgggggcagccggaggccucgcucuguuacugcucgguguugccggggcaggcggagcuaugugcuggcgucgcagaagggccaagccaucagaaagucggcaccccggcccugggagcuuuggacgagguggcucucuugggcugggaggcggugggggcaugggaccacgcgaggcggaaccgggcgaguuggggauugcccuaagaggagguggcgcagcugaucccccuuucuguccacacuacgaaaagguguccggggacuauggacaucccgucuacaucgugcaggauggcccuccacagucacccccgaauauuuauuacaaaguguga

SEQ ID NO: 55645 - RNA, 2466 nt, Artificial Sequence
  derived and/or modified sequence opt3 from EFR3A__Homo_sapiens__NP_055952
augcccaccagagugugcuguugcuguagcgcccugaggccucgguacaagcgccucgucgacaacaucuucccagaggauccgaaagacggccuuguuaagacagauauggaaaaacugacuuuuuaugcuguguccgcacccgagaaguuggaccgaauugggucuuacuuagccgaacgucugucaagagauguagugaggcaccggaguggauauguccuaauagcgauggaggcucucgaccagcugcuuauggccugccauagccaauccaucaaaccuuucguggaaucuuuucugcacaugguugcaaaguugcucgagucgggugagccaaagcuccaggugcugggcaccaauucauucgucaaauuugccaacauugaagaggauacgcccagcuaccaucgcagauaugacuucuuugugaguagguucuccgcuaugugucacucuugccauagcgauccugaaauccggacagagauucgcaucgcagggauacgaggaauccagggcguaguuagaaagacugugaaugacgagcugagggccaccauuugggaaccacagcacauggauaaaaucguccccuccuuacuguuuaacaugcaaaagauugaggaaguggacucacggaucgguccuccaaguagcccgucugcuacagauaaagaggaaaaucccgccgugcuugcggagaacuguuuccgugaguugcuggggcgcgcaaccuuuggaaauaugaacaaugccgucagaccuguuuucgcucaccuagaccaucacaagcucugggacccaaacgaauuugccgugcauugcuucaagauaauuauguacuccauccaggcacaguauucacaccacguaauucaggagauccugggccaucuugaugcuaggaaaaaggacgcccccagggugcgagcgggcaucauucaaguccuguuggaagccguggcaauagcugccaaagggagcaucggaccuacuguucucgagguguucaauacacuguuaaagcaucugcgccucagugucgaauuugaggcuaacgaucuucaggguggcucugugggguccguaaaucugaacaccagcucgaaagacaaugaugagaagauuguucagaacgccaucauacagacgauuggauucuuuggcucuaacuugccagacuaccaaagauccgaaaucaugauguucaucauggguaaagugcccgucuuugggacuucaacccacacacuagauauuagucagcugggagaccucggcacuaggcggauccagauuaugcugcuucgcagccuguugauggugaccuccggcuacaaggcaaagacaauagucaccgcccucccggggucuuuccuggauccuuuacugagccccucacuaauggaggacuaugaacucagacaacuggugcuugagguuaugcacaauuugauggauaggcaugacaaccgugcuaaacugcggggaauccgaauuaucccagacguggcggaucucaagaucaaaagagaaaagauuuguaggcaggacacgaguuuuaugaaaaagaauggucagcagcuguaccgccacauauaucuuggcugcaaggaggaggauaacguacagaaaaauuacgaacuguuguauacuucccucgcacugaucacaauugaguuagccaacgaagaggucgugaucgaccugauucggcuagcuaucgcccuccaagauagcgcaauaaucaaugaggacaaccugccuauguuccacagaugugggauuauggcccuuguugcugccuacuugaauuuugugucucagaugaucgcaguccccgcguucugccagcaugugucaaagguaauugaaaucaggaccauggaggcuccauauuuucugcccgaacacauauuccgcgauaaaugcaugcucccuaagagucuggagaaacaugaaaaggacuuauacuuucugacuaacaagauugccgagagccuuggaggcuccgguuacucuguggagcgauugucgguuccauaugucccgcaagugacagaugaagaccggcucagccguagaaaauccaucguggauaccgucucaauucagguugacauccugaguaauaacgugcccucugaugacgugguaagcaauacggaggaaauaaccuucgaggcacuaaagaaagccaucgacacauccgggauggaggaacaggagaaggaaaaacggcgccuggucauugagaaguuccagaaggcuccuuuugaagagaucgccgcacaaugugaaucaaaagcuaaccuccugcacgaucggcuugcccagauuuuggagcugacuaucagaccacccccuagcccaucuggcaccuuaacaauaacuuccggacacgcgcaguaccagagugugcccguuuaugagaugaaguucccggaccucugcguguacuga

SEQ ID NO: 55646 - RNA, 2454 nt, Artificial Sequence
  derived and/or modified sequence opt3 from EFR3B__Homo_sapiens__NP_055786
auguacggcgugugcggguguugcggagcccugagacccagguauaagcggcucgucgacaacaucuucccugaggauccagaagacggucuuguuaaaaccaauauggagaagcugacauuuuacgcuuugagcgcaccggaaaaauuagaucgcauuggcgccuaucuguccgagcgacuaauacgugacguggggagacacagguacggauauguauguaucgcgauggaagcucucgaucagcugcuuauggccugccauugucaaucuauuaaccuguucguggagucauuuuugaagauggucgcaaaacuccuggagagugaaaagcccaaucugcagauccucggcacuaacagcuucgugaaguuugccaauauugaggaagacacgccuuccuaccaccggucuuaugauuucuuuguuucgcgcuucucagagaugugccauagcagucacgacgauuuagagaucaaaaccaagauaagaauguccgguaucaaagggcugcagggaguggucaggaagacagugaacgacgaacuucaggcuaauauuugggauccacaacauauggacaaaaucguacccucuuugcuguuuaaccuacagcacguugaggaagcagagagccgguccccuucaccacuccaggcccccgaaaaggagaaggagaguccugcugaacuggccgagcgcugucuucgagaacuguugggcagagcggcauucggcaauauuaaaaacgccaucaagccagugcucauacaccuggauaaucauagcuuaugggagccgaaagucuuugcuauuaggugcuucaagaucauuauguacucuauccagccccaacacucccaucuggugauccagcagcuccuugggcaccuggacgccaacucacggagcgcagcuacugugcgugccggaauugucgaaguuuugagugaggcggccgugauagcagcuaccgguucuguaggcccuacagugcuagagauguuuaauacccugcuccgccagcugagacuuuccaucgacuacgcccugacugggagcuaugauggagcugucucguugggcacaaaaauuaucaaggaacacgaggaaaggauguuccaagaggccgugauaaaaaccguugguucuuucgcauccacgcucccaacuuaccagcggucagaagugauucuguuuaucaugaguaaggucccccgaccuagcuuacaucaggccguggacaccgggcgcacaggagagaacagaaauaggcugacucaaaucaugcuacucaagucccugcuucagguaucuaccggcuuccaguguaacaacaugaugagcgcuuugccaucaaauuuucuggaucggcuccugaguacagcgcuuauggaggacgcagaaauucgccuguucguuuuggagauccucauuuccuuuauagauagacacggcaacaggcauaaauucagcaccaucucuacgcugucagacauuaguguguuaaagcugaaagucgauaagugcagccgucaggacacuguguuuaugaaaaagcacucccaacagcuauaucggcauaucuaccucucuuguaaggaagagacaaauguccagaaacacuaugaggcccuguacgggcuuuuggcucugaucucgauugaacucgccaacgaggaagugguuguggaucugauacgauuaguacuggcaguccaggacguggcccaaguuaaugaggaaaaccuucccguguauaauagaugcgcuuuguacgcccucggagcagcguaccugaaccuaaucagccagcugaccacugucccggcuuucugccagcacauucaugaggugaucgagacaaggaagaaagaagccccuuauaugcuccccgaggauguauuuguggaacgcccacggcugucccagaaucuugacgguguugucauugaguugcuguucagacaaucaaagaucagugaaguguuaggcgggucuggauacaacagcgacaggcucugucugccuuauauaccccagcuuaccgaugaggaccgccuguccaaacgacggucaaucggcgagacgauuagccuccagguggaagucgagucucguaauuccccagaaaaggaggaaagaguucccgcagaggagaucaccuacgaaacauugaagaaagccauuguggauaguguggcuguagaggaacaggagagggagcgccggagacaagucguggaaaaguuucagaaagccccuuucgaggaaaucgcagcucacugcggugccagggcgagccugcuacagucuaagcugaaccaaauauuugagauuacuauccgaccaccgcccuccccuucagggaccauuacagccgcuuauggccagccacagaaucauaguauccccguuuacgaaaugaaauucccugaccucuguguguauuga

SEQ ID NO: 55647 - RNA, 1179 nt, Artificial Sequence
  derived and/or modified sequence opt3 from EFS__Homo_sapiens__NP_001264103
auggccaucgcuaccagcguguacgucguucccccuccagcaagaccgugccccacauccggcccuccagccgggcccuguccuccaucucccgaccugauuuauaagauaccuagggcgucaggaacucagcucgcugccccacgggaugcacuugagguguacgacguaccgcccacggcccugcgcgugccuaguagcgguccauaugauugccccgcuuccuucucucacccuuugacccgagucgcaccacaacccccgggcgaagacgaugccccucccucgccagagccucccggggcuuuagccucacaugaccaggauacacuggcgcagcuacucgcacguagcccacccccuccacacagaccgaggcugcccagugccgaaucccuuucucggcgcccucugccagcuuugcccgugccugaggccccaagccccuccccgguuccuucaccagcacccggaagaaaaggcaguauccaggacaggccuuuacccccaccucccccacggcugccggguuacgggggaccuaagguggaaggcgaucccgagggccgcgagauggaagacgauccagcugggcaucacaacgaguaugaagguauucccauggccgaggaguacgacuauguccaucugaaaggaauggauaaggcgcaaggcagccgaccuccagaccaggccuguacuggggaccccgaacucccugagagaggaaugccggcaccacaggaagcucucucucccggcgagccucuggugguauccaccggugaucuucaguugcuguacuuuuacgccgggcaaugccagucacacuauagcgcucuacaggccgcaguugccgcucucaugaguucuacacaggcgaaucaaccacccaggcuguucgugccucacuccaaacgggucgugguggcagcccaucgucuugucuuuguuggagacacccugggccgcuuggcugccagcgcaccgcucagagcccaggugagggcugccggcacugcacuggggcaggcguuacgggcuacaguacuggccgugaagggagcagcccucgguuaccccucgucuccagcuauccaagaaaugguccagugugugaccgagcuugccggccaggcacugcaguucacgacuuugcuaaccucccuggcuccuuga

SEQ ID NO: 55648 - RNA, 3210 nt, Artificial Sequence
  derived and/or modified sequence opt3 from EFTUD1__Homo_sapiens__NP_001035700
auggugcugaacagccucgacaagaugauccagcuucagaaaaauaccgccaacauuagaaauauaugcguccuggcucacguugaucauggcaacgaggaauacuugaucaauuuaauugacucccccgggcacguggauuucucuucagagguaaguacagcagugaggaucugugacggaugcauuaucgucguggaugccguugaagguguguguccucaaacucaggcgguccugcggcaggcuuggcuagagaacauacgcccagugcucguaaucaauaagauugaccgacugaucguugaacuuaaauuuacgccgcaagaggccuauagccaucugaagaacauuuuggagcagaucaaugcacucaccggcacacuguucacuuccaaagugcuggaggaacgugccgaaagagagaccgagucucaggucaaccccaauucggaacagggggagcaaguguacgauuggucaacaggacucgaagacaccgaugacagccacuuauauuuuaguccugagcagggcaacguggucuucacuuccgcuauagaugguuggggguuuggaauugaacauuucgcaaggaucuacucucagaagauuggcaucaagaaagagguucugaugaagacacuuuggggcgacuauuacaucaauaugaaagccaagaaaauuaugaagggggaucaggcuaaggggaaaaagccauuguuugugcaacugauacuagagaacaucuggagccucuaugacgccguacugaaaaaggacaaagauaagauugacaaaaucgugaccucccuuggucugaagauaggcgcgcgggaagcacgccacucagaucccaagguccagauuaaugccaucugcagucagugguugccuaucagccacgcugugcucgccaugguuugucaaaaacugccaucucccuuagacauuacggcagagagaguggaaaggcugaugugcacugggucccagaccuucgauucauuuccuccagagacacaggcucucaaggccgcguucaugaaauguggaagcgaagacacugccccggucaucauuuuugugaguaagauguucgcaguagaugcuaaagcccuuccccagaacaagccucggccacugacccaagaggagauagcucagcgccgagaaagagccaggcagcggcaugcagagaaguuggccgcugcgcagggccaagcaccccuagaaccuacacaggacgguucugccaucgagaccugcccaaaaggggaggaaccccguggagaugagcagcagguugaauccaugacgccgaagccugugcugcaagaggaaaacaaucaggagagcuuuauugcuuucgcccgcgucuucucgggcguggcaagaaggggcaaaaagaucuuuguccucgggcccaaauacucuccacuggaguuccuucggcgagugccucugggauuuuccgcucccccagacgguuugccccagguuccucacauggccuacugugcccucgaaaaccuguauuuacugaugggccgcgagcuagaauaccucgaggaagugccaccggggaauguacugggaaucggcggucuucaggauuucgucuugaagucagcaacucugugcagucuccccagcuguccuccauuuauuccccugaacuucgaggcgacaccuauagugagaguugcuguggagccaaagcaucccuccgaaaugccgcaacuugucaaagggaugaagcuguugaaucaggccgacccuugcgugcagauccucauucaagagaccggcgaacacguacuggugacugcaggagagguucacuuacagaggugccuggacgaucuaaaagaacgguuugccaagauccauauuucugucagcgagccaaucauacccuuccgcgagacaaucaccaaaccucccaagguggacauggugaacgaagagauuggcaagcagcagaaagucgcuguuauccaccaaaugaaggaagaucagucaaaaauuccagaggggauccagguggacagugauggacucauaacgauuaccacaccuaauaagcuggccacucuuuccgugagagcaaugcccuugccagaagagguaacccagauccuggaggaaaacagcgaccucauuaggucuauggagcaacugacaucaaguuuaaaugaaggugagaacacucauaugauccaccagaaaacccaggagaagauaugggaauuuaaaggcaagcuggagcagcaucuuacagggcgucgguggcgaaauaucgucgaucaaauuuggagcuucggaccgagaaaguguggcccuaacaucuuggugaauaaauccgaagacuuucagaacucuguuuggaccggucccgcugauaaggccucgaaagaggcgagcagguaucgcgaccucggaaauuccauugugucaggcuuccagcuggccacucuaaguggaccaaugugcgaggaaccccugaugggcgucuguuuugugcucgagaagugggaucugucuaaauucgaggaacaaggggcuagcgaccuugcaaaggaaggacaggaggaaaacgagacgugcuccgguggcaacgagaaucaggaauugcaggauggguguucagaggccuucgaaaagcggacaagccaaaaaggagagucuccucugaccgacugcuacggcccauuuuccggucaguuaaucgcuacuaugaaggaagccuguagauaugcacuccagguuaaaccccagaggcugauggcggccauguauaccugcgacauaauggcuacaggggaugugcuuggccgcguauacgccguccugaguaagcgagagggacggguguugcaagaggaaaugaaagagggcaccgacauguucauuaucaaggcagugcucccugucgcugagagcuuuggguucgccgaugaaauccguaagagaacuucuggacuggcauccccgcagcuaguguuuucacacugggagauuaucccaagugaccccuucuggguuccuacaacggaagaggaauaccugcacuuuggcgagaaagccgauagcgaaaaccaggcuaggaaguacaugaaugcgguacgcaaacggaagggucucuauguggaggagaaaauugucgaacaugccgagaagcagagaacccugucgaagaacaaauga

SEQ ID NO: 55649 - RNA, 2814 nt, Artificial Sequence
  derived and/or modified sequence opt3 from EFTUD2__Homo_sapiens__NP_001136077
auggacgaugacgaugacgaugacgaugugggcgaccacgaugacgaucaucccgggauggaggucguucugcacgaagacaagaaauacuauccuaccgccgaggaaguguacggaccagagguagaaacaaucgugcaggaggaggauacucaaccgcucacggaacccauuauaaagccugucaaaaccaagaaauucacacuuauggagcagacucugccagugaccguuuaugaaauggacuuuuuggcugacuuaauggauaacagcgagcugaucagaaaugugacacuaugcggucaucuccaccauggcaagaccuguuucgucgacugccugauugagcagacucaccccgaaaucaggaagcgguacgaucaggaccuuuguuauacagauauucuguuuaccgagcaagaacgcggggugggaaucaaauccacgccuguaacuguuguguugccagacaccaagggcaaaucuuaccucuucaacauaauggauacacccggucacgucaauuuuucagacgaggugacugcagggcugcgaaucagugauggagugguccuguucauugacgccgcggaaggcguuaugcucaacaccgagcguuuaaucaagcaugcugugcaggagagacuggccguaacagugugcauuaauaaaaucgauaggcuuauauuggaacugaagcuaccuccaaccgacgcauauuacaagcuccggcacauugucgacgaggugaacggccugaucagcauguacuccacggaugaaaaucuuauucugucuccguugcucgggaacguuuguuuuucgucaagccaguauaguaucugcuucacucugggauccuuugccaaaaucuacgcugacacauucggugauauuaauuaucaggaguuugcaaagcgcuuauggggcgacauauacuucaaccccaaaaccagaaaguuuacuaaaaaggccccuacaucuagcucccaaaggucauucguggaguucauccuggagccacucuauaaaauucuugcucaggucgugggggauguagacaccagucugccccggacguuggaugagcuaggaauccaucugaccaaggaagaacucaagcugaauauacgcccucuucugcgauugguuuguaaaaaguuuuucggcgaauuuacagguuucguggacaugugcguccagcacauuccaagccccaaagugggggccaagccgaaaaucgagcacacuuacaccggaggcgucgauucugaccucggcgaagcgauguccgauugugacccugaugggccccugaugugccauacaacuaagauguauucaaccgacgacggagugcaguuucacgcauucgguagaguuuuaagcggcacaauccaugccgggcaaccagugaagguacugggagagaacuacacccuagaggaugaagaggacagucagauuuguacugucggcaggcucuggaucucuguggcucgguaccacauugaaguuaaucgugugccugccgguaacuggguccugauagaggggguggaucagcccaucguaaaaacggcaacaauuaccgagccacgcggcaaugaagaggcucaaaucuuuagaccccuuaaguucaacacuaccuccgugaucaaaauugccguugaaccugucaacccaagcgaguugccgaagaugcuggacggacucaggaaagugaauaagucguaucccucucugacaaccaagguggaagaguccggcgagcaugucauacuugggacuggagaacuguacuuggauugcguuaugcacgaccuccggaaaauguauucagagaucgauauuaagguggcggacccugugguaacauuuugcgaaacggucguggagaccaguagccugaaauguuucgccgaaacuccaaacaagaaaaauaagaucacaaugauugcagagcccuuagagaagggucuggcugaagauaucgagaacgaaguugugcagauaaccuggaaucgcaaaaagcuaggcgaguuuuuccagacaaaauacgacugggaucuccuggccgcucgauccaucugggccuuugggccugacgcaacuggaccaaacauucuugucgaugacaccuugcccucugaaguggacaaggcccugcucggcagcguuaaagauucaaucgugcaggguuuccaaugggggacgagagagggcccgcugugcgacgaguuaauuaggaauguaaaguucaaaauccuggaugcugucguggcgcaggaaccucuucaccggggaggcgggcagauaauuccaaccgcacgcagaguggucuauagugccuuuuugauggcuacacccaggcucauggagccuuacuauuucguugaagugcaggcccccgcagacuguguauccgccguguacacuguccuggcucgucggcgaggacaugugacccaagaugccccaaucccugguagcccccuauacacaauuaaggcauuuaucccagcgauagacucuuucggcuuugagacugaucugagaacccacacgcaggggcaggcuuucucacucaguguuuuucaucacuggcagaucgugccgggagacccucuggauaagagcauugucaucaggccccuugagccacaacccgccccucacuuggcacgcgaguucaugauuaaaacacggagaaggaagggccuguccgaagacgugucuaucucgaaauuuuucgaugacccaauguuacucgaacuggccaagcaggacguugugcuuaacuaucccauguga

SEQ ID NO: 55650 - RNA, 3501 nt, Artificial Sequence
  derived and/or modified sequence opt3 from EGF__Homo_sapiens__NP_001171601
augcugcucacccuuaucauucuguugcccguggucagcaaguucuccuuuguuucuuuaucagccccucagcacuggaguugcccagagggcacacuggcugggaacggaaauagcacuuguguggguccggcacccuuccuaauauuuucccauggcaacucuaucuucagaauugacacggaagggaccaauuacgagcaacucguaguggaugccggagucucggugaucauggacuuucacuauaacgaaaagaggauuuacuggguugaucuggagcggcagcuucugcagcgcguguucuugaauggcucacgacaggaacgugucugcaacaucgagaagaaugugagcgguauggcgauaaacuggaucaaugaggaaguaauuuggaguaaccaacaggaggggaucauuacaguuacugacaugaaaggaaauaacucccauauccuccugucugcucugaaguauccugccaauguggcagucgauccaguggaaagauuuauauucuggagcuccgagguggccggcucacucuacagggcugacuuagauggcgucgggguuaaagcacugcuugagaccagugaaaagauuacagccgugagcuuggacguacuggauaagcggcuauuuuggauccaguauaaccgcgagggaucuaauucccucauuuguucaugcgacuacgaugguggcagcgugcacaucaguaaacaucccacccagcacaaccuguucgcuaugucucuuuuuggggacagaaucuucuauuccacuuggaagaugaaaacaauuuggauagccaacaagcacaccggaaaagauauggucaggaucaaucugcauagcucguuugugccuuugggcgaacucaagguugugcacccacuggcgcaacccaaggcagaggacgacacgugggaaccugagcagaaauuauguaagcugcggaaagguaacugcucauccacugucugugggcaggaucuccagucacaucuuugcaugugugccgagggauacgcucugagucgcgaccgaaaguacugcgaagaugugaaugagugugccuucuggaaccacggcugcaccuugggcugcaaaaauacaccagggagcuauuacuguacuugcccgguaggauucguucuacugcccgacgguaagagaugucaccaacucguguccugcccuaggaacgucucugaauguagccaugauugcgugcugaccucagagggcccacuuuguuuuugccccgaagggaguguccuggagcgggacggaaaaacauguuccggcugcagcucuccugauaaugguggguguucacaguugugcgugccacucagucccguuagcugggagugcgacuguuucccgggcuaugaucugcaguuagacgaaaaguccugcgcagcuucuggaccucaacccuuucugcuauucgccaacucgcaggauauucgucacaugcauuuugacggcaccgacuacgggacgcuccugagccagcagaugggaaugguguaugcgcuugaucacgacccaguagagaauaagaucuacuucgcccauacugcauugaaauggauagaacgcgcuaacauggaugguucccaaagagagaggcugauugaagagggcgucgacgugccugaggggcucgccguugauuggaucggacggcgauuuuauuggacagaccgcggcaagucacugaucgguagaagugaucuuaaugggaaaaggucuaagauuaucaccaaagaaaacauuagccagccccggggcauagcugugcacccaauggccaagcgccuguucuggacugacacaggaaucaaucccagaauugaguccucuagcuugcagggccucgggaggcuggucaucgcaucuuccgauuuaaucuggccuaguggaauuaccauagacuuucugacggauaagcuauacuggugugacgccaaacagagcgugaucgaaauggcuaaccucgaugguucuaagcgucggcgacugacccaaaaugacguaggccacccauucgcgguggcaguuuuugaggacuacgucugguucuccgauugggccaugccgucagugaugagagugaacaaaaggacagggaaggaccgcguccggcuucagggaaguauguugaaacccagcucgcugguuguggugcauccucucgcuaagccaggcgccgaucccugccuguaucagaacggugggugugagcacauuugcaagaaaagauuaggcacugcaugguguuccugcagggaaggauuuaugaaggccucugacggcaaaaccugucuggcucuugaugggcaucaguugcucgccggaggcgagguagaccugaagaaucaagucacaccucuagauauccugagcaaaacucgcgugucagaagacaacauuaccgagagucagcacaugcucguugcagaaaucaugguguccgaucaggacgauugcgcgccagucgguuguucuauguacgcucgaugcauaagcgagggggaggacgccacaugccagugucugaagggauucgcaggcgaugguaaacuuugcuccgacaucgacgaaugugagaugggcgugcccguuugcccgccugccucaagcaaauguauuaauaccgaagggggauaugugugccgguguagugagggcuaccaaggggauggaauccacugcuuggacucuacuccacccccucaucugcgugaagaugaccaccauuauuccguaagaaacagcgauucggagugucccuuaucacacgacggcuacugccuccaugauggugucuguauguauauugaggcucuggacaaguacgccugcaauugcguggugggguacaucggagaaaggugucaguaucgcgaucuuaaauggugggagcugcggcacgcaggccacggucagcaacagaaggucauaguuguggcuguaugcguggucguguugguuaugcuccugcuacugucucucuggggcgcccauuacuauagaacgcagaaacugcuuaguaagaacccuaaaaauccauacgaagaguccagcagggacgugcgaucucgccggcccgcggauacagaagacgggaugagcuccuguccacagccgugguucgucgugauuaaggagcaccaagacuugaagaacggaggccagccuguugccggggaggauggacaggcugcagacggcucaaugcagcccaccaguuggagacaagaaccacagcugugcgguauggggacugagcagggauguuggauccccgugagcucugauaaaggcuccugcccucaggucauggaaaggucauuucauaugccaaguuaugguacccaaacauuagagggcgggguagagaagccccacagccuccuguccgccaauccucuuuggcagcagcgugcucuggacccgccacaucaaauggaacuaacccaguga

SEQ ID NO: 55651 - RNA, 1665 nt, Artificial Sequence
  derived and/or modified sequence opt3 from EGFL6__Homo_sapiens__NP_001161362
augccccugccuuggagccucgcccuuccacuguuguuauccuggguggcuggcggguucggaaacgcagccucugcgagacaccauggucugcuagcuucagccaggcagccgggcgucugccacuacgggaccaagcucgcauguugcuauggauggcggcgcaauaguaaaggcguuugugaggccacaugcgaacccgguuguaaguuuggggagugcgugggaccuaacaaaugucgaugcuucccaggcuacacuggcaagacguguagccaagacguaaaugaaugcgggaugaaaccccguccuugucagcauagaugcgugaacacccacggauccuauaagugcuuuugucugucuggucauaugcuuaugccagaugcuacaugcgucaauucgaggacuugugcaaugaucaacugccaguacucaugugaggacaccgaagagggcccccagugccuguguccuagcaguggguugcggcucgccccaaauggacgcgauugccuggacauugaugagugugcuuccggcaaggugauaugcccguauaacagaagguguguuaauacauucgguucuuacuauugcaaaugccacaucggguuugaacugcaauacauuagcggacgguacgacuguaucgauauuaacgagugcaccauggacucccacacuuguucacaucacgccaauugcuucaacacacagggcaguuuuaaguguaaaugcaagcagggcuauaaagggaauggacuccgcuguagcgcgauccccgaaaacucugugaaggaggucuuacgagcaccugguaccauaaaggauagaaucaaaaagcugcuugcccauaaaaauuccaugaagaaaaaggcuaaaauuaagaacgugacgccagagcccacuaggaccccuacaccaaagguaaacuugcagcccuucaauuacgaagagaucguuucacggggcgggaacagccacggaggcaaaaaggguaaugaagagaaaaugaaggaagggcuggaggacgagaaacgugaagagaaggcccuaaagaacgauauugaggaacgcagucucagaggcgacguguuuuucccgaaagucaaugaagcaggagaguuuggccugauccuugugcaaaggaaggcucugacuucuaaauuggagcacaaggccgaucucaacauauccguggacugcagcuucaaucaugggauuugugacuggaaacaggaucgggaagacgauuuugacuggaacccugcggaucgagacaaugccaucggauucuauauggcaguccccgcucuggccggucacaagaaggauauuggccgcuuaaaacugcuccuuccagaccugcagccucagucgaacuucugcuugcuauuugauuacagacuggcuggggacaagguuggaaaacucaggguguucguaaagaacucuaauaaugcccuggcaugggagaaaaccacauccgaagaugagaaguggaagaccggcaaaauccaacuuuaucaggguacggacgccacuaagucaaucauuuuugaagcugagcgggggaaaggcaagacaggagagauagcgguggacggcguccuguuggugagugggcucugucccgauagccuguuauccguugacgauuga

SEQ ID NO: 55652 - RNA, 822 nt, Artificial Sequence
  derived and/or modified sequence opt3 from EGFL7__Homo_sapiens__XP_011517068
augagaggcagccaggaggugcugcucauguggcuucuggucuuggccguugggggaaccgaacacgcuuacaggcccggucggcgcgugugcgcaguacgagcccauggcgacccuguguccgagucuuucguccaacguguguaucagccauuuuuaacaacuugugaugggcacagagcgugcucaacguacaggaccaucuaucggacagcuuaccgcagaaguccgggacuggcccccgcaaggccucgguaugccuguugcccaggcuggaagcgcacuagcggucuacccggggcuuguggagcagccauuugccagccuccaugucgaaacggcggcuccugcguucagcccgggagauguaggugcccugcuggauggcggggugacaccugucaaucugauguggacgaaugcucggcccgucgcggcgggugcccacagagaugugucaauacagcgggaucauacuggugccaguguugggagggccauagccucagugcagaugguacccugugcgugccgaaagggggacccccuaggguagccccaaaccccacuggcguugacuccgcuaugaaggaagaggugcagcggcuucaaucucgagucgaucuguuggaggaaaaacuccagcuggugcuggccccucuccacagcuuagcaucccaggcucuggagcauggccuuccagaccccgggucauugcuggugcacaguuuccagcaacuaggacgcauagauagccucucugaacagaucuccuuucuggaggagcagcuugguucauguagcugcaagaaagacaguuga

SEQ ID NO: 55653 - RNA, 882 nt, Artificial Sequence
  derived and/or modified sequence opt3 from EGFL8__Homo_sapiens__NP_085155
augggcagcagagccgagcugugcacccuccuugggggauucuccuuucuguuguuacugauccccggugaaggcgcuaaagggggaucucuaagggagucacagggcguguguaguaagcaaacacucgucguuccucugcacuacaacgaaagcuauucccagccaguguacaagccguaucuuacucugugcgcaggucggcgcauuuguucuacguaccgaaccauguaucguguaauguggagagaggugaggcgggaaguccagcagacacaugccgugugcugucaaggguggaaaaagcgccaccccggagcguugacuugcgaggcuauaugugccaaaccuugccucaauggcggcguuugugugagaccagaccagugcgagugugcacccggguggggagguaagcauugccacgucgauguggacgaaugcaggaccucgaucacacuguguucacaucacugcuucaacaccgccggcagcuuuacuugugggugcccucacgaucugguacucggaguugacggccggacauguauggaggguaguccagaacccccuaccuccgcuucuauuuuaagcguggcaguccgcgaggccgagaaggaugaacgagcucugaaacaggagauccaugaacuuagagggagguuggagcggcuggaacagugggccggacaagcgggcgcaugggugcgugccgugcuaccagucccgcccgaggagcuccagccugaacagguugcugagcuguggggccgcggggacagaauugaaucccuuucagaucaggugcuguugcucgaggaaaggcugggagccugcaguugugaggacaauagcuuaggucugggcguaaaccaccgguga

SEQ ID NO: 55654 - RNA, 3054 nt, Artificial Sequence
  derived and/or modified sequence opt3 from EGFLAM__Homo_sapiens__NP_001192230
auggaccugaucagaggcgugcuccuuaggcuguuguuacuggccagcucccuagggcccggagcugucucucuccgggcagccauucgcaagccugguaaaguuggcccaccgcuggauauaaaacuuggggcgcugaacugcaccgcuuucucaauccaguggaagaugccccgacacccuggaaguccaauuuugggcuacacaguguuuuauagcgagguaggugccgacaagucccuccaagaacagcugcauucugugccccugucgcgugauaucccuacuacggaggaagucauuggggaccucaaaccaggaaccgaguacagagugucaaucgcagccuauagccaggcuggcaagggcagguuaaguucccccagacacguuacaacucugucucaggauagcugucuuccuccagcagccccgcaacagccccaugugauagucguguccgacucagaaguagcuuugaguuggaagccuggggccagcgagggaucugcgccaauccaguacuauuccguugaguucauucgccccgauuuugacaaaaaguggaccucaauccacgaacggauucagauggauagcauggugaucaaaggucuggacccugauacaaauuaccaauucgcagucagggccaugaacagucauggcccaucuccccgguccuggccgagcgacauaauucgcacccuaugcccugaggaagcugggucgggacgauauggccccagauacaucacugauaugggugccggggaggacgacgagggauuugaagaugaccucgaucuggacauuucuuucgaggaagugaagccacuuccugcaacaaaaggcggcaauaagaaguuucugguggaguccaaaaagaugucaaucaguaaccccaaaaccaucagcagguugauuccacccacguccgcuucucucccugucacuaccguugccccacagccgauacccauccagcggaaggggaaaaauggaguggcgauuaugagccgucuguucgauaugccuugugacgaaacauuaugcucagccgauaguuuuuguguaaacgacuacacuugggguggcucccgcugccaguguacccuggggaagggaggcgagagcugcucugaggauaucgugauacaauauccacaguucuuuggucacucauacgucacauucgaaccccucaaaaauaguuaucaggcauuucaaauuacccuugaguucagagcugaagccgaggacgggcuguugcuauacuguggcgaaaacgagcacggaaggggcgauuucaugagccuggcuaucauccggcgaucccuccaguuucgcuucaauugcgggacgggaguggccauuaucguuucugagacuaagauuaagcuggguggcuggcauacagugaugcuuuauagagacgggcugaacggauugcuccagcugaauaacggcaccccugucacuggucagucgcaagggcaguacagcaaaauaacauuuaggaccccauuauaucugggcggagcacccuccgccuacuggcuagugcgggcuacgggcaccaaucgcggguuccagggauguguacagucacucgcgguuaacgguagaaggaucgacaugcguccguggccucugggcaaggcacuuaguggggccgaugugggagaaugcucuagcggcauuugcgacgaggcuuccuguauccacggugggacaugcacugccaucaaagcagauucauacauuuguuugugcccacugggcuuuaagggacggcauugugaagacgccuucacccucacaauaccccaauuucgagagagccugagaucuuaugcugccacuccuuggccccuugaaccacagcacuaccuguccuucauggaguuugagaucaccuucaggccugauaguggcgacggggucuugcucuauagcuacgauacaggaucuaaagacuuucuguccauuaauuuagcaggcggucacguggaguuccgcuuugauugcgggucaggaaccggcguccugcggagugaagacccccuaacucucgguaacuggcaugaacugagagugagcaggacggcgaagaacggcauccuucagguugauaagcagaaaauuguggaggggauggcugagggaggcuucacacaaaucaaguguaauaccgacauauucaucgggggaguaccaaacuaugaugacgucaaaaagaacucgggcguguugaaaccguuuuccgguucuauucagaagaucauucugaaugaccgcacuauccacguuaagcaugauuucaccagcggggugaaugucgaaaacgccgcacacccuugcgugcgagcccccugugcucauggaggcucaugccggccacguaaagaggguuacgacugugauugcccccucggcuuugaagggcugcacugccagaaggaguguggaaauuauugcuuaaacacaauaauugaagccaucgagauuccucaguucaucggcagaaguuaccugaccuacgacaauccagauauacuuaaaaggguauccgggucucgcagcaacguguuuaugcgguucaagacuacagcaaaagacggauugcuccuguggagaggcgauucccccaugaggccuaauucagacuuuaucagccuaggucugcgagauggggcucucguuuucaguuauaaccugggaucuggcgucgccuccauuauggugaaugguagcuuuaacgacggccgcuggcaccgggugaaggcggucagagaugggcaaucgggaaagaucacgguugacgauuacggcgccaggaccgggaaaucaccgggaaugaugcgucagcuuaauauuaacggcgcuuuguaugugggugggaugaaggagaucgcacugcauacuaaccgccaguacaugcggggauuagugggcuguauaucucacuucacacucaguaccgacuaucauauuucccugguagaagacgccgucgauggcaaaaauaucaacacaugcggggcuaaguga

SEQ ID NO: 55655 - RNA, 3633 nt, Artificial Sequence
  derived and/or modified sequence opt3 from EGFR__Homo_sapiens__NP_005219
augagacccagcggcaccgccggggcugcacugcucgcccuucuggcggcuuugugcccugccuccagggcauuagaggaaaagaaagugugucagggaacaucuaacaagcugacucaacuagguacguucgaggaccacuuucucucacugcagcggauguucaauaacugcgaagucguucuuggcaaucuggagaucaccuacgugcagcgcaacuaugauuugaguuuucucaaaacaauucaggaaguagccggguacgugcugauagcucugaauacugucgagcgaaucccacucgagaacuuacaaauuauccguggaaauauguauuacgaaaacagcuaugcacuggccgugcuuuccaauuacgacgcuaacaagaccggcuugaaagagcugccgaugagaaaucuacaggaaauucuccauggugccguuagguucucuaacaaucccgcgcuguguaacguggagucgauccaguggcgggauauagucucaagcgacuuucuuaguaauauguccauggauuuccagaaccaccuggggucuugccaaaagugugacccuagcugcccaaacggauccuguuggggcgcaggcgaggaaaauugccagaaguugacaaaaaucauuugugcccagcagugcucagggcgcuguagaggaaagagucccagcgauugcugccauaaccaaugugcugccgguugcaccggcccuagggagucugacugucucgugugccggaaauuucgcgaugaagcaacuuguaaggacacaugcccaccccugauguuauauaauccuaccacguaccagauggauguaaacccagaggggaaauacuccuucggagcuacuuguguuaagaagugcccgcgaaauuauguggucaccgaccacggcucaugugugagagccugcggugcggauagcuacgaaauggaggaggacggggugaggaaauguaagaaaugcgaaggacccugccggaaggucuguaacggcaucggcauuggggaguuuaaagacagucugucuaucaaugccacaaacauaaagcauuucaaaaauugcacuuccauuagcggagaucuccacauccuuccuguugcauuucguggugacucguucacccacacaccaccccuggauccucaggaauuggacauucuaaagaccgugaaggagaucacgggcuuucugcucauccaggcuuggccagaaaaccgcacugaucugcaugccuucgagaaucuugagauuauaagagggaggacaaaacaacacggacaguucucucuggcuguaguguccuugaacaucaccucacucggccugcggaguuuaaaggaaauuagcgacggugaugucaucauauccgggaauaaaaaccuguguuaugccaauacuauuaacuggaagaaacuauuuggcacaucuggacagaagaccaagaucaucagcaaccgaggcgaaaauucaugcaaagcaacggggcaagugugucaugcccucugcagucccgaaggauguugggguccggagccucgcgacugcguuuccuguagaaacgugagcaggggccgggaaugcgucgauaaguguaaucugcuugagggggagccccgcgaguucguggagaacucugaaugcauucagugccacccagaguguuugccucaggcuaugaauauuaccugcacaggaagaggccccgacaacuguauucagugcgcgcacuacauagaugguccacauuguguaaaaacuugccccgcagggguuaugggcgagaauaacacccugguguggaaguaugccgacgcuggacacgucugucaucucugccacccuaauuguacauacggcugcacugggccaggacuggaagguuguccgaccaacggccccaaaaucccuucaauugccacagggauggugggagcacuucuguugcuccuggucguggccuuaggcaucggucuguuuaugaggcgucggcauaucguucgaaagagaacccuaaggcgccuccugcaagagcgggaacuuguggagccauugacucccaguggggaagcuccuaaucaggcccugcucagaauccugaaggagacggaguucaaaaagauaaaaguauuaggcagcggagcauuuggcacagucuauaaggggcuguggaucccagaaggagagaaagugaagauucccguugcgaucaaggaacuuagggaggcuaccuccccgaaagccaacaaggaaauuuuggacgaggcauacgugauggccucugucgauaauccucacgugugccgccuccugggcaucugccuaacuucgaccguacagcugauaacacagcucaugccauucgguugucugcuugacuacgugcgagagcacaaagauaacaucgggagccaauauuugcugaauuggugcguucagauugcuaagggaaugaacuacuuagaagaccggcgucucguccauagagaucuggccgcaaggaacgugcuugugaaaacuccccagcacgucaagaucaccgacuuuggccuggcuaaauugcucggugccgaggaaaaggaguaucaugcggaaggcgggaagguuccuauuaaauggauggcccuggaguccauccuacaccgcauauacacacaccagucagauguguggaguuauggagugacgguaugggagcugaugaccuucggcucuaagcccuacgacgggauuccagcuagcgaaaucuccucaauucucgagaaaggagaacggcugccucaacccccaaucuguacuauagaugucuauaugaucauggugaagugcuggaugauugacgcagauagcagaccgaaauuuagggagcuuaucauugaguucucuaagauggcccgagacccucagcgcuacuugguuauccagggcgaugaacggaugcaucugcccuccccaacagacaguaauuuuuacagagcuuuaauggacgaggaagauauggacgauguggucgacgccgaugaguaucucauaccccaacaggguuucuuuagcucuccuuccaccucaaggacaccacugcuuaguagccugucggcaacuuccaacaauucuaccguggcguguauugaccguaacgggcuacagagcugccccaucaaggaagauucauuccuccagcgcuacaguuccgacccuacgggagcccugaccgaggauucuaucgacgauacauucuugccgguuccagaguauauuaaucaaagcgugcccaaacggccugcuggcuccguacagaacccagucuaccacaaucagccccugaacccugccccgucaagagacccccauuaucaggauccacacagcacugcaguggguaauccugaauacuuaaacaccgugcaacccacaugugucaauaguacuuuugacucuccagcucauugggcccagaagggcucccaccagaucagccucgacaacccugauuaucagcaagacuucuuucccaaagaggcaaagccaaaugggauuuucaaaggaucgaccgccgaaaacgcugaguaccugaggguugcgccgcagucaucugaauuuauaggcgccuga

SEQ ID NO: 55656 - RNA, 1281 nt, Artificial Sequence
  derived and/or modified sequence opt3 from EGLN1__Homo_sapiens__NP_071334
auggccaacgacagcggcgggcccggagguccuuccccaucugagagagauaggcaguacugcgaacuguguggcaagauggagaaucuccuucggugcucacgcugucgaaguagcuucuauugcuguaaagaacaccaacgucaggacuggaagaaacauaagcuggugugccagggguccgagggagcuuugggccacggugucgggccgcaucagcacucuggacccgcaccuccagccgcgguucccccuccaagagcuggcgccagggaaccccggaaagcagccgcucgcagagauaacgcaucgggcgacgccgcuaaggggaaggugaaagccaagccuccagcggauccggcagccgcugccucacccuguagggcagcugccggaggucaaggcagcgcgguagccgcagaggcugagccugggaaagaggaaccacccgcccggaguuccuuauuucaggaaaaggcuaaucuguacccuccaucuaacacccccggagacgcccuaagcccgggcggugggcuccgcccuaauggacagacaaaaccccugccagcacuuaagcuggccuuggaguauaucgugccuugcaugaacaagcauggcauuugugucguggaugacuuccucggcaaagagacugggcagcaaauaggagaugaaguucgagcucugcacgacacggguaaguuuaccgauggccagcuggugucccagaaaucagacaguagcaaggauaucagaggggacaaaauuacauggaucgagggaaaggaacccggcugcgagacuauuggucucuuaaugucuuccauggacgaucugaucaggcacuguaaugggaaacuuggcucauacaagauaaacggacggaccaaggcgauggucgcaugcuauccaggcaaugggacaggauacgugcgucauguagacaaccccaauggugauggccgcugcguuaccuguaucuauuacuugaacaaagacugggaugccaaggugagcgggggcauucugagaaucuucccugaaggaaaagcucaguuugccgacauugagccaaaguucgauaggcuacucuuuuucuggagugaccggcgaaauccgcacgagguccaacccgcauacgccacucgcuaugcuaucacagugugguacuuugaugccgacgaaagagcaagggcgaaagugaaguaucugaccggugagaaggggguccggguugaacuuaacaaaccuucugauuccgugggcaaggacguauucuga

SEQ ID NO: 55657 - RNA, 1224 nt, Artificial Sequence
  derived and/or modified sequence opt3 from EGLN2__Homo_sapiens__NP_444274
auggacagccccugccagccucaaccacugucccaggcccucccgcagcuucccgggucuucaagugagccucuggaaccagagcccggcagagcuaggaugggaguggaaagcuacuugccuuguccauuacugcccuccuaucacugcccuggugucccaucugaggcaucggccggcucagggaccccgcgggcgacagcuacuagcacgaccgccaguccccuacgcgauggauucggcggucaggacgggggagaacuccgaccucugcaauccgagggcgcagccgcucuuguuacaaagggcugucagcgucuggcagcccagggggcuagaccagaggcccccaaaaggaagugggcggaagauggaggugacgcaccuucuccaagcaaacggcccugggcccgccaggagaaccaagaagcugagagagagggcgggauguccugcucauguaguagcggaucuggcgaagccuccgcagguuugauggaggaagcucucccgucagccccugagaggcuggcgcuggauuacaucgugcccugcaugcgguauuacgggauuuguguaaaggacagcuuucucggagccgcauuaggcggccgcgugcuggcugaagucgaggcccuuaaacgagggggaagauugagggauggucagcuggugagucagcgggcuauaccaccucguucuauccgcggcgaccagauugccuggguugaggggcaugaacccggaugcagauccaucggcgcacuaauggcccacguggaugcugucauuaggcauugugcgggucggcucgggagcuaugugaucaauggccgaacuaaggcaaugguagccugcuacccaggaaacggccugggguauguucgccacguggacaauccccauggagaugguagauguauaaccugcaucuacuaccuuaaccaaaauugggacgucaaggugcacggcgggcuguugcagauuuucccugagggaaggccaguggucgcuaacaucgaaccgcucuuugaucggcuguuaauuuucuggucggaccgcagaaauccccacgagguuaaaccugccuaugcaacaagguacgccaucaccgugugguauuuugacgcuaaggaacgugccgcagcgaaagauaaguaccagcuggcuucuggccaaaaagguguacaggugccagucucccagcccccuacuccaacauga

SEQ ID NO: 55658 - RNA, 720 nt, Artificial Sequence
  derived and/or modified sequence opt3 from EGLN3__Homo_sapiens__NP_071356
augccccugggccacaucaugagacucgaccuugagaagauugcccuggaauacauagugccuugcuugcaugaggucggguucuguuauuuagauaacuuucugggagaaguugugggugacugcguacuagagagggugaaacagcuccacuguaccggcgcucugcgggaugggcaacuugcaggaccacgcgccggcgucagcaagcgacaucugcguggugaccagaucacauggauugggggaaaugaagagggcugcgaggcgaucuccuucuugcucucucugauugauagacuggugcucuacuguggcucaagguuagggaaauauuacguuaaggaacggaguaaagcuaugguggccugcuauccgggaaacgguacuggcuacguccgccacguggacaaucccaacggggauggaagauguaucacgugcauauauuaccugaauaagaacugggacgcaaaacuucauggcgguaucuugaggauuuuuccugaggggaaguccuucaucgccgauguagaaccaauuuuugaccggcugcuauucuuuuggagcgaucgccgaaauccccacgagguucagccuucuuacgcuaccagauaugcaaugacagugugguacuucgacgccgaggaaagggcugaggccaagaaaaaguuucggaaccucacucguaaaaccgaaucggcgcugacagaggauuga

SEQ ID NO: 55659 - RNA, 1632 nt, Artificial Sequence
  derived and/or modified sequence opt3 from EGR1__Homo_sapiens__NP_001955
auggccgcugcaaaggccgagaugcagcugaugagcccccuccaaaucuccgacccuuucggcucuuuuccacacucaccgaccauggauaacuaccccaaacuugaagagaugaugcuguugaguaauggggcgccucaguucuuaggagcugccggugcaccagaaggcagcggguccaacucuucgucaagcaguuccggaggcggugggggaggcggcgggggaucuaauagcuccucaaguagcucuacauuuaacccccaggccgacacuggugagcagccuuaugaacaucugacggcugaguccuucccagauauuucacuaaauaacgagaaggugcucgucgaaaccagcuaccccagucaaacaacuagacugccuccaauaaccuauacaggcagguuuucucuugagccggcacccaauuccgggaacacccuguggccugaaccauuguucagccucguuucgggacuggugucuaugacuaaucccccugccuccucaaguagcgcuccaucccccgccgcgucuagcgcaucagccagucaguccccgccucugagcugcgcuguacccucuaacgacucaaguccaaucuacagcgccgcaccuacauuucccaccccaaauacggauauuuuccccgagccucagucccaggcuuuuccaggcucugccgguacugcgcuccaauauccgcccccugccuacccagcagcuaaagggggauuccaggugcccaugaucccugacuauuuauuuccacagcagcaaggcgaucugggccuugggacccccgaccagaagccguuccagggauuggagucgcggacacaacagccuagccugacuccacuauccaccauuaaagccuuugcuacacagucagguagucaggaucucaaggcccugaacaccucuuaccaaagccagcuuaucaagcccucccgcaugcgaaaauacccuaaucgucccucaaagacgccaccucacgaaagacccuaugcauguccagucgagagcugcgacaggcgguucucucgcuccgaugaacugacuagacauauaaggauccacacaggccagaaaccguuccagugucggauuugcaugcgcaacuuuagucgaagcgaccauuugaccacucacaucagaacacacaccggggagaagccuuucgccugugauauuugcggaaggaaauuugcucggucugacgaacguaagcgccauacgaagauccaccucagacaaaaagacaagaaagcggauaaguccgugguugcaucaagugccaccagcucgcuguccucuuaccccagcccaguggcuacaucauaucccaguccugucacuaccuccuacccaucucccgccacaacuagcuauccuuccccggugccaaccucauucagcagucccgguucuuccacauacccuagcccaguacauucgggcuuucccucaccuucuguugcaaccacuuauaguuccgugccgcccgccuucccagcucaggucagcucuuuuccuagcuccgccgugacaaauucauucagugcaagcacgggguuaucugacaugaccgcgacuuuuucccccaggaccauagagauuuguuga

SEQ ID NO: 55660 - RNA, 1431 nt, Artificial Sequence
  derived and/or modified sequence opt3 from EGR2__Homo_sapiens__NP_001129650
augaugaccgccaaggcuguggacaaaauccccgucacacugagcggcuucguucaccagcucuccgauaacauuuacccuguggaggaccuugcagccacuucuguaacgauauuuccaaaugcggaacugggagggccguucgaucaaaugaacgguguggcuggcgacgggaugaucaauauugauaugaccggagagaagagaucauuggacuuacccuauccuaguagcuuugccccagucuccgcacccaggaaccagacauucacuuacaugggcaaauuuucuaucgauccucaguauccaggugccucgugcuaccccgaagggauuaucaauauagugucagcuggaauccugcagggcguuaccagcccugcaaguacaaccgccuccucuagcgugacuuccgcuucaccaaacccgcuagccacaggcccccucggggucuguaccaugagucaaacgcagccugaccuggaucaucuuuauagcccacccccuccacccccgccuuacucuggaugcgcgggugaccuguaucaggaucccuccgcauucuugucagccgcuacuaccagcacaaguucuucccucgccuacccaccucccccaagcuaccccucgccuaagccagcaacugacccgggccuguuucccaugauuccugauuauccaggguucuuucccucucagugucaacgggaccugcacggaaccgcuggcccugaccgcaaaccauuccccugcccgcucgauacauuacgagugccuccaccccugaccccucuuuccacgauccguaauuuuacuuugggugggcccucagccggaguaacaggcccaggcgcgagugggggaagcgaggguccuagacugcccggcuccucuagcgccgcagcugccgcugccgcagccgcugcguacaacccacaucaccuaccgcucaggccuauucugcggccccgcaaguauccaaauagacccucaaagaccccuguucaugaaaggccauaccccuguccugcagaggggugcgaccggcgcuucagucgauccgaugagcuuacuagacacaucaggauacacacaggacauaaaccguuucagugucggauuugcaugcguaacuucagccgcucugaccaccugaccacgcauaucagaacccacacaggcgaaaagccauucgccugugauuauugcgguaggaaauuugcucggucagacgagcgaaagcgccacacuaaaauucauuugagacagaaggaaaggaagaguagcgcccccuccgcaucugugccugccccaucgaccgcuagcuguuccgggggcguccagcccggaggcacacucugcucaaguaauucuagcuccuuagggggagguccucuggccccgugcucaagccggacucgcacccccuga

SEQ ID NO: 55661 - RNA, 1002 nt, Artificial Sequence
  derived and/or modified sequence opt3 from EGR3__Homo_sapiens__NP_001186810
auggacaucggccugaccaacgagaagcccaauccugaacucagcuacuccgggucuuuccagccagccccgggaaacaaaacagugacuuaucuugguaaguuugcuuucgauucacccaguaauuggugccaagacaacauuauaagccugauguccgcaggcaucuugggggucccuccagccucuggagcguuaucgacgcagaccucaacagcuagcaugguucagcccccucagggcgauguggaggccauguacccagcacugcccccuuauaguaauuguggugaccuauacuccgaaccaguaucuuuucacgauccgcaagggaaccccggacucgccuauagcccucaggacuaccaguccgcuaaaccagcacuggauucaaaucuuuuccccaugauuccugacuauaaccuguaccaucacccaaaugauaugggcaguauccccgagcauaagccguuucagggcauggacccuauuagagugaaucccccaccuaucacucccuuggaaaccauaaaagccuucaaggauaagcaaauccacccaggguuuggaagccucccccagccuccacugacacugaaaccgauuaggccccggaaguacccuaaccgcccaucuaaaacuccccuccaugagcgaccucacgcuugcccagccgaggguugugaccguagauucuccaggucagaugaauuaacccggcaucugcgcauccacacaggccacaagcccuuucagugcagaauuuguaugaggagcuucagucggucugaccaucuuaccacgcacauccgcacucacaccggggagaaaccguuugcgugcgaguucuguggacgaaaguuugcaagauccgacgaaaggaagcggcaugccaaaauacacuugaagcagaaagagaagaaagcugaaaagggcggugccccuagcgcaucgucugcuccacccgucucccuggccccugugguuacaacuugcgcguga

SEQ ID NO: 55662 - RNA, 1770 nt, Artificial Sequence
  derived and/or modified sequence opt3 from EGR4__Homo_sapiens__NP_001956
auggccguggcuagaggcgucgggagccccgagccugcaccaccgcagcuguacaaguggggagguugcggccucggggaacccggauccgcccuugagaggcggggcgcggcugcccgcggucgaugugggcgugcaagagccccuaggcugccagacucuuucccccggggagaaugcccuaaaccaggcgcucgcgcacccagaucaguuagguguggcgagccuuugccaccggccagucccccuccagcucggccccaagcccagcgcgcgcgaccuagagcaccacacagcaggcggcgugccauguuacaucuguccgaauuuucugagcccgaugcucuacucgugaagucgaccgaggggugcugugccgaaccgucagcagagcugccucgccuucccgcuagagacgccccagcggccacaggauauccuggugcaggcgauuuccugagcugggcuuugaacaguugcggggccuccggagaccucgcugauucuuguuuucuggaaggccccgccccaacucccccuccaggucugagcuacuccgggucauucuuuauccaggcaguaccggagcacccccaugacccugaggcccucuucaauuuaaugaguggcauucugggacuugcuccauuucccggcccugaagcggcagccagcaggucuccauuggaugcucccuucccggccggguccgacgcacugcuaccuggaccacccgaucucuauucaccugaccugggugccgcucccuuuccagaggccuucugggaagcaagcccuugcgcgggcgcucccagucagugucuuuacgagccacaacugucuccgccugaugugaaacccggguugcgggccccacccgcauccccugcccucgacgcugucagcgccuuuaagggaccauaugcacccugggaacuguuaucggugggcgcuccugguaacugcgggucucagggcgauuaccaggccgcgccggaggcccgauucccaguuauaggaacgaaaaucgaggaccugcucuccauuucaugucccgcugaacuuccugcagugccagccaaucgccuguaucccaguggcgcuuacgacgccuuuccuuuggcaccgggggaucuaggagagggugcggaaggccugcccgggcuccugaccccaccuagcggagagggcgguuccucuggggacggcggagaguuccuugccagcacacagccccaacugucaccauugggccucagaagugcugccgcagcugauuucccuaagccccuggucgccgacaucccaggguccagcggaguggcagccccgccuguacccccacccccuccaacucccuuuccucaggcuaaggcgaggcggaaaggucgcagaggcgggaagugcucuaccaggugcuucuguccgcguccacacgccaaagcauuugcuugccccguugaaucaugugugcggaguuucgcccgaagcgaugaguuaaacagacaucugaggauucacacaggacacaagccuuuucagugccgcaucugucuacggaauuucuccagaucugaccaucucaccacucacgucaggacacauaccggcgaaaaacccuuugccugcgauguguguggucgccgauucgcucggucggacgagaagaagcgucacagcaaagugcaccugaagcagaaagcaagagccgaagagaggcuuaagggguugggcuuuuacucccugggacucucauucgcgagucuguga

SEQ ID NO: 55663 - RNA, 3483 nt, Artificial Sequence
  derived and/or modified sequence opt3 from EHBP1__Homo_sapiens__NP_001136087
auggccagcguguggaagagacugcagagggucggcaaacacgcuuccaaguuccaauuuguugcaucuuaccaggagcucaugguggaaugcaccaaaaaguggcagcccgacaaacuuguaguggucuggacacggcgcucacgacguaagaguagcaaggcccauuccuggcagccugggaucaaaaacccauauagaggagugguuguguggccgguccccgagaauauugaaauaacugugacgcuguucaaggauccucacgcggaggaauuugaggacaaagaguggaccuucguaaucgaaaacgagucuccaucggguaggcggaaggcuuuggccacaucaagcauuaauaugaaacaauacgcaagucccaugccuacucagaccgauguuaaguuaaaguuuaaaccacuguccaagaaaguggucucugccgcucuacaguucagccucuccuguaucuuucugcgcgaaggcaaggcaacagacgaggauaugcagucacuugccagucugaugagcaugaaacaagcugacauugggaacuuggaugacuucgaggaagauaaugaggacgaugacgaaaacagagugaaucaggaggaaaaggccgcgaaaaucaccgagcucauaaacaagcugaauuuucuggaugaggcagaaaaggaccucgccacugugaacucuaaucccuucgacgauccugacgcugccgaguuaaacccauuuggagauccggacuccgaagaacccaucacagaaaccgcaucaccuaggaaaacggaggauagcuucuauaauaacaguuacaauccauuuaaggagguccagacuccccaguaucugaacccuuucgacgaaccagaggcuuucguuaccauuaaagauucucccccgcaauccacaaagcggaaaaacauccgcccuguggacaugagcaaguaccuuuaugccgauucgucuaagacugaagaggaagaguuggacgaguccaaucccuuuuacgaaccaaaaucaaccccucccccaaacaaucugguaaaccccgugcaggagcuagaaacagagcgaagagucaagaggaaagcgccugccccaccggugcucagucccaagaccggcguucugaaugagaacacggugagcgcagguaaagaucuuuccacuucuccuaagccaagccccauuccuucaccaguccuggggcggaagcccaaugcuagucaguccuugcucguguggugcaaagaaguaacaaagaacuaccguggaguuaaaaucaccaauuucacuacaagcuggcgcaacggccugucuuuuugugccauauuacaucacuucagaccggaccugauugacuauaagucacucaauccucaagauaucaaagagaacaauaagaaggcuuacgacggcuuugccaguauugggaucagcaggcuucuggaaccauccgauaugguguugcuagcaauccccgacaaacugaccgucaugacguaucucuaccagauucgggcccauuucucuggacaggagcugaacgugguccagauagaagaaaauucgagcaaguccaccuauaaaguggguaacuacgagacagauacuaacucaaguguugaccaagaaaaguuuuaugcugagcuuucugaucugaaacgagaaccugaguugcagcagcccaucagcggcgcgguggacuuccucucccaggaugacucaguauuugucaaugauagcggggugggagaaucugaguccgagcaccaaaccccagacgaucaccugaguccuagcacagcaucucccuacugccgcagaacuaaguccgacaccgaaccacagaaaucacagcagaguagcggcaggacaucggguuccgacgauccggggauuuguucuaacaccgacagcacucaagcccagguuuuacugggaaagaagcggcuacucaaagcugagacgcuggaacuuucagauuuguacgugagugacaagaaaaaggauauguccccucccuucaucugcgaggaaacagacgagcagaaacugcagacccucgauauaggcucuaaucuggagaaggaaaaacuugagaacagccgcucccuggaauguagaucagacccagagagccccauuaaaaagacuuccuugucuccuaccuccaaacucggcuauagcuacucgagggaucuggacuuagccaagaaaaagcaugcaucacugcgucaaacagagucugauccagacgccgaucggaccacucuaaaucacgcugaccauaguuccaagaucguccagcaccgacuccugagcagacaggaggagcuuaaagaaagggcccgcguguugcuggagcaagcacggagagacgcggcucucaaggccgggaacaaacacaauacaaacacggcaacccccuuuugcaauaggcagcugucugaucagcaggacgaggagcgccgacggcaauuacgugagagagccaggcagcugaucgcugaagcccgcagcggaguaaagauguccgagcuuccuucauauggugaaauggcagcugagaaauugaaggaacggaguaaggccagcggcgagcagaacucuaaacucguggaucugaagcuaaagaagcugcucgagguucagccgcaagucgcgaauaguccaucaagugccgcucagaaagcagugacugaaagcuccgagcaggacaugaagucugggacagaagaucugagaaccgagaggcuucagaaaacaacugaacgauuccgcaaccccguggucuuuucgaaggacagcaccguucggaagacgcaauugcagucauucucccaguacauugagaauagaccugagaugaaaaggcaacguaguauccaggaagauaccaagaaaggaaacgaggaaaaggccgcuauuacagagacucagcgcaaaccaucugaggacgaagugcugaauaagggcuucaaggauaccagccaguaugugguaggugaguuagccgcacucgaaaacgagcaaaaacagauagacacacgggcggcccuggucgaaaagagacuuagguaccugauggauacugggcgaaacaccgaggaggaagaggcuaugaugcaggaaugguuuauguuggugaauaaaaagaacgcccucauccggcgcaugaaucagcugucccuacuggagaaagaacaugaccucgagagaagguaugagcugcuuaaccgggaauugcgagcaaugcuggcuauugaggacuggcaaaagacggaagcccagaagagacgcgagcaguuacuccuggaugaacuuguugcacuggugaauaaaagggacgcccuaguccgugaucucgacgcucaggagaagcaagcggaggaagaggaugaacaccuggagcggacauuggagcagaacaaaggcaagauggccaaaaaggaagagaagugugugcugcaguga

SEQ ID NO: 55664 - RNA, 1647 nt, Artificial Sequence
  derived and/or modified sequence opt3 from EHD1__Homo_sapiens__NP_001269374
auggagcagcccggcaccgccgcuagcccuguguccgggucuauguucucaugggucaguaaggacgcaagaaggaaaaaggaaccagagcuguuucaaacaguugccgaaggacuccggcagcuuuacgcgcagaaacuguugccguuagaggaacacuaucgcuuccaugaguuucacagccccgcucuggaggaugccgacuucgauaacaagccuauggugcuacucguaggucaguacuccacuggcaaaacgaccuuuauccgacaucugauugaacaagacuucccagggaugcguauaggacccgagccuacaacugauucuuuuaucgcagugaugcacggcccaaccgaaggugucgugcccgggaaugcccuuguuguggacccuagaaggccauuccggaagcugaacgcuuuuggaaaugcauucuugaaccgcuuuaugugcgcccagcucccgaaucccguccuggauucgauuucaaucauugacacaccuggcauccugagcggcgagaagcagagaauaaguaggggguaugauuucgcugccgugcucgagugguuugcggaacggguagaccgcaucauuuuacuguucgaugcacauaaacuugacaucuccgaugaguucucugaaguuauuaaggccuugaaaaaccacgaggacaagauccgagugguccugaauaaagcugaccagauagaaacccaacagcuaaugagaguguacggagcccucauguggagccuggguaagauuaucaacacuccagagguggucaggguuuauauuggcuccuuuuggucacacccccuucugaucccugauaaucggaaguuguucgaggcagaggaacaggaccucuuuaaagauauccagagucugccacguaacgcugccuuacgcaagcugaaugaccucauuaaaagagcgaggcuugccaaggugcaugcauacauaaucagcucucugaaaaaggaaaugcccaacguauucgggaaagaguccaagaagaaagaauuggugaauaaccuaggagagauuuaucaaaagaucgagcgggaacaccagauaucaccgggcgauuuuccuagccugcgaaaaaugcaggagcuccugcaaacacaggacuucaguaaguuucaggcucuuaaacccaagcuguuggauaccgucgacgauaugcucgccaaugacauugcucgccugauggugaugguuagacaggaagagucuuuaaugccaucccaaguggucaaggguggggccuucgauggaacgaugaacggcccuuuuggccauggguacggagaaggugcaggcgaggggaucgacgacguggaguggguaguuggaaaagauaagcccacuuacgacgaaaucuucuauacccugagcccagugaacggcaaaauuacaggugccaaugcuaagaaagagauggucaagucgaagcuacccaacacugugcucgggaaaaucuggaagcuggcggaugucgacaaagauggccuuuuggacgaugaagaguuugcacuggccaaucaccucauuaaggugaaacuggagggacacgaacuuccugcugaccugccaccgcauuugguucccccuucuaagaggcggcacgaguga

SEQ ID NO: 55665 - RNA, 1632 nt, Artificial Sequence
  derived and/or modified sequence opt3 from EHD2__Homo_sapiens__NP_055416
auguucagcuggcugaagagaggcggggccaggggacagcaacccgaggcuauccggaccgugacauccgcacucaaagaacuuuaccgcacuaagcuguugccuuuagaggaacacuaucgauuuggugccuuccauucuccagcgcuggaggacgcugauuuugacggcaaaccgaugguccuaguugccgggcaguacucaacgggaaagaccaguuucauucaguaucuccuggaacaggaggugcccggcagccguguagguccugagccaacaacugauugcuuuguggcagucaugcacggggacaccgaaggaacagugcccggcaacgcccuuguuguggauccugacaaaccauucagaaagcugaaucccuuuggcaacaccuucuugaauagguuuaugugugcucaacucccuaaccagguccuggaguccauaucuaucauugauacuccagggauccugucgggagcaaagcagcgggugucacgcgguuacgacuucccggccguacucagaugguuugcugaaaggguugauuuaauuauccugcuuuucgacgcccauaaauuggagauaagcgaugaguuuagugaagcgaucggcgcacugcgggggcacgaggacaagauucgcgugguccuaaauaaagccgauaugguggaaacacagcaacucaugcgaguguauggagcucugaugugggcccuuggcaaggucguugguacccccgaggugcugagaguauacaucggguccuucuggucucagccuuugcucgugccagacaacaggcggcuguucgaauuagaggagcaggaccuguuucgugauauucagggacucccccgccaugcagcucuuagaaaacugaaugacuuggucaagagggcccggcuagugcgaguucacgcguauaucauaagcuaccugaagaaagaaaugccuuccguguucggcaaggagaacaaaaagaaacaacucauucugaaacuuccagucaucuuugccaagauucagcuggaacaccauaucucacccggcgauuucccggacugccagaagaugcaagaguugcucauggcacacgauuuuacgaaguuccauagucugaaaccuaaguuacuggaagcucuagacgagaugcucacucacgauaucgccaaacugaugccccuuuugcgccaggaggaacuggagagcaccgaaguggggguacagggaggugcuuuugagggcacacacauggggccauucguugaaagaggaccugacgaggccauggaggauggcgaagaggguucugacgaugaagcagaguggguggucacuaaggacaaauccaaguacgacgagauauuuuauaaucucgcccccgcugaugggaagcugucaggcagcaaagcgaagaccuggauggugggaacaaaacuuccaaacaguguccugggcaggauuuggaaguugucugacguggaucgggacgggaugcucgaugacgaagaguucgcacuggccucccauuuaaucgaagcuaaacuggagggacacggucuacccgccaaucucccucgcagacugguuccaccgagcaagaggcgucauaagggcucggcagaauga

SEQ ID NO: 55666 - RNA, 1608 nt, Artificial Sequence
  derived and/or modified sequence opt3 from EHD3__Homo_sapiens__NP_055415
auguucagcuggcugggcaccgacgauagaaggcggaaggaccccgagguguuucagacagucuccgaagggcucaaaaagcucuacaaaucuaagcuguugccuuuagaggaacacuaucgcuuccaugaguuucacucaccagcccuggaagaugcugacuucgauaacaaaccgaugguucuacucgugggacaauacaguacugguaagacgaccuuuauccgauaucugcuugagcaggacuuccccggcaugcguauugggccugagccaacaacugauagcuuuauagcaguaaugcagggagacauggaaggcaucauucccgguaaugcccugguggucgauccuaagaaaccauucagaaaguugaacgcguuugggaaugcuuuccucaacagguuugugugcgcccagcugcccaauccuguucuggaguccaucucugugauugacaccccaggaauccucucgggcgaaaaacaacggauaucacgcggcuacgauuucgcagccgucuuagagugguuugcugagagaguggacaggaucauucugcuuuucgaugcacauaaguuggacaucagcgacgaguucagugaaguaauuaaagcccugaagaaccacgaagauaagaugcggguugugcuaaauaaagcugaccagaucgagacacagcagcucaugcgcgucuauggggcccugauguggucccuuggaaagauagugaacaccccggaagugauucgagucuacaucgguucuuuuuggagccauccccuguugauuccugauaauagaaaacucuucgaggcggaggaacaagaccuguuuagggauauccaguccuuaccacggaacgcagcccugcguaagcucaaugaccuuaucaaacgcgcuagacuggccaagguucacgcauauauuauaucaaguuugaaaaaggagaugcccagcguguucggcaaggauaacaaaaagaaagagcuaguaaauaaccuggcugaaaucuacgggaggauugaacgggagcaccagaucucuccuggagacuuuccaaaucucaagcgaaugcaggaucaacugcaggcccaggacuucuccaaauuucaaccccuuaagucaaagcuguuggagguggucgaugacaugcucgcgcaugacauagcccagcugaugguguuaguucgccaggaagagagccagagaccgauucaaauggugaaaggcggugcauucgaagggacucugcacggaccuuuuggccauggcuacggggagggagcuggugaaggcaucgaugacgccgagugggucguggcuagggauaagcccauguaugacgagaucuucuacacacuaaguccaguagaugggaaaauuaccggagccaacgcaaagaaagaaaugguucggucuaagcucccuaacuccgugcugggcaagaucuggaaacuugccgacauugauaaggacgguauguuggaugacgaugaguuugcucuggcgaaucaccucauaaaagucaagcuggaagggcacgagcuucccaacgagcugccagcacauuugcuucccccuagcaaacgcaagguggccgaauga

SEQ ID NO: 55667 - RNA, 1626 nt, Artificial Sequence
  derived and/or modified sequence opt3 from EHD4__Homo_sapiens__NP_644670
auguucagcuggaugggcagacaggccgggggaagggagcgggcugguggcgcagacgccgugcaaaccgucacagggggacugcgcucccucuaccuucgaaagguucugcccuuggaagaggcguaucguuuucacgaauuucauucuccugcuuuagaggaugccgacuuugaaaacaaaccaaugauccugcuagugggccaguacucaacugguaagacgaccuucauuagauaucuccuggagcaggauuuuccggggaugaggauaggacccgagccuacaacugacaguuucaucgcaguaauguacggcgaaaccgagggcagcacaccagggaaugcccuuguggucgaucccaaaaagccuuuucggaaacugucccgcuucggaaacgcuuucuugaauagauucaugugcucucagcucccaaaccaagugcugaagucgauuucaguuaucgacagccccgguauucugaguggcgaaaagcagaggaucucccggggguaugauuuuugucaggugcuccagugguucgcagagcgcgucgaccgaauaaucuuacuguuugaugcccacaaacuugacauuucugaugaguucagcgaagcuaucaaggccuucagaggacaagacgauaaaauuagggugguauugaauaaggcggaccagguugacacccagcagcugaugcggguguacggcgcacuaauguggucccucgguaaagucaucaacacuccugaggugcugcguguguauauagggucauuuugggcccaaccacuucagaauacagauaaccgcagacuguucgaagcugaggcccaggacuuguuuagggauauucaaagucucccgcagaaggcagcuguccggaagcugaaugacuuaaucaaacgagcccgccuggcgaagguucaugccuacauuaucagcuaccucaaaaaggaaaugcccucuguguucggaaaagagaacaagaaaagagagcuuaucuccaggcugccugaaauuuauauacaguugcagcgggaguaccaaaucucagcaggcgauuuuccagaaguaaaggcuaugcaggagcagcuagaaaauuaugacuucaccaaguuucacagccugaaacccaagcucauugaggccguggauaacaugcugaguaauaaaaucucuccucuuaugaaccugauaucccaggaggaaacgagcacuccaacccaauugguccagggcggggcuuucgacggaacaacugagggucccuuuaaucagggcuacggggaaggagccaaggagggcgcagaugaagaggagugggugguugccaaagacaagccgguguaugaugaacucuucuacacccugucgccuauuaacgguaagaucucuggggucaacgcuaaaaaggagauggugacauccaaauuacccaauucaguacugggcaagaucuggaaacuagcggacugcgacugugauggaaugcucgacgaagaggaguuugcacuggccaagcaucuuauuaagaucaaauuggauggcuaugaacugccaaguagccucccuccccaccugguuccacccucccaccgcaagucucuuccuaaagcugacuga

SEQ ID NO: 55668 - RNA, 969 nt, Artificial Sequence
  derived and/or modified sequence opt3 from EHF__Homo_sapiens__NP_001193545
augggccugcccgagagaagggggcucgugcuucuguugagcuuagccgaaauccuguucaagauuaugauacuagagggagguggcgucaugaaccucaauccugggaacaaucugcuucaccagccaccggcuuggaccgacuccuacucuacaugcaacguuucaaguggauuuuucggcggucaauggcaugaaauccacccccaguauuggacuaaauaccaggugugggaguggcugcagcauuugcucgauacgaaucaacuggacgcaaacuguauuccuuuucaggaguucgauaucaauggggaacaccugugcagcaugucccuccaggaguuuacccgggccgcgggaacagcuggccaguuacuguauucuaaccuucaacauuugaaguggaauggccaguguucgucagaccuguuccagagcacucacaacguaauugugaaaaccgaacagacagagccaaguaucaugaauaccuggaaggaugaaaacuaccuauaugacacuaauuacggguccacagucgaucuccuggacucuaaaaccuuuugccgcgcccaaauaagcaugacgacuaccucccaccuucccguggcagagucaccugauaugaagaaggagcaggacccacccgccaaaugucauacaaagaaacacaacccucgaggaacucaucugugggaguucauccgugauauuuugcucaauccagacaagaacccgggucugaucaaaugggaagauagaagugaaggcguuuuuagguucuuaaagagcgaggcuguggcacagcugugggggaagaaaaagaacaauucuuccaugaccuaugaaaaacucucacgggccaugcgcuacuacuauaagagagagauucuugagagggucgacggacggcgccugguguacaaauuuggcaagaacgcucgagguuggagagaaaaugagaacuga

SEQ ID NO: 55669 - RNA, 1884 nt, Artificial Sequence
  derived and/or modified sequence opt3 from EHHADH__Homo_sapiens__NP_001159887
auggccuucggcgggggacuggagcucgcucuugguugccacuacagaaucgcacaugccgaagcucaggugggccugcccgaggucaccuugggguuacugccuggagcuaggggcacacaacuacucccacggcugacugguguuccggccgcacuugaccugauuacgagcgggcgccgaauauuggccgaugaagcucucaagcugggaauccuggacaaagugguaaacuccgaucccguggaggaagcaauucguuuugcccagagagucucugaccagccucucgagucaaggcgguuauguaauaagccaauccagagucugcccaacauggauagcauuuucuccgaggcucuuuugaaaaugcgcagacaacacccuggcugccuggcccaggaagcgugugugagggcaguucaggccgcugugcaguauccauacgaggucggcaucaagaaagaagaggagcuauuucucuaucugcuucaaucugggcaggcccgggcacugcaguacgcuuucuuugccgaacgcaaggcgaauaaguggucgacccccucaggagccagcuggaaaacagcaagugcucgaccuguguccucuguagguguugugggcuuggggacuaugggaagaggcauagucaucagcuucgccagggcucggauuccagugaucgccguggacuccgauaagaaccagcucgcaaccgccaauaaaaugauuacaucaguccuggagaaggaagcuaguaaaaugcaacagagcggucauccguggucugggcccaagccucguuuaaccuccucaguuaaggagcugggaggcguggaccucguaaucgaagcgguguuugaggagaugagccuuaaaaagcaggucuucgcagaacugagugccgugugcaaaccagaggcuuucuuguguacuaacacaucugcccuagauguugacgaaauagcauccagcaccgaucgcccccaccuggugauuggcacgcauuucuuuucgccugcccacgucaugaagcuccuggaggugaucccaucucaauauuccucacccacuaccauugcuacaguaaugaaucuuaguaaaaagaucaaaaagaucgggguuguggucggaaacugcuucgguuuugugggcaauagaaugcugaacccguacuauaaucaggccuacuucuugcucgaagaggggagcaagccugaggaagucgaccaggugcuggaggaauuuggauuuaaaaugggccccuucaggguuuccgauuuagcaggucuggacgugggguggaagucucggaaaggccagggacuaacuggcccaacccuccugccugggacacccgcgcgaaagcgcggaaacagaagguacuguccaauucccgacguacuuugcgaguugggucgguuuggccagaaaaccgggaagggaugguaucaauacgauaagccucugggccgcauacacaaaccagacccguggcucagcaaguuccugucaagauauaggaaaacgcaucacaucgaaccccguacuauuagucaggaugagauccuugagcggugucuguacuccuugauaaaugaagcguuucgaauccucggugaggggauugccgcaagcccugaacauaucgacgucguguaucugcacggcuacggauggccaagacacaagggcgggcccauguucuaugccucuacaguuggauuaccuaccgugcuggagaaacuacagaaguacuacaggcaaaacccagauauuccccagcucgagccgucagacuaucugaagaaacuugcuagucaggguaauccuccauugaaggaauggcagagccuggccggcucccccucuucgaaacucuga

SEQ ID NO: 55670 - RNA, 2427 nt, Artificial Sequence
  derived and/or modified sequence opt3 from EHMT1__Homo_sapiens__NP_001138999
auggccgcugcagacgccgaggcggugcccgcuagaggcgaaccucagcaagauugcugugucaagaccgagcugcucggggaagagacaccaauggccgcagacgaaggaagcgccgagaaacaggcuggugaggcacacauggccgcugauggcgaaacuaacggguccugcgaaaauucugacgccucaagucaugcgaacgcagccaagcacacgcaggauagcgcuaggguuaauccgcaggacggaaccaacacacuuacucggaucgccgagaauggcguguccgagcgcgauucugaggcagcuaaacaaaaccauguaaccgccgacgauuucgugcagacaucggucauugguucaaauggguacauacugaacaagcccgcguugcaggcccagccuuuacgaaccacuagcacacuggcaaguucccuaccaggacacgcugccaaaacccuccccggcggcgcugggaagggacguacgccuucugccuuuccacaaacucccgcagccccuccagcuacccugggugaaggcagcgcggacacagaggauagaaaacuuccggcacccggggccgacgugaagguucauagggcucggaagacuaugccuaaauccguggucggacugcacgccgcaucaaaggauccacgcgaagugagagaggccagggaccacaaagaacccaaggaggagaucaauaagaacauuagugacuucggccggcagcaguugcucccuccauuucccagccugcaucagucucugccgcaaaaucaguguuauauggcuaccacaaaaucccagaccgccugccucccuuucguauuagcagcggcuguuucacgcaagaaaaagcgaagaauggguacguacagccuggugcccaaaaagaaaacuaagguccuuaagcaaaggacagugaucgaaauguuuaaaaguauuacccacucuacugugggguccaagggagagaaagauuugggcgccagcucgcugcaugucaacggcgaaucucuagagauggacuccgaugaagacgauucagaggagcucgaagaggacgaugggcacggagcagaacaggccgcugccuucccaacagaggacagucggaccagcaaggaauccaugucugaggcagaucgugcucagaaaauggacggugagagcgaagaggaacaggagucaguugauacgggcgaggaagaggaagggggagacgagagugaccuguccagcgaaucuucaaucaagaagaaauuucuuaagcgcaaaggcaagaccgauaguccuuggauaaaacccgccagaaagaggcggcgacgcagcagaaagaaaccauccggugcgcuggggucugagucguauaagagcuccgccggcucagcugagcaaacagcacccggagacaguacuggcuacauggaagugucuuuggauagccucgaccugaggguaaaagggaucuuauccucacaggccgagggacuggcuaaugguccugaugugcucgaaaccgacggccuucaggaggucccacuguguagcugccggauggaaacaccgaagucucgcgagauuacuaccuuggccaacaaucaguguauggcaacagaguccguggaucacgaacuagggagaugcaccaacaguguugugaaauaugagcugaugaggcccagcaacaaggcgccucuccugguccuuugugaagaccaucguggacggauggugaagcaccaaugcuguccaggcugcgguuacuucugcacugccgggaauuuuauggagugucagcccgaaucuuccaucucacaucgauuccacaaagauugcgcuaguagaguaaacaaugccagcuauuguccucauugcggcgaggagucguccaaggcaaaagaaguuacgauugcuaaggccgacacaaccucuacugugaccccaguccccggacaggagaaaggcagcgcacuggaagggagggccgauacaaccacuggaucagcugcggguccgccuuugagugaggacgauaagcuccagggcgccgcaucccacgugccagagggguuugaccccacaggaccugcuggccugggucgccccacgccaggguuaucucaaggcccuggaaaagaaacccuggagagcgcccuaaucgcccucgacuccgaaaagcccaagaaacugcgguuccacccaaagcagcuuuacuuuucagcuagacagggcgaguugcagaaaguccugcucaugcugguggaugggauagacccgaacuucaagauggaacaucaaaauaaaaggagcccucuucacgcagccgcggaggcuggacauguugauauuugucacaugcuggugcaguucugccgcuugggcaguccccgaucucgggguugucucugguga

SEQ ID NO: 55671 - RNA, 3702 nt, Artificial Sequence
  derived and/or modified sequence opt3 from EHMT2__Homo_sapiens__NP_001276342
augagaggccugcccagggggcggggacucaugcgcgcccgaggucguggcagagcugcaccuccagggagcaggggacggggccgcggugggccgcacagaggaaggggccggccccgcucccuucugucuuugccucgagcccaggcgucauggaccccacaauuaaguacaggccugacuagcccucccgugccaugccuacccucccagggggaggcuccugccgaaaugggagcacuccugcuugagaaggaaacgagaggugccaccgagaggguccauggcucucugggggacacaccacggucggaagagacuuugccgaaagcuacccccgauucacucgagccugcaggaccaagcagucccgccuccguuacagugaccguaggcgacgaaggugcugauacuccugugggggccacaccacugaucggagacgagucugaaaaccuggagggcgauggcgaccuccgugggggacgcauuuuacugggucacgcgaccaagagcuuccccuccucaccgaguaaaggcgggagcuguccuucuagagcaaagauguccaugacgggagccggcaaaucacccccaagcguccagagucuugcuaugagguugcugucuaugccuggugcccagggggcagcugccgcgggcuccgagcccccacccgccacuaccagcccugaaggacaaccaaaggugcaucgggcacgaaagacaaugucgaaaccgggcaaugggcagcccccuguuccagagaagcggcccccugaaauacagcacuuuagaaugucugaugacgugcauucccuaggaaaagucacuucagaucucgcuaagaggcggaaacugaacagugguggcgggcuuagcgaggaacugggauccgcccgcagaucuggcgaggugaccuugacaaagggugacccagggagccucgaggaaugggagaccguaguuggcgaugacuucucacuguacuaugauaguuacuccguggacgaaagggucgacagcgauucuaagucagagguggaagcucugacggagcagcugagugaggaagaggaagaggaagaggaggaagaggaagaggaggaagaggaagaggaagaggaggaagaggaagaggacgaagagagcggaaaucaauccgaucguucuggcucgagcgggcggcgaaaagccaagaaaaaguggagaaaagacucccccugggugaagccgucaaggaaacgccggaagagagagccuccaagggcaaaggaaccccgcggagucaguaacgauacuucuagccucgagacagaacgagguuuugaggaacuuccucugugcuccugucggauggaggcccccaaaaucgaccguauuucagagagagcuggccacaagugcauggcgaccgaaagcguugauggggaguugucuggauguaaugcagccauccuaaaaagggaaacuaugcgcccauccagucggguggcucugaugguacucugcgagacacacagagccaggauggugaagcaucacuguugcccuggcugugguuauuucugcaccgcagggacguuucuggagugucaucccgacuuccgagucgcccaccgcuuucacaaggcuugcgugagccagcuuaacggcaugguuuucugcccacauuguggagaagaugccucugaggcacaggaagugaccauuccgcggggcgacggggucacaccucccgcgggaacugcugccccagcacccccuccacugucccaggaugugcccggcagagccgacaccucacaaccuagugcuaggaugcguggucacggggagccgcgccggccacccugcgacccuuuggccgauacaaucgacagcucgggaccaucccucacucugcccaauggcgguuguuuaucugcaguaggccugccucuagggccgggaagagaagcucucgagaaagcccugguuauacaggagagcgaaaggcgaaagaaacuucgguuucauccccgccaguuguaccugucagugaagcaaggcgagcuccagaaagucauccugaugcuucuggauaacuuggacccaaauuuccagagugaucagcaauccaagagaaccccucuccacgcggccgcucagaaagggucuguggaaauuugccauguccuguuacaggcaggagccaacaucaaugcuguggacaagcagcaaaggacaccccugauggaggccguugugaacaaucaccuagaaguagcacgguauaugguccagcgaggcgguuguguguacagcaaggaggaggaugggucaaccugccuccaccaugcggccaaaauuggaaaccuggaaaugguuucccuuuugcugagcacuggccagguggacgucaaugcucaggauagugguggcuggacgccaaucauaugggccgcagagcacaagcauauugaagugaucagaaugcuccugacacgcggggcugacguaaccuuaacugauaacgaggaaaacauuugucugcacugggccucuuuuaccggauccgcagccaucgcugaggugcuuuugaaugcgaggugcgaccuccacgccguuaacuaucauggcgauacaccucugcacaucgcagcucgugagagcuaccaugacuguguccuacuguuccucucgcgcggggccaaucccgaacugagaaacaaagagggagacaccgccugggaucuuacuccagaaaggucagacgugugguuugcuuugcaacugaaucgcaaguuacgacucggcguggguaacagagcaauucggacagagaaaauaaucugcagggaugucgcccgcggguacgagaauguuccgauuccuugugugaacggaguggacggcgaacccugcccagaggauuauaaguacaucucugaaaauugcgagacgaguaccaugaacauagaccguaauauuacucacuuacagcauuguacaugcguagaugacuguuccagcucuaacugccuuuguggucagcugagcaucagaugcugguaugauaaggacggccgguugcuccaggaguucaauaaaaucgaacccccucugauuuucgaguguaaccaagcgugcuccuguuggaggaauugcaagaaccgcgucgugcagucagggaucaaaguucgacuacagcuguacagaaccgcuaagaugggauggggcgugcgggcccuccaaacaauuccacaggggacuuuuauaugugaauaugucggagagcugaucagugaugcagaagccgacgugagggaggaugacagcuaccuuuucgacuuggauaacaaagacggcgaaguuuauugcauugaugcucgcuacuacgguaauaucucuagauuuaucaaccaccugugcgaccccaauauuauaccugugaggguauucauguuacaccaggaucuccgguuuccgcguaucgcauucuuuuccucacgcgacauucgaaccggggaggagcugggauucgauuauggcgacagauuuugggauaucaagaguaaauacuucacgugucagugcggcagcgaaaaguguaagcauuccgccgaggcgauugcucuugaacaaucuaggcuggcccggcuagacccacaccccgagcuccugccugaauuggggucgcugcccccagucaacaccuga

SEQ ID NO: 55672 - RNA, 1023 nt, Artificial Sequence
  derived and/or modified sequence opt3 from EI24__Homo_sapiens__XP_011541371
auggccgacucagugaagaccuuccugcaggaucucgcuagaggcaucaaagacuccauuugggggauaugcacaaucucuaaacuugaugcaaggauucaacagaagcgggaggaacagcgccgacguagagccucaaguguccuggcgcagaggcgggcucaaagcaucgagcgcaagcaggaauccgagcccagaauuguuucuaggaucuuucaguguugcgccuggaacggagguguguucugguuuucguuguuacuguucuaccggguauuuauaccugugcuacagucagucacugcacgcaucauuggcgacccaagccuccacggggauguguggaguuggcuggaguucuuucuuacguccaucuucucugcccuguggguuuugccgcucuuugugcugagcaaagucgugaaugcuauuugguuccaagacaucgcagaucuggccuuugaaguauccggacgaaagccccauccuuucccaucaguuaguaagauaauugcugacaugcucuuuaacuuacugcuucaggccuuguuccugauccagggcauguucgugagccuauuucccauucaccucgucggucagcuggugucucuucugcauauguccuugcucuauucacuguacuguuucgaguauagaugguuuaauaaagggaucgaaaugcaccaaagguuaagcaacaucgagcggaauuggccuuacuauuucggauuuggccugccacucgcguuccuuaccgcaaugcagaguucuuacauuauauccggcugccuguuuagcaucuuguucccccuauuuauuaucucggccaacgaagcuaagacaccugggaaagccuaucuguuccagcuccgucuguuuucucuuguggucuuccuguccaaucgcuuguuucauaagacuguuuaccuccaaucagcacugaguagcuccaccucugcugagaaauucccaagcccgcaccccagcccugccaaguuaaaggcgacagccggacacuga

SEQ ID NO: 55673 - RNA, 564 nt, Artificial Sequence
  derived and/or modified sequence opt3 from EID1__Homo_sapiens__NP_055150
augagcgagauggccgaacuguccgagcucuacgaagagucuucagaccuucagauggaugugaugcccggcgaaggggaccugccucaaauggaggucggaagugguagcagagaguuguccuuaaggccaucucggucgggcgcucagcagcuggaagaggaagggccgauggaggaggaagaggcacagcccauggccgcgccugaaggaaagcgcucacuagcuaacggcccaaaugccggugagcaacccgggcagguugcaggagccgauuucgaaagcgaggacgagggcgaagaguuugaugacugggaagaugacuaugauuacccugaggaggaacagcucaguggcgcuggguaucgaguguccgcagcccuggaggaagcugacaaaauguuccuucguaccagagagccagcccuggauggagguuuucagaugcacuacgaaaagacacccuucgaccaauuggcguuuaucgaggaacucuucucucugaugguagugaacaggcugacugaggagcucggcugcgaugaaauuauagaccgggaguga

SEQ ID NO: 55674 - RNA, 498 nt, Artificial Sequence
  derived and/or modified sequence opt3 from EIF1AD__Homo_sapiens__NP_001229411
augagccaggccaccaagagaaaacacguggucaaggagguucugggcgaacauaucgugcccuccgaccaacagcagauuguaagggugcuccggacaccugggaacaaucuucacgaggucgaaacugcucagggacaacgcuuccuggugucuaugccaucaaaauaccgaaagaacauauggaucaaacguggugacuuuuugauuguugauccgaucgaggaaggcgagaaggugaaggcagagauuaguuucgucuuaugcaaagaucaugugagaagccugcagaaggaaggguuuuggcccgaggccuucuccgaaguagcggagaaacacaauaacaggaaucggcagacgcagccugagcuaccagcugaaccccaacucucuggagaggaaucgucaagcgaggacgauagugaccuguuuguuaacaccaaucgcagacaguaucaugaauccgaggaggaaucugaggaagaggaagccgcauga

SEQ ID NO: 55675 - RNA, 435 nt, Artificial Sequence
  derived and/or modified sequence opt3 from EIF1AX__Homo_sapiens__NP_001403
augcccaagaacaaaggcaaagggggaaagaauagaaggcgggguaagaacgagaaugaaagcgagaaacgcgaacugguguucaaggaggacggccaggaauacgcccaagucaucaagaugcucgggaacggacgacuugaggcuaugugcuuugauggcguuaaacgucugugucacauuagagguaaguugaggaaaaagguguggauaaauaccuccgacaucauuuuaguagggcugcgggauuaucaggacaacaaagcagaugugauccuaaaguacaaugccgacgaggcgcgcucucucaaggcuuauggagaacugccugagcaugccaaaauuaacgaaacagauacuuucggcccaggcgacgaugacgagauccaguuugaugacauaggggaugacgacgaggauaucgacgauauuuga

SEQ ID NO: 55676 - RNA, 384 nt, Artificial Sequence
  derived and/or modified sequence opt3 from EIF1AY__Homo_sapiens__NP_001265541
augcccaagaacaaaggcaaagggggaaagaauagaaggcgggguaagaacgagaaugaaagcgagaaacgcgaacugguguucaaggaggacggccaggaauacgcccaagucaucaagaugcucgggaacggacgacuugaggcucugugcuuugauggcguuaaacguuugugucacauuagagguaaguuaaggaaaaaggacaauaaagcagaugugauacugaaguauaacgccgacgaggcgcggucccuaaaggcuuacggggaacucccugagcaugccaaaaucaaugaaaccgauacauucggaccaggcgacgaugacgagauucaguuugaugacaucggcgaugacgaugaggacauugacgauaucuga

SEQ ID NO: 55677 - RNA, 342 nt, Artificial Sequence
  derived and/or modified sequence opt3 from EIF1__Homo_sapiens__NP_005792
augagcgccauccagaaccugcacuccuucgaccccuuugcugaugcaucuaagggcgacgaucuccuuccugccgggaccgaggacuacauucauauaagaauccaacagaggaauggacggaaaacacugacuacggugcaggguauugcggaugacuaugauaagaaaaaguuggucaaggcuuucaaaaagaaauuugccugcaacggcaccguuaucgaacacccagaguacggggaagugauucaguuacaaggagaccagcgcaagaauaucugucaguuccugguagagauaggccuagcaaaagaugaccagcucaaggugcaugguuuuuga

SEQ ID NO: 55678 - RNA, 1758 nt, Artificial Sequence
  derived and/or modified sequence opt3 from EIF2A__Homo_sapiens__NP_114414
auggcccccagcaccccucugcucacagugagaggcuccgaggggcuuuacauggucaacggaccaccgcacuucacugaaucuacgguuuuucccagggagucagguaagaauugcaaaguguguaucuucaguaaggacggcacccuguuugcuugggggaacggagaaaaaguaaauauuauaagcgugacaaacaagggcuuguuacauuccuucgaucugcuaaaagcagucugccucgaguuuucuccuaagaauacugugcuggccaccuggcagccauauacaaccucgaaggacgguacugcggggauccccaaccuucaacuguacgauguuaaaacaggaaccuguuugaagucauucauucagaaaaagaugcagaauuggugcccuagcuggagugaagacgagacgcucugugcucggaacgugaauaacgagguccacuuuuucgaaaauaacaauuuuaacacuaucgccaauaaacugcaucugcagaagauuaacgauuucgugcucuccccaggcccccaaccuuauaagguagcaguuuacgugccaggcucuaaaggggccccgagcuuuguccgcuuauaucaguaccccaacuucgcuggaccucacgcagcccuggcuaauaaguccuuuuucaaagccgacaaggugaccaugcuuuggaacaaaaaggcgacagcaguguuggucaucgccucaacugauguugacaaaaccggugcuaguuauuacggcgagcagacacugcauuacauagccaccaauggggaaagcgcagugguacagcuaccaaagaacggacccaucuaugauguggucuggaacucuuccucaacggaguucugcgcuguguacggcuuuaugccugccaaggcgacuauuuucaaucucaaaugugacccaguuuuugauuucgguacagggccccgaaaugccgcauauuacagcccgcacggacacauccuggugcuugcuggcuuuggcaaccugcgugggcaaauggaggucugggacgugaagaauuauaaauugauuaguaagccuguagccucugauuccaccuacuucgcuuggugccccgacggagaacauauccucacugccacaugugcaccaagacugaggguuaacaaugguuauaaaauauggcacuacaccggcagcauuuuacauaaguacgacgugccuucgaacgccgagcuguggcaggucucuuggcagcccuuucucgaugggaucuucccagcuaagacgauuaccuaucaggcggugcccuccgaagucccuaaugaggaaccaaaaguggcaacagccuaccggccgcccgcccuucgcaacaagccuaucacuaauucaaaacugcacgaggaggaaccaccccaaaacaugaagccucagaguggaaacgacaaaccauugagcaagaccgcucuaaagaaucagagaaaacacgaggcaaagaaagccgcuaagcaagaagccagguccgauaaaucucccgaccuggcaccgacuccugcgccacagagcacaccccggaacaccguuucacagaguaucuccggcgauccugagauugacaagaagaucaaaaaucucaagaaaaagcugaaagcuauagaacagcuuaaggagcaagccgcaacagguaaacagcuggagaagaaccaguuggaaaagauucagaaagagaccgcccuccugcaagaauuagaggaucuggaacuagggaucuga

SEQ ID NO: 55679 - RNA, 1893 nt, Artificial Sequence
  derived and/or modified sequence opt3 from EIF2AK1__Homo_sapiens__NP_055228
augcagggcgggaacagcggagugagaaagagggaggaagagggugacggcgccggggcugucgcagcgcccccugccaucgauuucccagcugaaggaccggaccccgaguacgaugaauccgacguuccugccgagauucaagugcugaaagagccacuccagcagcccaccuuuccuuucgcaguagccaaucagcuucuguuggugucuuuacuggaacaccuaucacauguccacgagccaaacccccuccggagucgccaaguguuuaagcugcuuugccagacauucauaaaaaugggccuguugagcuccuuuacuuguucugaugaauuuucgucacuccgacugcaucacaaucgugcuaucacgcaucugaugagaagcgcaaaggagaggguucggcaggacccuugcgaggauauuagucgcauccagaaaauuagauccagggaaguggcccucgaggcucaaaccucucgguauuuaaacgaauuugaggaacuggccauccuugguaaagggggauacggccgcgucuauaaggugcgaaauaaguuggacggccaguacuaugcgauaaagaaaauccugauuaagggggcaacaaaaacuguauguaugaagguucuaagagaggugaagguccucgccggacugcagcacccaaacaucguggguuaccacaccgcuuggauugagcaugugcacgucauccagccgagggccgaucgggcagcuauagaacuucccagccuggagguuuuguccgaccaagaagaggaucgugaacagugcggcgugaaaaaugacgagucaaguucuucuuccauuaucuucgccgagccuacaccagaaaaggagaaacgcuuuggggaaucagauaccgagaaccagaauaacaagagcguaaaauauacuacaaaucucgugauuagagaaaguggagagcuggagucuaccuuagaacugcaagagaacggccucgcgggucuuuccgccagcucgaucgucgaacagcagcugcccuugaggcggaauagccaucuagaggaguccuucacgucaacugaagagaguagcgaagagaacgugaauuuucuggggcagaccgaagcacaauaccaccucaugcugcacauccagaugcagcuuugugagcuguccuugugggacuggauuguugagcgaaacaagcgcggaagagaauacguggacgagucugcuugcccuuaugucauggccaacguggcuacaaaaauauuccaggaacucguagagggcguuuucuacauccauaauaugggcauugugcacagggaucugaagccacggaacaucuucuuacaugggcccgaccaacaggucaagauaggagauuucggucuggccuguacugacauucuacagaaaaauaccgauuggacaaaccgcaauggcaagagaaccccgacgcacacuagcaggguggggacaugccucuaugcaucaccugaacagcuggagggaagugaguacgacgccaaauccgauauguauagccuuggcgucguguugcuggaacucuuucaacccuucgguaccgagauggaacgugcugagguucugacugggcuucggacaggccagcugccagaaucuuugcgaaagagauguccugugcaggcgaaauacauccagcaucucaccaggcgcaacucaagucaacggcccagcgcaauccagcuguuacaguccgagcuguuucaaaauucuggaaacguaaaucuaacgcuccagaugaagauuaucgagcaggaaaaggagauugccgaacugaaaaagcagcuuaacuugcugucgcaagacaaaggcgucagagaugacgggaaggauggaggugugggcuga

SEQ ID NO: 55680 - RNA, 1533 nt, Artificial Sequence
  derived and/or modified sequence opt3 from EIF2AK2__Homo_sapiens__NP_001129124
auggccggcgaccugagcgcuggguucuuuauggaggaacucaacaccuacagacagaagcaaggagugguccuuaaauaucaggagcugcccaauuccgguccuccacacgauaggcgguucacauuucagguuaucauugacggccgcgaguucccggaaggggaaggacgaucuaagaaagaggcaaagaacgccgcggcuaaauuggccguggagauauuaaauaaggaaaagaaagcaguaucaccccugcuacucacuacgaccaacaguagcgagggccuguccauggguaauuacaucgggcuuauuaaccguaucgcccagaagaaaagacugacagugaauuaugaacaaugcgcuucuggaguccauggcccugagggcuuucacuacaaguguaaaauggggcagaaggaguauucgauuggaacugguucaaccaagcaggaagcaaaacaguuggccgcuaagcucgccuaccugcaaauccugagcgaggaaacaagugugaaauccgauuaucucucuagcggcuccuucgcgaccacuugcgagucacagaguaacagcuuaguuacaucuacccuggcauccgaaucaagcagugagggggacuuuucugccgauacguccgagauaaauagcaacucggacucucuuaauuccucaaguuugcugaugaacggacuaaggaauaaccagcggaaggcuaaacgcagccucgccccaagauucgaucugcccgacaugaaggaaacuaaauacaccguggauaagaggaaggcagagcgggaagucaaagcucuugccaagcuggaccaugugaauaucguacacuacaacggcuguugggaugguuuugacuaugauccugagacauccgacgacucuuuggaaagcucagauuacgacccagagaacaguaaaaauuccagccgcucuaagacuaaaugccucuucauucagauggaguuuugugauaaggggacccuggaacaauggaucgagaagcgaagaggagaaaaauuagacaagguucuggcgcucgagcuuuucgaacagauuacaaaaggcguggauuauauccauucaaagaaacugauacacagggacuugaagcccaguaacauuuuucuagucgauaccaaacaggugaagaucggcgacuucgggcuggugacgagccucaagaaugauggaaaacggacucguuccaaggguacacugcgcuacaugucuccugagcaaauuucgagccaggacuauggcaaagaggucgaucuuuacgcccugggguugauccucgcagaacuguuacacguuugcgacaccgcuuucgagacuuccaaguuuuucacagaccugagagauggaaucauuucagacauauuugauaagaaagaaaagacccuacuccagaaacugcuuaguaagaaaccagaggacaggccgaacacgucugagaucuugcggacccugacaguguggaagaaaagccccgaaaagaaugagcgacauacuuguuga

SEQ ID NO: 55681 - RNA, 3351 nt, Artificial Sequence
  derived and/or modified sequence opt3 from EIF2AK3__Homo_sapiens__NP_004827
auggagagagccaucagccccggccugcucgugagggcacuucuguuguuacugcuacuccuggggcuugcugcccggaccgucgcggcuggacgcgcccgaggucugccugcaccaacagccgaagcugcauucggcuugggggccgcugccgcgccgacuuccgcaacgcguguucccgccgcuggagccguggcagcugccgagguaaccguggaagacgcggaggcccucccugcagcugccggcgaacaggagccaagaggucccgagccugaugacgaaacagagcugaggccacgggggcgcucucuggucauuauaucaacucucgauggaagaaucgcugccuuagaccccgaaaaccacggcaagaaacaaugggaucuggacgugggcagugggagccuuguuuccucuucguugucaaagccugagguguuuggaaauaaaaugauuaucccaagccuggauggugcacuauuccagugggaccaggauagggagaguauggaaaccgucccguuuacaguggagucccuccuggaaucuagcuacaaguucggcgacgauguaguucuugucgggggaaaaucccugaccacuuauggcuugucagccuacagugguaaggugcgguauauuugcagcgcucucgggugucgccagugggacucugaugagauggaacaagaggaggacauccuguuacugcagcgaacacagaagaccgugagagcggugggacccagguccggcaacgaaaaauggaauuuuucagucggccauuucgagcuccgguacauaccugacauggaaacgcgugcaggguuuaucgagagcacuuucaagccaaacgaaaauaccgaggagaguaaaauuaucucugauguugaagaacaggaagccgcuauuauggacaucgugauaaagguauccguggccgauuggaaagucauggcauuuagcaagaagggaggucaccuugagugggaauaucaauucugcacacccauugccucggcuuggcuguugaaagacggcaaggugaucccuauuucucuauuugaugacacuuccuacaccucaaacgaugacguucuggaggaugaggaagacaucguggaggccgcacgcggggcgacagaaaauagugucuaucucggaauguacagaggccagcuguaccuucagagcuccgugaggaucucugagaaauucccaagcucacccaaggcucuggagaguguaaccaacgaaaaugccauuauaccguugccuacgaucaaauggaagccccucauucauuccccaagccggacuccuguucugguggguucugaugaguuugacaaauguuuaucaaacgacaaguucagucacgaagaguauagcaauggggcacuguccauccuacaguaccccuaugauaacggcuacuaucucccauacuauaagcgagaacgcaauaaaagaucuacacaaauaaccgucagguuccuggacaacccccauuacaauaagaacauucggaaaaaggauccugugcuuuugcugcacugguggaaagagaucgucgccacuauccucuuuugcauuaucgcuacaaccuucauugugcgcagacuguuucacccacauccgcacaggcagcguaaggagucggaaacgcagugucaaaccgagaacaaguacgacagcguuuccggagaagccaaugauucaaguuggaacgacaucaaaaauucuggcuauauaagccgguaccuuacagauuucgagcccauucagugccuggggcgaggagguuuuggcgugguauucgaagcaaagaacaaagucgacgauuguaauuaugcuaucaagagaaucagguugccuaaccgcgagcucgcccgggagaaagugaugagagaaguuaaggcgcuggccaaguuagagcauccagggauugugagguacuuuaaugcuuggcuggaagcacccccugagaaauggcaggaaaagauggacgagauauggcuaaaagaugaguccacugacuggccacucucaagccccucuccgauggaugccccuuccgucaagauccgccgaauggacccauucgcuaccaaagaacacauugagaucauugcccccaguccucagcggagccguucuuuuuccgugggaaucucaugcgaccaaacaaguagcucggaaucccaguucucuccccuggaguuuagcggcauggaucacgaggacauaucagaaaguguagaugcagcguauaaccuucaggacuccuguuugacugauugcgacguggaggaugguaccauggacgggaaugaugaaggccauucuuucgagcuguguccaagcgaagccuccccuuacguuagaucaagggagcgcacaagcaguucuaucgucuuugaggacuccggaugcgauaacgcuagcucgaaggaggagcccaagaccaaucggcuccacauuggcaaccauugcgccaauaaacugacugcauucaagccaacgucaucuaaaaguuccagcgaagcuacauuaucuaucagcccgccuagacccaccacucugucccuugacuugaccaagaacacaaccgagaaacuccagccaucaagucccaagguguaucuguacauucaaaugcagcuauguaggaaagaaaaucugaaggauuggaugaacgggcgaugcacuaucgaggagcgcgaacggagcgugugucuccacauauuccugcagauugccgaggcagucgaauuucuucauucuaagggauugaugcacagagaccugaaaccuuccaacaucuucuuuacaauggacgauguugugaaggugggugacuucggcuuaguaacggccauggaucaggacgaggaggaacaaaccguccucacuccaaugcccgcuuacgcgaggcacacaggacagguggggaccaaacuguauaugucaccugagcagauucauggcaauaguuacagccacaagguugauaucuuuucccuuggucugauauuguucgaacuccuguauccguuuucuacacagauggagcgugugcgcacucuaaccgacguccggaaccugaaauucccaccccucuuuacgcaaaaguacccuugcgaauaugugaugguucaggauaugcugucgccaagccccauggagagaccugaggccaucaauauuaucgaaaacgcaguguucgaggaccuugauuuuccggggaagaccguauugaggcagcgaucacggucccugaguucuagcggcacaaaacauucccgccaaucaaauaacucucacagccccuuaccaaguaauuga

SEQ ID NO: 55682 - RNA, 4950 nt, Artificial Sequence
  derived and/or modified sequence opt3 from EIF2AK4__Homo_sapiens__NP_001013725
auggccggcgggagaggagcucccgguaggggccgggacgagccuccagaaagcuacccgcagcgccaagaucacgagcugcaggcacucgaagccaucuauggggcggacuuccaggaucuucgacccgacgcuugcggaccugugaaggagccacccgaaauuaaccuggucuuguacccucagggcuuaaccggugaggagguuuaugugaaaguagaucugcgugugaaguguccacccacauacccugacgucgugccagaaauagagcuaaagaaugccaaggggcucuccaacgaaucuguuaaucugcuuaaaucaagacuggaggaguuggcaaagaagcauugcggagaagugaugaucuuugagcucgccuaucacguccaaaguuuccugagcgaacauaacaaaccgcccccuaaguccuuucacgaggaaaugcuggagaggcgggcucaggaggaacagcagcgccucuuagaggcaaaaagaaaggaagaacaagaacagagggagauucugcaugagauccagcggcgcaaagaagagauuaaggaagagaagaaacgaaaggaaauggccaaacaggagagacuugagaucgcuucuuugucgaaucaagaucacacuucaaagaaagacccaggcggccacaggacggccgcgauacugcaugggggaagccccgauuucguggguaacggcaagcaccgggcaaauaguuccgggcguucucgcagagaaaggcaguacagcguauguaacuccgaggacucaccuggaaguugcgaaauccuauauuuuaauaugggcagcccagaucagcucaugguucauaaagguaaguguauugggucugacgagcaacugggaaaacuuguguacaacgcccuggagaccgcuacaggcggcuucgucuugcucuacgaaugggugcugcaguggcagaaaaagauggggcccuuuuuaacuucccaggagaaagaaaagaucgauaaaugcaagaagcaaauucagggaaccgagacagaguucaauucacuggugaaacucagccacccgaacgucguucgguaucuugccaugaaucugaaggagcaggacgacaguaucgugguagauauauugguggagcacauuucuggugucucccuagcagcucaucugagccacucgggcccuauccccgugcaucagcuccgacgcuacaccgcccaacugcuuucugggcuggacuauuugcacuccaacucaguugugcauaaaguccucagugcgagcaaugugcugguagaugccgaaggaacuguuaagauuacagacuacuccaucucuaaaagauuagcagauaucuguaaggaggacguguuugaacagaccaggguccgguucagcgauaacgcucugccauauaagacgggcaaaaagggugacguguggcgccuagggcuccugcuuuugucacugagucagggccaggagugcggagaauacccugucacuauucccuccgaucucccagccgacuuucaagauuuccugaaaaagugugugugccuugacgacaaagagagauggagcccccagcagcuguugaagcacucuuuuauaaacccucagccaaagaugccgcucguugagcaaucacccgaagauagugagggccaggacuauguggaaaccguaaucccuagcaauaggcugccauccgcugccuucuucucugagacacagcgucaauuuucgcgguacuucauugaauuugaggaguuacagcugcuagggaaaggagcauucggugccgucaucaaggugcagaacaaacucgauggcuguugcuacgcuguuaagcgaauacccauuaauccugcgagcagacaguuuaggcgcaucaaaggggaagugacucugcuuucccgguugcaccaugagaacaucgucagauauuacaaugcauggauugaaaggcacgagcgcccagccggacccggcaccccgccuccagacucagguccccuggcuaaggaugaccgagccgcacgggggcaaccugccagugauacagacggccucgauucuguggaggcugccgcacccccaccuauccugagcuccucaguagaauggagcaccucuggagagcguuccgcgagugcuagauuccccgccacgggcccagggagcucugacgaugaagacgaugacgaggacgaacauggagguguguuuucccagucauucuuaccggcaagugauagcgagucggacauuauauuugauaacgaggacgaaaauuccaaaucucagaaccaggaugaggacugcaaugaaaagaacggcugucacgagagcgaaccuucaguuacuacagaggccguccacuaucuguacauccaaauggaguauugcgaaaagaguacccuuagggauacuauugaccagggguuguaccgcgauacagugcggcucuggagacuguucagggagauccuagacggacuggcuuauauccaugaaaaaggcaugauucaccgagaucucaagcccgugaauauauuucuggacuccgaugaccaugucaaaaucggugacuucgggcuugccaccgaucacuuggcauuuucugcugacagcaagcaggaugaccagacgggcgaucugauuaaauccgacccaucaggacauuuaaccggcaugguugggacagcccucuacgugagccccgaggugcaaggaaguacuaagucugcguacaaccagaagguagaucuguucucccuuggcaucauuuucuuugaaaugagcuaucacccuauggucaccgccucggagcgcaucuucgugcugaaucaguugcgggacccaacaucacccaaauuuccugaggauuucgacgauggugaacacgcuaagcaaaaaucuguuauaaguuggcuccugaaccaugacccggcaaagagaccaacugccaccgagcuacugaaauccgaacuccugcccccuccacagauggaggagagcgaacuucacgagguguugcaucacacacugaccaaugucgacgggaaggcuuacaggacuaugauggcccagaucuuuucucagcguauuagccccgcaaucgauuauacguacgacuccgauauuuuaaagggaaacuucucaauccgcacagcgaaaaugcaacagcaugugugugaaaccauaauucggaucuuuaagagacacggcgccguucagcucugcacuccucugcuucugccgaggaaccgacagauuuaugagcacaaugaagcugcccuauucauggaccauagugguaugcucgugaugcugcccuuugauuugcggaucccauucgcacgcuacguagcuagaaacaauauacugaacuuaaaaagguauuguaucgagcgggucuuucgaccuagaaagcucgaccgcuuccaccccaaagagcugcuugaaugcgccuuugauauugugaccagcacaaccaauucuuuccugccaacugcagagaucauuuacacaaucuacgaaauaauucaagaguucccugccuugcaggaaaggaacuauuccaucuaccucaaucauacgaugcugcuaaaggcuauccugcuucacuguggcauucccgaggacaagcucucacagguguauaucauucuguacgaugcggucaccgagaaauugacucgucgggaaguugaggccaaguuuugcaaccugaguuuaagcuccaauucucucuguagacuguauaaauucauagaacagaagggggaccuucaagaucugaugccaacaaucaacucguugauuaaacagaagaccggaaucgcacagcucgugaaauacggccugaaggaccuagaggaaguaguggggcugcuuaagaaacucggaauuaagcugcaggucuugaucaauuuaggccugguguauaaaguucaacagcacaacgguauaaucuuucaguucguggcuuuuauuaagaggcgccaacgagccgucccggagauccucgccgcugggggaagauacgaucugcuuauuccucaguuccggggcccccaggcacuggguccagugcccacagccaucggcguuagcauagcgauugacaaaaucucagcugccguguugaauauggaggaauccgucacuaucaguucuugcgaccuacugguagugagcguugggcagauguccaugucaagggcaauuaaccucacccaaaagcuguggacggccggaauaaccgcugagaucauguacgauuggucucagagccaggaggaacuucaggaguauugucgccaucacgaaauuacauacguggcauuagucagugacaaggagggcucccaugugaaaguaaagagcuuugaaaaagagcgucaaacugaaaagagagugcuggagaccgagcucgucgaucacguuuugcagaaacugcggacaaaggugacugacgaaaggaaugggcgcgaggccucugauaaccucgcggugcagaaccugaagggaucauucuccaaugcuaguggccuuuuugaaauccauggugccaccgucgugccuauuguuagcguacuggcaccagagaaauugucggccucuacgcgaagacgguaugaaacacaggugcaaaccaggcuacagacuucccuggcuaaccuccaccaaaagagcucagagaucgagauauuagccgucgaccugcccaaagaaacaauccuucaguuccugagucucgagugggaugcagacgaacaggcuuuuaauaccacugugaagcaguugcugucucgccucccuaaacagagauaccugaaacuuguuugcgaugagauuuauaacaucaagguggaaaagaaggucuccgugcuauuccuguacagcuauagggacgauuacuaccggauuuuguucuga

SEQ ID NO: 55683 - RNA, 918 nt, Artificial Sequence
  derived and/or modified sequence opt3 from EIF2B1__Homo_sapiens__NP_001405
auggacgauaaggagcugaucgaauacuucaaaagccagaugaaggaggaccccgauauggccuccgcuguggcagccauuagaacccuccuugaauuucugaaaagggacaagggcgagacaauacaaggguugcgggcgaacuuaacuucugcuaucgaaacgcugugcggagucgauucaaguguugccgugagcuccgguggcgagcuauuccuccgcuuuauuucucuggcaucgcuugaguauucagacuacagcaaauguaagaagaucaugauugaacgaggggagcuguucuugcguagaaucagucucuccaggaauaaaauagccgaucugugccacaccuuuaucaaggacggagcuacaauucugacucaugcauauucucggguagugcuccgcgucuuagaagccgcuguggccgcgaaaaagagauucagcguuuacgugaccgagucccagccugaucugucaggcaaaaagauggcaaaggcccuuugucacuugaacgucccagugacaguaguucuggacgcugccguggguuauaucauggagaaagcagaucuagucauugugggggcugaaggaguggucgagaauggcggcaucauaaacaagauugggaccaaucagauggccguuugcgcgaaagcccagaacaagccguuuuacgugguagcagaaaguuucaaauuugugaggcuuuucccccugaaucaacaggacgucccugauaaguuuaaauauaaggcugacacucuuaagguggcccagacaggacaggaccugaaagaggaacauccauggguugauuacaccgcucccagcuugaucacgcuccuguucacugacuuaggugugcugaccccuucugccgucuccgaugagcucauuaagcucuaccuguga

SEQ ID NO: 55684 - RNA, 1056 nt, Artificial Sequence
  derived and/or modified sequence opt3 from EIF2B2__Homo_sapiens__NP_055054
augcccggcagcgccgcuaagggguccgagcugucugaaagaaucgagucauucguggaaacccucaaaaggggagguggcccucggaguagcgaggaaauggcacgcgagacacuugggcuguugcgacagauuauaacugaccaccguugguccaacgccggagaguuaauggaacugaucagaagggagggccggcgcaugacggcggcucaaccaucugaaaccacagucgguaauaugguuagaagggugcuaaagauuauccgggaggaguacgggcgccuccauggacgaucggaugaaucagaccagcaggagagccugcacaaacuucugaccaguggcggcuugaacgaagauuuuuccuuccauuaugcccagcuccaaucuaauauuaucgaggcaauaaacgaacugcugguagagcucgaggggaccauggaaaauaucgccgcucaggcauuagagcacauucauagcaacgaagugaucaugacaauuggauuuuccagaaccgucgaggccuuccugaaggaagcugccaggaaacggaaguuucacgugaucguugcggagugcgcaccguucugucagggucacgagauggccgugaaucuuucaaaggcuggcauagaaacuacagucaugaccgacgccgcaauuuuugcugugaugagucguguaaacaaaguuaucauugggacgaagacuaucuuggccaauggagcgcugcgcgccgugaccggcacacauacucuagcacucgcugccaaacaccauagcacuccccugaucgucugcgcuccuauguucaaacuuucuccacaguuucccaacgaggaagauuccuuccacaaguuuguggccccugaggaagugcugccauucacagagggugacauuuuggagaaggucucaguucacugucccguguuugauuacguaccuccagaacucauaacccuguucaucagcaauauugggggaaacgcaccgaguuauaucuacagauuaaugucugagcuguaucaucccgacgaucacgugcucuga

SEQ ID NO: 55685 - RNA, 1269 nt, Artificial Sequence
  derived and/or modified sequence opt3 from EIF2B3__Homo_sapiens__XP_011540698
auggaguuccaggccguggucauggcuguuggcgggggaagcagaaugaccgaccugacauccucuauccccaagccucuccuuccaguggguaacaaaccgcugauuugguaccccuugaauuuacuggaaaggguaggcuuugaggaagugauagucgugacuacgcgggauguucaaaaggcacuaugcgccgaguucaaaaugaagaugaaaccugacaucguguguauuccagaugacgcggauauggggaccgcugacucacuccgcuauaucuaccccaagcugaagacagauguccuugugcugaguugcgacuugauuacugauguagcccuccacgaaguuguggaccuguuucgagcauaugaugccagccuggcuaugcucaugcguaaaggacaggacuccaucgagccugucccaggccagaaggguaaaaagaaagcaguggagcagagagauuucauagggguggacucuaccggaaagagguuacuguuuauggccaacgaagcugaccuugaugaggaauuggucaucaagggcucgauucugcaaaaaucaaucacaagcauucggagugagcuaauccccuaccucguucgcaagcaguucuccucugccagcucccagcagggccaagaggaaaaagaggaagaccugaagaaaaaggagcuuaaaucacuggauauauauaguuuuauuaaggaagcgaauaccuugaaccucgcaccuuacgacgccuguuggaaugcuugcagaggggauaggugggaggaccugagccggucucaggugcgcuguuauguacauaucaugaaggagggauuaugcucccgagugucaacucugggucucuacauggaagccaacagacaggucccaaaacuucugagcgcauuguguccggaggaacccccugugcacaguucugcucagauuguuuccaagcaucuagugggcgucgauagccugaucgggccagagacacaaaucggagaaaaaucgucuauuaagagguccgugauaggcucaaguugccucaucaaagaccggguaaccauuacgaauugucugcuuaugaacagcguuacuguggaggaggguuccaauauccaggggucugucauaugcaacaaugccgugauugaaaagggagcggauaucaaggacugucugaucggcagcggccagcguauugaggccaaagcaaagcgcgucaacgaagugaucguugggaaugaucaauugauggagauuuga

SEQ ID NO: 55686 - RNA, 1572 nt, Artificial Sequence
  derived and/or modified sequence opt3 from EIF2B4__Homo_sapiens__NP_001029288
auggccgcuguggcagucgccguuagagaggacagcggcuccgggaugaaggcggaacugcccccuggaccaggugcugugggcagggagaugaccaaagaagagaagcuccagcuucggaaagaaaagaaacaacagaagaagaaacgcaaggaggagaaaggggccgaaccggagacaggaucugcaguaucagccgcucagugccaggugggccccacucgagaacugccugagagugguauccaauuggggacgccacgugagaagguccccgcaggaagaagcaaagccgaauuaagggcugagcggcgcgccaagcaggaagcggagagagcacugaagcaggccaggaaaggcgaacagggcgggccuccacccaaggcuuccccuucuaccgccggagagacaccaucgggugugaaacggcuaccggaguacccccaaguugaugaccuccugcuucgccgacuggugaagaaaccugaaagacagcaggucccaacuaggaaggauuauggcucaaaagugagcuuguucagucaccucccccaguacucccggcaaaacucucugacccaguuuaugagcauuccuuccucaguaauacauccagcaaugguucgucuggggcuccaguauagucaaggauuagugagcggcucuaaugcucgcuguaucgcccugcuuagagcguugcagcaggucauucaggacuacacaacucccccgaacgaggaacuguccagggaucuagugaauaagcucaagccuuauaugucauuccugacccaaugccggccccuuagcgccaguaugcacaacgcaaucaaauuucugaauaaggagauuacaucuguggguuccagcaaacgagaagaggaggcuaagucggaauugcgcgccgcuaucgacagauacguccaggagaaaauaguucucgccgcacaggccaucucuagguucgcuuaucagaagauuuccaacggggaugugauccugguauacggauguucaaguuuagugagccggauucugcaagaagcguggaccgagggccgcagauuuagggucgugguuguggacucccguccauggcucgaaggccggcauacgcuucgaucucugguccacgcaggggugccugccagcuacuugcuaauccccgcugccucauauguacugccagagguuaguaaggugcuccugggagcacaugcccuucuggcuaaugguuccgucaugagcagagugggcacugcccaguuggcacucgucgcgagggcucacaacgugcccguucuggugugcugugagaccuacaaauucugcgaacgcguacagacagaugccuuugucucuaaugaguuagacgauccugacgaucugcaguguaagagaggggaacacguggcacuagccaacuggcaaaaucaugcuucacuccggcugcuuaacuugguuuaugacgugacuccaccggagcuggucgaccucgugauaaccgagcugggaaugauucccugcaguagcguaccugugguucuuagggucaaauccucugaucaguga

SEQ ID NO: 55687 - RNA, 2166 nt, Artificial Sequence
  derived and/or modified sequence opt3 from EIF2B5__Homo_sapiens__NP_003898
auggccgcucccguggucgcaccuccaggcguugugguaagcagagccaacaagagguccggggcgggaccggguggcucugggggaggcggugcucgcggggccgaggaggaacccccuccaccccugcaggcagugcucgucgccgacucauucgaucggcgauuuuucccuaucaguaaagaccaaccacgugugcuucugcccuuggcuaauguugcauuaauugauuacacccuggaauuucuaacagccacuggagugcaggagacguucgucuuuugcuguuggaaggcugcccagauaaaagaacaccuccuuaagagcaaauggugcagaccuaccucccuuaacgugguaaggaucauuacaucugagcuguaucggucguugggcgacguucuccgcgauguggacgcgaaggcacuggucagaucagauuuccugcucguguacggcgacgugaucagcaauauuaacaucacuagggccuuagaggaacaucggcugcgccgaaagcuggagaaaaaugucaguguuaugaccaugauauuuaaggaauccucuccaagccacccgacaagaugucaugaggauaacgugguaguggcugucgacuccaccacuaauaggguguugcacuuccagaaaacacaagggcugcggcguuuugccuucccccuaucacucuuucagggaaguagcgaugguguugaggugcgcuaugaccugcuugauugccauaucucuauuuguuccccucaggucgcacagcuguucaccgacaacuuugacuaccaaacgagagaugacuucgugaggggcuugcucguaaaugaagagauccuggggaaccagauucacaugcacguuacugcuaaggaauauggagcccgggugucaaauuuacauauguacagcgcggucugcgccgaugugauccgacgcugggucuauccacugacccccgaggcaaacuucacagacaguacuacccagucuuguacacacuccagacauaauauauacaggggcccugaagugagccucggucacgggucgauucuugaggagaacguucuguugggaucuggcaccgugaucggcuccaauugcuuuauuacgaacucaguaaucgggccaggaugucacaucggugauaacgucgugcuagaccagacuuaccuguggcaaggcguucggguggcugccggggcucagauucaucagagucuccugugcgauaaugccgaagucaaagagcgcgugacacuuaagcccagaagcguacugaccucccaagugguugucggaccgaacauaacuuugccugaaggcucugugaucagccuccaucccccagacgcagaggaagaugaggacgauggugaguucucagacgacaguggggccgaucaggaaaaggacaaagugaagaugaaaggcuauaauccugcugaggucggagcggcaggcaagggguaccuguggaaagccgcuggaaugaacauggaagaggaagaggaguuacagcagaaucuguggggucuaaagauuaacauggaagaggaauccgagagcgagucugaacaaucaauggauagugaggaacccgacagcaggggcggguccccacagauggaugacaucaaaguuuuucagaaugaggugcucggaacacugcagcguggcaaggaagagaacauaucuugugauaaucuuguguuggagauuaacucgcugaaguaugccuacaauaucagccucaaagaaguaaugcaaguccugucccacgugguucuugaguucccccugcagcagauggacucaccuuuggauaguucucgguauugcgcacuccuguuaccacugcuaaaggccuggagcccgguguuucgaaacuacaucaaaagagcugccgaccaccucgaagcacuggcggcuauugaggauuucuuucuugaacaugaggccuuggguaucuccauggcaaagguccugauggccuucuaucagcucgagauucuggcugaagagaccauauuaucaugguuuagccaaagggacacgaccgauaaagggcagcagcugcgcaagaaucagcaacuucagcgguucauccagugguugaaggaagccgaggaagagucuuccgaggacgacuga

SEQ ID NO: 55688 - RNA, 948 nt, Artificial Sequence
  derived and/or modified sequence opt3 from EIF2S1__Homo_sapiens__NP_004085
augcccggccugagcugcagauucuaccagcacaaguuuccugagguggaagacgucguuauggugaacguaagguccaucgccgagaugggggcuuaugugucucuccuugaauacaauaacauugagggaaugauacuguugucagaauuaagucggcgccgaauccguagcauuaauaaacugaucagaauugguaggaacgagugugucgugguuauccggguggauaaggagaaaggcuauauagaccuauccaagcgcagagucucuccagaagaggcaaucaaaugcgaagauaaguucaccaagucgaaaacaguguacucaauucucaggcauguagccgagguucuggaguauacuaaggacgaacaacuugagagccuguuucagcggacggcguggguguucgaugacaaauacaagcgcccgggguauggagcuuacgaugccuuuaaacacgcagucagugaccccuccaucuuggauucucucgaccugaaugaagaugagcgagaagugcugauuaacaauaucaacagaaggcucaccccucaggccgugaagauacgggcugacauugaggucgcauguuacggcuaugaggguaucgaugccguuaaggaggcuuuacgugccgggcugaauugcagcacagaaaacaugccaauuaaaaucaaucuuaucgcgcccccucgcuacgugaugacuaccacaaccuuggaaagaacugagggacuguccguacuaucacaggcaauggccgugauuaaggagaaaauagaagagaagaggggcgucuucaacgugcaaauggaaccaaaaguugugacagacaccgacgagacggaacucgcucggcagauggagcgacuggaacgcgagaaugccgaggucgauggcgacgaugacgcagaagagauggaagcuaaggccgaggauuga

SEQ ID NO: 55689 - RNA, 1002 nt, Artificial Sequence
  derived and/or modified sequence opt3 from EIF2S2__Homo_sapiens__NP_003899
augagcggcgacgagaugaucuucgaucccaccauguccaagaaaaagaaaaagaaaaagaagccuuuuaugcuggacgaagagggggauacacagacugaagagacgcaaccaucugaaaccaaagagguggagccggaacccacagaggacaaggaucucgaagccgacgaggaggauacuaggaaaaaggacgcuucagaugaccuugaugaccugaacuucuuuaaucagaaaaagaagaaaaagaaaaccaagaaaauuuucgauauagacgaagcagaggaaggagucaaggacuugaaaaucgagagugauguucaggaaccuacagagccagaggacgauuuagacauuaugcuggguaacaagaagaaaaagaaaaagaaugugaaauuucccgaugaagacgagauccuagaaaaggaugaggcccucgaagacgaggauaacaagaaagacgauggcauuagcuucuccaaucagaccgggccugcgugggcuggaucugagagagacuacacuuaugaggaacugcuuaaccggguauuuaauaucaugcgcgaaaagaacccagacaugguggccggcgagaaacgaaaguucgucaugaaacccccucaagugguucguguggguacaaagaagaccucguuugucaauuucacggauauaugcaaacuguugcacagacagccaaagcaucuccuggcauuucugcucgccgaauuagggacuucaggaagcaucgacggcaacaaucagcuggugauuaaaggcagguuccagcaaaagcagaucgagaacguacuucggcgcuacauuaaagaguauguuaccugucacacaugcagaaguccggauacuaucuugcagaaggacaccaggcuguacuuucuacagugugaaacaugccauucccgguguucuguggcuagcauaaagaccggguuccaagcagucacgggaaaacgcgcccagcuccgagcuaaggccaauuga

SEQ ID NO: 55690 - RNA, 1419 nt, Artificial Sequence
  derived and/or modified sequence opt3 from EIF2S3__Homo_sapiens__NP_001406
auggccggcggggaggcuggagugacccugggucagccccaccucagcagacaagaccuuacaacucuggaugucacgaaguugaccccuuuaucccaugaaguuaucucuaggcaggcaacaauuaacauaggcacuaucgggcacguggcccauggaaaaucaaccguagugaaggcgauuaguggcguccacacagugcgguucaaaaaugagcuggaacgcaacaucaccauuaagcuagguuacgcuaaugccaaaaucuauaagcucgacgauccaagcugcccgcgacccgaguguuaccguuccugcgggucuucgacuccugacgaauuuccaacagauauacccggaaccaagggcaacuucaaacugguuagacaugugucauuugucgacuguccuggccacgauauccuuauggcaacgaugcugaauggggccgcugugauggacgcagccuugcuccugauugcuggaaacgagagcugcccacagccccagaccagugagcaccuggccgcgaucgaaauuaugaagcucaaacauaucuuaauacugcaaaauaagauugaucuuguaaaagagucccaggcaaaggaacaguaugagcagaucuuggccuucguucaagguacuguggcugagggcgccccuauuaucccaaucucugcacagcugaaguacaacauugaagucgugugugaguauauagugaaaaagaucccgguucccccuagggacuuuacaagcgaaccacggcuaauugucauccgcuccuucgaugugaauaaacccgggugcgagguagacgaucucaagggaggcguggcuggugggucaauacugaaaggaguccuuaaggugggccaggaaauugagguuagaccuggcaucgugaguaaagacagcgaggggaagcugauguguaagccaaucuuuucuaaaauugucuccuuguucgccgaacacaacgaccuccaguacgcggcccccggaggucugaucggcguggggacuaagauugauccgaccuuaugcagggcagaccggaugguaggacaaguucugggcgcugugggugcccucccugagauauuuacagaacuugagaucucauauuuccuguugcgccgacuacugggggucagaaccgaaggcgauaaaaaggcugccaaagugcagaagcucagcaagaaugagguccugauggugaacauuggaagucuuucuacgggcgggaggguuuccgcagugaaagccgaccugggaaagaucguauugacuaaucccgucuguacagaggugggugagaaaaucgcucucagccggcguguugaaaagcauuggcgccugauuggcugggggcagauaagaaggggagugaccaucaaaccaacugucgaugacgauuga

SEQ ID NO: 55691 - RNA, 4149 nt, Artificial Sequence
  derived and/or modified sequence opt3 from EIF3A__Homo_sapiens__NP_003741
augcccgccuacuuccagagaccugagaacgcucugaagagggcaaaugaauuucucgaggugggcaaaaagcaaccagcccuugacguccuguaugauguuaugaaaagcaagaaacaccggaccuggcagaagauccaugaaccgauuauguugaaguacuuagagcugugcguggaccuacgcaaaucccaccucgcgaaggaagggcuguaucaguacaaaaacauaugucagcaaguaaauaucaagucucuugaggaugugguccgagcuuaucugaaaauggccgaggaaaagacagaggcagccaaggaagagucacagcagaugguguuggacauugaggaucucgacaacauccagacucccgaaaguguucugcugagcgcuguguccggagaggauacgcaagaccguaccgauagacucuuacugacaccuugggucaaauuccuuugggaaucuuacaggcagugcuuggaccugcuacggaauaacucgcgcguggagagacucuaucaugauauugcacagcaggccuuuaaguucugucugcaauacacuaggaaagcugaauuucggaaacuuugcgacaaucugcgcaugcacuugucacagauccagcgacaucacaaccaaagcaccgccauaaaucucaacaauccagagagucaguccaugcaccuggagacaagauuaguacagcuggauucugcgaucagcauggaacucuggcaggaggcauucaaagccguugaagacauucauggucuguuuucccuuucaaagaaacccccuaagccacaauugauggcuaacuacuauaauaaggugaguaccgucuucuggaaaagcggcaacgcccuauuucacgcaucuacucugcauaggcucuaccaccugucccgggagaugcguaagaaucuuacacaggacgaaaugcagcgcaugucaaccagagugcuguuggcuacgcucagcauccccauuacuccugagaggaccgauaucgcccggcuguuagacauggaugggauaauuguggagaaacagcgacgccuggcgacacuacucggacugcaagccccaccgacuagaaucggccuuauuaacgacauggucagguucaacguuuugcaguaugugguacccgaagugaaggaucuguacaauuggcucgaggucgaauuuaacccucugaaacuuugugagcgggugaccaagguucugaauugggugcgcgaacagccagagaaggagcccgaauugcagcaauaugucccucagcuccagaacaauacaauccugagauuacugcagcaagugagucagaucuaccagucuauugaguucuccaggcuaaccagccucguaccauuuguugacgcauuccaacuggaacgugcuauaguggaugccgcucggcacugcgaccuucagguccgaaucgaucauacgucgagaacuuugucuuucgguuccgaccugaacuaugccacaagggaggaugcacccauugggccgcaccuccagucaaugccuagugagcagauccgcaaucaacugaccgccaugagcuccguguuagcuaaagcgcuggaagucauaaagcccgcacauauucuucaggagaaagaagaacagcaccaguuggccgugacugcuuaccucaagaacucucggaaagaacaucaaagaauccuggccaggcgccagacaaucgaggagcgaaaggaacggcuagagagccugaauauucagcgugaaaaggaggaacucgagcagagagaggcagaacugcaaaaaguuaggaaggccgaggaagaacgccuucggcaggaagcuaaagagagagagaaggaaaggaucuugcaggagcacgaacaaauuaaaaagaagaccgugcgagagcgccuggagcagauaaagaagacggaauuaggagccaaagcauuuaaggacaucgacauugaggaucucgaggagcuggacccagauuucaucauggcgaaacagguagaacagcuugagaaggagaaaaaggaacugcaagagcgguugaagaaccaggagaaaaagaucgacuacuuugagagagcuaaaaggcucgaagagauuccucugauaaagucagccuaugaggaacagcguaucaaagauauggaccuaugggagcagcaagaagaggaacgcauuaccacaaugcagcuggagcgggagaaggcacucgaacacaagaauagaaugaguaggaugcuggaggaucgagaccuuuucgucaugcgguugaaagccgcucgccaguccguguacgaagagaagcugaaacaguuugaggaaagauuagccgaggaaaggcauaaccggcucgaggaacgaaagagacaacgcaaagaggagaggcguaucacuuauuaccgggaaaaggaggaagaggaacagagaagggcagaggagcagaugcugaaggaacgcgaggaacgagagagagcugaacgggccaaaagggaggaggaacuucgcgaguaucaggaacguguuaagaaacuggaggagguggaaagaaagaaacggcaaagggagcuagaaauugaggaacgcgagcgaagacgggaggaagagaggcgccucggcgauagcucucugucaagaaaggacaguagguggggcgaucgggacagcgaagggaccuggcguaagggacccgaggcggauuccgaauggcgccgagguccacccgagaaagaguggagaaggggcgaagggcgggacgaggaccgcucucacagaagggaugaggagcggccucgaagauugggagacgaugaagaccgcgagccaucgcugaggccggaugacgaucgggucccccguagaggcauggacgaugacagggguccucgccgggggccagaggaagaucgauucagcagaaggggagccgacgaugaccgccccuccuggcggaauacagacgaugacagaccuccacguaggaucgcugaugaggaccggggcaacuggcgccaugcagaugacgaucgacccccgagaaggggcuuagacgaagaucgggggucauggcgcacugccgacgaggauagaggaccuaggcgagguauggacgacgaucggggcccacguagagggggagcugacgaugagcgcaguucuuggaggaaugccgacgaugaccggggccccagacgcggucucgaugacgauagggggccucgacggggcauggacgaugacagaggacccaggcgcggcauggaugacgaccgugggccacggagaggaauggaugacgauagggguccucgccgaggccuggacgaugaccgggggcccuggagaaacgcagaugacgauaggauaccacgcagaggagcggaagacgaucggggcccguggaggaacauggacgaugaccgucuuagccgacgcgccgacgaugacagauuuccucggaggggugaugacucccgccccgggccauggagaccccuggugaagccuggcggauggcgggagaaagaaaaggcuagggaggaaucauggggcccaccccgagagagccguccuucugaggaaagagagugggaucgcgaaaaagagcgggacagggauaaucaggacagagaagagaacgauaaggacccggagcgcgaacgggauagggagcgagacguagacagagaagaucgguucaggcgcccacgugacgaagggggauggagacgaggucccgccgaagaguccaguagcuggagggauucuucccggcgcgacgauagagacagggaugaccggcgcagagagcgagaugacaggcgggauuugcgugaacgcagagaccucagggaugaccgggacagacgcggcccuccacugcgaucagagagggaagaggugaguagcuggcggagagcagaugaccguaaagaugaccgcguugaggaaagggaucccccucggagagucccgcccccagcucuaucgcgagacagggagcgcgaucgggacagagaaagggagggggaaaaggagaaggccuccuggcgcgcagagaaagaucgugaaucucugcggagaaccaagaaugagacagacgaagauggauggaccacugugcgaagguga

SEQ ID NO: 55692 - RNA, 2445 nt, Artificial Sequence
  derived and/or modified sequence opt3 from EIF3B__Homo_sapiens__NP_001032360
augcaggacgccgagaacguggcuguccccgaagcagccgaggaaagagcggagccuggccaacagcagccagcugccgaaccgcccccugcagaggggcugcucaggccagccggacccggugcuccugaggcagccggcaccgaagcuagcuccgaggaaguugggaucgccgaggcgggaccagagucugaagugcggacagagcccgcagccgaagcugaggccgcaucaggcccuagugaaagcccauccccgcccgcugccgaggagcuuccugguucucacgcggaaccacccguaccugcccagggggaggcaccaggagaacaagcucgcgaugagcgaucggacucacgugcccaggcugugagcgaagaugccggcggcaaugaggggagagcagccgaggcugaacccagggcgcuggagaacggagacgcagaugaaccgaguuucuccgacccugaggauuuugucgacgaugugucugaagaggaguuguuaggugacguucugaaggaucggccccaggaagccgacggcauugauagcgugauagucguggacaauguaccacagguugggccugaccgccuagagaaacucaagaacgugauccauaaaauuuucuccaaguuuggaaaaaucacuaaugauuucuaccccgaagaggacggcaagacgaaggguuauauuuuucuggaguacgcuucaccagcccacgcagucgaugccgugaaaaacgcugacggguauaaacuugauaagcaacauaccuucagagugaaucuguuuacagacuucgauaaguacaugacuaucagugacgaaugggauauacccgagaaacagccuuuuaaggacuugggaaaccucagguauuggcuggaagaggccgaaugccgggaucaguacagcgucaucuucgagucuggcgaccgcaccuccaucuuuuggaaugacguuaaggauccagugucaauugaggaacgagcaagauggacagagaccuauguaagguggagcccgaaaggcacuuaccuggcgacauuccaccagcgggggauugcucucuggggaggugaaaaguuuaaacaaauccagcguuucagucaucagggcgugcaauuaauagacuucucucccugugagcgcuaccuggucaccuuuuccccucuuauggauacgcaggacgauccacaggccauuaucauuugggacaucuugacugggcacaagaaaagaggauuccacugcgaaagcucggcacauuggcccaucuuuaaguggucucacgauggcaaauucuuugccaggaugacccuggacacacuauccauuuaugagacuccuucaaugggucuccuggauaagaagagucuuaaaauaagcgggaucaaggacuucuccuggucuccaggcggaaacauuaucgcuuuuugggugcccgaggauaaagacauaccggcccggguuacccugaugcaguugccuacacgacaagaaauucgcgugagaaaucucuucaacgucguggauuguaagcugcauuggcagaaaaauggcgacuacuuaugcguaaagguugacaggaccccaaaggggacgcagggaguggucacuaacuuugagaucuuccggaugcgcgaaaaacaggugcccgucgaugugguugagaugaaggaaacaaucauugcauuugcuugggagccuaaugguagcaaauucgccgugcugcacggcgaggcgcccagaaucucaguaaguuuuuaucacgucaagaacaacgggaaaauugaacucauaaagauguucgacaagcaacaggccaauaccaucuucugguccccacagggacaguuugugguucuugcuggccugaggagcaugaacggugcauuggccuucguggauacuucugacuguacagucaugaauauugcugagcauuacauggccucagauguggaaugggacccuaccgggcguuauguagugacgaguguuagcugguggucccacaaagucgauaacgcauacuggcuauggaccuuucaaggccggcugcuccagaagaauaacaaagaccgauucugccagcugcuuuggagacccaggccaccgacacuguugucucaggagcaaaucaagcagaucaaaaaggaucucaagaaauauucgaagauuuuugagcagaaagaccgccugagccaauccaaggcgucaaaagaauuaguggagcggagaaggacuaugauggaagauuuccgcaaguaccgaaaaauggcccaggagcuguacauggaacagaagaaugagcggcuagagcuccguggaggcguggacaccgaugaacuggacaguaacgucgacgauugggaggaagagacaauagaauuuuucguuacugaggagaucauuccucuugggaaucaggaauga

SEQ ID NO: 55693 - RNA, 2742 nt, Artificial Sequence
  derived and/or modified sequence opt3 from EIF3C__Homo_sapiens__NP_001254503
augagcagauucuuuaccacaggcuccgacucugagucagaaaguagccuguccggggaggaacucgugacuaagcccgucggagguaacuacggcaaacagccucuucuguugucugaggaugaagaggacacgaagaggguugugcggucggccaaagauaagcgcuucgaggaauuaaccaaucugauccgaacaauucguaacgcuaugaaaauaagagacguaacuaagugccuagaggaauuugagcuccuggggaaggcauauggaaaagccaagucaaucguggauaaagagggcgucccaagguucuacauucggauccuugcggaccuggaagauuauuugaaugagcucugggaagacaaggaggguaaaaagaagaugaacaaaaauaacgcuaaggcccugagcacccugcgccaaaagauuagaaaguacaauagggauuuugaaagucacaucacauccuauaaacagaacccggagcagucugcagacgaggaugccgaaaagaaugaggaagacagcgagggguccucagaugaagacgaggacgaggauggagugagugcugcaaccuuccucaaaaagaaaagcgaagcccccucuggcgagucccggaaauuuuuaaagaaaauggacgaugaagacgaggauucagaagacagcgaggaugacgaggauugggacacuggcaguacaucuuccgauagcgacucggaagaggaagaggggaagcagaccgcucuggccucucgcuuccuuaaaaaggcgccuacgacugacgaggauaagaaagcagccgaaaagaaacgagaggacaaggcuaaaaagaagcaugauagaaaauccaagagguuggacgaagaggaagaggauaacgagggaggugaaugggagcggguucguggcggggugccacuggucaaagaaaagcccaaaauguuugccaagggaaccgagauaacacacgcagugguaaucaagaaacuaaaugaaauucuccaagcucgcggcaagaaagguacugacagagccgcgcagaucgagcugcuucagcuguugguucagauugccgcagagaacaaucucggggaaggagugaucgucaagauaaaauucaacauuaucgcuucacuguacgauuauaauccuaacuuagccaccuacaugaagccagagauguggggcaaaugucuggacugcauuaacgaacucauggauauccuuuuugcuaaucccaacaucuucgugggcgagaauauucuggaagagagugagaacuugcauaaugccgaccaaccucuaagggugcggggguguauacugacacucgucgaacgaauggaugaggaauuuaccaagaucaugcagaacacggacccacacagccaggaguacguugagcaucugaaggaugaagcacaggugugcgccauuaucgagcgcguacaaagauaucuugaagagaaaggaacuacagaagagguguguaggauauaccuguugcggauucuccacaccuauuacaaguucgacuauaaagcucaccagcgccagcugacuccgcccgaggguuccucuaagagcgaacaagaccaggcggagaaugaaggcgaggauucagcagucuuaauggaaagacugugcaaauacaucuaugccaaggacaggacagaucguauccggaccugugcuauucuaugccauaucuaccaccaugcccuccacagucgaugguaccaggcaagagaccugaugcuuaugucccacuugcaggauaacauucaacaugccgacccuccagugcagauacuguauaauaggacgaugguucagcucgggaucugugcuuuccgccagggacugaccaaggaugcccacaacgcacuucuggacauucaaagcucuggccgggcgaaagaguugcucggucaggggcuguuacugagaucacuacaggagaggaaucaggaacaagagaagguggaacgccgacggcagguccccuuucaucuccacaucaaccuggagcuuuuggaaugcguguaccugguaagugcuaugcuccuggagaucccuuauauggccgcacaugagagcgaugcccguagaaggaugauuuccaaacaguuccaccaccaguuacgcguuggcgaacggcaaccacugcuuggacccccggagucuaugagagaacauguggucgcugccucgaaggcaaugaaaaugggcgacuggaagacaugucacagcuuuauaaucaaugagaagaugaacgggaaagugugggauuuguucccugaggcugacaaggucaggacuaugcucgugcgaaaaauucaggaagagucccugcgcaccuaccuauuuacauauucaaguguuuacgauucuaucagcauggaaacucuguccgacauguucgagcucgaccugcccaccgugcauucaauuaucagcaagaugauaaucaaugaggaacuuauggccucuuuggaucagccaacacaaaccguagucaugcaccggacugagccuacggcgcagcagaaccuggccuuacagcucgcugaaaaacugggaucccuuguggagaacaaugaaagaguuuuugaccacaagcaagguacauauggcggguacuucagggaucagaaggacggauaccguaaaaacgagggcuauaugcgccgggguggguacagacagcagcaaagucagaccgcauauuga

SEQ ID NO: 55694 - RNA, 1338 nt, Artificial Sequence
  derived and/or modified sequence opt3 from EIF3E__Homo_sapiens__NP_001559
auggccgaguacgaccugaccacaagaaucgcucacuuccucgauaggcaucuuguguuuccccuguuggaguucuuaagcgucaaggaaauuuauaacgaaaaagagcugcuacagggcaagcucgaccugcuuuccgauacuaauaugguugacuuugcaauggauguguacaaaaaccuguauucugacgauauaccucacgccuugcgggaaaagcgcacgaccguaguggcgcaacucaaacagcugcaggcugagacagagccaaucgucaagauguucgaagacccggagacuacccgacagaugcaaucaacacgugaugggagaaugcuguuugacuaccucgccgauaagcauggauucaggcaggaauauuuagacacccuguaccgguaugcaaaauuucaguacgagugcgguaauuacaguggcgccgcugaguaucuuuacuucuuucgcguguugguucccgcaacugauagaaacgcccugagcucccuaugggggaagcucgcuucugaaauucugaugcagaauugggacgccgcgauggaggaccuuacaaggcugaaagaaaccaucgauaacaauucggugucaagcccuuugcaaagucuccagcagcggacguggcugauucacugguccuuauucgucuuuuucaaccauccaaagggacgcgacaauaucauagaucuguuucucuaucagccccaauaccuuaacgcaauccagacuauguguccucacauucugcgauauuugaccacagccgugaucacuaauaaagacguaagaaagaggcggcagguucuaaaggaucuggugaaagucauucaacaggagucuuacaccuauaaggacccaaucacagaguucguggaaugccucuacgugaacuucgauuuugacggcgcucagaaaaagcugcgugagugugaaagcguccuuguuaaugauuucuuucugguggccugcuuggaggacuucauagaaaacgcacgccucuuuauuuucgagaccuuuuguagaauccaccagugcauuuccaucaauaugcuggcugauaaauuaaacaugacgcccgaagaggccgagagguggaucguaaaccugauucggaaugcgcgacuagacgccaagauagacucaaaacucggucauguggucauggggaacaaugcagugaguccuuaccaacagguuaucgaaaagacuaagagccugucuuuccgcucccagaugcuugcuaugaacauugagaaaaaguugaaucagaacucaagaagcgaagccccaaauugggcuacacaagauaguggauuuuauuga

SEQ ID NO: 55695 - RNA, 1074 nt, Artificial Sequence
  derived and/or modified sequence opt3 from EIF3F__Homo_sapiens__NP_003745
auggccacccccgcugugccugucagcgcaccaccggccacacccacuccuguuccagcggcugcccccgcauccgugccugccccaacgcccgcuccugcagccgcuccaguaccggccgcggcacccgccucuucaagugacccugcugccgcagcugccgcgaccgccgcaccaggccagacacccgcuagcgcccaagcuccugcccagacuccagcacccgcccugccggggccugcucuccccggaccauucccugguggcagaguggucaggcuucaccccgugauccuggcguccauuguugauucuuacgagcggcgcaacgaaggggcagcccgagugauaggaaccuuguuaggcacagucgacaagcauucgguggagguaaccaauugcuuuucaguuccacacaacgaaagcgaggaugaaguggcugucgacauggaguucgccaaaaauauguaugagcugcauaagaaagugagucccaacgaacuaauccucgguugguacgcaacugggcacgauauuacagagcauuccgugcugauccacgaauauuacucucgugaggccccuaauccaauucaccuuaccgucgacacgagccugcagaacggaagaauguccaucaaggcuuauguuucaacuuugaugggcgugccgggcaggaccauggggguaauguuuacaccccucacugugaaauacgccuauuacgauaccgagcggauaggagucgaccugaucaugaagacauguuucaguccuaaucgcgugauuggucugagcucugaucuccagcaaguuggcggggcauccgcgagaauccaggacgcuuuaucaaccgugcugcaguacgccgaagauguccuuagcggaaaggugagugcagacaacacgguaggcagguuuuugaugucucugguuaaucaggugccaaaaauuguccccgaugacuucgagacuaugcuaaacuccaauaucaacgaccuccugauggugacauaucuugccaaucugacccaaagccagauagcuuugaacgaaaagcucgucaaucuguga

SEQ ID NO: 55696 - RNA, 1059 nt, Artificial Sequence
  derived and/or modified sequence opt3 from EIF3H__Homo_sapiens__NP_003747
auggcuagcagaaaggagggcaccggguccacagcuacuucuucaaguagcacggcaggagccgcggguaagggcaaggggaaaggaggcuccggugacucugcugugaagcagguccaaaucgaugggcugguugugcucaaaauuauaaagcacuaccaggaagagggacagggcaccgaaguagugcagggcguccuucugggguuggugguugaggacagguuagaaaucacaaacugcuuccccuuuccucaacauacugaggaugacgccgauuucgacgaggugcaguaucagauggaaaugaugcggucgcugcgccacgucaauauugaucaucuacacgugggaugguaccagucaaccuauuacgguagcuuuguaacacgagcacuccuggacagucaauucuccuaucagcaugccaucgaggaaucuguugugcuuauuuacgauccaaucaagaccgcucagggcagccuguccuugaaagcauaucgucucacuccgaagcugauggaggucuguaaagagaaggacuuuucacccgaagcccugaaaaaggcuaacauaacauucgaguacauguuugaagaggugccuaucgugauuaagaauagucaccucaucaacgucuuaaugugggaacuggagaaaaagagcgccguugcggauaaacacgagcuuuugucucuggcauccucaaaucaucuagggaagaaccuccagcugcuuauggacagaguggaugaaaugagccaagacauuguaaaauacaauaccuauaugaggaacacgaguaagcagcagcaacagaaacaccaguaccagcaacggcgccagcaggagaauaugcagagacaaucuaggggagaaccaccccugccugaggaagacuuguccaaacucuucaagccaccccagccuccagcccggauggauagccuguuaaucgcuggccagauaaacacuuauugccagaauauuaaggaguuuaccgcccaaaaccuggguaaacucuucauggcacaggcccuucaggaguacaauaacuga

SEQ ID NO: 55697 - RNA, 630 nt, Artificial Sequence
  derived and/or modified sequence opt3 from EIF3J__Homo_sapiens__NP_001271265
auggccgcugcagccgcggcugccggcgacagcgauuccugggacgcagaugccuucucuguggaggaccccgucagaaagguugggggagguggcaccgcugggggagauaggugggaaggcgaggacgaagaugaggacgugaaacuggaggaaccugaggaaccaaagguacucacaccggaggaacagcuugcagauaaacugcgguugaagaaauuacaagaggagucagaccuggaacuagccaaggagacuuuuggugugaacaaugcugucuacgggaucgaugccaugaaccccaguagccgcgacgauuucacggaauuuggaaagcuccugaaagacaagauuacccaguaugagaaaucccuuuacuaugcgucuuuccuggaaguguugguucgagacgugugcauaucgcucgagaucgaugaccugaagaaaauuacaaauucacugacuguccucuguagcgagaagcagaagcaggaaaaacaaaguaaggccaaaaagaaaaagaaaggcgugguaccuggcgggggauuaaaggcaaccaugaaggaugaccuggcugauuacgguggcuaugacgggggauacguucaggauuaugaggacuuuauguga

SEQ ID NO: 55698 - RNA, 657 nt, Artificial Sequence
  derived and/or modified sequence opt3 from EIF3K__Homo_sapiens__NP_037366
auggccauguucgagcagaugagagcuaacgugggcaagcugcucaaagggaucgacagguacaaucccgaaaaccuugcaacccuggagcgguaugucgaaacacaagccaaggagaaugcguacgauuuggaagcuaacuuagccguucugaaacuauaucaguuuaauccugcauucuuucagacuacggugaccgcccagauucuccugaaggcucuuacaaaccugccacacacugacuucaccuugugcaaauguaugauagaucaagcacaucaggaggagcgcccgauccgacagauucucuaccugggagaccugcucgaaacaugccacuuucaggccuucuggcaggcuuuagaugagaauauggaccugcuugaagguaucaccggcuuugaggauagcguacguaaguucauuugucauguggucgggaucacuuaucaacacauagacagaugguugcuggccgagaugcuaggagaucucuccgacucucagcugaagguguggaugucaaaauacggcuggagugcggaugaaagcggucagaucuuuauuugcucccaagaggaaucuaucaagcccaaaaacauuguugagaagaucgacuucgauucggugucaagcauaauggcaaguucccaguga

SEQ ID NO: 55699 - RNA, 1125 nt, Artificial Sequence
  derived and/or modified sequence opt3 from EIF3M__Homo_sapiens__NP_006351
augagcgugcccgccuucaucgacauuuccgaggaagaucaggcugcagagcugagagccuaccucaagucuaaaggcgcggaaauaucagaggaaaacagugaagggggacuucacgucgaccuggcucaaaucauugaggccugcgauguuuguuugaaggaagacgauaaagacguggagagcguaaugaacuccguggucucuuuacugcuaauccucgaaccugauaagcaggaggcacugauugagucgcuuugcgaaaaacuggugaaguuuagggagggugaacggccaucauugcgccuccagcugcugagcaaucucuuccauggcauggacaagaauaccccgguucgauauacaguguacuguaguuuaaucaaagucgccgcuuccugcggggcaauacaguauauccccacugagcuggaucaagugcguaaguggauuucugacuggaaccuuacgaccgagaaaaagcacacauugcugagacuacucuacgaggcccugguagauuguaaaaagagcgacgcugccuccaagguuaugguggagcuucugggaucauauacugaagauaaugcgagucaggcaagggucgacgcccaucggugcaucgugcgcgcuuugaaagacccuaacgccuuucucuucgaucaccuguuaacccugaagccagugaaauuucucgagggcgaacuuauucaugaccuguugacaaucuucgucagcgcaaagcuagcuucuuacguuaaauuuuaucagaauaacaaggauuucauagacucccugggucuccugcacgagcagaauauggccaaaaugagacuucugaccuuuauggggauggcgguggaaaacaaggagauuucauucgauacuaugcaacaggaguugcagaucggagccgacgauguagaagcauuugugauugacgcugucaggacaaagaugguguacuguaaaaucgaucagacccaacggaagguuguggucagccacaguacgcaucgcacuuucggcaaacagcaguggcaacagcucuacgacacccugaaugccuggaagcagaacuuaaauaaagugaagaacucucugcuaucccucagcgauacauga

SEQ ID NO: 55700 - RNA, 1044 nt, Artificial Sequence
  derived and/or modified sequence opt3 from EIF4A1__Homo_sapiens__NP_001191439
augagcgccucccaggacucuagaucaagggauaacggccccgacgggauggagccugaaggagugaucgagaguaauuggaacgaaauugucgauagcuucgacgauaugaaucuguccgagucucuccuucgggguauauacgcuuauggcuuugaaaagccaucggcaauccaacagcgcgccauucugccgugcaucaaaggguacgacguuauugcgcaggcucagucaggaaccggcaagacagccacuuucgcaaucagcauauugcaacagaucgaguuagaucugaaagccacgcaggcucuagugcucgcacccacccgagagcuggcccagcaaauucagaagguagugauggcucuuggugacuauaugggggccaguugucacgcgugcaucggaggcacaaacguccgugcagaagugcagaaacugcagauggaggccccucauauuaucguuggcacuccagggagaguguuugauauguugaauaggcgguaccucucccccaaguauauaaagauguucguccuggacgaagcugaugagaugcugucucgcggauuuaaagaccaaauuuacgauaucuuccagaagcucaacagcaauacccaggugguauuacuguccgccacaaugccuucagacguucuugaggugaccaaaaaguuuaugagagacccaauuaggaucuuggucaaaaaggaggaacugacucuagaagguauccggcaauucuauauuaacguggagcgcgaagaguggaagcucgauacacugugugaccuuuacgagacccugacgauaacucaggcagugaucuuuauuaauacccgaagaaaagucgauugguugacagaaaagaugcacgcuagggacuucacuguuagugccaugcauggcgauauggaccagaaagagcgggaugugaucaugcgugaauuucgcagcgggucuuccagaguacucauaaccacagaccuguuaggaaagcuguacccccagaacaggucacgguggaccguguggccuuga

SEQ ID NO: 55701 - RNA, 1224 nt, Artificial Sequence
  derived and/or modified sequence opt3 from EIF4A2__Homo_sapiens__NP_001958
augagcggcggguccgccgacuacaacagagagcacggaggucccgaaggcauggauccugacggggugaucgagucuaauuggaacgaaauugucgauaauuucgacgauaugaaccugaaggagucacuccuuaggggaauauaugcuuacggcuuugaaaaaccaagugcaauccagcagcgggccauuaucccgugcauuaaggguuaugacguuaucgcgcaggcucagagcgggaccggaaaaacagccacuuucgcaauauccauccugcagcaauuggagauugaguuuaaggaaacgcaggccuuagugcuggcucccacccgcgagcuagcacagcagauccaaaaaguaauucucgcccugggcgauuacaugggcgcuacaugucaugccugcaucgggggaacuaaugugcgaaacgaaaugcagaaacuucaggcggaggcaccucacauagucguggguaccccaggccguguuuucgacaugcugaauagaagguauuugucucccaaguggauuaagauguuugugcucgaugaggccgacgaaaugcugucgcggggguucaaggaucagaucuacgagauuuuucaaaaacugaacacaucaauccaggucgugcucuuaagcgcuaccaugccuacugacguacuggaaguuacaaagaaauucaugcgcgauccaaucaggauucuugugaagaaggaggaauugacccuggagggaauaaaacaguuuuauaucaaugucgagagagaagaguggaagcuagacacgcucugugaccuguacgaaacucuuaccauuacacaagccgugaucuuccugaacacucggcgcaaaguggauugguugaccgagaagaugcaugcacgagacuuuacagucagugcucuccacggcgauauggaccagaaagaaagagauguuauaaugagggaguuccgguccgguucuagccgugugcugauuaccacggacuuacuggcccgcgggaucgauguacaacaggugucccucgucaucaauuacgaccuucccacuaacagagagaauuauauucauaggaucggacggggcggccgauuugggcgcaagggaguggcgauuaacuucguuacagaagaggauaaaagaauacugagggacaucgaaaccuucuacaauacuacaguggaggaaaugccuaugaacgucgccgauuugauuuga

SEQ ID NO: 55702 - RNA, 1236 nt, Artificial Sequence
  derived and/or modified sequence opt3 from EIF4A3__Homo_sapiens__NP_055555
auggccaccacagcuacuauggcaacgagcggcuccgccagaaagaggcugcucaaagaggaagacaugaccaagguggaguucgaaacaucugaggaagucgauguuacucccaccuuugacacaauggggcuucgggaggaucuguugcgcggaaucuacgcguaugguuucgagaaaccuucagcuauucagcaacgagccauaaagcagaucauuaaaggccgugacgugaucgcacagagucagagcgggaccggaaagacugccacauuuuccauuucuguauuacaaugccuggauauccaggugagagaaacccaggcucuaauacucgcaccaacgagggagcuggccguccagauccaaaagggccuucuggcuuugggugacuacaugaacgugcagugucacgccugcauugggggaacuaauguuggcgaagauauccggaaacucgacuauggccagcauguggucgcggggaccccgggacgcguguucgauaugauuagaaggcggucgcugcgcacacgagcaaucaagaugcugguacucgacgaggccgaugagauguuaaacaaagguuuuaaggaacagauauacgacguuuauagauaccugcccccugcuacucaagugguccuuauuucagccaccuugccacacgagauccuggaaaugacaaauaaauucaugaccgaucccauuaggauccuagugaagcgggacgagcucacgcuggaaggcaucaagcaguuuuucguggcagucgagcgugaggaauggaaauuugacacucuuugugaucuguaugacacauugaccauuacucaggcuguuauauucugcaacacaaagcgcaaaguggauuggcucaccgagaagaugagagaagccaauuuuacgguaagcaguaugcauggggacaugccucaaaaagagagggaauccaucaugaaggaguuccggucuggagcgagccgagugcugauuuccaccgaugucugggcccgcggcuuagacgugccacagguuucacugaucauaaacuacgaucuccccaauaacagagagcuuuacauucacaggaucggucggagugggcgcuauggaagaaaaggcguggcaaucaauuuugucaagaacgacgauauuaggauccugcgugacauugaacaguacuauagcacacagauagaugagaugccuaugaauguggcugacuugaucuga

SEQ ID NO: 55703 - RNA, 1836 nt, Artificial Sequence
  derived and/or modified sequence opt3 from EIF4B__Homo_sapiens__NP_001408
auggccgcuagcgcaaagaaaaagaacaaaaagggcaaaaccaucucccugacagacuuccucgccgaggaugggggaacugguggcgggucuacguacgugucaaagcccgucaguugggcggacgaaaccgaugaccuugagggagauguuagcacaacuuggcacuccaaugacgaugacguguauagagcuccuccaauugauaggucuauacugccgaccgcuccccgggcagcccgcgaaccuaacaucgaccgaucgcguuugccaaagucacccccuuacacagccuuuuuaggcaaucugccauaugauguaaccgaggaaagcauuaaagaguucuuuagaggucuaaacaucagugcagugaggcucccccgggagccuuccaauccagaacgccugaagggguucggauacgccgaguuugaagaccuugauucucuguugagcgcucucucccugaacgaggagucacugggcaauagaaggauucgggucgacguggccgaccaggcgcaagauaaagaccgcgaugaccgaaguuucggcagagauaggaaccgggacagcgauaagacugacacagauuggcgugcacgcccggccaccgacucuuuugaugacuaucccccuagaaggggagacgauuccuucggggacaaauaccgggaucgauaugacucagaucgcuacagagacgguuacagggauggcuaucgggacgggccacgcagagauauggacagguacggaggccgugaucgguaugacgaucgagguagcagagacuacgacaggggguaugauagucgcaucggaucuggccggagagcuuuuggcuccggguacaggcgcgacgaugacuaucgaggagguggcgaucgguacgaagaccguuacgauagaagggacgaucgcagcuggucgucucgggacgauuauuccagagacgauuacaggcgagacgaccgcgggcccccucagcggccaaagcucaauuuaaagcccagaucaacgccgaaagaggaugacaguagcgccuccacuucucagagcaccagggcagcuucaauauucggaggcgccaagccuguugauacagcggcccgugaacgcgagguggaggagcggcugcagaaagagcaagaaaaacuucagagacaguuggacgagcccaagcuggaaaggcgaccacgggagcgccauccuaguuggagauccgaagagacucaggagagggaacggagccgaaccgguucugagucaagucaaacagggaccagcacgacuuccucuagaaacgcacgcaggcgugaaucggaaaagagccuagaaaaugagacacucaacaaagaggaagauugccacucccccaccucaaagccacccaagccugaccagccacugaaagucaugccggcucccccuccaaaggagaaugccugggugaaacggaguucuaaucccccugcuagaagccaguccucagauacugaacagcaaagcccaacaucuggcggaggcaagguagcccccgcacagccguccgaggaggggccuggaaggaaagacgaaaacaagguugaugguaugaacgccccaaagggccagaccgggaacaguagccgcggacccggcgacggugggaaucgagaucauuggaaagagucugacagaaaggacggcaaaaaggaucaagacucccggucagcuccugaacccaaaaagccagaggaaaacccugcgaguaaguuuagcucggcauccaaauaugccgcucuuucuguggauggagaggacgagaaugaaggcgaggauuacgccgaauga

SEQ ID NO: 55704 - RNA, 705 nt, Artificial Sequence
  derived and/or modified sequence opt3 from EIF4E2__Homo_sapiens__NP_001263265
augaacaauaaguucgacgcccugaaagaugacgauagcggcgaccacgaucagaacgaggaaaauuccacccaaaaggacggggagaaagaaaagacagagagagauaaaaaccagucuucaaguaagaggaaggcugugguccccggaccugcagaacauccacuccaguacaauuauacuuuuugguacagccggcgcacgccgggucgacccaccuccucucagucguaugagcaaaacaucaaacagauuggcacauucgccucaguugagcaguuuuggcguuucuacagccacauggugagaccuggggaccuuacuggacauagugauuuucaccuguucaaggaaggcauaaaaccaaugugggaggacgaugcgaauaagaacggugggaaauggaucauuagguugcggaagggauuagcuucccgcugcugggaaaaucugauccuagccaugcucggcgagcaguuuaugguaggcgaggaaauuuguggggcaguggucucugugagauuccaagaggacaucauaagcaucuggaacaagaccgccuccgaucaggcuacaaccgcaaggauucgggacacucugcgccgaguucuuaaucugcccccuaacacaaucauggaauauaaaacccauacggacucaauuaaggauaauaguagcuuuagaaacacuaaaaucaccuuguga

SEQ ID NO: 55705 - RNA, 357 nt, Artificial Sequence
  derived and/or modified sequence opt3 from EIF4E3__Homo_sapiens__NP_001128121
augagaggcgagaggcggccccugugggaagaggaaagcaacgccaaagggggaguguggaagaugaaggucccuaaagacuccaccucuacaguuuggaaggagcuccuucuggcuacuaucggugaacaguucacggauugcgcagccgcggacgaugaggugauuggcguaucagugaguguccgcgaccgagaggaugugguucaaguguggaaugucaacgcuagcuuggugggggaagccaccguauuagagaaaauauacgaacugcuaccacacaucacauuuaaggcaguuuucuauaagccgcaugaggagcaccaugccuuugaaggaggccgugguaaacacuga

SEQ ID NO: 55706 - RNA, 357 nt, Artificial Sequence
  derived and/or modified sequence opt3 from EIF4EBP1__Homo_sapiens__NP_004086
augagcggcggguccucuugcucacagacccccaguagagccaucccugcuacaaggcgggugguccugggagacgguguucaacucccaccgggcgauuacagcacuacgcccgggggaacccuuuucuccacaacuccuggcgguacccgcauuauauaugaccgaaaguuucugauggagugucguaauucuccagugacaaaaacucccccuagagauuugccaaccauccccgggguaacaucgccuucaagcgacgaaccaccgauggaggcaagucagucccacuuaaggaacucucccgaagauaagcgggccggaggcgaggaaagccaguucgagauggacauuuga

SEQ ID NO: 55707 - RNA, 363 nt, Artificial Sequence
  derived and/or modified sequence opt3 from EIF4EBP2__Homo_sapiens__NP_004087
augagcuccucugccggcucagggcaccagcccagucaaagcagagcuaucccuaccaggacaguggcaauuuccgacgccgcgcagcugccacaugauuacugcacuacgccgggagguacccucuucucuacaacucccggcgggacccggauaaucuaugaccgcaaguuucuucuggaucgacguaacucgccuauggcucagacaccacccugucacuugccuaauauuccaggagucaccucacccggcacuuuaaucgaggacagcaaaguugaagugaacaaucugaacaaucuaaacaaucaugauagaaagcacgccguaggugacgaugcacaguucgagauggacauuuga

SEQ ID NO: 55708 - RNA, 303 nt, Artificial Sequence
  derived and/or modified sequence opt3 from EIF4EBP3__Homo_sapiens__NP_003723
augagcaccuccacaucuugccccaucccuggcgggagagaccagcugccagauuguuacucaacuacgccgggagguacccucuaugccacaacucccggcgggaccaggauuauauacgaccggaaguuccuucuggagugcaaaaacaguccuaucgcucgcacaccacccuguugcuugccucaaauuccaggagugaccacucccccuacagcaccauuaagcaagcuggaggaacuaaaagaacaggagaccgaagaggagaucccggaugacgcccaguuugaaauggauauuuga

SEQ ID NO: 55709 - RNA, 714 nt, Artificial Sequence
  derived and/or modified sequence opt3 from EIF4E__Homo_sapiens__NP_001124150
augcuggaccucaccagcagaggccagguggggacauccaggcggauggccgaggcugcaugcucugcccacuuccuugaaacuacgcccaccccuaacccaccgacaacugaggaagagaagaccgaaucaaaucaagaggucgcgaaccccgagcauuacaucaaacacccucugcagaaucgcugggcuuugugguuuuucaagaacgauaaaaguaagacauggcaggccaauuuacgacugauuagcaaauuugacaccguugaagauuucugggcacuauauaaccauauacagcucuccucuaaucugaugccaggaugugacuacucgcuuuuuaaggaugguaucgagcccaugugggaagacgagaagaacaaacguggcgggagauggcugauuacuuugaauaagcaacagaggcggucagaucucgaccgcuucuggcuggagacacugcucugcuuaaucggagagagcuuugaugacuauagugaugacguguguggcgccguagugaacgucagagcuaaaggugauaagauugcaaucuggaccacggaaugcgaaaauagggaggccgugacucacauagggcggguuuacaaagaacgccugggacuuccuccaaagaucgugauuggcuaucagucccaugcugacaccgccacaaagucuggcagcacuaccaaaaaccgauucgucguguga

SEQ ID NO: 55710 - RNA, 2436 nt, Artificial Sequence
  derived and/or modified sequence opt3 from EIF4ENIF1__Homo_sapiens__NP_001157974
auggacagaaggagcaugggcgagaccgaauccggggaugccuuccuggaccucaagaaacccccugcuucuaagugcccacaccgguacacaaaagaggaacuucuggauaucaaggaguugccgcauucaaaacagcgccccaguuguuuaagcgaaaaguaugacuccgauggagugugggacccugagaaguggcacgcaucucuguacccagccucgggucgaucaagccccgucgagagucucaaaaaggaacuagauacugaccguccuucccugguuagaaggauugugggcauaguagagugcaacgggggaguggcggaagaggaugaggucgaagugauccuugcucaagagccagccgcagaccaggaaguuccccgggaugccgugcugccugagcagucuccaggcgacuuugauuucaaugaauuuuucaacuuggacaaagucccgugucucgcuagcaugauugaggacgugcugggugagggguccguaucagcaagucgcuuuagcagaugguucucuaaucccuccaggucaggaagccggaguucuucccugggcagcacgccucaugaagaacucgaacgcuuagccggccuggagcaggcuauccuuucgccagggcaaaacucuggaaauuauuuugcccccauuccuuuggaagaucacgcggagaacaagguugacauccuggagaugcuacagaaagcaaagguggaucucaagccacugcuuuccucacugagugccaauaaagaaaaguugaaagagagcucccauucuggugucgugcucagcguggaagaggucgaagcuggccugaagggguuaaaaguugaccaacaggugaagaacucaacccccuucauggccgagcaccuggaggaaacacucagugcaguaacuaauaaccgacagcuuaaaaaggauggagacaugaccgcuuuuaauaagcugguguccacaaugaaaagaaacuuggagagccaccuaaugucuccggccgaaauaccuggccagcccgucccaaagaauauccugcaggagcuccugggucagccugugcaaaggcccgcgucaaguaaccuucugagcggguugaugggaucccucgagccaaccacuucucuguuaggccagcgggcccccucgccuccacugagccagguuuuccaaacacgugcagcuuccgccgauuaccuacgcccgaggauucccucaccuaucggcuuuaccccagggccccagcagcuccugggagacccuuuccaggguaugagaaaaccaaugagucccauuacggcucaacagaugucucagcuugaauugcagcaagccgcacuggagggccucgcccugccgcaugaucuugcugugcaggcggcaaauuuuuaucagccuggguucggaaagccacaggucgaccggacucgagauggcuuccgcaacagacaacagagggugaccaaaagccccgccccuguacaccgggguaacuccucaagccccgcuccagccgcaucuaucacauccaugcugaguccuagcuuuacucccaccucuguuauacgcaagauguacgaauccaaggagaaaucaaaggaggagccagccagugggaaagcugccuugggcgacagcaaggaggacacacagaaagcaucggaagagaaucuccuguccucuagcucagugccgagugcggauagagacuccucuccuaccacgaacagcaaguuauccgcucugcagaggucaagcugcaguacuccccuaucucaagccaaucguuauacaaaggaacaggauuaccggccaaaagcaaccggacgaaagacucccacacucgccuccccugucccaaccacgcccuuccugagaccugugcaucaggucccgcuugugccacacguucccauggugaggccugcucaccaauugcauccaggccugguacagcgcaugcucgcccaggggguccacccccagcaucugccuagcuuacugcaaaccggagugcuuccgcccgguauggacuugucgcaccuccagggcauuucagggccaauccugggacagccuuuuuacccccuaccagcagcuucucauccucugcucaacccccggccaggcacaccgcugcaccuugccaugguucagcaacaguugcagagaagugugcugcacccucccgguuccgggagccaugcggccgcugucucugugcagacuaccccacaaaauguacccagcagguccggcuuaccucacaugcauucacagcucgagcaccgcccaagucagcgaucuagcucccccgugggacuggcaaaaugguucggcucagauguucuucaacagccucugccgaguaugccagccaaggucauuagcguggacgaauuggaguaucggcaguga

SEQ ID NO: 55711 - RNA, 4821 nt, Artificial Sequence
  derived and/or modified sequence opt3 from EIF4G1__Homo_sapiens__NP_001181876
augaacaaggccccacagagcaccggcccuccaccggcucccuccccugggcugccacaacccgcauucccuccaggacagacagcccccguggucuuuucuacuccucaggcgacgcagaugaauaccccaucacaaccgagacaggguggcuucaggagucuccagcacuuuuaccccagccgggcucagccuccauccucugccgcaucgcgcguucaaucagccgcucccgcacgaccugggccagccgcucauguguaucccgccggaagccagguaaugaugaucccgagucagauuuccuacccugcgucucagggcgcauauuacauacccggucaagggcguagcacauauguggucccaacucagcaguacccugugcaacccggagccccaggcuucuaucccggcgcuuccccuaccgaguuugggacauacgccggagcauacuauccagcucaggguguucagcaguucccgaccggcguggcccccgcgccuguccuuaugaaccaaccaccccagaucgccccuaaaagagaaaggaagacuauucggauccgcgacccaaaucaagggggaaaagauauuacagaggaaaucaugucaggcgcaagaaccgcuaguacgcccacuccgccucagaccggugggggacuggagccacaggccaacggcgaaacaccccagguggcuguaauaguuaggccugacgaucggagccagggcgccaucauugcagaccgccccggguugccaggaccugagcacucucccuccgagucacagccaagcaguccgucuccuacucccuccccaagccccguguuagaaccugguucggagccaaaucuggccguccuaucuauccccggcgauaccaugacaaccauucaaauguccguggaagagucaacgccuaucagucgagagacuggggaaccguacagacucagcccagagcccacaccucuggcugaaccaauacuugagguggaagucacccuguccaagcccguuccugagucugaguuuagcucaaguccguugcaggcgcccacuccacucgcaucccauacaguggaaauucacgagccuaacggaaugguacccagcgaagaccuggagccagaaguggagucuucaccugagcuggcucccccaccggccugcccuagugaaagccccgucccaaucgcccccaccgcacagccugaggaacucuuaaauggcgccccaucucccccugcuguggaucuguccccgguuucggagccagaggaacaggccaaagaggugacggcaagcauggcgcccccuaccauucccuccgcuacaccagccacugcaccuucagccaccagucccgcucaagaagaggaaauggaggaggaagaggaagaggaagagggugaggccggggaagcaggcgaggcugaaucugagaagggaggcgaggaacuuuugccaccugagagcacaccgauccccgccaaccugucccagaaucuagaagcggccgcugcaacucaggucgccgugucaguaccaaagaggcggcguaaaaucaaggagcucaacaaaaaggaagcuguuggggaccugcuugaugccuucaaagaggcaaauccugcggugcccgaagucgagaaccaacccccugccggaagcaaucccgguccggagucugaaggcuccggggugccaccucgccccgaggaagcugacgagaccugggauaguaaggaggacaagauucauaacgccgaaaauauacagccaggagagcagaaauaugaauacaagagcgaucaguggaaaccccugaacuuggaggaaaagaaaagauaugacagggaguuucuccugggcuuccaauuuaucuucgcaucuaugcagaagccugaggguuuaccgcacauuuccgacgucgugcuggauaaagcuaacaagacaccccuccggccacuugacccuacccgacugcaggggaucaauuguggccccgauuuuacuccuucauucgccaacuugggacgcacgacacuaaguaccagaggcccaccccggggagggccugguggcgaacugccaagggggcccgcaggacucggcccgcgcagaagccagcaagguccuaggaaggagccacguaaaauaauugccacuguucugaugaccgaagacaucaaacuuaauaaagcugagaaggcguggaaacccucguccaagcggacagccgcagauaaggaccgaggggaagaggaugcugacggcucuaaaacccaggaucuguucagaagggugcgcagcaucuugaacaagcucacuccucagauguuucagcaacugaugaaacagguaacacaguuagccauugacacggaggaacggcugaagggagucaucgaucuaauuuucgagaaagccauaucagaaccaaauuuuaguguggcuuacgcaaacaugugcagaugucucauggcccugaagguucccaccacugagaagccgacagugaccgucaauuucaggaaacuuuugcugaaccgcugccaaaaggaauuugagaaagacaaggacgaugacgagguguucgaaaagaagcagaaggagauggaugaagcggcuacagccgaggagcgaggccggcucaaagaggaacuggaagaggcacgugacaucgccagaaggcgcucccuugggaauauuaaguuuaucggagaacuguucaaauugaagaugcucacugaggcuaucaugcacgauuguguagugaaacuguuaaagaaccaugacgaggaaucucuggagugccuaugucggcuccugaccacgauuggcaaagaucuugacuuugaaaaggcaaagccuagaauggaucaguauuucaaucagauggagaaaauaaucaaggagaaaaagaccagcuccaggauucgauuuauguugcaagacguucuggaucuccgcgguucaaacugggucccccggagaggggaccagggaccaaaaacaaucgaucagauucacaaggaagccgagauggaggaacauagggaacacaucaaggugcagcaacugauggcgaaaggcagcgacaagcgucgcgguggcccucccgggccacccauaagucggggauuaccucugguggacgauggcggguggaauacugucccaaucucuaaaggauccagaccgauugacaccagcaggcuuacaaagaucacuaaacccggcucgauugauucaaacaaucaguuguucgcuccuggugggcgacucucuuggggaaagggcaguuccgguggcagcggggccaagccaucugacgcagccagcgaggcugcccggcccgcaaccuccacgcugaaccgcuuuucagcucuacagcaggccguuccuacagaaaguaccgauaacagaaggguggugcaacggagcucucugucccgagagagaggagagaaagcgggcgaccgcggggauaggcucgaacguucagagcggggaggcgacagaggugauaggcuggaccgcgcccgaacuccagcaacaaagagaaguuucagcaaagaaguagaggagcgguccagggaacgccccucucagccugaggggcuucguaaggcugccucguugaccgaagauagagaccggggaagggaugcugucaaacgcgaggcagcccugccgccagugagccccuuaaaggccgcucucucagaagaggagcuggaaaagaaauccaaggcgaucauagaggaauaccuucaccugaaugacaugaaagaggcaguucagugcgugcaggaauuggccaguccuucucuccuguucauuuuuguccgacauggcguggagagcacucuagagagauccgcuaucgcccgggaacacaugggucaacugcuccaucagcugcuuugugcaggccacuugucaaccgcccaguacuaucaagggcuguacgagauuuuagaacucgcugaggacauggaaaucgauauaccccauguuuggcuguaucuugcggagcuggugacaccaauccuacaggagggaggcguaccuaugggggaacucuucagggagauuacgaagccccugcgcccauugggaaaagccgcaucucuguuacucgaaauccugggccuucugugcaagagcauggguccgaaaaaggucgggaccuuguggagagaggcuggacucaguuggaaggaguuucugccugaaggccaggacauuggcgccuucguggcagagcagaaaguggaauacacucuaggggaggaauccgaggcccccggacaaagggcucugccaagcgaggaacuuaaccggcagcucgagaagcuguugaaagaagguucuucaaaucagcgugucuuugauuggaucgaggccaaccuguccgaacagcaaauaguuaguaauacauuagugcgcgcgcucaugaccgcaguauguuauagcgccauuaucuucgagacaccccugcgaguggacgucgcugugcuuaaggccagagcuaaacuguugcagaaguaccucugcgaugagcagaaggaacugcaggcacuauaugcccugcaagcucuuguugugacucucgagcagccuccaaaccuguugaggauguuuuucgacgccuuauacgaugaagacgucgugaaagaggaugcauuuuacucgugggaaucuuccaaggaccccgcggagcagcaaggcaaagggguugcccucaagagcgugaccgcuuucuuuaaauggcugcgggaggccgaagaggaaucagaucacaauuga

SEQ ID NO: 55712 - RNA, 2610 nt, Artificial Sequence
  derived and/or modified sequence opt3 from EIF4G2__Homo_sapiens__NP_001036024
auggagagcgccaucgcugaaggcggggcauccagauucucugccucaaguggagguggcgggagcaggggagcgccccagcacuacccuaagaccgcuggcaacuccgaguuucuggguaaaacaccagggcaaaaugcccagaaguggauuccggcacggucuacucgccgagacgauaacucggccgcuaauaacucagcaaaugaaaaagagcgucaugacgccauauucagaaaggugaggggaauccucaacaaacuuacgcccgaaaaguuugauaagcugugcuuggaguuacugaaugucggcguugagagcaaacuaauucucaagggcgugauccugcuuauuguagacaaagcucuggaagaaccuaaguauaguuccuuguacgcccagcucugucugcggcuggcggaagaugcaccaaacuucgacgggcccgccgcugagggacagccuggucaaaaacagucuaccacauuucgcagacucuuaaucagcaagcugcaggaugaguucgaaaauaggacucggaacguggacgucuaugauaagcgcgagaauccacuuuugcccgaagaggaggagcagcgagccauagcaaaaaucaagaugcugggcaacauuaaauuuaucggggagcuaggaaagcucgaccugauucacgaauccauccuucauaaaugcauaaagacccuguuggagaaaaagaagagagugcaacucaaagauaugggcgaagaccuggaguguuuaugccagauuaugaggacaguugguccucggcuggaucacgaacgugcuaagucacucauggaccaguacuucgcccgcauguguagucuuaugcugagcaaagaguugccagcgagaaucagguuucuacugcaggacaccguggagcuccgggaacaucacugggucccgcgaaaggccuuccuggauaaugggcccaaaacuauuaaccaaauccgccaggacgcagugaaggaucuuggaguauuuaucccugcuccaauggcccagggcaugagaucugacuucuuucuggagggccccuucaugccuccaaggaugaagauggaucgggaccccuugggagggcucgcugauauguucggucaaaugccgggcuccgggauuggaacaggcccugguguuauacaggaccgcuuuucacccaccauggggagacacaggagcaaucagcuguucaacggccauggaggccacaucaugccaccuacgcagagucaauuuggggaaaugggagguaaauucaugaagucucagauuuccuuacgucccgcccagagcuuucugaugaacaaaaaucaggugccaaagcuacaaccccagaucacuaugauaccuccaucggcacagccgccccggacccagacaccuccacucggccaaacuccccagcuggggcuuaaaaccaacccuccauugauucaggagaagcccgccaagacaucuaaaaagccgccuccauccaaagaggaacugcucaagcugaccgagacggucgugacugaauaucuuaauucaggaaacgcuaaugaggcggugaacggcguccgagaaaugagagcacccaaacauuuccugccugagauguugaguaagguuaucauccucagccuggauagguccgacgaggauaaggaaaaagccucuagcuuaauuucacugcuaaagcaggaggguaucgcuacaagugacaauuuuaugcaagccuuccucaacgugcuggaccagugccccaaacuugaaguagauauuccauuggugaaguccuaccuggcacaguuugccgcucgcgccauaaucagcgagcucgucucuauuucagaacuggcacaaccuuuagagagugggacccacuucccccuguuucuuuugugucuccagcagcuggcgaaacuacaggaccgggaguggcugacugaacucuuccaacagagcaaggugaauaugcagaaaaugcugccagagaucgaucagaacaaggacagaaugcuugaaaucuuggagggcaagggacuguccuuuuuauucccgcuccugaaacuugaaaaggagcuguugaaacaaauuaagcucgauccuucuccccagacaauauauaaauggaucaaggacaauauuucgccaaagcugcacguugauaaaggcuucgugaacauccuaaugaccagcuuucugcaguacauuuccucagaggucaaucccccuagugacgaaacggauucuagcuccgcuccaucaaaggagcagcucgaacaagagaaacagcugcuuuugagcuucaagcccgugaugcagaaauuucugcaugaccacguagauuuacaaguuucugcccucuacgcacuucaggugcauugcuauaacuccaauuucccuaaggggaugcugcugagguuuuucguccacuuuuacgacauggaaaucauagaggaggaagccuuccuagcuuggaaggaggauaucacccaggaauuuccgggaaaagguaaggcccucuuccaggugaaccaauggcugacaugguuggagacugcagaggaagaggaaagugaggaagaggcugacuga

SEQ ID NO: 55713 - RNA, 747 nt, Artificial Sequence
  derived and/or modified sequence opt3 from EIF4H__Homo_sapiens__NP_071496
auggccgacuucgauaccuacgacgauagagcuuauagcuccuuuggcgggggaagggguucucggggcucagcagggggacacggcagucgcagccagaaggagcugcccacagaaccuccauacacugccuauguggguaaccucccguucaauacgguccaaggggacaucgaugcgauuuuuaaagaccuuuccauacgaucuguucgucuggugagagauaaggacaccgauaaauucaagggauuuugcuacguagaguucgacgaaguggauucguugaaagaggcuuuaacauaugacggcgcccugcuaggcgauaggucacuccgggucgacaucgcagaagggcgcaagcaggacaagggagguuuuggcuucagaaaagggggacccgaugacaggggcauggguagcagucgggagucccgcgggggaugggauucucgagacgauuuuaacagcggcuucagagacgauuuucugggcgggaggggagguucccggccuggcgaccgucgcacugggccacccaugggaucaagauucagggauggcccuccacuucgggguaguaauauggacuuucgagagcccaccgaagaggaacgcgcccagagaccuaggcugcaguugaagccacggacaguggcuaccccgcucaaccaaguugcaaaucccaacagcgccauuuucgggggcgcucgcccuagagaggaggugguccagaaagaacaggaguga

SEQ ID NO: 55714 - RNA, 462 nt, Artificial Sequence
  derived and/or modified sequence opt3 from EIF5A2__Homo_sapiens__NP_065123
auggccgacgagaucgauuucaccacaggcgacgcuggggcaagcuccacuuaccccaugcagugcucugcccugagaaagaacggauuugugguccucaaagguaggccuuguaagauuguugaaaugucaacgaguaaaaccggcaagcacgggcaugcgaaagugcaccuuguaggaauagauaucuucacaggcaagaaguaugaggacauuugcccaagcacucauaauauggaugugccgaacaucaaacggaaugacuaccaacugauuuguauccaggaugguuauuuguccuuacugaccgaaacaggggagguccgcgaagaccuaaagcuccccgagggagagcugggcaaagaaauagagggcaaguacaacgcuggggaagaugugcagguuucugugaugugcgccaugucggaggaguaugcagucgccaucaaaccuuguaaguga

SEQ ID NO: 55715 - RNA, 555 nt, Artificial Sequence
  derived and/or modified sequence opt3 from EIF5A__Homo_sapiens__NP_001137232
augugcggcaccgggggaacagacagcaagacuagaaggcccccucaccgggccuccuuccugaaacgccucgagucuaagccacuuaaaauggcugaugaccuggauuuugaaacgggugacgcaggcgccucagcgaccuucccgaugcaguguagugcuuugcgaaagaacggguuuguggucuuaaaaggacgucccugcaagaucguugagaugagcacauccaagacuggcaaacauggucacgccaaggugcaucugguagggauugauauauucaccggaaagaaauacgaagacaucuguccuucuacacacaauauggaugugccaaacauuaaaagaaaugacuuucaacuaaucggcauucaggauggcuaucucucgcugcuucaggacucaggggaggucagggaagaucugcgguugcccgagggagaccucgguaaggagaucgaacagaaguacgauugcggcgaggaaauacugaucaccgugcugagcgcaaugacugaggaggccgcuguugcaauuaaagccauggcuaaguga

SEQ ID NO: 55716 - RNA, 1296 nt, Artificial Sequence
  derived and/or modified sequence opt3 from EIF5__Homo_sapiens__NP_892116
augagcgugaacgucaauagauccguuucugaccaguucuacagguauaagaugccccggcugaucgccaaaguggagggcaaggggaacggaauuaaaaccguaauagugaauauggucgauguggcuaaggcacucaaccgcccuccaacauacccgacuaaauauuuugguugcgaacuuggcgcccaaacgcaguucgacguuaagaaugaucgauacaucgugaacgggucacacgaggcgaauaagcugcaggacauguuggauggauuuauuaaaaaguucgucuuaugucccgaaugcgagaacccugaaaccgaccugcaugugaaucccaaaaagcagacaaucggcaacaguuguaaggcuugcgguuaucgugggaugcuagauacucaccauaaacucuguaccuuuauucugaagaauccaccugagaacagcgacuccggaacaggcaaaaaggagaaagaaaagaaaaauagaaagggcaaagauaaggagaacgggucuguaucgucaagcgaaaccccacccccuccaccgcccccuaaugagaucaacccacccccucacacuauggaggaagaggaagacgaugacuggggagaggauacaaccgaagaggcccaaaggcggcgcauggacgagauaagugaccaugcaaagguucuuacgcuguccgaugacuuggaaagaacuaucgaggaaagggugaacauucucuucgauuuugucaaaaagaaaaaggaggaaggugugaucgacucuagcgauaaagagauuguggccgaggcugaacggcuggacgucaaggcaaugggcccacugguucucaccgagguguuauucaaugaaaagauccgcgagcagauuaaaaaguaccgaagacacuuucugagguucugccacaacaauaaaaaggcccagcgguaucuuuugcaugggcuggaauguguaguggcuaugcaccaggcccaacuaauauccaaaaucccccauauucucaaggagauguacgaugcggaccugcuugaggaagaggucaucaucucauggagugaaaaggcaagcaaaaaguacgugucuaaagagcuggccaaggagauucguguuaaagcugaaccguuuauaaagugguugaaggaggccgaagaggaauccucaggaggcgaggaggaagaugaggacgaaaacaucgagguggucuauagcaaagcagcuagugugccuaagguagaaacaguuaaaucugauaauaaggacgacgauauugacaucgaugccauauga

SEQ ID NO: 55717 - RNA, 738 nt, Artificial Sequence
  derived and/or modified sequence opt3 from EIF6__Homo_sapiens__NP_001254739
auggccgugagagcuagcuucgagaacaauugcgaaaucggcuguuuugcaaagcugaccaacacauacugccucgucgccauugggggauccgagaauuucuauucuguuuuugaaggugagcuuucagacacuauacccgugguacacgcgaguaucgcuggcuguaggauuaucgggcggaugugcgugggaaaccgccauggccuguuggucccuaauaacacgaccgaucaggaauuacaacacauucgaaauagccugccagacacagugcagauccguagaguugaggagaggcuauccgcccucgguaacgugacuaccuguaaugauuacgucgcacuggugcauccggaccuugaucgggaaacagaggaaauacuggccgacguauugaaaguugagguguuccgccagaccgucgcugaucaggugcucguggggucuuauugcgucuuuucgaaccaaggaggccugguucaccccaagacuucaaucgaggaccaggaugaacugagcagucucuuacaggugccucugguagcaggcacagugaauagaggguccgaggucauugccgcuggaauggugguuaacgacuggugugccuucugcggucuugauaccacgucuacugaauugagcguggucgaguccguguuuaaacugaaugaagcgcagccaucaaccaucgcaacaaguaugagggacagccuaauugauucucucacuuga

SEQ ID NO: 55718 - RNA, 1092 nt, Artificial Sequence
  derived and/or modified sequence opt3 from ELAC1__Homo_sapiens__NP_061166
augagcauggacgugaccuuccugggcacaggggccgcuuaccccuccccuacuagaggagcaucugccgucguucucaggugcgagggugaauguuggcuuuuugauugcggcgaggggacgcagacccaacugaugaagucacaguugaaagcgggacggaucacaaagauuuucauaacucacuuacauggcgaccacuuuuucggucugccagggcuacucuguaccaucagucugcagagcggauccauggugucuaaacagccgauugaaaucuauggccccguaggccuucgcgauuuuauuuggcgaacaauggagcugucgcauaccgaauugguguuccacuacgucgugcaugagcucguuccuacugcugaccaaugcccagccgaggaacugaaggaguuugcacacgugaaccgugccgauucacccccuaaagaggaacaggggagaacaauccugcucgacagcgaggaaaauaguuauuuacuguucgaugacgagcaguuugucgugaaggcuuucaggcuuuuucaccggauaccauccuucggauuuucuguaguugaaaagaaacgccccgguaaguugaacgcacagaaacugaaggaucuaggcgugccuccagggccggccuacggaaaacucaagaauggcaucagcgucgugcuggagaacggugugaccauuucaccccaagacguccuuaagaaaccuaucguugggagaaagauuuguauccugggagauugcuccggcgugguaggcgacgggggagugaaauuguguuucgaagcugaucuccugauacaugaggccacguuagacgacgcgcagauggauaaggcaaaagagcacggucauaguacuccacagauggccgcuaccuucgccaagcugugcagggcaaaacggcucguccuuacacacuuuagccagcgcuauaagcccguggcucuggcccgagaaggcgagacugacgggauugcggaauugaagaaacaagccgagucuguucuagaucugcaggaagugacccucgcagaggacuucauggucaucuccauuccuaucaagaaauga

SEQ ID NO: 55719 - RNA, 2361 nt, Artificial Sequence
  derived and/or modified sequence opt3 from ELAC2__Homo_sapiens__NP_001159434
augugggcccugugcagccuccuuagauccgcugcaggcaggaccaugucucaggggcggacaaucucacaagcccccgcgcgccgagagcguccuagaaaggacccacugaggcacuugcggacucgcgaaaagagaggaccgagugguuguagcggcgggcccaacacgguguacuuacaggucguugcugccggauccagggauucuggcgcagcccuguauguguucucggaguuuaaucgguaccuauucaacugcggugaagggguacagcgccucaugcaggagcauaagcugaaaguggcucgacuugacaauauuuuucugaccagaaugcacuggucaaacgucggaggcuugagcggcaugauacucacacugaaggaaacugggcugccuaaaugugugcucaguggaccaccccaauuagagaaguaucuggaggcaaucaagauuuucuccgguccucuuaaaggcaucgaauuggccguuaggccacauucugcucccgaguacgaagaugagaccaugacaguguaucagauuccuauccacagcgucucccagcggcguggggugcgcgacucaagucugguaguugccuuuauaugcaagcuacaucucaaaagaggaaauuuccuggugcuuaaggcgaaagagaugggccugccagucgguaccgcagccaucgcuccgauuaucgccgcagugaaggaugggaaaagcauuacucacgaaggaagggagaucuuggcugaagaacucuguacacccccugacccaggcgccgcguuuguggucguugaaugccccgaugagucuuucauacagccuauuugugagaacgccaccuuucaacgguaccagggcaaagcagacgcuccaguggcccugguagugcacauggcucccgccuccgucuuaguggauucacgauaucagcaguggauggaacgcuucgggccggacacgcaacaucugguucucaaugagaacugcgcaagcgugcacaaucuuagaagucauaagauccagacucagcugaacuugauucacccugauaucuuuccccuacugaccucuuucagguguaaaaaggaaggaccaacacucuccgucccuauggugcaaggugagugccugcuuaaauaccagcugcggccccgcagagaauggcagagggacgccaucauuacuuguaauccagaggaguuuauaguagaagcauugcagcuccccaacuuccaacagagcguucaggaguaccgucggucggcgcaggauggcccugcaccagccgaaaagcgaucucaauauccggagaucauuuuccuggggaccggauccgcuauccccaugaaaauaagaaaugugucagccacauuagucaacauuaguccugacaccagccugcuacucgacugcggcgaagguacguuugggcagcugugcaggcacuacggcgaucagguggaccgcguccuuggaacuuuggcagccguguucguuucccaucugcacgcugaucaucacacaggccucccaucuauccugcuucagcgggagagagcccuggcuagcuuggggaagccccuccauccucuguuagugguagcgccaaaucaacugaaggcuuggcuacagcaguaucacaaccagugucaagagguccuccaccauaucucaaugauucccgccaaaugccugcaggaaggagcagagaucaguuccccggccguggaaaggcuuauuagcucuuugcugcgcaccugugaccucgaggaguuucagacuugccugguucgacacuguaagcaugcuuucgguugcgccuuagugcacacaucaggcuggaaagucguguacaguggggauaccaugccuugugaagcacugguacggaugggaaaggacgcuacgcuuuugauacacgaggccacccucgaagauggccuggaggaagaggcgguggagaaaacacauagcacuaccucccaagccaucucuguugguaugcguaugaacgcugaauuuauuaugcuaaaucacuucucgcagagauaugcaaaggucccacuguuuagccccaacuucuccgagaagguggggguggccuuugaccauaugaaagucugcuucggcgauuuuccuacaaugcccaagcucaucccaccucugaaagcucuuuucgccggagacaucgaagagauggaagagaggcgcgagaagcgggaauugagacagguuagggcagcgcuguuaucacgagagcucgccggcgggcuggaagauggagagccccagcaaaaacgcgcucacacugaggagccacaggccaagaaggugcgggcacaguga

SEQ ID NO: 55720 - RNA, 804 nt, Artificial Sequence
  derived and/or modified sequence opt3 from ELANE__Homo_sapiens__NP_001963
augacccugggcagaaggcucgccugccuuuuccuggcuuguguguugcccgcauuacugcuagggggaacagcccucgcgagcgagaucgucgguggccggcgcgcucgaccucacgccuggccauuuaugguuucccugcagcuucgugggggacauuucugcggcgcaacucugauugccccgaacuuugugaugucugcugcacacuguguagccaaugugaacgucagagcugugaggguuguguugggugcccauaaucucucacggcgcgaacccacgagacaagucuucgcggugcagaggauauuugagaacggguacgacccuguaaaucugcugaacgauaucguuauucuccaguuaaauggaagugcaaccaucaacgccaaugugcaggucgcucaacugccagcccagggccggcgccuuggcaacggggugcagugcuuggcaaugggauggggucugcuaggccgaaauagagggauugcuagcgugcuccaggaacugaacgucacaguugugacuucccuuuguaggcggucuaauguaugcacccuggugcguggacgccaagccggcgucuguuucggugacucggggucacccuuggugugcaacggacucauccacggcauagcgagcuuuguuagaggcgggugugccaguggacuguauccugaugcauucgcuccaguggcccaguuugucaauuggaucgacuccauuauccagaggucugaggauaaccccugcccucauccacgggacccggaucccgcuagccgaacacacuga

SEQ ID NO: 55721 - RNA, 981 nt, Artificial Sequence
  derived and/or modified sequence opt3 from ELAVL1__Homo_sapiens__NP_001410
augagcaacggcuacgaggaccacauggccgaagauugcagaggggacaucggaaggaccaaucugauugugaacuaucucccccagaauaugacacaagaugagcuucggucccuguucucuucaauaggugaagucgagagugcuaaguugauccgcgacaaaguugcaggccauagcuuaggguacggauuugugaacuauguaacugccaaggaugcggaacgagcuauuaauacgcugaacggccuacgucuccaguccaaaaccaucaaggugucuuacgccagaccuucgucagaggucauuaaagacgcaaaucuguauaucagcggucuuccaaggacaaugacucagaaggauguggaggacauguucagucgguuugggcgcauaaucaacuccagaguucugguggaucagaccacaggauugucuaggggcgucgccuucauucgguuugacaagcgcagcgaagcugaggaagcaaucaccuccuucaauggccacaaaccgcccgggucaagugagccuauuacugugaaguuugccgcuaacccaaaucaaaacaaaaauguagcccuccugagccagcuguaccauucucccgcgcgaagauucggagguccuguucaccaucaggcacagagguuucgguucuccccaaugggcguggaucacaugucagggcucagcggagucaacgugcccggcaaugccaguucugguugguguaucuuuauauauaacuuagggcaagacgcugaugagggcauucuguggcagauguucggaccuuuuggcgccgugacaaacgucaagguuauccgugacuucaauaccaacaaaugcaagggguucggauuugugacgaugacuaauuacgaagaggcagcuauggccauugcgucccuuaacgguuaccgcuugggcgacaagauccugcagguaucguucaaaaccaauaagagccacaaauga

SEQ ID NO: 55722 - RNA, 1041 nt, Artificial Sequence
  derived and/or modified sequence opt3 from ELAVL2__Homo_sapiens__NP_001164668
auggagacccagcugagcaacggccccacaugcaauaacacugccaaugggccuacgaccaucaacaauaacuguuccucuccaguggacucaggaaauacagaagauaguaagacuaaccucauugucaauuaccuuccgcaaaacaugacccaggaggaacugaaauccuuguucgguagcauaggcgagaucgaaucuugcaaguuaguuagagacaaaauuacagggcagucgcugggauauggcuuugugaauuacaucgaucccaaggacgcugagaaagcaauuaacacccuaaauggucucaggcugcagacuaagacaaucaagguaucauaugcccggccuagcagugcguccauacgcgaugcuaaccuuuacgugucugggcugccaaaaaccaugacgcaaaaggaguuggaacagcuguucagccaguauggacgaaucauuacuucccguauccuggucgaccaggugaccggcauuucaagaggcguuggguuuaucagguucgauaaacggauagaggccgaagaggcaauuaagggacugaauggucaaaaacccccuggcgccacagagccaaucacugugaaguuugcuaacaaccccagucagaagaccaaucaggcaauucucagccaguuauaccaaucuccuaaccgcagauauccagggccgcuggcccagcaggcucaaagguuccgguuuucccccaugacaaucgacggaaugaccucacuugccggcaucaauauuccuggucacccagggacgggaugguguauauucgucuacaacuuggcgcccgaugcagacgaaagcauccuguggcagauguuuggcccuuucggcgccgugacuaauguaaaaguuauucgcgauuuuaacacaaauaagugcaaaggguucggauuugugaccaugacuaacuacgacgaggcugccauggcaaucgcuagucuaaaugguuaucgacucggcgauagaguccuccaggugucuuucaagacaaacaaaacccauaaggccuga

SEQ ID NO: 55723 - RNA, 1104 nt, Artificial Sequence
  derived and/or modified sequence opt3 from ELAVL3__Homo_sapiens__NP_001411
auggugacccagauccugggcgccauggagagccaagucgggggaggucccgcuggcccugcacucccaaacgggccgcuucugggaacaaauggcgccacugacgauuccaagacgaacuugauuguuaauuacuuaccccagaacaugacccaggacgaguucaaaucucuguuugguucaauaggggauaucgaaaguugcaagcuagugagagacaaaauuacaggacagagccucggcuauggcuucguaaauuacuccgauccuaacgacgcggauaaggcuaucaauacucugaacgggcuuaaacugcaaaccaagacaauuaaggugucuuaugccaggccaucgucagcaagcauccgggacgccaauuuguacgucaguggacuccccaaaaccaugucccagaaggaaauggagcagcuguuuucucaguauggucgcauaaucacuagccguauucugguggaucaaguuacaggcgugucccgaggggucggauucaucagauuugacaaaaggauugaagcugaggaggcaaucaagggccucaacggucagaaaccuuuaggggccgcugaaccaauaaccgugaaguucgccaauaaccccucacagaagacgggacaggcgcugcuuacucacuuguaccaaaguagcgcacggcgcuaugccggcccucugcaucaccagacccagagauuuaggcuagauaaucuccugaacauggcuuacggcguaaaaucuccacuuucccugauugcccgguucucaccgaucgcaauugacgggaugagcggauuggcugguguuggccucagugggggagccgcgggcgccgguugguguaucuuuguguacaaucugucucccgaggcagaugaauccgucuuauggcaacuguucgggccuuuuggcgcugugacaaacgugaaggucauccgcgacuucacuaccaacaaaugcaagggauuuggcuucguuacaaugaccaauuaugacgaggccgcuauggccauugcaagccucaacggguaccgacuuggagagagagugcugcagguaucguucaaaacgucuaagcagcauaaagccuga

SEQ ID NO: 55724 - RNA, 1116 nt, Artificial Sequence
  derived and/or modified sequence opt3 from ELAVL4__Homo_sapiens__NP_001281277
auggaguggaacggccugaagaugaucauuagcaccauggaaccccagguguccaaugggccuacaucuaacacuucaaauggaccaaguagcaacaauagaaacugcccgucccccaugcaaacgggugccaccacagacgauucuaaaacuaaucucauagucaacuaccuuccucagaauaugacccaggaggaguucaggucgcuguuuggcucaaucggggaaauugaaagcuguaaguugguucgggacaaaaucacaggacagaguuuaggcuaugguuucgugaacuacauugauccaaaggacgcugagaaagcaaucaauacccugaacgggcuacgccuccaaacuaagacaauaaagguauccuaugcccgacccucuagcgcguccauccgugaugcuaaucuguacgugucaggacuuccuaaaaccaugacgcagaaggagcuggaacaguuguuuagucaguauggcagaauuaucacuagcaggauucucgucgaccaagugaccggcguuucucgcggggugggauucauccgguuugauaaaagaauagaggccgaagaggcaauuaagggucugaacggccagaaaccauccggggccacagagcccaucacugucaaguucgcuaauaacccuucacaaaagagcagucaggcacugcucucucaguuauaccaguccccaaacaggcgguauccgggaccccugcaccaucaggcccaacgcuuucgacuugacaauuugcugaacauggcuuacggcgugaaaagauucagcccuauuaccaucgaugguaugacaucgcuaguagggaugaauaucccaggacacaccggcacgggcuggugcauuuuuguuuacaaccucucucccgacuccgaugaaucagugcuguggcagcuuuucgggccuuuuggagccgucaauaacgugaaggugauaagggacuucaauacuaacaaauguaaggguuuuggcuucgucacaaugaccaauuaugaugaggcggcaauggccaucgcuagucugaacggguaccgguugggagaccguguucuccaggugagcuucaaaacuaauaaggcccauaaauccuga

SEQ ID NO: 55725 - RNA, 1788 nt, Artificial Sequence
  derived and/or modified sequence opt3 from ELF1__Homo_sapiens__NP_001138825
auggccgcugugguccagcaaaacgaccugguuuucgaguuugcaagcaaugugauggaagaugagagacagcucggcgaccccgccaucuucccugcgguaauuguggaacacgucccaggggcugauauacuuaacuccuacgccggacuggcaugcguggaggaaccgaaugacaugaucaccgagucuucauuggauguugccgaggaagagauuaucgacgaugacgaugacgauauuacauuaacuguggaagcuaguugucaugacggugaugagacgaucgagaccauagaagcagccgaggcucugcuaaacauggacagccccggcccuaugcucgacgaaaagaggaucaaugggauuccagaggucauggaaacacaacaggugcaggagaaauaugccgauucccccggagcgucuucgccugagcagccaaagcggaaaaagggccgcaaaacuaagcccccucgaccagacucaccggcaaccacacccaacaucagcguaaagaaaaagaauaaagaugguaaggggaacaccauuuaccugugggaauuucuucuggccuugcuccaggacaaagcuacuugcccuaaguauaucaaguggacacagcgugagaaaggaauauucaagcugguugauaguaaagccguguccagacuguggggcaagcacaaaaauaagccagacaugaacuacgaaaccaugggcagggcacuccgguauuacuaucaacgcgggauuuuagcuaaagucgagggacagagacugguguaccaguuuaaggaaaugcccaaggaucuuaucuacauuaaugacgaggauccuucuagcuccaucgagucaagugaccccagcuugucuuccucagccacgagcaacaggaaucagacuagccggucucgcguguccagcucgccaggugucaaaggcggggcgaccacaguucugaagccgggaaacucuaaagccgcaaagccuaaagaucccguggaaguagcucaaccauccgaggugcuacgaacuguccagccuacccagucacccuauccaacacaacucuucagaaccgugcauguugugcagcccguccaggccgugccugaaggcgaggcugccaggacgaguacuaugcaggacgaaacacugaauagcuccguacaaucuauccggaccauucaggcaccaacucagguuccgguggucgugagcccccguaaccagcaacuucacacagucacccugcagacggugccuuugaccacaguuauagccucaacugacccaagugcugguaccgggucccagaaguuuauccuccaggcgauucccagcucucaaccuaugacagugcugaaggagaacguaauguuacagucacagaaagcaggaaguccacccagcaucguccugggcccggcccaggugcaacagguucucacuuccaaugugcagaccauauguaacggcacagucucuguggcuucgagcccuuccuucucagccaccgcaccaguagugacuuuuaguccccgcucuagccaacuuguugcccauccucccgggacggucauuacauccgugaucaagacccaggagacuaaaacccugacacaggaaguggagaagaaagaaucagaggaucacuugaaggagaauaccgaaaagacugagcagcaaccacagccuuacgucaugguugugaguucuuccaacggauucacaagucagguggcuaugaaacagaaugaacuacuggagcccaacagcuuuuga

SEQ ID NO: 55726 - RNA, 1515 nt, Artificial Sequence
  derived and/or modified sequence opt3 from ELF2__Homo_sapiens__NP_001263386
auggccaccagccugcacgagggccccacaaaccagcucgaccuucugaucagagcuguggaagcauccguccauucuucaaaugcccacugcacugauaagacgauugaggcggcugaagccuuguuacauauggagaguccuaccugucugagggacagccgguccccaguugaaguguucguaccgcccugcgugucuacaccugaguuuauacacgcagccaugcgcccagaugucaucacugagaccgugguugaagugucgacagaggaaucagagcccauggacaccagcccuauuccaacaagucccgauucccaugagccuaugaaaaagaaaaaggggaacacuaccuaccuaugggaguuccuccuggaccuucugcaagauaaaaauacguguccacgauauaucaaguggacucagcgugaaaagggaauuuuuaaauuggucgacucuaaggcugugagcaaacucugggguaagcacaaaaacaagccggauaugaauuacgaaaccaugggcagagcacugagguauuacuaucagcgggggauccuggccaagguagagggacagcgccucguuuaccaauucaaagacaugcccaagaacauaguggucaucgaugacgauaaauccgaaacaugcaaugaggacuuagcuggcacuaccgacgagaagucacuggaaagagugagucuuagcgccgagucuuugcugaaagcggcauccucagugaggagcgguaagaacaguucuccuauuaauuguucccgggccgaaaaaggggucgcucgcguugugaacaucacaagcccaggacacgaugccucgucucgaucccccaccacgacugcaucaguaagugcuacagccgcgccuagaaccgugagggucgccaugcaagugccaguugugaugacuagccuaggccagaagauuuccacagucgcagugcagucuguaaaugcuggcgcuccccucaucaccagcacgucaccgaccacagccaccaguccuaagguugugauacaaacuauucccacagucaugccagccuccacugagaacggggacaaaaucaccaugcagccugcaaagauuaucacaauccccgccacccagcuggcucagugccaacuucagacuaaaagcaaucugacgggaucugguucaauuaacauagugggcacaccauuggcgguccgggcacucacccccgugaguaucgcccaugggacuccuguuaugcgucugagcaugccaacccagcaggcuuccggacagacaccgccccgcgugauuucugccguaaucaagggcccugaagucaaaucggaggcaguggccaagaagcaggagcacgauguuaaaaccuuacagcugguggaagagaagccagcugacgguaauaaaacugucacacaugugguagugguuagcgcccccuccgcaauagcgcucccugucacgaugaagaccgaagggcuugugacuugugagaaauga

SEQ ID NO: 55727 - RNA, 1116 nt, Artificial Sequence
  derived and/or modified sequence opt3 from ELF3__Homo_sapiens__NP_001107781
auggccgcuaccugcgagaucagcaacauuuucuccaauuacuuuucugcaauguauucaagugaagacagcacacuggccuccgugcccccugcggcuacuuucggcgccgaugaccucguccuuacgcugucuaacccacagaugucguuggaggggaccgaaaaggcaucaugguuaggagagcaaccgcaguuuuggagcaaaacacagguucuggauuggauaaguuaccagguggaaaagaauaaauaugacgccuccgcuaucgauuucucuagaugugacauggauggugcaacucuaugcaacugugcccucgaggagcugaggcuuguauuuggcccccugggggaccaauugcacgcucagcuccgggaucugaccagcuccucaagugacgaacugagcuggauuaucgagcucuuagaaaaggauggaauggccuuccaggaggcgcuggacccuggcccauuugaucaggguucucccuucgcacaagagcuuuuggacgacgggcagcaggccuccccuuaccauccaggaucaugcggcgcuggcgcccccagcccugggaguucugauguguccacagcaggaaccggugcuagccgcucgucucacuccucagacaguggcgggagcgaugucgaccuggauccaacugacggaaaacuauuuccguccgauggcuuccgagacuguaagaagggugaucccaaacaugggaagcguaaaagaggaaggccucggaagcucucuaaagaauauugggacugccuggagggcaaaaagagcaagcacgccccacgcggcacacaucuuugggaauuuauuagagauauccugauacaccccgaguugaaugaagggcucaugaagugggagaacaggcacgagggaguguucaaauuucugcggucagaagcgguugcccaguuauggggucaaaagaaaaagaauaguaacaugaccuacgagaaacugucccgcgcaaugcgauauuacuacaagagagaaauccucgagaggguggacggccggcgucuugucuauaaguucgggaaaaauagcucuggauggaaggaagaggaggugcugcagucacgcaacuga

SEQ ID NO: 55728 - RNA, 1992 nt, Artificial Sequence
  derived and/or modified sequence opt3 from ELF4__Homo_sapiens__XP_005262446
auggccaucacccugcagcccagcgaccucauuuucgaguuugcuuccaacggcauggaugacgauauacaccaacuugaagacccuucuguguucccagcagucaucguugaacaggugccguaccccgaucuguugcauuuauauucagggcuggagcuagacgauguacacaauggaauuaucacagacgguacucucugcaugacgcaggaucagauucuggagggcaguuuucuucugaccgacgauaacgaagccacaagccauacuauguccaccgcggagguguugcucaauauggagucuccuucggacauccuggaugaaaagcaaauauucucaacaagcgagaugcugccagacagugaccccgcuccugccgucacccucccaaacuacuuauuucccgcauccgaaccugaugcccugaauagagcuggggacacuucugaucaggagggacacagccuugaggaaaaagcauccagggaggaaucagccaagaaaacaggcaagaguaaaaagcggauccgcaagaccaaagguaaccgaagcacgucuccagugacugacccguccauucccauccguaagaaaucaaaggaugggaaaggaagcaccauuuauuugugggaguuccugcuagcucuccugcaggacagaaauacauguccuaaguacaucaaguggacucagagggaaaaaggcauauuuaaacuuguugauaguaaggccgugucuaagcuguggggcaaacaaaagaacaaaccagacaugaauuaugagaccauggggcgggcguugcgcuacuauuaccagagagguauucucgcaaaggucgagggacagaggcugguguaccaguucaaggaaaugcccaaagauuuaguaguuaucgaggacgaagaugaguccagcgaagccacagcugccccuccacaagcaucgaccgcuucuguggccuccgcgucaacgacucggcgcacaaguagccgagucuccucuagaagcgcaccccagggcaaggggucaaguuccugggagaaaccgaagauucagcaugugggacugcaaccuagcgccucucucgagcuuggccccucacuggacgaagagaucccaaccacgaguacaauguuggugagcccugcugaaggucaggucaaacuaaccaaggccguuuccgcuucuucggugcccagcaacauccaccuggggguagccccagugggauccggcucagcacucacgcugcagaccauuccccuuacaacuguccugaccaauggcccuccagccaguacaacugcuccgacccaguuggugcuccaaucuguucccgcggcaagcacauuuaaggacaccuucacucugcaggccuccuuuccuuuaaacgcuucauuccaggauagccagguggccgcaccaggggcuccccugauacuaucuggacucccucaacugcuugccggugccaauaggccaacgaaccccgcaccgccuacagucaccggcgcggggccagcuggacccuccagucagccucccggcacugugaucgccgcauuuauucggaccagcgguacaaccgccgcuccacguguaaaagaggggccuuugagaucuuccucauauguucagggcauggugacuggagcccccauggaaggccugcucgucccagaggagacacugcgcgaacuucugagggaccaggcacacuugcaaccgcucccuacucagguggucagucgggggagccauaaucccucgcuguuaggaaaccagacccuguccccacccucucgaccuacugugggucuaacaccaguugcugagcucgaacugagcucaggcagugggucccuuuugauggccgagcccucugugaccacaagcggaucccugcucacucgcucaccuaccccggcgccauucagccccuucaacccuacgagucugaucaagauggagccacacgauauauga

SEQ ID NO: 55729 - RNA, 483 nt, Artificial Sequence
  derived and/or modified sequence opt3 from ELF5__Homo_sapiens__NP_001230009
augcuggacagcgugacccacuccacauuccuccccaacgccucuuuuugcgauccucuuaugucauggacugaccuguucaguaaugaggaauacuauccagcuuuugagcaucagacggaugcagacagcaacuguuugaagaccuccggcaucaaaucucaagauugccacucgcauucaagaacuagcuuacagaguucccaccugugggaguucgucagggaccuacuccugucuccggaagaaaauugugggauucuugagugggaggaucgggaacagggaauauuucgcguuguaaagagcgaggcccuggcgaaaauguggggucagcgaaagaaaaacgaccguaugacauacgaaaaguuguccagagcucucagguauuacuauaagaccggcauccuggagcggguggaucgcagacugguguacaaauucgggaagaaugcccauggauggcaagaggacaaacucuga

SEQ ID NO: 55730 - RNA, 288 nt, Artificial Sequence
  derived and/or modified sequence opt3 from ELK1__Homo_sapiens__NP_001244097
auggaccccagcgugacccuguggcaguuccuccuucaacuguugagagagcagggcaacgggcacaucauuuccuggacaucuagggauggaggugaauuuaaguuagucgacgccgaggaaguugcucggcuguggggccuacgcaaaaauaagacuaacaugaauuacgauaaacucucacgagcacugcguuauuacuaugacaagaacauaaucagaaaagugagugggcagaaguucguauacaaguuugugagcuauccugagucccauugcgccccauga

SEQ ID NO: 55731 - RNA, 1224 nt, Artificial Sequence
  derived and/or modified sequence opt3 from ELK3__Homo_sapiens__XP_006719338
auggagagcgccaucacccuguggcaguuccuccuucaacuguuguuagaccagaagcacgaacaucugauuugcuggacauccaacgauggcgaguuuaaacuacucaaggcugaagagguggcaaaacugugggggcuuagaaagaauaaaacuaacaugaauuacgacaagcugucuagggccuugcgguauuacuaugauaagaacauaaucaaaaaggucauuggacagaaauucguuuacaaguuugugucauuccccgaaauccucaaaauggacccucacgcgguagagauuagucgcgagagccugcugcuccaggauuccgacuguaaggcuucuccagaaggucgagaggcccauaagcacggcuuagcagcccugcguucgacgucaagaaaugaauauauccauagcgggcuuuacaguuccuuuaccauaaacucuuugcaaaauccgcccgaugcuuucaaagcaaucaagacagagaaacuggaggaaccuccagaggacagucccccuguggaagaggucaggacugugauucgguuuguuaccaacaagacagauaaacacgugacccgcccagucgugucccuacccucaacuagcgaagccgcugccgcgagcgcauuccucgccucuuccguaucagcuaagaucagcagucugaugcuuccuaaugccgcaucuauuuccagcgcuucgccauuuucuuccagaucaccgagucugagccccaacuccccuuugccaucugagcacaggagccucuuccuggaggccgcgugccaugacucagauaguuuagaaccccugaaucucuccagcggaucuaaaacaaagucaccuagucuuccacccaaggccaaaaagccgaaaggccuggagaucagcgcaccucccuugguucuauccgguaccgacauagggucuauugcucugaacucgccagcccucccuagcggaucccugacgcccgccuuuuucacugcucagaccccaaauggccuucuguugacacccucaccucuccugaguucuauccacuuuuggagcuccuuaucaccaguggcaccgcugagccccgcccggcuacagggcccuucuacucucuuccaguucccaacccugcuuaacgggcauaugcccgucccuauuccauccuuggaucgcgcugcgagucccgugcugcucagcucuaauucccaaaagucauga

SEQ ID NO: 55732 - RNA, 1218 nt, Artificial Sequence
  derived and/or modified sequence opt3 from ELK4__Homo_sapiens__NP_068567
auggacagcgccaucacccuguggcaguuccuccuucaacuguugcagaagccccagaacaaacacaugauuugcuggacauccaaugauggccaguuuaaguuacugcaagcugaggaaguggcaagacuaugggggauaaggaaaaacaagccuaauaugaacuacgacaaacucucucgggcccugcgcuauuacuaugucaagaauaucauuaagaaaguuaacggacagaaguucguguacaaauuuguaucauauccagagauccuuaauauggauccgaugacugugggucgaauugaaggcgacugugagagucugaacuucagcgaagucuccucuucgucaaaggauguggagaaugggggaaaagacaagcccccucagccaggcgcgaagacgagcagucguaacgauuacauccauuccgguuuguauucuagcuuuacccucaauucccugaacucaaguaauguuaaacuguucaagcucauaaaaacagagaaccccgcugaaaaguuagccgagaaaaagagcccucaggaaccaacucccucugugaucaaauuugucaccacaccuuccaagaagccaccgguggagcccguagcagccaccauuucaaucgggccuagcauuaguccaucuuccgaggaaacuauccaagcucuggagacacuuguuagccccaaauugccuucgcuggaagcaccaaccucugccuccaaugugaugacggcuuucgccacuacacccccgauaucaaguauuccuccccuacaggagccaccuagaacccccagcccaccccucuccucucacccugacaucgauacugacauugauagcgucgcgucacagccaauggaacugccggagaaccuuagucuggagcccaaggaccaggauuccguguugcucgaaaaagacaaggugaacaauagcucuaggaguaaaaagccuaagggacuggaguuagcaccaacccuggucaucacaucaagcgaccccuccccucucggcauccuuucuccaucgcugcccaccgccagcuugacgccggccuuuuucucccaaguugcuugcucacuauuuauggugaguccucugcucucuuucauuuguccauuuaaacagauacagaaccuguacacucaaguaugcuuccuucuguugcgguucgugcucgaacgccugugugucacagugauguga

SEQ ID NO: 55733 - RNA, 1923 nt, Artificial Sequence
  derived and/or modified sequence opt3 from ELL2__Homo_sapiens__NP_036213
auggccgcuggcgggaccggaggucugagagaggaacagagguacggccucagcugcgggcggcuuggacaagacaacaucacagugcugcacgucaaguugacugagacggcaauucgcgccuuagaaaccuaucagucccauaaaaaucugauacccuuccgaccuucuauccaguuucagggccuacacggucucguuaagauuccgaaaaacgauccacugaaugaggugcauaacuucaauuuuuaccuuucaaacguagggaaggacaauccccaaggaaguuucgauuguauccagcagacauuuagcuccucuggcgcgucgcagcugaacugcuugggcuucauucaagacaaaaucacugugugugcuaccaaugauucauaucagaugacacgugaaagaaugacccaggccgaggaggaaagcaggaaccggaguacuaaggucauaaagccugggggaccauacguggguaaacgcguucagaucagaaaggcaccccaagccguguccgacacagucccugagaggaaacggucuaccccaaugaaucccgcuaacacgauucgcaagacucacagcuccucaaccaucagucagcgaccuuauagagauagggugauucaucuccuggcacugaaagccuacaagaagccagaacucuuagcucggcugcagaaagacggcguaaaucaaaaggauaaaaacagccuuggggccaucuugcagcagguugcgaaucugaacucuaaggaccuauccuauacacucaaagauuacguguuuaaggagcugcagcgugacuggccgggauacucagagauagaucgcagaagccuugaaaguguccugucuaggaaauugaaccccucccaaaaugcagccggcacuagccggucggagucuccugugugcuccucacgagacgcugugaguagcccacagaagcgccuccuggacuccgaguucauugaucccuuaaugaacaagaaagccagaaucucucaccugaccaauagggucccuccaacacucaacggucaccuuaaucccaccagcgaaaagucagcagcugggcugccguugccucccgccgcggccgcaauuccaacgccucccccacuacccaguacuuaucugccuaucucccauccaccgcagaucguuaacagcaauucuaacucacccaguacaccugaaggacggggcacccaggaccucccaguggauagcuuuucccaaaaugacucuauuuacgaggaucagcaggacaaauauacuucgcgcacaagccuggagacccuucccccuggcuccguacuguugaaguguccaaaacccauggaagagaaccacucaaugagucauaagaagucuaaaaagaaaagcaagaaacacaaggaaaaggaucagaucaaaaagcacgacauagagacgauugaagagaaagaggaagaucucaagagagaggaagagaucgcuaaacugaauaacuccucaccgaauagcucugggggagugaaggaagacugcaccgccuccauggagccuagugcuauagaguuaccagauuaccugauuaaguauaucgccaucgucagcuacgaacaaaggcagaacuauaaagacgacuucaaugcagaguacgaugaauaccgugcccuacaugcucggauggagacaguggcgcgaagauuuauuaagcucgacgcacagaggaaacgccugucucccgguuccaaggaguaucagaacguucacgaagaggugcuucaagaauaccagaaaaucaagcagucaaguccuaacuaucaugaggaaaaauaccggugugaguauuugcacaauaagcuggcccauauuaagagacucauaggcgaguucgaucaacagcaggcugaaagcuggucguga

SEQ ID NO: 55734 - RNA, 1866 nt, Artificial Sequence
  derived and/or modified sequence opt3 from ELL__Homo_sapiens__NP_006523
auggccgcucugaaggaggacagaagcuacggccucuccugcgggagggugucugauggaucaaaagucaguguuuuccacgugaaguugaccgacagcgcacugcgggccuuugaauccuaucgcgcgcgacaggauucuguaucguugcgucccucaaucagauuccaagguagccagggccauauuaguauaccucagccagacuguccggcugaggccaggacauuuuccuucuacuuaucuaacaucgggcgggauaauccccagggaucuuuugacugcauucaacaguauguguccucacacggcgaaguccaucuggauugucuagguaguauccaggacaaaauuacugugugcgcaacggaugacagcuaccagaaggcccgccaaucuauggcucaggcagaggaagagaccagauccaggucagccaucguuauaaaagcugggggacgguaucucggcaagaaggugcaguuccgcaaaccugccccaggcgcgacagaugcaguccccagccgaaagagagccacuccuaucaaccuggcuagugccauuaggaaaucuggggcauccgcugugagcggagguucgggcguaucucagcggccauuucgugaccgcguucuucaccuguuggcccucagacccuacaggaaggcggagcugcugcuccgguuacaaaaagaugggcugacccaggccgacaaggacgcacuugauggauugcugcagcaaguggcuaauauguccgccaaggacggcacauguacccuacaggauugcauguauaaagacguccagaaggauuggccugguuacucagaaggggaccagcaacuccugaaacgagugcuugugcgcaagcugugucagccacagaguacuggaagccuucucggcgauccggcugccuccucucccccuggcgagagagggaggagcgcaucaccaccccagaaacggcugcaaccuccagacuucaucgaucccuuagccaacaagaaaccgcgcauuagucauuuuacacagagagcucagccugcggucaauggaaagcuggguguucccaacggcagggaagcacuccuuccaaccccugggcccccagccuccacggacacucugagcagcucaacccacuugcccccucgucuagagccaccgcgggcucacgauccccuggccgacgugaguaaugaccucggacauagcggccgagauugcgagcacggugaagcagccgcuccugccccaacaguaagacuggggcuuccccuguugacugacugugcacagccuuccaggccacauggcucucccucgcgcagcaagccgaaaaagaaauccaagaaacacaaggauaaggagcgggcggcugaagacaaaccuagagcccaacucccagauugcgcacccgccacccacgcuacaccuggagcccccgcagacaccccaggccugaacgggacguguucagugaguucugucccuacuagcacauccgagacccccgauuacuuacugaaguaugcugccaucucaagcucugaacagaggcaguccuacaaaaaugacuucaacgcggaguauagugaguaccgcgaucuacaugcccgaauagaacggauuacucguagauuuacacagcucgacgcucaacugaggcagcuuagccagggaucugaggaauaugagaccacgcgcggucaaaucuugcaggaauaccggaagauuaaaaagaccaauacaaacuauucccaggagaagcacagaugcgaguaccugcauucaaaacucgcacacaucaagaggcugaucgccgaauacgaucagcgacaacuucaggcuuggccauga

SEQ ID NO: 55735 - RNA, 744 nt, Artificial Sequence
  derived and/or modified sequence opt3 from ELMO1__Homo_sapiens__NP_569709
augcaaguggucaaggagcagguuaugagagcccugaccacaaaacccagcucccucgaccaguucaagucuaaacuucagaaccugucauacacugaaaucuugaagauuaggcagagugagcggaugaaucaagaagauuuucagagccgcccuauauuagagcugaaagaaaagauccagccagagauucuagagcucaucaagcagcaacgacugaaccgucuuguggaaggcacgugcuucagaaaacugaaugccaggcggcgccaggacaaguuuugguauuguagauuguccccgaaccacaaaguacuccauuacggggaucuggaggaaucuccccagggagaggugccucacgacucgcugcaggauaagcucccagucgcagacauuaaagccgugguuaccgguaaggauugcccccauaugaaggagaaaggcgcguuaaagcaaaauaaagaagugcuggagcuugcuuucucaaucuuguaugacagcaacugucagcugaauuuuauagccccugauaagcacgaauacugcaucuggacagacgggcuaaacgcacuccugggaaaagauaugaugagugaccuuacuaggaaugaucuggacaccuugcucuccauggagauuaagcugcgguuacuggaccucgaaaacauccagauuccagaugcucccccuccaaucccgaaagagcccucuaauuaugacuucgucuacgauuguaacuga

SEQ ID NO: 55736 - RNA, 2163 nt, Artificial Sequence
  derived and/or modified sequence opt3 from ELMO2__Homo_sapiens__NP_877496
augcccccuccaagcgacaucgugaaggucgccauugaguggccgggcgcuaacgcacagcugcucgaaauagaucagaaaagaccccuugccuccaucauuaaggagguuugcgacggguggucucugccuaauccagaauacuauaccuugagguacgcggauggaccccaauuauauaucacagagcagacucggucagacauuaaaaacgguacgauccugcagcuagcuauaaguccuagccgcgccgcacgacaacucauggaacguacccaguccucuaauauggagacaagacuggaugccaugaaggagcuugcuaaacugucggcagacgugacuuucgccaccgaauuuaucaacauggauggcauuaucguauugacaaggcucguggagucagggaccaagcugcugagccacuacagugaaaugcucgcuuucacuuuaacagccuuucuggagcuuauggaccauggaauugucuccugggauauggugucuaucaccuucauaaagcagauugcgggcuauguuagccagccaaugguggacgucuccaucuugcaacggucacuggcaauucuagagaguauggugcucaauagccagucucuguaccagaaaaucgccgaagagaucacgguaggucagcuuauuucccaucugcaaguuucaaaccaggaaauacagacuuaugcuaucgccuugauuaaugcacucuuucugaaggcucccgaggauaaacgccaagacauggccaacgcguucgcccagaagcacuuaagaagcaucauacugaaucacgugauuagggggaaccggccuaucaaaaccgaaauggcacaucagcucuacguccuucaggugcugacauuuaauuugcuagaggagcgcaugaugacuaagauggauccaaacgaccaagcucagcgagacaucauuuucgaacugagaaggaucgccuuugaugcugagagugacccgucuaaugcccccggauccggcaccgaaaagcggaaagcaauguacacaaaggauuauaaaaugcucggcuucaccaaccacauuaauccugccauggacuuuacgcagacuccacccgggaugcuggcucuugauaacaugcuguacuuggcgaaggugcaccaggacacauauauacguaucguccucgagaacagcucgcgcgaagauaaacaugaguguccuuucggaagaucugcaauugagcugaccaagauguuaugcgaaauccugcaaguuggugagcuaccaaaugaaggcaggaacgacuaccaccccauguuuuucacucaugaucgggccuucgaggaacucuuugggaucuguauucagcugcuuaauaaaacauggaaggagaugcgagcuaccgccgaggacuucaacaaggugaugcagguagugcgcgaacagauaacgagagcauugccguccaaaccuaauucacuggaucaauuuaagaguaaacucaggagccuguccuauucugagauccuucggcugcgccagagcgaaagaaugucacaggacgacuuccagagucccccaauugucgaguugagggagaagauccaaccugaaauucucgagcugaucaaacagcagcguuuaaaccggcugugcgaaggauccagcuuucgaaagauaggcaauagaaggcgccaagagcgguucugguacuguagacuagcccucaaccacaaggugcugcacuauggugaucuugacgauaauccccagggggaaguuaccuuugagucuuugcaggagaaaaucccaguggcugacauuaaggccaucgucacaggaaaagauugcccccauaugaaggaaaaaucagcacugaagcagaacaaggaggugcucgaacuggcguucaguauuuuauacgacccugaugagacucugaauuuuaucgcuccaaacaaauacgaauauuguauauggauugacggccuuagcgccuugcucggcaaggauauguccucugagcugaccaaaucggaccuagauacacugcucagcauggagaugaagcugaggcuuuuggaccuggaaaauauccaaauuccggaggcacccccuccaauccccaaagaaccuuccucauacgauuucguauaucacuacggguga

SEQ ID NO: 55737 - RNA, 981 nt, Artificial Sequence
  derived and/or modified sequence opt3 from ELMOD1__Homo_sapiens__NP_001123509
augaagcacuuccugagaaugcucauccaggugugccuuuacuuuuauuguaaauuccuguggaggugcuugaaguuugucaugcggaaauuaaccggccgcugugagcugcaacgaauuugcuacaacacaaagcccggggccagccguacuaugaaaauagaaacgucccuaagagacucuaagucaaagcuccugcagaccaguguuagcgugcauccugaugcuaucgagaaaacaauugaagacaucauggagcuuaagaaaauuaauccagauguaaacccgcagcugggaaucuccuugcaggcaugucuccugcaaauaguggguuauaggaaucugaucgccgacgucgaaaagcuccggcgcgaggcguacgauucugacaacccccagcacgaggaaauguuacugaaacuuuggaaguucuugaagccuaauacuccacuggagucgagaauuucaaaacaguggugcgaaaucggcuuucagggggaugaccccaagaccgauuucaggggaaugggccuacucggucuguauaaccuucaauacuuugcugagcgggacgccacagcagcccaacaggugcugagcgauaguuugcauccuaaauguuccaaguucucuaaagcugagugggaaaagaaacgcauggacaaggcaauuggguauagcuuugccaucguuggaauaaauauuaccgaucucgcuuacaaccuguuaguguccggcgcccugaagacucacuucuacaauaucgcgccagaggcacccacacucucacauuuucagcagaccuucugcuaucuuaugcacgaauuucacaaauucuggauugaggaagacccuauggacaucauggaguucaaccgagucagagagaaguuuaggaaacggaucauuaagcagcugcagaauccagauauggccuuguguccgcauuucgcugccagugaaggccuaauaaacauguga

SEQ ID NO: 55738 - RNA, 882 nt, Artificial Sequence
  derived and/or modified sequence opt3 from ELMOD2__Homo_sapiens__NP_714913
auguucaucagccugugggaguuuuucuacggccacuuuuucagauuuuggaugaaguggcuccuuaggcagaugaccgggaaaugcgaacugcaacggauuuucgacacauaugugggagcccagcgcacucaucgaauagagaacuccuugacguacucuaagaauaaagucuuacagaaggcuacccacguugugcagucagaaguagauaaauauguggacgauaucaugaaggagaagaacauuaaucccgaaaaagacgcaaguuuuaagaucuguaugaaaaugugccugcuacaaauuacagguuacaagcagcucuaucuggaugucgagagcgugcguaaaagaccuuacgacuccgauaaccuucagcaugaggaacuguugaugaagcucuggaaucugcugaugccaacuaagaaacucaacgccaggaucucuaagcagugggcggagauaggcuuccaaggggacgauccgaaaaccgacuuucggggaaugggcaucuuaggucugauuaaucuuguuuauuucucggaaaacuacacaucagaggcucaccagaucuugagccgcaguaaucaucccaagcugggguacuccuaugccauugugggaaucaaccuaaccgagauggcauacucucuccugaaaagcgaagcccuuaaguuucaccuguauaauuuggucccuggcauaccaacuauggagcacuuccaucaguuuuacuguuaucucguguacgaguucgauaaauucugguuugaggaagaacccgaguccauuauguauuucaaccuguacagagaaaaguuucacgagaagaucaaaggcuuacugcucgacugcaauguagcucuuacacugaagguuuga

SEQ ID NO: 55739 - RNA, 1146 nt, Artificial Sequence
  derived and/or modified sequence opt3 from ELMOD3__Homo_sapiens__NP_001128494
augaacgaaaagagcugcuccuuccacucuaaagaggagcugagagacggccagggggaaaggcucucagccggauacagucccagcuaugauaaggacaaauccgugcuugcuuuucgggguaucccuauuucugagcugaagaaucauggcauauugcaagcauuaaccacagaagccuacgagugggagccacgcgucguuucgacugaagugguacgagcgcaggaggaaugggaggcuguggauacgauccagccggagaccgggucacaggccagcagugaacaacccggacagcugauuuccuucucugaggcacuacagcacuuucagacagucgaccucagcccuuucaaaaagcguauccaaccaacuauuagaaggaccggccuggccgcacuucggcauuaucuguuuggucccccuaaguugcaccagcgccucagagaagagagggaucuggugcugacaaucgcucagugugggcucgacucccaggauccaguucauggacggguguuacaaaccauauacaaaaagcugacuggcucaaaauucgacugcgcccuucacggcaaccacugggaagauuugggguuucagggagcuaaucccgccacagaccugcgcggugcgggcuuccuagcacuccugcaucuucuguauuuggucauggauaguaagacccucccuauggcccaggagaucuuucgacugagcagacaccauauucaacaguucccauuuuguuuaaugucugugaacaucacgcacauugcuauccaggcccugagggaggaaugccucucccgggaguguaaucgucagcaaaaaguaauaccgguugugaacucauucuacgcagcuacuuuucuucaccuggcccaugucuggcgcacccagagaaagacaauuagcgacaguggguucguguugaaggaacuagaggugcuggcgaaaaagucucccaggcggcuccugaaaacucuugaacuguauuuggcccgagucuccaagggacaggcaagccuccugggcgcucagaaaugcuacgguccugaggccccacccuucaaggauuuaaccuuuacaggggagucggaccugcaaucucacuccucagaaggaguuuggcuaaucuga

SEQ ID NO: 55740 - RNA, 3138 nt, Artificial Sequence
  derived and/or modified sequence opt3 from ELMSAN1__Homo_sapiens__NP_919254
augaaccugcaggcccaacccaaggcucagaauaaaagaaagaggugccucuucggcggccaggagccugcaccaaaagaacagccgcccccucuucaaccaccccagcagagcauccgggugaaggaggaacaguaccugggacacgaggguccuggcggggccgucuccaccucucaaccaguugaauugcccccuccaucaaguuuagcgcugcuaaacagcgugguauauggaccggagcgcacauccgcugccaugcucucucaacagguggcaucggucaaauggcccaauucagugauggccccuggccgagguccagagcgugggggaggcggcgggguuagcgacaguuccuggcagcagcagcccggacagccuccaccccauucuacuuggaacugucacagccugucccuuuacucagcuacgaaggguaguccgcauccuggcguggggguccccaccuauuacaaucacccagaagcacugaagagagagaaagccggaggcccucaauuggauagguaugugcggcccaugaugccacagaagguacagcucgaaguuggucgcccccaggcuccucugaacagcuuucaugccgcgaaaaagccaccgaaucaaucucugccccuccagccuuuccaguuagcauuugggcaccaggugaacagacaagucuucaggcagggaccacccccuccaaaucccguggccgcuuuuccgccucagaaacagcaacagcagcagcaaccacagcagcaacagcagcagcaacaggccgcacugccccagaugccucuuuucgagaacuuuuacuccaugccccagcaaccaucacagcagccucaggacuucggcuugcaacccgcuggcccacuggggcagagccaccuagcccaucacaguauggcgccguauccuuuucccccaaaucccgauaugaacccugagcuccggaaggcccugcuucaggacucugcaccacaacccgcucugccucaggugcagauuccguucccacgccgauccagaagguugagcaaggaaggaauacuucccccuucggcccuggauggugcuggcacacagccagggcaagaggccacuggaaauuuauuucugcaucacuggccccuccagcagccuccgcccggcucucuuggucagccacacccugaagcacugggguuccccuuggagcuacgggaaucccaacugcucccagacggcgagcgucuggccccuaacggacgcgagagagaagcucccgcgaugggcucagaggaagggaugagggcagucaguaccggagauugcggucagguucuucggggcggggugauccagagcacacgacgcagaaggcgggccucccaggaggcuaaucuguugacccucgcccaaaaagcaguagaacuggccucuuuacagaacgcuaaggacggaagcggcucagaggagaaacgcaagagugugcuggccuccacuacaaaauguggugucgaauuuagcgagccaucucuagcaaccaagagagcgagggaagauucagggauggugccgcucauuaucccuguuagugugcccguccguacgguggacccaacugaggcugcccaggcaggcggacuggaugaagacggcaaagggcccgagcagaacccugccgagcauaagccaagcguaauuguuacccggcgaagauccacaaggauccccggaacugaugcucaagcccaggcagaagacaugaaugugaagcucgagggugaaccuucuguccgcaaaccgaagcagcggccaagacccgagccuuugauaauccccaccaaagcuggcacauucauugccccaccuguguacucgaacaucacccccuaccaaagccaccugagguccccaguccgccucgcggaccauccuucagagcgaaguuucgaacugccgcccuauacgccaccucccauucuuucuccagugcgggaggggagcggacuguacuuuaaugccaucauauccacuucaacaauuccugcucccccgccaaucaccccuaagagcgcacaccguacuuugcucagaacaaacucugccgaaguuacgcccccagugcuguccguaaugggcgaggcuacccccgucaguauugaaccuaggaucaauguggguagccgcuuccaggccgagaucccguuaaugcgggauagagcacuggcggccgcugacccccauaaagccgaucuaguuuggcagccaugggaggaccucgaaucuuccagggagaagcagcgacaaguggaagaucugcuuaccgcagcuugcucaaguauuuuuccuggggccggcacaaaccaggaguuggcacugcacugucuccacgaaagccgcggagacauacuggagacuuuaaauaagcugcuuuugaaaaagccccuccggccucauaaccacccacuggccaccuaucauuacacaggcucggaucaguggaaaauggcugagagaaagcuauucaauaaagggaucgcgauuuauaagaaggacuuuuuccugguccagaaacucauccaaacuaagaccguggcccagugcguagaauuuuacuauacauacaaaaagcaagugaaaauaggaaggaacggcacccugacuuucggugauguugacacguccgaugagaagucugcacaggaagaggucgaaguggacauuaagacaagccagaaauuuccccgugugccucuuccacgccgggagucacccagugaggaaagauuggagccgaagagggaagucaaagagccucgaaaggagggggaagaggaaguuccagagauccaggaaaaagaggagcaggaagagggacgggaacgcuccagaagggcugccgccgugaaggcuacccaaacucugcaggcaaaugagucugccagcgacaucuuaauucuccggucccacgaaucaaacgcgcccggcagcgcugguggccaggccagugagaaaccucgagaggggaccggaaagucuagacgcgcacugccauucuccgaaaagaaaaagaaaacagagaccuuuagcaagacucagaaucaagaaaacacauuccccuguaaaaagugcgggagguga

SEQ ID NO: 55741 - RNA, 2175 nt, Artificial Sequence
  derived and/or modified sequence opt3 from ELN__Homo_sapiens__NP_000492
auggccggccugaccgcugcagcccccagaccuggggugcuccuucuguuguuaagcauccugcacccauccaggccgggagguguccccggcgcgauuccugggggaguuccaggcgguguguucuaccccggggcuggacuaggcgcccucggcgggggagcacuggguccuggcgggaagccacuuaaacccguaccuggaggccuggccggugcuggguugggagcaggccucggcgccuuuccagcugugacauucccgggggcccugguccccggagguguggcggacgcagccgcugccuauaaggcagcuaaagccggcgcggggcugggaggcguuccuggugucgggggccucggagugucugccggcgcagugguaccacagcccggggcuggaguuaagccugguaaagugccaggcgucggguuacccggaguguacccgggcggugugcugccuggggcccgguuucccggcgucggaguucuuccaggcgugccuacuggggcuggaguaaagcccaaggccccaggugugggcggggcauucgccggaauacccggcgucgguccuuuugggggcccacaaccgggagugcccuugggcuauccuaucaaagcuccaaagcugcccgggggauacggccuaccuuauacgaccgguaaacucccauacggguauggacccggcgguguugcgggcgcagccgggaaggcuggauacccgacaggcacuggggugggaccucaggccgcagccgcugccgcagcgaaagcugccgcaaaguucggcgccggugcugccgggguccugccaggagugggcggugcaggcguacccgggguuccuggagcuauucccggcaucgggggaauugccggcguggguaccccagcggccgcugcagccgcugccgcagcggccaaggcugccaaauacggggcagcugccggacuugucccuggcggucccggcuuugggccaggaguggucggcgugccgggggcaggaguuccuggcguggguguacccggggccggaaucccagucgugcccggcgcuggcauaccuggggcggccguuccaggaguggucucacccgaggcagcugccaaggccgcugcaaaagccgcgaaguauggugcucgcccuggcguggggguaggaggcaucccgacauacggugugggggccggaggcuucccaggcuuugggguuggagucgguggcauucccgggguggcaggagugccuggcgucggugggguuccaggagugggcggcgugcccgggguaggaaucaguccugaagcccaggcugcagccgcggcuaaagccgcaaaguauggugucggcaccccggccgcugccgcagcuaaagccgcggccaaggcagcucaguucgggcuggugcccggaguuggcguggccccaggugucgggguggcuccuggaguuggcguggcacccggcguaggguuggccccaggagucgguguggccccuggcgugggggucgcucccggaguuggcguggcgccagguauugggccgggaggcguagcagccgcugccaagagcgcagccaaaguggcugcgaaggcccaacuccgagcagcugccggccugggggcaggaaucccugguuuaggcgucggggugggaguucccggccugggugugggggccggcgucccaggacucggcgugggggcuggaguucccgguuuuggcgccgugccuggggcgcuugcagccgcuaaagccgcuaaguacggagcagccgucccaggcguacuggguggguugggcgcucuaggaggcguggggauacccggagguguugugggcgccgggccugcagcggccgcugccgcagcuaaagccgcagccaaggcugcgcaguucggacuggucggcgccgcaggucucgggggccugggagugggcgggcuuggaguaccgggcgugggugggcugggaggcauuccacccgcugccgccgcaaaggcugccaaauauggugcggcuggccucgggggagucuugggcggggccggacaguuuccucugggcgguguugcagcccgucccggguucggauuauccccaaucuucccuggcggugcuugccugggcaaggcaugugggagaaaaaggaaguga

SEQ ID NO: 55742 - RNA, 252 nt, Artificial Sequence
  derived and/or modified sequence opt3 from ELOF1__Homo_sapiens__NP_115753
augggcagaaggaaaagcaaacggaagcccccuccaaagaagaaaaugaccgggacacuggagacucaguucacgugcccguuuuguaaccacgaaaaguccugcgacgugaagauggaucgcgcccgaaauaccggagucaucucuuguacaguuugccucgaggaguuccaaacucccauuaccuaccuuucagaaccuguggacguauauagugauuggauagacgcuugugaagcagccaaccaguga

SEQ ID NO: 55743 - RNA, 891 nt, Artificial Sequence
  derived and/or modified sequence opt3 from ELOVL2__Homo_sapiens__NP_060240
auggagcaccugaaggccuucgacgaugaaaucaacgcuuuucucgacaauauguucggccccagagauagcagggugcgggggugguuuaugcuugacuccuaccugccuaccuucuuuuugacagucauguauuuacugucuauuuggcuaggaaacaaauacaugaagaaucgcccagcacucucacugcgagguauacuuacucuguauaacuugggcaucacgcuccugagugccuacaugcuggcggagcucauuuuaagcaccugggaagggggauauaaucugcagugccaagaucuuacauccgcuggcgaggccgacauccguguugcaaaaguguuguggugguacuauuucucuaagucgguagaauuucuggauacuauuuucuuugugcuaaggaaaaagaccucacagaucacauuccuccaugucuaccaccaugccagcauguuuaacauaugguggugugugcugaauuggaucccgugcggucagaguuucuuugggcccacccuuaacuccuucauucacauccugauguacucuuauuacggauugagcguuuucccuuccaugcauaaguaucucugguggaaaaaguaccugacucaggcucaauuagugcaguuuguccugacaauuacccacacgaugucagcagugguaaaaccauguggcuuccccuuuggcugccucaucuuccagaguagcuauaugcuuacucugguuauauuguuucuaaauuucuacgugcagaccuauagaaagaaaccuaugaagaaggacaugcaagagccacccgccgggaaagaggucaagaacggauuuucuaaagccuacuucacagcugcgaauggugugaugaacaagaaagcacaguga

SEQ ID NO: 55744 - RNA, 945 nt, Artificial Sequence
  derived and/or modified sequence opt3 from ELOVL4__Homo_sapiens__NP_073563
augggccugcucgacagcgagcccggguccgugcuuaacgucguuucuaccgcccugaaugauacaguggaguucuacagauggacuuggucaaucgcugacaagaggguagaaaacuggccuuugaugcagaguccauggccgacguuaagcauuuccacccuguaucuacucuuuguguggcugggacccaaauggaugaaggaucgggaaccuuuccaaaugcgccuuguccugauaaucuacaauuuugguaugguguugcucaaccuguucauuuuucgagagcuguucaugggcucuuauaaugcaggguacucguauaucugccagucaguugacuacagcaacaaugugcacgaaguccguauugccgcggcucucuggugguauuuugugaguaaaggaguagaguacuuagauacaguuuucuuuauccugagaaagaaaaacaaucagguguccuuccuucaugucuaccaccauuguacuauguuuaccuugugguggauaggcaucaaguggguggccggugggcaggcauucuuuggagcccaacugaacucuuucauucacgugaucauguauagcuacuauggccuaacagcuuucggcccauggauucagaaguaccucugguggaaaagguaucugaccaugcuucagcugauccaguuucaugucacuauagggcacacagcauugucccucuacaccgacugccccuucccuaaguggaugcacugggcccugauugcuuaugccaucucauuuauuuucuuauuucugaauuucuacauccggacguacaaagagccaaagaaacccaaggcgggaaagacugcaaugaacgguaucagugccaauggcguuagcaaaucugaaaagcaacucaugauugagaacgggaaaaagcagaaaaauggaaaggcuaaaggcgauuga

SEQ ID NO: 55745 - RNA, 981 nt, Artificial Sequence
  derived and/or modified sequence opt3 from ELOVL5__Homo_sapiens__NP_001229757
auggagcacuucgacgccagccuguccaccuacuuuaaggcucuccuuggccccagagauacaagggugaaagggugguuccuguuggacaacuauaucccuacuuuuauuugcucugucauauacuuacugaucguuuggcuaggaccaaaguauaugcggaauaaacagccguucucaugucgcgguauucucgugguauacaaccugggccuuacgcuguugagucucuauauguuuugcgaaagcaagcgagagcaaccccguagauccgcaugugccucuaggaccgauccuucgacacagcagcagcugccagaaaaucggcuggugacuggggucugggagggaaaauacaacuucuuuugccaaggcacccgcacagcgggugaaucagacaugaagaucauuagagugcucuggugguauuacuucagcaaguuaaucgaguuuauggauaccuucuuuuucauacugaggaaaaauaaccaucagaucacuguucuucacguguaccaucacgcuaguauguugaauauuuggugguuugucaugaacugggugcccugugggcauuccuauuucggagccacacuaaauucuuucauccacguacugauguacagcuauuacggccucuccucaguuccuaguaugcggccauaucugugguggaagaaauacauuacccagggccagcuucugcaauuuguguugacgaucauacagacuagcugcggggucauuuggcccuguaccuucccucucggauggcuguauuuucagaucgguuacaugauuucuuuaaucgcacuguucacaaacuuuuacauccagacuuauaauaagaaaggcgccucccgccgaaaggaccaccucaaggaucaucaaaacgggucaauggcugcagugaauggacacaccaacagcuucaguccacuugagaauaacgugaaaccgagaaagcugaggaaagacuga

SEQ ID NO: 55746 - RNA, 798 nt, Artificial Sequence
  derived and/or modified sequence opt3 from ELOVL6__Homo_sapiens__XP_011530536
augaacaugagcgugcugacccuccaggaguacgaauuugagaagcaauuuaaugaaaacgaggccauccaguggaugcaggaaaauuggaaaaaguccuuccuuuucucugcucuguaugcagccuucauuuuuggcgggagacauuugaugaacaaaagggcgaaguucgaguuacggaaaccccugguccuauggucacucacacuggcuguuuuuaguauauucggagcccuucgcacuggugcauacaugguguauauccugaugacgaagggcuugaagcagagcguaugcgaccaaggguuuuacaauggaccuguguccaaauucugggccuaugcuuuuguccucucuaaggcaccagagcugggcgauaccauuuucaucauucugcgaaaacagaagcucaucuuuuuacauugguaccaccauauaacagugcugcuuuauucgugguacucauacaaagacaugguugccggugggggaugguucaugacuaugaacuauggcgugcacgcugucauguacagcuauuacgccuugcgugcggcaggcuucagagugaguaggaaguuugccauguucaucacccugucccagauuacacagaugcuaaugggguguguaguuaauuaucucguguuuugcuggaugcaacaugaucagugucacucucacuuccagaacaucuuuuggagcucccugauguaccuuucauaucuggucuuguucugccacuuuuucuuugaggcuuacauuggaaagaugcggaaaaccacuaaggccgaauga

SEQ ID NO: 55747 - RNA, 846 nt, Artificial Sequence
  derived and/or modified sequence opt3 from ELOVL7__Homo_sapiens__NP_001098028
auggccuucagcgaccugaccuccagaacagugcaccucuacgauaacuggaucaaggacgcugaucccagggucgaggacuggcuucugaugucuucaccuuugccacagacuauuuuacugggcuuuuauguuuacuucgugacgagucuagggccgaaacucauggaaaaucggaagcccuuugagcugaaaaaggcaaugauaaccuauaacuucuuuaucguacuuuucagcguguacaugugcuaugaauuugucauguccggaugggguauuggcuacucuuuccgcugugauaucguggacuauucgcgaucaccuacagcccugcguauggcgagaacuugcugguuguacuacuuuagcaaauucauugagcuccuggauaccaucuuuuucguucugaggaagaagaauagucaagugacauuucuccaugucuuccaccauaccauaaugccauggacuuggugguucggggugaaauuugcugccggaggcuuagguacauuccacgcacugcuuaacaccgccguacauguugugauguauuccuacuauggguugucugcucugggacccgcauaccagaaguaucuaugguggaaaaaguaccucacgagccugcagcuuguccaguuugugaucguggccauucacaucucccaauucuuuuucauggaagacuguaaauaucaguuuccugucuucgcuugcauuaucaugucauacaguuuuauguuccuguugcucuuucugcacuucugguaccgggccuauacuaagggccagcgcuuaccaaagaccguuaaaaauggcacauguaagaacaaagauaauuga

SEQ ID NO: 55748 - RNA, 2676 nt, Artificial Sequence
  derived and/or modified sequence opt3 from ELP2__Homo_sapiens__NP_001229804
augguggcccccguccuggagaccagccacguuuucugcuguccuaacagagugaggggcguacucaauugguccucugggccacggggacuucuggcuuuugguacaucaugcaguguggucuuguacgacccguuaaagcgcgugguugugacuaaccugaauggccauacggcacgagucaacuguauccaguggauuugcaaacaagaugggagccccuccaccgagcuagugucuggaggcucggacaaucagguaauacacugggaaaucgaagauaaccagcuccugaaggccguucaucuucagggucacgaggggccuguguaugcgguccaugcuguguaccaacguagaacaucagacccagcccuguguacuuugauugugagcgcagccgcugauagugcagucaggcucugguccaaaaagggacccgaaguuaugugccugcagacccugaauuucggcaacggcuuugcccucgcuuuaugucugucuuuccuuccuaauacagacgugaccuggaaaacugggcagguagagcggggacgcgccuggaagccacccgcgagcuuggcacugugcuccagaucaugugauaguauggugagcugcuaugccucuauccuauguaaggcucucuggaaagagaagcugcacacauuuuggcaccauaacaggauuuccuuccuuccuucagccuuucggccaaucccgauacuggcaugcgguaaugacgauugccgcauccacauuuucgcucagcaaaacgaccaguuucagaaagucuugagccucuguggccaugaagauuggauccgagggguggagugggccgcguucggaagagaccuguuuuuagccaguugcucucaggauugucugauuaggaucuggaagcucuacauaaaauccaccagccuugaaacgcaagacgacgauaauauucggcugaaggagaacacuuucaccaucgagaaugaaucgguuaagauugcauuugcugugacauuggagacuguccuagccggccacgaaaacugggugaacgcuguacacuggcagcccguuuucuauaaagacggugugcugcagcaaccuguccgucuccugucugccuccauggauaagaccaugauccuuugggcaccagacgaggaaucagggguguggcuggagcagguccgcgugggagagguuggcggcaauacauugggguucuacgauugccaguuuaacgaagacggaaguaugaucauugcccaugcuuuccacggugcgcuccaucuguggaaacagaauaccgugaaccccagagaguggacgccugaaauaguaaucagcggccacuuugaugggguccaagacuuagugugggauccagagggagaguucauuaucacuguuggcacagaccagaccacuaggcuguuugcacccuggaagcggaaagaucagucccaggugacauggcaugaaauagcccgaccgcaaauucacgguuaugaccuaaagugucucgcuaugaucaaucgcuuccaguuugucucuggggccgacgagaaagugcugagaguauucagcgcaccuaggaacuuuguggaaaauuucugcgccaucaccggccagucacuuaaccacguuuuguguaaucaggauagugaccugcccgagggagcuacggucccagcccucggccuguccaacaaggcaguguuucaaggggauauugcgagccagccuucugacgaagaggaacuucugaccucaacaggauucgaguaccaacagguggcuuuucagcccaguaucuugacugagccacccaccgaagaucaucuccugcagaauacauuauggccugagguccagaagcuguacggucacggcuaugaaauuuucugcguuacuuguaacagcuccaaaacccuacucgccucugcaugcaaggccgcuaaaaaggagcaugccgcaauaauccuguggaauacaaccucguggaaacaagugcagaaccuuguguuccacagcuugacuguaacgcagauggcuuuuuccccaaaugagaaguuccugcucgccgucucacgggaccgcacauggagucuguggaagaaacaggauaccauuucuccggaauuugagcccguguucagcuuauuugcguucacuaacaagaucaccuccguucacucaagaaucauuuggagcugugacuggucuccugauuccaaauacuuuuucacagggaguagggacaagaaaguggucguguggggagaaugcgauagcaccgacgauugcauagagcauaacaucggcccauguucuuccguucuggacguggguggggccguaacugcugucucagugugccccgugcuucacccuagucaacguuaugucguugcagugggcuuggaauguggaaagauuugccucuacacauggaagaaaacggaccagguaccagagaucaaugauuggacccauuguguggagacuagccagucgcagucccacacacuggccauucggaagcuaugcuggaaaaacuguucuggcaagaccgaacaaaaagaggcugaaggggccgaguggcugcauuuugcaagcugcggagaagaccacacagucaagauccaccgagugaauaagugugcgcucuga

SEQ ID NO: 55749 - RNA, 1602 nt, Artificial Sequence
  derived and/or modified sequence opt3 from ELP3__Homo_sapiens__NP_001271151
augaugcugaccaucggcgacgugauuaagcagcucauagaggcccacgaacaagggaaagauaucgaccuuaacaaggucaaaacaaagacugcugcaaaauacggacugagcgcccagcccagauugguugauauuaucgcggcugugccuccacaguauaggaagguauuaaugccgaagcugaaagccaagcccauucggacggcauccgguaucgccguggucgcugugaugugcaaaccucaucgcuguccacacauaucuuucaccggcaauaucugcguuuacugucccgggggaccugacucagauuuugaguauaguacacagagcuacacuggcuaugaaccaaccuccaugcgagcaauucgugccagauacgaccccuuccuacaaacaaggcaucggaucgagcagcucaagcagcugggucacucuguggauaaagucgaauuuauugugaugggagggaccuucauggcucuaccugaggaguaucgcgacuacuuuaucagaaaccugcaugaugccuugucgggccacacuucaaauaacauauacgaagcgguaaaguauagcgagaggagucucacaaagugcauuggcaucaccauugaaacgcggccagacuacuguaugaaacgccaccuguccgauaugcugacuuaugggugcacccgacucgagaucggaguucagucuguguacgaggacgucgcaagagauacaaauaggggucauacugugaaggccgugugugagagcuuccacuuagcuaaagacuccggcuuuaaggucguugcccauaugaugccggaccugcccaacguggggcuugagcgggauaucgaacaauucaccgaguuuuucgaaaauccugcauuucguccagacggauugaaacuguaucccacacuuguaauucgcggcaccggucucuacgagcuguggaagucagggagauauaaaaguuacagcccuucugaucuuguggagcuggucgcuaggauauuggcccucgugccacccuggacgcggguuuaccgagugcagcgcgacaucccgaugccucuggucuccucaggaguggaacacggcaacuuaagagagcuggcgcucgccaggaugaaggaucuuggcauucagugccgggacguacgcacuagagaaguugggauccaggagauacaccauaaggugaggcccuaucaagucgaacuggugcgucgggauuacgucgcaaauggagguugggagacauucuugagcuaugaggacccagaucaggacauucuaaucggccugcuccgacugagaaaauguagugaagagaccuuuagguucgaacuugggggaggcgugucuaucguucgcgagcugcacguguacgguuccguagucccugugagcucgcgggaucccacuaaguuccagcaucaaggguuuggcauguugcucauggaagaggcugagagaauugccagggaagaacacggaucuggcaaaaucgcuguuauuuccggggugggaacacgcaacuauuaccgaaagauagguuaucggcugcagggcccauacauggucaaaauguuaaaguga

SEQ ID NO: 55750 - RNA, 1431 nt, Artificial Sequence
  derived and/or modified sequence opt3 from ELP4__Homo_sapiens__NP_001275654
auggccgcuguggcaaccugcggcagcgucgccgcguccacagggucugcuguugccacugcaucaaagaguaacgugacgagcuuccagagaaggggaccccgggccuccguaaccaaugacucugguccucgccuggugucgaucgcuggcacacgaccaucaguccguaacgggcaacuccuugugagcacuggacugccggcauuggaucaguuacugggcggugggcuagccguuggaaccgugcuccugauugaggaagacaaauacaauauauauaguccccuucuguuuaaguacuucuuggcugagggcaucgucaacggccacacacuccugguggccuccgcgaaagaagauccugcaaauauucugcaggagcucccagcccccuuacuggacgauaaguguaaaaaggaauuugacgaggauguauauaaccauaagaccccugagucuaauaucaaaaugaagauugcuuggagauaccagcuuuugccaaaaauggaacaaaucgggcccguuagcuccucaagguucggacacuauuacgacgccaguaagcggaugccucaggagcugauagaagcaagcaacuggcauggguuuuuccuaccagagaaaaucucuuccacucucaagguggagccgugcucacugacacccggcuauaccaaacuucugcaguuuauucagaauaucauuuacgaagagggguucgauggaagcaacccucaaaagaagcagcgcaauaucuugagaauaggcauucagaaccucgguaguccacuguggggugacgauaucuguugcgcugaaaauggaggcaacucucacuccuuaacgaaauuucuguacguccucaggggccuucugcggacuagcuugucggccuguauuaucaccaugcccacacaucuaauccagaauaaggcgauuauagcccgcgugacuacccugucugacguggucguugggcucgaguccuucaucggaucagaacgagagacaaacccucuguauaaagauuaccacggucuuauucacaucagacaaauaccaaggcugaacaauuugauuugcgacgagagugacgugaaggaucucgcauuuaaacugaagcggaaguuauucaccaucgaauggguacaggacaacuaucugcgucaggagcgcaauaucuaucccccgggcuuuagcuaccuacucaaacaaaaggauuccgcuuggggagaagggucucugcagcauagcacguuccuuaugucauucuuggccaaagcuacugccuuugcaaguagacuggugaggcacuccgagccucucaagcagaacggcagcggucggauucgacaggccgcugggccccgccuguggcaugacggcagaaggcaagaagcgccaggacuucugggcaucccucccuga

SEQ ID NO: 55751 - RNA, 801 nt, Artificial Sequence
  derived and/or modified sequence opt3 from ELP6__Homo_sapiens__NP_001026873
auguucguggagcugaacaaucuccuuaacaccacacccgacagagccgaacagggcaagcugacuuuguuaugcgaugcuaaaacggacgggagcuuucugguccaccauuuccuauccuuuuaccucaaggcaaauuguaaaguuugcuucguggcccugauccaaucuuuuucacacuauaguauuguaggacagaaacuuggugugagccugaccauggcgagggagcggggccaguuggucuuccucgaagggcugaaguccgcuguggauguuguguuucaggcccaaaaggagccucauccacugcaguuccuccgcgaagcaaacgccggaaauuuaaagccgcuguuugaguucguccgagaggcucuuaaacccguggacucuggcgaagcacguuggacauacccuguauugcugguugaugaccuaucggugcuccugucacuugguaugggggccgucgcugugcuggauuuuauacacuauuguagagccacugugugcugggaguugaagggaaacauggucguucucgugcaugacagcggcgaugcggaagacgaggagaaugauauccuguuaaacggccugagucaccagucccaccucauucuuagggcagaagggcuggccaccggauucugucgggacguacauggucaguugcgcauccuauggagaaggccaucucaacccgcugugcaccgggaucagagcuuuacauaccaguauaaaauucaggacaaguccgucucauucuucgccaaaggcaugaguccugcagugcuguga

SEQ ID NO: 55752 - RNA, 672 nt, Artificial Sequence
  derived and/or modified sequence opt3 from ELSPBP1__Homo_sapiens__NP_071425
augaccagauggagcuccuaccugcucggcuggacaacuuuccuucuguauucuuacgagucaagugggggaaugcacgaagagugcguguuucccuucacguauaaggguagcgucuacuuuaccuguacacauauccacuccuugucuccuuggugcgccacuagggcuguuuauaacggccaguggaaauacugucaaucggaagacuauccacggugcauuuucccguuuauauaccgcgggaaggcauacaauucauguaucagccagggaaguuucuuaggcucccuguggugcucugugaccagcguauuugaugagaaacagcaguggaaguucugugaaacaaacgaguaugguggaaauucccuacgaaaacccugcauuuuuccuucaaucuaccguaacaauguggucagugacuguauggaggaugaaagcaacaagcucuggugcccaaccacugagaauauggacaaggaugggaaauggucuuucugugccgacacaagaauuuccgcgcuggugcccggcuuuccuugccauuucccauuuaacuauaagaauaaaaacuacuucaauugcaccaacgaaggcucaaaggagaaucuuguuuggugugcuacgagcuauaacuacgaucaagaccacacuuggguguauugcuga

SEQ ID NO: 55753 - RNA, 984 nt, Artificial Sequence
  derived and/or modified sequence opt3 from EMB__Homo_sapiens__NP_940851
augagagcccugcccggccuccuugaggcuagggcacggaccccucgccuguuguuacugcagugccuacucgccgcggcucgaccaagcuccgccgacgggucugcaccggauucacccuucacaaguccuccacugcgugaagagaucauggccaacaauuuuagccuugaaucccacaacauuucucugacugagcauucgucaaugcccguggaaaagaauauaacguuggagagaccuagcaacgucaaucucaccugucaauucacaaccaguggagaccugaacgcuguuaaugugacuuggaaaaaggauggugagcagcuggaaaacaauuaccucguauccgcaacaggcucuaccuuauauacucaguacagguuuacaaucauuaacagcaaacagaugggguccuauucaugcuucuuucgggaggaaaaggagcaacgcggaaccuucaauuuuaaagugccagagcugcacggcaagaacaagccccuuaucaguuacgucggugacagcacgguguugacuuguaaaugccagaauuguuucccucugaacuggaccugguauucuuccaaugggucaguuaaggugccagucggagugcagaugaacaaauacguaauuaacggcacauaugccaaugaaacuaagcuaaaaaucacccagcuccuggaggaagauggcgagagcuacuggugcagagcucuuuuucaacugggggaaagugaggagcauauagaauugguugugcucucuuaccuggucccguuaaagcccuuccuggugaucguggccgaggucauucuccuuguugcgacaauccuguugugugaaaaguauacccagaaaaagaaaaagcacuccgacgagggaaaagaauuugagcagauugagcagcuaaagagcgaugacucgaacgguaucgaaaauaacgugccuaggcaucggaaaaaugagucucugggccaauga

SEQ ID NO: 55754 - RNA, 765 nt, Artificial Sequence
  derived and/or modified sequence opt3 from EMC10__Homo_sapiens__NP_778233
auggccgcugcaagcgccggcgcgaccagacugcuccuucuguuguuaauggcuguggccgcacccuccagggcccgggggucuggaugccgcgcugguacaggcgcacgaggggccggagcugagggccgugaaggugaggccugugggacugucggacugcuacucgaacacucauucgagaucgacgauagugcgaacuuuagaaagaggggcagccugcuuuggaaucagcaagacggcacgcuguccuugucucagcggcagcucucggaagaggagcgcgggagacugagggauguugcagcccugaacggacucuaccgggugcgcauuccucgaagaccaggugcuuuagacggccuggaagccgggggauauguaagcucauucgugccggcaugcagucuugucgagucccauuugucugaucagcugacccuacacguggacguugcuggcaauguggucggugugagcguaguuacacaucccgggggauguaggggccacgaaguggaggaugucgaccucgagcuguuuaacacuuccgugcaacuucagccuccaaccacagcccccggcccugaaaccgcggccuucauagagcggcuggaaauggagcaggcacagaaagcuaagaauccacaagaacagaaaucauuuuucgccaaguacuggcauaucauucucgggggagcuguguugcugacugccuuacgucccgcagccccugguccagcuccgcccccucaggaggcguga

SEQ ID NO: 55755 - RNA, 894 nt, Artificial Sequence
  derived and/or modified sequence opt3 from EMC2__Homo_sapiens__NP_055488
auggccaaggugagcgagcuguacgacgucaccugggaagagaugagagauaaaaugaggaaguggcgggaagagaacucccgcaauucugaacagaucguugaggugggcgaggaacucauuaacgaguaugcuucaaaacuuggggacgauauauggaucauuuacgaacaaguaaugaucgcagcccuggacuauggacgagaugacuuggcguuauucugccugcaggagcuacguagacaguuucccgguagucacagggugaagcggcucacaggcaugcgcuucgaggcuauggaaagauacgaugacgccauucagcuguaugauaggauccuucaagaggacccuacuaauacggcagcccggaaacgcaagauagcuauccgaaaggcacaggggaaaaacgucgaagccauuagagagcugaaugaauacuuggagcaguuugugggagaucaggaggcuuggcaugaacucgccgagcuguauaucaacgaacacgacuacgcgaaggcagccuucugucuggaggaacucaugaugaccaauccacauaaccacuuauacugccaacaguaugcugagguuaaauacacacagggcggucuggagaaucuugaauugagcaggaaguauuuugcccaggcacugaaacuaaacaaucggaacaugcgugcucucuucgggcuguacauguccgccucucauauugcgucgaauccgaaggccucagcaaagacuaaaaaggauaacaugaaauaugcuagcugggccgcuagucaaaucaaucgcgccuaccaguuugcaggaagauccaagaaagagaccaaguauucucuuaaagccguggaagacaugcuggagacauugcagauaacccaaagcuga

SEQ ID NO: 55756 - RNA, 786 nt, Artificial Sequence
  derived and/or modified sequence opt3 from EMC3__Homo_sapiens__NP_060917
auggccggccccgagcugcuccuugacagcaacaucagacuguggguggucuugccuauuguuauaaucaccuucuuuguggggaugauuaggcacuacguauccaucuuacugcagucugauaagaaacuaacacaagaacaggugucagacagucagguccucauucggagccgcgugcugcgagagaauggaaaguauaucccaaaacaguccuuccuuacucguaaguacuauuuuaacaauccggaagaugguuucuuuaaaaagacgaagagaaaaguugugcccccuucuccaaugaccgaccccacaaugcugacugauaugaugaagggcaacgucaccaauguguugccuaugauacucaucgggggauggauuaacaugacauucucgggcuuuguaaccacuaaaguuccauucccccugacacugagguuuaagccuaugcuccaacaggguaucgaguuacugacccuugacgcuucaugggugagcagugcauccugguacuucuugaaugucuuugggcugcggucuauuuauagccuaauccucggacaggauaacgccgcggaccagucccgcaugaugcaagaacagaugacgggcgcugccauggcaaugccagccgauacuaauaaggcuuucaaaaccgagugggaggcacuggaacuuacagaccaucagugggcccuggaugacguggaggaagaguugauggcuaaggaucuccacuuugagggcauguucaaaaaggaacugcagacuucaauauucuga

SEQ ID NO: 55757 - RNA, 729 nt, Artificial Sequence
  derived and/or modified sequence opt3 from EMC7__Homo_sapiens__NP_064539
auggccgcugcacuguggggcuucuuucccgugcuccuucuguuguuacugagcggggacguccaguccucugagguuccuggagccgcggcugaagguucaggcgggaguggagugggcaucggugauagauucaagauugaggggagggccguagugccaggagucaaaccgcaagacuggauaagcgcagcccgggugcuaguugauggcgaggaacacgugggcuuucucaagaccgacggguccuucgucgugcaugauauccccucuggaucguacguaguugaaguggucaguccugcuuaucgcuuugacccagugcgaguggauauuacaagcaaagguaagaugcgugcaagauacgucaacuauaucaaaacuucagagguugugaggcugcccuacccucuucagaugaaguccucuggcccacccagcuauuucauuaagcgggaguccuggggguggacggacuuucugaugaauccuaugguaaugaugaugguguugccacuccugaucuucguccugcucccgaaagugguuaacaccucagaucccgacaugcgcagagaaauggagcagaguaugaauauguuaaacagcaaucacgaacugccugaugugucugaguuuaugacaaggcuuuucuccucaaagagcaguggaaaaucuuccagcggcucgucuaagacugguaaauccggggccggaaagcggcgcuga

SEQ ID NO: 55758 - RNA, 381 nt, Artificial Sequence
  derived and/or modified sequence opt3 from EMC8__Homo_sapiens__NP_001135760
augcccggcgugaagcugaccacacaggccuacugcaaaaugguccuccacggggcuaaguauccucauugugcaguuaacggacuucugguggccgagaaacaaaagccaagaaaagaacacuugccguuagguggccccggggcgcaucacacucuguucguagacugcaucccucuauuucauggaacgcucgcucuggccccaaugcuugagguggcacugaccuugauugauagcugguguaaggaccacuccuacgucauagccggcuauuaccaggcuaaugaaagggugaaggaugcaucucccaaccagguugccgagaaaguggcuucacggaucgccgaagguuucagugacacagcgcucauuauguga

SEQ ID NO: 55759 - RNA, 747 nt, Artificial Sequence
  derived and/or modified sequence opt3 from EMCN__Homo_sapiens__NP_001153166
auggagcugcuccaggugaccauccuuuuccuguugcccagcauuugcuccucuaacucaacaggcgucuuagaagccgcuaauaacagucugguugugacuacgaccaagccuagcauaacaacuccaaauaccgagucccuacagaaaaacguagugacaccgaccacugggacaacccccaagggaacgaucacuaaugaacuccugaaaaugucucuuaugucgaccgcaacauuucugacuucaaaggacgaggguuugaaagccaccacaaccgaugucagaaagaacgacagcauuaucaguaaugugacgguuacuuccgugacacucccuaacgcggucucuacccugcaaagcuccaagccaaaaucaagugugcugcagcccgaugcuagcccuucuaagacuggcacacucaccuccauuccaguaacgauccccgaaaauaccucacagagccaaguuauagggacagagggaggcaaaaacgccaguacuucugcaaccuccaggagcuacucgucuaucauuuuaccuguggucaucgcccugauugugaucacacuuuccguguucgucuugguuggucuguaucggauguguuggaaggcugacccagggacuccggagaauggaaacgaucagccccagucagacaaagaaagugugaagcuacucaccguaaagacaauaagccacgaguccggcgaacauucugcacagggcaaaaccaagaauuga

SEQ ID NO: 55760 - RNA, 765 nt, Artificial Sequence
  derived and/or modified sequence opt3 from EMD__Homo_sapiens__NP_000108
auggacaacuacgccgaucugagcgacaccgagcucacaacucuucugagaagguauaauaucccccacggcccuguggucggguccacgcggcgcuuguacgaaaagaaaauuuucgaguaugaaacccagcgacguagauuaucuccaccgucaaguagcgcugcauccucuuacucguuuucagaucugaacagcacaaggggagacgccgauauguaugaccuacccaagaaagaggaugcgcuccuguaccaaaguaaggguuauaaugacgauuacuacgaagaguccuauuucacuacccggacauacggcgagccugaaucugcugggccaagccgcgccguuagacaguccgugaccucauuucccgacgcagaugccuuccaucaccagguacaugacgaugaccuucugaguagcucugaggaagagugcaaagacagggagcggccuauguauggacgcgauuccgcuuaccagucaauaacucacuaucgaccagugagcgcaaguagaucuuccuuggaccucagcuacuaucccacaucgucuuccaccucauuuaugaguagcuccucuagcucaaguuccuggcugacgaggcgggccauccguccugaaaaccgcgcuccaggcgccggucuggggcaagauagacaggucccgcucuggggacaguuacugcuuuucuugguguuuguuauugugcuguucuuuaucuaccauuucaugcaggcggaggaaggcaaucccuuuuga

SEQ ID NO: 55761 - RNA, 1713 nt, Artificial Sequence
  derived and/or modified sequence opt3 from EME1__Homo_sapiens__NP_689676
auggcccugaagaaaagcucccccucucucgacucaggcgauagugacagcgaggaacuuccuaccuucgcuuuucugaagaaagagccauccucuacaaagagaaggcagccggaacgggaggagaaaaucguggucguugauauuucggacugcgaagcaucaugucccccugccccagaguuguucagcccucccgugccagaaauagcggagacuguaacgcaaacccagcccgugcgcuuacugaguuccgaaucugaggaugaggaagaguuuaucccucuagcucagcgacucacaugcaaguuccugacucacaagcagcuuagcccagaagacuccucaaguccggucaaaagcgugcuggaucaucaaaacaaugagggggccucuugugacuggaagaaacccuuuccuaagauuccagaaguucccuugcacgauaccccugagcguuccgcagccgacaacaaagaucucauccuggacccaugcugucagcugcccgcuuaccucucaacaugcccgggacagagcaguucuuuagcagugaccaagacuaauuccgauauucugccuccccagaagaaaacaaagccaagccaaaaaguccaggguagaggcucgcauggguguaggcagcagcggcaagcccgccagaaggagucuacccuuagaaggcaggaacggaaaaacgcugccuuggugacgcgcaugaaggcgcaacgaccugaggaaugccugaaacacaucauaguaguucuagaccccgugcuccugcagauggagggaggcggucagcuucugggggcauugcagacuauggaauguagaugcgucaucgaggcccaagcugugccauguuccgugaccuggaggcggcgugccggacccucagaggaccgcgaagauugggucgaggaaccuacaguucucgugcuguuaagagcagaggcuuucguaaguaugauugacaauggcaagcagggcagccuggauuccacuaugaaggggaaagaaacccuccagggauuugugacagacaucaccgccaagacggcggguaaagcccuuucucuggucauuguggaucaggagaagugcuucagcgcacaaaacccaccgaggcggggcaaacagggggcuaauaagcagacuaagaaacagcaacagcgacagcccgaggccucaaucggaaguaugguuucccgcguggacgcugaagaggccuuggucgaucuacagcugcauacagaagcacaagcccagauagugcagagcuggaaggagcucgcugacuuuaccugcgcguucacuaaagcaguagccgaggcuccuuuuaagaaacugagagaugaaacaaccuucucuuuuugucuugagucagacugggccggcgguguuaagguggaucuggcagggaggggauuggcccucgucuggcggcgccaaauucagcagcugaacagagugaguuuagaaauggcuagcgccgucgugaaugcauauccaucuccccagcugcuaguucaagcguaccagcagugcuucuccgacaaggagaggcagaaccuccuggcugacauccaagugcgucggggcgaaggcguaacgucgaccagccgaagaauugggccugagcuuuccaggcgcaucuauuugcagaugacaacucugcagccacaccucucacuggauagugccgacuga

SEQ ID NO: 55762 - RNA, 735 nt, Artificial Sequence
  derived and/or modified sequence opt3 from EMG1__Homo_sapiens__NP_006322
auggccgcucccagcgacggcuucaagccuagagagagguccgggggagaacaggcacaagauugggacgcccugccaccgaagcggccccgccucggugcgggcaacaagaucgggggacgacgucuuauugugguccuggagggcgcuucuuuggaaaccguuaaaguggguaagacauacgaguuacugaauugcgauaaacacaagucaauacuacucaagaacgggagagacccuggagaagccaggccagauaucacucaucagagucugcuuaugcugauggacagccccuugaaucgggcaggccuccugcagguauauauucacacgcagaaaaacgugcugaucgaggucaauccucaaacccgcauuccaagaacauuugauagguucuguggccucauggugcaguuacugcauaaacuuuccguucgggccgcugacgggccccagaaguugcugaaggugaucaaaaacccugucucugaucacuuuccagugggaugcaugaagguagguacuucguucucaauaccgguugugagcgacguccgcgagcuagugcccaguuccgauccuaucguguuugucguuggcgcauucgcccaugggaaggugucuguagaauacaccgagaaaauggugagcauuuccaauuauccacucucagcugcccugacaugugcgaaacuuaccacugcauuugaagaggucuggggagugaucuga

SEQ ID NO: 55763 - RNA, 3051 nt, Artificial Sequence
  derived and/or modified sequence opt3 from EMILIN1__Homo_sapiens__NP_008977
auggcccccagaacccuguggagcugcuaccucuguugccuucugacagcugcagccggcgcggcuuccuauccuccaaggggguucucuuuguacacuggaucaaguggugccuuaagcccgggcgggccccaggcacaaaucgccccucggccagcuucccgccaccgaaacuggugugcauauguggucacgcguaccguuucuugcgugcuggaggacggaguagaaacauacgugaaguaucagcccugugccuggggccagccucagugcccacaaucgauuauguacagaagguuucuacggccccgcuauagagucgcuuacaaaacugugaccgauauggaguggagguguugccaggguuacgggggagacgauugugccgaaaguccugcgccagcacucggcccggccagcaguacaccccggccucuggcucgcccagcccgacccaaucuuuccggcucuagcgcaggguccccucugucaggauuggguggcgaggggccaggagaaagugagaagguucagcagcucgaggaacaagugcagagccugaccaaagagcugcagggccucagaggugucuuacaggggcugucuggaaggcuugcugaagacgugcaacgggccguagagacugcguucaacggccgucagcagcccgccgaugcagcugcccgcccgggcguucaugagacauugaaugaaauacaacaccagcugcagcuacucgacaccagaguguccacgcaugaucaggagcuggggcaccuuaacaaucaucacggagguucaagcaguucuggcggguccagggcuccugcccccgcaagcgccccaccuggacccucggaagaacuguugcggcaacucgaacagcgacugcaggagucuugcuccgucuguuuagcuggccuggacgguuuucgcagacagcaacaggaggauagggaacggcuccgcgcgauggagaaacuucuggcaucaguggaagagagacagaggcacuuggccgggcuagcugugggccgucggccaccccaggaaugcugcaguccugagcugggacgaagacucgccgagcuggaaaggcgccuugacgucguugcaggcagcgugacuguacuguccgggcggagaggaaccgaguuggguggcgccgcugggcaaggaggccauccaccggguuauacaucucucgccagcaggcugucacgcuuagaagaucgauucaacaguacucuggggcccuccgaggaacaggaggagagcuggccuggcgcaccaggaggccuaucucacuggcuccccgcggcucgggggcgucuggaacagcuuggagguuugcuggccaaugugucaggcgagcucgggggaagacuggaccuucuggaggagcaggucgcaggcgccaugcaggcuuguggucaauugugcaguggggccccuggcgagcaggauagccaaguguccgaaauccucucugcacuggagaggcgcguuuuagacucggaaggacagcugcggcuagugggcagcgggcuccauaccgucgaggcugccggagaagcgagacaggccacacuggagggccuucaggaggugguagguagguugcaagaccgaguugaugcucaggacgaaaccgcagccgaguuuacgcugcgccucaaccugacugcugcccgguuagggcagcuggaaggacuuuugcaggcacacggcgaugaggguuguggcgcgugcgggggagugcaagaggaacucggcagacugagggacggggucgagcguuguuccugcccacuacugcccccgcgcggaccuggcgccgguccaggggugggaggccccucacgggguccucucgauggcuucagugucuuugggggaucuagcggcuccgcucugcaggcccuucagggggaauugucagaggugauucugagcuucucuuccuuaaaugacagucucaacgaacugcagacaaccguugagggacaaggcgcagaucuugcugaccugggugccacuaaggauagaaucauuagcgaaaucaauagguugcagcaggaggcaacagagcacgccaccgaaucugaggaacgauuucgggggcucgaggagggacaagcucaggcgggccagugucccucccuggaaggucgccuaggcagacuggagggggugugcgaaaggcucgacacgguagccggaggccugcaggggcuucgggagggauugucacgacaugucgcaggccugugggcugguuuaagagaaaccaacacaacuucacaaaugcaggccgcccuccuggagaaacuuguugggggacaggcuggccugggccgcaggcuaggggcacucaauagcucgcugcaguugcuggaggaucguuuacaccaacucucccugaaggaccuuaccggaccagccggugaagcgggcccucccgggccaccgggacugcagggcccucccgguccagcugggcccccuggaucuccaggcaaggacggccaggaggggcccauaggaccuccggguccacagggcgaacaagggguggagggagcccccgcagccccugugccacaggucgcuuucagcgcagccuugucacucccccggagugaaccuggcacagugccguuugauagaguacugcuaaacgacgguggguacuaugaucccgagacuggaguguucaccgcgccacuggcuggcagguaccuucucuccgccguucugacaggccaucgccacgagaaggucgaagcaguguugucucgaagcaaucaggggguggccagagucgacuccggagguuaugagccugaaggccuggagaacaaacccguugcugaaucacagccaagcccugggaccuuaggaguguuuagucucauccugccccuucaagccggcgauacuguguguguagaccuggucaugggucaguuggcacauucugaggagccacucacgauuuucuccggggcucugcuauacggagauccggaacuggagcacgccuga

SEQ ID NO: 55764 - RNA, 3162 nt, Artificial Sequence
  derived and/or modified sequence opt3 from EMILIN2__Homo_sapiens__NP_114437
auguggcagcccagaaggccuuggccacgggugccguggcgcugggcccuggcucuccuugcacuggucggcgccggguugugccacgcgggaccccaaccugguuacccagcucgacccagcgcccguaacaagaauuggugugcauauaucguuaacaaaaauguguccugcucuguauuagagggcucagaaaguuucauucaggcccaguacaacugugcuuggaaucagaugccuugcccaagcgcacugguguauagagucaacuuuaggccccgguacgugacccgcuauaagacaguuacucaacuagaguggagauguugcccuggguucaggggaggcgacugucaggaagguccaaaagauccggugaagacgcuccggcccaccccugcccgcccacgaaauucccugaaaaaggcuacagacaacgagcccucucaguuuucggaaccuagaaagacucuuucaccaaccgggacagcccagcccagcuggggagucgauccgaaagagggcccucaagagcugcaggaaaagaaaauacagguguuggaggaaaagguacucaggcugacccggacuguucuggaccuccagaguuccuuagcgggcgugucugagaaucugaaacaugcaacacaagaugacgccagccguacccgcgcucccgggcuuuccucacagcacccaaagccugauacgacugucaguggagacaccgagacaggucagagccccggcguguucaacacuaaggaaucugggaugaaagauaucaaguccgaguuggccgaagugaaagacacccugaagaauaaaucagauaagcuagaggaacucgacggaaaagucaagggcuacgagggucaacugagacagcuucaggaggcagcucaggggccaacaguuaccaugacgacuaacgaacuguaucaagccuacguggauagcaagauugacgcguugagggaggaacucauggagggaauggaccggaaacuggccgauuuaaagaauaguugcgaauacaaacugacaggccuccagcagcagugugacgauuauggcagcuccuaccuugggguaaucgagcugauuggagagaaggaaaccagcuugcgaaaagagaucaacaaucuacgcgcaagacugcaagaacccucggcucaggccaacugcugugacucugagaagaacggugauauaggccagcagaucaagacucucgaccagaaaauugaaaggguggcugaggccacacggaugcugaaugggcgccuugauaacgaguuugacagacugaucgucccugaaccagauguggacuucgaugcaaaguggaaugaguuggacgccaggauuaacguuaccgaaaagaaugcugaggagcauugcuuuuauaucgaagagacgcuccguggagcgauaaacggcgaagugggugaccugaaacaauuagucgaucagaaaauucagucccuggaggaccggcuagggucagugcuccugcaaaugaccaauaacacaggcgcagaacuuaguccgcccggagccgcugccuugccuggcguaagcggguccggagaugagcgaguuaugauggagcugaaucaccucaaggacaaggugcaggucguggaagauaucugccugcuuaacauucaggguaaaccacauggcauggagggggcacugcccaauagagaagacagggccguccgcgauucuuugcaccuccugaagucuuuaaacgacacuaugcaccggaaauuccaagagaccgaacagacaauccagaagcugcagcaagauuuuucauuccuauacagucagcucaaucauacugagaacgacgugacccaucugcagaaagagauguccaauuguagagcuggagaaaacgccggcauggguagguuuacaaagguuggggagcaggaacgcaccguggauacucuuccuagcccacaacaccccguagcacacugcuguucucaguuggaggaacgauggcagcggcugcagucacaagucaucagugagcucgacgcgugcaaggaguguacgcagggcgugcagcgugaaguuagcaugguggagggaagagucucccacauggagaaaacaugcucuaagcuggauucgauuagcggcaacuuacaaaggauaaaagaagggcugaauaagcauguguccucacuuuggaacuguguacgccagaugaauggaaccuugcggagucacucuagagacaucagcggucucaaaaacuccgugcagcaguucuauucacauguuuuucaaauuagcacugaccugcaggaucuagucaaguuccagccgucugcuaaagccccuuccccacccccucccgcagaggccccaaaggaaccucugcagcccgagccagcuccgccuaggcccaguggcccagccaccgcagaagaccccgggcgacgcccugugcucccacaacggcccccugaggaaagaccgccacagcccccuggaagcacaggcgugaucgcugagaccggucaggccgggccacccgcgggcgccggagucucuggcagggggcugccucguggaguugauggccagacugguuccgggacagugccgggagcugagggcuucgccggugcacccggcuacccaaagucaccucccguggcuaguccaggggccccuguacccagccuugucucguuuuccgcaggauugacgcaaaaaccauucccgucugacggcggggugguucuguuuaauaagguguuagucaacgauggagacguguauaauccuagcaccggcguuuucacugcgcccuacgauggucgcuaccucauaacagccacccugacaccagaacgggacgcuuauguggaggccguacuuucagucaguaacgcauccguggcucagcugcacacugccggguacagaagggaauuuuuggaguaucaucgacccccuggagcacuccauaccugcggcgguccaggcgccuuccaccugauugugcaccuaaaagcuggggaugcggucaauguugugguaacgggaggcaagcuggcccacaccgacuuugaugaaauguacucuacauucagcgggguguuucucuaucccuuccugucccaucuuuga

SEQ ID NO: 55765 - RNA, 2301 nt, Artificial Sequence
  derived and/or modified sequence opt3 from EMILIN3__Homo_sapiens__NP_443078
augggcagaaggcggcugcucguguggcuuugcgccgucgcugcacuguugagcggggcccaggcgcgcggaacccccuuacuggcucgaccugccccaccgggugcaucccguuacucucuauauacaacuggcuggagacccaggcuccggccugggccacacaaggcccugugugcuuacguugugcaucgcaacguaacgugcauccuucaagagggagcagagucauaugugaaagccgaguacagacaguguagguggggccccaagugcccugguaccgucacauaucggacugugcugcgcccaaaauacaagguuggguauaaaaccgugacagacuuggcuuggcgauguugccccggauucaccggcaagagauguccugaacaccucacugaucauggcgccgcgaguccacagcuggagccggaaccccagauuccuagcgggcaacuggacccaggacccaggccuccauccuacucucgggcagcccccucgccgcacggucguaagggcccugggcucuuuggagagcgcuuagagagacuggaaggcgauguccagaggcuugcucagacauacgguaccuugucagggcugguggccagccaugaggaccccaaucggaugacgggaggcccacgagcuccugcaguacccguuggcuucggggugauaccagaaggacuggucggucccggcgaucgcgccagagggccucucacuccaccgcuggacgagauccuuaguaaagugaccgagguguccaacacacugcagacuaagguccaauugcucgauaaaguucacggacuggcguuaggccacgaagcccaucugcagaggcuccgggaggcacccccuucuccacuuaccagccuggcuuugcuagaagaguauguggaccgcagacugcacaggcucugggguucccugcuugauggguuugaacagaagcugcagggcguacaaucagagugcgacuugcgugugcaggagguccggcgacagugugaagagggacaagccgcuaguagaaggcuccaucagagccuggauggccgcgaauuagcccugcggcaggagcuaucucagcucgggucccaacugcagggacuuucagugagcgguagaggcaguugcugugggcaguuggcacugauuaaugccaggauggacggacucgaacgcgcucugcaggcgguuacagagacccaacgaggccccggugccccugcaggggaugagcuuacgcggcugucugcugccauguuggaaggcggaguggacggccuccuggagggguuagaaacucugaacggaacagaggguggcgcacgugggugcugccuaagacucgacaugggaggcuggggugucgggggcuucggaaccaugcuggaagagagggugcagucccuugaggaacgcuuggccacucuggcuggcgagcucagccacgauucggccucuccagggcgguccgcaagaccccugguacagacagaauuagcgguucuggagcagaggcuugugucauuggagaccaguuguacgccgagcaccacauccgcuauccucgacucucuggucgccgaagugaaagcauggcaaagccgaucagaggcccuacugcgccaggucgcuagucacgccgcacuccugcagcagcuuaauggaacuguggcugaaguucaaggccaguuggccgaggguaccggguccagccugcagggagaaauuacauuacucaaggugaaccuaaauucuguaucaaagagucuuacuggccugagcgauuccgucucucaauacucggacgcguuuuuggccgcuaacaccagccucgaugagcgggagagaaaaguggaagcagagguucaggccauccaggaacagguguccucacaagguaguaggcugcaggcuggccaucgucagguccuaaaucugcgcggggagcucgaacagcugaaggccggaguggcaaaaguagcgucuggccuuagccggugccaagacacagcccagaaguugcagcacaccguggggcauuucgaucagagaguugcucaagucgagggagccuguaggcgacugggcuuacucgcagcuggucuggacucccuuccuacugagccacugcggccccgcgaagggcuauggucacacguggaucagcucaacagaacgcuggcccagcauacacaagacauagcaagguugcgggaugaccuguuagacugccaggcccagcucgcugaacaggugcgaccuggacaagcgaauuga

SEQ ID NO: 55766 - RNA, 2505 nt, Artificial Sequence
  derived and/or modified sequence opt3 from EML1__Homo_sapiens__NP_001008707
auggaggacggcuucagcuccuacucuucacuguaugauaccaguagccuccuucaguuuugcaacgacgauuccgccucugcugcaucgucaauggaagugacagacagaaucgccagccuggagcaaaggguccagaugcaggaagaugacauucaguuguuaaagagugcgcuggcugauguugugcggcgccuaaauauaacugaggaacaacaggccguacucaaccgaaaagggcccacgaaggcacguccucugaugcagacccuuccacugagaacaacugugaauaacggaaccgucuugccgaaaaagcccacagguucccucccuucuccaagcggcgugaggaaagagaccgccguucccgcuacuaagcggcugaaucgcuccgugucacugcucaacgcauguaaguuaaauagaaguacaccuagcaacaucaaaaggaccucuuccucagagcgggucagcccagggggacgccgagaaaguaauggcgacucuagagguaacaggaaucggacgggguccacuagcucgucuuccucaggaaagaaaaacagugagagcaagcccaaagaaccuguguucuccgccgaggagggcuacguaaagauguuucugcguggccgcccaguuaccauguauaugccgaaggaucagguggacucuuacagccuugaagcuaaagucgaguugcccacaaagagacugaaacuagaauggguguauggguacaggggacgggauugccgaaauaaccucuaucugcuuccuacuggugagaccguguacuucauugccucagucguugugcuguacaauguagaggagcaauugcagcgccacuaugcgggccauaacgacgaugugaagugucucgcaguccacccagacagaaucacaauugccaccggacagguggcugggacgaguaaagacggcaagcagcugcccccucauguuaggaucugggauuccgugacuuuaaacacacugcacgucauagguaucggguuuuucgaccgggccgugaccugcauugcauuuagcaaaucuaauggaggcacuaaccucugugcuguagaugacucaaaugaucauguucuuagugugugggacuggcaaaaggaggaaaagcuggccgaugucaaaugcagcaacgaggcgguguucgccgcagacuuucacccaacagauaccaauaucauugucacguguggcaagucccacuuguacuucuggacccuagaagggucuucgcugaacaaaaagcagggacucuuugagaaacaggaaaagcccaaguucgugcugugcguuacauuuagcgagaauggugacacuaucaccggcgauuccucagggaacauacuuguguggggaaaaggcacaaaucgcauuaguuaugcuguacaaggugcccaugaagggggcaucuucgcucuguguauguugagagacggaacucucgucucuggcgggggaaaggacaggaaacugauuagcugguccgguaacuaccagaaguuacguaaaaccgaaaucccggagcaguucggcccuauccggacaguggccgaagggaagggagauguuauucugauaggcaccacucgaaauuuugugcuacaggguacgcucucaggggacuucacacccaucacccaaggccacacugaugagcuguggggacuugcaauucaugccagcaagucucaguuuuugaccugcggccacgacaaacacgcuacacugugggaugcggucgggcauagaccagugugggacaagaucauagaagauccugcacaguccaguggauuccaccccagcgguucuguaguggccguuggcacccucacugggaggugguuugucuucgacacagagacgaaagaucuggugaccgugcauacugacggaaacgagcagcuuuccgucaugcgcuauucaccagauggcaauuuucuggcuauugguagucacgacaacuguaucuacaucuaugggguuagcgauaauggccggaaguacacaagagugggaaaaugcucgggccauuccucuuucauuacccacuuggacuggagcgugaacucacaauuucucguaaguaacuccggggacuacgaaauccuguauuggguccccucugccugcaaacaggugguuagcguggagacaacuagggauauugaaugggcaaccuacacguguaccuuaggauuccacgucuuuggcguguggccugaggguuccgacgggacagauauaaaugccguuugccgcgcucaugagaagaagcugcuaucaacuggagacgauuucggcaaggugcaccucuuuagcuauccauguagucaguuccgagccccgucucauaucuacgguggccacuccagccacguaaccaacgucgacuuccugugcgaagauucgcaucuuauuucaacagggggaaaagacacuucuaucaugcaguggcgggugaucuga

SEQ ID NO: 55767 - RNA, 2553 nt, Artificial Sequence
  derived and/or modified sequence opt3 from EML2__Homo_sapiens__NP_001180197
augcuggagagaagggcccuccuuuggcagcgggaagcuggccccggguggggagaccgcgcacgagccgguaccggcggggcgggaggcgguugcgggggagcuauggccgagcguggcccugcauucuguggccuguacgauacaagcuccuuguuaagauauugcaacgacgauaaucugucugggacuucaggaauggaaguggacgauagggucagugcccuagagcaacggcuccagcugcaggaagacgagcuugcuguucugaaggcagccuuggcugaugcccuccgcagacugagggcgugugaggaacagggugcagcccugcgggcucgcggcacgccaaaagggcgagccccgcccagacucggaaccacagcaagcgugugccaauuacugaagggccuuccuacuaggaccccauugaacgguuccgggcccccucggcguguaggaggcuacgcuacaucuccaucgucacccaaaaaggaggccaccagcggccgcaguuccgugagaagguaucugucuccugaacggcuagcgagcguccgacgcgaggacccaagauccaggacuacaucaaguagcucuaauuguuccgccaaaaaggaggggaagaccaaagaagugaucuuuucaguugaggauggaagcgugaagauguuccuccggggucgcccgguccccaugaugauuccugacgaacuggcaccaacguacagucuugauacuagaucugagcugcccuccugcagguugaaacucgaauggguguauggcuaccgugggcgggacugucgagcuaaccuguauuuacugccuaccggagagauaguauacuuuguugccagcguggcuguccucuacucgguggaggaacagagacagaggcacuaucuuggccauaaugaugacaucaagugccuggccauucacccagacauggugacaaucgcaacuggucaggucgccgggaccacaaaagagggcaagcccuugccgccucauguucgcauuugggauucugugucccuaucaacccugcacguacucggacugggcguguucgaccgggcugucuguugcgugggguuuaguaagagcaacggagguaaucuucugugugcgguugaugaauccaacgaccauauguugucugugugggauugggcaaaagagacgaaggucguggacguaaaaugcagcaaugaagccguucucguggcuacuuuccaccccacagauccaaccguccugaucacuugcggcaagucacacauauacuuuuggacauuagaagggggaagucuguccaaaagacaaggccuauucgagaagcaugagaaaccuaaguaugugcucugugucaccuuucuggaggguggggacgugguuacgggcgauagcggaggcaaccuuuacgugugggggaagggagguaauaggaucacccaggccguauugggcgcacacgacgggggagucuucggccugugcgcccuccgcgaugguacacuggugucugggggcggacgagaccggcguguugugcuuuggggcucagacuauaguaaacugcaggaagucgaggugcccgaagauuuugggccaguaagaacuguggcugagggacauggcgacaccuuguacguugguacaacuaggaacagcauucuccagggguccguccacaccggauucucucuguuagugcaaggccacguggaggaacuguggggucuagccacacaucccucgcgcgcacaguuugucaccuguggccaggauaagcucguucaccuguggagcuccgacucacaucaaccucuuuggagucggaucauugaggauccagcgagaucugcuggguuccacccgagcggauccguguuggccgugggcacuguaacggggagguggcugcuccuggacacagaaacccaugauuuagucgcaauccacacugacggaaaugagcagauaucagugguuagcuucucucccgauggcgccuaucuggcuguggguucccacgacaaccuugucuacguguacaccguugaucaagggggacgaaaagugagucgcuugggcaagugcagcggucauucuuccuuuauuacacaccucgacugggcccaggauucaaguuguuucguaaccaauagcggcgacuaugagauccuguacugggacccugcaacuugcaaacagauuacaucggcugaugccguccggaacauggaaugggcgacggccaccugugugcuaggguuuggaguguucggcaucugguccgagggggcugacggaacugauaucaacgcagucgccagaucucaugacggcaagcugcucgcuagcgccgaugacuuugguaagguucaccuguucucauauccaugcugucagcccagggcacuuagucacaaauacgggggacauuccucucacgugacaaauguagcguuuuugugggaugacagcauggcccugaccacaggcgguaaggauacuuccguguuacaguggcgugucguguga

SEQ ID NO: 55768 - RNA, 2772 nt, Artificial Sequence
  derived and/or modified sequence opt3 from EML4__Homo_sapiens__NP_001138548
auggacggcuucgccgggagccuggaugacuccaucucugcugcaucaaccagugaugugcaggacagacucagcgcccuugaguccaggguccaacagcaggaagaugagauuacaguucugaaggcggcuuuggccgacguguuacggcgccuggcaauaucugaagaucacguagccucggugaaaaagucagucagcaguaaaggacagcccuccccucgagcugugaucccaaugucuugcauuacuaacgguagcggcgcaaaucguaagccgucccauacgucagccguuaguaucgcugggaaagagacccuaagcucugccgcgaaguccauuaagagacccagcccugcagaaaaaucacacaacaguugggaaaauucugacgauuccaggaacaagcucagcaaaaucccaucgacacccaagcugauaccuaaagugacuaagaccgccgacaagcauaaagaugucaucauuaaucaagagggagaauacaucaagauguuuaugcggggccgcccaauuacaauguucauccccucugacguggauaacuaugacgacauaagaaccgagcuuccuccagaaaaacugaaguuggagugggcuuacgguuauagggggaaagauugucgggccaauguauaccuccugccgacuggagagauuguuuauuuuaucgcauccguggucgugcuguucaacuacgaggagcgcacacagcgacacuaucucggccauaccgacugcgugaaguguuuagcuauucaccccgauaaaaucagaaucgccacgggccagauugcgggggucgacaaggauggaaggccucugcagccacacguucgggugugggacucaguaacucuuaguaccuugcaaauaaucggucugggcacauuugaacguggggugggaugccuagauuucagcaaggccgacuccggcguccaucucugugugauugaugacucuaaugagcacaugcugacuguuugggauuggcagaaaaaggcaaaaggugcugaaaucaagaccacaaacgaggugguccuugccguggaguuucaucccaccgacgcuaauacgauaauuacuugcgggaaaagccacaucuucuuuuggacauggucaggaaacagucugacccgcaagcagggcaucuucggcaaguacgaaaaaccuaaguuuguacaguguuuggccuuccucgggaauggagacguucugacuggugauuccggcggggugauguuaauuuggagcaaaacaaccgucgagccaacgcccggaaagggcccgaaagguguguaccaaaucucuaagcagauuaaggcacacgacgggucagucuuuacccugugccagaugagaaacggcaugcuccuuacaggaggcgggaaagauaggaagauaauccugugggaccaugauuugaauccugaacgggagauugaagugcccgaccaauauggaacuauccgagccguugcugaggguaaagcggaucaguuccuagugggcaccagucgcaacuucauccugagagggacauuuaacgacggauuccagauugagguacagggccacacugaugaacucuggggucuggcaacccauccauuuaaggaccuucuguugacaugugcccaagauaggcaggucugccucuggaauagcauggagcaccggcuggaauggacccgcuuaguggacgagccugggcauugugcugauuuccaccccuccggcacuguuguggccauaggaacgcacucuggcagaugguuuguccuggacgcagaaacaagggaccuagugucgauccauaccgaugggaacgagcagcucagcguaaugcguuacuccauugacggaacuuuccuggccguggguucacacgauaauuuuaucuaucuuuacguugucagugagaacggccggaaauauucucgauacgggagaugcaccggacauagcuccuauauuacacacuuggacuggucaccagauaauaaguacaucaugagcaacucuggcgacuacgaaauacuguauugggauauccccaaugguugcaagcucauuaggaaccgcuccgacuguaaagauaucgacuggaccacuuacacaugcgugcugggguuccagguguuuggcgucuggccugagggaagugauggcacggacauuaaugcucuuguucggagccacaacagaaaggugaucgccguggcagaugacuucuguaaaguacaucuguuucaauauccaugcucuaaggcgaaagcuccgucccacaaguacucagcccauaguagccacgucaccaaugugucguucacucauaacgacucccacuugauaucuacagggggaaaagauaugagcauuauccaguggaagcucguugaaaagcugucauuaccccagaaugagaccguggcagacacaacucugaccaaagccccugucaguuccacggagucugugauucagagcaacaccccaacacccccuccaucccaaccccuaaaugaaacugcugaggaagagucaaggaucagcaguucuccgacccuccuggaaaacucccuugagcagacaguugagccuagcgaagaucacucggaggaagagucagaagagggcucuggugacuugggggagccacuguaugaggaacccuguaacgaaauaaguaaggagcaggccaaagcaacucuccuggaagaucagcaagacccuucccccagcucuuga

SEQ ID NO: 55769 - RNA, 5934 nt, Artificial Sequence
  derived and/or modified sequence opt3 from EML5__Homo_sapiens__NP_899243
auggccgcuagaagcgcacccuccugccaccugaggcucgaguggguguacggcuaucgggggcaucagugucgcaacaaucuuuacuauaccgccgcgaaggaaaucgucuacuucguugcuggaguggguguaguguauucuccucgagagcaccgucaaaaauuuuacagaggccauucagacgauauuauaagucuggccuugcacccagaaagggucuuaguggcaacagggcagguuggaaaggagccguauaucugcauuugggacagcuacacugugcagacgaucuccguccugaaagaugugcauacccacggcauugccugucuagcuuucgaccucgauggucagcggcugguaucuguugggcuugacucgaagaacgcagugugcgucugggauuggaaacgcggaaagaugcugucaauggcccccggccacacagacagaaucuuugauauaagcugggacuuguaccaaccuaauaagcucgugaguuguggcgugaaacauaucaaguucuggucccugugcgggaacgcucugacuccaaaaaggggagucuuugguaagaccggcgaucuccagacaauuuuaugucuggccugcgcgcgggacgaacuuaccuauucuggggcauugaauggagauaucuacguuuggaaaggcauuaaccugauccgcacuauacagggugcccacgcugccgggauuuucagcaugaaugcaugugaggagggauuugcuacaggcggccgagacgggugcaucagacuaugggaccucaccuucaagcccauuacggugaucgaucugagggaaacugaccagggauauaagggucuuuccguacggucaguguguuggcguggcgaucauauccuggucgggacccaagacagugagauuuuugaaauagugguucaggagcgcaacaaaccuuucuugaucaugcagggacacugcgagggcgaacucugggcccuggcggugcacccaacaaagcccuuagccgucacugguagcgaugacagaucugugaggauuuggucccugguagaucaugcacucaucgcucggugcaauauggaggaaccuauacgaugugccgcuguuaacgccgacgggauucaccuugcacugggcaugaaagauggaucauuuaccguguugcgcgucagagacaugacagaggugguccauaucaaggauaggaaagaagccauccacgagcuaaaguacagcccagacggcaccuaucuggcuguggggugcaaugacaguucuguugauauuuacggaguggcgcagcgguauaaaaagguaggugagugucucggcucccugagcuucaucacgcaucuugacuggucgucugauucccgcuaccugcaaacuaacgacgggaauggaaagagauuguuuuacaggaugccgggcgguaaagaagucacaucaaccgaggaaauuaagggggugcacugggcaaguuggacuugcguuagcggccucgaggugaacggaauauggcccaaauauuccgauaucaaugacauuaacucugucgauggcaacuacaucgggcaggugcugguaacagccgacgauuauggaaucauuaaguuauuccguuacccuugucugcggaaaggugcuaaguuccgaaaguauauaggccacagcgcccaugugaccaauguuagauggucacacgacuaccagugggucaucaguauugggggagcagaucauuccguguuucaauggaaauucaucccagaaaggaagcuaaaagacgccgugcacauugcuccccaggagagccucgccgauucucacucagacgagagugacagcgaucuguccgacgucccugaacuugauucugagaucgaacaggagacgcaguugaccuaucgccggcaaguuuacaaggaagaccugccacagcucaaagagcagugcaaggagaagcagaaaucggcaacaagcaagagaagggaacgcgcgcccggcaacuccauacgacugcauuuugugcacgguuaccggggguaugauugucguucaaaucuuuucuacacucaaaucggcgagauuguguaucauguagcugccgucggagugaucuacaacagacagcagaauacccagagguuuuaucugggccacgacgaugacauuuugugccucacaauccauccgcugaaagauuacguugcaacugggcaagugggacgcgacccuaguauacacauuugggauaccgaaacaaucaagcccuuaucuauucugaaaggccaccaucaguauggugucagcgccguggacuucuccgcugaugggaagcggcuagccucaguuggaaucgacgacagccacaccgugguacucugggauuggaagaaaggcgagaagcugucuauagcaagagguuccaaagacaagaucuuugucgugaaaaugaacccauacgugccugauaagcuuauuacugcuggcaucaaacauaugaaguucuggaggaaggccgggggaggcuugauugggcgaaaaggauacaucggcacgcuggguaagaaugacacaaugaugugugcggucuauggguggaccgaggaaauggccuuuaguggaacuagcaccggcgauguuugcauauggcgcgacauuuuccucgugaaaacaguaaaggcucacgauggucccguguuuucuaugcaugcacuggagaaaggcuucgucaccgggggaaaggacggcaucguggccuuaugggaugacuccuuugaacggugucugaagacuuacgcuaucaaaagagccgcacuugcgccagggucaaagggauugcuccuggaggauaaccccaguauuagggccaucagccuaggccacggucacauucugguugggacaaaaaauggagaaauacucgagguggacaagucgggcccuaucacgcugcuuguccagggucauauggagggcgaaguguggggguuggcuacccacccauaucugccgauuugcgccacuguuuccgacgauaaaacauuacguaucugggaccucucucccagccauugcaugcuggcagugcgcaagcuuaagaaaggaggccgguguugcuguuucucaccugaugggaaggcucuggccgucggauugaacgacggcaguuuccucauggcaaaugccgauacccuggaggaccuaguauccuuucaccacagaaaagauaugauuucugacaucagguucagcccagguuccgggaaguaccuggcuguggcgucacaugauagcuuuauagacaucuauaacguuaugaguucuaaacgagugggaauuugcaagggcgccacauccuacaucacucacauugauugggacauccggggcaagcuccugcaggucaauaccggggcaaaagaacaacuuuucuuugaggcuccccgcggaaagaaacagacgauaccuagcguggaaguagagaagauugccugggccucguggaccucaguguugggucuguguugcgagggcaucuggccagucaucggggaaguuacagaugugacugcuucuuguuuaaccagugacaaaauggugcucgcaacaggagacgaucugggcuucgucaagcuuuuuagauaucccacuaaagguaaguucgggaaguuuaaaagguacguggcccauuccacccacguuacgaacguacgguggacauacgacgauagcaugcuggugacccuaggaggcacugacaugucucucauggucuggacaaaugagauggaaggcuaucgagagaagagaccgugcgauagcgaagaguccgacauugauucagaggaagacgggggauacgauagugacgugacccgcgagaacgaaauaagcuauacuaucagggcgcugucuaccaacauucguccuauguuggguaucaaaccacaucugcagcaaaaggagcccuccauugaugagcggcagggcguugugagagggucaaggccucccgucagucgcgcuccaccucagcccgaaaaauuacagacaaauaacgugggaaagaagaaacgaccaaucgaggaccucguacuggaacuuauauucggcuacagaggucgggauuguaggaauaacguccacuaucugaaugacggggacgauaucauuuaccacacggccagcgugggaaucuugcauaacguugcaaccggcucccaaucuuuuuaucaggagcacaaugacgauauucucugccugacugugaaccagcauccgaaguucaucaauauagucgccacaggccaggugggggacucggcugauaugagcgcaaccgccccuucaauucacaucugggacgcgaugaacaaacaaacacuauccauccugcgcuguuaccacaguaagggaguuugcucugugagcuuuuccgcuacugguaaacuucuccugucagucggcuuggaucccgaacauaccauuacgaucuggcguuggcaggagggggccaagauagcaucuagagccggacacaaucagcggauuuucguggcugaguucaggccagacagcgauacacaguuuguaagugugggcguuaagcaugucaaauucuggacccuggccggucgcgcauuacucuccaagaaagggcugcuuagcacucuggaagacgcucgaaugcaaaccauguuggccaucgcguuuggagccaacaaucucacauucacuggcaccauuucuggcgaugugugcguguggaaggaccacauccuguguagaauagucgcacgggcucauaacgggcccguauuugccauguacacaacgcuaagggacggacugauugugaccgguggcaaagagcgcccuucaaaggaagggggagcuguuaagcuuugggaucaggagcucagaaggugccgggcauuccgucuggaaacuggccaggccacagacugugugcgcuccgucugccgagguaaagggaagaucuuggugggaaccagaaaugccgagaucauugagguuggcgaaaaaaacgcugcguguaacaucuuagugaauggccacgucgaugggccaauuuggggacuggcaacucaccccaguagggacuuuuuccucagcgccgcugaggaugguacagugcggcugugggacauagccgauaagaaaaugcuuaacaagguaaaucugggccaugcagcccgcaccgugugcuauucgccugaaggggacaugguugcuaucggaaugaagaacggcgaguuuauuaucuugcuagucucuucccugaaaaucugggguaagaaaagagauaggcggugugcgauucacgacauacgauucagcccggauucaagauaccucgccguggggaguucugaaaauuccguggacuuuuaugaucugacgcuuggcccaacuuuaaaccgcaucagcuacugcaaggacauucccucauucgucauccaaauggacuucagugcagauagcuccuaucugcagguuucuagcggauguuacaaaaggcauguguaugagguaccuuccggcaagcaccucauggaccacgcugccauugaucggaucaccugggcaacauggaccucaauauugggggacgaggugcugggaaucuggucucgucaugccgaaaaagcugaugucaauugcgccugugugagucacucggguauuagccucguuacuggcgacgauuuugggauggugaagcuguucgacuuuccaugccccgagaaguucgcgaaacauaagagauuucuuggacacuccccucaugucacaaacaucagguucaccucuggcgaucgccacguagugucagcagguggggacgauugcagccuguuuguuuggaaaugugugcacacaccgcauuga

SEQ ID NO: 55770 - RNA, 5877 nt, Artificial Sequence
  derived and/or modified sequence opt3 from EML6__Homo_sapiens__NP_001034842
auggccgacagaaccgcucccaggugccagcugcggcucgaguggguguacggcuaucgcgggcaccaaugucgaaacaaucuuuacuauacagcaggaaaggaagucguuuacuucguggccgguguaggcguggucuauaacacucgugagcauagccagaaauuuuuccuggggcacaaugaugacaucauuuccuuggcguuacauccugauaagacgcugguggcuaccggacagguuggcaaagaaccauacauaugcaucugggacucuuauaacgugcagacagucucacuacucaaggaugugcacacucaugguguagccugucuggcauuugacagugaugggcaaagacuugccagcguuggacuggacgcuaaaaauaccgugugcauuugggauuggaggaagggcaaguugcucgcauccgccacaggccacucugaccggaucuucgauauuucgugggacccguaccagcccaaccgcgucgugucauguggggugaaacacaucaaguuuuggacccugugcggaaaugcucugacugccaaaagagguauauucggcaagacaggggaucuccagaccaucuuaugucuggcgugcgcaaaagaggacauuacguacagcggagcccuuaacggcgacaucuaugucuggaaggguuugaaucugguuaggacuauucagggggcucauagugccggaaucuuuuccauguacgcaugugaagagggcuucgcuaccggcgggcgggauggaugcauacgccuaugggacacagauuuuaagccuauuacuaaaaucgaccuccgagagaccgaacaagguuauaagggccugucuauuagaagcguguguuggaaagccgauaggcuucuggcggggacacaggacuccgagaucuucgaaguaaucgugcgggagcgugauaagccaauguugauucuccagggacacugcgagggcgaacugugggccuuagcacugcaucccaaaaagccucucgcugucaccgguucagacgaucgcagugugagacuuuggagccuggccgaccacgcuuugauagccaggugcaacauggaggaagcaguucggucuguggccuuuuccccagaugggucacagcuagcucugggcaugaaagacggaagcuucaucguccuccgagugcgcgacaugacggagguaguucacauuaaggauagaaaggaagugauccaugagaugaaauuuagucccgacggcucuuaccuggcggucggguccaaugauggaccuguggacgucuaugcaguggcccaaagguacaagaaaauaggugaguguagcaagucgcuuucuuucauuacucacaucgauuggucccuggacucaaaauauuugcagacaaacgauggcgcuggggaacggcucuucuaccgcaugccaaguggaaagccgcugaccagcaaggaggaaaucaaaggcauucccugggccuccuggacuugcguuaaggguccugaggugucugggaucuggccaaaauacacagaaguaaccgacauuaauagcgucgaugcaaacuauaauucaaguguguuaguuuccggcgacgauuuuggacuggugaagcuauucaaauuucccugucucaagagaggcgccaaguucaggaaauacgucgggcauagcgcucacgugacgaacguacguuggucucaugacuuucagugggugcugucaaccggaggugccgaucacaguguuuuccaauggcgguuuauaccugagggcgucagcaacgggaugcuugagacagcaccacaggaaggaggcgcggacuccuauucugaggaaucggacagcgauuuguccgacgugcccgagcuggauucagacaucgaacaggaggcucagauuaauuacgaucgacaaguguauaaggaggaccucccgcagcugaaacagcagaguaaggaaaaaaaccacgccgucccuuuccuuaagagagagaaggcacccgaagauucucugaaauugcaauuuauccaugguuacaggggguaugacugccgcaauaaccucuucuacacucaggccggcgagguuguguaccacaucgcugccguggcaguagucuauaaucggcagcagcauagccaaagacuguacuuaggacacgaugacgauauucugucccuaaccauacacccagugaaggacuauguugcuacaggccagguggggagggaugccgcgauccaugucugggacacucagacccucaaaugucugucacuuuugaagggacagcaccaacgcggcgugugcgcccuggacuuuagcgcugaugguaaaugucucguuucuguggggcuggacgauuuccauuccauuguauuuugggacuggaagaaaggagagaagaucgcaacaacccgaggccacaaggauaaaauuuucgucgugaagugcaacccucaucacguggacaaauuagucacuguugguaucaagcacauaaaauucuggcagcaggccggcgggggauuuacgaguaagcggggcacauucgggagcgugggaaagcuggaaaccaugauguguguaucuuacggccguauggaggaucuuguguuuuccggugcugccacuggggacaucuucauuuggaaagauaucuugcuccugaagaccgucaaagcacaugacggacccguguuugcgauguaugcccuagauaagggcuucguuacagguggcaaagacgggauuguggaacugugggacgauauguuugagagaugccucaagaccuacgcuaucaagaggucagcccugaguacuagcucgaaaggacuuuugcuggaagacaauccauccauacgcgcaauuacauuaggccacgggcauauccucgucggaacgaagaacggcgagauucuggagaucgauaaaucuggucccaugacccuucuggugcaagggcacauggaaggagagguuuggggcuuggcugcccauccucuccugccaauaugugcaacugugagcgacgauaagacacuacggaucugggaacugucagcccagcacagaaugcucgcugucaggaaacugaagaaggguggccgaugcugcgcguucaguccggacgggaaagcccuugcaguaggauugaaugauggcuccuuucuggugguuaacgcugacaccguggaggauauggucucuuuccaccaucgcaaggaaaugauuagcgacaucaaauuuuccaaggauacagggaaauauuuagccguggccucacacgacaauuucguagauauuuacaacgugcucacuagcaagcgggucggaaucuguaaaggcgcuaguucuuacauaacccauauugacugggacuccagagguaagcugcuucagguuaauagcggggcaagggagcagcuguuuuucgaggccccccguggaaagcgccacaucauccggccuucggaaauugagaaaaucgaaugggauacguggaccugcgugcuaggcccaacaugugagggcauuuggcccgcgcacucagacauaacugaugugaacgcugccucucucaccaaggacugcagucuguuggcaacaggggaugacuucggauuugucaaacuguucuccuauccugugaagggucaacaugccagauuuaaaaaguacguuggccacagcgcucauguaacuaaugugaggugguuacacaacgauucuguccuccugaccguggggggagcagacacggcccuuaugaucuggacacgagaauucguuggcacccaggagagcaagcugguggauuccgaggaaucagacacugaugucgaggaagacgguggguaugauagugacguggcgcgggagaaagcuauugacuacacaaccaagaucuaugccguaagcauucgcgagauggaaggaacuaaaccacaucagcaguugaaggaggucucuguggaagagagacccccgguuuccagggcagccccucaaccagaaaaacuccagaagaacaauaucaccaagaaaaagaaacugguggaggagcuagcucuggaucacgucuuuggcuaccggggcuucgacugucgaaacaaucuucacuaucucaacgauggggccgacauaaucuuucauacagcagcugccggaauugugcagaaucugucaacggguagucagagcuucuacuuggaacacaccgaugacauccugugcuuaacuguuaaccaacaucccaaguacagaaauguggucgcgacaucccagauuggcaccacaccuucuauccacauaugggaugccaugacuaaacacacccucucgaugcugcgcuguuuucauagcaagggggugaacuauauuaauuucucagcaacgggaaagcuucugguauccgugggcguugaccccgagcacacaaucaccgucuggagguggcaggaaggugcuaaaguggccagucgugggggacauuuggagcggaucuuuguggucgaauucagaccagauucugacacucaauucguaagcgugggcguuaagcacaugaaauuuuggacccucgcuggcuccgcacugcuauacaagaaaggggugauuggaucacugggugccgccaagaugcagacaaugcuuucugucgcuuucggcgcgaacaaucucacuuuuaccggggcaauaaacggagauguguauguuuggaaggaccauuuccugaucagguugguggccaaagcucacacaggcccugucuuuacgauguacaccacuuuacgcgacggucugauugugacagggggaaaggagcgacccaccaaagagggcggcgccguaaagcucugggaucaggaaaugaaaagaugccgggcauuccagcuggagacugggcaacuuguggaauguguuaggagcgucugccgcggaaaggguaaaauccuggugggcacaaaggacggggagauuaucgaagugggagagaagaaugccgcuaguaacauauugaucgauggccacauggagggugaaauuugggggcuagcgacccauccauccaaagaccuguuuaucagcgccucuaaugauggaacggcacguauuugggaccucgcugauaagaaacugcuuaacaaggucucauuaggccacgccgcaagaugugccgcuuauuccccggacggcgagaugguugccaucgggaugaaaaacggagaauucgugauacugcucguaaauaguuugaaggugugggguaagaaacgggauaggaagagcgcgauucaggacauccgcaucucgccugauaaccgauuucuggcagucggcucuuccgagcauacuguggacuucuacgaucucacccaggggacaaaucugaacagaauuggauauugcaaagacauccccagcuuuguuauacagauggacuucucagccgauggcaaguacauucaagugaguaccggugcuuacaaacggcagguccacgagguaccacuugggaagcaggugacugaagccguugugaucgagaagauuacaugggcuucuuggaccuccguccugggcgacgaagugaucggaauauggcccaggaaugcagauaaagccgacgucaacugcgcuugugugacacacgccggcuugaauauuguuacuggggaugacuuuggacuagugaagcuguucgauuucccuugcaccgagaaauuugcaaagcauaaacgcuauuucggucacagcgcgcauguaacgaacaucagauuuucauacgacgauaaguauguggucaguacaggcggggacgauuguagcguuuucguguggaggugccucuga

SEQ ID NO: 55771 - RNA, 474 nt, Artificial Sequence
  derived and/or modified sequence opt3 from EMP1__Homo_sapiens__NP_001414
augcuggugcuccuugccggcaucuucgucguucacauugcuaccgugauaaugcuguuuguaagcacaaucgcaaacgugugguuggucuccaauacuguggacgccucuguuggguuauggaagaacugcacgaauauuucauguagugauagccuguccuacgcgucugaggacgcucuaaaaaccgugcaggccuucaugauccucucgauuaucuuuugcgucauagcacugcuuguguucguauuucaacuguucacaauggaaaagggaaacagauuuuucuugucaggugccacuacccucguuuguuggcugugcauccuggugggcgucagcauuuauacaagucauuacgcuaauagggaugggacccaguaucaccauggauacuccuauauccucggcuggauuuguuuuugcuucucuuuuaucauagguguguuauaccuggugcuucggaaaaaguga

SEQ ID NO: 55772 - RNA, 504 nt, Artificial Sequence
  derived and/or modified sequence opt3 from EMP2__Homo_sapiens__XP_006720927
augcuggugcuccuugccuucaucauugcuuuucacauaaccagcgcagcccuguuguucaucgcgacagucgacaacgcuugguggguuggcgaugaguuuuucgccgacguguggagaauuugcacuaauaacacgaauuguaccguaaucaacgauuccuuucaggaauacucuacauuacaagcagugcaggccacuaugauucugucaaccauccuaugcuguauagcuuucuuuaucuucguccuccagcuguuuaggcuuaagcagggggagcgguucgugcugacaaguauuauccaauugaugagcugccucuguguuaugauugcagccuccaucuauaccgaccgccgagaagauauacaugacaaaaaugcuaaguuuuaccccgugacucgugagggaucuuaugguuacucguauauucuggccugggucgcguucgcaugcacauuuaucucaggcaugauguaccugauucucagaaaaaggaaguga

SEQ ID NO: 55773 - RNA, 873 nt, Artificial Sequence
  derived and/or modified sequence opt3 from EMX1__Homo_sapiens__NP_004088
augugccuggccggcuguacccccagaaaggcugcagccccugggaggggagcgcucccacgggcucgccuuccgcgaacagcccccgcagccgcuacuauguuccagccugcagccaaacgugguuuuacgaucgagagccugguggcuaaggacggcgggaccggaggcgguacagggggaggcggcgccgggucccacuuguuagcggcagccgcuucugaggaaccacugagacccacugcccuaaacuacccucauccaucagcagcugaagccgcguucgucaguggauuucccgccgcagcugccgcuggugccggcaggagccucuaugggggaccugagcugguuuucccagaagcaaugaaucacccggcccuuaccgugcaucccgcucaccaacugggcgcguccccuuugcagccaccccauucguuuuucggugcacagcaccgggauccucuccacuuuuacccauggguacugcgcaacagauucuuugggcauagguuccaggccucugacgugccccaagauggacugcucuuacacggcccguuugcucggaaaccuaagcgcauucgaacagccuucucacccagccagcugcuuagauuggagagggcauuugagaaaaaucauuaugucgugggcgccgaacggaagcagcuggcugggagucuaucccucucugagacccagguuaaggugugguuccaaaaccgucgcacuaaauacaagagacagaaacuggaagaggagggaccagaaagcgagcagaagaaaaaggguucccaccacauaaauagguggcggaucgccacaaagcaggcaaacggcgaagacauugaugucaccucaaaugacuga

SEQ ID NO: 55774 - RNA, 510 nt, Artificial Sequence
  derived and/or modified sequence opt3 from EMX2__Homo_sapiens__NP_001159396
auguuccagcccgccccuaagagaugcuuuaccaucgagagccugguggcuaaagacuccccacucccggcaucuaggucagaagaucccauucggccugccgcgcuuaguuacgcuaacagcuccccaauaaaucccuuccugaacggcuuucacucugccgcagccgcugcagccgggcgcggagucuauucgaauccugacuugguuuucgcugaggccgugucacauccacccaacccugcgguaccagugcacccggugcccccuccacaugcauuagccgcucacccccugccuagcagucauuccccacacccccuauuugccucucaacagcgagauccgagcacauucuacccuuggcucauccaccguuauagauaccugggucauagguuucagggcaaguccauggucucagaacccaaaaauaagguucagaaagcagaggcugggggacggcgccuuagauucgccacuaaggaaaagagggacgcgccauauuga

SEQ ID NO: 55775 - RNA, 1179 nt, Artificial Sequence
  derived and/or modified sequence opt3 from EN1__Homo_sapiens__NP_001417
auggaggaacagcaacccgagccuaagagccagagagacuccgcccugggcgcugcagccgcggcuaccccagggggacucucucuuucacugaguccgggugccagcggcuccucugggucgggaucagauggcgacagcgugcccgucaguccucagccagcacccccuuccccacccgccgcuccuugcuugccaccguuagcacaccauccccaccuuccuccacaucccccuccacccccgccucagcaccuagccgcucccgcccaucaaccacagccugcggcacagcuccacaggacaacuaacuucuuuaucgauaauauucugcggcccgacuucgguuguaaaaaggaacagccacccccucaacuucugguugccgcugccgcacgcgggggagcuggcggcgggggacgaguggagcgugauagaggucagacggccgcgggcagggacccaguacacccguuggggacccgggcccccggagcagcuucucuccugugcgccccugaugcuaacuguggcccacccgacgguagccagccugccgcagccggggcuggagcguccaaagcaggcaauccagccgcugccgcagccgcugccgcagcggcuguggccgcagccgcugccgcagcugccgcgaagcccucagauacaggcgggggagguaguggcgggggagccggcagcccgggugcucaggggacuaaauacccugaacauggcaacccagcaauacugcucaugggaucugccaauggcgggcccgucgugaagaccgacucccaacagccuuuaguuuggcccgcuuggguguauugcacacgcuacucagauagaccaagcaguggaccuaggacccggaagcugaaaaagaaaaagaacgagaaagaggacaagcgcccccgaacugccuuuacagcagaacagcuucaaagauugaaggcggaguuccaggccaauagguauaucaccgaacagcggcgucagacgcuggcucaagagcuaucucucaacgagucccagauuaaaaucugguuucagaauaagcgcgccaaaauuaagaaagcaacugguaucaagaacggccuggcucugcaccugauggcccagggguuguacaaucauagcaccacaacuguccaagauaaagacgaaucggaguga

SEQ ID NO: 55776 - RNA, 1002 nt, Artificial Sequence
  derived and/or modified sequence opt3 from EN2__Homo_sapiens__NP_001418
auggaggaaaacgaccccaagccuggcgaggccgcugcagccguggaagggcagagacaaccagagagcuccccgggagguggcucugggggaggcggugggucaagucccggagaagcggauaccggcaggcggcgcgcucugaugcucccugccguccuucaggcaccaggcaaucaccagcauccccaccgaaucacaaacuucuuuauugacaauauacugcguccugaguucgggagaaggaaagaugccggaacuugcugugcuggugcaggcgggggacggggcgguggggccggaggcgagggcggggcuagcggagccgaagguggcgggggagcgggcgguuccgagcaguuguuagggucuggcucgcgcgaaccaagacaaaaucccccuugcgcaccaggagccggcgggccgcugcccgcugccggaucagacagcccuggugauggcgaagggggaaguaagacgcuaucccuccauggcggugcaaagaaagggggcgacccaggaggcccccuggaugggucucuuaaagcuaggggacuggguggcggggacuugagcguuuccucagauagugacagcucucaggccggagcgaaccucggcgcccagccuaugcuguggccagcauggguguacuguacccgguauuccgaucgccccucaagcgguccgcgaaguagaaagccuaagaaaaagaaccccaauaaagaggacaagaggccacggacagcuuuuacugccgagcagcugcaacgucucaaagcugaguuccagaccaaccgcuacuuaacagaacagagaaggcagucucuggcccaagagcuuuccuugaaugaaagccagaucaagauuugguuucagaacaagcgggcaaaaaucaagaaagccaccgggaauaagaacacucuggcuguacaccuaauggcgcaaggccucuauaaucauucgacaaccgcaaaagagggaaagucugauuccgaguga

SEQ ID NO: 55777 - RNA, 1776 nt, Artificial Sequence
  derived and/or modified sequence opt3 from ENAH__Homo_sapiens__NP_001008493
augagcgagcaguccaucugccaagccagagcugcagugauggucuacgacgaugccaacaagaaauggguucccgcgggcgggucuaccggauucucaagggugcacauuuaucaucacacagguaauaacacuuuucggguagugggccgcaagauacaggaccaucaggucgugaucaauugugcuauuccuaaagggcugaaguacaaccaggccacgcaaaccuuccaccaguggcgagaugcacgucagguuuauggacucaauuuuggcaguaaagaagacgccaacguguucgcuagcgcaaugaugcaugcccuugagguccuuaauucccaggaaacagguccaacuuugccgagacaaaacucucaguuacccgcucaggugcagaaugggccuucgcaagaggaacuggagauccagaggcggcagcuacaagagcagcagcgccagaaggaacucgagagagaaaggcuggagcgggagcgcauggaacgagagagacuugaaagggagcggcuggaacgugagcgcuuggagagagaaaggcucgagcaagaacagcuggagcgggaacgacaggagcgcgagagacaggaaaggcuggagcggcaagaacgccucgagagacaggaaagguuagagcgucaggagcggcuggaucgagaaagacaggagaggcaagaacgcgagcggcuugagagauuggaaagggagcgccaggaacgagagcggcaggaacagcuggagcgugagcaacuagaaugggagagagaaaggcgcauuucaagcgccgcggcaccagccaguguagagacaccccucaacuccguucugggagacucuagcgcuuccgaaccuggccuucaggccgcaucacagccagcugagacccccagucaacagggcaucgugcuggggccuuuggccccaccgcccccuccaccccucccuccaggacccgcgcaggccagcgucgcacugccgccucccccagguccucccccacccccuccauuaccgucuaccgggcccccuccacccccuccacccccgccucugccaaaucaggugcccccucccccaccucccccaccggcuccuccccucccagccuccggcuuuuuccuugcuucaaugagcgaggauaaccggccccugacuggauuggccgcagccauagcuggcgcgaagcuaagaaaagugaguaggauggaagacacaucuuuuccuuccggugggaaugcaaucggagucaacagcgccucgucuaagaccgauacgggccgaggcaaugggccacugccccucggagguuccggccugauggaggaaaugucagcucugcuggcccgccggagaaggauugcagagaaagggaguacuaucgaaaccgagcaaaaggaggacaaaggagaagauagcgagccuguuacauccaaggccucuagcacuucaaccccggaaccaacacguaagcccugggagcgcaccaacacgaugaacggcaguaaauccccugugauuagccggagagacucuccaaggaagaaucagaucguauucgauaaccgaucauacgacaguuugcaccggcccaaaagcacuccucucucccagccgucugcuaauggugugcagacagaggggcuggacuaugaucgcuuaaagcaagacauacuggaugaaaugagaaaagagcuaaccaagcucaaagaggaacugauugacgccaucaggcaggaacuuagcaagucgaacacugcauga

SEQ ID NO: 55778 - RNA, 3429 nt, Artificial Sequence
  derived and/or modified sequence opt3 from ENAM__Homo_sapiens__NP_114095
augcuggugcucagaugcaggcuuggcaccagcuuccccaagcuggacaacuuggucccuaaagggaagaugaaaaucuuacugguuuuucuaggacuccuggguaauuccguggccaugccaaugcacaugccgcggaugcccggcuucucuucaaagagugaagaaaugaugcgcuacaaccaguuuaauuucaugaacgggccucauauggcucaccuuggaccauuuuucggcaauggucugccccaacaguuuccucaguaucagaugccaauguggccccaaccuccaccgaacacauggcauccccgaaaaagcuccgcaccuaagcgucacaauaagacugaucagacgcaggagacccagaaaccaaaccaaacacagucuaagaaacccccucagaagagaccauugaaacagcccucgcauaaucaaccgcagccugaagaggaagcccagcccccacaagcguucccucccuuugggaacggacucuucccauaccagcagcccccuuggcagauuccacaaaggcugccgcccccuggcuauggccggccacccauaucaaaugaggaagggggaaacccuuacuuugguuauuucggcuaccacggguuuggaggccgcccacccuauuacagcgaagagauguucgaacaggacuucgagaagccgaaggaggaagauccuccaaaagcugagagucccgguacugaaccuaccgccaauuccacaguaaccgagacuaacucuacacagcccaauccaaaggggagccagggaggcaacgacaccuccccuacgggcaacucaacucccgggcugaauaccggaaacaauccaccggcacaaaacgguaucggcccucuccccgccgugaaugcuagugggcagggaggcccagguagccagauucccuggagaccuucucagccaaacaucagggaaaaucaccccuacccuaacauucggaauuuuccguccgggcgccaaugguauuucacaggcacugucaugggacaucgacagaacagaccauuuuacaggaaucaacaggugcagcggggcccccguuggaacuucuuugcaugggagcgcaaacagguugccagaccugggaauccaguguaucacaaggcuuacccuccuaccucaaggggaaacuauccgaauuacgccgguaaccccgcgaacuuacggcgaaaaccacagggcccuaauaagcaucccgucgggacaaccguggcaccacugggaccuaaacccggcccaguaguucgcaacgagaagauccaaaauccgaaggaaaaaccucuuggucccaaggagcagauaaucgugccaacgaaaaaccccacuagcccuuggagaaauagucagcaguaugaagucaacaagucuaauuacaaauugccacacuccgagggguacaugcccgugccuaacuucaauagcguggaucaacacgaaaacucguauuacccgaggggcgacucucggaaggucccaaauuccgauggacagacacagucacagaaccugcccaagggcauuguucuagggagucgcagaaugccuuaugagagcgagaccaaucaauccgaacucaaacauucuagcuaccagcccgccguguauccagaggaaaucccuucacccgcuaaggagcacuuuccagccggaaggaacacuugggaccaucaggaaauuaguccuccguucaaagaggaucccggucgucaggaggaacaucugccacacccuucccacggcagccgggggucuguauuuuaccccgaguauaauccauacgacccucgagaaaacucacccuaccuuagaggaaacacaugggaugagagggacgauaguccgaauaccaugggccaaaaggagagcccacuguauccuaucaacacgcccgaccagaaagaaauagugccauacaaugaggaagaccccgucgauccuaccggugacgagguguucccggggcagaaccgcuggggcgaagaguuguccuuuaagggaggccccacaguucggcacuaugagggggaacaauacacuucuaaucagccaaaggaguaucucccuuacucgcuggauaaccccagcaaaccuagagaagacuucuauuacuccgaguuuuacccauggucacccgaugaaaauuucccuaguuauaacaccgcaucuacaaugccacccccgauugagagcaggggauacuaugugaauaacgcugccggcccugaggaauccacuuuauucccaucacgcaauagcugggaccaucgaauccaggcgcagggucaacgggagcguagacccuacuuuaacaggaauauuugggaucaggccacccaucugcagaaggcacccgcucgcccacccgaccagaaagggaaccaaccguauuacucuaauaccccugccggacuccagaagaaccccaucuggcacgaaggcgagaaccuuaauuaugguaugcagaucacacggaugaacuccccagaaagagagcacaguagcuucccuaauuuuauucccccaucuuaccccuccggccagaaagaggcucaccuguuccauuugucacaaagggggaguuguugcgccggaagcucgacuggcccuaaggauaacccacuagcacugcaggacuacacgccguccuaugggcucgcccccggagaaaaucaggauacaucuccucuguacaccgacggcagccacacuaagcagacccgagacauaaucucaccaacaaguauucuucccggucaacgcaacuccucugagaaacgggaaagccagaauccuuuuagagaugacgucuccacccugaggcguaacacuccauguucaaucaagaaucaguuggggcaaaaagagauaaugcccuucccugaggcuagcagucuccagucuaagaacacaccgugccugaaaaaugauuuaggaggcgacgguaacaauauucuggaacagguguuugaggauaaccagcuaaaugaacgcacgguagaccucaccccagagcaacugguuaucggcacucccgaugaaggguccaacccugagggaauccagagccaggugcaggagaaugaaucggagcggcaacagcagagacccucaaacauucuucauuugccauguuucggcucuaagcuggcgaaacaccauaguuccacaaccgggacaccuagcucugacggaaggcagagccccuuugauggcgacuccaucacuccaaccgaaaacccgaauacgcucgucgagcuggcaaccgaggagcaauucaagucaauuaacguggauccucuugacgccgaugagcacagucccuuugaguuccugcagcgagguacaaauguccaggaccaagugcaggacugcuugcuccugcaggcuuga

SEQ ID NO: 55779 - RNA, 1770 nt, Artificial Sequence
  derived and/or modified sequence opt3 from ENC1__Homo_sapiens__XP_011541999
augagcguguccguccacgagaauagaaagucuagggccucaaguggcagcaucaauauuuaccuguuccacaaauccucuuaugcugacucgguucucacccaccuuaaccuguugcggcagcaacgcuuauuuacagaugugcugcuacaugcagggaaucgaacuuuccccugccaccgugccguacucgcggcuuguucaagauacuuugaagccauguucagcggaggucugaaggagagucaggacuccgaagugaacuuugauaauucuauacauccugagguccuugaacuguugcucgacuaugcauacagcuccagggugaucauuaacgaggagaaugccgaaucacugcuggaggcuggcgauaugcucgaguuccaggacauccgggaugcaugcgccgaauuuuuagagaaaaaccugcacccaacgaauugucuugggauguugcugcuaagugacgcucaccagugcaccaagcucuaugaacugagcuggcgcaugugucuuucuaacuuccaaacaauuaggaaaaaugaggauuuucugcaguugccgcaggacaugguugugcagcuccuguccucagaagaguuagaaacugaggaugagagacuggucuacgaaagcgccaucaacuggauaaguuaugaccucaagaagcgguacugcuaccuucccgagcuguugcaaaccgugcgccuagcgcugcucccugcaaucuaucugauggaaaauguagccauggaggaacuuauuacaaaacagcgaaagucuaaagagaucguugaggaagcuauuagauguaagcugaaaaucuugcagaacgauggaguggucaccucccucugcgccaggccacggaagacuggccaugcacuguucuuacugggugggcagacauuuaugugugacaagcuauaccucguggaccaaaaagcuaaggagauaauucccaaagccgauaucccuagcccacguaaggaguucucggcgugcgccauuggauguaaaguguauaucaccggcggccgcgggucugaaaauggagucuccaaggacguuuggguguacgauacgcugcacgaagaguggucaaaagcagcucccaugcuuguagccagauuuggucauggcagugcugaguugaagcacugccuguauguggucgggggacacacugccgcaaccggcugccucccugccagcccauccgugucucugaagcagguugaacauuacgacccgacaaucaacaaauggacuaugguggcuccccuuagggagggugucagcaacgcggcagugguaucagccaagcugaaauuguucgcuuucgggggaaccaguguuucccacgauaagcucccuaaagugcaguguuaugaccaaugcgaaaaucgguggacagucccagccaccuguccccagccuuggcgauacacggcagccgcugugcugggcaaccagauuuuuauaaugggcggggauacugaguucagcgccugcucugcauacaaguuuaauucagagacauaucaguggaccaaggucggagacgugacugcgaaacgcaugaguugucaugcuguugccagcgguaacaaguuauacgugguaggcggguauuucggaauccaaagaugcaaaacacuggauuguuacgacccaacccuagaugucuggaacuccauuacgaccgugcccuauucucucaucccgacagcauuuguuucgacuuggaagcaucugccuagcuga

SEQ ID NO: 55780 - RNA, 894 nt, Artificial Sequence
  derived and/or modified sequence opt3 from ENDOG__Homo_sapiens__NP_004426
augagagcccugagggcuggccucacccuugcaagcggggccggacugggugcgguggucgagggcuggcggcgccgacgugaagacgcuagagccgcacccggguuguuaggaaggcugccuguucuaccaguggccgcugcagccgagcucccgcccguaccuggcgguccacgggggcccggagaacuggcuaaguacggccuuccuggccuggcccaguugaaaucccgcgagucuuaugugcucugcuacgauccaagaacaaggggagcgcugugggucguggaacaacugcggcccgagcgccuccgaggggacggugauagaagggagugugacuuccgggaagaugacucaguucacgcauaucaucgugccacuaacgcugauuaccgcggcaguggguuugacagaggacacuuagccgcagcugccaaucauagguggagccagaaggcgauggaugacacguucuaucuguccaacguggccccucaggucccacaccuuaaucagaacgcauggaauaacuuggagaaauacucucggucgcugacccgaucauaucaaaauguguacguaugcacaggcccgcuauuucucccccgcacugaagcugaugguaagagcuacguuaaauaucaggugaucgggaagaaccaugucgccgugccuacccacuucuuuaaggugcugauucuugaggcugccggaggccagauagagcugagaacauacgucaugccaaaugcacccguugacgaagccaucccuuuggagagguuccucgugccaauugaaaguaucgagcgggcuuccggccuguuauuuguacccaacauucuggcgcgcgcagggucucucaaagccaucaccgcuggaagcaaguga

SEQ ID NO: 55781 - RNA, 1233 nt, Artificial Sequence
  derived and/or modified sequence opt3 from ENDOU__Homo_sapiens__NP_001165910
augagagccugcaucagccuggugcucgcuguccuuuguggccuggcaugggccgggaagauugaguccugcgcgucuagguguaacgaaaaauucaaucgggacgcugccugccagugugaucgccgaugcuuguggcacggaaacuguugcgaggacuacgaacauuuauguaccgaggaucacaaggaaucagagccccugccucaacuagaggaagagacagaagaggcacucgccaguaaucuguauagcgcuccaacuuccugccagggucguuguuacgaggcauuugacaaacaucaccagugccauugcaacgccagaugucaggaauuuggcaauugcuguaaggauuuugagucucuuugcucggaccacgaaguuucacacagcagugaugcuauaacgaaagaggaaauccaauccauuucugagaagaucuauagggccgacaccaacaaggcgcagaaagaggauauugugcugaauagccagaacuguaucuccccgucagaaacacggaaucagguagaccgcugccccaagccuuuguucacuuacgugaacgagaaacucuuuaguaagccaaccuaugcagccuucauaaaucugcugaacaauuaccaaagagcuacagggcauggagaacacuuuagcgcccaggagcucgcagaacaggaugcuuucuuaagggagaucaugaaaaccgccgucaugaaggagcuguauucuuuucuucaucaccagaaccgguacggcuccgaacaagaguucguggacgauuugaagaauaugugguuuggucuguacucacgcgggaacgaagagggagacagcaguggcuucgaacacguuuucucuggcgaggugaaaaaggggaaagucacuggauuccauaacuggauucgauucuaucuagaggaaaaggagggucucguggacuacuauucccacaucuacgauggccccugggacagcuauccugauguacuggcgaugcaguuuaauugggacggguacuauaaagaaguuggaucggccuucauugguucuuccccagaguuugaguucgcacuuuacucacuguguuuuaucgcuagacccggcaaggugugccaguugagucucgggggauacccucuggccgucaggacauauaccugggauaaaagcacguacggcaacggcaagaaguauauagcuacugccuacauuguguccucuaccuga

SEQ ID NO: 55782 - RNA, 714 nt, Artificial Sequence
  derived and/or modified sequence opt3 from ENDOV__Homo_sapiens__NP_001158109
auggcccuggaggcugcaggcgggcccccugaagagacccucagccuuuggaagagagaacaggccaggcugaaagcgcacguggucgaccgggauacagaggcuuggcaacgcgacccagccuucuccggauugcagcgaguugguggcguggauguaucuuuugugaagggggacucaguccgugcaugcgccaguuuagugguucugagcuucccggaacuagaggugcuccuggucgauggaaacggcgugcuucaucacagagguuuugggguagcuugucaucugggaguuuugacugaccuccccugcgugggcgucgccaaaaagcugcuccagguggauggccuggagaauaacgcauuacacaaagaaaagaucaggcugcuucagacgcggggcgacuccuucccuuugcugggagauucugguaccgugcuaggcauggcucuccgcucgcaugacagaucaacaaggccacuguacauuagcgucgggcaccggaugagucuugaggccgcgguucgccugacuuguugcuguugccgauuuagaauacccgaaccugugaggcaagcagauaucuguucccgggagcacauucguaagucuuugggacucccagggcccccuaccccacgcagcccgaaagcccagagacccguagcuugcccuaagggugacuccggggagucaagugcccuguguuga

SEQ ID NO: 55783 - RNA, 2232 nt, Artificial Sequence
  derived and/or modified sequence opt3 from ENGASE__Homo_sapiens__NP_001036038
auggaggccgcugcagugaccgucacaagaagcgccacuaggcggcgccgacgucagcugcaaggccucgcggcucccgaagccgggacgcaggaggaacaggaggaccaggaaccuagaccaaggcggcgcagaccgggaagguccaucaaggaugaggaggaagagaccguuuuccgggaagugguaucuuuuucacccgacccucuuccagugcgcuacuaugauaaagacacaacuaagcccauuaguuucuaccugagcuccuuggaggaguuacuggcauggaaaccucgacuagaagaugguuuuaacgucgcccucgagccacuggcuugcagacaacccccucuuucuucgcagaggccacggacccuguugugucacgacaugaugggcggguaucucgaugaccguuucauacagggaucagugguucagacaccguacgcauuuuaucauuggcaaugcaucgauguguucgucuacuuuagccaccauaccgugacuauucccccuguaggcuggacaaauaccgcccaccgccaugguguuugugugcuggggacguucaucacugaauggaacgagggaggcagacugugcgaggcuuuucucgccggcgacgaaaggaguuaucaggcggucgcagaucgguuagugcagauuacccaguucuuucgauucgacggguggcugaucaauauagagaacucccuuucuuuggccgcugugggaaauaugccacccuuucugcgcuaccuaacaacucaacuccacagacaggucccugguggccugguucuuugguacgauagcgugguacaguccgggcaacugaaguggcaggacgaauugaaccagcacaauaggguguucuucgacucaugugauggauuuuucaccaacuauaauuggcgggaggaacaucucgagcgcaugcugggccaggccggugaaagaagggcagacgucuacguggggguugauguguuugcucguggaaacgucgugggcggccgguucgacacagauaaaaguuuagagcugauccgaaagcacggguuuagcguagcccucuucgcgccaggauggguuuaugagugccuugaaaagaaagacuuuuuccaaaaucaggauaaguuuugggguagacuggagagguacuugcccacccauucuauuuguucccuaccguucgugacgucauuuugccugggcaugggggcccgccgggucuguuauggacaggaagaggcagugggcccuugguaccaccucagcgcucaggaaauccaaccccuguucggugagcacagacuugggggcgacggaaggggcuggguccgcacucauugcugucuggaggaugccuggcacgggggaaguucuuugcucgugcgagguguuauuccaccugaagugggcaacguagcuguccggcuguuuuccuuacaggcccccgugccacccaaaaucuaucugagcaugguuuacaagcuagaggggccuacagacgugaccgucgcacucgaacugacuacaggagaugccggcucgugccauauaggugggauuucugugcuuaaugcugagaccuccucacgucacaguuugagaccacugaggguaccgcccacgaaacucgcgcgcugggugggccggugcggaagacagcugagcggcggguggguucagcauuguuacgaggucucccuuaggggaugccuguugcucgaccuguuaguguguuucucucgaccuccagguagccgcgaagaggaaucauuuaccugccggcugggcgagauccaaguggucgacgcagccagucuacucgcuccccugccucagguucaggccgugacaauuucccacaucagauggcagccaagcgcaucugaaagggaggggcccccggcccuuuugcaacugucauguacucuccacuggaguuuccuguuaagccaggugcguugcuuccgcauccauuguuggggaggcauguccgaugacucuccuggucgggagcugccaagacccgaaaugccuauguuucuuggguuggcuuucgccacccaguauaggauuguagaucuccuggucgaggcagcgggccccggacaagaccgacggauggaauuucuaguggagccaguuccuaaggaaggcuuccgcgugccccaggcugagugggggagagccguccugcucuacucggcaccagccuga

SEQ ID NO: 55784 - RNA, 1878 nt, Artificial Sequence
  derived and/or modified sequence opt3 from ENG__Homo_sapiens__NP_000109
auggacagaggcacccugccccucgccguggcucugcuguuggcaagcugcuccuuaucuccuacaucacuggccgagacuguccacugugaucuacagccaguugggccggaaaggggagaggugacguacaccacaagucaaguaagcaaggguugcguggcgcaggcucccaacgccauccucgaaguccaugugcuguuccuugaguuuccuacuggcccaucccagcuggaauugacccuccaggcaucuaaacaaaaugggacauggccccgggagguucugcuggugcucucggucaacucaagcguguucuuacaccuucaggcccuuggcauuccuuugcaucuggcuuauaauaguucccuaguaaccuuucaggagccacccggaguuaacacuacagaacucccuucuuucccaaagacccagauacuggagugggcagccgaacgcgguccgaucacgagcgcugccgagcuuaaugacccccaauccauucuguugcgacucgggcaggcgcagggaucacugaguuuuuguauguuagaggcaagccaggauaugggccguacucuggaauggagaccuaggaccccagcccucgugcggggcugccaccuugagggggucgcuggacauaaagaagcccacauccugcgcguguugcccggucacucugcaggcccuagaacagugacugucaagguugagcuauccugugcuccaggggaccuggaugccgugcucauucugcaaggacccccguacguaucauggcuuaucgacgcgaaccauaauaugcagauauggaccacaggcgaauauagcuucaaaaucuuuccugagaagaacauuagggguuucaagcugcccgauaccccacagggguugcucggagaggcccggaugcugaaugcaaguaucguggcuucuuuugucgaauuaccucuggccuccauugugagccuacacgcuucgucuugcggcggccgccuccaaacgucccccgccccaauccagacuacacccccuaaagacaccuguucaccagagcugcuuaugaguuugauacagacuaagugcgcagaugacgccaugacacugguucucaaaaaggaacugguggcucaucuuaaauguaccauuacggggcugaccuucugggauccgagcugcgaggcggaagaccgaggagauaaguuugucuugagauccgcauacucuagcugugguaugcaagugucagccaguaugaucuccaacgaggcuguaguuaauauucucucuagcucaaguccccaaaggaagaaagugcacugccugaacauggacagcuuauccuuccagcugggccuauaucucucuccucacuuucugcaggccucgaauacaaucgagccagggcagcagagcuucguccaggugcgggucucccccucagugagugaguuccuuuugcagcuggacucuugccaucucgaucugggaccugaaggcgguacuguugaauuaauccaggggcgugcagccaagggcaacugugugagccugcuuuccccaucacccgagggagacccgcgcuuuagcuucuugcuccacuuuuacaccguaccuauuccaaaaacaggcacucugucuugcaccgucgcucuaagacccaagacagggucccaagaucaggaagugcauaggaccguuuucaugcggcugaauauaaucaguccugaccucagcggauguacuucuaaaggucuggugcuucccgccgucuugggcauuacguuuggggcauuccugaucggagcguuacucacagcugcccugugguauauauacucccacacccgagaguacccacgcccuccccaguga

SEQ ID NO: 55785 - RNA, 231 nt, Artificial Sequence
  derived and/or modified sequence opt3 from ENHO__Homo_sapiens__NP_940975
augggcgccgccaucagccagggggcacugauugccauagugugcaacggacucgucgguuuccuucuguuguuacuguggguuauccuauguugggcgugccacuccagaucugcugacguggauucacucagugagagcucccccaauucuucgccuggcccauguccggaaaaggcucccccuccacaaaaacccucacaugaggggagcuaccugcuucagccuuga

SEQ ID NO: 55786 - RNA, 1305 nt, Artificial Sequence
  derived and/or modified sequence opt3 from ENO2__Homo_sapiens__NP_001966
augagcaucgagaagauuugggccagagaaauacuggacuccaggggcaaccccaccguggaggucgaucucuacacagcuaaagggcuuuuccgggcagccguuccuucuggagcgucaacugguaucuaugaagcucuggaguugcgcgacggcgauaagcagcgauacuuagggaaaggagugcugaaggccguagaccacauuaauaguacgaucgcaccagcccuaauuagcuccggccucucuguggucgaacaagagaaacuggauaaccuuaugcuggaguuggacgguaccgaaaauaagucgaaguuuggggcuaacgcaauccucggagugucacuggccguuugcaaagcuggcgccgcggagcgugaacugccgcucuauagacauauagcacaguuagccggcaauagcgaucugauccuucccgugccugcuuucaacgucauuaaugggggaagucacgccgguaacaaguuggcaaugcaggaguuuaugauccugccagugggcgcugaguccuucagggacgccaugcggcuaggggcggaaguauaccauacacucaaaggaguuauuaaggauaaauauggcaaggacgccacuaaugugggugaugaagggggauuugcacccaacauccuggaaaauucugaggcucuugaacuggucaaggaggccauagacaaagcuggcuacaccgagaagauugugaucggcauggauguggccgcaagcgaguucuaucgcgacgggaaauacgacuuggauuuuaaguccccuacagacccaucaagauacauuaccggagaucagcucggugcccuguaucaagacuucgucagggauuaccccguugugaguaucgaggacccuuuugaucaggacgauugggcugcguggagcaaauucacugcaaacguaggcauccagauugugggggacgauuuaacagucaccaauccaaagcggauagaacgcgccguggaggaaaaggcuuguaacugccugcuccuuaaaguuaaucagaucggaucugugacggaggccauucaagcauguaagcuggcccaggagaacggcuggggugucauggugucccaccgaucaggggaaacugaggacaccuuuaucgcugacuugguaguuggccuaugcacaggacagauaaaaacuggcgccccguguagaagcgaaaggcuggcaaaguauaaccagcucaugcggauugaggaggaacugggggaugaggcgcguuucgcuggacauaauuuucgcaaccccagugugcuuuga

SEQ ID NO: 55787 - RNA, 1176 nt, Artificial Sequence
  derived and/or modified sequence opt3 from ENO3__Homo_sapiens__NP_001180432
auggccaugcagaagaucuucgcuagagagauucuggacagcaggggcaaccccaccguggaagucgaucuccacacagcaaaagggcgguuucgcgccgcgguuccuuccggagcuucuacugguauauacgaggcccuugaacugcgagacggcgauaaggggcguuauuugggaaaagcaaaguucggcgccaaugcuaucuuaggugugucacuggcaguaugcaaagccggggcugccgagaagggagugccacuauacagacauauugcggaccucgcaggcaacccggaucugauccuucccgucccugccuuuaaugugauuaacggcgggagucacgcuggaaauaagcuggccaugcaagaguucaugaucuugccaguuggugcaagcuccuuuaaagaagcuaugaggauaggcgccgagguguaucaucaccucaagggggucaucaaagcgaaguacggaaaagacgccacgaacgugggcgaugaagguggguucgcacccaauauucuggagaacaaugaagcucuggagcucuuaaagaccgccauccaggcugccggauauccugacaagguaguuauuggcauggauguggcagccucugaguuuuaccggaacggcaaauaugaccuggauuucaagucgccagacgaucccgcucgccauaucacaggggaaaaacuuggagaguuguacaagucauuuauuaaaaauuacccugucgugagcauagaagacccauucgaccaggaugacugggcgacuuggaccaguuuucuguccggugugaacauccagauugucggcgaugaccuaacaguuaccaauccgaagagaaucgcacaagccguggagaaaaaggcuuguaacugccuccugcuuaagguaaaucagaucgggucugugacugaaagcauucaggccuguaaacuggcacaguccaacggauggggcgucauggugucacacaggaguggugagacagaggauaccuucauagccgacuugguuguggggcucugcacgggccaaaucaagacuggagcucccugucggagcgaacgccuggccaaauauaaccaguuaaugcgaauugaggaagcacugggcgauaaggcgaucuuugcugggagaaaauucaggaauccuaaggccaaguga

SEQ ID NO: 55788 - RNA, 1878 nt, Artificial Sequence
  derived and/or modified sequence opt3 from ENO4__Homo_sapiens__NP_001229628
auggaggaagagggcgggggaagaagcugcgguaccacaagggaacugcagaagcucaaacaacaggccauggaguacuaucgggaaaacgacgugccccgccgacuugaggagcuguugaauagcacuuucuacuuacagccugcugaugucuauggccaccuggcaaacuguuuuucuaagcuagccaaaccaccgacgaucugcaagauuguugggaaagacgugcucgauggacugggccuucccacccugcagguagacauauucuguacaauccaaaauuuuccuaagaacgugugcucagucgugauuaguacucauuucgaaguucacgagaaugcguugccagaacucgcuaaggccgaggaggcagaacgugccagcgcuguguccaccgcaguccagugggugaacucuacaaucacccaugagcugcaggguauggcccccucggaucaggcugaaguagaccaucugcucagaaucuuuuucgccucaaaaguucaagaggauaaggggaggaaagaauuagaaaagagccuggaguacaguacugugccuacaccacuucccccugucccaccgcccccuccacccccuccacccaccaaaaagaagggacagaaaccgggccggaaggacacgauuacugaaaaaccuauagcgcccgcagagccaguggaaccuguguuguccggcucuauggccaucggggcugucagccuggccguugcaaaggcuugugccaugcuacucaauaaaccccuguaucuuaacauugcgcuguugaagcacaaucaggagcagccaaccacacucuccaugccccuguuaauggugucacugguaaguugcggaaaauccucuuccgguaagcucaaccuuaugaaggaagugaucuguauuccucacccagagcugacuaccaaacaaggcgucgagauguugauggaaaugcagaagcacaucaauaaaauaauugagaugccgucacccccuaaggccgaaacuaaaaaggggcaugauggaagcaagcgcggccagcaacagaucaccgguaaaaugagucaccuagggugccugacgauuaacugugacucuaucgagcagccacuccugcuuauccaggaaauuugcgcaaaucugggauuggagcucggcacuaaccugcauuuagcuauaaauugugccggccacgagcugauggauuacaacaaggggaaauaugaagugaucaugggaacauacaagaacgcugccgagaugguugaccuauacguggaucucauuaauaaauaucccuccaucauagcacugauugacccuuuuagaaaggaagacagcgagcaaugggauucgaucuaccacgcccuugguucuaggugcuauaucauugcuggcaccgcguccaagucaaucaguaaauugcuggagcaggggaacauuagcauaccaaaguccaauggacucaucauuaaacauacuaaccagacaaccaugucugaccuggucgaaaucacgaaucuuaucgauagcaagaaacacauuaccguguucggcucaacagagggugaaaguuccgacgauagccugguagacuuggcaguugggcucggcgugcgguuuauaaagcugggaggcuuaucucgcggggagcgagucacuaaguacaacagacugcuaaccaucgaagaggagcucgugcagaauggaacacuggguuucaaagaggagcauacauuuuucuauuuuaacgaagaggccgaaaaggcugccgaggcacuugaggccgcugccgcaagggaacccuuggucccgaccuucccuacacaaggcguggaggaaucagcggagaccggggcuaguagcggauga

SEQ ID NO: 55789 - RNA, 786 nt, Artificial Sequence
  derived and/or modified sequence opt3 from ENOPH1__Homo_sapiens__NP_067027
auggugguccugagcguucccgccgaggugaccguaauccuccuugacauugaaggcacaacuacgccuauagcuuucgugaaggauauccuguuuccauacauugaggaaaacgucaaagaguauuugcagacccacugggaagaggaggaaugccaacaggacguguccuuacugagaaagcaggcagaggaagaugcccaucuagacggggcgguuccgauccccgcugccucuggaaaugguguggaugaccuccagcaaaugauucaggcagucguggauaacguauguuggcagaugucacuggacaggaaaacaacugcccuuaagcagcugcaaggccacauguggcgggcugcauucaccgccgggcgcaugaaagcugaguuuuucgccgauguugugccugcgguccgaaaguggcgugaggcaggaaugaagguguacaucuauaguagcggcuccguggaagcccagaaauugcucuuuggucauucuacagagggggacauacuggaacuggucgauggacacuucgacaccaagaucggccauaaaguugagucggaaucauacagaaagauugcugauagcaucggcugcaguacuaauaacauucucuuuuuaacagacgugaccagggaggccuccgcagcugaggaagccgacguacacguggcggucgugguucggccagggaaugccggacugacggaugacgagaaaacuuauuacucucuuaucaccagcuucuccgaauuguaucugcccucaaguacauga

SEQ ID NO: 55790 - RNA, 1086 nt, Artificial Sequence
  derived and/or modified sequence opt3 from ENOSF1__Homo_sapiens__NP_001119595
augcagaagauggagagcagaggcguggaacugcccucccucugggagaaagcccuuaagcugaucgggccugaaaaaggagucguucacuuggcuaccgcagccguguuaaacgcgguaugggaccugugggcuaagcaagaggguaaaccaguguggaagcuacucgucgauauggacccgaggaugcuggugucuugcauugauuuccgguacauaacagacguucuuacugaagaggaugcccuggagaucuugcagaagggccagauugggaaaaaggaacgcgagaaacagaugcucgcacaaggauaucccgccuacacgaccucaugugcuuggcugggcuauagugacgauacacugaagcagcucugcgcacaggccuuaaaagacgguuggacucgauuuaaggugaaggucggggcugaucugcaggacgauaugcguagaugucaaaucauuagggacaugaucggaccugagaaaacccuuaugauggaugccaaucagcggugggacgugccagaggcgguagaguggaugagcaaguuggcaaaauucaagccccuguggauagaagaaccuacauccccagacgauauccuaggccaugccaccauuucuaaagcucucguuccccugggcaucgggauugccacuggagaacagugccacaaccgcgugaucuuuaagcagcuucugcaagcaaaggcuuugcaguuccuccagauagacucguguagacuggguucagucaaugagaacuuaagcgugcugcucauggccaaaaaguuugaaauuccugugugcccacaugcgggcggggucggacuuugugagcugguucaacacuugaucauuuucgauuacaucaguguguccgccucucuagagaauaggguaugcgaauauguggaccaucugcacgagcacuuuaaauacccggucaugauccagcgggcaagcuauaugcccccuaaggauccaggcuacuccacagaaaugaaagaggaaucagugaagaaacaucaguaccccgacggugagguuuggaagaagcuccugccugcucaggagaacuga

SEQ ID NO: 55791 - RNA, 1932 nt, Artificial Sequence
  derived and/or modified sequence opt3 from ENOX1__Homo_sapiens__NP_001121087
augguggacgccggcggggucgagaacaucacccagcugccccaagaacucccucagaugauggcugcagccgcggauggacuugguagcauugcuauagacacaacucagcugaauauguccguuacggauccaaccgccugggcaacagccaugaacaauuugggcauggugccgguaggguuacccggacagcaacuggugucugacucaaucugcgucccuggcuucgauccaagucuaaacaugaugacugguauuacccccaucaauccuaugauuccagggcucggacuggugcccccuccaccgcccacagagguugcuguggucaaggaaaucauacacuguaaaagcugcacccuuuuuccucagaacccaaaucugcccccuccauccacuagagagaggcccccgggcuguaagacaguguucguaggcggguugccugaaaacgcaaccgaggagaucauucaggaaguuuuugagcagugcggagacaucacggccauucggaaaucuaagaaaaauuucugucauauccgcuuugcugaagaguucaugguggauaaggccauauaccucucggguuaucgaaugcgucugggcucaagcacugacaagaaagauagugggagacugcacgucgacuuugcgcaagcaagggaugacuucuacgagugggaaugcaagcagcggaugcgcgccagagaggaaaggcaucggcgcaaacucgaggaagaucgauuaagacccccauccccucccgcuauuaugcacuauucugagcaugaggccgcacugcuugcugaaaaguugaaagacgacagcaaguuuuccgaggccaucaccgugcugcuaucauggauugaaaggggagaggugaaccggcguagugcgaaucaguucuacagcaugguccagucugccaacucccacguucgcagacucaugaaugaaaaggcaacacacgagcaagagauggaagaggcuaaagaaaacuuuaagaaugcccugacuggcauccuuacccaguucgagcagaucguggcuguauuuaacgccucaacaaggcaaaaagcaugggaucauuucagcaaggcccagcggaaaaacauugacauauggcgaaagcacagugaagaacugcgcaaugcucagucugagcaguugauggguaucagaagggaagaggaaauggagauguccgaugacgagaacugugauagcccaaccaaaaagaugcggguggacgaaucggcgcucgcagcccaggcuuaugcccugaaggaggaaaaugauucuuuacgcuggcaacuggacgcauacagaaacgaggucgaacuccuuaaacaggagaaggagcagcuguucaggacggaagagaauuugacuaaagaucaacagcuacaguuucugcagcaaacaaugcaggggaugcagcagcaacuccugaccauucaggaggagcuuaacaauaagaaauccgaacuggagcaggccaaggaggaacaaucacauacucaggcuuugcucaaggugcugcaggagcaguuaaaaggaacaaaggaacugguugagaccaacggccacagucacgaagacagcaaugagaucaacgugcuaacggucgcccucgugaaucaagaucgugagaacaauauagaaaaacggucccagggccugaagucugagaaagaagcacuuuugauugggaucaucagcaccuuccugcauguacaccccuuuggagcgaacauugaguaucucuggucauacaugcagcagcuggacaguaagaucuccgcuaaugagauugaaaugcuucugaugcgauugccuagaauguucaagcaagaguuuacagguguuggcgccacucucgagaaaagguggaagcugugcgcauucgaagggauaaaaaccacauga

SEQ ID NO: 55792 - RNA, 2022 nt, Artificial Sequence
  derived and/or modified sequence opt3 from ENOX2__Homo_sapiens__XP_011529546
augcugcacaucaaccagcuccuucugugcaauggcaccgccagcgcugcaacaaacaaggacgagacuaauuguaacuucuugauuuccucuggguuaaaucaacugcccuuugauccugccaacaauaacgaaccacuacaguucggaucagcgagugguccgcucgugacggagggccugauagaaaaugggggagagagcuccaaaaagagaaaaaggaccaacacacccucugcugacaauucgcggacucuuaacgucgauucaaccgccaugacacugccuaugagcgacccaaccgcaugggccacugcuaugaauaacuugggcauggcaccccucgguaucgccgggcagccuauucugccagauuuugaccccgcucugggaaugaugacaggcaucccuccaauuaccccgaugaugcccggccucgggaucguuccuccacccauaccuccagauaugcccgugguaaaggaaaucauucauugcaaaaguuguacguuauucccgccuaaucccaaccugccaccucccgccacucgcgagcgaccacccggaugcaagaccguguuugucgguggccuuccugagaacgggacagaacagaucauuguggagguuuucgaacaauguggagagaucauagcgauucguaaguccaaaaagaauuuuugccacaucagauucgcagaggaauacaugguggacaaagccuuguaucugucuggcuacaggauucggcuagguagcuccacugauaagaaagacaccgggcgccuccaugucgauuuugcucaggccagagacgaucuguaugagugggaauguaagcagaggaugcuugcacgggaggaacgccaccgaagaaggauggaggaggaacggcugcguccaccgucacccccuccagugguacauuacagugaccacgagugcagcaucguugcugaaaaguugaaagacgauucuaaguucuccgaggccgugcagacacuccugaccuggaucgaacgcggagaggucaacagaaggucagcgaauaacuuuuauagcaugauucaaagugccaauucucacgugcggcgauuagugaacgagaaagcagcucaugaaaaggacauggaggaagccaaagagaaguucaaacaggcucuguccggcauacucauccaguuugaacagauugucgccguuuaccacagcgcaucgaagcaaaaggccugggaucauuucacgaaagcucagcgcaagaauaucucugugugguguaaacaggcggaggagauaagaaacauucacaaugacgaacuuaugggcaucaggcgggaggaagagauggagauguccgaugacgaaaucgaggaaaugacugagacaaaggaaaccgaggagucagcacugguaagucaagccgaggcuuugaaagaagaaaacgauagccuacgcuggcagcuggacgccuauagaaaugagguggaacuccugaagcaggagcaggggaagguccacagggaggaugaccccaacaaagaacaacagcuuaagcuguugcagcaggcacuccaaggaaugcagcagcaucuguuaaaagugcaggaggaauacaagaaaaaggaggccgaacuggagaagcuaaaagaugacaagcuccaaguugagaaaaugcuggaaaaucuuaaggagaaagaauccugcgcuucucguuugugugccagcaaccaggacucagaguacccucuggagaagacuaugaauaguuccccaauuaagagcgaacgggaggcacuccugguggguaucauuucuacauuccuucacguccaucccuuuggcgcgucaauagaauauaucugcaguuaccugcaccgauuggauaacaaaauuugcaccagcgacguggagugucucauggggagacugcagcauacguucaagcaggaaaugaccggaguaggcgcuuccuuagagaaaagguggaaguuuugcgguuucgaggggcugaaacuaacauga

SEQ ID NO: 55793 - RNA, 2874 nt, Artificial Sequence
  derived and/or modified sequence opt3 from ENPEP__Homo_sapiens__NP_001968
augaacuucgccgagagagaaggcagcaagagguacugcauccagaccaaacacguggcuauucugugugcagucguuguggggguaggacucauagugggucuugccgucggccugacacgguccugcgacucuucaggggauggaggccccgguacugcgccugcuccaagucauuugccgagcuccacggccucucccucggggccuccagcacaagaccaggauaucugucccgccucagaggacgaaagcggacaguggaagaauuuucgcuuaccugauuucgugaacccaguucacuaugaccugcaugugaaaccccuacucgaggaagauaccuacacaggcacugucaguauuuccaucaaucugucugcuccuacccgauaucuuuggcugcacuugcgugagacaagaauuaccaggcucccagagcugaagcggccgagcggcgaccaggugcaaguacgcagaugcuuugaauacaaaaagcaggaguauguuguggucgaagcagaggaggaacugacucccuccucaggggauggacucuacuuacugacaauggaguucgccgguuggcuuaacggcaguuuggugggguuuuauaggaccacguacacugaaaauggacaggugaagucuaucgucgcuaccgaccaugagccuacagaugcccggaaaucuuucccauguuuugacgaacccaacaagaaagcgacuuacaccauauccaucacacacccuaaggaguauggcgcacugucaaauaugccaguugccaaagaggaaagcguggaugacaaguggacccgcacgacuuucgagaagaguguacccaugucuacauaccuagugugcuuugcuguccaccaguucgacuccgugaaacgaauuagcaacucggguaagccgcucaccaucuauguucaaccugaacagaaacauacugccgaguacgcagcuaauauuacaaagucuguguuugauuauuucgaagaguacuuugccaugaacuauucccugcccaaacuugacaagaucgcgauaccagauuucgggaccggagccauggagaauuggggccugauuacguacagagaaaccaacuugcucuacgacccuaaagagucagcaaguagcaaucagcagagggucgcuacagugguagcccacgaacugguucaucaaugguucggcaacaucgugacuauggauuggugggaggacuuauggcugaaugaaggguuugcuuccuucuuugaguuccucggagucaaccacgccgagaccgauuggcagaugcgggaccagaugcuucuggaagauguguugcccguccaagaggacgauucucuaaugagcucacacccaauuaucgugacaguuacuacccccgacgaaaucacaaguguguuugacgguauuuccuauagcaaggggucuucaauacugcguaugcucgaggauuggaucaagccugagaacuuccagaaaggcugucagauguaccuggaaaaguaucaguuuaaaaaugcaaagaccagugacuucugggccgcucuugaggaagcgagccgccugccaguaaaagaggucauggauacuuggacgagacaaaugggauacccgguguugaacguuaauggcgugaagaacauuacacagaagagguuucuccuggacccccgggcaaauccuucccagccacccucugauuuagguuauaccuggaacaucccugucaaauggacugaagacaauauaaccucgagcgugcuguucaaccgauccgagaaggaggggauuacacuaaauucaaguaacccaucuggcaaugccuuucucaaaaucaaccccgaucauaucggauucuaccgcguaaauuaugaaguggcuaccugggacagcauugccacugcacugucccuuaaccacaagacauuuucaagcgccgauagagcuucuuugaucgacgaugccuucgcacuggcgagggcucagcuccuggacuacaaaguugcccuuaaucugacgaaguacuugaagcgggaggaaaacuuccucccguggcaacgcgucauuuccgcagugaccuauauaaucaguauguuugaggaugacaaagaacuguacccuaugauugaggaguauuuccagggccaggugaagccaaucgccgacagcuuaggguggaacgaugcuggagaccaugucacuaaacugcuaagaucuuccguucucgguuuugccugcaagaugggcgauagggaagcacugaauaacgcuucaagucuuuucgagcagugguugaaugggacagugagccugcccgugaaccuccgucuguuaguauaccgguauggaaugcaaaauucgggcaacgaaaucuccuggaauuacacccuggagcaguaucagaaaacaucucuugcccaggaaaaggagaaguugcucuacggucuggcgagcgucaaaaacgugacucuacugucacgauaccucgaccugcuuaaggauaccaauuugauuaaaacgcaagacguuuuuaccgugauaagauauaucaguuacaacuccuaugggaagaauauggccuggaacuggauucagcugaauugggauuacuuagucaacagguauacacucaauaaccgcaaccugggccggaucgugacuauugcugagccuuucaauaccgaacuucagcuguggcaaauggagagcuuuuucgcaaaauacccccaggccggagcuggcgaaaagccaagagagcagguuuuggagacagugaaaaacaauaucgaauggcucaagcagcacaggaacacuauacgcgagugguuuuucaaucugcuagaaagcggguga

SEQ ID NO: 55794 - RNA, 2778 nt, Artificial Sequence
  derived and/or modified sequence opt3 from ENPP1__Homo_sapiens__NP_006199
auggagagagacggcugcgccgggggagguagcaggggcggggaaggaggccgggcuccccgcgaggguccugcagggaacggacgagaucguggcagaucccacgccgcggaagcuccaggcgacccgcaggccgcagccucucugcucgcucccauggaugugggggaggaaccucuugagaaggcagccagggcucggaccgccaaagacccaaauacauacaagguccugucauugguuuuaaguguguguguacugacuacgauccuaggaugcauuuucggucucaaacccagcugugcgaaggaggugaaauccugcaagggccgcuguuuugaaagaaccuucgggaacugccgaugugaugcagccugcgucgagcugggaaauuguugccuugacuaucaagaaacauguauagagccugagcauaucuggacuugcaacaaguuucggugcggcgaaaaacgccugacccgaucuuugugugcuugcucggaugacuguaaggauaaaggugacugcuguauuaauuacucaagcgugugccagggggagaagaguuggguugaagaaccaugugaauccaucaacgagccccagugcccugccggauucgagacaccaccgacccuccuguuuucucuggauggcuucagagcagaauaucuccacacuuggggcggguuacugcccgugauuagcaaacuuaagaaguguggaacauacaccaaaaauaugaggccugucuauccaacgaagacuuuucccaaccauuacuccaucgugaccgguuuguauccugagucacacggcauaaucgacaauaaaauguacgauccaaagaugaacgcuaguuucagccugaaaucuaaggaaaaauuuaaucccgagugguacaagggggaaccgauuuggguaacagccaaguaucagggacuaaaauccggcacuuucuuuuggccugguucagacguugagaucaacgggauuuuccccgacaucuacaagauguauaauggcagcgugccauuugaggaacggauacucgcgguccugcaauggcuucagcugccuaaagaugagcguccccauuucuacaccuuguaucucgaggagccagacaguucuggacacuccuacggccccgugagcucggaagugauuaaggcccugcagcgcgucgaugggaugguuggaauguuaauggacggucugaaagagcucaaccuucacagaugccugaauuugauccuaauuucugaucauggcauggagcagggguccuguaagaaguauaucuaccugaacaaauaccucggagacgugaagaacaucaaaguaauuuauggcccugcagcuaggcugcggccaucagaugugccggacaaguacuauaguuucaauuacgaagguauagcccgaaaccuuagcugccgcgagcccaaucaacacuuuaaaccuuaucugaagcauuucuugccaaagagacuccacuuugcuaaauccgauaggaucgaaccccugacauucuacuuagacccucaguggcagcuggcccuaaacccaucugagcggaaguauugcgggagcggcuuucacggaucagauaaugucuucaguaacaugcaggcacucuuugugggcuacgggcccggauucaaacaugguauugaggccgacaccuuugaaaauaucgagguuuacaaccugaugugugaccuuuugaaucugacgccggcuccuaacaauggcacucacgggucccucaaccaucugcuuaagaauccaguguauacacccaaacacccuaaggaaguccauccccuggugcaaugcccauucacccgcaacccuagagauaauuugggauguagcugcaaccccucuauacucccaauugaggacuuucagacucaguucaaccugacaguagcggaagagaagaucaucaaacacgagaccuuaccguacggcaggccucguguucugcaaaaggaaaauacgauuugucuacucucacagcaccaguuuaugagugguuauagccaggauauccugaugccccuuuggaccuccuacacaguggaccggaacgauucuuucucgacugaggacuucagcaauugcuuguaucaagauuuuaggauuccacugucccccguccauaaauguucauucuacaagaacaauaccaaagugaguuauggguuucucucuccuccacagcugaacaagaauagcuccggcauauacucagaagcauuacugacaacuaacaucguccccauguaccagagcuuccaggugauuuggagauauuuucacgacacccuuuugaggaaauacgccgaggaacgcaauggaguuaacgugguaucuggcccugucuucgauuuugacuaugaugggcggugcgacucccucgagaaucugagacaaaagaggcgcgugauccgaaaccaggagauccuaauuccgacacauuucuuuauaguucugaccaguuguaaggauacuagccagacgccacuccacugcgaaaaucuggacacacuugcuuucaucuugccccaccggaccgacaacucugaguccugugugcauggaaaacacgauucaaguugggucgaggaacuguuaaugcuccaucgugccagaauuacugacguggaacacaucaccggccugagcuuuuaccagcaaaggaaggagccuguaucggauauucuuaaacugaagacacauuugccaaccuucucccaggaggacuga

SEQ ID NO: 55795 - RNA, 2592 nt, Artificial Sequence
  derived and/or modified sequence opt3 from ENPP2__Homo_sapiens__NP_001035181
auggccagaaggagcuccuuccagucuugccaaaucauuucacuguuuaccuucgcugugggcgucaacauaugucucggguuuacagcacaccggaucaagcgcgccgagggaugggaagagggucccccuacuguucuuagugauagcccauggacgaauauuuccggcucuugcaaagggcgauguuucgaacugcaggaggcgggaccgcccgauugccguugugacaacuugugcaagucguacaccucauguugccaugauuuugacgaauuaugucugaaaacagcuagaggcugggagugcacuaaggauagguguggugaggugcggaaugaagagaacgccugccacugcagcgaagacugucuagcacgcggggauugcuguaccaauuaucagguagugugcaaaggagagagucauugggucgacgaugacugugaggaaaucaaggccgcugagugcccugcaggcuucgugagaccaccccucauuaucuuuuccguugauggcuucagggccucuuacaugaagaaagggagcaaggugaugccuaacauagaaaaacugcgguccuguggaacacacucaccauauaugcgccccgucuacccuaccaagacuuuuccaaaucuuuauacacuggcuaccgguuuguacccggagagucauggcaucguggggaacagcauguaugaccccguauucgaugccacguuucaccuccgaggaagagaaaaauucaaucacaggugguggggcggucagccucuguggauuacugcgaccaagcaagggguuaaggcaggaacauuuuucuggucuguggucaucccacaugagcggcguauucugacuauccuccagugguuaacccugcccgaccacgagcgcccuuccguguacgccuucuacucagaacagccagacuuuagcggccauaaauauggccccuucgggccggagaugacaaacccucuuagagaaauagauaagauugugggacaguugauggacggucugaaacaacuaaagcuccacaggugcgucaauguuaucuuugugggcgaucacgggauggaggacguaaccugugaucggacggaauuucugaguaacuaccuuacuaauguggacgauauuacacugguccccggaaccuugggccgaauccgcucuaaauuuuccaacaaugcuaaguaugacccaaaagccaucauugcaaaccucacuugcaagaagccugaucagcauuucaaacccuaccugaagcagcacuuaccaaaaagacugcauuaugcuaacaauaggcggauagaggacauccaccuccuuguggagcgcagauggcauguugccaggaagccccuggauguguacaaaaagccuagcgguaaguguuucuuccagggggaccacggcuuugacaacaaagucaauucgaugcaaacaguguucguaggauauggcucuaccuuuaaguacaaaacgaagguuccaccguucgaaaacauugaguuguacaaugugaugugcgaucuacuggggcucaaacccgcgccuaacaauggaacccacgguucccugaaccaucuucugcguacaaauacuuuucggccaaccaugcccgaagaggucacacgaccuaacuauccaggcaucauguacuugcagucagacuucgaucucgggugcacuugugacgauaagguggaacccaagaauaaacuggacgaguuaaacaagagacugcacaccaaaggaaguacagaggaaaggcaucuacucuauggccgcccggccguccuguaccggaccagauaugauauacuuuaccacacugacuucgagagcgguuauuccgaaauuuucuugaugccucuguggacgucuuacacagugagcaagcaggcagagguuucaagugugccagaucaccucaccuccugcguaaggcccgacguccgcgugagcccuucuuucucacaaaauugucuggcuuacaaaaacgauaagcagaugaguuauggguuucuuuuucccccauaccugagcuccucuccugaggccaaguaugacgccuuuuugguuacuaauauggugcccauguacccagcuuucaaacgagucuggaacuauuuucagcgggugcucguaaagaaauacgcaucggaacguaacggcgugaauguuaucagcggaccgaucuucgauuaugacuacgacggccugcaugauaccgaggacaagauuaaacaguacgucgaaggguccucaaucccugugcccacacacuauuacaguauuauaaccucuugcuuagauuuuacucaaccagccgacaagugugauggaccccugagcguguccucauucauccuaccucauagaccagacaacgaggaaagcugcaauucuuccgaggaugagaguaaaugggucgaggaacucaugaagaugcacacagcuaggguucgcgacauugaacaucugacgagccuugacuuuuuccggaagaccucuagauccuaucccgagaucuugacucugaaaacauaccuccacaccuaugaaucagagaucuga

SEQ ID NO: 55796 - RNA, 2628 nt, Artificial Sequence
  derived and/or modified sequence opt3 from ENPP3__Homo_sapiens__NP_005012
auggagagcacccugacacucgccacugaacagcccgugaagaaaaacacgcuuaagaaauacaagaucgcuugcauuguccuguuggcauuacugguuauaaugucccuaggccucgggcugggacuuggucugagaaaauuggagaagcaaggcucuuguaggaagaaaugcuucgacgccucauuucgggggcucgaaaauugucgcugcgauguggcguguaaggaccgaggagauugcuguugggacuucgaggauaccugcguagaaaguacacguaucuggauguguaacaaauuuagaugcggcgagacuaggcuggaggcuagccuguguuccugcucugacgauugccuccagcggaaggacuguugcgccgauuauaaaucggugugucagggugaaaccucaugguuagaggaaaauugcgacacagcacagcaaagccaguguccugagggguucgaucugccaccggucauucuuuuuaguauggacggauuccgcgccgaguacuuguauaccugggauacucugaugcccaacaucaauaagcuaaagacaugcggcauucacuccaaauacaugagagcuauguauccuaccaagacguuuccaaaccauuacacuaucgugaccggccucuaucccgaaucucacgggauaaucgacaauaacauguacgacguuaaucugaacaaaaauuucagccuuuccucaaaggagcagaacaauccugcaugguggcauggacagccaauguggcugacagccauguaccaagguuugaaagcugccacuuauuuuuggcccggcagugaaguggcgauuaacgggagcuucccuucuaucuacaugccauauaauggauccgucccguuugaggaaaggauuucaacccuccugaagugguuagaucugcccaaagcagagcggccucgcuucuacacaauguauuuugaggaaccagacagcaguggccacgccggugggcccgugucugcucgaguaaucaaggcccuccagguuguggaucaugcauucggaaugcuuauggagggccugaagcagagaaacuugcacaacugugucaauauaauucuacuggcugaccacggcauggaucagaccuacugcaacaaaauggaauauaugacggacuacuucccuaggaucaacuuuuucuacauguaugaggggccagccccucggauucgugcgcauaauaucccgcacgacuuuuucuccuuuaauagcgaagagaucgugcgcaaccucucguguagaaagccugaucaacauuucaaacccuaccugacuccagaucuuccuaagaggcugcacuaugccaaaaaugugcggauugacaagguccacuuguuuguugaucagcaguggcucgcagugcgaucuaaguccaacacaaauugcggagguggcaaccauggguacaauaacgaguuccgcucaauggaagcuauauuucuggcccacggacccaguuucaaagagaagaccgaaguagagccauuugaaaauaucgagguguauaacuuaaugugugaccugcuaaggauucaacccgcuccuaauaacggcacucaugguagccucaaccaucugcuuaaagucccauucuacgagccgucccacgccgaagaggugucuaaguuuagcguuugcggguucgcaaaucccuugccuacagaaucacuggacugcuucuguccacaccuccagaacaguacccagcuggaacaggugaaucaaaugcuuaaccugacgcaggaggaaaucaccgccacagucaaagugaauuugcccuuuggcagaccucggguacuccagaagaacguugaucacugccuguuauaucaucgcgaguacguguccggauucggcaaggcuaugagaaugccaauguggagcucuuacacugucccccagcugggggacaccucaccgcuaccuccaacagugcccgauugucucagggcggacguccgugugccucccagugaaagccaaaaaugcuccuuuuaucuggcagauaagaauauaacucacggauuccuuuacccacccgccucuaaccggaccucggacagccaguaugaugcuuugauuacauccaaucugguucccauguacgaggaauuucgaaaaaugugggacuauuuccauucagugcuccugaucaagcacgccaccgagagaaacgguguaaaugucgugaguggcccaaucuuugauuacaacuaugacgggcacuucgaugcaccggacgagauuacuaaacauuuagccaauacggauguuccuauccccacacacuacuuugugguccugaccucuuguaagaacaagagccauacuccagaaaauugccccggauggcuugacguguugccuuucauuauaccacacaggcccaccaacguagaguccuguccugaaggcaaaccggaggcucucuggguggaggagcgcuuuacagcccauaucgcacggguuagagacgucgagcugcuaaccggucuggauuucuaccaggacaaggugcagccagugucagaaauucuccaacugaaaacuuaucuucccacauuugagacgaccaucuga

SEQ ID NO: 55797 - RNA, 1434 nt, Artificial Sequence
  derived and/or modified sequence opt3 from ENPP5__Homo_sapiens__XP_005249317
augaccagcaaguuccugcucguguccuuuauccuugccgcucugucuuugucaacaacuuucaguuuacagcccgaccaacagaaaguccugcuaguuagcuuugauggcuucagaugggacuaccucuauaaggugccuacgccacacuuucauuacauuaugaaauaugggguacacgugaagcaggucaccaacguguucauaacaaaaacuuacccgaaucauuauacccugguuacaggacuuuuugcagagaaccacgguaucguggccaaugauauguucgaccccauuaggaacaaguccuuuucucuggaucauaugaauaucuacgacucgaaguucugggaagaggcgaccccuauuuggaucacuaaccagcgggcuggccacacaucaggggccgcaauguggccaggaaccgaugucaaaauacacaagcgcuuucccacgcauuauaugccuuacaaugaaagcgugaguuucgaggaccgaguagccaaaaucauugaaugguuuacuuccaaggagccaaucaacuugggccuccuguacugggaggaucccgacgauaugggucaccaucuggggccugacucuccacucaugggaccgguuauuagcgauaucgacaaaaaguuaggcuaucugauacaaaugcuuaagaaagcuaaguuguggaauacccugaaccuaauuaucacauccgaccacggcaugacucagugcucagaggaacgucucauugaacuggaucaguaccuugacaaagaucacuauacccugaucgaccagagucccguggcagccaucuugccuaaggaggggaaauucgaugaggucuacgaagcucucacacaugcccacccaaaucugaccguguauaagaaagaggacgugcccgaaagauggcauuacaaguauaacagcaggauucaaccuauaaucgcggucgcagaugagggauggcacauuuuacagaauaagucugacgauuuccugcucgguaaccauggcuacgacaaugcccuugcugauaugcacccaaucuuucuggcccacgggcccgcauuccggaaaaacuuuuccaaggaagcuaugaacucaacggacuuguacccgcuacugugucaucuccugaauauaacugccaugccucacaacggcagcuucuggaauguucaggaccuucugaacagugcgaugccccgcgugguaccauauacacagucuaccauuuugcucccuggauccgugaaacccgccgaguacgaucaagaggguagcuauccauacuuuaucggggucucgcugggaucuaucauugugaucguuuucuuugugauuuucauaaagcauuuaauccacucccagauucccgcacugcaggacaugcacgcugaaaucgcccaaccucuacuccaggcuuga

SEQ ID NO: 55798 - RNA, 1377 nt, Artificial Sequence
  derived and/or modified sequence opt3 from ENPP7__Homo_sapiens__NP_848638
augagaggccccgccgugcugcucaccgucgcucuugcaacacuguuggccccuggggcgggagcuccaguucagagccaagguucccagaacaaguuacugcuagugucuuucgacggcuuuagguggaauuacgaucaggacguagauacuccgaaccucgacgccauggcacgggauggggugaaagcccgcuauaugacgcccgcuuucgucaccaugacaucaccuugccacuuuacucuggugaccggaaaguacaucgagaaucauggcguugugcacaacauguauuacaauacaaccaguaaagucaaacuuccauaucaugcaacucuggguauucagcgauggugggacaacgggagcgugcccauauggaucacagcccaacgucagggauugagagcuggcuccuucuuuuacccuggcgggaauguaaccuaucagggaguugccgugacgaggucucggaaggaagguauugcgcacaacuacaagaaugagacugaauggcgcgcaaacaucgauaccgucauggccugguucacagaggaagaccucgaucuggugacucuguacuuuggcgagccagacucgaccgggcauagauauggacccgagucaccugaaaggcgggagauggugcgccaggucgaucgaacaguuggcuaccucagagaaagcauugcuaggaaucacuuaaccgaccggcugaaccuuaucauaacgagugaucacgguaugacuacaguggacaagcgugccggggacuugguagaguuccauaaauuuccaaauuucaccuuucgcgauaucgaguucgaacugcuagacuauggaccgaacggcaugcuccugcccaaggagggcagacuugaaaaaguguacgaugcacugaaggacgcucacccuaaauugcaugucuauaagaaggaggccuuuccagaagcguuccacuacgccaauaaccccagggugacuccucuccugauguauuccgauuuaggguacguuauucacggacggaucaacgugcaauucaauaacggugagcauggcuuugacaauaaagauauggacaugaagacaauuuuccgagcagucgggccaucuuuucgcgcuggacuggagguggaacccuucgagagcguacacguuuacgaacucauguguagacuucugggcaucgugccggaggccaacgauggucauuuggcuacccuacugccuaugcuccacacggaauccgcccugcccccagacgggaggccuacccuucugcccaaaggccggucagcauugccacccaguagccgcccucuccuggucaugggauuacugggcacagugauacuacucucugaggucgccuga

SEQ ID NO: 55799 - RNA, 1578 nt, Artificial Sequence
  derived and/or modified sequence opt3 from ENTHD2__Homo_sapiens__NP_653280
auggccgcugcacccccucugagagacaggcucagcuuccuucaccggcugccaaucuuguuaaagggcaccuccgaugacgaugugccgugccccggguaccuguuugaggaaauugccaaaauaucucaugagucaccuggaaguagccagugucuacucgaauaucugcuuucccgccugcacucuucgucaggucauggcaaguugaaaguccucaagauccugcuguaccucugcagccacgggaguuccuucuuuuuacugauucuuaaacgaaacucugcguucauccaagaggcugccgcauuugccggaccacccgacccuuugcauggcaauagccuguaucagaagguucgugcugcagcccaggaucuagguuccacacucuucucagacacugugcugccacuugcucccagucagccucuggggacgccaccggccaccggaaugggcagccaagcgagaccccacucuacauugcagggcuuuggguacuccaaggaacacggaaggacugcaguacggcaucagccuggucaggccggcgggggaugggaugagcucgacucaggcccaagcagucaaaacucuucccagaauagcgaucugucgcgcgugucugacuccgguucacacagugggagcgauucccauucuggagcuagcagagagcccggcgacuuagccgaaagggucgaggugguugcacugucagauugucagcaggaacucagucuugugcggaccgucacacgcggcccucgagcuuuccuguccagagaggaggcccaacacuuuauuaaagcgugcggguugcuaaacugugaagccgugcugcagcuccugaccugccaccuuaggggaacuagcgaguguacacagcugcgggcauugugcgcuaucgccucucucgguucaagugaccuguuaccacaagaacauauacugcuacguacccgccccuggcuccaggagcugagcaugggcuccccggggccuguaacgaauaaggcuacuaaaauccuuagacacuucgaagccucuuguggacaguugucgcccgcaaggggcaccagcgccgagccagguccuacagcugcgcugcccgggccauccgaccuccugacugaugcaguuccccuuccuggcucacagguguuucugcaaccauugaguucuaccccggucagcucccggucacccgccccuagcucuggaaugccauccagucccgugccuacaccacccccggacgcuagcccuauuccagcccccggcgauccuucugaggcagaagcccgacucgcugagucccgcagauggaggcccgaacggaucccagggggaaccgacucaccuaagcgcggucccaguagcugcgccuggucgagagauucccuguucgcaggcauggaguuaguggcguguccaaggcuggucggggcuggagccgcagccggcgaaucuugcccggacgcuccucgugcaccccagacgagcucacagcggacugccgcuaaagagccacccgguagugagccuuccgccuuugcguuccuaaacgccuga

SEQ ID NO: 55800 - RNA, 1554 nt, Artificial Sequence
  derived and/or modified sequence opt3 from ENTPD1__Homo_sapiens__NP_001091645
augaagggcaccaaagaccugacaagccagcaaaaggaguccaacgugaaaacuuucugcucuaagaauauccucgccauucuuggguuuucaaguauaaucgcugucauugcacuguuggccguuggauuaacgcagaacaaagcgcugcccgaaaaugugaaguacgguaucguacuagaugcuggcagcucccacaccucucucuauauuuacaaguggccugccgagaaagaaaacgacacaggggugguccaucagguggaggaauguagaguuaagggaccaggcaucucgaaauucgugcagaaggucaaugagauagguaucuaucugacugauugcauggagagggcacgggaagugauuccgcgcucacaacaccaggagacccccguauaccuuggggccacagcuggaaugcgacuguugcguauggaaagcgaggagcucgcagacagaguucuggauguggucgaaaggagucuguccaacuauccuuuugacuuccagggcgcccggaucauuaccggccaggaggaaggggcuuacggauggaucacuauaaauuaucucuuagguaaauuuucucaaaagacacgcugguucagcauugugccauacgagaccaacaaucaggaaacguuuggcgcccuggaucuugggggagcguccacucaggugaccuucgucccccagaaccaaacaaucgagucaccugacaaugcauugcaguuuagacuguacggcaaggauuauaacguuuacacucauaguuuccuauguuaugguaaagaccaggcccucuggcaaaagcuggcuaaagauauucagguggccagcaaugagauccuuagggacccaugcuuucaccccggguacaagaaaguagugaacgucucugaucuguauaagaccccuuguacaaaacgguucgaaaugaccuugccauuucagcaguucgagauccaaggaauuggcaauuaccagcagugccaucaguccauacucgaacuguucaacacgucauauuguccguacagccaaugcgcauuuaacggcaucuucuuacccccucugcagggggacuuuggagcuuucagugccuuuuacuucgugaugaaguuucucaaucuuacuucugagaagguuucccaggaaaaagugacagagaugaugaagaaauucugugcgcagccaugggaggaaauuaagaccagcuaugccggugucaaagagaaguaccugucggaauauugcuuuucuggcacuuacaucuugucccuacugcuccaaggguaucacuucacagcagacucaugggagcacauacauuuuauuggaaagauccagggcagugaugcugguuggacccugggguacaugcuuaaccugacgaauaugauccccgccgaacagccuuugagcaccccacucucccacucuacauauguguuccugaugguauuauuuagccugguucuauucacuguggcuauuaucggccuccugauuuuccauaaacccucauacuuuuggaaggacauggucuga

SEQ ID NO: 55801 - RNA, 1419 nt, Artificial Sequence
  derived and/or modified sequence opt3 from ENTPD2__Homo_sapiens__NP_001237
auggccggcaaggugagaagccuguugcccccucuucuguuggcugcagccggguuagcgggacugcuacuccugugcgucccaaccagggacguucgggagccgcccgcucuuaaauacgguaucgugcuggaugccggcuccucucacacaucaauguucauuuauaaguggccugcagacaaagaaaacgauacugggauaguaggacagcauaguagcugugacgugccaggcggugggaucuccucuuacgccgauaaucccucgggagcuucacaaagccucgucggcugccucgagcaggcacugcaggacgugccuaaggaacgccacgccggcacgccacuguaucucggggcuaccgccggaaugcgauuacugaaccuuacaaaucccgaggcgaguacuuccguuuugauggcagugacccauacacugacccaguacccuuuugauuuccguggugccaggauucuaucuggccaagaagagggggucuuuggaugggugacugcuaacuaucuccuggagaauuucaucaaauacggcuggguagguagaugguuucggccacgcaaggggacacuuggagccauggaccugggcggcgcaagcacccagauuacguucgaaacuaccuccccggcugaggauagagccucagaaguucaguugcaccucuaugggcagcauuacaggguguacacacacaguuuucuguguuauggacgggaccaagucuuacagcgccugcucgcgagcgcccuucagacucacgguuuccaucccugcuggccucgaggcuuuucuacccaggugcuguugggggauguguaccaauccccauguacaauggcacagagaccccagaacuucaauucaagcgcuagggucagucuaucuggauccagcgacccucaccugugccgggaucucguuucgggccuguuuucuuucuccucauguccauuuagucguugcagcuucaacgguguguuccaacccccgguagccgggaauuuuguggcuuucuccgccuuuuucuauaccgucgacuuucuucgcacgucuaugggccugccuguggcaacuuugcagcagcucgaggccgcugcgguuaacguguguaaucagacaugggcacaacagcuguuaagcagaggauacggcuucgacgagagggccuuugggggagucaucuuccagaagaaagcugccgauaccgcaguggguugggcccugggcuauaugcuaaaccucacuaaucugauacccgcugacccaccugggcuucggaagggaacagauuuuucaaguuggguaguuuugcugcuccuguucgccuccgcacuucuggcggcuuuggugcuccuguuacgacagguccauagcgccaaacugcccucuaccaucuga

SEQ ID NO: 55802 - RNA, 1827 nt, Artificial Sequence
  derived and/or modified sequence opt3 from ENTPD4__Homo_sapiens__NP_001122402
augggcagaaucgggauuagcugccuguuccccgccuccuggcacuuuucuauaucaccugugggauguccaaggauccucaacaccaaucuucggcagauuauggucaucaguguucuggcugcagccgugagcuuguuauacuucuccguagugauuauccgcaacaaguauggucgacugacacgugacaaaaaguuucaaagauaccuagcgagggucacugauauagaggcuacggacaccaauaacccgaaugugaacuauggcaucguuguggauugcgggucuucgggaucacgggucuucguguacuguuggccccgccauaauggcaacccucacgaccuccuggauauuagacagaugagggacaaaaaucggaagccaguaguuaugaaaaucaagcccgguauuagcgaauuugccacaaguccugagaagguguccgauuauaucucuccacuucugaacuucgcagccgaacaugucccccgcgcuaaacacaaggagacuccuuuguacauacucugcaccgcagggaugcgaauccugccagaaagccagcagaaagccauucuggaggaccucuuaacagauauuccggugcauuuugacuuccuguuuuccgauucacacgcugaggugaucaguggaaagcaagaaggcgucuaugccuggaucggcauuaauuucguucuugggagauuugagcacauagaagacgaugacgaggcggugguagaggugaacauccccggaagcgaaucuuccgaggcaauugucaggaaacggaccgccgguaucuuggacaugggcggggugucaacucagauagcuuacgaaguuccuaagacagaggaaguggccaagaaucugcuagcagaguucaaccucggaugugauguccaucagaccgagcacguguaccguguauauguugcuacguuucugggcuucggugggaaugccgcgcgccagagauacgaagacaggauuuucgccaacacuauccagaaaaaccggcuucugggaaagcaaaccggcuugacaccagauaugcccuaucucgacccuugccugccauuagauaucaaagacgagauucagcagaauggccaaacuaucuaccugcgagggaccggagauuuugaccucugucgcgaaacaauucagcccuucaugaacaagaccaaugagacgcagacuagccuuaacgguguguaucaaccgccuauacauuuucagaauagugaauuuuacggcuucucugaguucuauuacugcacagaggauguccugagaaugggaggggacuacaacgcagcuaaauuuaccaaggccgcuaaagauuauugugccacuaagugguccaucuugagggaacgguucgaccgcggccuauacgcaagccacgccgaccugcacagacucaaguaucagugcuuuaaaucggcuuggauguucgagguguuucauagggguuucucuuuucccgucaauuacaagucccugaaaacagcgcuucagguguaugauaaggaaguucaauggacccugggggcaauuuuguaccguacgcgguuccucccacugcgagacauccagcaggaggccuucagagcuucacacacccauuggaggggcgugaguuuuguauauaaccacuacuuauucagcggauguuuucuggucgugcuacucgccauccugcuuuacuugcugcgccuccggaggauucauagacgcacaccucgauccucuagcgcagccgcucuguggauggaagagggccuucccgcccagaaugcaccagggacucuguga

SEQ ID NO: 55803 - RNA, 1287 nt, Artificial Sequence
  derived and/or modified sequence opt3 from ENTPD5__Homo_sapiens__XP_006720387
auggccaccagcuggggcacaguguucuuuaugcuggucguuuccugcguguguucugcuguaucacacagaaaccagcaaacuugguucgaggggaucuuucucaguagcaugugccccauuaauguguccgcaucuacgcuuuacggaauaauguucgacgccgguucgaccggcacaaggauccaugucuauacuuuugugcagaagaugccugggcagcugccaauuuuggaaggagagguuuucgauucagugaaaccgggcuuaagcgcguuugucgaccagcccaagcaaggugcugaaaccgugcaggggcugcuagagguagccaaagauaguaucccucggucccacuggaagaaaacaccaguugugcucaaggcaaccgccggacugcgccuucugcccgaacauaaggcuaaagcauuguuguucgaggucaaggagauuuuucgaaaaucuccuuuccuggugccaaagggcagcguguccaucauggacggcucagaugaagggauacuggccugggucacuguuaacuuucucacaggacaguuacacggucaucgucaggagaccgugggcacgcuggaccuugggggagcuaguacucaaaucaccuucuugccccaguuugagaaaacacuggaacagacuccuagaggcuaccuaaccagcuucgagauguucaauucuacauauaagcucuacacccacuccuaucuggguuuugggcuuaaggccgcgaggcuggcaacguugggagcccucgaaacugagggcacagauggccacaccuuccggucagcuugucugccacgcugguuagaagccgaguggauuuuugggggaguaaaauaccaguaugguggcaaccaagaaggggaggugggauucgagccgugcuacgcagaaguccugagagugguuaggggcaagcuccaucagcccgaggaagugcagcgggguagcuuuuacgcuuucaguuauuacuaugaccgcgccgucgauacugacaugaucgauuacgagaaagggggcauucuuaagguggaagacuuugagcgaaaagcgagagagguaugugauaaucuggaaaacuucacaucuggauccccuuuucucugcauggaccuaagcuauaucaccgcccugcucaaggacggcuucggguuugcagauucgacgguucugcaacuuaccaaaaaggugaauaacauagagacaggaugggcucugggugccacuuuccacuugcuccagucucugggcauuucccauuga

SEQ ID NO: 55804 - RNA, 1404 nt, Artificial Sequence
  derived and/or modified sequence opt3 from ENTPD6__Homo_sapiens__NP_001107561
augcagccccaacacggcccuuggcagaccagaaugaggaagaucagcaaccaugggucccugcggguggccaaagucgcuuacccacucggacuuugcguugguguguucauuuauguagcauacauaaaguggcaccgcgccacagcgacucaggccuuuuucucuaucacgcgagcugcaccgggcgcccguugggggcagcaagcucauucaccccugggaaccgcagccgacggccacgagguguuuuaugguauuauguucgaugcugggaguacaggaacuagaguccauguguuucaguucaccaggccuccacgggaaacacccaccuugacucacgagacauuuaaagccuuaaagccuggccugagcgcguacgcagacgauguugaaaaauccgcccagggcauccgcgagcuacucgacguggcuaagcaggauauuccauucgacuuuuggaaggccacgccccugguccuuaaagcaaccgcugggcugagauugcucccuggagaaaaggcccaaaaacugcugcagaaggugaaagagguauucaaggcgucuccauuucucguuggugaugacugugugucgaucaugaauggcacugaugagggggucucagccuggauaaccaucaacuucuuaacaggaagccugaagacuccgggcgguaguuccguggggaugcuugacuugggaggcggcucuacccagauugcauuucugcccaggguggaagggacacuacaggcuagcccuccaggauaucucaccgcccugcggauguucaaucgcacguacaaacuuuauuccuacucauaccuggguuugggccucaugagugcucgacuggccaucuuagggggagucgagggccaacccgcaaaggaugguaaagaacugguuagcccuugccucucuccauccuucaagggggagugggagcacgccgaagugacuuauagaguaucaggccagaaagcugcggcaagccuucaugagcugugugccgcuagggugagugaagucuugcagaaccgggugcaccguacagaggaaguuaagcauguggacuuuuacgccuucucuuauuacuaugaucuagcagccggagucggccugauugacgcugagaaagggggaucccucgugguaggugacuuugagaucgccgcaaaguacguuugccgcacccuggaaacucaaccccagagcucgccguucucuuguauggaucuuacauaugugucccuguugcuccaggaguuuggcuucccuagaucaaagguccugaaauuaaccaggaagauagacaauguggaaacgaguugggcgcugggggcuauuuuucacuacaucgauagccuaaaccggcagaaaucccccgccucuuga

SEQ ID NO: 55805 - RNA, 1815 nt, Artificial Sequence
  derived and/or modified sequence opt3 from ENTPD7__Homo_sapiens__NP_065087
auggccagaaucagcuucuccuaccugugccccgcuucuugguauuuuaccgugccuacagucucaccauuccucaggcagcggguugcauuucuuggccuguucuuuauuaguuguuuguuacugcuaaugcucauaaucgacuuccgccacuggagcgccucccugccgcgagaucgucaauacgagagauaucuugcgagggugggggaacuggaggcuacugacacggaagaucccaacuugaauuacggacucguaguggacugcgguucuucgggcucacggauuuuugucuauuucuggccucgccauaacgggaauccacacgaucugcuggacaucaagcagaugagagauaggaacagccagcccgugguuaaaaagauuaaaccuggaaucagugccauggcagacaccccagagcaugccuccgauuaccuccggcccuuacugucuuuugcugcagcccacgugccugucaagaaacauaaggaaacaccacuuuauauauuguguacugcuggcaugcgccugcuaccggagcgaaagcagcucgccauccuggcggaccuugugaaagaucugcccuuggaguucgacuuucucuucagccaaucccaggcagaaguaauuucagguaagcaggaggggguuuacgccuggaucggaauuaauuuugugcugggcagauucgaucacgaagacgagagugacgcugaggccacccaggaauuagcagcuggcaggcggcguacagucgggauccuggauaugggaggugccagccuccaaauagcguacgaggugccuaccucuacuuccgugcuuccagccaaacaggaagaggcagcuaagauucuguuggccgaguucaaccuaggcugcgacguccagcacacagaacauguuuaucgcguguacguaaccacguuucugggguucggaggcaauuuugcuagacagagguaugaggaucucgugcugaacgaaacucuuaauaaaaaccggcuguugggucaaaagaccgggcucucacccgacaauccuuuccuggauccauguuuacccgucggacugacagacgugguugagcgaaacagccaggugcuacacguccgcggcagaggcgauugggugaguugcggggccaugcucucuccgcugcuugcaagguccaauacuagccaggccucguugaacggaaucuaccaaucuccuauugacuuuaauaacuccgaauuuuaugguuucucagaguucuuuuacuguaccgaagauguacugcggaucggcgggcgcuaucauggacccacauucgcuaaggcggcacaggacuacugcggcauggccuggaguguucucacccagagauuuaaaaacggucuguucagcucccacgcugaugagcacaggcuuaaguaccaguguuuuaaaucugccuggauguaucaagugcugcaugagggguuccacuucccauacgacuauccuaauuugcguacggcacagcucgucuacgaccgggaagugcaguggacucugggcgccaucuuauauaagacacgauuucugccccuaagagaucucaggcaggagggaguccgccaagcucauggcagcugguuccggcugucauuuguguacaaccacuaucuuuucuuugccugcauuuugguugugcugcucgcaauauuccuguacuuacugagacuuaggcgcauccaucaccgacagacccgggcgagugcuccauuggaccuccuguggcuagaagagguaguccccaugaugggggugcagguuggaccuuga

SEQ ID NO: 55806 - RNA, 1584 nt, Artificial Sequence
  derived and/or modified sequence opt3 from EOGT__Homo_sapiens__NP_001265618
augcugaugcuuuucguguuuggcguccuucugcacgagguuagcuuguccgggcagaacgaagcucccccuaauacccauucuaucccaggagagccguuauacaacuaugccucaauuagacugcccgaagaacacauaccuuucuuucuacauaauaacaggcacaucgcaacagugugccggaaggacagucucuguccauacaaaaagcaucuggaaaaacuuaaguauugcugggguuacgagaaaagcuguaagcccgaguuccgcuuuggcuauccuguaugcuccuacguggauaugggguggacugacacgcuggaaucugccgaggauauuuucuggaagcaagcggacuuuggauaugcucgagaacguuuggaggagaugcacguccucugucagccaaaagaaaccucggauucaagccuggugugcaguagauaccugcaguacuguagggccacaaaucucuauuuagaccugcggaacaucaagcgcaaucacgauagauucaaagaggacuuuuuccaguccggcgaaauuggugggcauugcaagcucgauaucaggacuuugaccucugagggacaacggaaaagcccccugcaguccugguuugcagaacuacagucauacacacagcucaacuuccgcccuauagaggacgccaagugugauaucguuauugagaagccaaccuauuuuaugaaacuggacgcuggcgugaauauguaccaccauuucugcgauuucaucaaccuuuauauuacucaacacgucaauaacaguuuuagcacagacguguacaucguaaugugggacaccucuuccuauggcuacggggaucuguucucagacacguggaaugcauuuacugauuacgacguuauacacuugaagaccuaugauagcaaacgaguguguuucaaggaagccgucuuuagucuccugccgagaaugagguacggauuauucuauaacacaccccugauuucugguugccagaauacuggccucuuucgggcuuucgcccagcaugugcuucaccgucugaacaucacccaggaggggccuaaagacggaaagauucgcgugacaaucuuggcgagauccaccgaauacaggaaaauccuaaaccaaaaugagcuggucaacgcacucaagacgguuagcacuuuugaagugcagauuguagauuauaaguaccgggagcugggcuuccuugaccagcugcgaauaacacauaauaccgauaucuuuauugguaugcacggggccggauugacucaucuccuguucuuaccagacugggcugccguguuugagcuguauaacugcgaagaugagcgcuguuaccuagaccucgcaagacugaggggcguccacuacaucacauggcggcgccaaaauaaaguguucccccaggacaagggccaccauccuacccuuggggaacacccaaaauucacgaacuauucguuugauguugaggaguucauguacuuggugcugcaggcugccgaccauguccuccagcaccccaaguggccguuuaaaaagaagcacgaugagcuguga

SEQ ID NO: 55807 - RNA, 2118 nt, Artificial Sequence
  derived and/or modified sequence opt3 from EOMES__Homo_sapiens__NP_001265111
augcagcugggcgagcaacuccuugugagcuccgucaaccugcccggggcccacuucuacccuuuggaaucugcuagaggagguucaggcgggagugcaggacauuuaccaagcgccgcgccgucuccccagaagcuggaccuagauaaggcuuccaagaaauuuucgggcucacucagcugcgaggccguuaguggugaaccugcagccgcuuccgcaggggccccagcugccaugcugucugacaccgaugcgggagacgcauucgccagcgcugccgcaguggcuaagcccggcccuccagauggcaggaaagggucccccuguggagaggaggaacuuccuucagccgcggccgcagcugccgcugccgcagccgcugcggcagccacagcucgguauaguauggacagccugucuuccgagcgcuacuauuugcagucaccagguccgcagggcagcgaacucgccgcacccugcagucuguuuccuuaccaagccgcugccggggcaccacacggacccguauauccugcgccaaauggcgcucgauaccccuaugguucuaugcugccgccugggggauuccccgccgcaguguguccaccuggccgugcccaguuuggccccggggcuggagccgguuccggcgcagggggaagcucgggcggugggggcggaccaggcacuuaccaguacucucagggggcuccccucuauggaccuuacccaggugccgcggccgcuggcuccugcgggggauuaggcggucugggggucccgggcucaggauucagagcacauguguaucuuuguaacaggcccuuguggcugaaguuucaccggcaucaaacggagaugaucauuaccaagcagggccgcagaauguucccuuuucuaaguuucaauauaaacgggcucaauccaacagcccacuacaacguuuuuguggaagucgugcuggcugaucccaaucacuggagguuccagggagguaaauggguaacuugcggcaaggccgacaacaauaugcaggggaacaaaauguauguucauccugagagcccaaauaccggaucccacuggaugcggcaagagaucucuuuuggcaaacuuaaacugacaaacaauaagggugcaaacaauaacaacacccagaugauuguguugcagagccuccauaaguaccaaccccgccugcacaucgucgaagugacugaggaugggguggaagacuuaaaugagccgucaaaaacacagaccuucacguucagugaaacucaguuuauugcggucaccgccuaucagaacacagauaucacucaacugaagauagaccacaauccuuucgcuaaaggcuuucgagauaacuacgacuccauguacaccgccagcgagaaugacagacucacaccaucucccaccgauucaccuaggagucaucagaucguucccggaggccgguauggggugcagagcuucuuuccagagccuuucguaaacacgcuuccccaggcacguuacuauaauggagaacgcacugugccacaaacaaacggccuguuguccccgcagcagucugaggaagucgcuaauccuccccagagauggcuagugaccccaguucaacagcccgguacuaacaagcuggacauuucgagcuacgaguccgaauauacaucaaguacccuccugccuuacgggaucaaaucucuuccacugcagacgagccacgccuugggauauuaccccgauccuaccuuuccggcaauggccggcugggguggcaggggguccuaccagcggaagauggcugcgggacucccauggacaucacgaacuagccccaccguguucucugaggaccaacuguccaaagagaaggucaaggaagagauuggcaguagcuggaucgaaacaccuccaucuauaaaauccuuagauucaaaugacagugggguguauacuagcgccuguaagcgcagaaggcugucgcccuccaacucuagcaaugagaacucaccuaguauuaaaugcgaagauaucaaugcagaggaguacuccaaggacaccucuaaaggaaugggcgguuauuacgcuuuuuauacaaccccguga

SEQ ID NO: 55808 - RNA, 7245 nt, Artificial Sequence
  derived and/or modified sequence opt3 from EP300__Homo_sapiens__NP_001420
auggcagaaaacgugguagaacccggcccuccaagcgcuaagagaccgaaacuguccucucccgcacuaucagccagugcgagcgacgggaccgauuucggaucccuuuuugaccuggagcacgauuugccugacgaauuaaucaauucuacagagcugggucuaacuaacggcggggauauuaaucagcuccagacgucgcugggaaugguucaggacgcugccucaaagcacaaacagcuuagcgaacuguugaggaguggcuccucuccaaaccucaauauggguguagggggacccggccaggugauggcaagccaggcccagcaguccucaccuggccuggggcugauaaacaguaugguaaagagcccaaugacccaggcuggacucacaucucccaauauggguaugggcacuuccgggccuaaccagggaccaacccagucaacaggcaugaugaauagcccggucaaccagcccgcaauggguaugaauaccgggaugaacgccggaaugaauccuggcauguuagcugccggcaacgggcagggaaucaugccaaaucaagugaugaacgguaguauuggcgcggggcggggacgccagaacaugcaguaccccaauccuggcauggguucugcagggaaccugcuuacugagccauugcaacagggcagcccccaaaugggaggccagacagggcugcgaggaccgcaaccucuaaaaauggguaugaugaauaaccccaauccauauggcuccccuuacacccagaaccccgggcagcagaucggagccucgggccucggucugcaaauucagacgaagacuguucuuucuaauaaccuguccccauucgcuauggauaagaaagccgugcccgggggcggaaugccuaauaugggccagcagccagcaccgcaaguccagcagcccggguuggugaccccuguggcucagggaauggguucaggcgcccacacagcggacccagagaagcguaaacucauccaacagcagcugguuuuacugcuccaugcccacaagugccaaagaagggaacaggcaaacggggaggugcggcaguguaaucuuccccauugccgcacuaugaaaaacguccugaaucacaugacccacugucagaguggaaagagcugccaaguggcucauugugccuccucuagacagauaaucagccacuggaagaacugcacaaggcaugauuguccugugugcuugccacucaagaaugcuggcgacaagcggaaccagcagcccauucugaccggugccccggucgggcucggcaacccuucaagucugggaguuggccaacaguccgcaccaaaucuuagcacggugucucagaucgaucccucaaguauugaacgcgccuaugcugcgcugggguugccuuaccagguaaaccaaaugcccacucagccacaggugcaagccaaaaaucagcagaaccagcaaccuggacagagcccccagggcaugcgaccaauguccaauaugucugccucgccgaugggugucaacgggggagugggcguucagacaccuagccuccuguccgacucaauguuacacagugcuaucaauucucaaaaccccaugaugagcgagaaugccuccgugccaucacugggucccaugccuaccgcagcccagccaagcacuacaggcauaagaaagcaguggcacgaggauauuacccaggaccuaaggaaccaucucguccacaaacuggugcaagcuaucuuucccacgccugacccggccgcacuuaaggaucggcguauggaaaauuugguagcguaugcucgcaaaguugagggggacauguacgaaucugccaacaauagagcagaguauuaccaucugcucgccgaaaagauuuacaagauccagaaagagcuggaggaaaagaggcggacccgacuucagaaacagaacaugcugccaaaugcugccggaauggugcccgucuccaugaacccuggcccaaacauggggcaaccccagccuggaaugacaaguaauggcccguugcccgauccaagcaugauccgcgguucugugccuaaccagaugaugcccagaauuacuccacaauccgggcucaaucaguucggacagaugucaauggcacagccucccauagucccaaggcaaaccccgccucugcagcaccauggccaguuagcucagcccggugcccugaacccacccaugggcuaugggccucggaugcaacagccaaguaaucagggacaguuucuaccccaaacacaguucccuagccagggcaugaacgugacuaauaucccgcucgcgccaucguccgggcaagcccccguuucucaggcucagaugagcucaaguuccuguccugugaacucucccauuaugccaccuggaagccagggcucccacauccacugcccccaacugccacagccugcacuucaucaaaauucaccgagccccguaccaagucgcaccccuacaccccaccauaccccaccuucuauaggugcccagcaacccccggcuacuacgauuccagccccuguccccacaccacccgcaaugccuccggggccccagucccaggcguugcacccaccucccagacagaccccuacuccacccaccacacaacugccucaacaggugcagccaagccuccccgccgcuccgucggccgaccaaccucagcagcaaccaaggucacagcagucuaccgcagcuaguguucccacuccuacagccccacuguuacccccgcagccugcaacgccccugucccaaccagccgugagcaucgagggacaggucucuaacccucccagcaccuccucaacugaagugaauagucaggcuaucgcggagaagcagccaagccaagaaguaaaaauggaggccaagauggagguggaucagcccgaaccugcagacacacagccagaggauauuucugaauccaagguugaggacuguaaaauggaaucaaccgagacagaggaacguaguacugagcuuaagaccgaaaucaaagaggaggaagaucagccgagcacguccgcuacccaaucuucgcccgccccuggccagagcaagaaaaagauuuuuaagccagaggaauugcggcaggcccucaugcccacacuggaggcucuauaccgacaagacccugaaucacugccauucagacagcccgucgauccucagcuccuggguauaccggacuauuuugacaucgugaaauccccaauggaucuuaguacuauuaagaggaaauuggacaccggccaguaccaagagcccuggcaguauguggaugacaucuggcugauguucaacaaugcaugguuauacaaccgcaagacaucucgggucuauaaauacugcagcaagcucuccgagguuuuugaacaggagaucgauccugugaugcagucacugggguacugcuguggaagaaaacuugaguucucuccccaaacucugugcuguuauggcaaacaguugugcaccauuccaagggacgccacguacuauagcuaccagaaucgcuaucacuuuugugagaagugcuucaacgaaauacagggggagagugugucccucggagaugacccuagccaaccccagacaaccaucaacaaagagcaguucucuaagcggaaaaaugauacucuggacccagaacuauuuguagaguguacagaaugcggcagaaagaugcaucaaauuuguguccugcaccaugagaucauuuggccggcggguuucgugugcgaugggugucucaaaaagucagcucguaccagaaaggaaaacaaauuuuccgccaagaggcugccuaguacucgccuuggaaccuucuuggagaaucggguuaacgacuuucugagaaggcagaaucaccccgagagcggcgaagugacaguccgagugguucaugcaucggauaaaacgguggagguaaagccaggcaugaaagcccgcuucgucgacucuggggaaauggcugaguccuuucccuaccggaccaaggcauuauucgccuuugaggaaaucgacggaguggaucucugcuucuuugguaugcacgugcaggaguauggcagcgacugcccuccacccaaccagagaagggucuacauaucauaccuggauaguguucacuucuuucguccuaagugucuucgcacugcgguguaucaugaaauccugauuggguaccuagaguaugucaaaaagcucggauacacaaccggccacaucugggcuugcccgccaucugaaggugacgauuauauuuuccauugucaucccccugaccagaaaaucccaaagcccaaacggcugcaggagugguacaagaagauguuggauaaagccguguccgagagaauaguccaugacuauaaggauauuuucaaacaggcaacagaagacaggcugacuagcgccaaggaguuaccuuacuuugaaggggauuucuggcccaaugugcucgaggaaucaaucaaagagcuggagcaggaagaggaagaacgaaagcgggaagagaacaccaguaaugagagcacggacguuacaaagggagauuccaaaaacgcuaagaaaaagaauaacaaaaagaccucuaaaaauaagagcucccuuucacgcggcaacaagaaaaagccaggcaugccgaaugugucuaacgaccugagucaaaaauuguacgccacuauggaaaagcacaaagaggucuuuuucgugauuagacucaucgcagggccugcugccaauucgcugcccccaauaguugacccugauccccuaaucccaugcgaccugauggauggaagggacgcguuucuuacccucgcccgggauaagcaccuggaguucagcuccuugcgacgagcacaguggucuacaauguguaugcugguggaguuacauacucagucacaggaccgcuuugucuauaccugcaacgaguguaagcaccauguagaaacaagguggcacugcacggugugugaggauuacgaccucugcauuaccuguuauaacacuaaaaaucacgaucauaagauggaaaaacugggucuuggccuggacgaugagagcaacaaucaacaggcugccgcuacacaguccccuggggacagucgucgguugucuauccagagaugcauucaaagccucguucacgcaugccaguguaggaacgccaauugcucacugcccuccugucagaagaugaaacgcgugguccaacauaccaagggaugcaagcgaaaaacuaacggcgguuguccgaucugcaagcagcuaauagcccuguguugcuaccacgcuaaacauugucaggaaaauaagugcccagugccuuucugucuuaacauuaaacagaagcucagacaacagcagcugcagcaccgguugcaacaggcgcagauguuaaggcgccguauggcaaguaugcagagaacagggguagugggacaacagcagggccugcccagcccaacccccgccacgccuacuaccccgacaggccaacagccaaccacuccccagacaccucagcccaccucucaaccacagccuacacccccaaauuccaugccuccguaucucccccggacucaggcugccgggccagucucacagggaaaggcagccggucaaguuaccccucccacgccaccucagacagcucagcccccgcugccaggcccucccccagcggccguggagauggcaaugcagauccaaagggcugccgagacccagcgccagauggcacacgugcagaucuuucaacgacccauucagcaucagaugccucccaugacuccaauggccccuauggggaugaacccgcccccaaugaccagaggaccuagcggccaccuugaacccgguauggggccaacaggaaugcaacagcagccucccuggucgcagggcggccugccgcaaccucagcaguugcagucugggaugccacggcccgcuaugaugagugucgcccaacauggacagccucuaaauauggcgccacagcccggucugggccagguggggaucuccccucucaaaccaggaacuguuagccaacaggcacugcagaaccuuuuaaggacccugcgcucacccuccucuccgcuccaacagcagcagguauugagcauucugcacgccaauccucaacuccuggcugccuucauaaagcagagagcugcaaaauacgccaacaguaauccccagccaauccccggccagccugguaugccacaagggcagcccggacuucagccuccaacgaugccgggccagcaaggcgugcacuccaaccccgcuaugcagaacaugaauccuaugcaggccgggguccaaagggcaggacugccacagcagcagccccaacagcaguugcagccuccaauggguggcaugagcccccaagcgcagcagaugaacaugaaucauaacacaaugccgucucaguuucgggacauucuacgucgccaacagaugaugcagcagcaacagcagcaaggggccggaccuggcaucgguccagggauggcuaaucacaaccaguuccagcagccccaaggcgugggauauccuccccagcagcagcaacgaaugcagcaucacaugcagcagaugcaacagggcaauauggggcagauuggacaacugccacaggcccucggugcagaggcuggcgccucauuacaggcauaccagcaaagacugcuucagcagcagauggggaguccgguucaaccuaaccccauguccccacagcagcauaugcugcccaaucaggcccaaagcccucaccuccagggacagcagaucccaaacucuuugucgaaucaagugaggucaccccagccugucccaagcccgcggccccagucccaaccuccacacaguucucccagcccucgcaugcagccacagcccuccccucaucacgugucaccgcagaccaguucuccccauccaggccugguagcugcgcaagccaacccuauggaacagggucacuuugcaagccccgaucaaaauuccaugcucucacagcuggcuagcaacccagggauggccaaucuucacggcgccucugcaacugaccuaggacuguccacagauaacagugacuugaacagcaauuuaucgcaauccacccuggauauacauuga

SEQ ID NO: 55809 - RNA, 9372 nt, Artificial Sequence
  derived and/or modified sequence opt3 from EP400__Homo_sapiens__NP_056224
augcaccacggcacagggccccagaacgugcaacaccagcugcagagaagcagggccugcccuggguccgagggugaagaacagccagcucauccgaaucccccuccaucucccgccgccccuuucgcgccaucagcuagucccagcgccccucaauccccaucuuaccagauccagcagcucaugaaccggucgccggcaacaggccaaaaugucaacauuacucuucagucaguugggcccgugguaggaggcaaucagcagaucacgcuggccccuuugccauuacccagcccuaccaguccagguuuucaauucuccgcucagccccgccgauuugaacacgggucuccgagcuauauccaggugacauccccucugucacaacagguccagacucagagucccacccaaccaagcccuggacccggccaggcacuacagaacgugcgugccggcgcuccagggcccggacucggucuguguucuuccucaccuacaggcggguucguugacgccagcgugcuugucagacagauuagucugucuccauccagcggaggccauuuuguguuccaagaugguucgggguugacccagaucgcgcagggagcacagguacaacuccagcacccgggcacucccauuacaguuagggagcggcgcccuucucagccacacacccaguccggcgggacgauccaucaccugggaccccaaagcccugccgcugccgguggcgcagggcugcagccacucgcuagucccagccauauaacuaccgccaauuuaccgccucagaucuccucuauuauccaaggacagcuggugcagcagcaacagguccuucagggcccacccuugccuagaccccuggguuuugaaaggacaccaggggugcuacucccuggcgcgggaggcgccgcaggguucggaaugacuucacccccaccgccuaccucacccagucggacagcugugccacccggucuguccagccuuccucugaccucugucggcaacacggggaugaagaaaguuccaaagaaauuggaggagauucccccugccucaccggaaauggcucagaugcgcaagcaaugccucgacuaccacuaucaggagaugcaggcccugaaagaaguguuuaaggaguacuuaaucgagcuguucuuucuccagcacuuccaaggaaauaugauggauuuucuugcauucaagaaaaagcauuaugccccacugcaggcuuacuugcgacagaacgaccuagauauagaagaggaagaggaagaggaggaagaggaagaggagaagagugagguaauuaaugacgagcaacaggcgcuggcaggcagccucguggccggugcuggguccacugucgaaacagaucuguucaagagacagcaggccaugcccucuaccggcauggcagagcaaucgaaaaggccucggcuugaagugggacaccagggcguuguguuucagcauccaggggccgacgcuggagucccccugcagcaauugaugccuacugcccaggguggcaugccgcccacaccacaggcagcgcagcucgcugggcaacgucagagccagcagcaauaugauccuuccaccggacccccagugcagaacgccgcaucacugcacacgccuuuaccccagcugccaggccgccuaccgccugccgguguacccaccgcugcccucaguucugcacugcaauucgcucagcagccacagguuguggaggcccaaacacagcuucagauccccgucaagacucagcaaccuaaugugccaauucccgcgccuccgagcucccaguugccaauacccccuucacagcccgcccagcuggcucuccaugucccaaccccugggaaggugcaaguucaggcaagccagcugucuucccuuccccaaaugguggccaguacaagacugccaguagacccugcuccgcccuguccaaggccuuugcccacuagcucuaccuccucacucgccccagucaguggcagcggaccuggccccucgccggcacgguccucuccagugaaccgaccuagcucagcgacaaauaaagcccugagucccguuaccucccgcacuccagggguggucgcuucugcccccacgaagccucagagcccggcacagaacgcuacauccucacaggauagcagucaagacaccuuaacugaacagaucacccuggagaaccaggugcaccagagaauugccgagcuaaggaaagcaggacucuggucucaacggcgccugcccaaacuucaggaagccccaagaccuaaaucccacugggauuacuugcuggaggaaaugcaguggauggcuacagacuuugcgcaggagaggcguuggaagguagccgcagcuaaaaagcucgugcggaccguuguccgacaucacgaggaaaagcaacugagagaggaaaggggcaaaaaggaggaacagagccgcuuacggagaauagccgccucgacugcuagggagaucgagugcuucuggucaaauauugaacaggugguggagaucaaacugcgcgucgaacuugaggaaaagagaaagaaggcauugaaccuccagaagguuucucggcgugguaaagagcugagacccaagggguuugacgcccuacaagagaguucccuggauagcggaaugucuggcaggaaacgcaaggcgagcauaucccucacagacgaugaaguggacgaugaggaagagacgauugaagaggaggaagcuaaugagggugugguagaccaucagaccgaacugucaaaccuugccaaagaggcagaguugccucuguuagaucucaugaagcuguacgaaggcgccuuccuuccaaguagccaguggccccggccuaagccagacggggaggauacuucuggagaagaggacgcugaugacugucccggcgacagagaauccaggaaagaucuggucuugaucgacucacucuuuaucauggaucaauucaaggcagccgagcgaaugaauauugggaaaccgaacgcgaaggacaucgcugaugugacagccguugcagaggccauucugccuaaaggaagugcucgcgugaccacaagcgucaaguuuaaugccccaucccuacuguauggcgcacuccgggacuaccagaagauaggucuggauuggcuugcuaaauuguauagaaagaaccugaaugggaucuuagccgacgaagcgggacucggcaaaacugugcagauuaucgccuucuuugcacaccuggcuugcaacgaggguaauuggggcccccaccuuguugugguaaggucuuguaacauccugaagugggaacuagagcucaaacguuggugcccugggcugaagauuuugucguacauaggaagccaucgcgaacugaaagccaagcggcaggagugggcugagccaaauucauuccacgucuguaucaccuccuauacgcaauuuuucagaggcuuaaccgcauucacaagggugcgauggaagugccucgugauugaugaaaugcagcgggucaaagggaugacugagcgccauugggaagccguuuuuacccugcagagucagcaaagacuucuguugaucgacucuccccuccacaacacauuccuggagcuauggacuauggugcauuuucugguaccgggaauuagcaggccuuaccuuuccucaccccuccgggccccaucugaagagagccaggauuauuaccacaagguggucauccgacugcacagagugacccagccuuucauauugcgcaggacgaaacgugacguugagaagcagcugaccaagaaguacgaacauguguuaaagugucggcucaguaauagacaaaaagcucuguaugaggaugucauccuucagcccggcacccaggaagcgcugaaguccggucacuuugugaacguuuugagcauucucgugaggcugcaacgcaucugcaaccauccagggcuagucgagccccgacacccuggaucuucauacguagcaggcccacuggaguauccguccgccagucuuauucucaaagcucuggaaagagacuucuggaaggaggccgacuugagcauguuugauuuaaucggucuggaaaauaaaauaacucggcaugaggcagaacuccugucgaagaagaaaauucccaggaaacuuauggaggagaucucuacauccgccgcuccugcggcccgcccagcagcugccaaacugaaggcaagccguuuguuccagcccgugcaguacggccagaaaccugaagggagaaccguugccuuuccaucaacucaucccccucggaccgcugccccgacaacggcgagugcagccccacaaggaccccuaaggggccgcccucccauugcuaccuucucugccaacccagaggcuaaggcagccgcugccccuuuucagacuucccaggcaagcgcgucagcaccccgacaccagccagcuagugccagcuccacagcagcuucuccggcccauccugcaaagcugagagcccaaaccacagcucaggcgagcacucccgggcagccacccccucagccacaagcccccucccacgcagcuggacagucagcccucccucagcggcuggugcuuccgucucaagcccaggcaagguuaccaaguggcgaagucgugaaaaucgcucagcuggccucgauaaccgguccccagagccgcguagcgcaaccugagacgccagugacacuccaguuccagggguccaaguuuaccuugucucauucacagcugagacaacucacugcuggacagccccugcagcuucagggcagcguccugcaaaucguuuccgccccuggccagcccuauuugagggcaccagggccgguggugaugcagaccgucagucaggccggagcugugcacggugcacuaggcucuaaaccucccgccgggggaccaagcccugcgccccugacaccacaaguuggcguaccuggucggguggcugucaaugcccucgcagugggggaacccggaacugccucaaagccggcuuccccaauuggcggcccuacccaggaggagaaaacacguuuacugaaggaacgccuugaccagaucuaccugguuaacgagcgaagaugcagucaagcccccguguaugggagggaucucuugcggauuugugcacugccaagccacggacgcguccaguggagagguucucucgacggcaggcgggggaaagaagcuggacccgcccauuccuacacgucaagcucggagucuccuagugaacugaugcuuacccuaugccgauguggcgagucccugcaggaugugaucgacagaguagcguucgucauaccgccagugguugccgcacccccuagcuugcgcgugcccaggccaccucccuuauacucacaccggaugcguauucugagacagggucucagggagcaugcugccccauauuuccaacagcugcgccagacuacagcaccucggcuucugcaguuuccggaacuccgauugguccaauucgauuccgggaagcuggaggcucuagccauccugcuccagaaacuuaaaucugaaggaagaagggugcugaucuuaagccagaugauuuugaugcuggacauccucgagauguuucugaauuuccacuaccuuaccuauguucgcauugaugagaacgccaguuccgaacagcggcaagagcugaugcgaucauuuaaucgugacaggcggauauucugcgcgauccucucuacucauucacgcacaaccggcauuaacuugguggaagcugauacggucguguuuuacgacaaugaucugaaccccguaauggacgcaaaggcccaggaguggugugaccgaaucggcagaugcaaagauauucacaucuauagguuagugaguggaaauuccauagaagagaagcuacugaaaaacggaacuaaggaccucauccgggagguugcugcccaggguaaugauuacagcauggcauuccuuacccaacgcacaauucaggaacuguuugaggucuauucuccaauggacgaugccggcuucccugugaaggcugaagaguuuguggucuugucgcaggaacccucaguaaccgagacuaucgcgccaaaaauugccagaccuuucaucgaggcacugaaguccauagaauaccucgaggaagacgcucagaaauccgcccaagagggggugcugggaccccacacagaugcacuuaguucugacagcgaaaacaugccgugugaugaggagccaucccagcucgaagaacuggccgacuucauggaacaguugaccccuauugagaaguacgcucugaauuauuuagagcuauuucauacaucaaucgaacaggagaaagaaaggaacagugaggaugccguuaugacugcggugcgagcaugggaguucuggaaccugaagacccuccaagagcgggaggcccgucuuagacuggaacaggaggaagcugaguugcugacguacacacgcgaagacgccuauucuauggaguacgucuaugaggacguggauggccagaccgaaguuaugccccucuggacuccacccaccccuccccaggacgauagcgacaucuaccuggauuccgugaugugccuuauguaugaggcaacaccaauuccugaagcuaaguuaccgcccgucuacgugaggaaagagcggaagagacacaaaacugacccaucagccgcuggucgcaagaaaaagcaaaggcauggggaagccguagugccuccccgaagccuguuugaucgggcaaccccaggacucuugaagauaagaagggagggcaaagagcagaagaaaaauauccugcuaaagcagcagguuccuuucgcgaaaccccugccgacguuugccaagccuacagcugaaccaggccaagacaaccccgaguggcucauuucugaagauugggcccuucugcaggcagucaagcaguugcuggagcucccucugaauuuaaccaucguguccccagcucacacucccaacugggaccuugugagugaugucguuaauagcuguucgcgcauuuaccguuccucuaaacaaugccggaacagauaugagaaugugaucauaccuagggaagagggaaagagcaaaaacaaucgcccacugcgaacaagccagaucuacgcccaggacgaaaacgcaacccacacucagcucuauacaagucauuucgaucuaaugaagaugaccgccgggaaacggucucccccgauuaagccucuguuggguaugaaucccuuucagaaaaacccaaagcacgcgagcguacuggcugagagcggcaucaauuacgacaagccccucccuccaauucagguggccucacuuagagcagaaaggaucgccaaagagaagaaagcucuggccgaccagcagaaggcacaacagcccgcugucgcccagccuccaccgccccagccucaaccacccccuccaccccagcagccgccuccacccuugccucaaccccaggcggcugggucccagccaccggccggaccucccgcagugcagccacaaccccagccucagccacagacgcaaccccagccuguucaggccccagcuaaagcacagccggccauaacuaccggcgguagugcggccgugcuggcugggacaauuaagaccagcgucacaggaacuucuaugcccaccggcgcaguaucaggcaacgugaucguuaauacgaucgccggggugccugcugccacauuccaauccauuaacaagcgccucgcaagcccagucgcucccggagccuuaacuaccccugguggcucugcgccagcccaggugguccauacacagcccccuccgagagcaguggggagucccgcuaccgccacuccagaucugguuucgauggcaaccacacaaggagugcgggccguaacguccgugacugcuagcgccgucguuaccacaaaccuuaccccugugcagacucccgcgaggucacuggucccacaggugucucaggcuacaggcguacaacuaccugguaaaaccaucacgcccgcacacuuucagcuccugcgucagcagcaacagcagcagcaacagcagcagcaacagcagcaacagcagcagcaacagcagcagcaacagcagcagcaacagcagcaaacuacaaccaccagccaggugcagguuccacagauacaagggcaggcccaguccccggcucagauuaaggccgugggcaaauugacuccugagcaucugaucaagaugcaaaaacagaagcuccagaugcccccacagcccccuccaccccaagcacagagugccccuccgcagcccacagcucagguccaagugcagaccucacagccaccucaacagcagucuccccagcuuacaacugucacggcgccacgaccuggagcccuguuaaccggcacaacuguggcaaaucugcaaguugcccgcuugaccagaguacccacaagccagcuccaggcucaggggcaaaugcagacccaggcaccacagccggcccaaguggcucuggccaagccucccgucguguccguuccagcggcaguggucaguagcccuggagugacuacgcuacccaugaacguagccgguauuuccguggcuaucggccagccacagaaagccgcagggcaaaccguugucgcucagccugugcacaugcagcagcuucugaagcucaaacaacaggccgugcagcagcaaaaggcgauacagccccaggccgcucagggaccggcagccguccaacagaaaauuacagcucagcagaucacuaccccaggcgcacaacagaagguugccuaugcugcccagcccgcacugaagacacaauucuugaccacuccuaucucucaggcccagaaacuggcgggugcucagcaagugcagacacagauucagguagccaagcucccacaagugguccagcagcagacgcccguggcaucaauccaacagguugccagcgcuucgcagcaagccuccccucagaccguggcacuuacucaggcuacagccgcggggcagcaaguccagaugauuccggcagugaccgccaccgcucagguaguucagcaaaaacugauacagcaacagguggucacaacugccagugcucccuuacaaacgccaggcgcaccuaaucccgcccaggugccagcgucuagcgacucaccuucccagcaacccaagcugcagaugcgggugccagccgucagguugaaaaccccuacaaagcccccgugucaguga

SEQ ID NO: 55810 - RNA, 2613 nt, Artificial Sequence
  derived and/or modified sequence opt3 from EPAS1__Homo_sapiens__NP_001421
augaccgccgacaaggagaaaaagagaagcuccucugaaaggcggaaagagaagucacgcgaugcugcacgaugccguagaaguaaagaaacagagguguucuacgaacuggcccacgagcucccccuuccucauagcgucuccucucaccuggacaaggcgucgaucaugagguuggcuauuucauuuuuacggacucauaagcugcuaagcaguguuuguuccgagaacgaaucugaggccgaagcagaucagcaaauggacaaucucuaucugaaagcccuugagggcuucauagcugugguaacgcaggauggggacaugaucuuucugagcgagaacauuuccaaguucaugggauugacccagguggaacucacaggucacucaaucuuugauuucacucauccaugcgaccacgaggaaauucgcgagaaucugagucugaaaaacggcagcggguuuggaaagaaaucuaaggauauguccaccgaaagagacuucuuuaugaggaugaaguguacagucaccaaucggggccgcacugugaaccucaaaucagcaacauggaagguuuuacacugcaccggucaggugaaagucuacaauaacuguccgccccauaauagccugugcggguauaaggagccucuuuugaguugucugaucauaaugugcgagccaauccaacaccccucucauauggauauuccucuagacuccaaaacguuccucagccgacacucgauggauaugaaguuuacuuacugugacgacagaaucaccgaacugauuggauaucacccagaggaacuucugggcaggucugccuacgaguucuaucaugcuuuggauuccgaaaacaugacaaaaucacaccagaaucucugcacuaagggccaggugguaagugggcaguaccggaugcuggccaagcauggagguuacguuugguuagagacccaaggcacagugaucuauaacccccguaaucugcagccucaguguauaaugugcgucaacuacgugcucagcgagauugagaaaaaugacguggucuuuuccauggaucagaccgagucucuuuucaagccacaccugauggcgaugaacagcaucuucgacucaagugggaaaggagcaguuuccgaaaagagcaacuuuuuguucacgaaacuaaaggaggaaccggaggagcuggcccaacucgcucccacuccuggcgaugccauuaucucucuggacuuugguaaucagaacuucgaagagucaagugcauaugggaaggcuauccuuccacccagccagccuugggccacagaacugcgcucccauucuacccaaucggaggcgggcagcuugccagccuuuacugugccccaggcagcugccccgggauccacaaccccuucagcuacgaguucuagcuccucaugcagcacccccaauucuccagaggauuacuauacaucccucgacaacgaucugaaaauugaaguaauagagaaguuauucgccauggacacugaagcaaaagaucaguguaguacccagacagacuuuaaugagcuggaccuagaaacucucgccccuuacauccccauggauggcgaggacuuccaacugagcccaauuugccccgaggaaagacuuuuggcugagaacccucagucuaccccacagcacuguuuuuccgcgaugacaaauaucuuccagccgcuggcacccguggccccucacucaccauuucuccuggauaaguuccaacagcagcuugaaaguaaaaagaccgagcccgaacauaggccuaugagcucgauauuuuucgacgcuggguccaaggccucucugccacccugcuguggacaggcaagcacuccguugucaaguauggguggccgguccaacacgcaauggccuccagaucccccucuccacuucgggcccacaaaaugggccgucggagaccagcgaaccgaguuucugggcgcugccccauuagguccucccgugucuccaccgcauguuagcacuuucaagacccgcuccgcaaaaggguuuggcgcgagaggaccugaugugcugucacccgcuauggucgcccuaagcaauaagcucaaacugaagaggcagcuugaguaugaagaacaggcauuccaagacuugaguggcggggauccacccggagguucuacaucccaccugauguggaagcggaugaaaaaccuccgcggcgggagcugcccucugaugccagacaagcccuuaucggccaaugugccuaacgauaaauuuacccagaauccgaugagaggacugggccacccacuuaggcauuugccccucccucagccacccucagcuauuucuccuggugaaaacaguaagucccguuucccgccccaauguuacgccacucaguaccaggacuauagccugucuagcgcacacaaaguauccgggauggcuucacggcuacugggcccaaguuuugagagcuaccuccugccugaacuuacacgauaugauugcgagguuaaugugcccgucuugggaucuuccacgcuguuacagggcggggaccuccugagagcccuugaccaagcgaccuga

SEQ ID NO: 55811 - RNA, 2643 nt, Artificial Sequence
  derived and/or modified sequence opt3 from EPB41L1__Homo_sapiens__NP_001245258
augaccacagagacuggccccgacagcgaagugaagaaagcccaggaggaagcuccucaacagccagaggcagccgcggcugucacgaccccgguuacacccgccgggcacggacauccugaagcaaacuccaaugagaagcacccaucucagcaggauacuagacccgccgagcaaucacuggacauggaagagaaagauuacagugaagcugacggucucagcgagaggaccacaccuuccaaggcacagaaaucuccacagaagaucgccaagaaauauaagucggcuauuugccgggugacccuucuggaugccucagaguacgaaugugagguagaaaaacauggccgcgggcaaguguuguucgacuuagucugcgagcaccugaaccuacucgaaaaggauuauuuuggacugacuuucugugacgcggauagccagaaaaauuggcuugaccccaguaaggagauaaagaaacagauccgauccucuccuuggaacuuugcauucacagugaaguuuuacccaccggaucccgcccagcugaccgaggacauuacgcguuauuacuugugccuccagcugagagcugauaucauuacuggcaggcugccuuguagcuucguuacccaugcccucuuagguuccuaugcagugcaagcugaacugggggacuacgacgccgaggaacacgucggaaauuacgugucagagcuucgguuugcgccaaaccagacacgcgaauuggaggagagaaucauggaacugcacaaaacuuauaggggcaugacccccggcgaggccgaaauacauuuccuagagaaugcaaagaaacucaguauguacgggguagaucugcaccaugcuaaggacagcgaaggaaucgauauuaugcuugguguuugcgccaacggccuguugaucuaucgggaccgccuccgaauuaauagauuugcuuggccuaaaauccugaagauaucuuacaagagguccaacuucuauauuaaaauccggccaggggaguacgagcaguuugaaucaacaauuggauucaaguuacccaaucaccguagcgccaaacgccuguggaagguguguaucgagcaccauaccuuuuucagacucgucaguccggaaccucccccaaaaggcuuccuugugauggguucuaaguuuagguauuccgggcggacgcaagcacagacucgacaggccagcgcucugaucgaucgcccugcgcccuucuuugagagaucgucuuccaagagguacacaaugucacggaguuuggacggagcagaguucagccgcccagccuccgugucugaaaaccacgaugcuggccccgacggcgauaaaagagacgaggauggggaaagcggaggucagaggucagaggccgaagagggcgagguccguaccccuacuaagauuaaagaacuaaagccagagcaagaaacaaccccgcggcauaaacaggaguuucuggacaagcccgaagacguucuccugaagcaccaggcaaguauaaaugagcuuaaacgaacgcugaaggagccuaacuccaaauugauccauagagauagggacugggaacgcgagcggagacucccaagcucucccgccucaccuaguccaaaggggacccccgaaaaagcuaaugagagggccggacugcgcgaaggcagcgaggagaaggugaagccgccucgaccacgggcacccgaauccgauacaggugacgaggaucaggaccaagaacgugauacuguauucuuaaaagacaaccaccuggcgauugagagaaaguguucuucgaucaccgugagcuccacaucaagucuagaggcugaagucgauuuuacugugauaggggacuaccacggcucugccuucgaggauuuuagcaggucccucccugaacuggaccgcgauaaaucagacagcgacaccgagggacuuuuguucucucgggaucugaacaagggcgcacccucccaggacgaugaaagugggggaauugaggacagcccagauagaggugccugcucuacaccugacaugccccaguuugagccaguuaaaaccgaaacuaugacgguguccucacucgcuaucaggaagaaaaucgagccggaagccguccugcagacacgagugagugcaauggauaauacccaaguagacggcagcgcuucgguugggcgcgaguucauugccacuaccccuuccaucacaaccgaaacuauuucuacaacgauggagaacagccuuaagucaggaaagggcgcggccgcuaugauacccgguccacagaccguggcaacugagauccggagucugucccccauuaucgggaaagaugucuugacaucuaccuauggcgccacagcugaaacucucagcaccuccacgaccacacaugugacuaagaccgucaaaggaggcuuuucagagacaagaaucgaaaagaggauuauaaucacuggggacgaggauguggaccaggaucaggcccuggcauuagcgauuaaagaagccaagcugcaacacccugacaugcuaguuaccaaggcugugguauaccgugagacggacccaagccccgaggaacgcgauaaaaagccucaggagaguuga

SEQ ID NO: 55812 - RNA, 2022 nt, Artificial Sequence
  derived and/or modified sequence opt3 from EPB41L2__Homo_sapiens__NP_001129026
augaccacagaggugggcagcgucuccgaaguuaagaaagacucuucacagcuggggacugaugccacgaaggagaaacccaaggaaguggcugagaaccaacagaaucagaguagcgacccugaagaggagaaaggaucccagccaccgcccgcagccgaaucucaaucgucacucagaaggcagaagcgggagaaggaaaccagcgagagucgcgguaucucccgauucauuccuccauggcuuaaaaagcagaaaucuuacacacugguaguggcgaaggauggcggggacaaaaaggagcccacucaggcugucguggaagaacaaguuuuggauaaggaagaaccuuuaccagaggagcagcgucaggccaaaggagacgcagaggaaauggcccagaagaaacaagagauaaagguggaagucaaagaggaaaagcccagcguguccaaagaggagaagccuucaguaaguaagguugaaaugcagccaaccgagcuggugagcaaagaaagagaggaaaaggucaaagagacacaggaggauaagcuagaaggcggugcugcaaaaagggagaccaaggaagugcaaacuaacgagcucaaggccgagaaggcuucucagaaggugaccaaaaagacaaaaacgguccagugcaagguuacucugcuugacgggaccgaauauuccugugaucuggagaagcacgccaaaggacagguguuguuugacaagguaugcgaacaucucaaucugcuggagaaagauuacuucggccucuuauuucaagaaucaccggagcagaagaacuggcuggaccccgcgaaagagaucaagcggcagcuucgcaauuugccuuggcuguucacauuuaacgugaaguucuauccacccgauccuagccagcuaacugaagacauuaccagauacuuucucugucugcaacuuaggcaggacaucgcaaguggccggcugccaugcucuuucgucacacacgccuugcucggguccuauacccugcaggcugaguuaggagauuacgaccccgaggagcaugguagcauugaucugucggaauuucaguucgccccgacgcaaacuaaagagcucgaggaaaagguggcagagcuucacaaaacacaucgcggccugucuccugcucaggccgacucccaguuuuuggaaaaugcgaagcgacuaucaauguaugggguugaucugcaccacgccaaagacagugagggaguggauaucaagcucggcgucugugcaaacggucugcuuauauacaaagacagacugaggaucaaucgguucgcuuggcccaagauuuugaagaucagcuacaaacguuccaacuuuuauauuaaggugcgcccagccgaacucgagcaguucgagucuaccaucggguucaaacugccuaaucauagagcugccaagagguuauggaaaguaugcguugaacaccauacuuuuuaccggcuggugagccccgagcaaccacccaaggcaaaguuccuaacacucggaucaaaauuucgauauaguggccgcacccaggcccagacgagacaagccuccacccugauagauaggccugcgccacacuucgaacggacaagcucuaagcgcgucucaagaagucuugacggcgcaccgauuggggugauggaucagagcuugaugaaagacuuucccggagccgcuggugagaucuccgccuacggcccugggcuggucucuauugcagugguucaggacggagauggcaggcgugaggugcggucgccaacuaaggcuccccaccuccagcugaucgaagguaaaaccguaaaagggggcaucagcgagacacgaauugaaaagagaauagucaucacuggagacggcgauauugaccaugaucaagcucuugcccaggcaaucagggaggcgcgcgaacagcacccugacauguccgugacccggguugugguccauaaagagacagagcuggcugaagagggggaagauuga

SEQ ID NO: 55813 - RNA, 2652 nt, Artificial Sequence
  derived and/or modified sequence opt3 from EPB41L3__Homo_sapiens__NP_001268462
augaccacagagagcggcuccgacucugaaucaaagcccgaucaggaggccgaaccucaagaggcugcaggggcccagggacgugcgggugcuccagugccggaacccccuaaagaggagcagcagcaagcccuggaacaguucgcagccgcugcagcccacaguacuccagucaggcgggagguuacggacaaggaacaggaguuugcugcccgcgcggcaaaacagcucgaguaccaacagcuugaagaugacaagcugagccagaaauccucuucgucaaaguugagccgaagucccuuaaagaucgugaaaaagccuaaauccaugcagugcaagguaauucugcuagauggcucugaguauaccugugacguggaaaaacguagcagagggcaaguccucuucgauaaggugugcgagcaucugaaccuucuggaaaaggacuacuuuggauugacauauagggaugccgagaaucagaaaaacuggcucgacccagcuaaggagauaaagaagcagguucgguccggcgccuggcacuucucauuuaaugugaaauucuaucccccugauccagcacaacugagugaagacaucacucgcuacuaccugugucuccaguuaagagaugacauugucagcgguaggcugccgugcucuuuugugacccuugcuuugcugggguccuauacaguacagucagagcuaggagacuacgaucccgacgaauguggcagcgauuacaucagugaguuccgguuugccccuaaccauaccaaggaacucgaggacaaaguuauugagcugcacaagucucaucgcggcaugacuccagcggaagccgagaugcacuuccuugaaaaugcaaagaaacuguccauguaugggguggauuugcaccaugcuaaggacagcgagggagucgaaaucaugcucggugugugcgccucgggccuguuaauauaccgagauagacugaggaucaaccgguuugcuuggcccaaagugcucaagauuucuuauaaacguaauaacuucuacaucaagauucgcccuggggaguuugagcaguucgaauccacaaucggauucaaacuuccaaaucacagagccgcaaaaaggcuguggaaggucuguguugagcaucacaccuuuuuccgguugcuacugcccgaagccccgccuaaaaaguuucucacgcugggcucaaaauuccgauauaguggucgcacucaagcucagaccagaagggcgagcgcacuuauagaccggcccgccccauacuuugagcgcuccucuagcaagagauauacaaugucaaggagucuggauggggcuuccgugaacgagaaucacgaaauuuacaugaaggacagcaugucugccgcagagguaggaacuggccaguacgccaccacaaaaggcaucucacagaccaacuugauuacgacugugacaccugaaaagaaagcugaggaagagagagaugaggaagaggacaagcggcgaaaaggggaagaggucacccccaucagugccaucagacaugaaggaaagacugacagcgagaggacagauaccgcagcggacggugagacgaccgcuacagaauccgaucaagaggaagacgccgagcucaaggcacaggaacuggagaaaacucaggaugacuuaaugaagcaccagaccaauauuucugagcugaaacgcacauuccuagaaacuucgaccgauacagccgugaccaacgagugggaaaagcggcucagcacuuccccaguuagacuggcugccaggcaagaggacgcacccaugauagagccucuugugccagaagagacgaaacagucaaguggcgaaaaguugauggaugggucugagaucuuuagccugcucgaauccgcucgcaaaccgacagaguucauuggaggcgucaccucaacuagccagucuugggugcagaagauggagaccaagacagaauccagugguaucgagaccgaacccacuguacaucaucugccucuuagcacagagaaaguugugcaagaaacgguccugguggaggagcgacgggucgugcacgccucuggggacgcguccuauucagccggcgauaguggagacgcugcagcccagccagcuuuuaccggcauaaaggggaaagaaggaagcgccuugacugagggugcaaaggaagagggcggggaagagguugcgaaagccgugcucgagcaggaagagacagcugccgcaucgcgugaaagacaagaggagcaguccgcugccauucacaucucugaaacccuggagcagaagccccacuucgaaagcucaacaguaaagacugagaccaucaguuuuggauccgucucuccuggcggugugaaauuagaaauuagcacgaaggagguuccagugguccauaccgagacaaaaacuaucaccuacgaauccucacagguggaucccgggacagaccuggagccgggcguacuaaugagcgcacaaacuauuaccagugaaacgacaucuaccacuacaaccacucacauaaccaagacagugaaaggaggcaucuccgagacgaggauugaaaagcgcaucguuaucaccggggacgccgauauugaccaugaucaggaguga

SEQ ID NO: 55814 - RNA, 2061 nt, Artificial Sequence
  derived and/or modified sequence opt3 from EPB41L4A__Homo_sapiens__NP_071423
augggcugcuucugugccgugcccgaggaauuuuacugcgagguccugcuccuugacgaaagcaagcugaccuugacaacucagcaacaggggaucaaaaaguccacgaaaggaucuguuguguuagaucacguauuccaucacgugaaccuggucgagauugacuauuuuggucuaagauacugugauaggucacaucagaccuauuggcucgacccugcuaagacacuggcagaacacaaagagcuuauaaauacuggcccaccguacacccuguauuucgggaucaaguuuuacgccgaggaucccugcaaguugaaagaagagauuacacgguaucaguucuuucuccaagugaagcaggacguucugcagggacgccugccuuguccagugaacaccgcggcucagcucggcgccuacgcaauccaaagugaauuaggugauuacgaccccuauaaacauacugccggguacgucagcgaguaucgauucgugccugaucagaaggaggaacuggaggaagcuauugagcguauccacaaaacacuuaugggacagauaccauccgaagcagaguugaauuaccugagaaccgccaagucucuagagauguauggcguagaccuccaccccguuuacggcgaaaacaagucggaguauuuucuggggcuuacgccugugggagucgugguguacaaaaauaagaaacaggucgguaaguacuucuggccaaggaucacuaaaguucauuuuaaggaaacccaauucgagcugcggguguugggcaaagauugcaacgaaacaucauuuuucuucgaggcucgcagcaagacugccuguaagcaccucuggaaaugcaguguagagcaucacaccuuuuucagaaugccggaaaaugaguccaacucucugagcaggaaguuauccaaauuugggucaauucgguauaagcaccgcuacaguggacgaacagcgcugcagaugagcagagaccucucuauccagcuucccaggccugaucaaaaugugacccggucccguucaaaaacguauccaaagcgcauugcacagacucagcccgccgaaagcaacaguaucucuagaauaacagcuaauauggagaacggcgaaaaugaggguaccauuaagaucauugccccuuccccagucaaaucguucaagaaagcaaagaacgaaaauagccccgacacucagaggucuaaaucccaugcuccgugggaagagaacgggccucaaucaggacuguacaacagucccagcgaccggacaaaguccccaaaguuuccuuauacccgacgcagaaaucccucuuguggcagcgauaacgacucagugcagccaguuaggcggcgcaaagcccacaauaguggcgaagauuccgacuugaagcagagaaggcguagccggucucgaugcaacacgucaagugggagcgaguccgaaaauucuaacagagaauacaggaaaaagcgcaaucggaucagacaggagaacgauaugguggacucggcgccccaaugggaagccguccuaaggcgccagaaagagaagaaucaggcagauccuaacaaucgacggagccgucauagauccaggucacgcaguccagacauccaggcuaaggaggagcuguggaaacacauucaaaaggagcucguggauccgucuggacugagcgaggagcagcuuaaagaaauacccuauaccaagaucgagacacagggugacccuauucggaucagacauucccacucaccaaggagcuaccgacaguaccgccggucucaauguuccgauggcgaaagaaguguacugagcgagguuaacucuaaaacugacuuggugcccccucucccagucacccacuccucagacgcccaggggaguggagaugcuacagugcaucagaggcguaauggcagcaaggacucgcugauggaggaaaaaccccaaacuuccaccaacaauuuagccgguaagcacacagcaaagaccauaaaaacuauucaggccucucgccugaagacggagacauga

SEQ ID NO: 55815 - RNA, 1557 nt, Artificial Sequence
  derived and/or modified sequence opt3 from EPB41L4B__Homo_sapiens__NP_060894
augcugagauuccucaggcggaccuuuggccgccgaagcaugcagcguuacgccagaggggcugcaggaaggggugccgcgggccuuggggacgagcgggauggaggcccccgcggugggccugcugccgcagccuccucuucagcucugccagcagccccgggaggcaguguguuccccgcuggcgggggaccuuuguuaacagguggcgccgcgguccacaucagcgcagccggggcugccaaggcaacucuguauugcagaguuuuucuacucgacggaacggaaguguccguagaucugccaaaacaugcuaagggccaagaccuuuucgaucagauuguguaccaccuggacuuggucgagaccgauuauuuuggucuccaguuccuggacucugcccagguggcgcauuggcuggaucacgccaaacccauaaagaaacaaaugaagaucgggccugcauacgcucuccauuuuaggguuaaguauuacucgucagaaccaaacaauuuacgggaggaguucacacgcuaucuguuugugcuucaguugcgacacgacauucugagcggaaaacuaaagugucccuacgaaacugccgucgagcucgcugcccugugccuucaggcagaacugggcgagugugaauugccugagcacaccccagagcucgugagugaguucagauuuaucccgaaccagacagaagccauggaguucgauauuuuucaaagguggaaagaaugccggggcaagucccccgcucaggcggaacugucuuacuuaaauaaagcaaaguggcuggagauguaugggguagacaugcauguugugcguggacgcgaugguugugaguacagccucggccuuaccccuacugggauccugauauucgaaggagccaacaagaucggcuuguucuuuuggccaaaaauuacaaagauggacuucaaaaaguccaaacuaacccuggucgugguggaggacgaugaccaggguagagaacaggagcacacguuugucuucaggcucgauucagcucggacuugcaagcaucuguggaaaugugccguugaacaccacgcauuuuuccgacuucgcacccccgggaauaguaagagcaacagaucugacuuuaucaggcugggcucccgguuccgcuuuucaggaagaacagaguaucaagccacucauggcagcagguugcgucggaccaguacauucgagcgaaagccuucuaaaagauacccauccaggcgccacagcaccuuuaaggcuucgaaucccgugauugccgcacagcucugcucuaaaacgaacccggaaguacauaauuaucagccucaauaccaccccaacauccauccaucccagccucgguggcacccccacucaccaaaugugagacccaguuuccaggaugacaggagccauuggaaggcguccgcuucuggggaugacagccacuuugauuauguccaugaccagaaccagaaaaaucugggagguaugcaaucaaugauguaccgcgauaaguuaaugacugcccuguga

SEQ ID NO: 55816 - RNA, 2076 nt, Artificial Sequence
  derived and/or modified sequence opt3 from EPB42__Homo_sapiens__NP_001107606
augggccaggcccuggggaucaagagcugcgacuuccaagcugcaagaaacaaugaggaacaccauaccaaagcccucuccucuaggcggcuuuuugugcgccgaggacagcccuucacaauuauacuguacuuucgugcgccugucagagcuuucuugccagccuuaaagaaaguugcacugacugcccagacgggugagcagccgucaaagaucaacaggacccaagcuacauuucccauuaguagccuaggcgaucggaaauggugguccgcagugguagaggaacgcgacgcccagucuuggacuaucucggugaccaccccugcugaugccgucauugggcacuauucacuccugcuucaggugagcggaagaaagcagcuguugcucggccaauucacacugcuguuuaauccauggaacagggaagacgcgguuuuccucaagaaugaggcacagcggauggaguacuuacugaaccagaauggucuuaucuauuuggggacugccgauuguauacaggcugaaaguugggacuuuggacaauucgagggcgaugugaucgaccugucccuacgccuccugucuaaagauaagcaggucgaaaaauggagccagcccgugcauguagcccgaguucuuggcgcacuguugcacuuucucaaggagcaaagagugcugccuacaccacagacccaggcuacgcaggagggggccuuacugaacaaaaggcggggauccguccccauucuccgucaauggcuuacuggucgcggcagaccuguguacgacgggcaggcgugggugcuggccgcagucgcuugcaccguuuugaggugucuaggaaucccagcccgggugguaacaacuuucgcuucagcccagggcaccggugggcgacugcucauugaugaauauuacaaugaggaaggacugcagaacggcgagggccaacgcgggagaaucuggauauuucagacaaguaccgaaugcuggaugacgaggccggcacuuccccagggauaugacgguuggcagauucugcauccuagcgccccaaauggcgggggaguguugggcucuugugaucucguccccgugcgggcuguuaaggaggguacucugggguuaaccccugcgguguccgaccuguucgcagccaucaacgcuucaugcgucguguggaaguguugcgaggacggcacacuagaacucacugauagcaauacaaaauacguaggaaacaauauuaguaccaagggcguugggucugaccgcugugaggauaucacgcaaaacuacaaauauccagaaggaucccugcaggagaaggaagugcuugagagagucgagaaagaaaagauggagagggaaaaagacaacgguauccgucccccgagcuuggagaccgccucgccucuguaccuccugcuuaaggcacccucuucccugccauugcggggcgaugcccagauuucagugacacucgucaaucacagugaacaggagaaggcugugcaacuggccauagggguucaggcagugcacuauaacggaguauuagcggcuaaacuguggcgaaagaaacuacaucucacucugagcgccaaucuugagaagaucauuaccaucggcuuguucuuuuccaacuucgaaagaaauccucccgagaacacauuucugaggcucacugcaauggccacccacucugaaagcaaucugucaugcuucgcucaggaggacauagccauuugucgcccacauuuagcaaucaaaaugcccgagaaggcugaacaauaccagccucugacagccagugucucccuucagaacagcuuggaugcgccaauggaggacugcgugaucucuauucucggucgggggcugauccacagagaaaggucauaucgcuuucgaaguguuuggccggagaauaccaugugcgccaaguuccaguuuacucccacgcacgugggccuacaacggcugacagucgaaguggauuguaacauguuccagaaucucaccaacuacaaaagcguaacugugguugcuccugagcuguccgcauga

SEQ ID NO: 55817 - RNA, 2442 nt, Artificial Sequence
  derived and/or modified sequence opt3 from EPC1__Homo_sapiens__NP_001258933
augagcaagcuguccuucagagccagggcucucgacgcaucuaaaccccuuccuguguuucggugcgaggaucugccagacuugcacgaauacgccucaaucaaccgcgcggucccgcagaugcccaccggcauggagaaggaagaggaaagugagcaucacuuacaacgagcuauuagcgcccagcagguuuauggggagaaacgugauaauauggugauaccuguaccagaagcagaguccaacaucgccuacuaugaaucuauuuaccccggagaguucaagaugccuaaacagcugauccauauucaaccauuuucgcuagacgcugagcagcccgauuaugaccucgauucagaagacgagguguucgucaauaagcugaagaaaaagauggauaucuguccucuucaguuugaagagaugauagacagacuggaaaaagguagcggccagcaaccagugaguuugcaggaggcaaagcuccugcugaaagaggaugacgaacucaucagggagguuuacgaauauuggauuaagaagcggaaaaacugccgcgggccguccuuaauccccucugugaagcaggagaaaagagauggaagcuccacaaaugacccuuacgucgccuucaggcggcgcacugaaaagaugcagacgcgaaagaacagaaagaaugacgaggcuucauacgagaaaaugcugaaacuuaggcgggauuugagucgugccgugaccauucuggaaaugaucaagcgcagagagaaaagcaagagggaacuacuccaccugacacuugagauaauggaaaaacgguauaaccugggcgacuacaauggugagauuaugucugagguaauggcgcaacgacagccaaugaagcccacuuaugcaaucccuauuaucccaaucaccaacuccucacaguuuaaacaucaagaagccauggauguuaaggaguucaaggugaauaaacaggacaaggcugauuugauucgccccaaaagaaaguacgaaaagaaaccgaagguccucccuagcagugccgcagcuacaccccagcagaccucuccagccgcgcugccuguguuuaacgccaaagacuuaaaucaauaugauuuccccuccagcgacgaggagccacugucucaggugcucucgggguccucagaagcagaggaagauaacgaccccgauggaccuuuugcuuucaggcggaaggccggcugucaguacuaugcuccacaccuugaccagacuggcaauuggccguggacaagucccaaagacgggggacugggugauguccgcuacagauacugcuugaccacgcuaacuguuccucaaagguguauaggcuuugcccgucggcgaguggggagaggaggcaggguacugcucgaccgcgcacacagcgauuaugacuccguguuccaucaccuggaucuugagaugcugucuagcccacagcauucacccgucaaccaguucgccaacaccagugaaacaaauacuuccgacaagagcuuuucuaaagauuugucacagauccucgugaacauuaagaguugccgguggagacacuucaggccucgcaccccaagccugcacgacuccgauaaugacgaguuaucuugucgaaagcuguaccggucgaucaaccguacagguaccgcucaacccgggacgcagacuugcagcacauccacccagucaaaaaguucuagcggauccgcgcauuuugcauucacugccgagcaguaucaacagcaccagcaacagcuagcucucaugcagaagcagcaacuggcccagauacagcagcaacaggcaaauucaaacagcucuacaaauaccucccagggcuuuguuaguaaaacgcuugauagcgccucugcucaguucgccgcauccgcguuggugaccucagaacaacugaugggcuuuaagaugaaagacgaugucgugcucgggauuggaguaaacgguguucugccggcuaguggcguguacaaggggcuucaucugagcucgacaacuccuaccgccuugguccacacauccccaucuacugcaggaagcgcccuccugcagcccucaaauaucacccagacaaguuccucucauagcgcuuuaucccaccaagugaccgccgcaaacucagcuacuacgcagguccugaucggcaauaacauuagacuaacagugccuagcaguguugccaccguaaauucuaucgcgcccauuaacgccaggcacauaccacgcacucucuccgcugugccuagcucggcacugaaacuugccgcugccgcaaauugucaggucucaaaggugcccucuaguuccagcguugacucugugccacgggagaaccaugaaagcgagaagccggcguugaacaauaucgccgacaacaccgucgcuauggaagugacauga

SEQ ID NO: 55818 - RNA, 2424 nt, Artificial Sequence
  derived and/or modified sequence opt3 from EPC2__Homo_sapiens__NP_056445
augagcaagcuguccuucagagccagggcucucgacgcagccaaaccccuuccuaucuaccggggcaaggauaugccagaccugaacgauugcgugucuauuaaucgcgcggucccgcagaugcccaccgggauggagaaagaagaggaaucagagcaccauuugcaacgagcuauaagugcccagcagguuuuucgugaaaagaaagagagcauggugaucccuguaccagaggcagaauccaacgugaauuauuacaacagauuauauaagggagaguucaagcagcccaaacaauuuauucacauccagccuuucaaucuggacaacgaacagccagauuacgacauggauucugaggacgagacacuacucaauaggcugaaccggaagauggaaauuaaaccccuucaguuugagaucaugauagaucgccuggaaaaggccucgucaaaucaauuggucacucuccaggaggcuaaacugcugcucaacgaagacgauuauuuaaucaaggcaguguacgacuauuggguuagaaagaggaaaaauugucgggguccuagccugauuccacagaucaagcaggagaaacgcgauggcaguacgaacaaugacccguacguggccuuccgaagaaggaccgagaagaugcaaacacggaaaaaccguaagaaugacgaagccuccuacgagaaaaugcuuaaguugcgcagagaauuuucuagggccauuacuauccuggagaugauaaagcggcgagaaaagaccaagcgcgagcuacuccaucugacacuugaggucguggagaaaagauaucaccugggggauuacggaggcgaaauuuugaacgaaguaaagaucagcagguccgagaaagaacucuaugcgacccccgcaacucugcauaacgguaaucaccacaagguucaggagugcaagacaaaacauccucaccauuuaucacugaaggaggaagccagugacgugguccggcagaaaaagaaauacccaaagaagcccaaagcugaggcccucauuaccagccaacagccuacgccagaaacucuucccgugaucaacaagucugauaucaaacaguaugacuuccacuccucagaugaggacgaguuuccucaggugcugagcccggucagugaacccgaggaagagaaugauccagacgggccuugugcauuccgcagaagggcuggaugccaauacuaugcuccccguuuggaucaggcgaaccacucuugugaaaauuccgagcuagccgaccuggauaagcuccgguaccgacauugccugaccacacuuacuguuccaagaagguguauuggcuuugcacgccggagaauaggccgcgggggaagggugaucauggaccgaauuagcaccgagcacgaccccguacugaaacagaucgauccugaaauguugaacucguucucuuccucaagucagacaauagacuuuagcuccaauuucucucggaccaacgcuagcucaaagcauugcgagaaucgucucagucuguccgaaauuuuaagcaacaucagaucuuguaggcugcaaugcuuccagccacgccuacucaaucugcaggauucagacagugaggaauguacgagccggaagccgggucagacugugaacaauaaaagagucuccgccgcuucuguggcccuuuugaacacaucgaagaauggcaucagcguuaccgggggaauuacugaggagcaauuucagacacaccagcagcaacuggugcagaugcagaggcaacagcucgcacagcugcagcaaaaacagcagucccagcauucaagucaacagacccaccccaaggcccagggcucuagcacguccgauugcaugucaaaaacccuugacagcgcuucugcgcacuucgcagccuccgcugucgugagugccccuguaccaagccgaucugaaguugcaaaggagcagaacacaggucauaacaauaucaacggggugguccaacccuccggaacuucaaaaacccuguacaguacaaauauggccuugagcucguccccuggcauuucugcugugcagcucguccgcacugugggccacaccacaaccaaccaucugauaccagccuuaugcacuagcucaccccagacgcugccgaugaauaacaguugucuaacaaaugcaguucaccucaacaauguguccguagucucuccugugaacguucacaucaauacccggacuagcgcgccaucccccaccgcucugaaacuugccacaguggcagccucaauggauagagucccuaaggugacccccagcagugcuauuucuuccaucgccagggaaaaccaugagccagaacguuuggggcugaauggaaucgcagagacuacaguagcuauggaggugacguga

SEQ ID NO: 55819 - RNA, 945 nt, Artificial Sequence
  derived and/or modified sequence opt3 from EPCAM__Homo_sapiens__NP_002345
auggcucccccucaggugcuggccuucggccuccuucuggcagccgcgaccgcuacauuugccgcagcccaagaggaaugcgucugugagaacuacaaguuggcuguuaauugcuucgugaacaauaacagacagugucagugcacuagcguaggggcacagaauacggugaucuguuccaaauuagccgcuaagugccuggucaugaaagccgaaaugaacggaucuaagcuagguaggcgggcgaaaccagagggcgcacuccaaaauaacgacgggcuguaugauccggacugugaugaaucaggacuuuuuaaggccaagcagugcaauggcaccaguauguguuggugcgugaacacagcugguguucgccgaacugacaaagauaccgagauuacauguagcgagcgugugagaaccuacuggauaaucauugaacugaagcacaaagccagggagaagcccuaugacuccaaaucuuugcggacugcacuccagaaggaaaucacaacccgcuaccagcuggauccuaaguucauuacgucgauccuguaugagaauaacgucauaacuaucgaccucgugcaaaauucaagccagaaaacccagaacgauguagacauugcugauguugccuacuauuuugagaaggacgugaaaggggaaaguuuauuccauuccaagaaaauggaucugacagucaauggagagcagcuugacuuggacccaggccaaacucugaucuacuacguggaugaaaaggcgcccgaguuuucuaugcagggccuaaaagccggggugauugcagucaucguugugguagugauagcugucguggccggaauuguugugcucgucaucagcagaaagaagaggauggcuaaauaugaaaaggccgagauuaaagagaugggugaaaugcaccgggagcugaacgcauga

SEQ ID NO: 55820 - RNA, 675 nt, Artificial Sequence
  derived and/or modified sequence opt3 from EPDR1__Homo_sapiens__NP_060019
augcccggcagagccccucugaggaccgugccaggggcucucggagcauggcuucuggguggcuugugggccuggacauuaugcgggcuguguagccuaggagcggucggcgcuccgcggcccugccaggccccucaacagugggagggucgccagguuauguaccagcaauccucugggcgaaacucacgugcacuccugaguuaugacggacuuaaucagagagugaggguacuggaugaacggaaggccuugaucccauguaaacgccucuucgaguacauucugcuguauaaggacggcgugauguuucagauagaucaggcuacuaaacaaugcagcaagaugacgcucacccagcccugggacccuuuagauaucccacagaacuccacauucgaagaccaguacucuauuggcgggccccaagagcagaucacuguccaggaauggucggauagaaaaucagcaaggagcuaugagaccuggauuggaaucuacacagugaaggacuguuauccuguucaagagaccuuuacuauaaauuacagugugauccuguccacacgguucuuugauauucagcuugguaucaaggacccaucugucuucaccccgcccagcacgugccagauggcccaguuggagaaaauguccgaagauuguucaugguga

SEQ ID NO: 55821 - RNA, 7740 nt, Artificial Sequence
  derived and/or modified sequence opt3 from EPG5__Homo_sapiens__NP_066015
auggccgaagcugugaagccccagcgaagggcaaaagccaaggcgagccggaccaaaacuaaggagaagaagaaguacgaaacuccucaacgcgaagaauccucugaaguaucacugccaaaaacgagucgagaacaggaaaucccgagccucgcuugcgaguucaagggcgaccaccuuaaaguugugaccgauucccagcugcaggacgaugccucugggcaaaacgagucggaaauguuugacguacccuugacuucauuaacuauuagcaaugaggagagucugaccuguaacacagaaccuccaaaggagggaggugaagcacgucccugcgugggagauuccgccgucaccccuaaagugcauccaggggacaauguuggaacuaagguggagacacccaagaacuucaccgaagucgaggagaauaugucugugcagggcggucugagcgaauccgcuccucagucaaacuuuaguuauacgcagccagcaauggagaauauacaaguaagagaaacucagaacagcaaagaggauaagcaggggcucguuuguucuuccgaagugccgcagaaugucggacugcaaucaagcugccccgccaaacacggcuuccagaccccuagggugaagaaacuuuacccacagcugcccgcugagaucgccggcgaggcgccugcauugguggccgucaagccacuccugcggagugaacgccuguaccccgagcucccgucucaauuagaacugguuccuuuuacaaaagagcagcuuaagauuuuggaacccggguccuggcuggagaacguggagagcuaccuugaagaguucgacucgauggcucaucaggauagacacgaauuuuaugagcuccugcuuaauuacucuaggugucggaagcagcuguugcucgccgaggcagaacuguuaacucugaccuccgacugccaaaacgcuaaaucacgccucuggcaguucaaggaggaacagaugaguguacagggaaucugugccgaucaagugaaagucuuuagcuaucaucgauaccagagaguggagaugaaugaaaacgcgcuuguugagcugaagaaauuguucgacgccaaguccgagcacuugcaccagacacuggcacuccauucuuacaccagcgugcugucaaggcuucaggucgaaaguuauauuuacgcucuguuguccagcucugccgugcuccggucaagugcuauccaccaacagggucgugccagcaagcagacggaguccauaccaucugaucugugccaguuaaaagaauguaucucgguacuguuuauguucacucgcagaguuaaugaggacacacaauuucaugacgauauucugcucuggcugcagaaacuugugagcgucuugcagagggugggcugcccuggggaccaccuguuccuccugaaccacauccuucggugucccgcaggagucuccaaaugggccgugccauucauucaaaucaagguucugcauaaccccucaggcguguuucacuucaugcagaguuuggcucuccugaugucuccugucaagaaccgagcggaauuuaugugccauaugaagccaagcgagcgcaagccguccucaagcggucccgggucuggaaccuggacuuuagucgaugagggcggcgaagaggacgaagauccugagacauccuggauacugcugaacgaagacgaucucgugaccauucuggcacaguucccauuucacgagcuuuuccagcauuugcugggguuuaaagccaagggagacuaucuccccgagacgaccagaccucaagaaaugaugaaaaucuucgcuuuugccaauagucugguugaguuacuggcagugggucuugaaacauucaacagggcccgguaccgccaguuugucaagagaauuggcuauaugaucaggaugacuuugggguacgugagcgaucacugggcucaguauguaucucacaaucagggauccggccucgcccaacagccauacucaauggagaaacuacagguggaguucgacgaacuauuucugcgugcaguucuccauguccugaaggcgaagcggcuugguaucugguuguucaugagugagaugcccuucgggacccugagcgugcagauguuauggaaacucuuuuaccugaugcaccaaguggaaucggagaaccuucagcagcuguccucuagcuugcaaccggcucagugcaagcagcagcuccaagauccugaacauuucacaaauuuugagaaaugucugucaaguaugaacuccucugaggaaauuugccuacugacuaccuucgcccagauggcacaggcccgaagaacaaaugucgacgaggacuuuauaaagaucauuguucucgaaaucuaugaggugagcuacgugacccuguccacuagggaaacguucucaaaaguaggccgcgagcuuuugggaacaauaaccgcuguccacccagagauuaucagcgugcuguuagaucggguucaggaaacuaucgaccaagugggcauggucagucucuaucuguuuaaggagcuuccccuguaccuauggcagccuucugccuccgaaauugcagugaucagagauuggcuccugaacuauaauuugaccguugugaaaaacaagcuggcuuguguaauuuuagaggggcucaauuggggauucgccaagcaggcgacacugcaccuugaccaggccguccaugcugaaguggcacugaugguguuggaggccuaccaaaaauaucucgcucagaagcccuacgccgguauacugagcgagucgaugaaacaggucucauaccuagcaucuaucguuagguauggcgaaaccccagagacaaguuuuaaccagugggcguggaaucugauucuucgccucaagcugcacaaaaacgauuacgggauccaaccuaacugccccgccgugccauucuccguaacagugccggacaugacggaaagcccuaccuuucaucccuugcugaaggcugucaaggccggaaugccaaucggcuguuauuuagcacucucuaugacugcugugggucacagcauugagaaauucugcgccgaggggauaccccugcuuggcauccugguucagucccgacauuugcggacagugguccacgugcucgauaagauucugccucuauuuuacccaugucaguauuaccugcuuaaaaaugaacaauuccucucacaccuguuguuauuccugcaucucgacaguggaguuccccagggcgugacccagcaggucacacacaagguagcacaacaucugacuggggccagccacggagauaacgugaaacuucuaaauucuaugauccaggcucauauuuccguuucaacccagccuaacgagguggguccggucgcgguguuggaauuuuggguacaggcccuaaucagucaacaccugugguaucgugagcagccaauacucuuccugauggaccaccuuugcaaggcagcuuuucaguuaaugcaggaagauuguauccaaaagcugcucuaccagcagcauaaaaaugccuugggcuaccacugcgacagaagccugcucuccucucuggugucguggauugucgccgggaacaucacgcccagcuucguugagggacuugcuaccccuacacaagugugguuugcauggacugugcugaauauggagucaauuuucgaagaggauucccaguugaggcgcgucaucgaaggcgagcuagugauaaacagugccuuuaccccagaccaggcgcugaagaaagcucagacacaacucaaguuacccauuguuccuucucugcagcggcuucugaucuauagaugggcccaucaggcacucguaacuccgagcgaccaccccuugcugccacucauuuggcagaaauucuuucugcuuuaccuacacaggccugguccccaauaugggcugccaaucgauggcuguauaggacgacgcuucuuucaguccccugcccauaucaauuuguuaaaggaaaugaagcggagacugaccgagguggcugacuuccaccaugcagccucaaaagcgcucaggguccccgcugagggcucugaagggcugccagagagccacaguggaacgccgggcuaccuuacauccccugaacugcauaaggagcucgugcguuuguucaacguuuauauucuguggcuagaagaugagaauuuucagaaaggugacaccuacauccccagccugccaaagcacuaugauauucaccgccucgccaaagugaugcagaaccaacaggaccuuuggauggaguaccugaauauggaacggaucuaccaugaguuccaggaaacugucggguuauggacacaggcaaaguuggagucucacucaacccccugcucccugagugugcaacucgauuuuacugacccucugcuugccaaagagagaguacugagcaaccucaggaagcaugaagcuccacagcccccuuuggcccugcacccgaccaagccacccgucccugugauaucgucugcaguuuuacuaucccagaaagaugcuacacaacuggugugcacggaccucaaucuucugcagcagcaggcccgaaccgcggccuugcgggagagccaacaggucgcacuggauggagaacuccuggacacuaugcccaagcaguaugugaaccgcgaggaacagacaacccuucaccucgaguguagaggcucaagugguaaaaagugccaaggcgcugccguugugacaguccaguucgaggggaugcauaaaaacgaagcuauuucucagcagcugcacguguugaggaaggagguaaagcaacugcaggcagaagccgccaaaccaccuuccuuaaauaucguggaggcugcgguucaugcagaaaaccuaaucacugcccuggucaaugcuuacaagcuccagcccaccccaggcauucaaaaagugggcaucagccuauuuuucacgauuguggauuaugucucagacgagacacagcggcacccuccgacccgacaguuuuucacaaguuguauagagauccuggggcagguauuuauuagcggaaucaaguccgaaugcagaaaaguguuggagaccauucugaagaacucucgccucuguagccugcuuucccccuucuuuacaccaaaugccgccccugcagaguucauccaauuauacgagcagguugugaaguuucugucagaagacaacucugauaugauauucaugcucuugacuaaauucgaccugaagcaguggcuaagugcuaccaaacccccacugucggauaggacacgucuccuugagagcauccaucuggcguugacggccuggggccuggagccugacgaagauauucucaugcccuuuaaucuguucugcaagcacuggaccuauuuacuucuguaccaguuuccggaccaauauuccgauauccuccggcuacugaugcagucuucagcagagcaguugcugagcccagaauguuggaaagcuacucucagagcccuugguugcugugcaccuuccugccagcaaggggccgcuaguacagagggagccguccugcccucuagcucagacgcguugcuguccgauaaacaggugauggagaccauucaguggcucagugacuucuuuuacaaguuaaggcugagcaaaauggauuucaagucuuuuggccuuuucuccaaauggucaccauacauggcagacguuaagacuuuucuggguuaucuagugaaacgccucaucgaccuggaaaugacauguuuggcccaagaucccaccgcuagccgaaagacgguccugaagucgcuccacucugugauaauucagcuuuucaaaccuuggauccugguauuagaggacaacgaaaguucccagcagagacauuacccguggcuggagagcgauacugugguugccucauccaucguccaauuguuuaccgacugcauugauucucuccacgagagcuucaaggacaaacugcuacccggcgaugcuggggcacuuuggcugcaucucaugcacuauugcgaggccuguacagcuccaaagaugccugaguuuauacuguacgccuuccacaguaccuaucggaaauugcccuggaaggaccugcauccugaucagaugcucauggaagcauucuuuaaaguggagaggggauccccaaagagcugcuuccuuuuucugggcucuguguuaugugaagucaauuggguuucagugcugagugacgcguggaacuccagcccccacccugagacucgcucuaugaucguaugccuacucuucaugaugauucugcuagccaaggaagugcagcuugucgaucagacagacucgccacugcucucacuguuggggcaaaccagcuccuuaaguuggcaucugguggauaucguuucuuaccagagcgugcucuccuauuuuucaagucacuaucccccgucuauuauccuugcuaaagagagcuacgccgagcugauaaugaagcuacugaaagucuccgcaggacucucaaucccuacagacagccagaagcauuuggacgcuguaccaaaaugucaggccuucacucaccaaauggugcaguuucugucuacccuugaacagaauggcaagauuacgcuggcaguucucgagcaggaaauguccaaguuacuggaugacaucauuguguucaaucccccugauauggacagucaaacacgucacauggccuugagcucgcuguuuauggagguccucaugaugaugaauaacgcuaccaucccaacugcggaguuccuuagagguuccauacggaccuggauugggcagaaaaugcauggacuggugguccuaccccugcucacagccgcaugccagucuuuggcuucagugaggcacauggccgagacuaccgaggccuguaucacggcauauuuuaaggaaagcccgcugaaucaaaacaguggcugggguccuauccuuguuucccuacaggugcccgaguuaacaauggaagaguuccuccaggagugccugaccuugggcucuuaccugacucucuauguauaccuucugcagugucuaaacagcgaacaaacacugcgcaaugagaugaaagugcucuugauucugucaaagugguuagaacaggucuauccauccaguguugaggaagaggcuaaacuuuuucugugguggcaucaggugcuccagcugagcuugauccaaaccgagcagaacgauucuguccugacugaaucagugauacggauucuccuucugguacaguccagacagaaucuaguggccgaggaaagacugagcucugggaucuuaggagcgauuggcuucgggaggaagaguccucucucgaaccgcuucagaguuguggcuagguccauggccgcauuucugagcguccaagugcccauggaggaccagauccgguugcguccaggaucagaacuucaccugacacccaaggcccagcaagcucucaaugcacuggagucuauggccagcuccaaacaguacgucgaguaucaggaucagauauugcaagcgacccaguucauucgccauccuggccacugccugcaggacgguaagaguuuucuagcucuccuugugaacugucuguacccagaaguucacuacuuagaucauauccgauga

SEQ ID NO: 55822 - RNA, 465 nt, Artificial Sequence
  derived and/or modified sequence opt3 from EPGN__Homo_sapiens__NP_001257918
auggcccugggcgugcccaucagcgucuaccuccuuuucaacgcuaugaccgcacugacagaggaagccgcgguuacugugacgccuccaauuaccgcucagcaagggaauuggacaguaaacaagacugaggccgacaauauagaaggaccgaucgcauugaaauuuucccacuuaugccuggaggaucauaacucuuauuguauuaauggugccugcgcuuuccaccaugaacuagagaaggcaaucuguagaugcuuuaccggcuacacaggggagaggugugaacaccucacccugacuucauaugccguggacaguuacgagaaauauauugcuaucggaauaggcgucggucuucuguugagcggguuccucgugaucuuuuacugcuauauucggaagcgcugucugaaacugaagucccccuacaacguuugcucuggagaacgacguccucucuga

SEQ ID NO: 55823 - RNA, 2931 nt, Artificial Sequence
  derived and/or modified sequence opt3 from EPHA1__Homo_sapiens__NP_005223
auggagagaagguggccccugggccucgggcuugugcuguuguuaugcgccccucugccaccgggagcucgggcaaaggaagucacccuaauggacacaagcaaagcccagggugagcucggcuggcugcuugaucccccuaaggacgggugguccgaacaacagcagauccugaacggaacuccauuguacauguaucaggauugucccaugcaaggccgccgagacacggaucacuggcuccguucuaauuggauuuacagaggugaggaagcgucaaggguucauguggagcugcaguucaccguacgggacugcaaaaguuuuccugggggagcuggcccacugggcuguaaggagacauucaaccucuuauauauggaaagcgaucaggacguggggauacagcugcgcagaccccuuuuucaaaaagucacuaccguggccgcagaucaguccuucacaaucagggacuugguuucuggaucggugaagcugaaugucgagcggugcucacuaggucgccucacccgaagaggccuguaccuugccuuucacaacccuggggcuuguguggcacugguaagcguuaggguguucuaucagcggugcccagaaacuuugaauggacucgcccaguuuccggauacacugcccggcccugcugguuuagucgagguggccgggaccugucugccacaugcgcgugcaaguccccgcccuuccggagccccaagaaugcacugcucucccgacggcgaguggcucgugccggucgggaggugucauugcgaaccuggguacgaggaaggagguagcggcgaggcuuguguugccugccccuccgggucauaucggauggauauggacacgccacacugccuuacuuguccucaacagaguaccgcagaaagcgagggagcuacaauuugcacuugugagucuggccacuaccgagcccccggugaagggccacagguggcgugcaccggcccuccuuccgccccacgcaaccugucauucagcgcaaguggaacacaauugucucuaagaugggagccgcccgcugacaccggcgggaggcaggauguacgguacuccgugcgcuguagccagugccagggaacggcccaagacgguggcccuugucagccaugcggggucggagugcauuuuucgcccggcgcuagaggucugacuacacccgccguucacgugaaugggcucgaaccauaugcaaacuacaccuucaaugucgaggcccagaacggcgugucuggacugggcuccucagggcaugcuaguacuagcguauccaucucuaugggacacgcggaaagccuuucaggucugaguuugaggcucguuaagaaagagccccgucagcuggaguuaacaugggcaggcucccggccgcgaagcccuggggccaaucugaccuaugaacuacacgugcucaaccaagaugaggaaagauaccagaugguccuggagccaagggugcuuuugacggaacugcagcccgacaccacauauauuguccgcgugcggaugcucacuccucugggacccggcccauuuucuccugaucaugaguucagaaccucacccccaguuaguaggggucuuacagggggcgagaucguggcuguaauauuuggacuguugcucggcgccgcacuguuacuggggauccuagucuuccgcagccgacgggcccagcgucaaagacagcagaggcagcgcgaccgggcuacugauguggacagagaagauaagcucuggcugaaaccguacguugaccuucaagccuaugaggauccugcacagggagcguuggacuucaccagggaacuggaccccgcuuggcucaugguggauacagucauuggcgagggugaguuuggggaaguguaccgaggaacccugcgcuuaccaucccaggacuguaagacuguagccaucaaaacgcugaaggauacaucucccggcggucaaugguggaauuuccuucgggaggcaaccauuaugggccaguuuucgcacccucauaucuugcaccucgaaggggugguuacuaagagaaaaccaauaaugauuaucaccgaguucauggaaaacggagcccuggacgcuuuucuaagggagcgugaggaucagcugguccccggccagcucguggccaugcugcaagggauugcaagcggaaugaauuaccuuuccaaccauaacuaugugcaccgcgacuuggcugcccggaauauccuggucaaccagaauuuaugcuguaagguuucagauuucggccucacaagacugcuugacgauuuugacgguaccuacgaaacucagggcggaaaaaucccuauuagguggacagcgccggaggccauagcucaccgaaucuucacgaccgcaagugauguguggucuuuuggcauugugaugugggaaguacugagcuucggugacaagccauauggcgagauguccaaccaggaagucaugaaaucaaucgaggauggguaccgguugcccccuccaguggacugccccgccccucucuaugagcugaugaagaauugcugggcuuacgaccgcgccagaaggccgcauuuucaaaaacuacaggcacaccuggaacagcuccuggcgaacccccauagccuucggacuauagccaauuucgauccacgaaugacauugagacugccuucuuuauccggaagugacggcauucccuaucgcaccguuagcgaguggcucgaaucuaucaggaugaagcguuacauccugcacuuucacuccgcugggcuugauacaauggagugugugcuggaacuaacugccgaggaccucacccagaugggaauuacgcugccaggccaucaaaagcggaucuugugcucaauucaggguuucaaagauuga

SEQ ID NO: 55824 - RNA, 2952 nt, Artificial Sequence
  derived and/or modified sequence opt3 from EPHA3__Homo_sapiens__NP_005224
auggacugccagcugagcauccuccuucuguuguccuguucuguguuagauucauucggcgagcugauuccccaaccuaguaacgaagucaaucuacucgacagcaagaccauacagggggagcugggauggaucuccuacccaucucacgguugggaagagauuucgggcguugaugaacauuauacaccgaucagaacuuaccaggugugcaacguaauggaccacucacagaauaacuggcuuaggacgaauugggugccccggaacagcgcccagaaaauuuaugucgagcugaaguuuaccuugcgcgauuguaauaguaucccucucgugcuggggacaugcaaagagacuuucaaccuguacuauauggaauccgacgaugaccauggaguuaaguuucgagagcaccaauucaccaaaauagauacaaucgcugcagacgaaucuuuuacccagauggaucucggcgaccguauuuuaaagcugaauacugagaucagagagguggguccagucaacaagaaaggguucuaccuugccuuucaggaugugggagcguguguagcuuugguuagcgugagggucuauuucaagaaaugccccuuuacagugaagaaucuggccauguucccugacaccgugccaauggacucccaaagucuagucgaaguucggggcucaugugugaacaauagcaaagaggaagaucccccucgcauguacugcucuacggagggcgaauggcucguaccaauugggaaguguuccugcaacgcaggauacgaggagagagguuuuaugugucaggccugcaggccgggcuucuauaaggcucuggacgggaauaugaaaugcgcaaagugucccccucauucaagcacucaggaagauggaaguaugaacugccggugugagaacaauuacuuucgcgccgacaaagauccacccucuauggcuugcacccgaccuccauccagccccagaaacgugaucucgaauauaaacgaaacaucugucauucuugacugguccuggccgcuggauacuggcgguaggaaggacgugaccuucaauaucauuuguaaaaagugcggguggaacaucaaacagugugagccuugcucacccaauguucgguucuugccacgucaauuuggacucacaaacaccacggugacugucacagaucuguuagcccacaccaauuauacuuucgaaaucgacgcggugaacggcguaagugagcugagcuccccuccccgccaguuugcagccguuucuauuacaaccaaucaggcugccccaagccccgugcucacgauaaagaaggauagaaccucaaggaacaguaucucccuuagcuggcaagagccugaacacccaaauggcauuauccuggacuacgaggucaaauauuacgaaaagcaggagcaggaaacaucuuauacuauauugcgggcacgagggaccaacgugacaauuucaagucuaaaaccggacacuaucuacgucuuccagauccgcgcuagaaccgccgcgggauacgguacaaauagcaggaaguuugaguucgagaccucccccgauucuuuuucgauuagcggcgaauccucacaagugguuaugaucgccauuagugcagcuguggccauaauccugcucacuguagucauuuaugugcugaucgggcgguucuguggauacaaaucuaagcauggcgcugacgagaagcgccuucacuuugguaacgggcaucugaaauugccuggccucagaacguauguugauccacacacauacgaagaccccacccaggccgugcacgaguucgcaaaggagcuggaugccacuaacaucagcauugacaaagucgugggagcuggcgaauuuggggagguaugcuccggaagguuaaagcugccuagcaaaaaggaaauaucaguggcgaucaagacccuaaaaguugguuauacagagaagcagcgucgggauuuccucggcgaagcaucuauuauggggcaguuugaccauccaaauaucauucgacuggagggagucgugaccaaauccaagcccgugaugaucgucacugaguacauggaaaacggcagucuugauagcuucuugagaaaacacgacgcccaauucacaguuauacagcugguggguaugcucagggggaucgcuucuggcaugaaguaucuguccgauaugggauacgugcaucgcgaccuugccgcacggaauauucugaucaacucaaauuugguauguaaggucagugauuuuggccucagcagagugcuggaggacgacccggaagccgcuuacacgacccgcgggggaaaaauuccuaucagguggacuucgccagaggccauagcauaucgaaaguucacauccgcgucugauguuuggagcuacgguauuguguuaugggaagucaugucauauggcgagcggcccuacugggagaugaguaaccaggacgugaucaaagcuguugaugaaggguaucgucugccucccccaauggacugcccugccgcacuauaccagcucaugcuggauugcuggcaaaaggacagaaauaacaggcccaaauuugagcagauuguguccauccuugauaaguugauacgcaauccaggaucucugaaaaucauuaccagcgccgcugcccggccguccaaccuccuguuagaccagucaaauguagauaucacaacuuucagaaccacgggcgacuggcugaacggugucuggaccgcacacuguaaggaaauuuuuacagggguggaguauagcaguugcgauacuaucgcuaagauaucuaccgacgauaugaaaaaggugggcgucacaguugugggaccucagaaaaagauuaucuccagcaucaaagcccuugaaacucaaucgaagaauggccccguaccaguguga

SEQ ID NO: 55825 - RNA, 2961 nt, Artificial Sequence
  derived and/or modified sequence opt3 from EPHA4__Homo_sapiens__NP_001291465
auggccggcaucuucuacuuugcucuguucagcugccucuuugggauuugugacgcagugaccggauccagagucuaucccgccaacgagguuacacuucuggauucuaggucagugcagggugaauugggcuggauagcgaguccuuuagaagggggaugggaagagguaagcaucauggacgaaaagaauacuccaauucggacguaccaagugugcaacgucauggagccgucccagaauaacuggcugcgcaccgauuggaucacacgagagggcgcucagcguguguauauugaaaucaaauucacucuaagagacuguaauucucuccccgguguuauggggaccugcaaggagacauuuaaccuguacuauuacgaaucggauaaugacaaagagagguucauacgggagaaccaguuugugaagaucgauaccauugccgcagacgaaucauucacucaagucgauaucggagaccgcauuaugaaacuuaauacagagaucagagaugugggcccucugagcaagaagggcuuuuauuuggccuuccaggacguaggggcuuguauagcacucguuagugugagggucuuuuacaaaaagugcccacugaccgugcggaaccuggcccaguuccccgauacgauuacuggagcugacaccuccucucucguggaaguccgcgguagcuguguuaauaacuccgaggaaaaagacgugccuaagauguacugcggcgccgauggggagugguuaguaccaaucggaaauugucugugcaacgcgggccacgaggaacgaucaggugagugucaggcaugcaaaauuggguauuacaaggcccuuaguacagacgcuacuugcgccaagugucccccucauagcuauucugugugggaaggagcaaccuccugcacaugugauagaggcuuuuucagggcugacaaugaugccgcgucaaugccaugcacccggccgcccagcgccccuuugaaccugaucaguaacgucaaugagacgucugugaaccuagaaugguccagcccacaaaauacuggcgggcgucaggacaucucguacaacguuguguguaaaaagugcggagcuggugaucccucuaaaugucgcccuugcggcuccgggguccacuauacaccacagcagaauggacucaagaccacuaaagugucaauuacagaccugcuugcacauaccaacuacacguucgagauaugggccguaaauggcguuaguaaguauaaccccaauccggaucaaagcguguccgucaccgugacaacuaaccaggcugccccuucuagcaucgcacugguccaggccaaagaggugaccagauacucaguugcuuuggcguggcucgaacccgacaggccaaauggugugauucuggaguacgaaguaaaguauuacgagaaggaucaaaacgaacggaguuaucgaaucguccgcacagcagccagaaauacugacauaaaaggguuaaacccucugaccuccuacguguuucacguuagggcucggacagccgcaggcuauggagacuucagcgagccccucgaggugaccacuaauacggucccaucucgcauuaucggcgauggggccaacucaacagugcuucugguaagugugagcggauccguugucuugguggugauccuaauugcugccuuugucaucucuagaaggcguucgaaguacagcaaagcaaagcaggaagcggacgaggaaaaacaucugaaccaggguguucggaccuauguggaucccuucacuuacgaggacccuaaucaggcugugcgagaguuugccaaggaaauugaugcauccuguauaaagaucgagaaaguaauuggcgucggggaguucggagaggugugcucaggcagacucaagguuccagguaaaagggaaaucuguguggccaucaagacccugaaagcuggguacacagacaagcaacgccgggauuuucuuagugaggccucuauuaugggccaguucgaccacccgaacauaauccaccuggagggagucgugaccaagugcaaacccguuaugauuaucacugaauauauggagaauggcagcuuggaugcauuucucagaaagaacgacgggagguucacagugauucagcugguaggaauguuacgcgguaucggcuccgggaugaaauaccugucagauaugagcuauguccaucgagaccuagcugcccggaauauacucgugaacucuaaucuggugugcaaggucuccgauuuuggaaugagucguguucuugaagacgacccugaggcggccuacacgaccagaggcgguaaaaucccaauuagguggacugcucccgaagcaaucgccuaucgcaaguucacaagcgcuucugaugugugguccuacgggauuguaaugugggaggugaugucauauggcgagcggccuuacugggacaugaguaaccaggaugucaucaaggccauagaagagggauacagauugccacccccgauggacuguccuauugcacugcaccaacucaugcuggauugcuggcagaaagaaaggagcgaccgaccaaaguuuggccagaucgugaauaugcuugauaaacugauucgcaaccccaauucguugaagcggaccgggacagaguccucuagaccuaacacugcgcuccuggaccccagcucaccagaguucagugccguuguguccgucggagauugguuacaggcuaucaaaauggacagguauaaggauaauuucaccgccgcaggcuacacgacccuggaagcugugguucaugugaaccaagaggaccuagcccguauagguaucacagcaauuacucaccagaauaaaauccucucuagcguccaggccaugcgcacccagaugcaacagaugcacgggcggaugguaccuguguga

SEQ ID NO: 55826 - RNA, 3117 nt, Artificial Sequence
  derived and/or modified sequence opt3 from EPHA5__Homo_sapiens__NP_001268694
augagaggcagcgggcccaggggagccggucggcgccgaccuccauccggcgggggagacaccccgaucacacccgcuucucuggcaggcugcuacucagccccucguagagcgccacucuggacuugucuucuguugugcgcugccuuaaggacgcugcuagcaagucccagcaacgaggugaaucuccuggauucccggaccgucaugggugaccuuggguggauugccuucccuaagaacggaugggaagagauaggcgaaguugaugagaauuaugcuccaauccacacauaccagguguguaaaguaauggaacaaaaccagaauaacuggcuguugacuucuuggauuucgaaugagggcgcaucacgcaucuuuauugagcucaaguucacccugagagacugcaacagccugcccgggggacucgguacauguaaagaaaccuuuaauauguauuacuucgagagugaugaccagaacggcaggaauaucaaggaaaaccaguauauaaaaaucgauacuauugccgcugacgaguccuuuacagaguuagaucugggggaccgggugaugaaacuuaauaccgaaguccgcgaugugggaccuuugucuaagaagggcuucuaccuggccuuucaagacguuggugcgugcaucgcgcuagugagcguccgaguguauuacaagaaauguccauccguaguuagacaucucgccguguucccggauacgauuacuggggcugacucaagucagcugcuugaggucagcggaucuugcgugaaccacuccgugaccgacgaacccccuaagaugcauuguucagccgagggcgaauggcuggucccaaucggcaaaugcauguguaaggcaggguacgaggagaagaauggaacaugccagguuugcaggcccgguuucuucaaagcuagcccucacauacagaguuguggcaagugcccaccccauucuuauacucacgaagaggccuccaccagcugugugugcgaaaaagauuacuuucggcgugagucggacccgccuacaauggcguguacccggcccccaucugccccuagaaacgcaauuuccaacguaaaugaaacgucaguguucuuggaguggauucccccagcugauacugggggaaggaaggacgucaguuauuacaucgccugcaaaaaguguaacagccacgcuggcgugugcgaggaauguggugggcauguucgguaucucccccgacaauccggccugaaaaauacaucugugaugauggucgauuuacuggcccacaccaacuacacuuuugagaucgaagcagugaauggaguaagcgaccucucaccuggcgcccgccaguauguuagugugaacgucacaaccaaucaggcugcgccauccccggugacgaacgucaagaaggggaaaaucgcaaagaauagcauuucucuuucauggcaggagcccgauagaccuaacggaauaauccuggaauacgagauuaaauacuucgagaaggaccaagaaaccaguuauacaaucauaaaaagcaaggagacuaccauuacagccgaagguuugaagccagcuuccguguacguuuuccagaucagggcccggacugcagccggcuaugggguguuuucucgcagauucgaguuugagaccacacccguaucggucgcugccagcuccgaucagucacaaaucccugugauugcaguuagugugaccgucggagugauccuacuggcgguagugauuggcguucuccugucugguagcugcugugaaugcgggugcggcagggcuuccucacuuugugccgucgcacauccaagccugauauggcguugcggauacucuaaagccaagcaggaccccgaggaagagaaaaugcacuuccacaauggccauaucaaguugccgggggugcggacuuauauugauccucacacguacgaagacccaaaccaggcugugcaugaguuugccaaagagaucgaagcauccuguaucacaauugagcgagucauaggagcuggugaauuuggcgagguuugcagugggagacucaagcugcccggaaagagggaauuaccuguggccaucaaaacccugaaggugggcuauacugagaaacagcgccgggacuuucuaggugaggcgagcauuauggggcaauucgaucaccccaauaucauucaucucgaaggcguagucaccaagucuaaaccagugaugaucguuacagaguacauggaaaacggaucccuggacaccuuucuuaagaagaaugauggccaguucacugugauacaguuggucgggaugcugagaggaaucucagccggcaugaaauaccucagugacauggguuaugugcacagggaucuggcugcacgcaacauucuuaucaacagcaaucugguuuguaaggugucggacuuuggguugucccgaguacucgaggaugacccugaagccgcuuacacaacgcggggaggcaaaauucccauccguuggaccgccccagaggcaauagcguucagaaaguuuacuucugccagcgaugucuggucauaugguauugugaugugggagguggucaguuacggcgaaaggccguauugggagaugacaaaccaggacguuaucaaagcuguggaagagggguaccgccugccuucccccauggauugcccagccgcauuauaucaacugaugcuagacuguuggcagaaggagcgcaauucuagacccaaauucgaugaaauuguaaacaugcucgacaagcugaucaggaauccuagcucccuuaagaccuuggugaacgcuucaugccgagucagcaaucugcucgccgagcacaguccacugggaucuggcgcauaccgcuccgugggggaaugguuagaggccauaaaaaugggacgguacacagaaaucuucauggagaacggcuauagcucgauggacgcuguugcacaggugacucuggaggaucuuagaagguugggugucacccucguggggcaucagaagaaaauuaugaacucacugcaagaaaugaagguucagcuagugaauggaauggucccccuguga

SEQ ID NO: 55827 - RNA, 3393 nt, Artificial Sequence
  derived and/or modified sequence opt3 from EPHA6__Homo_sapiens__NP_001073917
augcaguuccccagcccuccagccgcuagauccucuccggcaccccaagccgcgucaaguagcgaggcugccgccccugcaaccggccagccagggcccuccugcccugugccaggaacaucuaggcggggucgccccggcacuccuccagcugggcgagucgaagaggaagaggaagaggaggaagaggacguugauaaggacccgcaccccacgcagaacaccugucugcguugcagacauuuuucgcucagggaacggaaacgcgagccuagaaggacaaugggaggcugugaggugcgggaauuucuucugcaguuugguuucuuuuugccauuacugacugcauggcccggggauugcucacacguaagcaauaaccaagugguccuacucgacaccacaaccgugcugggagagcuuggcuggaagacuuacccucugaauggcugggaugccaucacagaaauggacgagcauaaccgcccaauucacaccuaucagguuuguaaugugauggaacccaaccagaauaacugguugcgaacgaauuggauaaguagagaugcugcccagaaaaucuacgucgagaugaaguucacucucagggacugcaacuccauuccgugggugcuggggaccuguaaagagacauuuaaucuguucuauauggaaucugaugagagccauggaaucaaguuuaagccuaaccaauacacuaaaauugacaccaucgcggcagaugaauccuucacacagauggaccucggugaucggauauuaaagcugaauaccgagauccgugaaguaggccccauugagcgcaaaggguuuuaucuugccuuccaggacaucggagcuugcauugccuugguuucagugagagucuuuuacaagaaauguccauucacggugaggaaccuggcaauguucccugacacuaucccccggguggauaguagcucucuagucgagguucgaggcuccugcgugaagucagcugaggaacgcgacacaccaaagcucuauuguggugccgauggggacuggcugguaccccuuggaagaugcauaugcagcaccggcuacgaagagauugaaggcaguugucacgcgugcaggccuggguuuuacaaagccuucgcaggaaauacuaaguguucuaaaugcccaccgcacucccugacauauauggaggcuaccagcgugugucagugcgagaaggguuacuuucgggccgaaaaagaucccccuucgauggcuuguacgcgcccacccucugccccuagaaacgucguguucaacaucaaugagaccgcauugauucucgaaugguccccacccucagacacaggcgggaggaaggaucugacuuauaguguuaucugcaaaaaguguggauuagacaccagccaaugcgaggauuguggcggugggcugcguuuuaucccgcggcauacaggccucauuaacaauuccgugauaguccuugacuucgugucucacguaaacuacacuuuugagaucgaagccaugaauggaguuagcgagcugucauucaguccuaagccauuuaccgcuauuacagugaccacugaucaggacgcgcccuccuugaucggcgucgugcgaaaagacugggcaagccagaacucuauagcccuaucauggcaagcuccugccuucaguaauggggcaauucuggauuaugaaaucaaguacuaugagaaagaacaugagcagcucacguacagcuccacaagaucuaaggcccccucggucaucauuaccggacugaaaccagcuacuaaguacguguuucacaucaggguucgcaccgccacagguuauagcggcuacucccagaaguucgaguuugaaaccggggacgagacuucagauauggcagcggaacagggacaaauucuugugauagcuacagccgcaguaggcgguuucacgcuguuggucauccucacccuguucuuuuuaauuacugggcggugccagugguauaucaaagccaagaugaaaagugaggaaaagagaaggaaccaucugcagaauggccaccuacgcuucccuggaaucaaaacauacauugaccccgauaccuaugaggacccaucucucgcugugcacgaguuugccaaggaaauagauccgagccgaauccggauugagcguguuaucggcgcaggggaauuuggagaggugugcuccgguagacugaagacaccuggcaaaagggaaauucccgucgcuaucaagacucuuaaagggggacauauggaccgccagcggagagauuucuugagggaggccucaauaaugggccaauucgaccacccaaacaucauucgacuggagggugugguaaccaagcgcagcuuucccgcgaucgggguggaagccuucuguccuucuuuucuccgggcuggcuuccuuaauuccauucaggcaccacaucccguuccuggaggcgggagucugccgccaagaauccccgccggaaggccugucaugauagugguggaguacauggaaaacggcagccuggauucuuucuugcguaaacacgacggucacuucacggucauucagcucguugggaugcugcgcggaaucgcuuccggcaugaaguauuuaucagauauggguuacgugcaucgggaccuggccgcaagaaauauucuagugaacaguaaucucguaugcaaggucagcgacuuuggccugucgagggugcuugaggaugacccagaggcggccuacaccacaacugggggaaaaauccccauacgauggaccgcuccugaagccaucgcauaucggaaguucuccucugcuagcgaugccuggucauacggcauuguuaugugggaggugaugaguuauggggaacgcccguacugggagauguccaaccaggacgucaucuugucuauugaagagggauauagacugcccgcaccaaugggcuguccugccagccuccaccaacugauguuacauugcuggcagaaagagaggaaccaccggcccaaguucacagauaucguguccuuucuggacaaacuuauacgaaauccaucagcuuugcacacucucguugaagauauucuggugaugccugagagccccggugaaguaccagaguacccgcuauucgucaccgugggggacuggcuggauaguaucaagaugggacaguauaaaaacaauuuuguggcggccggcuucacgacauuugaccucaucucuagaauguccauugaugacauccgcaggauuggugucauacugaucggccaucagcgucggauuguuagcucgauccaaacccuuagauugcacaugaugcauauucaggaaaagggguuccacguguga

SEQ ID NO: 55828 - RNA, 840 nt, Artificial Sequence
  derived and/or modified sequence opt3 from EPHA7__Homo_sapiens__NP_001275559
augguguuccagaccagauaccccagcuggaucauucugugcuauauauggcuccuuagguuugcccacacaggcgaggcucaagcagccaaggaaguccuguuguuagacuccaaagcgcagcagacugagcuggaauggaucucuucaccuccaaacgggugggaggaaauuaguggacuagaugagaauuacacgccgauccggaccuaucagguuugucaagugauggagcccaaccagaauaacuggcuccgcacaaauuggauuagcaaggguaacgcucagcgaaucuucguagaacugaaauuuacucuucgugacugcaauucccugccuggcguguuggggaccuguaaggagacauucaaccucuacuauuacgaaaccgauuaugacacuggaagaaauauaagggagaaccuguacgucaaaaucgauacaauugccgcagacgagucuuuuacccagggcgaucugggugaacggaagaugaagcucaauacggaggugcgcgaaaucgggccauuaucgaaaaagggauucuaccuggccuuucaagacguuggcgcuugcauugcacuugugucagucaaaguguauuacaagaaauguuggagcaucauagagaacuuggccauuuuccccgauacuguaaccggcagugaauuuuccucucugguugaggugagagggacaugcgucagcuccgcugaggaagaggccgaaaaugcgccuaggaugcauuguucagcagagggagaauggcuagugccaaucgguaagugcauuuguaaggccggcuaucagcagaaaggggacacuugcgagcggaaguga

SEQ ID NO: 55829 - RNA, 2955 nt, Artificial Sequence
  derived and/or modified sequence opt3 from EPHB1__Homo_sapiens__NP_004432
auggcccuggacuaccuccuucuguuguuacuggcuagcgcaguggccgcgauggaggaaacccuaauggauacaagaacugcuacggccgagcucggcuggaccgcaaaucccgccuccgggugggaagaggucucuggauaugacgaaaaucugaacacaaucaggacuuaccagguuugcaauguguucgagccuaaccaaaauaacuggcuucugaccacauuuauuaaucggcgcggugcucaccgaauauauaccgagaugcguuucacuguaagagauuguucaaguuugccaaacgugccgggcagcugcaaggaaacauuuaaucucuacuauuacgagaccgacuccgucaucgcaacgaaaaagucugccuucuggucggaagcucccuaucugaaaguggauacuauugccgcggacgagucauuuagccagguugauuucgggggaaggcugaugaaggugaacaccgagguccggaguuuuggcccucucacacgcaaugguuucuacuuagcauuucaggacuacggggccuguaugucccugcuuucugugagaguauucuuuaaaaagugcccaagcaucguucagaacuucgcuguguuucccgaaacuaugaccggagccgaguccacaucauuggucauugcaaggggcaccuguaucccuaaugcugaagagguggaugugccaauaaagcuguauugcaacggcgacggggaauggaugguccccaucggacgguguacgugcaaaccugguuacgagccagagaauaguguugccuguaaggcgugcccggccggcacuuucaaagcaagccaagaagcugagggguguucucauugccccuccaacucacgcagcccugccgaagcuaguccaauuugcacaugucgaaccggauauuacagagccgauuucgaucccccugagguggcaugcacuucuguaccauccggccccaggaacgugaucagcauugucaaugaaacaucgaucauacuagaguggcacccgccucgggagaccggugggcgugacgacgugacguauaacauuaucuguaagaaaugccgcgccgacagaaggucuuguucccggugcgaugacaauguugaauuugugccccgacagcucggacugaccgagugucgcgucucaauuaguagccuuugggcucauacaccauacacuuucgauauccaggcgaucaacggcguguccucuaagagcccuuuucccccacagcacguaucaguuaauauuaccacaaaccaagcagcccccaguacugugccuauaaugcaucaggucuccgcuaccaugagaagcaucacacugucuuggccacagccggaacagcccaauggcauuaucuuggacuaugagauaagguacuacgaaaaggagcacaacgaguucaauucaaguauggcccggagccaaaccaacacugcacgcauugaugggcucagaccuggaaugguguaugucgugcagguuagggcccguacgguggcugguuacggcaaauuuuccgggaagaugugcuuccagacacugaccgacgaugacuauaaaucugaauuacgggagcaacugccacucaucgccggaucggcagcggcuggcguagucuuugugguuagccuuguggccaucuccauugucuguucacgaaagagagcauacaguaaagaagccguguauucugauaagcugcagcacuacagcacugguagggggucccccggcaugaaaaucuauauugacccuuucaccuacgaggauccaaaugaggcuguacgcgaauuugccaaggagauagacgugucauucguuaagaucgaagaggucauuggagcaggcgaauuuggggagguguacaaaggacgguugaagcuacccgguaaaagagagaucuauguggcuaucaagacacugaaagccggcuacagcgaaaagcagaggcgcgacuuccucucugaggcguccauuauggggcaguuugaucauccgaacauaauccgacuggaaggagucguuaccaagagucggccugugaugauuaucacugaguucauggaaaauggcgcccuugacagcuuccugcgucaaaacgauggucaguuuacagugauucaguugguagggaugcucagaggcaucgcugcaggaaugaaauaucuggccgagaugaauuacguccacagggacuuagcugcccgcaacauacuggugaacucuaaucuaguuugcaagguguccgauuucggccucucacgguaucugcaggacgauacgagugacccaaccuacacuagcucgcuugggggaaaaauccccgucagauggacagcaccugaggcgauugccuauaggaaguuuaccuccgcuucugauguguggagcuacgguaucguuaugugggaagugaugucauucggcgagcgacccuacugggacaugaguaaccaagauguaauuaaugccaucgaacaggacuaucgcuugccaccucccauggauuguccagcagcucugcaucagcucaugcuggacugcuggcagaaagaccggaacuccagaccgagguuugccgagauagucaauacacuugauaagaugauucguaacccugcaucucugaagacuguggccaccaucacggcugugcccagccaaccauugcucgaccgcuccauucccgauuucaccgcguuuacaacugucgacgauuggcugucagccaucaaaaugguucaguaccgggacagcuucuuaaccgcaggguuuacaagucugcagcuagugacucagaugaccucugaagaucuccugagaauaggaaucacgcuugcuggccaccaaaagaaaauuuugaacuccauccacagcaugaggguacagauuucgcagucaccuacagccauggccuga

SEQ ID NO: 55830 - RNA, 2997 nt, Artificial Sequence
  derived and/or modified sequence opt3 from EPHB3__Homo_sapiens__NP_004434
auggccagagcuaggcccccuccaccgcccagcccuccacccggccugcucccucuucugccacccuuguuacugcuaccucuccugcuucugccagcagggugccgggccuuggaggaaacccucauggacacaaagugggugacuuccgagcuggcguggacgucucacccggaaucaggaugggaggaagucagugguuacgaugaggcuaugaaccccauccgcaccuaucagguuuguaaugugcgagagagcucccaaaacaauuggcugcguacaggcuucauuuggagaagggacguacagcggguguacgucgaacucaaauuuacugugcgcgauugcaacucuauaccuaauaucccagggucguguaaggagaccuucaacuuauuuuauuacgaagccgacucagauguugcaagcgccaguucccccuucuggauggagaauccuuaugugaaagucgacacaauugcuccagaugagucuuuuagcagacuggacgcaggaagggugaacaccaagguacgguccuucggcccccuuucaaaagccgguuuuuacuuggcuuuccaggaucagggggccugcaugagucugaucagcguucgcgcguuuuauaagaagugugcaucuacuacagccggauucgcucuauuuccggaaacccucacgggcgccgagccuacuucccuggugauugcacccgggaccugcaucccaaaugcugucgaagugucagugccucuuaaacuguacuguaacggcgacggagaguggaugguccccguuggugccugcacaugugcgacuggccaugaaccagccgcaaaggagagccaaugccgacccuguccuccagggaguuacaaagcuaagcagggagagggcccgugcuugcccugcccuccaaauucuagaaccacaucccccgccgcuagcauauguaccugccacaacaauuucuauagggccgauucggacucugcagauuccgccuguacgacugugccuucaccaccccgggguguaaucaguaacgugaaugaaacaagccucauucuggagugguccgaaccgcgugacuuagggggacgcgacgaucugcucuacaacgucaucugcaaaaagugucauggcgcuggcggggcgucugcaugcagcagaugugacgauaacguggaguuuguuccuaggcagcuuggacugaccgaacggcgagugcacauuucacauuugcuagcccacacucgcuauacauucgagguccaggcugugaaugguguaaguggcaaguccccacugcccccuagauacgccgcaguuaacaucaccacgaaucaagccgcucccagcgaggugccaacccucaggcugcacucuucaagugggagcucccuuacacugucuugggccccucccgaacggccaaacggagucauauuggacuaugagaugaaauacuucgaaaagucggagggcauugcaagcacugugaccucccagaugaacucaguccagcucgauggucugcgcccggacgcgagauaugugguucaggugagggcucguacaguagccggguacggccaauacagucggccugcagaauuugagacuaccucugagcgaggaagcggcgcccagcaguuacaagaacagcugccccuaaucgucggguccgcuacagccggacucguguucguuguggcagucgugguaauugcuaucgugugccugagaaaacagaggcaugguucagauagcgaguauaccgaaaagcuccagcaauacaucgccccaggcaugaaaguuuauauugaccccuuuacuuacgaggauccuaaugaggcgguccgcgaguucgccaaggaaauagacgugucuugugugaaaaucgaagaggucauuggggcuggagaauuuggcgagguuugccgggguagauugaagcagccagggaggcgcgagguguucguggcaaucaagacgcugaaaguaggcuauacagaacgacagcggcgugauuuucucuccgaggccaguauaaugggacaguucgaccaccccaauauuaucagacuggaaggcgucgugaccaagagcaggccuguuaugauccuuacugaguuuauggaaaacugugcucuggacucuuucuugcgccucaaugaugggcaauuuaccgugauucagcuggucggaauguuacgggguaucgccgcaggcaugaaauaccuguccgagaugaacuaugugcauagagaccuagcggccaggaauauucucguuaacucaaaucuggugugcaagguaagugauuucgggcuuagccgauuuuuggaggacgauccgucggacccaacauacaccuccucucugggaggcaaaauacccauccgcuggacugcuccugaagccauugcauaccggaaguucacaagcgcuucagaugucuggaguuaugguaucgugaugugggaggugauguccuacggggaaagaccauauugggacaugucuaaccaggaugucaucaaugccguugagcaggacuacaggcuucccccuccgauggauugccccacggcacugcaccaauuaaugcuggacuguugggugcgugaucgcaaccuucggccaaaguucagccagauuguaaacaccuuggacaaacucauaagaaaugccgcuucccugaaggugaucgcgucagcccagagcggcaugagucagccucuacuggacaggacuguccccgauuauacaaccuuuacaacugugggagacuggcucgaugcaauuaaaaugggccgauacaaggaaucuuucguuuccgcuggguuugccagcuucgaccugguggcccaaaugaccgcugaggaucuuuugcggaucggagucacgcuggcaggccaccagaaaaagauuuuaucgucaauccaggacaugcgccuccaaaugaaccagacccugccagugcagguuuga

SEQ ID NO: 55831 - RNA, 2964 nt, Artificial Sequence
  derived and/or modified sequence opt3 from EPHB4__Homo_sapiens__NP_004435
auggagcugagagugcuccuuugcugggccagccuggcugcagccuuggaagagaccuuacugaacacaaagcuagaaacugcggaccucaaaugggucacguucccccagguugauggccaaugggaggaacuguccgggcuugacgaggagcagcacucugugaggaccuacgaaguaugugaugugcagcgggcuccuggacaggcccauuggcugcgcacagguugggucccacgacguggcgcagugcacguuuaugccacuuugagauuuaccaugcucgagugccugucacugccgagggcugggcggaguuguaaggaaacauucaccguguuuuacuaugagagcgacgcagauacugccacagcucucacccccgccuggauggagaauccuuacaucaaagucgacacgguggcggcagaacauuuaacucgcaagagaccaggagccgaggcuaccggcaaaguaaacguuaagacacugaggcuuggucccuuguccaaggccggguucuaucuggcauuucaagaucagggagcuugcauggcccuacucucucugcaccuuuucuacaaaaagugugcgcagcugacugugaauuugacccgguuuccugaaacagucccacgcgagcucguggugcccgucgccggcucgugcguuguggacgcaguaccugcuccaggcccgucacccagccuguauugucgagaagaugggcagugggccgagcaaccugugaccggaugcaguugugcuccagguuucgaggccgcagaaggcaacacgaaaugcagagccugugcucaggggacuuuuaagcccuuauccggagagggcucuugccagccuugcccagcgaauagccauuccaacacaauugguucagcagucugucagugcagggugggguacuuccgggcccguaccgacccccgcggagcuccguguacuacaccucccagugccccaagaagcguugugucuaggcugaauggcuccucacuccaccuugaauggagcgcaccucuggagaguggcgggcgggaagauuugaccuacgcccuacgaugccgcgaguguagacccggagguucuugcgcuccauguggcggggaccugacguuugaucccggaccuagggaccucgucgagccaugggugguaguucggggccugcgcccggacuucaccuauacauuugaagugacugcccuuaacggugucuccagccuggcaaccgggcccgugccuuucgagccagucaaugugacaacugauagagaaguucccccugcggugucggacauaaggguaacccguucuuccccaucaaguuugagccucgcuugggccgucccccgggcaccguccggcgccgugcuggauuacgagguuaaauaucacgaaaagggagcugagggcccuucuagcgugcgauucuuaaagacaucagagaacagagccgaacugagggggcuaaaacgcggagcaaguuaccucguccaagugcgggcuagauccgaggccgguuauggcccauuugggcaggaacaucacagccagacccaacuggacgagucugagggauggagggaacagcuugcguugaucgccggcacugcuguaguggguguuguccuggugcucguggucauuguuguggcagugcugugccuucgcaagcagucaaaugggcgagaggccgaauacagugauaaacauggccaguaucugaucggacacggcacgaagguauacauugaccccuucacauacgaggauccuaacgaagcuguccgggaguuugccaaagagaucgacgugagcuauguuaagauagaagaggugaucggggcaggagaguucggugaagucugucguggcagauugaaagcgcccgggaagaaggaauccugcguggccauuaaaacccucaagggaggcuacacugagaggcaacgccgggaguuucugucugaagcuaguaucaugggucaguucgagcacccaaauauuaucagauuagaagggguugugaccaacagcaugccuguaaugauacugacagaguuuauggaaaauggcgcccuagauuccuuccucaggcugaacgacggacaguuuaccgucauucagcuugugggcauguugcgagggaucgcaucaggaaugcgcuaucuggcugagaugaguuacgugcaucgggaucucgccgcaagaaacauucuggucaauucuaacuuaguuuguaaagugagcgacuucggccuguccagguuucuugaggaaaauucaagcgaccccacuuauacaucuuccuugggugggaagaucccaauccguuggacggccccggaggcuauugcguuccgcaaauuuaccagugccagcgaugcauggucuuacggaauaguaaugugggaagugauguccuucggcgagcggccuuauugggacaugucaaaccaagaugucaucaaugcuauugagcaggacuacagacugcccccacccccugauugcccaacuucgcuccaccagcuaaugcuggacugcuggcagaaggauaggaacgcccgaccccgguucccucaagugguuagcgcccucgacaagaugauccgcaauccggcuucgcugaaaauaguggcaagagaaaacgguggcgccucccauccacuuuuggaucagaggcagccccacuacucugcguuugggagcgucggagaguggcugcgggcuauuaagaugggccgauaugaagagucauucgccgcagccggguuuggaaguuucgaauuagugucccagaucucugcugaggaccuccugagaaucggcguuacacuugcaggucaucagaaaaagauucuggccagcgugcaacacaugaaaucccaggcgaagccugggaccccaggaggcacagguggccccgcuccucaauacuga

SEQ ID NO: 55832 - RNA, 2190 nt, Artificial Sequence
  derived and/or modified sequence opt3 from EPHB6__Homo_sapiens__NP_001267724
augguggccgucggcgggugcagaugucagcccggauaccaaccugcuaggggugacaaggcaugccaggccuguccacggggccuguauaaagcgagcgcugggaacgccccgugcucccccuguccugcacgcucucacgccccaaaucccgcugcaccuguuugcccaugucucgagggauucuaccgagccucaagugaucccccugaagcuccaugcaccggcccgcccagcgccccucaggagcuuugguuugaagugcaggguuccgcgcugauguugcauuggcguuuaccaagagagcugggagggaggggcgaccuacucuucaacguaguguguaaggaaugcgagggccggcaagagcccgcaucugggggagguggcacaugucaccgcugcagagaugaaguccauuuugacccuaggcagcgggggcugacugagucgcgcgugcuuguuggaggccugcgagcccacgugccauauaucuuggaaguccaggcugugaaugguguaucagagcucagccccgauccgccucaggccgcagcuauuaacguuaguacgucccaugaggugcccucugccgucccaguggugcaccaagucagcagagcguccaauucaauaaccguuaguuggccucagcccgaccagacaaacgggaauauccuggauuaccagcugagguauuacgaccaagccgaagaugagagccacucuuucacucucaccuccgaaacaaacaccgcaacugugacacaguuaucaccaggacauauuuauggcuuucagguacgggcucguaccgccgcuggccacgggcccuacggagguaaaguguacuuccaaacgcugccucagggcgagcuuagcagucaguugccagaacgccugucucuagucaucggguccauucucggagcccuggcauuucuucuguuggccgcuaucacugugcucgcgguuguguuccagagaaagaggcggggcaccgguuauacagagcaacugcagcaguacagcucgccgggguuaggcgucaaauauuacauagaccccucuacuuaugaggauccuugccaggcaauccgagaacuggcccgcgagguggacccagcuuacauuaagaucgaagagguaauuggaaccggcuccuuuggggaaguuagacaaggaaggcuccagccccggggucgcagagagcagacaguggccauccaggcacuuugggccggcggggcugagucacugcaaaugaccuucuugggaagggccgcaguccuaggccaguuucagcauccuaauauacugcgucucgaagguguggucacgaagagucggccacugauggugcuuacugaguucauggaacuggggcccuuggauagcuuucuccgacagagagagggccaauucuccucucugcaguuaguugcgaugcagaggggaguggcugccgcaaugcaauaucugagcucauucgccuuuguacaccgcagucuauccgcucacagcguccucgugaacucucaucugguuuguaaaguggcccggcuuggccacucaccgcaggggccuaguugcuugcugagaugggcagcuccagaagucauugcccauggaaagcacacaaccagcuccgacguguggucuuucgguauccucaugugggagguaaugucguacggcgagaggcccuacugggacaugagcgaacaggaggugcugaaugcgauugaacaggaguuucgccuuccucccccaccugggugucccccaggacugcauuugcucaugcuggauacuuggcaaaaagaccgagcccggcguccgcacuucgaucaguuaguugcugcauuugacaagaugaucagaaaaccugauacacugcaggccggcggugaccccggggagaggccaucccaggcucuacucacccccgucgcccuggauuucccuugccuugacucaccacaagcaugguugagugcgaucggccuggaauguuaucaggauaacuuuucuaaguucggacucugcacguuuagcgacguggcccagcuguccuuagaggaucugcccgcucuuggcauuaccuuggccgggcaccagaagaaacuccugcaucacauacaacuacugcagcagcaucuccgccaacagggaucaguggaagucuga

SEQ ID NO: 55833 - RNA, 1368 nt, Artificial Sequence
  derived and/or modified sequence opt3 from EPHX1__Homo_sapiens__NP_000111
auguggcuggagauccuccuuaccagcgugcugggcuucgccauuuacugguuuauauccagagacaaggaagagacauugcccuuagaagaugggugguggggaccugguacuaggucugcugcacgggaggacgauucaauccgcccauucaaagucgaaacgagugacgaggagauucacgaucugcaucagcgaaucgacaaguuucguuucaccccgccccuagaagauagcugcuuucacuauggcuucaacuccaauuaccucaaaaagguuauuucuuauuggagaaacgaguuugacuggaaaaagcaaguggaaauccugaauagguacccucauuucaagacaaaaauagaggggcuugauauccacuuuauucauguaaagccaccccagcugccugccggacacacuccaaaacccuugcucauggugcacggcuggccugguucguucuaugaguuuuacaagaucauuccacugcugaccgacccgaaaaaccaugggcucucagaugaacacgucuucgaggugaucugucccagcauaccuggauauggcuuuagugaagcguccucuaagaagggcuucaauagcguugcuacagcccggauuuucuacaaauuaaugcugcgccuuggguuucaggaguucuacauccagggaggugacuggggcuccuugauuugcaccaacauggcacaacuggugccaucacaugucaaggggcuacaccucaauauggcccuggugcuuaguaacuuuagcacucugacauugcuccugggacagagauucggcagguuuuuaggucugaccgaacgggauguagagcuccuuuaucccguuaaagagaagguguucuacucucugaugcgcgaauccggguauaugcacauccaguguacgaaaccugacacugucggaucagcuuugaaugacagcccagugggccuagcagccuacauccuggagaaguuuaguaccuggacaaacacugaguuccgauaucucgaggauggcgggcuggaaagaaaauuuucucuugacgaucuguugaccaaugugaugcucuacuggacaaccggaacgauuauauccagccagagguucuauaaggagaaccugggucaaggcuggaugacucagaagcaugagcggaugaaagucuacguucccacaggguuuucggcuuucccguuugaauuacugcacaccccugagaagugggugcguuucaaauaccccaagcuaaucucuuauuccuacaugguacgcggaggccauuucgccgcguuugaagaaccagaacuccuggcacaggacauuagaaaauuccuuucaguguuggagaggcaguga

SEQ ID NO: 55834 - RNA, 1509 nt, Artificial Sequence
  derived and/or modified sequence opt3 from EPHX2__Homo_sapiens__NP_001243411
augaagggcgagaucacccugagccaguggauuccccucauggaagagaacugcagaaaauguuccgaaacagccaaggugugccuuccuaaaaauuucucuauaaaggagaucuuugacaaagcuauuucagcaaggaagaucaaccggccaaugcugcaagccgcguugauguuacgcaagaaaggguucacuacggcuauucugaccaauacauggcuagaugaccgagccgaacgugauggacucgcacagcugaugugugagcuuaagaugcacuuugacuuccugaucgagaguugccaggucgguaugguuaaaccggaaccccagauauacaaguuuuugcucgauacucugaaagccagcccuuccgaggugguauuccuggacgauaucggcgcuaaccucaagccagcaagagacuuagggauggugaccauucugguccaagauacagacaccgcccuuaaggaauuggagaaagugacuggaauccagcugcuaaauacacccgcuccucucccaaccucuuguaaccccucggauaugucacauggcuauguuacggugaagccuaggguccggcugcacuuuguggagcuugguagcgggccagccguaugccugugucauggauucccggaaaguugguacuccuggcgcuaucagauucccgcguuggcacaggccggcuacagaguucucgcuauggacaugaaaggcuauggggagucuagcgccccuccagaaaucgaggaauacugcauggaggugcuguguaaggagauggucaccuuuuuagauaaacugggacucucccaagcaguguucauaggucacgacuggggcgggaugcuugugugguauauggcucuguuuuaccccgaaaggguccgggccguugcgucauugaauacuccuuucauuccagccaaccccaauaugaguccgcuagagagcaucaaggcaaacccuguguuugacuaccagcuguauuuccaggaacccggaguagcugaggccgaacucgagcagaaucugucucgcacauucaaaucccuuuuucgagcuucagaugagagcgugcugaguaugcauaaggucugcgaagccggcgguuuguucgugaacucuccagaggaaccuucccucagcagaaugguuacugaggaagagauucaauuuuacgugcagcaguucaagaaaucgggguuuaggggaccccugaauugguaucggaacauggagcguaauuggaagugggcauguaaaucuuuaggccgcaagauccugaucccagcccuaauggucaccgcugaaaaagacuucgugcucguaccccaaaugucccagcacauggaggauuggauuccucaccugaagagaggccauauagaagacugcgggcacuggacacagauggauaagccaaccgagguuaaccagauccuuauuaaaugguuggacucagaugcgaggaacccgcccguggucaguaagauguga

SEQ ID NO: 55835 - RNA, 1083 nt, Artificial Sequence
  derived and/or modified sequence opt3 from EPHX3__Homo_sapiens__NP_001136358
augcccgagcugguggucaccgcccuccuugcuccuagcagacuguccuugaaguuacugagggcauucauguggucucuaguuuucucaguggcccucguagcggcugccguguacggcugcaucgcacugacacacguccuuugucggccacgccgagggugcuguggacguagaaggagugccagcccggcuugccuguccgaccccucuuugggugaacauggcuuccucaaccugaaaucgucagggcugcggcuccacuaugugagcgcaggacgcggcaaugguccuuuaaugcuguuucuucauggguucccagagaacugguuuaguuggagauaccaguugagggaauuucaaucccgguuucacguuguggccgucgaucugcgcggauauggccccucugacgcuccucgagauguggacuguuacacuauugaucuacuccugguagacauaaaggauguuauccuuggccugggguauagcaaaugcauuuugguggcccaugacuggggagcgcuccuggcauggcacuucuccaucuacuauccaucauuagucgagagaauggugguggucaguggugcccccaugagcguuuaccaggauuacucucugcaccauauuucccaguuuuucaggucacacuauauguuucucuuccagcuuccuuggcugccagaaaaguugcuaagcaugagugacuuucaaauccugaaaacgacccucacacaucggaagacuggcauaccgugucugacccccucugagcuugaggcuuuccuguacaauuucucccagccugggggauugacaggcccacucaacuauuaccguaaucuguuucgcaacuuccccuuagaaccucaggagcugaccacuccaacacuacuccuguggggugaaaaggauaccuaucuugaguuggggcugguggaggccaucggaagcagauuuguacccggcaggcucgaagcacacauucugccgggcaucgggcacuggauuccucagucgaauccccaagagaugcaucaguacaugugggcuuuccuucaggaccuguuggauuga

SEQ ID NO: 55836 - RNA, 954 nt, Artificial Sequence
  derived and/or modified sequence opt3 from EPM2A__Homo_sapiens__NP_001018051
augagauucagguuuggcguggucguucccccugccguggcuggggcacggccagagcugcucguagugggaagccgcccggaacuuggucgaugggagccccguggcgccgucagacugaggccugcggggaccgcugccggagacggcgcauuggccuuacaggaaccaggucuguggcuaggggagguggaacucgcugcagaggaggccgcucaagauggagccgaacccggccggguugacacauucugguacaaguuucugaaacgcgagccuggcggggaacuuuccugggagggaaacgguccacaccaugauagaugcuguacuuauaaugagaacaaucugguggacggcgucuacugcuugcccaucgggcacuggauugaagcgacgggacauaccaacgagaugaagcacacaacugauuucuauuuuaauauagcaggccaucaggccaugcacuacucuaggauccucccuaacauuuggcuggguucauguccacgccagguggaacacguaaccaucaaacugaagcaugagcucgggauuacagcuguuaugaauuuccagaccgaaugggacaucgugcaaaacaguagcggaugcaaucgguauccggagcccaugacuccugauacaaugauaaaauuauaccgagaggaaggccuggccuauaucuggaugccaacccccgacauguccacggagggcagaguccagaugcuuccucaggcaguguguuugcugcacgcucuacucgaaaaggggcauauuguguacguccacugcaacgccggaguugguaggucuacugcggccguguguggcuggcugcaguacguaaugggguggaaucuucggaaggugcaauauuuucugauggcaaaacguccagcugucuacaucgaugaggaagccgcuucgcaggacaccuuccccuuguga

SEQ ID NO: 55837 - RNA, 1824 nt, Artificial Sequence
  derived and/or modified sequence opt3 from EPM2AIP1__Homo_sapiens__NP_055620
auguggaugacccccaagagaagcaaaauggagguggacgaagcccuggucuucaggccugaguggacacagcgguaccucguuguggaaccaccggagggcgauggggcucuuugccugguaugucgccgauugaucguggcaacucgugaaagagacgucaggcggcacuaugaggccgagcaugaauacuaugagcgcuacguggcggauggagaaagagcugccuuaguugagaggcugcggcaaggugaccuacccguggcauccuuuacgccugaggaacgcgccgcucgagcaggccucgggcugugcagacuucuggccuugaagggaaggggcuggggugagggggauuucgucuaucaguguauggaagugcuccugcgggagguacugccagaacacguuucugugcuccagggagucgacuuaucacccgauauuacccgucagcgcauacugaguaucgacagaaaccuuaggaaucaauuguuuaaccgggcucgagauuucaaagccuacagccuggcgcuagacgaucaggcauuuguggccuaugagaauuaccuccugguguucauucgcggcgucggcccugagcuugaaguucaggaggaccuguugacaaucauuaaccucacucaucacuuuuccgugggggcucugaugucugccaucuuagaaucgcugcagaccgcaggacucucacuucaaagaaugguaggucugacaaccacucauacauugaggaugauaggcgagaauagcgggcuagugaguuacaugcgggaaaaggcugucuccccaaacugcuggaaugugauccacuauucuggauuccugcaccucgagcugcuuagcuccuacgauguugacgugaaccagauuaucaauaccauuucagaguggaucguccugauaaaaacgcgcggcgugagaaggcccgaauuucagacuuugcucaccgagagugaaagcgagcauggugaacguguaaacgggcggugucugaauaacugguuacgaagaggaaagacacugaagcuaauuuucucucucaggaaagagauggaggccuuucugguuuccgugggcgcgacuaccguccacuucucagacaagcaguggcuuugcgauuuuggcuucuugguggacaucauggaacaucugcgcgagcucagcgaggaacugcgggucaguaaaguguucgccgcagcugccuuugaucacauuuguacauucgagguuaaacuuaaucuguuucaaagacacaucgaagagaagaacuugaccgacuucccugcucucagggaagugguagaugagcugaagcagcagaauaaggaagacgagaaaaucuuugauccagaccgcuaucaaauggucauuugccgauuacagaaggaguucgaacggcauuuuaaagaucugcguuucauaaagaaagaccuagagcucuuuucuaacccguucaacuuuaagcccgaauacgccccuaucuccgugagaguugagcugacgaaacuucaggcaaauacuaacuuguggaaugaauauaggauuaaggaucuggggcaguucuacgccggacucagcgcugagucguauccaaucauaaaggguguggcguguaaagucgcaucucuguuugacuccaaccaaauuugcgagaaggccuucucauacuuaacacgcaaucagcacacccugagucagccccuuacugacgaacauuugcaggcucucuuccggguggccacaaccgagauggaaccuggcugggaugaccugguaagagagaggaacgaaagcaauccauga

SEQ ID NO: 55838 - RNA, 1989 nt, Artificial Sequence
  derived and/or modified sequence opt3 from EPN1__Homo_sapiens__NP_001123543
augggcgaccagagcuggcuguggaaccaagccgcucccggggugagauccccugucuucgcaugcucuguugagaagggaaaugugccacucguacuuucagaacaccuggcccauaguagggauccggguagcggcgcggugcgguuuuugaucucccccgagccuugggcuucugccauuuuagggaccucgggacugcuagcaucaccaguccuccccgccgcucuggacgcagugacaugucagcaccuuccucagccaagcaguggcucccgccccauaucuccucgaaucggugcccugugcccauugcuccugcagccggggacuaugagcacguccucacugcguagacaaaugaaaaacauuguucauaauuacagugaagcugagaucaaggugagggaagccaccagcaacgaucccuggggaccuucuuccucacucaugagcgagauugcggacuuaacauauaaugucguggcauucagugagaucaugucuaugauauggaaacggcugaacgaucacggcaagaauuggcgccauguauacaaagccaugacucuuauggaauauuugaucaagaccggcuccgagagaguuagccagcaguguaaggaaaacauguacgcugugcagacacugaaagacuuucaauaugucgauagggacgggaaggaucagggagugaaugugcgggagaaagccaagcagcuagucgcacuccugcgcgacgaggaucgacuuagagaagagagggcucacgcccugaaaaccaaggaaaaguuggcgcagacugccacagcaucgucugcugccguugguuccggcccacccccugaggcugaacaagccuggccacagucaaguggggaggaggaacuccagcugcaauuagcacuggccaugagcaaagaggaagcugaccaggaggaacggauucgucgcggagaugaccucagacuucagauggcgaucgaggaguccaagagggaaaccggcgguaaagaggaaucuagccugauggacuuggcagauguguucacggcccccgcuccggccccuacuaccgaccccuggggagggccagcaccuauggccgcugccguacccacagcagcgccaacuucagaucccuggggcggcccuccagugccgcccgcugccgacccuuggggagggccagcacccaccccugccaguggugauccauggcggcccgcugccccggcaggcccuuccgucgacccauggggagggacacccgcuccugccgcgggcgagggucccaccccagauccuugggggagcucugacggcggagugcccguuucaggcccaagugccagcgauccguggacgccugcucccgcauuuuccgacccauggggagggucucccgccaagccuucgacuaacgguacaaccgcugccggcggguucgauacugaaccagacgaguuuagcgacuucgaucgacuacgcacagcacugcccaccuccggaucaagugcgggcgagcucgaacugcuugccggugaggugccugcuagaucuccgggggccuuugacaugagcggcgucaggggaucccuggcagaagcugugggcucaccacccccugccgcaacgccaacccccacaccuccgacucggaaaacccccgagagcuucuuggggccaaaugccgcucucguagaucuggacucuuuaguuucccgcccuggacccacaccaccuggugcgaaggccaguaaccccuuucugccaggcgggggaccggcaacuggcccuagcgugaccaaucccuuccagccagcucccccugccacacuaacccucaaccaacugagacuuucuccagugcccccugucccgggugccccacccacuuacauuuccccuuugggcgggggacccggccugccaccuaugaugcccccagggccuccggcucccaauacgaacccauuucuccuguga

SEQ ID NO: 55839 - RNA, 582 nt, Artificial Sequence
  derived and/or modified sequence opt3 from EPO__Homo_sapiens__NP_000790
augggcgugcacgagugccccgccuggcuguggcuccuucugagcuuguuaucccugccucuagggcucccaguccugggagcuccgcccagacuuaucugugacucuaggguucuggaacgguacuugcucgaggcaaaggaagccgagaauauuaccacagguugcgcggaacauuguucacugaaugagaacauaacugugccugauacgaaaguaaauuucuaugcuuggaagcgcauggaggugggccagcaagccgucgaaguguggcaggggcuggcacucuuaagugaggccguucugcgaggacaggcucuuuuggugaacagcucccagccaugggaaccccugcaacuacacgucgacaaagcagugucuggccuccguucgcugaccacacuucugagagccuugggugcucagaaggaggccaucucaccuccagaugcggcaagcgccgcuccccucaggacuauuaccgccgacacauuucggaaacuguuccgcguauacaguaacuuuuuaagagggaagcugaagcucuauaccggagaggcaugcaggacuggcgaucgguga

SEQ ID NO: 55840 - RNA, 1527 nt, Artificial Sequence
  derived and/or modified sequence opt3 from EPOR__Homo_sapiens__NP_000112
auggaccaccugggcgccagccucuggccccagguggggucccuuugccuguuguuagcuggagcagccugggcgccuccaccgaaccugcccgauccuaaguucgagucuaaagcugcccuacucgcagccagagguccagaggagcugcuuuguuuuaccgaaaggcuggaggacuuggucugcuucugggaagaggcugcaucagccggcguugggcccggaaauuacaguuuuagcuaucaacucgaggaugaaccuuggaagcugugucggcugcaucaggcuccaacagcccgcggcgcggugcgauucuggugcucccuccccacugcagacacgucuucguuuguaccuuuagagcugcgugugaccgccgcuucaggugccccaagauaccacagggucauccauauuaacgaagugguucuuuuggaugcaccgguggggcuggucgcucggcuagccgacgagagcggacacgugguacuccgcuggcugcccccuccagagacacccaugaccagucauauaagauaugaaguugauguguccgcgggcaauggcgccgggucuguccagaggguggagauccuugaaggacggacugagugugugcugagcaacuugcgcggucgaacaagauacaccuucgcagucagggcucggauggccgaaccuuccuuuggcggguucuggucagcuuggagugagccaguuagccuccugacucccucugacuuagauccgcugauucucacacuuucccugaucuuggugguaauucuagugcugcucaccguccuggcccuucugucacaccgucgcgcauugaaacagaagaucuggccuggaauacccagcccagagagugaauuugagggccucuucacgacucacaaagguaauuuucaacugugguuauaucagaacgacgggugccugugguggucuccuuguacccccuucacagaagauccacccgccucccuagaggugcucagcgaaagaugcuggggaacuaugcaggcuguugagccuggcaccgacgaugagggcccacugcuugaaccgguggggucggagcaugcgcaggacacauacuugguccuggacaaguggcuccugcccaggaauccuccaucugaagaucuucccggaccugguggcuccguggacaucguagcaauggaugaggggucagaagccaguagcuguuccucugcucuggccagcaagccaucacccgagggagcaagugccgcuuccuuugaguauaccauuuuggacccgagcucucaacuccugcggccuuggacguuaugcccagaacugcccccuacucccccacaccuaaaauaccucuaccugguugugucagauaguggcaucagcacagacuauuccucuggugauucgcagggggcccagggcggacuuagcgacggcccuuacuccaaccccuaugaaaauucauugauuccagcagcggaaccgcugccucccaguuacgucgcuuguucuuga

SEQ ID NO: 55841 - RNA, 384 nt, Artificial Sequence
  derived and/or modified sequence opt3 from EPPIN__Homo_sapiens__NP_001289790
augggcagcuccgggcugcucucucuucugguguuguucgucuuacuggccaacguucagggacccggucuaaccgacuggcucuuuccuagaaggugcccaaagauccgggaggaaugugaguuccaagaacgcgaugugugcacaaaagaccgacagugucaggauaauaagaaaugcuguguauuuucaugcggcaagaaaugucuggaccuuaaacaggugagucugcaaauguacgcuaagugccagaagaaguuggcaccggccuggcucauuuucuuuauagggggaaugacucguaaaaucauucuggcgcccugucugagcauggucgcugccagagagacgaucaccacauccaacccuaagccaacugcauga

SEQ ID NO: 55842 - RNA, 540 nt, Artificial Sequence
  derived and/or modified sequence opt3 from EPPIN-WFDC6__Homo_sapiens__NP_001185915
augggcagcuccgggcugcucucucuucugguguuguucgucuuacuggccaacguucagggacccggucuaaccgacuggcucuuuccuagaaggugcccaaagauccgggaggaaugugaguuccaagaacgcgaugugugcacaaaagaccgacagugucaggauaauaagaaaugcuguguauuuucaugcggcaagaaaugucuggaccuuaagcaggaugugugcgagaugccgaaggaaacugggcccugucuggcuuacuucuugcacuggugguaugacaaaaaggauaacacgugcaguauguuugucuacggaggcugucaagguaauaacaauaacuuccagagcaaagcaaauugccucaauaccugcaagaacaaacagccuuguccaaagauuaagguggagugcgagguugaagagauagaccaguguacaaaaccccgugauugcccugaaaacaugaaguguugcccauuuuccagagggaaaaagugucuggacuucaggaaagccucucugucgacuuga

SEQ ID NO: 55843 - RNA, 15267 nt, Artificial Sequence
  derived and/or modified sequence opt3 from EPPK1__Homo_sapiens__XP_011515627
augagcggccacacccugcccccucucccagugccggggacgaacuccacugagcaggcaucugucccccgcgcuauggcagccacgcuuggagcggguaccccuccaaggccccaagcucggucaaucgccggcguuuacguggaagcaagcgggcaggcccagagcguguaugcugcaauggagcagggacuguugccugccggcuuaggucaagcucugcuggaagcccaggcggcaacagggggacucguggaccuggcccgcggccagcuucugccagucuccaaggcuuugcagcaaggccucguggggcuggagcugaaagaaaagcucuuagccgcagagcgagcuacuaccggauaccccgauccuuaugguggcgagaaacuggcccuuuuccaggcgauugggaaggaaguuguggaccgugccuugggacagucuuggcuggagguccagcuagcaacaggcggucucguggauccagcucaagggguacugguugccccggaacccgcuugccaccagggacuucuggacagagagaccuggcacaaauugucggagcucgaaccuggcacuggcgaucugagguuuuuagacccaaauacacuggagcggcucaccuaccaucagcuucuggaacgcugugugagagcccccgggucaggauuggcacuacugccucucaagauaacguucaggagcauggguggcgccgucagugcugcggagcugcuugaaguggggauccuggaugagcaagcagugcagggauugcgggagggccgccucgccgcugucgacguuuccgcccgagcagaagugagaagguaucuggaggguacugggucuguagccggcguggucuuacugccagaaggacacaaaaagagcuuuuuccaggcugccaccgagcaucuacuccccaugggcacagcacugccgcuuuuggaagcgcaggcugccacucacacccugguggauccuauuacagggcaacggcucuggguugacgaggcagugcgugccggacuggucucccccgagcuucacgaacagcuguugguggcugagcaggccguaaccggucaucacgauccauuuucaggcagucagaucccucucuuccaagcaaugaagaaggggcugguugaccgccccuuagcucugagacuacucgaugcccagcuggcgacgggaggccuugugugcccagccaggcgguugcgacugccccucgaagcugcacugcgcugugguugcuuagacgaggacacucagagacagcugagccaagccgggucuuuuuccgauggcacacauggaggccuuagguacgaacaguugcucgcucugugugucaccgacccugagacugggcuagccuuccugccacucucaggagguccgcggggcggggagccccagggaccuccauuuauuaaguauagcacacgccaggcacugaguaccgcgacggccaccgugucugucggcaaauucagagguaggcccgugucccuuugggaauugcuguuuagcgaggcuaucucgucugaacaacgugccauguuagcacagcaguaccaagaggggacacucuccguugagaagcuggcugccaaacuuucagcaacucuggaacaggccgcugcgaccgcccgggugacauucaguggcuugcgagauacuguaaccccuggagagcuccugaaagcagaaauaaucgaccaggaucuauacgagagacuggaacacggccaggcuacagccaaggacgucgggagccucgccuccgugcaaagguaucugcagggaaccggcugcauugcuggucuuuugcugccagggucucaggagcgcuuaagcaucuacgaggcacgguguaaaggacuccugagacccggcacugcccuuauucugcuagaagcgcaggcugccacggguuuuaucauagauccgaaggcaaacaaaggccacucaguugaggaagcccucagggcugcagugauugggccugacgucuucgccaagcuguugagugcggagcgcgcugugacaggauauaccgauccauacacuggccaacagaucucccuguuccaggccaugcagaaaggguuaauuguacgagaacauggaauccggcuccuggaggcacaaaucgccaccggcggugugauugaccccguucacagccaucgugucccuguggauguggcuuauagaaggggguacuuugaccagaugcuuaaucugauauugcucgaccccucugaugacacaaagggauucuuugauccaaacacccacgagaaucugacuuaucuacagcugcuugaacgcugcguccgggacccugagacaggccucuaccuguugccccugucaaguacgcaaagcccauuaguugauuccgccacccagcaggcauuccagaaccuccugcuuucugugaaguacgguagauuucaaggccagagggugucggcuugggaacugaucaauagcgaguauuucuccgaagggcgacgccggcaguugcucagaagguaccgucagcgcgagguaacucugggacaagucgccaaacuacuggaggcggaaacacagcggcaggccgacauuaugcuuccggcacucagaucaagggugaccguucaucagcuguuggaggcuggcaucauagaucaacaguuacuggaccaggugcucgccgggacaauuaguccugaagcucugcuucugauggauggaguccgacgguauuuguguggccuaggugcaguaggggguguucgccugcuccccucuggccagagacugagccuuuaccaagccaugaggcagaaguuacuggguccacggguggcccucgcuuugcuggaggcgcaggcagccacuggcaccaucauggacccccacuccccugagucacucagcguagaugaagcuguccgaagagggguggugggaccagagcuguauggccgccuuaaaagggccgaaggggcaaucgccggauuucgugaccccuucucuggcaagcaagucuccguuuuucaggcuaugaaaaagggucugauuccuugggagcaggcggcccgguugcuagaagcacagguggcuacagggggaaucauugauccgaccagucaccaucaucugccaaugcccguagccauacaaagaggcuacguggaccaggagauggagacagcacucaguucuuccucagaaacuuucccuaccccagacggccaggggaggacaaguuaugcccaguuacuggaggaaugcccccgcgaugagacuagcggacuucaucugcucccuuugccggaaucggcucccgcccugccaaccgaggagcaaguccagcgaucccuccaggcggugccuggugcaaaggacggcacgucucugugggaucuucuaagcucaugucacuuuacagaagaacagagacgggggcuguuggaagacguucaagagggaaggaccacugugccccaguuacuggccaguguccagcgcugggugcaagaaacaaaacuccuggcucaggcccguguuauggugccaggcccuagaggugagguccccgcuguauggcuucuggaugcagggaucauuacccaggagacucucgaagccuuggcucagggaacccaauccccagcccagguggcagagcagccggcgguuaaggccugccuguggggcacaggcugcguggcugggguccuacugcagccuucuggagccaaagcaagcaucgcucaagccgugcgggacggucuccuucccacgggccuggggcagagguuauuggaagcacagguagccuccggauuccugguggauccacucaacaaucagcgccugucagucgaggacgcuguuaaggugggccuugugggucgagagcugagcgaacaacucgggcaggcggagagagccgcagcuggauaccccgauccuuacagucgggccucuuugucccuguggcaggccauggaaaaaggcuuagucccacagaacgagggccuaccccugcuccaagugcagcuugcaaccgggggaguuguagacccugugcacgguguccaucugccgcaggcugccgcguguagguugggccugcucgauacucaaacaagccaggugcugaccgcuguugacaaggauaauaaguuuuucuucgacccaucggcccgcgaccaggugacauaucagcaacuuagagaaaggugcgucugugauucagagacugggcuccuguugcugcccuuaccuucugacaccgugcuagagguagaugaccacacggcagucgcccugcgggcuaugaaagugcccguuaguacaggacguuuuaagggcugcuccgugagccucugggaucuucuguugucugaauacgucggugcagacaaacgccgagagcugguggcccucuguagaagcgggagggcggcugcccugcggcagguuguguccgcagucaccacucuuguggaagccgcugagcgccagccauuacaggccaccuucagaggacugaggaagcaaguaucagcacgggaucucuuucgagcucaguugaucaguagaaaaacacuggacgaacuaagccagggcacuaccacagugaaggagguugccgagauggauucugucaagcgcucccuggaaggcgggaacuucauugcgggagugcucauacaggguacgcaagagaggaugucaaucccugaagcccuucggcgucauauucugagacccggcaccgcauuggugcugcucgaggcucaggccgcaacuggguuuaucauugacccagucgaaaauaggaaacugacaguagaggaggcuuucaaggccggaauguuuggcaaagaaaccuaugugaaguuacuuagugccgagcgcgcgguuacugguuacacagauccuuauaccgggcagcaaaucagccuguuccaggcuaugcagaaagaccucauagugcgggaacacggaauccgacuacuggaggcacagauugccacgggcggcaucauugacccgguccauucccacagagugcccguugauguggcuuacaggugcggguauuuugacgaggaaaugaaccgcaucuuggccgauccaucugacgauacuaagggauucuuugacccuaauacccacgagaaccugacauaccuccaacuucuggaacggugugucgaggaucccgaaaccgguuuguaccugcuccagauaauuaaaaagggcgagaacuauguguacaucaaugaggcaacuagacauguauuacagucgcguacagccaagaugaggguggggcgguucgcugaccagguugucagcuuuugggaucugcuuucauccccauauuucaccgaagaccgcaaacgagagcugauucaagaauacggagcgcagaguggcggucuagagaagcuccuggaaaucauaacaacuaccaucgaggagacggaaacacagaaccaggggauuaaaguggccgcaaucagaggcgaggugaccgcugccgauuuguucaauucuagggucauugaccaaaagacucugcacacccuccggguuggacgcacaggcgggcaggcacuuagcacucuggaaugcgugaaaccuuauuuagagggauccgguuguaucgccggcguaaccgugcccucaacgagagaagucaugucucugcaugaggcuagcaggaaggaguugauaccggccgcguuugcaacauggcuccuggaagcccaggcugccaccggguuccuacuugauccaugcacucgacaaaagcugaguguggacgaggcaguugacgugggacucgucaacgaagaacugcgggagcguuugcugaaagcugaaagagccgcuacaggcuaccgcgauccugccaccggugacacuauuccccucuuucaggcaaugcagaagcagcuuaucgagaaagcggaagcccugagguuacuggagguacaaguggcuacagggggcguuaucgauccacagcaccaucaccgguugccccucgaaaccgccuauagacgcggaugucugcacaaggacauuuacgcacuaaucuccgaucagaaacauaugaggaagcgauucguggacccuaauacgcaggagaaggucagcuaccgggagcuucaagaaagaugcaggccgcaggaggauacuggcuggcugcucuuucccgugaacaaagcugcccgcgacucugaacacauugaugacgagacccgucgggcacuggaagccgagcaggucgagauaacaguggggagauucaggggacagaagccaaccuugugggcguuacuaaauucagaauauguuacagaggagaaaaagcuccaacuugugcgcauguaccgaacucauacccggagagcucugcagacgguagcccagcuaauccuggagcucauugaaaaacaggagacauccaacaagcacuugugguuucaagguaucaggcgccagauuacugcaagugagcugcuuagcucggccaucauaaccgaagagaugcugcaggaucucgaaacaggcagaucuaccacucaagaguuaauggaggacgaucgggugaagagguaucuggaagggaccuccugcaucgcuggagucuugguuccugccaaagaccagcccggccgucaggagaagaugagcauuuaccaggcaauguggaaaggugugcugcgaccugggacagcucucguccuucuggaagcccaagcggcuacgggcuucgugaucgacccaguacgcaaucuaagacugucaguggaggaagccguugcagccggaguggucggcggggagauucaggagaagcucuugagugcugaacgggcagugacuggauauaccgaucccuacacaggccagcagaucucucuguuucaagccaugcagaaagaccuuauagucagggagcacgguauucgccuguuagaagcgcagaucgccaccgggggagugaucgauccuguucauucccacagaguaccaguggacgucgcuuaucggaggggcuacuucgaugaggaaaugaaccgagugcucgcagaccccagcgaugacacuaagggauuuuucgauccgaauacacaugagaaccugaccuacguucaguugcugcguagaugugugccugacccagauacgggccucuauaugcuucaacuggccgggcgcggaucagcuguccaccagcuaagugaggaacugcggugcgcccucagggacgcaagagugacucccggcagcggggcuuugcagggacaauccguaucugugugggagcuguuauucuaccgcgaaguuagcgaggaccggaggcaggaucuucugucccgauauagagccggcacacucaccgucgaagaacugggugcgaccuugacuucacugcucgcccaggcacaggcucaagcccgggcagaggccgaagcugggucuccuaggccagacccccgcgaggcccuucgugcggcuacaauggaagugaaagugggaagacugcgaggcagggcagucccgguuugggaugugcuagccagugguuacguaucgcgggcugcccgcgaggagcuguuagcagaauuuggcagcgggacccucgaccugccugccuugacaagaaggcuuacugcuauuauagaggaagcggaggaagcccccggagcacggccacagcugcaggaugccuggcgcggcccuagagagcccgggccagcuggacgaggcgacggugauuccgggaggucucagcgggagggacaaggcgaaggcgagacgcaggaagcagccgcugccgcggcagccgcugccgcacgucgccaggagcagacccucagagacgcuacaauggaagugcaaagggggcaguuccagggacggcccgucucagugugggauguucuguuuagcuccuauuugagugaggccagacgcgacgagcugcuagcgcagcaugccgcuggugcacucggccuuccugaucugguggccgucuuaacucgagugaucgaagagaccgaagagaggcugucuaaggugagcuuccgggggcucagacgucaaguuucagcuuccgaacugcacacaaguggaauuuugggcccagagacccuucgcgaccuggcacaggguacuaagacgcuccaggaggugaccgaaauggauagcgucaaaagguaccuggaggggacaucuuguaucgccggagugcuagugccggcuaaggaccaacccggccggcaggagaaaauguccauuuaucaggccauguggaagggcgucuugagaccugggacugcacugguucuccuugaggcccaggcggcuaccggauuugugaucgacccaguacgaaaucugagguuaucaguggaggaagccgucgcagccggugugguuggcggggagauacaagaaaaacugcucagcgcugagcgcgccgugacaggauacaccgaucccuacacuggccagcagaucucgcuguuccaggcaaugcaaaaggacuugauuguccgggaacacgguaucagacuucuggaggcucagauugccacagggggagugaucgauccuguacauucucacaggguuccaguggacgucgcguaucagcgcggcuacuuugaugaggaaaugaaccgugugcucgcagaccccagugaugacacgaagggcuucuuugauccuaauacccaugagaaccugacuuauguucagcuauuacggagaugcgugccggacccagauacagggcuguacauguugcaacucgccggacgagguuccgcuguccaccagcugagcgaagaacuuaggugugcccugcgcgacgcucgggugacccccggcucaggggcacuccagggacaauccguaucugugugggaacuguuguucuauagagaggucagcgaggacaggcgccaggaucuucugaguagauaccgggccggcacccuaacaguugaggaacucggugcgacucugacguccuuacuggcccaggcucaggcacaagcccgagcugaagccgaggcagggagcccuaggcccgacccacgugaagccuugagagcugcgaccauggaggugaaagucggacggcuccgcggcagggccgugccuguaugggaugugcuggcaucuggcuauguuucacgagcugccagagaggaacuucuggcagaguuugggaguggaacacucgacuugcccgcccugacucggcgccuuaccgcuauaauugaagaggcggaggaagccccaggugcaaggccgcagcugcaggaugcuuggagaggcccucgggagcccgggccagccggacguggcgacggugauuccgggcgcagccagagggaaggacaaggcgagggcgaaacacaggaggccgcugcagccgcucgaagacaggagcagaccuuacgggacgcgacuauggaagugcaaagggggcaguuccagggacgccccgucucugugugggauguucuauuuucgucauaccucagcgaggccagacgggacgaacugcuggcacaacacgccgcuggugcauugggccucccugaucuggucgccgugcuuacgagggugaucgaggaaacagaggagcgccuguccaagguaaguuuccgaggguuaagaugccaggucucugcuagcgaacuccauaccuccggaauccugggcccagagacuuugcgugaccuugcccaggguaccaaaacacugcaggaagugacugagauggauucaguuaagcgguaccuagaagggaccaguuguauugcaggagugcucguccccgcgaaagaccaaccuggcaggcaggagaagaugucuaucuaucaggccauguggaagggcgugcugcgcccggggacagcucugguuuugcucgaggcccaggcagcuacgggauucgugauagacccaguaagaaaccugcggcuuagcgucgaagaggccguggcggccggugugguuggcggggaaauucaagagaaacuguuauccgcugagagggcagucaccggauacacugaucccuauacaggccagcagaucucacucuuucaggccaugcaaaaggaccugauugugcgagaacacgguaucagacuauuggaggcucagauagcaaccgggggcguaauugauccugugcauagccaccgcgucccaguggacguugccuaccggaggggauauuucgaugaagagaugaaucgugugcuggccgaccccucugaugacacuaaaggcuuuuucgauccuaacacacaugaaaaucuuaccuacguccagcuccugagacgcugcgugcccgacccagauacggggcuguauauguugcagcuugcuggaagggguuccgcaguucaccaacucagugaggagcugcggugugccuuacgagacgcgagagugaccccgggcagcggggcucugcagggacagucgguauccgucugggaacuacucuuuuaccgcgaggugucugaagauaggcggcaagaccuguugucaagauaccgugccggcacacugacuguugaggaacuuggugcaacccucacaagccuguuagcccaggcucaggcccaggcacgcgcugaggccgaggcggggaguccuaggcccgacccacgggaagcacugcgagccgcuacuauggaggugaaggucggcagauugaggggacgcgccgugccuguaugggaugugcucgcuuccggcuaugucucucgggcagccagagaggaacugcuugcggaguucgggagcggaacccuggaccuacccgcccucacacgaaggcugaccgcuaucaucgaggaggcagaagaggccccaggugcucggccucaauugcaggaugccuggcgcggccccagagaaccggggccagcaggacguggcgacggugauucaggcaggucccagcgggaggggcagggagagggcgaaacucaagaggccgcugcggccacggcagcugccagacgccaggaacagacacugagggacgcaaccauggagguucagcgagggcaauuucagggacggccugugagugugugggauguccuuuucagcucuuaccucucagaagccagacgcgacgagcuguuagcucagcacgcggccggcgcacuggguuugcccgaucucguggcuguucugacuaggguaauugaggaaaccgaggaacgucuuuccaaagugagcuuuagagggcugcggcgccaagucucugccagugagcuacauacaucgggaauccucggcccagaaacgcugagggacuuggcccaggguaccaagacucugcaggaggugacagagauggauuccguuaagcgauaucuugaaggcaccagcugcauugcugggguguuaguccccgcaaaagaccagccuggaagacaagagaagaugucaauauaccaggccauguggaaaggcgugcugcggccggggacugcgcucguacugcuagaagcucaggccgcaacaggauucgugaucgacccaguccgcaacuugaggcugucuguugaggaagccguggcugcaggcgucguggguggggagauucaggagaagcuccuuagcgccgaaagagcuguuaccggauauacagaucccuacacuggccaacagaucucccuguuucaggccaugcagaaagaccucaucgugcgggagcacgguauucgucuguuagaagcgcaaauagcaaccggcgggguaaucgauccugugcauagucaccgaguccccguggacguugccuauaggcgcggauacuucgaugaggagaugaauagagucuuggcugacccaucagaugacacgaagggcuuuuucgauccuaacacccacgaaaaucugacauacgugcagcuucugcggaggugugugcccgacccagauacugggcucuauaugcugcagcuagccggacgcggcucugcaguacaucagcuuagcgaggaacugagaugcgcucuccgggacgcccgagucaccccugguuccggggcguugcaaggacagagugugagcguuugggagcuguuauucuacagggaaguguccgaggauagacgccaggaccugcucucucguuaucgggccggcacacuuacugucgaggaacugggcgcaaccuugacgucacugcucgcucaagcccaggcucaggcaagggccgaggccgaagcugggagcccgagacccgacccacgcgaggcacuacgggccgcgacaauggaagugaagguuggacgacugagggguagagcugugccugucugggaugugcuugccucgggcuacguaucccgcgcagcccgggaggagcugcucgcugaauuugggaguggaaccuuggaccugcccgccuuaacuaggcgucugacagcaauuaucgaggaagcugaggaagccccaggcgcgagaccucagcuccaagaugcauggcgagguccccgcgagccggggccagccggacggggcgacggcgauucugggaggagccagagagagggacagggugaaggcgagacccaggaagcugccgcagcuacugccgcggcccggcgccaagagcagacccuuagggacgcuacaauggaggugcagagagggcaguuccaaggacgaccuguuucagucugggaugugcuguuuuccucuuauuugagugaagcacgucgggacgagcugcucgcccagcacgcugccggcgcacuaggucugcccgauuuaguggccguccugacgaggguuauugaagagaccgaggaacgccucagcaaaguguccuucagagggcuuaggcggcagguaucagcuagcgaguugcauacuucuggaauccugggcccagaaacacugagagaccucgcgcaaggcaccaagacucuucaggaggugacagaaauggauagugucaaacgcuaccuggaggggaccuccugcauagccggaguguugguucccgcaaaggaccagccuggucaccaggagaaaaugagcaucuaucaagcuauguggaagggcgugcugcgacccgggacggcccucguccuacuggaggcacaggccgcuacaggauuuguaauugauccagugaggaacuuacggcuuucaguugaggaagcgguggccgcaggcgucguggguggggagauccaggaaaaacugcucucugcugagagagccgugaccggauacacugacccuuacaccggccagcaaauuuccuuguuccaggccaugcagaaggaccugaucguccgcgaacauggcauacgucugcucgaggcacagauugcuacagggggaguuaucgauccggugcacucgcacaggguacccguggacgucgccuaucggagagguuacuuugaugaggaaaugaaucgaguucuugcgcauccaagcgacgauacuaagggcuucuuugacccuaacacccacgagaaucugacauaugugcaauugcuaagaaggugugugcccgauccagacacggggcuguacaugcuccaguuagcuggacggggcagugccguccaucagcugucugaggaacuuagaugcgcacugcgcgaugccaggguaaugccugguuccggggcucuccagggacaaagcgugucaguuugggaguugcuguucuaucgugaagugagugaggacagacggcaggaucugcucucccgauaccgcgcaggcacucuaaccgucgaggaacugggcgccacacuuaccagcuugcuggcucaggcccaagcgcaggcaagggccgaagcugaggccgaggcagggucucccagaccggacccucgggaagcucucagggccgcgacuauggaggugaaaguuggacgcuuaagaggucgggccgugccagucugggacguacuggcaucaggcuaugugagcggggcugcccgagaggaacuucuggcugaauuuggauccggcacacucgauuugcccgcacugacccguaggcuaacggccauuaucgaggaggccgaagaggcuccuggugcacgcccacagcugcaggacgccuggagagggccccgggaaccuggcccagcgggaaggggcgauggggacucuggaagaagucaacgagagggucagggcgaaggggagacucaggaggcugccgcagccgcucgccggcaggaacaaacccucagggaugcaacaauggagguccagagaggacaguuccagggccgccccgugucgguuugggacguguuauuuagcuccuaccugucagaagcccaccgggaugagcuucuggcgcaacaugcugccggugcauuggggcucccggaccuggucgccgugcuuacccguguaauagaggaaacugaggaaaggcugucuaaggugagcuucagaggccuccgacggcagguuagugcuuccgaguugcacacaucaggaauccugggcccugaaaccuuacgcgaucuggcccaggggacaaaaacucuccaagaggugaccgagauggacucugucaagagguaccuagaaggaacgagcuguauugccggugugcugguucccgcuaaagaucagccaggcagacaggagaagauguccaucuaucaggccauguggaaggggguccuucggcccggaacagcguuggugcugcucgaagcccaagcugcaaccggcuucguaauugacccugugcgcaaccugaggcuuagugucgaggaagccguggcugccgguguuguagggggcgagauccaggagaaacugcucagcgcagaacgagcggucacuggauacaccgauccauauacaggccagcagauaucuuuguuucaagccaugcagaaggaccugauugugagagagcacgggauccguuuacuagaagcucagaucgcaacuggagguguaauugaccccguucauucacaccgggugccugucgauguggccuaccgcaggggcuauuucgacgaggaaaugaauagagugcuggcugauccauccgacgauacgaaaggguuuuucgacccgaacacccaugagaaucucacauaccugcagcuuuugcaacgggccacccuggaucccgagacuggacuccuguuuuuaagccugagucuucaguga

SEQ ID NO: 55844 - RNA, 4539 nt, Artificial Sequence
  derived and/or modified sequence opt3 from EPRS__Homo_sapiens__NP_004437
auggccacccugagccucacagugaacuccggcgaucccccucuuggggcucuguuggcagucgagcacguuaaggacgacgugucuaucucaguagaagagggaaaagaaaauauuuuacaugugagugagaacgucauauucacugaugugaauagcauccugagauaccuagccaggguugcgacgaccgcuggucucuauggcuccaaccugauggaacacacagagauugaccauuggcuugaguuuucugccacuaagcugucgucaugcgauagcuucaccaguacaaucaaugaauugaaccacugucucucccugcggaccuaccuggugggaaauucucucagcuuagcagaccugugcgucugggccacucuuaaagggaacgcugcauggcaggagcaauugaagcagaaaaaggccccagugcauguaaagcgcugguuuggcuuccuggaagcucagcaggccuuucaauccguugguacaaaaugggaugugucaaccacgaaggcgcgagucgcaccggagaaaaagcaggacguggggaaauucguggagcuacccggagccgaaaugggcaaggucacuguucguuuuccuccagaggcuaguggcuaucuccacauugggcacgccaaggcagcucugcuuaaucagcauuaccaggugaacuucaaaggaaagcugaucaugagauuugaugacaccaaucccgaaaaagagaaggaagauuucgagaaaguaauauuggaggacguggccaugcuccacaucaagccugaucaauuuacauauacuagcgaccauuucgaaaccauuaugaaauacgcggagaagcugauccaggaagguaaggccuaugucgacgauacaccagcagagcagaugaaagcugaaagggagcagcggauugacucuaagcaccgcaaaaaccccaucgagaagaauuuacaaaugugggaagagaugaaaaagggcucccaguuugggcagucauguugccugagagccaagauagauaugagcaguaacaauggauguaugagggacccuacccucuaccggugcaaaauucaaccacacccgcgcacgggcaacaaguacaacguguaucccacuuacgauuucgcuuguccuaucguugacucuauugaaggugugacacaugcccuucgaaccacugaguaucacgauagagacgaacaguucuacuggaucaucgaggcacuggggauuaggaaaccauauauaugggaguacucccgguugaaucuaaacaauacaguccugagcaagcguaaacucaccugguuugugaacgaaggacugguagauggcugggacgauccccgcuucccuacgguuagaggcgugcuuaggcgggggaugaccgucgagggacugaagcaguuuaucgccgcucaggguucgucucgauccguggucaauauggaaugggacaagauuugggcguucaacaaaaaggugaucgacccaguugcaccccgcuauguggccuugcucaaaaaggagguaauaccggucaaugugccugaggcucaagaagagaugaaagaaguugccaagcaucccaagaacccagaggugggccugaaaccugucugguacucacccaagguguuuauugaaggggcagaugccgagacauucagugagggagaaaugguaacuuuuaucaauuggggcaacuuaaauaucaccaaaauucacaagaacgcugacgguaaaaucauuagccuggaugccaagcuaaaucucgagaacaaagacuacaagaagacaacuaaagugaccuggcuggcagaaacaacccaugcgcuuccaauacccguuaucugcgucacuuaugagcacuugauuacgaagccugugcuggggaaagaugaagacuucaagcaguacgugaauaaaaacuccaagcacgaggagcucaugcugggcgauccaugucuuaaggaccugaaaaagggagauaucauccaguugcagagaaggggcuuuuucauuugcgaccaaccguaugaacccgucucuccuuacagcuguaaagaggcuccaugcguucucauauauauccccgaugggcauacaaaggaaaugccuaccucaggaaguaaagagaagacuaagguggaagccaccaaaaacgagacauccgcaccauuuaaggagcggcccaccccgagccugaauaacaauugcacuacaucugaagacucauuagugcuguacaaccgcguagccguccagggugaugugguuagagagcuaaaagcuaagaaagccccuaaggaagacguggacgcagcugucaagcagcuccugagucuuaaagccgaguauaaggagaaaacgggccaggaauacaagccagggaaucccccugcggagauuggacaaaacaucagcuccaauucuucggccagcauuuuggaauccaaaucacuguacgaugagguggcugcacagggcgaaguugugaggaagcucaaagccgagaagagucccaaggcuaaaaucaacgaggccguagaaugucuguuaucucugaaggcacaguauaaagagaagaccgguaaagaauacauaccagggcagccuccccuuagccaauccucagacagcucuccaacucguaauuccgagccggcgggcuuggaaacaccugaggccaagguccucuucgauaagguggcuagucagggagaggugguccggaaacugaagaccgaaaaagcccccaaggaccagguugauaucgcagugcaagagcuacugcagcucaaagcucaguauaagagccugauuggcguagaauacaagccagugucugccacaggggcagaggacaaagauaagaaaaagaaagaaaaggagaacaaguccgagaaacagaauaagccccaaaaacagaacgacggacagcgaaaggauccuaguaaaaaucaggguggcgggcuuaguagcucgggagccggcgaaggucaagggccaaagaagcagacuagauugggccuggaggcuaaaaaggaagagaacuuagcggacugguauucccaggucaucaccaaaucugagaugauugaauaccacgauaucagcggaugcuauauacucaggcccugggccuacgcaauuugggaggcuaucaaggacuuuuucgaugccgaaauuaaaaagcugggcguggagaauuguuacuucccuauguuuguuucacagagugcccuugaaaaagagaagacgcauguggcugacuucgcaccggaggucgccugggugacccgcuccgggaagacagaacuggcggagccaaucgcuauacggcccacuucugaaaccguuauguauccugccuacgcaaaaugggugcaaagccacagagacuugccaaucaagcucaaccaguggugcaacgucguaaggugggaguuuaaacacccccagccuuuccugcgcacacgagaauuucuauggcaagagggacauuccgccuucgcuacuauggaggaagcagccgaggaagugcugcagauucucgaucuguaugcgcagguuuacgaggaacuuuuggcuaucccgguggucaagggccggaaaaccgagaaggagaaguuugccgguggggacuauacgacaaccauugaagcauucaucucagccagcggacgugcuauacagggcgguacuucacaccaucugggccaaaauuuuucuaaaauguucgagauuguguuugaagaucccaagaucccaggggagaaacaguucgccuaccagaacuccuggggauuaacaaccagaacuaucggcguaaugaccauggugcacggggacaauaugggacucguccugccucccaggguugcauguguccagguggugauuaucccaugcggcauuacaaacgcucuuagcgaggaagauaaggaggcccugauagcgaaauguaaugacuaucgccggagacuacucucggugaacaucaggguucgagccgaucugcgcgacaauuacucaccugguuggaaguuuaaccauugggaauugaaggggguacccauucggcuggaggugggaccaagagauaugaaaucuugccaauucgucgcagugaggcgugacacgggcgaaaaguuaaccguugcugagaaugaggccgaaacuaaacuccaggcuauccuggaggauauucaggugacacuuuucacccgcgcaagugaagaccugaagacacacauggucguggccaacacuauggaggacuuucagaaaaucuuggauuccgguaagauaguacaaaucccguucuguggcgaaauugacugcgaggauuggaucaagaaaaccacggcccgggaccaggaucucgagccuggggcucccagcaugggagcgaagucucuguguauuccauuuaaaccccuaugcgaacugcagccuggcgcaaagugcgucugugggaaaaauccagccaaguacuauacacuuuucggaagaagcuacuga

SEQ ID NO: 55845 - RNA, 2733 nt, Artificial Sequence
  derived and/or modified sequence opt3 from EPS15L1__Homo_sapiens__NP_001245303
auggccgcuccccugaucccucucagccagcaaauuccaaccggcaacucccuuuacgagucuuauuacaaacagguggacccggcauauacagggagagucggagccucagaagcggcucuguucuugaaaaagagugguuuaagcgauauaauccugggcaaaauuugggaccuagccgaucccgaggggaagggauuucucgacaaacagggcuucuacguugcacugaggcuuguggccugcgcucaguccggucacgaaguaacucugucuaauuugaaccucucgaugccuccacccaaguuucaugauacgucaagcccucugauggugaccccacccagugcagaggcccacugggcuguccggguggaagagaaggccaaauucgacgggaucuuugagucccugcucccuauuaauggauuacugucuggcgauaagguuaaaccagugcuuaugaacagcaaguugccgcuggacguccuaggccgcgugugggaucucuccgacaucgauaaagacgggcaucuggaucgagacgaguucgcgguagcaaugcaccuuguuuaucgugcccuggagaaggaacccgugccuucagcuuugccacccagucucauaccuccaagcaagagaaagaagacagucuuucccggagccgugccggugcugccugcaucucccccaccuaaagacuccuuaaggucaacucccagccaugguagugucucuucccugaauagcaccggcucgcucucuccaaagcacucccuuaaacaaacacagcccaccguuaacugggugguaccuguggcugauaagaugcgguucgacgagaucuuucugaaaacugauuuggaccuagauggguacgucucaggacaggaggugaaggaaauuuucaugcacaguggccugacacagaaucuccuggcccauaucugggcgcuugccgacacccgccaaacggguaagcugagcaaagaucaguuugcauuggcuauguauuucauucagcagaagguuuccaaagggaucgacccaccgcaagugcucucucccgauauggucccuccaagcgagagaggaacucccggcccugacucaaguggcucccuggggagcggagaauuuaccggugugaaggaguuagaugacauaucucaggaaauugcccagcugcaaagggagaaauacucacuagagcaggacauccgggaaaaggaggaagcuauucgccagaagacaagugagguacaggaacuccaaaacgaucuggaccgagagacuagcucccuucaggaguuggaagcccagaaacaggaugcacaagacagacuggaugagauggaccagcagaaggccaaacucagggauaugcugucugacguucggcagaagugucaagaugaaacccagaugaucucgagccuuaaaacacagauccagucccaagagucagaccugaagagucaggaagaugacuugaaucgugcuaagucugagcucaaccgccugcagcaagaggaaacccaguuagagcagagcauucaggcgggcagagugcaacuggaaacgauaaucaaaucccuaaagucaacucaggaugagauuaaucaggcaaggagcaaacucucucagcugcacgagucccggcaagaagcccaucgaagucuugagcaguacgaccaggucuuggacggggcucacggagccagccugacagaucucgcaaaccugucugaaggcguguccuuagccgagcgcgguucauucggggcuauggacgauccauucaagaauaaagcccugcuuuuuaguaacaauacccaggaauugcaccccgacccguuccaaacugaggauccuuuuaagagcgacccauucaagggcgcagaucccuuuaaaggagacccuuuccagaacgaucccuuugcggagcagcaaacaaccucgacggacccauucggcggggauccuuuuaaggaauccgaccccuucagaggaucugcuaccgaugacuuuuucaaaaagcagacuaaaaacgacccauuuacaagcgauccguucaccaagaauccuucacuccccaguaaacuggacccauucgaguccucugaucccuuuagcuccucaagcgucaguucuaaggguuccgacccuuucggcacacuagauccauuugggagcggaucguucaacucagccgaaggcuuugcagacuucucucagaugaguaagcccccuccguccgguccauuuacuagcucucucgggggcgccggauucagcgaugaccccuuuaaauccaagcaggauaccccugcucugccacccaaaaagccugccccgcccaggccaaaaccucccucaggcaagaguacaccagugagccaacuggggucugcagacuucccugaggcucccgauccauuucagccgcuuggagccgacuccggugacccuuuccagucaaagaaaggcuuuggggaucccuucaguggaaaggacccauucguucccagcuccgcggccaaaccuucuaaggcuucggcaagcggcuuugccgauuucaccucauuugguaaugaagaacagcaauuggcuugggccaaacgggaguccgaaaaggcagagcaggaacgccuggcgagauuaaggcgucaggagcaggaagaccucgagcuggccaucgcucuuaguaaggccgauaugccagcagcuuga

SEQ ID NO: 55846 - RNA, 2502 nt, Artificial Sequence
  derived and/or modified sequence opt3 from EPS8__Homo_sapiens__XP_005253396
augagcaaccugaauacccaggugaaggacacaaugaacggccacaucuccaaucaucccucuucauucgggauguacccuagucaaaugaacggauaugguagcuccccaacuuuuucucagacggauagagagcacggcucgaaaaccucagccaaggcucucuacgaacagaggaaaaauuaugcacgggacagcgucaguuccguuucugauauuagccaguaccgcguggagcaucuuacaacuuucguacuggaccgaaaggaugccaugauaaccguggacgaugggauccguaaauugaaguuacuggacgcgaagggaaaagucuggacacaagauaugauucuacagguggacgauagagcuguuucccucaucgaccuggaaucaaagaacgagcuugaaaauuuuccgcugaacaccauucagcacugccaggccgugaugcauaguuguagcuaugauucugucuuggcacucgugugcaaagagcccacucaaaauaagccugaccugcaccuguuccagugugacgagguaaaagccaaccucaucuccgaagauauagagucagcuaucagcgacaguaagggcgguaagcagaaaaggcggccagaugcauuacgcaugauuucuaaugccgaccccuccaucccuccacccccuagagcuccagccccggcgcccccugggacaguuacccagguggaugucaggagccggguggcagccuggucggcuugggccgcagaccaaggagauuuugaaaagccacgccaguaccacgagcaggaggaaacgcccgagaugauggcugcccgaauugacagagaugugcaaauccugaaccauauacuugacgauauugaguucuuuaucacuaaauugcagaaggcggccgaagcauucucugaacuguccaaaaggaagaaaaauaagaagggcaaacggaagggcccuggggagggaguccuaacccuccgugcuaaaccacccccgccugacgaguuucuggacugcuuccagaaguuuaaacacgguuucaaccuucuggccaaguugaagucacauauucagaaucccagugcugccgaucucguucacuuucuguucacaccauuaaacauggugguacaagcaacuggcgggccugaacuggccagcuccgugcucucuccccuucugaacaaagacaccaucgauuucuugaauuauacagucaacggagacgagcgccagcuauggaugagccugggcgguaccuggaugaaggcuagagcggaauggccaaaagagcaguuuauucccccuuacgugccaagguuccggaaugggugggaaccgcccaugcucaacuuuaugggagcaacgauggagcaggaucuguaccaacuugccgagucaguugcuaauguggccgaacaccagcgaaagcaggagaucaaacgccugaguacugaacauuccagcgucucugaguaucacccugcagacggcuacgccuucucaaguaacauauauacaagaggcagccauuuggaucagggggaagcugccguggcauuuaagccaaccuccaauaggcacaucgaccggaacuacgagccccucaagacucaaccuaaaaaguaugcgaaaucuaaguacgauuucguagcucgcaauaacucggagcugagcguuuuaaaagacgauauucuggaaauccuagacgauagaaagcagugguggaaggugaggaaugccuccggagacucagguuuugucccaaacaauauacucgacauugugcgucccccggagaguggccuggggcgggcagauccuccauauacacauaccauccagaaacagcgaauggaauacggacccagaccugccgacacgcccccagcuccuucucccccaccgaccccugcccccgucccagugccccuuccuccaagcacacccgcaccuguuccgguguccaagguaccagcuaacaucacuaggcaaaauucaucuagcuccgauaguggcgguagcauuguccgcgacucucagcggcacaaacaguugcccguggauagaaggaagucccaaauggaggagguucaggacgaacugauccaccgccucaccauugggcgaucagccgcgcagaaaaaguuccaugugccucggcagaacgucccagugauaaacaucacauacgauaguacucccgaggacguaaaaaccuggcugcaaagcaagggcuuuaauccugugacaguuaacucgcuuggaguccugaauggcgcccaguuguucucccucaacaaggaugaacugcguaccguguguccggagggggcuagaguguauucucagauuacuguccagaaagcagccuuagaagacagcucaggaaguuccgagcugcaagagaucaugaggcgccggcaggaaaagaucucugcugccgcaagcgauuccgguguugagucauuugacgaaggcagcagucacuga

SEQ ID NO: 55847 - RNA, 2148 nt, Artificial Sequence
  derived and/or modified sequence opt3 from EPS8L2__Homo_sapiens__NP_073609
augagccaguccggcgccgugucuugcugucccggggcuaccaacggaucacuggguagaagugacggcgucgcaaagaugagcccuaaagaucucuucgagcaaaggaagaaauacuccaauucuaacguuaucaugcacgaaacaucgcaguaucaugugcagcaccuugccacuuuuauuauggacaagucagaggcgauaacgagcguagaugacgcuauccggaaacuggugcaguugaguuccaaggaaaagauuuggacccaagagauguuacugcaggucaaugaucagucucuacgccuccuggacaucgaaagccaggaggagcuugaagauuucccacugccgacagugcaacgaucccagacuguuuugaaccagcuccguuaccccucagugcugcugcucgucugccaggacagugagcaaagcaaaccugaugugcacuuuuuccauugugacgaaguagaggccgaguuaguucaugaagauauugagucugcacuggccgacugcagacuugggaagaaaaugaggccacagaccuugaagggacaccaggaaaagauccggcaacgccaguccauacugcccccuccacagggccccgcuccuaucccauuucagcacagagguggggauucaccggaggcaaagaauagggugggaccccaagucccucuaagcgaaccaggcuuccggcgccgagagagucaggaggaacccagagccgugcucgcucagaagauugagaaagaaacacagauccugaacugugcccuugacgacauugagugguuuguggcgaggcugcaaaaggcagccgaggcuuucaaacaguugaaucagcggaagaaaggcaagaaaaaggggaagaaagccccugcagagggaguccucacccugcgugcucgcccacccucugagggugaauuuaucgauugcuuccagaagauaaaauuagccauuaaccugcucgcgaaacuucaaaaacauauccagaauccguccgccgcagagcugguucacuuuuuguucggcccucuagaccugauugugaacacuuguagcgggcccgauaucgcuagaucgguaucuugcccacuccuguccagggacgccguggauuuucuucggggacaucuggucccuaaggaaaugucauugugggagagucucggcgaaagcuggaugcgaccccgcuccgaguggccaagagagccccaggugccucuguauguuccaaaguuccacucugguugggaaccgcccguggacgucuuacaggaggcuccuugggaaguggaggggcuggccagcgcaccaaucgaggaaguaucacccguuaguaggcaauccauucggaauagccagaaacacucuccuacaucagagccaacgcccccgggagaugcccuaccuccagugaguagcccccauacccaccgcggcuaccagccuacucccgcuauggcgaaguaugucaaaauacucuacgacuucaccgcaagaaacgccaaugaacuguccgugcuuaaggaugaggucuuggaagugcuggaggacggcaggcaaugguggaaacuccguucucggucggggcaggcuggauauguuccauguaacauccugggugaggcccgaccugaagaugcaggcgcccccuuugagcaggcugggcagaaguacuggggaccagccagcccgacacauaaacuuccucccuccuucccaggcaauaaggacgaacugaugcaacacauggacgaggugaacgaugaauugauuagaaagaucucaaacauaagggcacagccccagcgccauuuucggguagagagaagucagccugucucucaaccacucacuuacgagagcggucccgacgaagugagggcguggcuggaggcuaaagccuucuccccucgcauuguugaaaauuuagggauccugaccggcccgcagcuauuuucacucaacaaggaggaacugaaaaaggugugcggagaggagggcguccgaguguauagccagcuuacaaugcagaaggcauucuuggaaaaacaacagucuggguccgagcuggaagaacucaugaauaaguuucacaguaugaaccagcggcguggagaggauagcuga

SEQ ID NO: 55848 - RNA, 1233 nt, Artificial Sequence
  derived and/or modified sequence opt3 from EPSTI1__Homo_sapiens__NP_001002264
augaacaccagaaauaggguggucaacagcggccugggggccucccccgcuucucggccuacacgcgacccacaggauccgucaggacgacaaggugagcucagucccguugaagaccagcgugagggccuugaagcagccccuaaggggccaagcagagaguccgugguacacgcgggacagaggcggacuucugcuuacacgcugaucgcccccaauauuaaccgcagaaaugaaauacagaggaucgcagagcaagaguuggccaacuuagaaaaauggaaggagcagaaucgggcuaaaccugugcaucuggucccacgccgacuaggcgguucgcagucagaaaccgaggugagacagaagcaacagcuccagcugaugcagagcaaauauaagcaaaaacuuaaaagggaggaaaguguucggauuaagaaagaggcagaagaggccgaacugcagaagaugaaagcuauccagcgugagaaguccaacaaguuggaggaaaagaagcgccuccaagagaaucugagaagggaagccuuccgggagcaccagcaguacaaaacagcggaauuucugucuaagcucaacacugagagccccgaucgauccgcaugccagucagccgugugugggccucaaaguagcaccuggaaauuaccaauucugccgcgcgaccauucuugggcuagauccugggccuauagggauucacuuaaggcagaggaaaaucggaaauugcagaagaugaaggacgagcagcaccagaaaagcgaacugcuagagcucaagcgccaacagcaggaacaggagagagcuaaaauccaucaaacagagcacaggcgugucaacaaugccuuccuggaucggcuucagggaaagagucagcccggcggccuggaacagucugggggaugcuggaacaugaacuccgguaauagcuggggcucguugcucguguuuucucgacaccugagaguauacgagaaaauauuaaccccuaucuggccauccucaacugaccuggaaaagccccaugagaugcuuuuccucaacguuauucuguuuaguuugacaguguucacccuaaucagcacggcgcacacucuggauagggccguccgcuccgacuggcuccugcuugugcugauuuaugcauguuuggaggaacucaucccugagcugauauuuaauuuauacugccaagggaacgcuacccuguucuuuuga

SEQ ID NO: 55849 - RNA, 2148 nt, Artificial Sequence
  derived and/or modified sequence opt3 from EPX__Homo_sapiens__NP_000493
augcacuuacuccccgcccuugcuggcgugcuggcaaccuuggucuuagcccagccuugcgaggggacagacccagcgagcccgggagcuguugaaacuuccgugcugagagauuguaucgccgaggcaaagcuacucguagacgccgcuuacaacuggacgcaaaaaucuauuaagcagaggcugcggucagguagugcaagccccauggaucuucuguccuauuucaaacagccuguggccgcuacccgcacagucgugcgagccgcggacuacaugcauguugcauugggccuccuggaagagaagcugcagccacaacguucugggcccuuuaaugugacugauguccucaccgaaccucaguuaagacugcuuucgcaggccucaggaugcgcuuugagggaccaggccgagcgguguagcgauaaauaucgcacaauaaccggcagaugcaacaauaagaggcggccacugcuaggugcaaguaaccaagcucucgcccgcuggcugcccgcggaguacgaagacgggcuuucccugccuuucggauggacuccaucucgaagaaggaauggcuuuuugcucccgcuggugcgggccguaagcaaccagaucguucguuuccccaaugagcgcuuaacauccgauagaggcagggcacugauguuuaugcagugggggcaguucauugaccacgaucucgacuuuucaccugaaaguccagcucggguggccuucaccgcuggagucgauugugagcgaacgugcgcccaacuucccccuuguuuuccaaucaagauucccccgaacgacccucgcaucaaaaaucagagagacugcauacccuucuuuaggagcgcaccaucuuguccucagaacaagaaucgggugcgcaaccaaaucaaugcccugacuuccuucguggaugcuucaauggucuaugguagcgagguuaguuugucucuaagacugaggaaccguaccaauuaccucggccugcuugcgauuaaccagcgguuucaggacaacgggcgagcacuguugcccuucgauaaucuccaugacgauccaugccuguuaacaaacagauccgccaggauccccuguuuccuggcuggagacacucgcagcaccgaaacaccuaaacuagccgcaaugcacacccucuuuaugcgggagcauaauagacuggccacggaacuuaggcgcuugaacccacgauggaauggcgauaagcuguauaacgaggcucggaaaauuaugggugccauggugcagaucauaacuuaccgugacuuccucccgcugguacuugggaaggcaagagcgaggcgcacacugggacacuaccggggcuauugcucgaauguggaucccagagucgcuaacguguuuaccuuggccuucagguuuggccacacuaugcuccaaccuuucauguuucgacuggacucucaguaccgcgcauccgccccaaauucacauguucccuuaaguagcgcuuucuuugccuccuggcggauuguguaugaagggggaaucgauccuauucugagaggucuaauggcaacaccagcuaagcucaacaggcaggacgccaugcuggucgacgagcuucgugaucgcuuguucagacaggugcggaggaucggccuggaccucgcggcccugaauaugcaacgaucucgggaucacggguuacccggauacaacgcuuggcgcagauuuugcggccugagccagccgaggaaucuugcacaguugucacggguacucaaaaaccaggaccuggcccgaaaguuccuaaaucuguaugguaccccugauaacaucgacauuuggauaggggcuaucgccgagccacuccugcccggcgcaagaguuggaccucuuuuggcgugucuguuugaaaaccaauuccgcagggcccgugauggcgaccgguucugguggcagaaaagagggguguuuacgaagaggcagcgcaaagcucugagucgaauuucccucagcagaaucauaugcgauaauaccggaauuacaacugucucucgggacaucuucagggccaacaucuacccccgcgguuuugugaauuguucacguauuccaagacugaaccuuagugcauggcggggcaccuga

SEQ ID NO: 55850 - RNA, 969 nt, Artificial Sequence
  derived and/or modified sequence opt3 from EPYC__Homo_sapiens__NP_004941
augaagacccuggccggccucgugcuugggcuggucaucuucgacgcugcaguuacagcccccacuuuggagagcauuaacuacgauuccgaaacguaugacgcgaccuuagaggaucuggacaaucuauacaacuaugaaaauauaccuguggauaaaguagagaucgaaauugcuacagugaugccaucuggaaacagagagcuccugacuccgcccccucagccagagaaggcccaagaagaggaagaggaggaagagucaacccccaggcuuaucgacgguaguagcccucaggaaccagaguuuacaggcguccuggggccccacaccaaugaagauuucccuacuugcuugcucuguacaugcauuuccaccacgguguacugugacgaucaugagcuggacgcaaucccaccgcugcccaaaaacacugccuauuuuuacucucgguucaaucgcauaaagaaaaucaacaagaaugauuuugcuucgcucucagacuuaaagcgaauugaucugaccagcaaccuuaucagugagauugacgaagacgcauuccguaaauugccucagcugagagagcuaguucucagggauaauaagauccggcagcugccagaacuucccacaacucugaccuuuauagacauuuccaacaaucgcuugggaagaaaaggcaucaagcaagaggccuucaaagauauguaugaccuccaccaucuguacuuaacagauaacaaucuggaccacauuccucucccacuucccgaaaaccugagggcuuugcaucuacagaacaauaacauccuggagaugcacgaggauaccuuuugcaaugugaagaaccucacguacauccggaaggcccuggaagacauucgccuugaugguaauccgauaaaccugucuaaaacuccucaggcguauauguguuugccccgacucccagucgggagccugguguga

SEQ ID NO: 55851 - RNA, 1314 nt, Artificial Sequence
  derived and/or modified sequence opt3 from ERAL1__Homo_sapiens__NP_005693
auggccgcucccagcuggagaggcgcaaggcuggugcaguccguccuccggguuuggcaaguggggccucacguagcccgcgagcgagugaucccauucucuucacuucugggauuucagcguagaugcgucaguuguguggcggguagcgcuuucuccggcccgagguuggccucugcaucgcggucaaacgggcagggaagcgccuuagaccauuuucugggcuucagucagcccgauuccucuguuaccccuugcgugccagcugucagcaugaaucgcgacgaacaagaugugcuacucguacaccaucccgacaugccugagaacuccagaguucugagggugguccuucugggugcaccaaaugccgggaagucaacauugaguaaccagcuccugggacggaaaguguuucccgugagccgcaagguccacacuacgcgaugucaggcucugggcguuauuaccgaaaaagagacacaggugauacucuuagauacuccuggcaucauuucuccagggaagcagaaaagacaucaccuggaacuuuccuugcuggaggacccguggaagucaauggagagcgccgaucuaguagugguccucguggacguuagugauaaguggaccaggaaucaacugucuccccagcuucugcggugcuugacaaaauacucccagaucccuagcgugcucgucaugaacaagguggacugucugaaacaaaagucgguauuacuggaacucaccgcggcacuuacugagggaguugugaaugguaaaaagcugaagaugcgucaggccuuccacucucauccaggcacacacugccccuccccugcugucaaagauccaaacacccagucaguggggaauccccaacgcauuggauggccgcauuuuaaggaaaucuucauguugagugcccuaagccaggaggacgucaaaacgcugaagcaguaucuccugacucaggcacaaccuggccccugggaguaccacuccgcugugcuuaccucucagacaccagaagagauaugugccaacaucauuagagaaaaacuguuggagcaccucccucaggaaguucccuauaaugugcagcaaaagacugcgguaugggaggaggguccagggggagaacuggucauccagcagaaauuacuggugcccaaggagagcuacguuaagcuacucauuggcccuaaaggccaugugaucucacagauagcccaagaagcagggcacgaucugauggacauuuuucuuugcgacgucgauaucagguugagugugaagcugcucaaauga

SEQ ID NO: 55852 - RNA, 2826 nt, Artificial Sequence
  derived and/or modified sequence opt3 from ERAP1__Homo_sapiens__NP_001185470
augguguuccugccccucaaguggagccuugccaccauguccuuucuguugucuucauuacuggcucuacucacagucaguacuccuagcuggugccaguccacggaggcaucuccaaagagaucggacggcaccccguuccccuggaacaagaucaggcugccugaauacguuauuccagugcacuaugaucuucugauacaugccaauuugacaacucucaccuuuugggggacaaccaaaguagagaucacugcgucacaacccacaagcaccauuauccugcacagucaucaucugcagauuucccgggcuacgcuccgcaagggagccggugaacgauuaucugaggaaccucuucaggugcuugagcacccacgucaggagcaaaucgcauugcuggcccccgaaccucuacucgucggccugccauacacugugguuauacacuaugcugggaaccuuagcgagaccuuccacggauuuuacaaauccacauauagaacuaaggaaggcgagcugaggaucuuggcaucaacccaguucgagccgacagccgcucggauggccuuucccuguuucgacgaaccugcguuuaaggcaaguuucagcauuaaaauccgcagagagccaaggcaucucgccauuucuaauaugccccuggugaaguccgucaccguggcugaagguuuaaucgaggaucacuuugacguaacgguuaaaaugucaacuuaccugguggccuucauaauuagcgauuuugaaagugucucuaagaucacaaaauccggggugaaggugagcgucuaugcaguuccugacaagauuaaccaggcugauuacgcccucgacgcggccgugacccuucuggaguucuacgaggauuauuucucgaucccauaccccuugccgaaacaggaccuagcagcuaucccugauuuucaaucuggagccauggaaaauuggggccugacuacauaucgggaguccgcucuccuguucgacgccgaaaagucaagugcaagcuccaaacuuggcauuaccaugacgguagcccaugagcuggcucaccagugguuugggaacuuggugaccauggaaugguggaaugaucucuggcugaacgagggauucgcgaaguuuauggaguucgucucugugagcguuacacaccccgaauuaaaagugggugacuacuuuuucggcaagugcuuugacgcaauggaggucgaugcccuuaauucaagucauccaguguccacuccuguagaaaaccccgcucagauacgcgagauguucgacgauguuagcuaugacaaaggggccuguauccuaaauaugcuccgagaauaccugucugcagaugccuuuaagucaggaauugugcaguaucuucaaaagcacaguuacaaaaacaccaagaaugaggacuugugggauagcauggcuuccaucugcccaacagacggcgucaaagguauggauggguucuguucuagaucgcagcauagcuccucaaguucucacuggcaucaggagggaguggacgucaagacuaugaugaacaccuggacacugcaaaaaggcuuuccccucauaaccauuacugugaggggccggaauguucacaugaagcaggaacacuacaugaaggggagcgauggagccccugacacggguuaucuguggcaugugccacuuacauucaucaccuccaaaucagacaugguacaccguuuccuguugaagacuaaaaccgauguccucauccugccggaggaaguggaguggauuaaguuuaacguuggcaugaacggguacuauaucgugcauuacgaggacgauggaugggacagcuuaacaggccugcuaaaagguacccacacugcagucucuuccaaugaucgcgcgagucucauuaacaaugcuuuccagcuggugagcauagggaagcugucuaucgaaaaggccuuggaccugucccucuaucugaaacacgagacagaaauuaugcccguauuucagggcuuaaacgagcugaucccuauguacaagcugauggaaaagagagauaugaaugagguggagacgcaauucaaggcauuuuugaucaggcuccugcgggaccuaauugauaaacagaccuggacugacgaaggaucaguuagugagcgaaugcugcgcagccagcuccugcuuuuggccugcguccauaacuaucagccaugugugcaaagagcugaaggcuacuucaggaaguggaaggagucgaaugggaaccuguccuuacccguggaugucacacucgccguuuuugcagugggagcucagucuaccgaagguugggacuuccuguacagcaaauaucaguuuucacuuaguuccacagagaagucucagauagaguucgcccugugccggacucaaaauaaagaaaaguugcaguggcuccuggaugagagcuuuaaaggcgacaagaucaaaacccaggaguucccucagauucuaacgcugaucgggcgcaacccagugggauacccccucgcguggcaauuucugagaaagaauuggaacaaacuuguacagaaauucgaauugggcuccucaagcauugcccacauggucauggguaccacaaaucaguucaguacuaggacccgucuggaagaggugaagggguuuuucucuuccuuaaaagagaacggcagccaacuccgguguguucagcagacaaucgaaacuauagaggaaaauaucggauggauggacaagaacuuugauaaaauucgaguguggcugcagucggagaaacuugagagaauguga

SEQ ID NO: 55853 - RNA, 2883 nt, Artificial Sequence
  derived and/or modified sequence opt3 from ERAP2__Homo_sapiens__NP_001123612
auguuccacagcuccgccauggugaacucucauagaaagcccauguuuaauauccacaggggcuucuacugccugaccgcuauucucccucagauauguaucugcucacaauuuagugucccaagcuccuaucauuucacagaggacccgggggcauuucccguugccacuaacggagaacgguucccuuggcaggagcuucgccugccaucugugguaauucccuugcacuacgauuuauuugugcauccuaaucugacgucgcuagacuucgucgcgucagagaaaaucgaagugcucguuagcaacgcuacccaguuuauuauccugcacaguaaggaucuugaaauaacaaaugccacucugcaguccgaggaggacucucgauauaugaaaccagguaaggaauugaaagugcucagcuaccccgcacacgagcaaaucgcccugcuggucccugaaaagcucaccccacauuuaaaguauuacguggcuauggauuuccaggcaaaacugggcgacggguuugagggauucuauaaguccacauaccguacccuuggcggugagacuagaauuuuggccguaacagauuuugaaccgacccaggcuaggauggccuuccccuguuucgacgagccucuguuuaaagcgaacuucucaaucaagauucggcgcgaaaguagacacaucgcacuaagcaauaugccaaaaguuaagacgauagagcucgaagggggacugcuugaggaucauuuugagacuaccgugaagaugucuacauaccuggucgccuauauugugugcgacuuccacuccuugucaggcuuuacuagcaguggcgugaaagucucuaucuacgcuucccccgauaagaggaaccagacccacuaugcccuccaagcaagccugaaauuacuggacuucuacgaaaaguauuuugauauuuacuauccucucucgaaacuugaccugaucgcuaucccagacuucgcccccggggcgauggagaauuggggauugauuacauaccgggaaaccucucuacuguuugauccgaagacguccucagccagugacaaacucuggguuacucgcgugauagcacaugagcuggcucaccagugguucgguaaccuuguaacaauggaaugguggaaugauaucuggcugaaggagggcuuugccaaguacauggaguugauugcugugaacgccaccuauccugaacuccaguucgacgauuacuuucugaaugucuguuucgaggugaucacuaaagacagcuuaaacuccucucgacccauaagcaagccagcagaaacaccuacccagauucaagagauguucgaugaaguuucauauaauaaaggggccugcauccugaacaugcuaaaggacuuucucggagaggagaaauuccagaagggcaucauucaguaccugaagaaauuuaguuauagaaacgcuaagaaugaugaccuuugguccagcuugucuaacucaugucuggaaagugauuucacgagcgguggggugugccauuccgaccccaaaaugaccucuaauaugcucgcguuucugggagagaacgcagaagucaaggagaugaugacaacuuggacccuucaaaaaggcaucccacuguuggugguaaagcaggacggcuguucgcucaggcugcagcaggagcgguucuuacaagggguuuuucaggaagaucccgaguggcgugcccugcaggaacgcuaccuauggcacauuccucucacauauagcacuuccucaaguaaugugauacauagacacauccugaagucuaaaaccgacacacuugauuugccagagaagaccagcugggucaaauucaacguggacuccaauggauacuacauuguccacuaugaaggucauggcugggaucagcugaucacucaacucaaccagaaucacacgcuguuaaggccgaaggaccggguggggcugauccaugauguuuuucagcuugugggagcuggccgauugacacucgacaaagcccuggauaugaccuacuaucuacagcacgagacuucaagccccgcacugcucgagggucugucuuaccuugaauccuucuaucacaugauggaccgcagaaacauuagugauauaagcgagaauuugaagagguaccuguuacaauauuuuaagccuguaaucgaccggcagucuugguccgauaaagggucagucugggaccgcaugcucagaagugcccugcuuaagcuggcuugcgacuugaaccaugccccauguauucagaaagcagcggaacucuucagccaguggauggagucguccggcaagcugaauauccccaccgaugugcuaaaaauuguuuacucugugggagcucaaacaaccgccggcuggaacuaccugcucgaacaguaugagcugagcaugucaagugcagagcagaauaagauccuuuacgccuuguccacuucuaaacaccaagaaaagcuguuaaagcucauagagcuggggauggaaggaaaagucaucaagacacagaaccuugcugcccugcuacaugcaauugcuaggcguccuaaaggucagcagcucgccugggacuuugugcgggagaacuggacgcaccuguugaagaaauucgaucugggcagcuaugacauccgaaugauuaucuccgggaccacugcgcauuucucaagcaaggauaaguuacaagaaguaaaacucuuuuucgagagucuggaggcccagggaucucaccuugacauauuucagacagugcuggaaaccauuacaaagaauaucaaaugguuggagaagaaccucccaacucugagaaccuggcuaaugguuaauacguga

SEQ ID NO: 55854 - RNA, 702 nt, Artificial Sequence
  derived and/or modified sequence opt3 from ERAS__Homo_sapiens__NP_853510
auggagcugcccaccaagccuggcacauucgaccucgggcuugccacuuggagcccauccuuucagggagaaacgcacagagcucaagcaaggcggcgcgaugugggucgacagcugccggaguacaaagccgucguugugggcgcgucugggguaggaaagucagcuuugaccauccaguuaaaccaucagugcuucguggaagaccacgaucccacaauucaagacaguuauuggaaagagcugacucuagauagcggcgacuguauacucaauguccuggauaccgccggucaggcaauccaucgugcccuuagagaccagugccuggcugugugugaugggguuuugggaguguuugcacucgacgauccuuccucucugauucagcugcaacagaucugggccacauggggcccacaccccgcucagccucucgucuuagugggcaacaagugcgaccugguaaccacugccggggaugcgcaugcagccgcugccgcacuugcucacucguggggagcccacuucguugaaacaucagcgaaaaccaggcaggguguggaggaggccuuuagcuugcugguccaugaaauucaacgggugcaggaggcaauggcuaaggaaccaauggcccgcaguuguagagagaagacgaggcaccagaaagcuacuugccauuguggcugcuccguggccuga

SEQ ID NO: 55855 - RNA, 3678 nt, Artificial Sequence
  derived and/or modified sequence opt3 from ERBB2__Homo_sapiens__NP_001005862
augaagcugagacuccccgccagcccugagacccaccuugacaugcugaggcauuuguaccagggcugccaagugguccaggggaacuuagaacugacauaucuaccaacuaaugcuucccucucuuuccugcaggauauccaggagguucaaggauacgugcuuauugcacacaaccagguacgccaggugccgcugcagcgguugcgaauaguccgugguacgcaacucuuugaagacaauuaugcccuggcggugcuggauaacggcgacccccucaauaacaccacaccuguuacuggggcuucaccaggaggcuuaagagagcugcagcuuaggaguuugaccgaaauccugaaagguggggugcuaauucagcggaauccccagcucuguuaccaagauacaauccuguggaaggacauuuuccauaaaaacaaucagcuugcccugaccuugaucgauacuaaccgcagcagagcaugccacccuuguuccccaaugugcaagggaucuagguguuggggcgagucgucagaggacugccagagccucacacggaccgucugugccggcgggugcgcucgcuguaaaggaccccugccuacggauugcugucaugaacaaugcgcagccgguugcacuggcccaaagcacagugacuguuuagcuugccugcacuuuaaucauuccgggauaugugagcuccacugcccggcccuugugaccuauaacacagauacuuucgaaucuaugcccaauccugagggacgauacaccuuuggcgcgagcuguguaacagcaugcccauauaacuaccuguccaccgacguugguucauguacguuggugugcccccuacauaaucaggaggucacugccgaagaugggacacagagaugugagaagugcaguaaaccuugugcuagggugugcuacggacugggcauggaacaccuccgggaggugcgugccgucaccagcgcaaacauccaggaguucgcuggcugcaagaaaauuuuugggucucuggccuuccuuccagaauccuuugacggagaccccgcgucaaacacugccccgcugcaaccugagcaguugcagguuuucgaaacacucgaggaaaucaccgguuaucuguacauuagcgcauggcccgauaguuuaccagaccugucuguguuucagaaucuacaaguaauccgcggcagaauacuccacaacggggcuuauucccugacgcuucagggauugggcauuagcuggcugggucucaggucgcugcgggagcuugggucuggccuggccuugauccaucacaauacccaucucuguuucgugcacacagucccuugggaucagcuguuucgaaacccccaucaggcuuuacugcacacugccaaucgcccagaagacgagugcgugggagagggccuagcaugucaccaacucugcgccagagggcauuguuggggacccgguccuacccagugcguuaacuguucccaguuccugaggggccaggaaugcguggaggaaugucggguccuucaaggguugccacgcgaguacgugaaugcuagacacugccugccgugucaucccgaaugccagccucagaacggaucaguaacaugcuucggcccagaggcggaucaauguguugcaugcgcccacuauaaggaucccccuuuuuguguggcuaggugcccaaguggugucaaacccgaccucagcuacaugccgauuuggaaguucccugacgaggaaggggccugucagccaugccccaucaauuguacucacuccugcguggaucuggacgauaagggcuguccugcagagcagcgugccucucccuuaaccagcaucauuucagcugucgugggaauacugcuuguugugguauugggcgucguguuugggauccucauuaaacggcgacagcaaaagaucagaaaauauacaaugaggcgccugcuacaggaaaccgagcugguugagccacucacuccuaguggagccaugcccaaccaggcacagaugcggauacugaaggaaacggagcuuagaaaagugaaggucuuggguuccggcgcguucgggacaguguacaaaggaauuuggaucccagacggcgaaaauguaaagaucccgguggcuauuaagguucugagggagaacaccagcccuaaagccaauaaggaaaucuuagacgaggcauacgucauggccgguguggggucucccuaugugucacgccuccugggcauuugccuuacuagcaccguccaacugguuacacaguugaugccauacggaugucuccuggaucaugugcgagagaaccggggccgucuagggagccaggaccugcucaauuggugcaugcagauagcuaaaggaauguccuaucuggaagaugugagacuuguacacagggacuuggccgcacgcaacguccuggugaagucucccaaccauguuaaaaucaccgauuuuggcuuagcucggcuccuggacauugaugagacugaauaccacgccgacggugggaaggugccuaucaaguggauggcgcuugagucgauccugagaaggcgauucacacaucaaagcgaugucugguccuauggagugacgguuugggaacuaaugaccuuuggcgccaaaccauacgacgguauucccgcucgcgagauaccugaucuccuggagaagggcgaacgguugccgcagccacccaucugcacuauugacguguauaugaucaugguaaaauguuggaugauugauucagagugcagaccuagguuccgugaacuggucagugaguuuucucgcauggcacgggacccacagagauucguggugauccaaaaugaagacuuagggcccgccagcccucucgauuccacauuuuacaggucacugcuugaggacgaugacaugggagaucuggucgacgcugaggaauacuugguuccgcagcagggcuucuuuugucccgauccagccccuggggcaggaggcauggugcaccaccgacaucggaguucuuccacccgcaguggugggggagaccucacacugggccuagagcccagcgaagaggaggcgccaagaucuccucuggcccccuccgaaggugcuggcucagauguauucgacggggaucuuggaaugggcgccgcaaaggggcuccagagucugccaacucacgacccgagcccuuugcaaagguauucggaggaucccaccgugccacugcccuccgaaacggacggauacgucgcuccuuuaaccugcucuccacagcccgaguaugugaaccagccugacguucggccgcagccacccagcccucgagaaggcccccucccagccgcaagaccugccggugcuacacuggagcgccccaaaacucuuucaccagggaagaauggaguggucaaggauguguucgcguuuggcggugccguugagaacccugaauaccugaccccgcaaggcggggcagcuccccagccacauccucccccagccuucaguccugccuuugacaauuuguauuacugggaucaggaucccccggagaggggagcuccaccuuccacauucaaaggcacucccaccgcagaaaacccagaguaucucgggcuggacgugcccgucuga

SEQ ID NO: 55856 - RNA, 3909 nt, Artificial Sequence
  derived and/or modified sequence opt3 from ERBB2IP__Homo_sapiens__NP_001006600
augaccacaaagagaagccuguucgugaggcucguccccugccggugucuucgcggcgaggaagagacuguuacgacccuggacuacucccacugcucuuuggaacaggugccuaaagagaucuuuacauucgaaaagacuuuagaggagcuguaucuagaugccaaccaaauugaagaacucccaaaacagcuguuuaauugucagucacuucauaagcugaguuugccggacaacgaucucaccacacugcccgcuagcauagcaaaucugaucaaccuccgagaauuagacguauccaaaaaugggauucaggaguucccugagaacaucaagaauugcaaggugcugaccauugucgaagccucugugaacccaaucucgaaacuucccgauggauuuucacaauugcugaaucuaacucagcucuaccugaacgacgcguuccuugaguuucugccugcuaauuucggucguuugacaaagcuccagauacuggaauuaagagagaaccagcugaaaaugcucccaaagaccaugaauaggcuuacgcaacuggaacgguuggaucuaggcagcaacgaguuuacugagguucccgaagugcuggagcagcucagugggcugaaagaguucuggauggacgccaaucgccuuaccuuuaucccuggauucauuggcucccugaagcaguugacauaucucgaugucucuaagaacaacaucgagaugguggaagaggguauuagcacuugugagaaucugcaggacuuacugcuauccucaaacagucuccaacagcugccagaaaccaucgggagccuuaaaaauauaacaaccuugaagauugaugagaaccagcugauguaccucccggacucuaucggaggccugauuuccguagaagaacuugauugcucauuuaaugaaguugaggcacugcccagcaguaucggccaauugacgaaccucagaacuuucgccgcugaccacaauuaucugcagcaguuaccuccagagaucgggucuuggaaaaacauuacagugcuguuccuacauuccaauaagcucgaaacccugcccgaggaaaugggagacaugcagaaacuuaaggucauaaacuugagcgauaauaggcugaaaaaccucccuuuuucguucacuaagcugcaacaguuaacagcaauguggcugucugacaaucaguccaagccacuuauccccuugcagaaagagaccgauucagagacgcaaaagauggugcucaccaacuacauguuuccgcagcagccucggacagaagacgugauguucauuagugauaaugagagcuuuaaccccucccugugggaggagcagcgcaaacaacgagcccaggucgcuuucgaaugugacgaggauaaggacgagagagaagccccaccuagggaggguaaccuaaaacgguaucccacuccauaccccgaugaacugaagaauaugguuaagaccgugcagacaaucguacaccgucucaaagacgaggaaacuaacgaggauucuggccgcgaccugaagccucaugaggaccagcaagauauaaauaaagacgugggggucaagaccagcgaaucaacaaccacugugaaaaguaagguugaugagagagaaaaguacaugauuggaaacuccgugcagaaaaucagcgagccagaagcggagaucucuccgggcucacuucccgucacggcaaauaugaaggccagugagaacuugaaacacauugugaaucacgacgauguauuugaagagagcgaggaacuguccucugacgaggaaaugaagauggcugagaugaggccuccauuaaucgaaacaucgauuaaccagcccaaaguuguggcccucagcaauaacaagaaggaugacaccaaagagacugauucccugucagacgaagucacccauaauaguaaccaaaauaacucuaauugcagcuccccuucacggaugagcgauucugugucccuuaacacagacaguagccaggauaccucucuguguuccccagucaagcagacucacauagacaucaacucaaaaauucgacaggaggacgagaauuucaacaguuugcuccaaaauggugauauccugaacagcucgacagaagagaaguuuaaagcacaugacaagaaagauuucaaucuacccgaauaugaccugaacguggaggaacgccucguucugaucgagaaguccguggauucuacggcuaccgccgacgauacucacaaacuugaccacauuaauaugaacuugaauaagcugauaacaaacgauaccuuucagccggagaucauggaaagaagcaagacacaggacauuguauuagggacuucauuccucaguaucaauuccaaagaggaaaccgagcaucuggaaaacggaaauaaguacccuaaccuugagucugucaauaaagugaacggccacagcgaggaaacgucccagucaccaaacaggaccgagccccaugauagcgacugcaguguugaucugggcauuucuaaguccacagaagaccuaagcccucaaaagucggggcccgugggaucagucgugaaaucucacaguaucacuaauauggagauagguggccucaagaucuaugacauucuguccgauaacgggccacagcagccuagcaccacaguaaaaaucacuucugcgguggacggaaagaauauuguucggagcaaauccgccaccuugcuguacgaucagcccuuacaagucuuuacgggcucaaguucuagcuccgaccucaucucagguacaaaggcaauauucaaguucgauaguaaccauaauccagaggaaccgaacauuauccgcgggccuaccagcggcccccaguccgcuccacagauuuauggacccccucaauacaauauccaguauucuucgagcgccgcugugaaagacacucuguggcacucaaagcagaacccacagauagaucacgccuccuuucccccucaacuucugccgagaagugagucuacagaaaaucagagcuacgcaaaacauuccgccaacaugaauuucucaaaccacaauaacgugagggcuaauaccgcguaccauuugcaccagcgucucggcccagcacggcacggggagaugugggccaucucucccaacgaccgacugauuccugcugucacuagaagcaccauccagaggcaaaguuccguuagcucuacagccucagugaaucuaggagauccagguuccacgcgccgggcacagauucccgaaggcgacuaucugaguuacagagaguuucauagcgccgggaggaccccuccgaugaugcccggaucgcagcgcccacuuucugcucgaacuuauuccaucgauggcccuaacgccagccggccccagucagcacguccaaguauaaacgagauuccugaaagaacaaugucuguguccgacuucaauuacagcaggaccucacccaguaagcgcccaaacgcgcggguagguagcgagcacucccuccuggacccgccugggaaaucuaagguccccagagauuggagggaacaaguguugcgacauaucgaggcuaagaaacuggaaaagauccgcguucggguggagaaagacccagaguuaggcuuuagcauuuccggaggcgucgggggaagagguaaucccuucaggccugaugacgauggcaucuuugugacacguguucagccagaagggcccgccucaaagcuccugcagccuggagacaaaauuauacaggcaaacggcuauucuuucaucaauauugagcacggucaagccgugagucuucugaagacuuuucagaacaccguagaauugaucauuguccgcgaggugucgagcuga

SEQ ID NO: 55857 - RNA, 552 nt, Artificial Sequence
  derived and/or modified sequence opt3 from ERBB3__Homo_sapiens__NP_001005915
augagagccaacgacgcucuccaggugcugggccuucuguucagcuuggcaaggggguccgaggucggaaauucucaagccguuugccccgguaccuuaaacggccugucagugacaggggaugcggaaaaucaguaccagacucuauauaagcucuacgagcggugugaaguagugaugggaaaccuggagaucguccuuacgggccacaaugcugaccugagcuuuuugcaguggauucgcgaagugaccgguuauguucucguggccaugaacgaguucaguacacugccucugccaaaucuccgagucgugcgugggacucaaguauacgauggaaaauuugcaauauucguuauguuaaacuauaauaccaacuccucucaugcccugagacagcuuagguugacacagcugaccggccaguuuccgauggugcccucgggccuaacuccucaaccagcucaggacugguaccuccuggaugacgauccccggcuucugacauugucagcaagcaguaaggucccugugacccucgccgcuguguga

SEQ ID NO: 55858 - RNA, 3879 nt, Artificial Sequence
  derived and/or modified sequence opt3 from ERBB4__Homo_sapiens__NP_001036064
augaagcccgccaccggccugugggugugggucagccuccuuguugcugcagggacagugcagccuuccgacucucaaucaguaugcgccggaacugagaacaaacugaguagcuuguccgauuuagaacagcaguacagagcgcugaggaaguauuacgagaauugugaaguggucauggguaaccuagagaucacgucuauugaacacaaucgggaccucucguuccugcgcucagugcgagagguuaccggcuaugugcuugucgcucugaaccaguuucguuacuugccacucgagaaucugagaauaaucagggggacaaaacuguaugaagaucgguacgcccucgcaauuuucuuaaacuaucgcaaggacggaaauuuuggccugcaagagcuugguuugaaaaaccugacugaaauccuaaaugggggaguguacguagaucagaacaaguuccucugcuacgccgacaccauucauuggcaggauaucguuagaaauccguggcccagcaaccugacacuugugaguaccaauggcuccucuggcugugggaggugccacaagagcuguacuggacggugcugggguccuacagagaaccauugucagacccugacgcgcacugucugcgcugagcaaugugacggccgaugcuaugggccauacguguccgauuguugccacagagaaugcgcaggaggcuguucaggucccaaagacaccgauugcuuugccuguaugaauuucaacgacaguggggcuugcgugacacaguguccucagacuuuugucuauaacccaaccacauuccaguuggagcauaauuuuaacgccaaguacaccuauggagcguucugcguuaaaaaguguccccacaauuuugugguagauaguucuuccugcgugagggcauguccuucaagcaaaauggaagucgaggaaaacggcauaaagaugugcaagccauguacggacaucugcccgaaagccugcgacggcauugggacuggaagucucaugucugcucaaacaguggauuccagcaauaucgacaaguucauuaacuguaccaaaaucaaugguaaccugauauuuuuaguuacuggcauucacggggaucccuacaaugccaucgaggcaauugacccugagaagcugaacguguuccggacaguccgugaaaucaccggauuccucaauauccagucguggccacccaacaugacggauuuuucuguguucuccaaucuuguaaccauuggcggucgcguucuguauucaggguugagucuacugauacucaaacagcaaggcaucacaagccugcaguuucagucccuuaaggagauuucugcuggaaacaucuacauaacugacaauagcaaccugugcuacuaucauaccauuaacuggacaacuuuguucucaaccaucaaucagagaaucgugauuagggauaaccggaaagccgaaaauuguacagcggagggcauggucugcaaccaccucuguaguuccgacgggugcuggggaccugguccagaucaaugucugagcugccgacgcuuuucuagaggcaggaucuguauugaaucaugcaauuuauacgacggggaguuccgggaguuugaaaacggaaguauauguguggagugcgauccccagugcgaaaagauggaggacggccugcuaaccugucaugguccggggccugacaauugcacuaaguguagccacuucaaagauggccccaacugcgucgaaaaguguccagacggacuccagggcgccaauuccuuuaucuucaaauaugcagauccugaccgcgagugccaccccugucauccaaacugcacgcagggguguaauggacccacaucucacgauugcauuuacuauccuuggaccggucauucgacucugccacaacacgcuagaaccccgcuuaucgccgcuggcgugaucgggggauuguuuauucugguuauagugggccucacauucgccguauacgucaggcguaagagcaucaaaaagaagcgggcacugcgaagauuucuugagaccgaacugguggagcccuugacuccuuccgguacagccccaaaccaggcucagcucaggauucugaaagaaacggaguuaaagcgcguuaaagugcuggggucaggcgcguucggaaccgucuauaagggcaucugggugcccgagggggaaacuguaaaaauuccuguggcaaucaagauacuaaaugagacaaccggaccaaaggccaacguugaguucauggacgaagcucucaucauggccaguauggaucauccccaccugguccggcuuuugggcgugugucugucuccgacaauucagcucgugacucaacugaugccucacgguugcuuacuggaauacguccaugagcacaaagacaauaucgggagccagcuuuugcucaacuggugcguucagauugcaaagggaaugauguaccuggaggaaagaaggcuagugcaucgcgaucuggccgcucgaaacgugcucguaaaauccccaaaucacgucaagaucaccgacuuuggccuggcccggcuuuuggagggugaugaaaaagaguauaacgcagacggcgggaagaugcccauaaaguggauggcgcuggaauguauucacuaccguaaauucacgcaucagucagauguguggagcuauggaguuaccaucugggaguuaaugacauuuggcgggaagccuuacgacgggauucccacuagagagaucccagaccuccuggaaaaaggcgagaggcuuccucaacccccaauaugcaccaucgauguguauauggucauggugaaguguuggaugauugacgcugauucucgcccgaaauucaaggaacuggccgcagaguuuucccggauggccagagacccucagagguacuugguuauccagggugaugaccgaaugaaacuccccaguccaaaugauagcaaguucuuucaaaaccugcuagacgaagaggaucuggaggacaugauggaugcugaagaguaucucgugccccaggccuucaauauuccuccacccaucuacacaucucgcgcacggauagacuccaacagaaaucaguuuguauacagggaugggggauucgcugccgaacagggcgucucagugccuuaucgugcgccgacuagcaccauuccagaggcccccguggcucaaggugcaacggccgagaucuuugacgacagcugcuguaacggcacacugcgcaagccugucgcuccacacguucaggaagauucguccacccagcgguacucugccgaccccacuguguucgcaccugagagaagcccgaggggagaacuugaugaggaaggauauaugacacccaugcgagacaaaccaaagcaggaguacuugaauccuguagaggaaaaccccuuugugucacggcgcaaaaauggcgaucugcaagcguuagacaacccagaguaucauaaugccaguaacgggccucccaaggcugaagaugaguacgucaaugaaccacucuaucugaacaccuucgccaacacucuuggaaaagcagaguaccugaagaauaacauccuauccaugccggagaaggcuaaaaaggccuucgacaauccugauuacuggaaccacucucugcccccaagaagcacccuccagcaucccgacuauuugcaggaauacuccacaaaauauuuuuacaagcagaauggcaggauucggccuaucguggcagagaacccagaauaucugucagaguucagcuuaaaacccgguacgguucucccuccgccacccuaccgacacagaaauaccguggucuga

SEQ ID NO: 55859 - RNA, 3456 nt, Artificial Sequence
  derived and/or modified sequence opt3 from ERC1__Homo_sapiens__XP_011519238
auguacggcagcgccagauccguggggaaggucgagcccucuucacagaguccuggaaggagcccacggcugccgcgcagcccccgacucggucaccguagaaccaacucuacaggcgggucgucaggaagcaguguuggcgguggguccggaaaaacucuuucuauggaaaauauccaaagccugaacgcugcauaugccacguccggcccuauguacuugucagaccaugagaaugugggcagugaaaccccaaagagcacaaugacuuuagggaggucuggaggucggcugcccuauggcguacgcaugaccgcgaugggguccucaccuaacauugcuagcaguggaguggccucugauacaauagcauucggcgagcaccaucuaccacccgucuccauggccagcaccgugccucacucgcucagacaggcuagggacaauacuaucauggaucugcagacacagcuuaaagaaguucugcgggagaacgacuugcuccgcaaggauguggaggucaaagaaucuaagcuguccucaaguaugaauagcauuaagaccuuuugguccccagagcugaaaaaggaacgagcacucagaaaagacgaggccucuaagaucacgauuuggaaagagcaauacagggugguacaggaagagaaccagcauaugcagaugacuauccaggcuuuacaagaugaacugcggauacagcgugaccuuaaucaguuguuccaacaggauagcucaagucgcaccggugagccgugcguugccgaacugacagaggagaacuuucagagacuacacgcggaacacgagaggcaagcaaaggaacucuuccugcuucggaagacucuggaggaaauggaguugcgaaucgagacccagaaacagacacucaaugcccgcgacgaauccauuaagaaacuguuagagaugcugcagagcaaggggcucucugcuaaagccaccgaagaggaucaugaaagaacgaggcggcuugcagaggcugagaugcacgugcaucaccuggaaucauugcuagagcaaaaggaaaaagagaacaguaugcugcgcgaggaaaugcacagaagguuugagaaugcccccgacagcgcgaagacuaaggcccuccagacagucaucgaaaugaaagauuccaagauuucuucgauggagcguggacugcgggaccuugaagaggagauccagaugcugaaaagcaacggcgcauuguccaccgaagaacgagaagaggaaaugaagcagauggagguguauagaucacauaguaaauucaugaagaauaagauaggccaagugaaacaggagcucucuaggaaggacacugaacuguuagcucugcagacaaaacuagagacccucacgaaccaguuuagcgauuccaagcaacacauugaaguccugaaagagucacuuaccgccaaggaacagcgcgcugccaucuugcagacagagguugacgcacugcggcucagacuggaggaaaaggagacuaugcuuaacaaaaagaccaaacagauucaagauauggccgaagagaaggggacacaggcuggagagauccaugaccugaaagauauguuggacgugaaggaaaggaagguaaaugugcuccagaaaaagaucgagaaccugcaagaacaguuacgcgauaaagagaagcagaugagcucucugaaagaacgagucaagucccuacaggcggacacuaccaauacagauaccgcacucacuacgcuggaggaggcccuugcugaaaaagagcggacaauugaacguuugaaggagcaaagagacagggaugaacgcgagaagcaggaggaaauagacaacuacaaaaaggaccugaaagaucucaaggagaaagugagucuguuacagggugaccugagcgaaaaggaggccucucuuuuggaucucaaggaacacgcauccucacuggccaguagcggccuaaagaaggacucgcggcugaaaacccucgagaucgcucuggagcagaagaaagaagagugucuuaagauggaaucccaauugaagaaagcccaugaggcagcgcuggaggcuagagccucuccugaaaugagcgauaggauucagcacuuagagcgagaaaucacucgcuauaaggacgagucaaguaaagcacaggccgaaguugaucggcuccuggagauacuuaaggagguggaaaaugagaaaaacgacaaggauaagaaaauugcugaacuggaguccuugaccucuagacaggucaaggaccaaaauaaaaagguggccaaccucaaacacaaggaacagguagagaaaaagaaguccgcacagaugcuggaggaagcuaggcgucgcgaggauaaucuaaacgacuccucacaacagcugcaggauagccuccggaaaaaggacgacagaaucgaggagcuggaagaggcccuuagggagaguguucagaucacagcggaacgagagaugguguuggcccaagaagagucugcucggaccaaugcagagaaacaggucgaggaacuguuaauggccauggaaaaggugaaacaggagcucgaauccaugaaggcuaagcugagcucgacucagcaaucacuugccgagaaagagacacaucugacgaaccuacgcgcagaaagaaggaagcaccucgaggaaguccuggagaugaaacaggaagcguugcuggccgcuauuucugagaaggaugccaauaucgcauuacucgagcugaguuccagcaaaaagaagacccaggaagagguggcugcccuuaaacgggaaaaggaccgacugguucagcaauugaaacagcagacucagaacagaaugaagcucauggcagauaauuacgaggacgaucauuucaaaucuagccacuccaaccaaacaaaccacaagccaucacccgaccagauuauacagccucugcuagaacuggaucaaaaucgcaguaaacuuaaacucuacaucgggcaucugaccacauugugccacgacagggauccacugauuuuacguggacucacucccccggccagcuauaaccuggacgaugaccaggcugcgugggagaaugagcuucagaagaugacccggggccagaacacgccucauuuucugaaacccgccucugcaaauuuguggccagauaaggacuuccaauccccuucagugcaccuccugcuacaggacuguaccaguagcaaacauuccacacagaaggaaucuguagcuucgcagagccacgguaagacugccuuuuuccacgucaugcugaugcuucaagaugagcucgaaaaaggggagagagacaacgccgagcugcaggaauuugcuaaugcaaucuugcagcagaucgccgaucauugccccgacauuuuagagcaagugguuaacgcgcuggaagagucauccuga

SEQ ID NO: 55860 - RNA, 2874 nt, Artificial Sequence
  derived and/or modified sequence opt3 from ERC2__Homo_sapiens__NP_056391
auguacggcagcgccagaaccaucacaaaccuggaggggucccccucuaggucaccucggcucccacgcaguccgcgacuuggacaccguagaacuagcuccgguggcgggggaggcacggguaagacccugucuauggaaaauauucagucguugaacgcugcauaugccacaucagggcccauguacuuaagcgaccaugagggaguggcgaguacuaccuauccuaaaggcacaaugacccugggcagggcuacuaaucgggccgucuacgggggacgcguuacagcaauggguuccucuccaaacauagccagcgcuggccuaucccacaccgaugugcucucauauacggaccaacaugggggacugacuggcaguagccaccaucaccaccaucagguacccucuaugcuuagacaggugagggauuccaccaugcuggacuugcaggcacaacucaaggaacugcagcgggagaaugaucugcuccgcaaagaauuagacaucaaggauucaaaacuggguagcaguaugaacucuauuaagacauucugguccccugagcuuaagaaagagcgagucuugagaaaggaagaggccgcuaggaugagcgugcugaaagaacagaugcggguuucgcacgaggagaaucagcaucuacaacucacuauccaggcccugcaggacgaacuucguacccagcgcgaucugaaccacuugcuccaacaggagucugggaauagaggagcggaacacuuuacaauugagcugaccgaagagaacuucaggcgguuacaggcagagcaugaccgacaagccaaggaacuguuucuccuucgcaaaacgcuggaggaaauggaguugagaaucgaaacucagaagcagacacuaaaugcuagggaugaguccauaaagaaacugcucgagaugcugcagucaaagggccuuccaaguaaaagccuggaagacgauaacgagcggacccgcagaauggccgaagcagagucccaagugucucacuuggaagucauccucgaccagaaggagaaagagaauauucaucugagggaagaguuacaccgucggagccagcugcagcccgaaccugcuaagacuaaagcccuacaaacagugaucgagaugaaggacaccaagauugcgucacucgagcgaaacaucagagaucuggaagacgagauacagaugcuuaaagccaauggcguauugaacacggaagauagggaggaagagauuaagcagaucgagguuuacaaaagucauuccaaguucaugaaaaccaagauugaccagcugaagcaagaacucagcaaaaaggagucugaacugcuugcacugcagacaaaauuggagacucucucaaaccagaauagugauugcaagcagcacaucgaagugcugaaagagagcuuaaccgcuaaggagcaacgcgccgcuauccugcagacagaagucgacgcccuacggcucagacuggaggaaaaggaguccuuucuuaacaaaaagacuaaacaguugcaagaucugaccgaagagaaggggacacucgcaggagagauuagggacaugaaagauaugcuggaagugaaggagcgcaagauaaauguguuacagaaaaagaucgaaaaccugcaggagcagcuucgagacaaagauaagcaauugaccaaucucaaagaccgggucaagucucugcagacugacucgagcaacacggauacagcccuagcuacccuggaggaagcgcucuccgagaaagaacguauuaucgagagacugaaggaacagagggagcgcgacgaucgggagagacuugaagagauagaaucauucaggaaggagaauaaagacuugaaggaaaaaguuaacgcacugcaggccgaguuaacugagaaggaaaguucucucauugaucugaaagagcacgcuagcucccuugccucagcaggucugaagcgagacagcaaguugaaaucucucgaaaucgccaucgagcaaaagaaagaagaguguuccaagcuggaggcucagcugaaaaaggcccauaauauugaagaugacagucgcaugaacccagaguuugcagaucagaucaagcagcuagacaaagaagcgagcuauuaccgggaugagugcggcaaggcucaagccgagguggacagacuccuggaaauucuuaaagagguagaaaaugagaagaacgauaaagacaagaagauagcagaauuggagucucugaccuuaaggcacaugaaagaccagaauaagaaaguggccaaccucaagcauaaucagcaacuggagaaaaagaaaaacgcucagcuucuggaagagguccgucgccgggaagauuccauggccgacaacucacagcaccuacagaucgaggaacucaugaaugcacuggagaagacaagacaagaguuggaugcuaccaaggccaggcuggcgaguacucagcagagcuuagccgaaaaagaggcucaccucgcaaaccugcgaauugaacggcgcaagcagcuugaggaaauccuggagaugaaacaagaggccuugcucgcugccaucucggaaaaggacgcaaauauugcgcugcuagagcuguccgccucuaaaaagaagaaaacacaggaagaggugauggcucuuaagagagagaaagauaggcucguucaucagcugaagcagcaaacgcagaaccggaugaaauugauggccgacaauuacgaugacgaucaccaucacuaucaucaccaccaucaccaucaccaucaccgaagcccggggagaucacagcacaguaaccaucgccccuccccugaccaggaugacgaagagggaauaugggcauga

SEQ ID NO: 55861 - RNA, 822 nt, Artificial Sequence
  derived and/or modified sequence opt3 from ERCC1__Homo_sapiens__NP_001159521
auggaccccggcaaggauaaagagggggugccucagccaagcggaccgcccgccagaaagaaauucgucaucccucuggacgaagaugagguuccacccgguguggcuaagccucucuuuagguccacccaaucucuuccaacaguagacacuucagcacaggccgcgccccagacguacgcugaauaugccauuagucagccucuggagggcgcaggggcuaccugcccaacaggaagcgaaccguuggccggcgagacucccaaccaagcauuaaaaccuggugccaaguccaauucuauaaucgugucgccacggcagcgcgggaaccccguccugaaguucgugcgaaauguuccuugggaguuuggagaugugauuccagacuacguccuaggccagucaaccugugcucucuuccugagccuucguuaucacaaccugcaucccgauuacauccacggcagauugcagagucucgggaaaaauuuugcccugagggugcugcucguacaaguugacgugaaggauccgcagcaggcguuaaaagaacuggcaaagaugugcauucuugccgacuguacauugauccuggcuugguccccugaggaagccggacgguaucuagagaccuacaaagcauaugagcagaagcccgcugaucuccugauggaaaaacuugagcaagacuucgucucucgcagccuggaacaguugauagccgcguccagagaggaucucgcccugugcccagguuuaggcccucagaaggcaaggcggcuguuugacgugcuccaugaacccuuccuuaaggugccauga

SEQ ID NO: 55862 - RNA, 2283 nt, Artificial Sequence
  derived and/or modified sequence opt3 from ERCC2__Homo_sapiens__NP_000391
augaagcugaacguggacggccuccuugucuacuuccccuaugauuacaucuauccugagcaguuuagcuacaugagagaacugaaaaggaccuuggacgccaaggggcacggaguuuuagagaugccauccgguacaggcaaaacugugucucugcuagcucucauuauggcauaucaacgggccuacccgcuggaaguaacgaaacuuauauauugcucacgcaccgugcccgagaucgaaaaggucauugaggagcugcgaaaguugcucaauuucuacgaaaagcaggagggggaaaaacugccuuuucugggacucgcguuaaguagccguaagaaccuguguauccauccagaggugacaccccuuagauucggcaaagauguugacgguaagugccacuccuugacugcuucuuacgugagggcccaguaucagcaugauaccucgcugccucacugucgguuuuacgaggaguucgacgcacaugggcgcgaagucccacuacccgccggaauuuauaaucucgaugaccugaaagcucuuggcagaaggcaaggcuggugcccuuacuuucuggcacgguauucaaucuugcacgccaacgugguaguuuacagcuaucacuaccuccuggauccaaagauagcugacuuagugaguaaggaacuggcccgcaaagcggucgugguguucgaugaggcacauaauaucgacaacgucuguauugauuccaugucuguuaaucucacacgaagaacccuugacaggugccaggggaaccuggaaacuuugcagaagacagugcuacggaucaaagagaccgacgagcagcgucugcgcgaugaauacagaaggcucguagagggacugcgggaagccagcgcugcccgagagacggacgcacaccuugcuaauccggugcugcccgaugaagucuugcaagaggccgugccugguuccauucgcacugcggagcauuuucucggcuuccugagaagguuacuggaauauguuaaguggcggcuacgcgugcagcacgucgugcaggagucaccacccgccuuucucagugggcuggcacagagaguauguauccaaaggaaaccucuucguuucugcgcugaacgguugcgaagccugcuccacacccuggagauaacagaccuugccgauuuuucuccacugacuuugcucgcuaacuucgccacccugguuuccacauacgcaaagggauucaccauuaucauugaacccuuugacgauagaacgccgacuaucgccaauccuaucuuacauuucucauguauggacgcuagccuggcgauuaaacccguguuugagagguuccagagugucauaaucacaucuggcacccuauccccacucgauauuuauccuaagauccuggacuuucaccccgugacuauggcaacauucaccaugacgcuugcccgcgucugcuuguguccaaugauaauuggucgggggaacgaucagguggcuaucagcucgaaguuugagaccagagaagacaucgccguuauuaggaauuacggaaaccugcuccuggagaugucugcagugguacccgacggcaucgucgccuucuuuacauccuaucaauacauggaaucaacuguggcuaguugguaugagcagggcauuuuagagaauauacagcgcaacaaacugcuuuucaucgaaacccaggauggggccgagacaagcguugcauuggaaaaguaccaagaggcgugcgaaaacggacgaggugcuauucuccuguccguggcccggggcaaagucucugaggggaucgacuuugugcaucacuacggacgugcaguaaucauguucggcgugccuuauguuuacacucagagcaggauucuaaaggccagacuggaguaucuccgcgaucaguuucagauacgggaaaaugacuuccugaccuucgaugcuaugagacaugccgcacaaugcgucgguagggcuauccgagggaaaacagacuacggccuuaugguguuugccgauaagcgcuucgcgcggggagacaagagaggcaaauugccaagguggauucaggagcaccugaccgaugccaacuuaaaucucacuguggacgaagggguccagguugcuaaguauuuucugcgucagauggcacaaccguuccaccgcgaggaucagcuuggacugucauugcucagucuggaacagcuagaguccgaggaaacgcugaaacggaucgagcagauugcccaacagcucuga

SEQ ID NO: 55863 - RNA, 2349 nt, Artificial Sequence
  derived and/or modified sequence opt3 from ERCC3__Homo_sapiens__NP_000113
augggcaagagagacagggccgaucgggacaaaaagaaaagccgcaagcgacacuacgaggaugaagaggacgaugaagaggacgcucccgggaacgauccucaggaagcagugccauccgccgcgggaaaacaagucgacgagucugguaccaagguugaugaguauggcgcuaaggacuaccgucugcagaugccgcucaaagaugaccauacaucaagaccccuuuggguggccccugaugggcacaucuuccuggaagcauuuaguccaguauauaaguacgcccaggacuucuugguggcuauugcagagcccgucugcaggccuacucaugugcacgaauauaaauuaacggccuacagccuguaugcugccguuuccgugggacuacagaccucugacauaacagaguaccuccggaagcugucgaaaacuggcgucccagaugguaucaugcaauuuauuaaacuuuguaccgugucauacgggaagguaaagcugguuuugaagcauaaucgcuauuucguggagagcugccaccccgacgucauccagcaccuccugcaggauccugugauuagagaauguaggcugcggaacagugagggagaagcgacagagcucaucaccgaaacuuuuacauccaaaucugcaauaagcaagaccgccgaguccucaggcggcccaaguacgagccgcgugacugacccgcaggggaaaucugauauccccauggacuuauucgauuuuuacgagcaaauggacaaggaugaagaggaagaggaagagacccagacagucuccuucgagguuaaacaggaaaugauugaggaacugcagaagcgaugcauccaucuugaguauccuuugcuggcugaauacgacuuuagaaaugauucagugaacccagacauuaauaucgaccuaaagcccacugccguacucaggccuuaucaagagaaaagccugcggaagauguucggaaacggucgugcacgcaguggcgugauaguccuuccauguggggcuggaaaaucucuggugggcguuaccgccgcgugcacagugagaaagagguguuugguccucgguaauuccgccgugagcguagagcaguggaaagcacaguuuaagauguggucgaccauugaugacucucaaaucugccgguucacguccgaugcuaaggacaaacccauuggguguucaguugccaucaguacuuacagcaugcugggacacacaaccaagcgauccugggaagcugagcgcgugauggaaugguuaaaaacucaggaguggggccugaugauccucgaugagguccauacaauuccggccaagauguuuagaagggugcuuaccauaguccaggcacacugcaaacugggcuugacggccacccuagugcgggaagacgauaagaucguugaccugaacuuccucauugggccuaagcuguaugaggcuaauuggauggaacuucagaacaauggauacaucgcgaaagugcaaugugcagagguauggugccccaugucuccagaauuuuaccgcgaguaugucgccauaaagacuaaaaagaggauucuguuguacacuaugaacccuaauaaauuuagagcuugccaguuccucaucaaguuucacgagcgucggaacgauaagaucauuguguucgccgacaauguuuuugcacugaaagaauaugccauccgauuaaacaagcccuacauuuaugguccaaccagccagggcgagagaaugcagauacugcaaaacuucaaacauaaucccaagaucaacacaauuuuuaucucaaaagugggggauacaaguuucgaccuaccugaagcuaauguccucauccagauuuccagccacggaggcucuaggcgccaggaggcccagcggcuggguagagugcuuagggcaaagaaagggaugguagcggaagaguacaacgcuuucuucuauucauuggugagucaagauacccaggagauggccuacagcacaaagcgccagcgauuucugguugaccagggcuacuccuucaaggucauaaccaaacucgcaggaauggaagaggaagaccuggccuuuucuacuaaggaggaacaacagcagcuucugcaaaaaguguuggcugccacggaucucgacgcagaggaggaaguggucgcuggcgaguucgggucgcggagcucccaggccucacguagauucggaacaaugaguucuaugagcggugcggaugacaccguuuauauggaauaccauuccucaaggagcaaggccccaucuaaacacgugcauccgcuguuuaagcgcuuccggaaguga

SEQ ID NO: 55864 - RNA, 2751 nt, Artificial Sequence
  derived and/or modified sequence opt3 from ERCC4__Homo_sapiens__NP_005227
auggagagcggccagcccgccagaaggaucgcuauggcaccucugcucgaauacgagcggcaacuugugcuggaauuguuagacaccgaugggcuggucguuugcgcccgcggacuaggugcggaccgacuccuguaucacuuccuucagcugcauugucacccagcuugcuuggugcucguacugaacacacagccggccgaggaagaguacuuuauuaaucagcugaagauagagggcguggaacaucucccccguagagucacuaacgagaucacguccaauucuagguaugaaguguacacccaagggggaguuauuuucgcaacaucacggaucuuaguggucgauuuucugacugaccgcauuccuagugaucuuaucaccggcauauugguguauagagcccacaggaucauugagagcugucaggaggcuuucauccugcggcuauuucgccagaaaaacaagcgagguuucauuaaagcauuuacagacaaugccguagcuuucgauaccggguuuugccauguugaaagagugaugaggaaccucuucguccggaagcuguaccuuuggccacguuuucacguggccgucaauuccuuccuggagcagcacaaacccgaagugguugagauccaugugucuaugacuccuacaauguuggcgauacaaaccgcaauucucgacauccugaacgccuguuuaaaggaacugaagugccacaauccaucgcucgagguagaggaucuuucacuggaaaacgcuauuggaaaacccuuugacaagacgauccgccauuauuuggauccucuauggcaccagcugggcgccaaaacuaagagccucgugcaggaccugaaaauccuuagaacccuguugcaguaccucagucaauacgauugugucacauuccugaauuuacuggagucccuaagggcaacugaaaaggcuuucggccagaacucuggguggcucuuucuggacagcuccaccucaauguucauuaaugcccgggcgcgaguguaucaccuuccagacgccaagaugaguaaaaaggagaaaauaagcgaaaagauggagaucaaagagggagaagagacaaagaaagaauugguucuggagucuaacccgaagugggaagcacucaccgaggugcugaaggagauugaagcugagaauaaagaauccgaggcccuugguggccccgggcagguccugaucugcgcuucagaugaccgcacguguagccaauugagagauuacauaacucucggagccgaggcauuucuguuaaggcuguaucggaagacauucgaaaaagacaguaaggccgaggaaguguggaugaaauuucgcaaggaggauucuuccaagagaauuaggaaaagccauaagcguccuaaagacccacagaacaaggaacgggcuucgaccaaagagcgaacucuaaagaagaaaaagagaaaacucacacugacccagaugguaggcaagcccgaggaacuugaggaagagggugauguugaagagggguacaggcgcgagaucucuuccucaccugaaaguugcccagaggaaaucaaacacgaggaguucgacgugaacuugagcuccgaugcggcauuugggauucugaaggagccccucacgaucauucauccgcuguuaggcuguucugacccuuaugcccugacccggguccuucacgagguggaacccagauacgucguguuguaugaugcugagcucacauucguuaggcagcuggaaauauaccgcgccagccgaccaggcaagccucuacggguguacuuucugaucuaugggggaucaacugaggagcaacguuaccucaccgcacugagaaaagaaaaggaggccuucgaaaaacuuauuagggagaaggcuaguaugguaguccccgaagaacgcgagggucgggacgaaacaaauuuggaccuggugagaggcacugccuccgcagauguuagcaccgacacaaggaaagcgggaggacaggagcagaacggcacccagcaaucuaucguggucgauaugcgagaauuucgcucagaguuaccaagucucauccaucggagagguauugacauagaacccgugacucuggagguaggggauuauauccuuacgccugagaugugcguggaacgaaagagcauuuccgaccugaucggcucuuugaauaacggacgucucuacucgcagugcauuagcaugucccgcuauuacaaacggccaguucugcuaaucgaguucgauccgucaaagcccuuuagucugacaucuagaggcgcucucuuccaggaaauaagcuccaaugacaucucaagcaagcugacccuuuugacucugcacuucccuagguuaaggauucucugguguccaucuccccacgccaccgcagagcuguuugaggaacuuaaacaguccaagccucaaccagaugccgcuacagcccuggcaaucaccgcugacagugagacucuacccgaaagcgagaaauauaacccggggccucaggauuuccuccugaagaugccaggagucaaugccaaaaacugccggucuuugaugcaucacgugaagaauauugcggaacuggccgcuuuaucccaggacgagcucacaucaauccuggguaacgcagccaaugcuaagcagcuuuacgauuuuauacauacgaguuucgccgagguggucagcaaaggcaaggggaaaaaguga

SEQ ID NO: 55865 - RNA, 3561 nt, Artificial Sequence
  derived and/or modified sequence opt3 from ERCC5__Homo_sapiens__NP_000114
augggcgugcaggggcuguggaagcuccuugaaugcagcggaagacaagucucccccgaagcccuggaggguaaaaucuuggcuguugacauuucuauaugguuaaaccaggcacugaagggcgugagggaucggcacggaaauucaaucgaaaacccucaucuacucacccuguuccaccgccuuuguaaacuguuguuuuuccguauucgaccaaucuuuguauucgacggagaugccccgcuccugaagaaacagacacuggugaagagaaggcagcggaaggaccucgcgaguagcgauucccgcaaaacuacggagaaguuacugaaaaccuuucuuaagagacaagcuauuaaaacagccuucaggucuaagcgggacgaagcauugcccucgcugacucagguccgccgagagaaugaucuauacgugcucccuccacugcaggaggaagagaagcauucaagcgaagaggaggacgaaaaagaguggcaggaaagaaugaaccaaaagcaggcccuucaggaggaauuuuuccacaauccccaggcuaucgauauagagagugaggacuuuuccucucugccuccagaaguuaaacaugagaucuugaccgauaugaaggaguucacaaaaaggcggcguacccucuuugaagcaaugcccgaagagagcgacgauuucucccaauaucagcugaagggcuuacugaaaaagaacuaccucaaucagcacauugagcacgugcaaaaggaaaugaaccagcagcauucaggucacauccgcagacaguaugaggacgaagggggauuucuuaaagaggucgaaaguaggcgggugguaagcgaggacacuucucauuacauucugaucaagggcauacaagccaaaacaguugcugagguggauuccgaaucauugccuagcaguucuaagaugcacggcauguccuucgacgucaaaagcucgccaugcgagaagcuaaagaccgaaaaagagccggaugccacgcccccuucuccacgaacucugcucgcgaugcaggcagcccugcuuggguccucaagugaggaggaacuggaaagcgagaaucgcagacaggcuaggggacggaacgcccccgcagcuguggacgaagguuccauuucuccucgcaccuugagcgccaucaagagagcgcucgaugacgaugaggacgugaaagucugugccggcgaugacguucagacagggggaccaggcgcagaggaaaugaggauuaauucaaguacugagaacuccgaugaaggucugaaggugcgugacgggaaaggaauccccuucaccgcuacauuagccagcagcucaguaaauagugcugaggaacacguggccagcaccaacgagggccgggagccgacggacuccgucccuaaggaacaaaugucucuggugcauguuggcacugaggcauuucccaucucggaugaaagcaugauuaaggaccgaaaagauagacuaccacucgaguccgccguggucaggcacucagacgcuccugggcugcccaauggacgcgaacuuacaccagcgaguccuaccugcacuaacucugugagcaagaacgagacacaugcagagguauuggaacagcagaaugagcugugucccuaugaauccaaauucgauucaagccuccugucuuccgacgaugagaccaagugcaaaccaaacagugccagcgagguuauagguccggugucucuucaggaaacguccucaaucgucagugugcccagcgaggcugucgacaauguggaaaacguugugucguuuaaugccaaggagcacgaaaacuuccuggagaccauucaagagcagcagacaacugaauccgcaggccaggauuugaucucuauaccuaaggccguagagccaauggaaauugacagcgaggaaucagagagugauggguccuuuaucgagguccaaucugugaucagcgacgaggaacuccaggcugaguuccccgaaaccuccaaaccuccaucagaacagggagaggaggaacugguuggcacacgggagggugaagcccccgcagagagcgagaguuuacugagagauaauucugaaagggacgacguggauggggagccgcaagaagcggagaaggacgcugaagauucccuacaugaguggcaggacauuaaccucgaggaacuggagacucuugaaagcaauuugcuggcccagcagaacucgcucaaagcacaaaagcagcagcaggagcgcaucgccgcuaccgucacaggccaaauguuucuggaaucacaggaguuacugcgacuuuucgggauuccuuacauacaggccccaauggaggcagaagcucagugugccaucuuggaucucaccgaccaaacuucuggcacgauuacagaugacagugauaucuggcuguuuggggcgcggcacguguaucguaauuucuuuaacaaaaauaaguucguagaguacuaccaguauguggacuuucacaaccagcuaggacuggauagaaauaaacucaucaaccuggccuaccuuuuggguuccgacuauaccgaaggcauucccacuguugggugcgucaccgcuauggagauacugaacgaguucccuggacauggcuuagaaccccuccugaaguucagcgagugguggcacgaagcacaaaagaauccaaaaaucaggccuaacccccaugauacaaaggugaaaaagaaacuucgcacccugcaguugacuccagguuuuccgaauccugccguggcugaggccuaccucaagcccgucguugacgacucuaaggggagcuuccuguggggcaaaccagaucuagacaagauucgggaauuuugucagagauauuucggauggaacaggacaaaaacggaugagucccuguuucccgugcucaagcagcuggacgcacaacagacccagcuucgaaucgauucauucuuucgcuuggcgcagcaagagaaagaagacgccaagcggauuaagagucagagacugaauagggcugugacuugcauguuacguaaagagaaggaagccgcagcuagcgagaucgaagccguaucugucgcaauggagaaagaguucgaacuccuggauaaggccaaacgcaagacacagaagcggggcauaaccaacacacuugaggaauccucaagucugaaaagaaagaggcuaagcgacuccaaacgaaagaauacuugugggggauuucucggugagaccugccugucugaaucgagcgauggcucauccagugaggacgcugagucuagcuccuugaugaacgugcagcggcgcacggcggccaaagaaccuaagaccucagcaucugauagccaaaauaguguuaaagaggcuccagugaagaacgggggagccacaacuuccucuucuucagacuccgacgaugacggcgguaaggagaaaaugguccuggugaccgccagaaguguuuucgggaagaaaaggcggaaguuaagacgagcucgcggcaggaaacguaagacauga

SEQ ID NO: 55866 - RNA, 4482 nt, Artificial Sequence
  derived and/or modified sequence opt3 from ERCC6__Homo_sapiens__NP_000115
augcccaacgagggcaucccucacagcucccagacccaagaacaggacugccugcagucucagccagugucaaauaacgaggaaauggccauuaagcaagagagugggggagauggugaagucgaggaguaccucagcuucagauccguuggcgacgggcuuucuacaucggcugugggaugugcaucagccgcgccgaggcggggccccgcucuguugcauauagaucgccaccagauccaggccguagaaccuagcgcacaggccuuagagcugcaaggucuagggguggacgucuaugaucaggacgugcucgaacagggaguucugcagcaaguggauaaugcuauucaugaggcaagucgagccucccagcuugucgacguggagaaagaauaccguucuguacuggaugacuugacuagcugcacgaccucccucagacagaucaacaagauuaucgagcaacugucaccacaggcugccacaaguagggauauaaaucggaaacuggacagcguuaagcgccagaaauauaacaaggaacagcaacucaagaaaaucacugcgaagcagaaacacuuacaggcaauucugggcggcgccgaggugaagaucgaacuugaucaugcuucuuuggaggaggacgccgaacccgggccuuccucacugggaagcaugcuaaugccaguccaggagaccgcaugggaagaacucauuagaacaggucaaaugacccccuuuggcacucagaucccucagaaacaggaaaagaagccaaggaaaauaaugcugaaugaggcuaguggguucgagaaguaccuugccgaccaagcgaaacugucuuuugaacggaagaaacagggauguaacaagcgcgccgcacgaaaagcuccggcccccgugacaccuccagcucccgugcagaauaagaacaagccuaauaaaaaggccagagucuuguccaaaaaggaggaaaggcucaaaaagcacauuaagaaacugcagaagcgggcauuacaauuccagggcaaaguuggucugccaaaggcccgucgccccugggagagcgauaugagaccggaagcugagggggacucggagggagaagagucugaauauuuuccuaccgaggaggaagaggaagaggaagaugacgagguggagggcgcggaagcagaucucuccggcgacgggacggauuacgagcuuaaaccccugccaaagggagguaagaggcagaaaaagguaccugugcaagaaaucgacgaugacuucuuucccucaaguggcgaggaagccgaggcugccagcgucggggagggaggcggugggggccggaaagugggacgauaucgcgaugacggcgacgaagauuacuacaagcagagauugaggcgguggaacaaacuacgccugcaggacaaggagaagagacucaaacuggaagaugacuccgaggaaucugaugcagaguucgacgagggguuuaagguuccaggauuccuuuuuaaaaagcuguucaaauaucagcaaacuggugugaggugguugugggaacuccacugccagcaggccggcgggauucugggagaugagaugggcuuagguaagaccauccagaucauugcuuuucuggccgggcuaagcuacucaaaaauacguacacggggcaguaauuaucgauucgaaggacucggccccacugucaucguguguccuaccacaguaaugcaucaauggguuaaggaguuccacaccugguggccaccguuuagaguggcaauucugcaugagacgggguccuacacucacaagaaagaaaaacuuaucagggacgucgcgcacugccauggaauauugauuacaagcuauucuuacauccgccugaugcaggaugacaucucacgguaugauuggcacuacgugauucucgacgagggucauaaaaucagaaaccccaaugcugccgucacccuggcauguaagcaguucaggacuccucaccgcauuauacuuaguggcagcccaaugcagaacaaccugcgagaauuguggucccucuuugauuucaucuuucccgggaaacugggaacauuaccuguguucauggagcaauuuucuguuccaauuaccaugggcgguuacucgaaugccagccccgugcagguaaagacggcuuauaagugcgccuguguccugcgggacaccaucaacccguaccuacuccguagaaugaaauccgacgugaagaugucacugagucuuccugauaaaaaugaacagguuuuguucugcaggcugacagacgagcaacauaagguguaucagaacuuugucgauucuaaagagguguaccgcauccucaauggggaaaugcagauuuucagcggccugauagcauuacggaagaucuguaaccacccagaccuguuuuccggaggccccaagaaucuuaaaggguugccugaugacgagcucgaagaggaucaguucggauauuggaagagaucaggcaaaaugauuguaguggaaagccugcuaaagaucuggcacaaacaaggucagaggguucugcucuuuucucagucccgacagaugcuggacauucuugaggucuucuugcgcgcucaaaaguacacuuaucugaagauggaugggaccacaacuaucgccagucggcagcccuuaauaaccagauacaacgaggacacaagcaucuucguguuucuccugaccacuagggugggaggccuuggugucaaucugacgggcgcgaaccguguugugauuuacgauccagacuggaauccuucuacagauacccaggcccgcgaacgggcuuggagaaucgggcagaaaaagcaagugacuguauauagguugcucaccgcaggaacaauugaggaaaagaucuaccaucgacagauauucaagcaguuucugaccaaccggguccuaaaagaccccaagcagcgcagauucuuuaaauccaaugaccuguaugagcuuuucacucugacaucaccagaugccagucaaagcacggaaaccucggcuauuuuugccggcacuggguccgacgugcagacaccgaagugccaccuuaagaggcggauccagccugcauucggagcggaucaugacguucccaaacgaaagaaauuuccagccucuaacauuagcgugaaugaugcuaccucaagugaggagaaguccgaagccaaaggcgcagaggucaacgcugugacaucuaacagaagcgaccccuugaaggaugacccucacauguccucaaauguuacuagcaacgaucgccugggugaagagaccaaugccgugagugggccagaggaauuaucuguaaucuccggaaacggcgagugcagcaauucgucagguacgggcaagaccucuaugcccaguggggacgaauccauagaugagaaacucggacugagcuacaagagggaacguccuucucaagcacagacagaggccuucugggagaacaaacagauggaaaauaacuuuuauaagcacaaaagcaagacuaagcaucacuccgucgcugaggaagagacccuugaaaaacaucugcggccgaagcagaaaccaaagaacucaaaacacuguagagacgcgaaguucgagggcacaaggaucccccaucuagugaagaaacgccgauaccaaaagcaggacagugagaauaaaagcgaagccaaggagcagucuaaugaugacuaugugcucgaaaaacuguuuaagaaguccgucgggguucacucagugaugaaacacgaugcaauuauggacggagcuaguccugauuacguauugguggaggccgaagccaacagagucgcucaggacgcacugaaggccuuacggcucagcaggcaacgcugccugggcgcgguguccgguguuccaacuuggaccgggcaucguggaaucucuggcgcucccgccgguaaaaagucgagauucggcaaaaagcggaauagcaacuucucagugcagcacccuuccaguacgucuccgacagagaaaugucaggaugggauuaugaagaaggagggaaaagacaauguccccgaacauuuuagcggcagggcagaggaugccgacuccucaucugggccacuugcuagcaguucccuguuggcaaagaugcgcgcccgaaaccaccucauccugccugaaagacuagagagcgagucuggacaucugcaggaagcgucagcucuccuccccaccacugagcacgaugaccuguugguggaaaugcggaacuucauagccuuucaagcacacacagauggccaggccuccaccagggagauucugcaggaguucgagaguaaauuaagcgcuucgcaaucuugcguuuuucgcgagcuccugagaaaucuuuguacuuuccauaggaccuccgguggggaaggaaucuggaagcugaaaccagaguacugcuga

SEQ ID NO: 55867 - RNA, 2139 nt, Artificial Sequence
  derived and/or modified sequence opt3 from ERCC6L2__Homo_sapiens__NP_001010895
augcagcccggcagcgccccuccaccggggagaauggaccccuccgcuccucaaccaagggcagagaccucuggaaaggauaucuggcaccccggugaacggugccuggccccuucaccagacaacggcaaacucugugaggcgaguauuaagagcauaacaguggaugaaaaugggaaauccuucgcugucguucuuuacgccgacuuucaggagcgcaagaucccccugaaacaguugcaggaagugaaguucguaaaggauugcccucgaaacuuaauuuuugacgaugaggaccuggagaaaccauauuucccgaaucguaaguuucccucuucgucaguggcauucaaacuaagcgauaacggagacaguaucccuuacacuauuaauagauaucucagggauuaccaacgggaaggcacgcgcuuucuguauggucauuacauccacgggggaggcuguauacuuggcgacgauauggggcugggaaagaccguccaggugaucuccuucuuggccgcuguucuccauaaaaaggguacaagagaggacauugaaaacaauaugccagaguuucugcugaggucuaugaagaaagagccccucagcuccacugcaaagaaaauguucuuaaucguggccccucugucaguccuuuauaacuggaaggacgaauuggauaccuggggcuacuuucgggugacaguacugcacgggaaucgcaaagacaacgagcuaauucgaguuaagcagagaaaaugcgaaaucgcucucaccacuuacgagacacugaggcuuugucuggaugaauugaauagucucgaguggagcgccgugauagucgacgaggcgcaucggauuaagaacccaaaggcacgugugaccgaagugaugaaagcccugaagugcaauguccgcaucggauuaacgggcacuauucugcagaacaauaugaaagagcucugguguguuauggauugggcugugcccggucuucuggggucuggaaccuauuucaagaaacaauuuuccgacccgguagaacacggccagagacacacagccacuaagagggaguuggcaaccggccggaaggcuaugcagcgacuagccaaaaagaugucagggugguuccugcgcagaacaaaaacccucaucaaggaucagcugccuaaaaaggaagacaggaugguguacugcagccuuacggauuuccaaaaggcggucuaucagacugugcuggagacagaggacguuaccuugauccuccagaguucugaacccuguacuugccgguccggacaaaaacgcagaaacuguugcuacaagacaaacagccauggugagaccgugaaaacgcuguauuuaucguaccugaccguccuacagaagguggccaaucacguagcacuccugcaggcugccucuacauccaaacagcaagaaacucuuauuaagaggauaugcgaucagguguuuucacguuucccagacuuuguucagaagaguaaagacgcugccuucgagaccuugagcgauccuaaguauuccggcaaaaugaagguccugcagcaacuccugaaccauugucggaaaaaucgagacaaggugcuucuguuuucuuucagcacaaaauugcucgauguccugcagcaguacugcauggcaucaggguuagacuacagaaggcuggauggaaguacuaaguccgaggaacgccuaaagaucgugaaagaguuuaacagcacccaggacguuaauauuugucucgugucuacaauggccggcggucuggggcuuaacuucguaggcgcuaaugucgugguuuuguuugaucccaccuggaacccagcgaaugaccugcaagcaaucgaucgggccuauagaauaggacagugcagggacgugaagguccuccgccugauuucauuaggcacuguggaagagaucauguaccugcgacagaucuauaaacagcaacuucacuguguagugguugggagugaaaacgcuaagcgguacuucgaggccguccagggaagcaaagagcaccagggugaauuguuuggcauucauaaucucuucaaguuucguucccaagggucuugccugacgaaggauauccuagagguguga

SEQ ID NO: 55868 - RNA, 3186 nt, Artificial Sequence
  derived and/or modified sequence opt3 from ERCC6-PGBD3__Homo_sapiens__NP_001263988
augcccaacgagggcaucccucacagcucccagacccaagaacaggacugccugcagucucagccagugucaaauaacgaggaaauggccauuaagcaagagagugggggagauggugaagucgaggaguaccucagcuucagauccguuggcgacgggcuuucuacaucggcugugggaugugcaucagccgcgccgaggcggggccccgcucuguugcauauagaucgccaccagauccaggccguagaaccuagcgcacaggccuuagagcugcaaggucuagggguggacgucuaugaucaggacgugcucgaacagggaguucugcagcaaguggauaaugcuauucaugaggcaagucgagccucccagcuugucgacguggagaaagaauaccguucuguacuggaugacuugacuagcugcacgaccucccucagacagaucaacaagauuaucgagcaacugucaccacaggcugccacaaguagggauauaaaucggaaacuggacagcguuaagcgccagaaauauaacaaggaacagcaacucaagaaaaucacugcgaagcagaaacacuuacaggcaauucugggcggcgccgaggugaagaucgaacuugaucaugcuucuuuggaggaggacgccgaacccgggccuuccucacugggaagcaugcuaaugccaguccaggagaccgcaugggaggaacucauuagaacaggucaaaugacccccuuuggcacucagaucccucagaaacaggaaaagaagccaaggaaaauaaugcugaaugaggcuaguggguucgagaaguaccuugccgaccaagcgaaacugucuuuugaacggaagaaacagggauguaacaagcgcgccgcacgaaaagcuccggcccccgugacaccuccagcucccgugcagaauaagaacaagccuaauaaaaaggccagagucuuguccaaaaaggaggaaaggcucaaaaagcacauuaagaaacugcagaagcgggcauuacaauuccagggcaaaguuggucugccaaaggcccgucgccccugggagagcgauaugagaccggaagcugagggggacucggagggagaagagucugaauauuuuccuaccgaggaggaagaggaagaggaagaugacgagguggagggcgcggaagcagaucucuccggcgacgggacggauuacgagcuuaaaccccugccaaagggagguaagaggcagaaaaagguaccugugcaagaaaucgacgaugacuucuuucccucaaguggcgaggaagccgaggcugccagcgucggggagggaggcggugggggccggaaagugggacgauaucgcgaugacggcgacgaagauuacuacaagcagagauuguccccaaaaaugcccaggacucuaucucugcacgagauuaccgaccuccuggaaacagaugacagcaucgaggcaucagccaucguuauucagccuccagaaaacgcuacugccccggugagugaugaggaguccggggacgaagagggagguaccauaaauaaccuucccggcagccuguugcauacagcagcguaucucauccaggaugggucugacgcugaaucagauagugacgauccuagcuacgccccaaaggacgauucccccgacgaggucccuucuaccuucacggugcaacagccacccccgucgcggcgcagaaagaugacuaaaauucugugcaaguggaaaaaggcagacuuaacaguacagccuguugccggaagggugaccgcuccacccaaugauuucuucacugucaugcguacaccuaccgagauccuggaacuauuucucgacgaugaggugauagaacugauugucaaauauagcaaccuuuacgccuguuccaagggcgugcacuugggucugacgucaagugaguucaaaugcuuucucgggaucaucuuccugucuggcuauguuagcgugccccggcgaagaauguucugggaacagaggaccgacguacauaacguccuuguguccgcagcuaugcgccgggauagauuugagacaauuuucucaaaucugcacguugccgacaacgcgaauuuggauccaguggacaaguuuagcaagcucaggccucugaucucuaaauuaaacgagcgcuguaugaaguucguccccaaugaaacuuacuuuuccuucgaugaguuuauggugccauauuucggacgacacggcugcaaacaauuuauucgggggaagccgauacguuucggauacaaauuuugguguggugcuaccugccugggcuacaucuguugguuccagccuuaucaggggaagaaccccaauacaaagcaugaagaguacggaguaggcgccagucuagugcuccaguuuagcgaagcacugacugaggcccacccaggucaauaucauuucguuuucaacaacuuuuucaccucuauugcucuuuuggacaaacuguccucaauggggcaccaggccacaggcaccgucagaaaggaucauaucgacagggugccccucgagagugauguggcacugaaaaagaaagaacgcggaacuuuugacuaccggaucgacggcaaggggaauauugucugcagauggaaugauaacagcguugugacgguggcgucguccggagccggcauacacccuuuaugccugguaucuagguauagccagaaacuuaagaagaaaauccaaguccagcagccaaauaugauuaagguguacaaccaguucaugggugggguugaccgagcugaugagaauaucgacaaauaucgcgccucaauucggggaaagaagugguacaguucccccuugcucuuuuguuucgaacuggugcuacaaaacgcauggcagcugcacaaaacauacgaugagaagccugucgacuuucucgaauuuagaaggcgugugguuugccauuaucuggagacccacggccauccgccagagcccggucagaaaggccgcccucagaagcggaacaucgauucuagauacgacgggauaaaucacgugaucguaaaacaaggaaagcagacuaggugugcugaaugccacaaaaacaccacauuucgaugugagaagugcgaugucgcccuucaugugaaguguagcguggaauaucacaccgaguga

SEQ ID NO: 55869 - RNA, 1191 nt, Artificial Sequence
  derived and/or modified sequence opt3 from ERCC8__Homo_sapiens__NP_000073
augcugggcuuccucagcgccagacagaccgggcuugaggacccccugagguugcggcgcgcugaauccacacgacguguguuaggacuggagcuaaacaaggauagagacgucgaaaggauccacgguggcgggauuaauacucucgauauagagccuguugaaggacgguacaugcugucuggcgguucagacggggugaucguacuuuaugaucuggagaacaguagccgccaauccuacuauacgugcaaagcaguguguucuauuggaagagaccauccagauguccacagguacucgguggagaccguucagugguauccgcaugacacaggcauguuuacuucaagcaguuucgauaagaccuugaaagugugggacacaaauacccuccagacugccgaugucuuuaacuucgaagagacaguguacucccaccauaugucucccguaagcaccaagcacugccugguugcggugggcacgcgggggccuaaaguccagcugugugaccucaaguccggaucaugcagucacaucuuacaaggucaucgccaggaaauucuggcugugagcuggucuccacgauaugauuacauccuugccacugcauccgccgacucaagagugaaguugugggacgucaggcgggcuagcggcugucugauaacccuagaucagcacaaugggaaaaagagucaggcaguugagucugccaacacagcucauaauggaaaagugaacggccucugcuuuacuuccgacggucugcaccuucugaccguagggacagauaaucguaugcgcuuguggaacagcucgaauggagagaacacccucgugaauuacggcaaggucuguaacaauucuaaaaagggccugaaguucacgguguccugcggguguucaagugaauuuguuuucgugcccuauggaagcacuaucgccgucuacacaguguauuccggugagcaaauuaccauguuaaaaggccacuacaagacuguagacugcuguguuuuucagucuaacuuccaggaacuguauagcgggucaagagauugcaacauccucgcgugggugccuagucuuuacgagccaguccccgacgaugacgaaacaaccacgaaaucccagcugaauccugcauuugaggaugccuggucuagcucagacgaggaaggauga

SEQ ID NO: 55870 - RNA, 510 nt, Artificial Sequence
  derived and/or modified sequence opt3 from EREG__Homo_sapiens__NP_001423
augaccgccggcagaaggauggagaugcugugcgcugggcgggugcccgcacuccuucuguguuugggauuccacuuacugcaggccguccuaagcacaacuguuaucccuuccugcauuccaggugaaucuucagacaacuguacggcgcucgugcaaaccgaggauaauccgcgcguagcucaggugaguauaacaaagugcagcuccgacaugaacggcuacugucugcaugggcagugcaucuaucuugucgauaugucucagaauuacugucgaugcgaagugggauauacuggcguucguugugagcacuuuuuccugaccgugcaucaacccuugucgaaagaauacgucgcccucacagugauucugaucauucuguuucucaucaccguaguugguucaacuuauuacuucugcagaugguauaggaaccgcaagagcaaagagccuaagaaagaguacgaacgggugacaaguggggacccagaguuaccccaggucuga

SEQ ID NO: 55871 - RNA, 1422 nt, Artificial Sequence
  derived and/or modified sequence opt3 from ERF__Homo_sapiens__NP_001287964
augaacuacgacaagcugagcagagcccucagguauuacuauaauaaacggauccuucacaagaccaaaggcaagcgcuucacauacaaauuuaacuucaauaagcugguguuggucaacuaucccuuuauugauguuggguuagcuggaggugcagugccucaguccgccccaccgguacccucuggcgggucacauuuccgauuuccuccaaguacucccagcgaggugcuguccccuacggaagacccacguucucccccugcgugcucgucaagcaguuccucucuauucagcgcugucguggccagaaggcucggacggggcuccguuucagauuguagugacgguaccagcgagcuggaggaaccacuuggggaagauccgcgcgcaagacccccuggaccacccgaccugggcgccuuuaggggcccuccauuggcucggcucccccacgauccggggguguuccgcgucuacccucgacccagaggagguccagagccucugucucccuuuccagugagcccccuggcaggcccugggucacucuuaccaccgcaacugagccccgcccuuccuaugacaccaacucauuuggcuuauacccccaguccuacacugucuccaauguaccccuccggaggcggugggccgagcggaucgggcggcgggucucacuucuccuuuucaccugaggacaugaagagguaccuacaggcccauacccagaguguauauaauuaccaccucagcccacgggcguuccugcacuaucccggacuuguugugccucagccccaacguccagauaaaugcccucugcccccaauggcaccggaaacuccucccgucccauccucugccagcucaaguuccuccucuucaaguagccccuuuaaguucaaauugcagccuccaccccucggucgcagacagagggcugccggcgagaaggcaguggcuggggccgacaaauccggaggcucugcgggugggcuggccgaaggcgcaggagcuuuagccccuccgccacccccuccacagauaaagguggagcccaucucggagggcgaaagcgaggaagucgagguuacagauauuuccgacgaagaugaggaggacggggaaguguucaagaccccucgggcuccgcccgccccaccuaaacccgagccaggagaagcaccuggugccucacaauguaugccccugaagcuccgauuuaaacgcagauggagugaggacugcaggcuugaaggcgggggaggcccagcugguggguucgaggaugagggcgaagacaagaaaguacggggagagggcccgggggaagcgggagguccucugacgccccgcagagugucuagcgauuugcagcaugcaacugcccagcuaucccuggagcacagggacucauga

SEQ ID NO: 55872 - RNA, 1461 nt, Artificial Sequence
  derived and/or modified sequence opt3 from ERG__Homo_sapiens__NP_001129626
augauccagaccgugcccgacccugccgcucacauuaaggaggcacugagcgucguuuccgaagaucaaucucucuucgagugcgccuacggcacaccacaucuugcgaaaacugaaaugacggcuucaaguagcuccgacuaugggcagaccucuaagaugucgccgagagugccccagcaggauuggcugucacaaccuccagccaggguaacaauaaaaauggaguguaaccccagccaggugaauggaagucggaacuccccugacgaaugcucugucgcaaaggguggcaaaaugguggggagcccagauacuguuggaaugaauuacggcuccuauauggaggagaagcacaugcccccuccaaacaugaccacaaaugaacgccgagugaucgucccggccgaccccaccuuguggucaacugaucaugugcgucagugguuagagugggcuguaaaggaauacggucugccugacguuaacauucuacucuuucagaauaucgaugggaaagagcuguguaagaugacaaaagacgauuuccaaagacuuaccccaaguuauaacgcagacauucuguugagccaccuccauuaccugagggagacgccccugccucaccucacuucugaugacguggacaaggccuuacaaaauuccccacggcugaugcacgcucgcaacaccggaggcgccgcguuuaucuuccccaauacaucagucuauccggaagcaacucagagaauaaccacaaggccugaucuucccuacgagccaccucggcgcagcgccuggaccggccaugggcaccccacgccacagaguaaagcugcccagcccucuccuuccacugugccaaagacagaagaccagcgaccgcaguuggaucccuaccaaauccugggaccuaccagcucgagacuagcaaacccagguucuggccagauucagcucuggcaguuucugcuugagcuguuguccgacucaaguaauagcuccugcaucacuugggaagggacaaacggagaguucaagaugaccgaucccgacgagguggcuaggcgguggggcgaacguaaaucuaagccuaauaugaacuaugauaaacucagccgcgcccugagauacuauuacgacaagaacauuaugacgaaaguccaugguaagagguaugcguacaaauuugauuuccacgggaucgcccaagcauuacagccacaucccccggagucaagucuguauaaguacccuuccgaccucccauacaugggaagcuaucacgcucacccccagaagaugaauuuuguugccccucaucccccagcccuuccugugaccucuucaaguuucuuugcugcacccaacccauacuggaauagcccgacaggcggcauauauccuaacacucggcugcccaccucccacaugccaucucauuuggggacauacuauuga

SEQ ID NO: 55873 - RNA, 873 nt, Artificial Sequence
  derived and/or modified sequence opt3 from ERGIC1__Homo_sapiens__NP_001026881
augcccuucgacuuuagaagguucgauaucuaccggaaggugccuaaagaccugacccagccaacauauacuggcgccauuauaagcaucugcuguugccucuuuauucuuuuccuguuuuuguccgaguuaacgggguucaucaccacagaagucguuaacgagcuguacguggaugacccggauaaggacucuggagguaaaauugauguaucacuaaauaucagucuccccaaccugcacugugaacuugugggccuggacauacaagaugagauggggcgccaugaagucggacacaucgacaauagcaugaagauuccuuugaacaauggcgcugguugccgauuugaggggcaguucuccaucaacaaagugccaggaaauuuucauguuucuacucacucggcaaccgcccagccccagaacccugauaugacacaugugauucacaagcucucauucggcgacacccugcaaguccagaauauccacggcgcguuuaacgcucucgggggagccgaucgucugacuagcaauccauuagcaagucaugacuauauacugaagauugugcccacaguauacgaggacaaauccgguaagcagagauauucuuaccaguauaccguugccaacaaagaauacguggcuuacagccacacgggcaggaucauuccugcaaucugguuccgguaugaucuuuccccaaucacugucaaguacaccgagcgcagacaaccguuguauagguuuauuacaacuauaugugccaucauugggggaaccuucacaguggcuggcauccuggacucaugcauauucaccgccagugaagcguggaaaaagauucagcuagguaagaugcauuga

SEQ ID NO: 55874 - RNA, 1134 nt, Artificial Sequence
  derived and/or modified sequence opt3 from ERGIC2__Homo_sapiens__NP_057654
augagaaggcugaaccggaagaaaacccucagccuugugaaggagcuggacgccuuccccaaagucccugaauccuacguugagacaucugcuucaggcgggacugugaguuugaucgcauuuacgaccauggccuuacugacaauuauggaguucagcguauaucaggauacuuggaugaaguacgaguaugaaguggacaaagauuuuuccucuaagcuacgcauaaauaucgacauuaccgucgcgaugaagugccaauacgugggagcugauguucucgaccuggccgagacaaugguggcaucggccgauggucuugucuaugagccaaccguguucgaccugucaccgcagcagaaagaauggcagcgaauguugcaacucauccagagccgucugcaggaggaacacagucugcaggauguaauuuuuaaguccgcuuucaaaucuacuagcacagcacugcccccuagagaggacgauuccucacaaaguccaaacgccuguaggauccauggccacuuauacguuaauaagguggcugggaacuuucauauaaccgucggaaaagccaucccccacccucggggccaugcgcaccuggcagcccuugugaaucacgagagcuauaacuucucucaucgcauugaccacuuguccuuuggugaacuggugccagcuaucauuaauccccuagaugggacggagaagaucgccauagaccauaaccagauguuccaguacuuuauuacugucguuccuaccaagcuccacacauacaaaaucucagcagacacucaccaguucagcgugaccgaaagagagaggauuaucaaucaugcugccggaagucacggcguaucuggcaucuuuaugaaguaugaucuguccagccuuauggugacagucaccgaagaacauaugccauucuggcaauucuuugugcggcugugcgggauuguuggagguauauucucgacgacuggcauguugcacgggaucggaaaauuuauuguggagaucauauguugccgcuuccgacucggcucuuacaagccggucaacuccgugcccuuugaagacggucauacagauaaucaccucccuuuacuggagaacaauacccacuga

SEQ ID NO: 55875 - RNA, 1152 nt, Artificial Sequence
  derived and/or modified sequence opt3 from ERGIC3__Homo_sapiens__NP_057050
auggaggcccugggcaagcucaaacaguucgacgcuuaccccaagacccuugaagauuuuagagugaaaacaugcgggggagcaacugucacgaucguuagcggucuguugauguuacugcuauuccucuccgagcugcaauauuaccuuaccacagaagugcacccugagcuguauguagacaagucuaggggcgauaaauugaagauuaacauagacgugcucuuuccacauaugccgugugccuaccugucaaucgaugcgauggacgucgcuggggaacagcagcuggauguggagcacaaucucuucaagcagcgguuagacaaagauggcauucccguuaguagcgaggccgaacgccaugagcugggaaagguggaagucacuguguuugacccugauucccuugacccagaucgaugcgagucuuguuauggugcagaggccgaagacaucaaaugcuguaauaccugcgaggacguacgugaggcuuacagaaggcgggggugggcauucaagaaccccgauacaauugaacaaugucgcagagaaggauuuucgcagaaaaugcaggagcagaagaacgagggcugccaaguuuauggcuucuuggaagugaauaaggucgccgggaacuuucacuucgcuccuggaaaaucauuucagcagagccaugugcacgugcacgaccugcagaguuucggucuagauaauaucaacaugacccauuacauacaacaccucuccuuuggcgaggacuacccagggaucgucaauccccuggaucauacuaacguuacagccccucaggcgucuaugauguuccaguauuucgugaagguagugccaaccgucuacaugaaaguggacggagaaguucuuaggacgaaucaauuuagcgugacucggcacgagaaggucgcaaacggccuguugggugaucaggggcucccgggaguguucguacuguaugaauuaucccccaugaugguuaaacugaccgagaagcaccgcucauuuacacauuuccucacuggcgugugugccauuaucggcgggauguuuaccgucgcuggacuuauugacagucugaucuaccacagcgcccgagcaauacagaaaaagauugauuuggguaagacaaccuga

SEQ ID NO: 55876 - RNA, 780 nt, Artificial Sequence
  derived and/or modified sequence opt3 from ERI3__Homo_sapiens__NP_001288628
augcuggcuccccuccagaccggcgccgcaagauucagcuccuaccuucugucuagggcccggaagguguuggggucacacuuauuuaguccuugcggagucccagaguucuguagcaucuccacacgcaaacuggcggcucaugguuuuggcgccucuauggcagccaugguuucguucccgccccaacgauaucacuacuuucuagugcucgacuucgaagcuacuugcgauaagccucagauucauccacaggagauaaucgaauuucccauucugaaacuuaacgggcguacgauggagaucgaaucaaccuuccacauguauguacagccugugguccauccacaacugacacccuuuuguacugaguugaccggaauuauccaggcaaugguggacggccagccuagccuccagcaaguucuggagagaguggaugaauggauggccaaggagggucugcucgacccaaaugucaaaaguauauucgugacaugcggggauugggacuuaaagguaaugcugccgggacagugucaguaccuuggcuugcccguugcugauuauuuuaagcaguggaucaaccugaaaaaggccuacuccuucgcgaugggcugcuggccuaaaaaugggcuacucgacaugaacaagggacugucucuucaacacauugguaggccacacagcggcaucgaugacuguaaaaauauugcaaacaucaugaagacccuggccuaucggggguuuauauucaagcagacuuccaaacccuucuga

SEQ ID NO: 55877 - RNA, 171 nt, Artificial Sequence
  derived and/or modified sequence opt3 from ERICH5__Homo_sapiens__NP_001164277
augggcugcagcuccucugcccugaacaaggcuggggacucaaguagauuccccagcggagagaccggugaaaaaguggagacagauauggaaaaugagaaggucuccgaaggcgcagagacuaaagaggaagagacgggggaaguuguggaccucucugccgcgaccuga

SEQ ID NO: 55878 - RNA, 2091 nt, Artificial Sequence
  derived and/or modified sequence opt3 from ERICH6B__Homo_sapiens__NP_872348
augagcgccgagaacaaucagcuguccggcgcuucucccccucacccaccgaccacaccccaauacucaacucagaaccucccuagugaaaaggaggacacggaaguggagcuugaugaagagagccugcaggacgaguccccauucucucccgaaggggagucguuggaagauaaagaguauuuagaggaagaggaagaccuggaggaagaggaguaccuaggaaaggaagaguaucucaaagaagaggaauaccuggguaaggaggagcaucuugaagaggaagaguaucuggaaaaagcaggcuacuuggaggaggaagaguauaucgaagaggaggaauaccucgggaaggagggauaccuggaagaggaagaguaucugggcaaggaggaacaccucgaggaagaggaauacuuagguaaagagggguaucuggagaaggaagauuacauugaggaagucgacuaucuuggaaagaaggccuacuuggaggaagaggaguaucugggcaaaaagucauaccuagaagaggaaaaggcgcucgagaaagaggaaaaucuggaggaagaggaagcucuugagaaggaggaaaaccuggauggcaaagagaauuuguacaagaaauaucucaaggaaccuaaagccagcuacaguucccagaccaugcuguuaagagacgcaaggucuccagaugccgggcccagccaaguuacaacuuuucugaccgugccucucacauucgcuaccccauccccgguaucagagagugcaacugaaagcucugagcuucuguugacacuauaucggcgcucccaggccucacagaccgacuggugcuacgaucgaacggcugugaaaagccugaagaguaaaucugagacugaacaggagaccacaacuaagcucgcccccgaggaacaugucaacaccaaagugcaacagaagaaagaagagaauguucuggaguuugcguccaaggaaaacuucugggacggaauaacagaugagagcaucgacaaguuggaaguggaggaccuggaugagaauuuucuuaacucgucuuaucagaccgucuucaaaacgauuaucaaggaaauggcagcccacaaugagcucgaagaggacuuugauauuccucugacuaaauuacuggaauccgagaaccguuggaagcuagugaucaugcucaaaaagaauuacgagaaguucaaagaaacaauacugagaaucaagaggcggcgcgaggcucagaaacuuaccgaaaugacuucauuuacauuccauuugaugaguaagccaacccccgagaaaccugaaacggaggagauucaaaagccacagagaguaguucaccacaggaagaaacuggaacgggacaaggaguggauccagaaaaagaccgugguccaucaaggugauggcaaacucauucuguaucccaacaagaauguguaccagauccuuuuuccggacgggacaggacagauacacuacccuagcggcaaccuggccauguugauucucuaugcaaaaaugaagaaguucacuuacaucauucuggaagauuccuuagagggucgcauccgagcucugaucaacaauucugggaacgccaccuuuuaugacgaaaauagcgauauuuggcuaaaccucucaaguaaucugggauacuauuuccccaaagacaagagacagaaagcguggaacugguggaaucuuaacauacaugugcacgccccaccuguccaacccaucuccuugaagauuaaugaguacauccagguucagauaaggagccaggauaaaauuaucuucuguuuuacauaugagcaaaagcagaucugccugaaccucggcacucgguacaaguucgugauuccagaaguacugucugagaugaaaaagaaaaccaucuuagaagcagagcccggcccuacagcucagaagauucgugugcugcuugggaaaaugaaucgcuugcucaacuacgccaccacuccagaccuggagaauuuuauagaagcugucucaaucagucuaauggacaacaaguaucugaagaaaaugcucagcaagcugugguucuga

SEQ ID NO: 55879 - RNA, 1374 nt, Artificial Sequence
  derived and/or modified sequence opt3 from ERLEC1__Homo_sapiens__NP_001120869
auggaggaaggcgggggaggugugagaagccugguccccggcgggccuguucuccuugugcugugcggauuguuagaggccuccggcggugggagggcucugccacagcuaucugacgauaucccguuccggguaaacuggcccggaaccgaauuuucacucccuacaacuggcgugcuguacaaggaggacaauuaugucauuaugacgaccgcacacaaagaaaaguacaaauguauacuuccacuggugacaaguggcgaugaggaggaagagaaggacuauaaagggcccaacccucgcgaauugcucgagccacuguucaagcaaagcuccugcucuuaccgaaucgagucguauuggacuuacgaaguuugucauggaaagcacauucgucaguaucaugaggaaaaagagaccggucagaagaucaauauucacgaauacuaccugggcaacaugcucgccaaaaauuuacuguuugagaaggagagagaagcggaggaaaaagagaagucaaacgaaauccccacaaagaauauagaggggcagaugaccccuuauuacccagugggaaugggcaacgguacuccgugcagccuuaaacaaaauaggccccggaguuccacagucauguauaucugucauccugagucuaagcacgaaauuuugagcguggcugagguaaccacgugcgaauacgagguugugauccugacuccacuacucuguucccaccccaaauaucgcuucagagccucaccugucaacgauaucuuuugccagagucugccagggagccccuucaagccgcuuacccugaggcaguuggaacagcaagaggagauucuccgggugccuuuucgccgaaauaaagaagaggaccugcagucuacaaaggaagagagauuccccgcaauacauaaauccauugccaucggaucacagccaguguuaacugucggcaccacacacauuagcaagcugaccgaugaccagcucaucaaggaguuucuuaguggcucuuacuguuucaggggagggguugguugguggaaauaugaauuuugcuacggcaagcaugugcaccaauaccacgaggauaaagacuccgggaagacgagcguaguggucggaacuuggaaccaggaggaacauaucgaaugggcuaaaaagaauacagcacgggccuaucaucugcaggaugacggcacccaaacugugcguuguaaggagucggauucuccucacgcuguuacaguguacauguuggagccccacuccugccaguauauucuaggugucgaaucaccagugauaugcaaaauccuggacaccgccgacgagaacgggcuccugagucuucccaauuga

SEQ ID NO: 55880 - RNA, 1047 nt, Artificial Sequence
  derived and/or modified sequence opt3 from ERLIN1__Homo_sapiens__XP_005269499
augaacaugacccaggccagagugcuggucgcugcaguugugggccucguagccgugcuucuguacgcgagcauccacaagauugaggaagggcauuuggcugucuauuacaggggaggugccuuacugacaucccccucuggcccuggguaucacauaaugcuaccauucaucacuacguuucggucagugcaaaccacacuccagacugacgagguuaaaaaugugccgugcggaaccaguggcggugucaugauuuacaucgaucgcauugaagugguaaacaugcuggcacccuaugccguuuucgacaucgugcgaaauuacacagcugauuaugacaagacccuuauauuuaacaaaauccaucacgagcugaaucaguucuguagcgcacauacuuugcaggaagucuacauugagcucuuugaucaaaucgacgagaaccugaagcaggcccugcagaaagaucucaauuuaauggcuccugggcugacaauucaggccgugcgugugaccaagccaaagauccccgaagcgauaagaaggaacuucgagcuuauggaagcagagaaaacgaaguugcugauugccgcucaaaaacagaaggucguugagaaagaagccgagacugaacggaagaaggcagugaucgaggcugagaaaauugcccagguagcgaagauccgcuuucagcaaaaagugauggaaaaggagaccgagaaaagaaucuccgaaauugaagacgccgcauuccuagcuagggagaaggccaaagcugaugccgaauacuaugcagcccacaaguacgcuacaucuaauaagcacaaacucacuccugaguaucuggagcuuaagaaauaccaggcgauagcaucgaacucaaagaucuauuuuggaagcaauauuccaaacauguucgucgacaguuccugcgcccugaaauacucugauauccggaccggccgcgaaagcuccuugcccucaaaggaggcucucgaaccuaguggcgagaaugugauacagaacaaggaaagcacaggguga

SEQ ID NO: 55881 - RNA, 459 nt, Artificial Sequence
  derived and/or modified sequence opt3 from ERLIN2__Homo_sapiens__NP_001003791
auggcccagcugggcgcuguggucgcaguugccagcuccuucuuuugcgcgucucucuucucagcugugcacaagaucgaggaagggcauauuggaguauacuauagagguggcgcccuucugaccaguacaagcgggcccggauuucacuugauguuaccuuucauaacuuccuacaaaucugugcaaacgacccugcagacagacgaggucaagaacgugccauguggcacuucgggugggguuaugaucuauuuugauaggauugaaguggucaauuuccuagugccgaacgcaguauacgacaucguuaaaaauuauaccgccgauuacgacaaggcucucauuuuuaacaaaauccaucacgagcugaaucaguucugcucagugcauacacuucaggaagucuauauagagcuguuuggauuggagaacgauuucagccaagaaaguuccuga

SEQ ID NO: 55882 - RNA, 1428 nt, Artificial Sequence
  derived and/or modified sequence opt3 from ERMAP__Homo_sapiens__XP_011538872
auggagauggccagcuccgcuggcucuuggcugucagggugccucaucccccuuguguuccugagauugagugugcacguuagcggacaugccggugacgcaggcaaguuucacguggcguuacuugggggaaccgcugaacuacucuguccucugucccuuuggccaggcacaguaccgaaagaggugagguggcugcggucucccuucccucagcgcucgcaagccguccauauuuuucgagaugguaaggaccaggaugaagacuugaugccagaguacaaagggcguacugugcucguuagagaugcacaggaaggaucagugacgcugcagauacuggacgucaggcucgaggaucaaggcagcuaucggugcuuaauccaggugggcaaccugaguaaggaggacaccguaauucuucagguugccgcucccuccguggggucuuugagcccuuccgcagucgcccuggcugugauccuaccagugcucguccugcuuauuaugguuugucugugcuugaucuggaaacagcgcagagccaaggaaaagcuccuguacgagcacgugacagaaguagauaauuuacugucagaccaugcgaaagagaagggaaaacuccacaaggcagugaaaaagcugaggagugagcugaaguugaaacgggccgcugccaacagcgguuggcgccgagcaagacuacacuucgucgcugugacucuggaucccgacaccgcccauccuaagcucauacugucugaagaucaaagguguguucggcuuggcgaccgucgccagccagugccggacaauccccagagauuugauuucgucguguccauccuggggucagaguauuuuacaaccggaugccacuacugggaaguauauguuggcgacaaaacuaaguggauuuuggguguguguagcgagagugucucuaggaaagggaaggugacagcguccccugccaacggacauuggcuccugcggcagagccgaggcaaugaauacgaggcauuaaccucgccacaaacgucuuuccgccugaaagagcccccuagaugcgucggcaucuuucuagauuaugaagcuggggugauuuccuucuacaacguuacuaauaagucacacaucuuuaccuucacacacaacuuuaguggaccacucaggcccuucuucgagccgugucugcaugacgguggcaagaauacugccccucuugugauaugcagcgaauugcacaaauccgaggaaucuauuguaccccggccagaggggaagggacaugcuaacggcgaugucagccugaaagucaauucaagucuccugccucccaaggccccagagcuuaaagacaucauucuguccuugcccccugaucucgguccagcacugcaggaauuaaaggccccgagcuuuuga

SEQ ID NO: 55883 - RNA, 1896 nt, Artificial Sequence
  derived and/or modified sequence opt3 from ERMARD__Homo_sapiens__NP_001265460
auggaggugcugaucggcgaccccauuaccacaugccucagcccuuccgucuacgauauaaucuguaaccuuggguuccagcugagagaaaauugcgacauuaacucuaucguuacucaaaauggagagguguguuggaagacgauuaccgauugcguaucauauacagaaagugagcaggguuuggacuacuggggcagcgugagguuacuggggccagucugugaagccgugcacucccauuuucuaucucucacuaaaggacaguucgagauccgguaugcuccgugguuucaguggaccucguuccccgagcuguuuccugaaauauucgaugcacuugagucacugcaaagcccagccaucaguuugucccucaugaagcugacaucuugccuggaacgcgcgcucggcgacguuuucuuacugauugguaaagagugucccuuucuuuugcgagaucugcuaagcuccgaggaacucgcucagguguuuucacagagugucaugaacgugcugaagguauucguugggagcccuugcggacuuaaucugcguaacguguuguggcacggcuuugccucuccagaggaaauucccccuaaauacuguuccaugaugauccuccugaccgcaggcuuagggcagcugcucaagucauaucuucaaaauacuaagcugacauuggcccauaggagcuucaucagucuaaccaaccuggaggaccucauagucuuuccagaugugacguacgaagugcugucuguccuugaggagguuaugaugaaauccgcuuucauucugaagaucauguugccguauugggaaguggcacucguaaaauucaagagccacagguuugccgacugcgcuauucuguuacugacucagcuagagaccggacuccggaauguguucgccacacugaaccgcugucccaaaagacuuuugacugcggaaucgaccgcacuguacacaaccuuugaucagauccucgccaagcaucugaaugacgguaagaucaaccagcuuccucuguucuugggcgagccagcuauggaauuucucugggauuuccugaaucaccaagaggggcccaggauucgggaccacuuaucucauggagagauaaaccugcacgaauuuuccaaagagacgacuaaucagcuacucgccuucucacugguccuuuugcugcgcuuuguggacgauugccuccugaguguuuucaaggagaaaagcgcaguggaguuacugaucucccuugcugaaggcuacucuagccgaugccauccugucuuucaguugaagaaacaagugcucucaugugaggagaguauuagaguaugggcccugcuaccauuccccgaagaacugacaaggcaggcgguucggcucgaagacaacuccgagaccaacgccugccacagccugaucacuaagaugacagaugagcuuuaucaccauaugccggaaaaucguuguguguugaaagaccuggaucgcuuaccuaccgagacgcccaccucugacacaccacucgcacuggcuccuagaaagccccagccaugcagaugucggcgacgcgucagacccucaauaaggcuucugaguccuguguugagccucauucugcuacugaucgcccucgaacuggucaacauccacgcugugugcgguaagaaugcccaugaguaccagcaauaucuuaaauuuguuaaguccauuuugcaguacacugaaaaccugguggcauauaccucuuacgagaaaaauaaguggaacgagacaaucaauuuaacucacaccgcccuccugaaaauguggacauucucggaaaagaagcagaugcuuauucaucuggcuaaaaagagcaccuccaaaguacuacucuga

SEQ ID NO: 55884 - RNA, 2715 nt, Artificial Sequence
  derived and/or modified sequence opt3 from ERMP1__Homo_sapiens__NP_079172
auggaguggggcagcgaauccgccgcugugagaaggcaccgggucgggguugagcgccgagaaggagcagccgcggcucccccuccagagcgugaagccagagcacaggagccgcugguggacgguugcucuggcgggggaaggacccggaagcgcucacccggcgguagugggggagccagcagaggcgcuggcacagggcucuccgagguaagggcagcccuuggacuggcuuuguacuuaaucgcccugcggacucuagugcaacucucucugcagcagcuuguccugcgcggugcggcaggccaucgaggggaguucgaugccuugcaggcuagagacuaucucgaacacauuacgucgauaggaccuaggaccacaggcucaccagaaaacgagauccugacugugcauuaccugcucgagcaaauuaaauuaaucgaaguucagagcaauagucugcacaagauuuccguggauguccagcggcccaccgguucuuuuagcaucgacuuccuugggggauuuacauccuauuacgauaacauaaccaaugugguaguuaaauuggagccucgugacggcgcccagcaugcagugcuggcuaacugucacuucgauucagucgccaauaguccaggcgcgagcgacgaugccgugucuugcuccgugaugcuagaaguccuccgcguucugucaacuagcagugaggcacuucaccaugcugugaucuuucuguucaacggggccgaagagaauguauugcaagcuagucacggauuuauuacacagcaucccugggccucccucaucagagcauucauuaaccuggaggccgcuggugugggcgggaaggaauuagucuuucagaccggaccugagaauccauggcuggugcaggcguauguuagcgcagccaaacacccguucgcuucgguggucgcccaagaaguguuucagucuggcaucauacccuccgacacggauuucaggauuuaccgggacuuugguaacaucccugggauugaucucgcauucaucgagaauggcuauaucuaccacacuaaguacgacaccgccgaccgcauucuuacagauucaauacagcgagcuggagacaacauccuggccguauugaagcaucuagcaacuucugauaugcuggcggcugccagcaaauauagacacggcaauaugguuuucuuugacgugcucgggcuguucgucauugcauacccauccaggaucggaucuauaauuaacuauaugguggucaugggugugguucuuuaccugggcaagaaauuuuugcaacccaagcauaaaaccgggaauuauaagaaggauuuccucuguggacugggcaucacauuaaucagcugguuuaccucacuggugacgguacuaauuaucgccgucuucauuagucucauaggucagucccugagcugguacaaccacuuuuaugugucuguuugccuuuacgggacugcuacaguggccaaaaucauuuugauccauacccuggcaaagcgguucuacuauaugaacgcuucagcccaguaccucggcgaagucuuuuucgacaucagucuguuugugcacuguugcuuccuuguaacucugacauaucagggauuguguagcgcguuuauuuccgccguguggguugcuuucccucuccugaccaaauuaugcguccacaaggauuucaaacaacauggcgcacaggggaaguuuauagccuucuaccugcuaggaauguuuaucccauaucucuacgcucuguaucuuauuugggccguguucgagauguuuacgcccaucuugggucgcucuggcucggagauuccgccugacgugguccuggcaagcauccucgcgggguguaccaugauacuguccucauacuucaucaauuuuauuuacuuagccaaaaguacaaagaagacuaugcugacccuuacauugguuugcgcuaucacuuuccuccugguguguucuggaaccuuuuuccccuauagcuccaacccagccaauccuaaacccaagagaguguuucuacagcacaugacaaggaccuuccaugaucuggaaggcaacgcaguaaaacgugacucagguauuuggaucaauggguuugauuacacuggcauaagccacauuacgccacacauccccgagauuaacgacucuauccgggcucauugcgaagagaaugccccucucugcggauucccaugguaucugccgguccacuuccuuauacgaaagaacugguacuugcccgcaccugaaguguccccaagaaaucccccucauuuuaggcugaucaguaaagagcagacaccaugggacagcauuaaguuaaccuucgaggccacuggccccucucacauguccuuuuauguucgcgcucauaaggggucaacccucagucaauggagccugggaaacggcacaccggugaccucgaaagguggggauuacuucgucuuuuauucccacggacuucaggcgucugccuggcaguucuggaucgaagugcagguuagcgaggaacacccugagggcauggugacuguagcaauugcugcccauuaccugucaggugaggacaagcggaguccacaauuggaugcccucaaagaaaaguuucccgacuggacauucccuuccgcuugggucuguacguacgaucuguuuguguucuga

SEQ ID NO: 55885 - RNA, 2934 nt, Artificial Sequence
  derived and/or modified sequence opt3 from ERN1__Homo_sapiens__NP_001424
augcccgccagaaggcugcuccuucuguugaccuuacugcuaccuggccucgggaucuucggaagcacauccacugugacgcugccagagacccuucuguuugucucuacauuggacgguucacuccacgcuguuaguaagcggacuggcagcauuaaauggacccugaaggaagauccggugcugcagguacccacacauguggaggaaccugcauuccucccagaccccaacgauggguccuuauacacccugggaucuaaaaauaacgagggccuuacuaaguugccuuuuacaauaccagaacugguccaagccucgcccugccgcucaagcgacgguauccuauauauggggaaaaagcaggauauuugguacgugaucgaccuccugaccggagagaagcagcagacgcuuaguuccgcguucgcugauucucuguguccuagcacuuccuugcucuaucugggccgaaccgaguacacaauuacuauguaugacaccaaaacacgugaauuaagauggaaugccaccuacuuugauuaugcagccucacugccagaggacgauguugacuacaagaugagucacuucgugagcaacggcgaugggcucgucgugacgguagacucugaauccggagacguucuuuggauccaaaauuacgcuucaccgguggucgcauuuuauguguggcagagggagggucugcggaaagugaugcauauaaacgucgccguugagacuuugcgcuaccuaacauucaugagcggcgaaguggggagaaucaccaaguggaaauaucccuuuccuaaggagacugaagcuaagaguaaacugacaccaacccucuacguaggaaaguauucuacgucccuguacgccagccccucgauggugcacgagggcgucgcggugguuccuagggguucuacccuuccacuguuggaagggccccagacagauggagugacuauuggcgacaaaggcgagugcgucaucaccccguccacagaugugaaguucgacccugggcucaaaucaaagaauaaacugaacuauuuacggaauuacuggcugcuaauuggacaucacgagacuccccucagugcaagcaccaagaugcuggaacgcuuuccaaacaaucuuccuaagcaccgagagaacguaauccccgccgauuccgagaaaaagucuuucgaagaaguuauaaauuugguggaccagacaagcgagaacgcuccaaccacugucucaagagauguggaggaaaaacccgcccaugcuccugcaaggccagaggccccggucgacaguaugcugaaggauauggcgacgauuauccucuccacauuucugcuuauugguuggguggccuucaucaucaccuacccccugagcaugcaccaacagcagcaguugcaacaucagcaguuccaaaaagaacucgagaagauucagcuguuacagcagcaacagcagcagcugccuuuucacccacccggcgacacugcacaagauggggaacuacucgacaccucuggaccuuauucagagaguagcggcacauccucuccaucgaccagcccccgggcuuccaaucacucacuguguagugguucuagcgccuccaaggcugggucaagcccgucucuugagcaggacgauggcgacgaagagacuuccguugugauaguaggaaaaaucaguuucugcccuaaggaugucuugggccauggggccgaaggaacaauuguguaccgugguauguuugacaaccgcgauguugcagugaaaagaauccugccagaguguuucagcuuugccgacagggagguccagcuccugcgggaaucugaugagcaccccaacgugauacgauauuucugcacggaaaaggaccgccaguuucaauacauugcuaucgaguuaugugcggcaacccugcaggaauauguagagcagaaagauuucgcccaucuuggcuuggagccuaucacucuccugcagcaaacaaccuccgggcuagcucaucugcacucacucaauauugugcacagagaccugaagccccacaacauccuuauuaguaugccaaaugcccauggaaagauaaaagcaaugaucagcgauuuuggcuugugcaagaaacuggccguugguaggcacucguucucccggcgcucuggggucccuggcacagaaggauggauugcucccgagauguuaagcgaagacuguaaggagaacccaacuuacaccguggauaucuuuucagccggcugcguguucuauuacgucaucagugaagggucccauccguuuggaaaaucucuccagagacaggcaaauauucugcuuggugcguguagccuggacugcuugcacccugagaagcacgaggacguuauagcuagggaacucaucgagaagaugauugccauggauccccaaaaacguccauccgcaaagcaugugcugaaacaccccuucuucuggucacuagaaaagcagcugcaguuuuuccaggacgugagcgaucggaucgagaaagaaagucucgacggcccuauuguaaagcaacuggagcgagggggcagagccgucgugaaaauggauuggagggagaacaucacgguuccacuucagaccgacuugcgcaaguuucggacauacaagggagguucugugagagaucuguuaagggcuaugcgcaauaaaaagcaucacuaucgagaacuccccgccgagguccgggaaacucuggggucccuuccugacgauuucgugugcuacuuuaccagccguuucccgcaucugcuagcacacacauauagagcuauggagcucuguucgcacgagaggcuguuucagccauacuauuuccaugaacccccugagccacagcccccuguuacuccggacgccuuguga

SEQ ID NO: 55886 - RNA, 2781 nt, Artificial Sequence
  derived and/or modified sequence opt3 from ERN2__Homo_sapiens__NP_150296
auggccagcgcugugagaggcuccaggcccuggccucggcuggggcuccagcuucaauucgcagcccuguuguuaggaacccugucuccacagguccacacacuacgcccggagaaccuccugcuuguuucaacucuggacgguaguuugcaugcgcucagcaagcagacgggcgaucugaaauggacccugcgagacgaucccgugaucgaagggccuauguacguaacagagauggcuuuucucuccgacccagccgauggaucuuuauauauucugggcacucagaagcaacagggucuuaugaaauugcccuucaccauaccugaacuggugcacgcaucgccaugccguucaagcgacggggucuuuuacacaggaagaaagcaggaugccugguucgugguugaccccgagaguggcgaaacccagaugacucuaacaaccgagggcccuuccacgccaaggcucuauaucgggcggacucaauacaccgugacaaugcaugauccgcgcgcucccgcacugagauggaauacuaccuauaggcgguacucugccccuccaauggacggaagccccgguaaauauaugucccaccuugcuucauguggcauggggcuguugcucacagucgauccuggaaguggcaccgugcuguggacgcaggacuuagguguaccaguuauggggguguacacuuggcaucaggauggacugcgccagcucccccaccuuacacuggcccgagacaccuugcacuuucuagcgcugagauggggccauauuaggcucccggcaagcggcccucgggacacugccacacuguucucuacccuugauacgcaacuguugaugacccucuacgucgggaaggacgagacaggauuuuauguguccaaggcucuggugcacacuggugucgccuuaguuccccguggccugacccuagcaccagcugaugggccuacaacugacgaagugacccuccagguaucaggagagcgcgaaggcagccccaguacagccgugagauacccaucugguuccgucgcgcugcccagccaguggcuuuugaucgggcaucacgagcugccuccagugcuccacaccacuaugcugaggguucauccgacgcuuggcucgggaacagccgagacccggcccccugaaaacacucaagcaccagcuuucuuucuggaguugcucucucugucccgagaaaaauuaugggauucagagcugcaccccgaagagaagaccccugacaguuaucuaggccucgggccacaggaucugcuugccgcuagcuugacagccgugcugcucggagguuggauucuguucgucaugcgccagcagcaaccccaggugguagagaaacagcaggaaaccccguuagccccugccgacuuugcucauaucucccaagaugcgcagucucugcacagcggcgcaucaagaaggagucagaagcggcuucaguccccaagcaaacaagcccagcccuuggacgauccugaggcugaacagcucacuguuguggggaagauaucuuucaaucccaaggacguccugggacgcggcgccggugggacauuuguguucagaggccaguucgagggaagggcagucgccgugaaacgucuacugcgggaaugcuuuggccucguucgaagagaggugcaacugcuucaggagucagacaggcauccaaacguauugcgcuacuucuguacggaacgggggccucaguuucacuauaucgcucuggaguuaugcagagccagucuccaagaauacgucgagaaucccgaucuggacaggggaggucuugaaccagaggugguucugcagcaguugaugagcggccucgcacaucugcacucccuacacauugugcaucgcgaucugaagccggggaacauccucauuaccggaccugacucucagggccugggucgagucgugcuuucggauuucggguuguguaaaaagcugcccgcgggccggugcagcuuuuccuuacacucaggaaucccaggcacugagggguggauggcucccgaacuccugcaacuucugccuccagacagucccacaucugccguagauauauucagcgcaggauguguguuuuauuacguucuauccggcgguucacacccuuucggggacagccucuaccgucaggccaauauucugaccggagcuccgugcuuggcccaucuggaggaagagguccacgauaaagugguggcaagagacuuagucggcgcuaugcucucuccacugccccagccuaggccauccgcaccccagguucuugcgcauccguuuuucuggagucgcgccaagcaacugcaguuuuuccaggaugugagcgacugguuggagaaagaaucugagcaggaaccucucgugcgggcucuggaggccgguggcugugcaguagucagagauaacuggcacgaacauaucuccaugccccuacaaacagaccugaggaaguuucgaucauauaaggggaccagugugcgcgaccuucuccgggcuguuagaaauaaaaagcaccacuacagggagcugccaguggagguccgucaggccuugggacaggugccugauggcuucguucaauauuucacuaaccgcuuuccccggcuguuacuccauacgcacagagcaaugaggagcugcgcgucggaaucccuguuccuuccauacuauccucccgacucugaggcccgacggccauguccgggggcuaccggacgcuga

SEQ ID NO: 55887 - RNA, 1404 nt, Artificial Sequence
  derived and/or modified sequence opt3 from ERO1LB__Homo_sapiens__NP_063944
augagccagggcgugagaagggccggggcuggacaaggugucgcagccgcgguucagcugcucgugacccuuuccuuccugcggucuguaguggaggcucaggucacaggcguguuggacgauugcuuaugugacaucgauucaauugacaacuuuaauacuuacaagauauuccccaaaaucaagaaacugcaggaacgcgauuauuuucgauacuauaagguuaaccuaaaacguccuugcccauucugggccgaggacgggcacuguaguauuaaggauugccauguggaaccgugucccgagagcaagaucccugucggaauuaaagcaggccacuccaauaaguaccucaaaauggccaacaauacgaaggaacuggaggacugcgagcaagcuaacaaacuuggugcaaucaauucuacccugucgaaccagucaaaggaagccuuuauagauugggcuagauaugacgauagcagggaccauuucugugaguuggaugacgaacggaguccagccgcgcaguacguggaccuccugcugaaucccgagcgcuauacaggguacaagggaacuuccgcauggagaguauggaacucuaucuacgaggaaaauugcuuuaaaccuaggagcguuuaucggccacucaaccccuuagccccuucccgcggcgaggaugacggcgaaucauucuacaccuggcuggaggggcuuuguuuggaaaagcgaguguuuuauaaacugauuaguggacuacacgcuagcaucaaucuccaucugugcgccaacuaccuucuggaggagacaugggguaagccaucuuggggcccgaauauuaaagaguucaagcacagauuugaucccgucgagaccaaaggggaaggaccuaggcgguugaagaaccucuauuuccuguacuuaaucgagcugcgugcacucuccaagguggcuccauauuuugaacgcucaauaguggaccuuuacacuggcaacgccgaggaggaugcggacacaaaaacccuguugcuaaauauuuuccaggauacuaagagcuuccccaugcacuuugacgagaaaaguauguucgccggugauaagaaaggggcaaagucucugaaggaagaauuuagacuccauuucaaaaacaucuccaggauuauggacugugucggaugcgauaagugccggcuguggggcaaacuucaaacgcagggccuggggaccgcuuugaagauccucuuuagcgagaaagaaauccagaagcugccugaaaauucgccaucuaagggauuccaguuaacacgacaagagauuguugcccugcuaaacgcuuuuggucgccucuccacuucaauaagagaccugcagaauuucaaagugcuuuugcagcacaguagguga

SEQ ID NO: 55888 - RNA, 1407 nt, Artificial Sequence
  derived and/or modified sequence opt3 from ERO1L__Homo_sapiens__NP_055399
augggcagaggguggggauuccuguuuggucuccuuggcgccguguggcuguugagcuccgggcacggagaggaacagcccccugagaccgcugcacaaaggugcuucugucaggucucuggcuacuuagacgauugcacaugugacguugaaacuaucgaucgguuuaacaauuaucgccuguucccacgacuacagaagcuccuggagucagacuacuuucguuauuacaaagugaaccuuaagagaccgugccccuucuggaaugauauuagucagugugguaggcgggacugcgccguaaaaccuugucaaagcgaugaagugccagacgggauaaaguccgcgucuuauaaauacucggaggaggcuaacaaucugaucgaagagugcgaacaggccgagcgcuugggagcagucgaugagucacucagcgaagagacgcagaaggccgugcugcaguggaccaagcaugacgauaguuccgacaacuuuugugaagcugaugacauucaaucucccgaggcagaauauguugaccugcucuuaaauccugagagauacacaggcuacaaaggcccagaugccuggaagaucuggaacgugauuuaugaggaaaauugcuucaaaccccagacuaucaagaggccucugaacccacuugcuagcgggcagggaaccuccgaggaaaauacauuuuacucaugguuggagggucugugugucgaaaaacgggccuucuaucgccuaauaaguggccuccacgcgagcaucaacgugcaucugucugcacgauaccuucugcaggagaccugguuggagaagaagugggggcacaauauuacugaauuucaacagagauucgacggaauccucacagagggcgaagguccgaggcggcugaaaaacuuauauuuucuguaccucauugagcuucgugcccuguccaagguauugcccuucuucgaacgcccugauuuucagcuauucaccgggaauaaaauccaagacgaggagaacaagaugcugcuccuggaaauacuucaugagauuaaaucauuuccacugcacuucgaugaaaacagcuuuuucgcuggagacaagaaagaggcccacaaguugaaggaggauuuuagacuccauuucaggaauaucagucggauuauggacugcguuggcugcuuuaaaugucgacuguggggcaaguuacagacgcaggggcugggaacugcacuaaaaauccucuucucugaaaagcugaucgcuaacaugcccgaguccgguccuagcuaugaauuucaccuuacccgccaggagauugugucguuguucaaugccuuuggcagaauaucuacauccgucaaagaacuggagaacuucaggaaucuccugcaaaacauccauuga

SEQ ID NO: 55889 - RNA, 162 nt, Artificial Sequence
  derived and/or modified sequence opt3 from ERP29__Homo_sapiens__NP_001029197
auggccgcugcagugcccagagccgcguuccugagcccucuccuuccacuguuguuaggcuuucugcuacucuccgcuccgcacgggggaucuggucugcauaccaagggcgcccuuccccuggacacagucacuuucuacaaaaucaugguuacgucauga

SEQ ID NO: 55890 - RNA, 1221 nt, Artificial Sequence
  derived and/or modified sequence opt3 from ERP44__Homo_sapiens__NP_055866
augcaccccgccguguuccugagccucccugaccuuagaugcucccuguuguuacuggucaccuggguuuuuacaccagugacuacggagaucaccucucuagauacagaaaacauugacgagauacucaauaacgcugauguagcacuggugaauuucuacgccgacugguguagguuuucacagaugcuucauccgaucuucgaagaggcgagugaugucauuaaggaagaguuucccaacgagaaucaagugguuuucgcucggguggacugcgaucagcacagcgacaucgcccagcgcuaucgaauuuccaaauacccuacucugaaguuguuucguaacggcaugaugaugaaaagagaauauagggggcagcggucugucaaggcacucgccgauuacauccgccaacagaaaucggacccaauacaggagaucagagaucuggcugaaauuaccacacuggacaggucaaagcggaauaucauuggauauuucgagcagaaggauagcgacaacuaccgcguguuugagcgaguagcaaauauccuccaugacgauugugccuucuuaagugcuuuuggugacguuuccaaacccgaaagauauucuggcgauaacauaauuuacaagccuccagggcacagcgcccccgacaugguguaccugggagcgaugaccaauuucgaugucacuuauaacuggauccaagacaaaugcgugccucuugugagggagauuacauuugaaaauggcgaggaauugaccgaggagggucugccauuccuaauccucuuccauaugaaggaagauacggagucccuggaaaucuuucagaacgaggucgcacggcagcuuauuucagaaaaagggacuauaaauuuccugcacgccgacugugauaaguuucgucacccguugcuccauauccagaagacccccgcugacugcccuguuauugccaucgauaguuuccgccacauguacguguuuggagacuucaaagacguacugauaccaggcaaguuaaaacaauuuguguucgaucugcauagcggcaagcuccacagagaguuucaccaugggcccgacccuacagauacugcaccaggagagcaggcucaggacgucgccucuucacccccggaauccagcuuccaaaaacuugcgccuagugaguauagguacacccuguugcgggaucgagacgaacuauga

SEQ ID NO: 55891 - RNA, 1815 nt, Artificial Sequence
  derived and/or modified sequence opt3 from ERV3-1__Homo_sapiens__NP_001007254
augcugggcaugaacaugcuccuuaucacccuguucuuguuacugccccuaagcaugcucaagggggagccuugggaaggaugccugcacuguacacauacuacgugguccgguaauauuaugaccaaaacacuucuguaccacacuuauuacgagugcgccggcaccuguuuggggacaugcacccauaaccagacuacauauucugugugugacccaggaagaggccaaccguacgucugcuaugaucccaagucaaguccugguaccugguuugaaauacacguugggagcaaagagggagaccuccugaaucagacgaagguguucccauccggcaaagauguagugucucuguacuuugacgucugucagaucgugucgaugggcucacucuuccccguuauuuuuagcaguauggaauauuacuccucuugccauaagaacagguacgcucacccugcauguagcacugauuccccagugaccacaugcugggacuguacuaccuggucaacaaaucagcaaaguuuagggcccaucaugcugaccaagauuccucuugagccagauugcaaaacgagcacuugcaacucugucaauuugacaauccuggagccggaccagcccauauggaccacuggacuaaaggccccucucggugcgcggguguccggcgaagagaucgggccaggagcuuauguauaccuguauauuaucaaaaagacacgcacccgaucaacgcagcaguuccguguuuuugagagcuucuacgaacacgugaaccaaaaacuucccgagccuccaccccuggccaguaauuuguuugcacagcucgccgaaaacauugcuucuucccugcaugucgcaagcuguuaugugugcggcgguaugaauaugggggaucaguggccgugggaggccagagaauuaaugccucaggacaacuucacccugacagcuucgucucucgagcccgccccauccucacaaaguaucugguuucuuaagacuagcauaauuggaaaguucuguaucgcgagguggggcaaagcauuuaccgauccugugggcgaacugacaugcuuggggcagcaguacuauaaugagacucuaggaaagacccuguggcgggguaaauccaacaauucugagagcccccacccaucacccuucagucgcuucccuucccucaaccauagcugguaccaacuggaagccccaaacacauggcaggcuccgucuggccuuuacuggauuugugggccccaggccuauagacagcugccugcaaaguggucaggagcuugcgucuugggcaccaucaggccaaguuucuuucucaugccccugaaacaaggugaggccuuaggguacccuaucuaugacgaaacuaagcggaaaagcaagcgcggcauuacgauaggagauuggaaggacaaugaguggccacccgaacgaaucauucaguacuauggcccggcgacaugggccgaggacgggauguggggauacagaaccccuguuuauaugcugaacaggaucauacggcuacaggcagugcucgagauuaucacuaaugaaaccgcuggugcccugaaccuuuuggcucagcaagccacaaaaaugcguaauguaaucuaccagaaccgccuggcacucgauuaccugcuugcccaggaggaaggcgugugugggaaguuuaaucugaccaacugcuguuuggagcucgacgaugaaggaaaagucauuaaggagaucacugcuaaaauucagaagcuggcgcacauaccagugcaaacauggaagggcuga

SEQ ID NO: 55892 - RNA, 1617 nt, Artificial Sequence
  derived and/or modified sequence opt3 from ERVW-1__Homo_sapiens__NP_055405
auggcccugcccuaccacaucuuccucuuuaccgugcuucugccuagcuucacauugacugcuccaccgcccugcagauguaugacguccucuucaccuuaucaggaguuuuuauggaggaugcaacggccaggcaacauugacgcacccaguuaccgcagccuguccaaggggaccccuacauucacugcccauacccacaugccacgaaauugcuaucauucugcgacacuauguaugcacgcuaacacccauuacuggacuggaaaaaugauaaaucccucgugcccugguggccucggggucacaguuuguuggaccuauuuuacgcagacuggaaugucagauggcgguggggugcaggaccaggcccgugaaaagcacguaaaagaggugaucagccaacugaccagaguccacggaacaaguuccccauacaagggccuugaucugucuaaauugcaugaaacucucaggacccacacacggcuggugagccuguucaacaccacgcucacuggcuuacaugagguuuccgcacagaauccgacaaacugcuggauuugucugccccuuaauuuucgcccuuaugugucaaucccaguccccgaacaguggaacaauuucaguaccgagauuaacacuacaagcguguugguagggccucugguuucuaaucuagagaucacccacacguccaacuugaccugcgugaaguuuucaaauacaacuuacaccacaaacagccaguguauaagaugggucacuccacccacccaaaucgugugccugccgaguggaauuuucuuugugugugguacaucugccuacaggugccuuaauggcuccagcgaaucgaugugcuuccugucuuuucucgucccucccaugaccaucuauacugagcaggaccucuacuccuauguuauuucaaagccacggaacaaacgcgugccuauccugcccuucguaauaggggcuggaguguuaggcgcacuggguacggggauuggaggcaucacaaccaguacucaguucuacuauaagcucagccaggaacuuaacggcgauauggagcgagucgccgacucccuggugaccuugcaagaucagcuaaauucucuggcugccguugugcuccagaacagaagggcgcuggaccuucugacagcagagcgugggggaaccuguuuguuucucggugaagagugcuguuacuaugucaaucaaagcggcauugugacugaaaaaguaaaggagauccgggaucgcauccagagaagggccgaggaacugcggaacacagggccauggggauuacugucacaguggaugcccuggauucuaccuuuccucggcccacuggcugccauaauccuuuugcugcucuuugguccgugcauuuucaaucugcuuguuaacuuugugaguucccgaaucgaggcagucaaacugcagauggaacccaagaugcaaagcaagacgaaaauauaccgcagaccuuuggacaggccagcuucuccccggucagaugugaaugacauuaaggggaccccuccagaggaaaucagugccgcgcagccccuccugcgcccgaacagcgccggcuccucuuga

SEQ ID NO: 55893 - RNA, 1173 nt, Artificial Sequence
  derived and/or modified sequence opt3 from ESAM__Homo_sapiens__NP_620411
augaucagccugcccggcccucucgugaccaaccuucugagauucuuguuuuuagggcuguccgcccuagcuccaccgucuagggcacagcuccaacugcaccuucccgccaaucggcugcaggcggucgagggaggugaaguuguguugccugcuugguacacacuccauggcgagguaucaaguagccagccaugggaagugcccuucgucaugugguuuuucaagcagaaagagaaggaagaccaagugcuguccuauauuaacgggguuacuacgucuaaaccuggagugucgcuggucuacucaaugccaagccgcaaucucaguuuacgacuggagggccuucaggagaaggauuccggucccuauucuugcagcgugaacguacaggacaaacaggggaagucccguggacacucaauaaagaccuuggaacugaauguucuagugccuccagccccgcccaguuguagacuccaaggcgucccucaugugggcgcaaacgugacacugagcugccagucuccaagguccaaacccgccguccaguaccagugggaucggcaacuuccuucauuucagacuuucuuugcuccagcacuggacguuauccgcgggagcuugagucucaccaaucugucuuccagcauggccggaguguauguauguaaggcucacaacgagguggguacagcccagugcaaugucaccuuagaagugucgacuggccccggggcggcaguuguggccggagcugucgugggcacacugguaggucucgggcuucuggccggauugguucuacuguaccauagaaggggcaaagcacucgaggagccggcuaacgauauuaaggaagacgccaucgcgccucggacccugcccuggccaaaaucuuccgauacgauuucaaagaauggcacucuuaguagcgugaccuccgcccgcgcacugcgaccuccccacgggccacccagaccuggagcuuugacaccaacuccgucucucagcucacaagcccugcccaguccuagguuaccaaccacagacggugcucacccccagccuaucuccccaauacccggcggggucucuagcucaggacugagucggaugggcgccgugccggucauggugccugcacagagccaggccgguucccuaguuuga

SEQ ID NO: 55894 - RNA, 2523 nt, Artificial Sequence
  derived and/or modified sequence opt3 from ESCO1__Homo_sapiens__NP_443143
augaugagcauccaggagaaguccaaagaaaacucuucaaaggugaccaaaaagagugacgauaaaaauagcgagacagaaauucaagacucccagaagaaccuggccaagaaaucuggccccaaggagacuauaaaaucgcaggcuaagucaagcagugaauccaaaaucaaucagccugagcucgagacgagaaugucuaccaggagcuccaaggcagccucaaacgauaaggcgacaaaaaguauuaauaagaacacugucaccguucggggguacagccaagaaucuacuaaaaagaaacuuucccagaagaaacuggugcacgagaauccaaaggcuaacgaacaguugaaucgccgaucacagcguuuacaacagcugaccgagguaagcagaaggagucuacggucucgcgagauccagggacaggugcaagccgucaagcagucccucccgcccacuaaaaaggaacagugcagcucgacacaaucuaaauccaacaagaccucacagaaacaugugaagagaaagguucuggaggugaaaagugacagcaaggaagaugagaaucuugucauuaacgaagugaucaauuccccuaaagguaagaaaaggaagguagagcaccagacggcaugugccugcucuagccaguguacucaaggcucagagaagugcccacagaaaaccacacggcgcgacgaaacuaagcccguuccugugaccagugaggucaaacgauccaagauggcuacaagcguggugcccaaaaagaacgaaaugaagaaaucuguccauacccagguuaauacgaacacuacacugcccaagucaccucagccaagugugccggagcaaagcgauaacgaauuggagcaggcagggaaauccaagagaggaucuauacuccagcugugugaggaaaucgccggcgagauugaaucggacaauguagaggugaaaaaggaaagcucccagauggagucagucaaagaggaaaagcccaccgagaucaagcuggaagagacaaguguggagaggcaaauucuccaccagaaagaaacaaaccaggauguucagugcaaucgguucuuuccuucucguaagaccaaaccagugaaguguaucuuaaacgguauaaauagcuccgcuaaaaagaacucaaauuggacgaagauuaaacugagcaaguucaacucuguccaacauaauaaacuugacucccaggugagucccaaguuggggcugcuacgcaccagcuuuucuccuccagcccucgagaugcaccaccccguaacacaguccacuuuccugggaaccaaacuucaugauagaaacaucacaugccaacaggaaaagaugaaggagauuaauucagaagagguuaaaaucaacgacaucacuguggagauuaauaagaccacagaaagggcgccggagaacugucaccuggcaaaugaaauaaaaccuagugaucccccauuggacaaccagaugaagcauagcuuugacucggccuccaacaaaaauuucucucagugccucgagagcaagcuggaaaacucaccugucgagaaugugaccgcugccaguacuuuacugucccaagcaaagaucgauacgggcgagaacaaauuucccggcucugcuccacagcagcacagcauucucuccaaucagacaucaaagagcagugacaaccgggaaaccccacgaaaucacucucuuccuaaauguaacucccaucuggagaucacuauaccaaaggauuugaaacuaaaggaagccgagaaaaccgacgaaaagcaacugauuaucgaugcggggcagaagcgcuucggagccgucagcugcaaugugugcgguaugcucuauacagcaucgaacccggaggacgagacccagcaccuccuuuuucauaaucaguucaucucagcuguuaaauacgugggcuggaagaaagaaaggauucuggccgaguaucccgaugggagaaucauuaugguauugccugaagacccaaaguacgcucucaaaaaggucgaugagauacgggagaugguggacaacgaucugggauuucaacaggcccccuuaauguguuauucucgcacuaagacacugcuauucaucaguaaugacaaaaagguugugggcugccucauugcagaacacauccagugggguuacagagucaucgaggaaaaacugccugugauuagguccgaggaagagaagguacguuuugagcggcaaaaagccugguguugcagcacgcuuccagaacccgcuauaugugggaucucucgaauuuggguguucagcaugaugagaaggaagaagaucgcgucccgcaugauugagugcuugcggucaaacuucaucuauggaaguuaccugagcaaagaagagauagcauuuucugacccgaccccugauggcaagcuguucgccacucaguacuguggcacagggcaguuucugguuuauaauuucaucaacggacagaacuccaccuga

SEQ ID NO: 55895 - RNA, 1806 nt, Artificial Sequence
  derived and/or modified sequence opt3 from ESCO2__Homo_sapiens__XP_011542723
auggccgcucugacccccagaaagaggaaacaggacagccucaagugcgauucccuucugcacuucacagagaacuuguuuccuucuccaaauaaaaagcauuguuucuaccaaaacucagacaaaaaugaagagaacuuacacugcagucagcaggaacauuuugugcugagcgcacuaaagacuacggagaucaaucggcucccguccgccaaccagggcucucccuucaagucggcgcugucaaccgucagcuuuuauaaucaaaacaaaugguaccuuaauccucuggaacgcaaguugauuaaagagagucgauccacaugucucaagacuaacgaugaggacaaaucuuucccaauaguuaccgaaaagaugcaggggaagcccgugugcagcaaaaagaauaacaaaaagccucagaaaucccugacagcuaaguaucagccaaaauaccgucacaucaagcccguaucaagaaauaguaggaacagcaagcaaaaucgggugauuuauaaaccuaucgucgagaaggaaaacaacugucauucugccgagaauaacuccaaugcaccacgcgugcugucacagaaaauuaagccgcagguuacccuccagggaggugccgcauuuuucgugaggaaaaagagcaguuuaagaaagucuucccuggagaacgaacccagccuuggccggacucaaaaaucgaagucugaggucaucgaagauuccgacguggagacaguaucagagaaaaagaccuuugcuacgcgccagguuccuaaaugcuuggugcuggaagagaagcuaaagauagggcuccugagugccagcuccaaaaauaaggaaaaacuuaucaaggauucuagcgacgaucgagucucaaguaaagagcacaagguggacaagaacgaggcuuucuccagcgaagauucucugggagaaaauaaaacuauuucaccaaagaguaccguguaccccaucuuuagcgccuccucugucaacucgaaaaggagcuugggcgaggagcaguucuccguugguucagugaauuuuaugaagcaaacaaacauucagaaaaauacuaacaccagagacacaaguaagaaaaccaaggaucagcucaucauagacgcggggcagaagcacuucggagcaacgguauguaaaucuugcggcaugauuuauacugccagcaauccugaagacgagaugcaacaugugcagcaccaucaccgguuccuggaaggcaucaaguacgucggguggaaaaaggagcgugugguugcugaauuuugggauggaaaaauuguguuaguccugccacacgaccccuccuucgccaucaagaagguggaggauguacaggagcucguugacaacgaacuugguuuucagcaaguggucccgaaauguccuaauaagaucaaaacauuccuguuuauuucagaugagaagcgcguggucggcugcuugauagcagaacccaucaaacaggcuuucagagugcuaagcgagccaauugggccugagucucccuccaguaccgaauguccaagggccuggcagugcagcgacguucccgagccugcggugugcggaaucucucggauauggguauuucgacugaagcgcagaaagaggauugcccggcgccucgucgauacucugagaaacuguuucauguuuggcugcuuccuuuccacagacgaaaucgcauuuucagauccaaccccggacgguaaacuguucgcuacgaaguacuguaacacccccaacuuuuugguguauaauuucaauaguuga

SEQ ID NO: 55896 - RNA, 849 nt, Artificial Sequence
  derived and/or modified sequence opt3 from ESD__Homo_sapiens__XP_011533256
auggcccugaagcagaucagcuccaacaaaugcuucggcgggcuccaaaagguguuugagcacgacucugucgaacuuaauuguaaaaugaaguucgcuguuuaccugcccccuaaagcagagaccggaaagugcccagccuuguauugguuaucaggucugacauguacugaacagaacuuuauuaguaagagcggcuaccaucaguccgcgucugagcacgggcuagugguaauagcuccggauacgucgcccagaggaugcaauaucaaaggcgaagacgagucaugggauuucgguaccggggccggauuuuauguggacgcaacagaggauccuuggaagacuaacuacaggauguauagcuacgucaccgaagaacucccacagcugauuaaugccaacuuccccguggacccucaacggaugaguaucuuuggccauuccaugggcgggcacggagcucuuauuugugcacugaaaaauccagguaaguauaaaucuguuagcgccuucgcucccaucugcaacccuguguuguguccauggggcaagaaggccuuuuccggguaccucggaacagaucagucaaaauggaaggcguacgacgcaacccaucuggucaaaaguuauccgggcagccagcuggauauacucaucgaccaggguaaggaugaccaauucuuacuggaugggcagcuuuugcccgacaauuuuauugccgcuugcacugagaaaaagaucccugugguauuccgccugcaggagggauacgaccacucuuauuacuuuauugccacauucaucaccgaucacauacgacaucacgcaaaauaucuaaacgcuuga

SEQ ID NO: 55897 - RNA, 2556 nt, Artificial Sequence
  derived and/or modified sequence opt3 from ESF1__Homo_sapiens__NP_001263309
augagcuccaagcaggagaucaugucugaccaaagauucaggcggguggccaaagauccccgcuuuugggaaaugccugagaaggaccgaaaagucaagauugauaaacguuucagagcuauguuucacgacaagaaguucaaacugaacuacgcaguugauaagaggggccggccaauaucacauaguaccacagaagaccucaaacgcuuuuaugaucuuagcgacuccgauucuaaucugucgggggaggacucaaaggccuugagccagaaaaagaucaagaaaaagaaaacucagacgaagaaagaaauugauaguaagaacuuaguggagaaaaagaaggagaccaaaaaggcgaaucacaaaggauccgaaaacaagacagaccuggauaauucuaucgguauuaaaaagaugaagacuagcugcaaauucaagaucgacuccaacauaucaccgaaaaaggacaguaaagaguuuacccagaagaauaagaaagaaaagaaaaacaucguacaacauacaaccgauagcucucuagaggagaagcagagaacucucgacuccggcacaucagaaauugugaaaagccccaggaucgaguguaguaagacccggcgcgaaaugcagucugucgugcagcugauuaugacgcgagauuccgacggguacgagaauagcacugauggagaaaugugcgacaaggaugcucuugaggaggacucggaaucuguuuccgagaucggcucagaugaagagagugaaaacgagauaaccagcguggguagagccuccggggacgaugacggaucugaggacgaugaagaggaagacgaggaugaagaggaggacgaagaugaggacagcgaagaugacgauaaaucagacaguggcccugaucuggcaaggggcaaggggaauauugagacauccagcgaggacgaagaugacacugccgacuuguucccagaggaaucuggauuugagcacgcuuggcgggaacucgauaaagacgcaccccgugccgaugagaucacccgcagacuggcugucuguaacauggacugggauaggcugaaggccaaagaccucuuagcgcuguucaauucauuuaagccuaaagguggcgugauuuucaguguaaagaucuauccaagcgaguuugggaaggaacggaugaaagaggaacaaguucagggacccguggagcuuuuguccaucccugaagaugcaccagagaaggacuggacaucucgagagaaacugcgcgauuaccaguucaagagacuaaaauauuacuaugccgucguggacugcgauucgccggaaaccgcuagcaagauuuacgaggacugugauggccucgaguucgaauccucaugcaguuuuauagaccugagguucauccccgacgauauuacguuugacgaugaaccuaaggacguggccucugaggucaaccuuacugcauacaaaccaaaguauuucacaagcgcugccauggguaccuccacuguugagaucacaugggaugaaaccgaccaugagcggauaacgaugcugaaucgcaaauuuaagaaagaagaguugcucgauauggacuuccaggcguaccuggccucaagcucugaggaugaagaggaaauugaggaagaguuacaaggggacgauggagugaacguagaggaagacggcaagaccaagaaaucccagaaggacgaugaggaacagaucgcaaaauauagacaacugcuccaggugauccaggagaaggagaaaaagggcaaggaaaacgacauggagauggaaauuaaauggguccccgggcuuaaggagagugcugaagagauggugaaaaauaagcuggaaggaaaagauaaguugacaccuugggagcaguuucuagagaaaaagaaggagaaaaagaggcugaaacguaagcaaaaagcccucgcugaagaagccagcgaggaggaacugccaucugacguugaucuuaacgaccccuacuucgcagaggaagugaagcagaucgguauuaauaagaaauccgucaagucagccaaagauggcaccaguccggaggaagagauagagaucgaacggcagaaggcugagauggcgcuguugaugauggacgaagaugaggacagcaaaaagcacuuuaacuauaauaagauuguggaacaccagaaccucucgaaaaagaaaaagaaacaacugaugaagaagaaagaguuaaucgaggaugacuucgaaguaaauguuaacgaugcacgauuucaggccauguacacuucccaucuguucaaucuagacccuucugaccccaacuuuaagaaaacaaaggcuauggagaaaauccucgaagagaaggccagacagagggaacgcaaggagcaggagcugacucaagcaauuaaaaagaaagaaagcgagauagaaaaggagucacagcggaaaaguaucgauccagcccuuuccauguugauuaagucuaucaaaaccaagacagagcaguuccaggcuagaaagaaacaaaaggugaaauga

SEQ ID NO: 55898 - RNA, 405 nt, Artificial Sequence
  derived and/or modified sequence opt3 from ESM1__Homo_sapiens__NP_001129076
augaaaagcgugcugcuccuuaccacacuguugguccccgcccacuuaguugcugcaugguccaacaauuacgccguggacugcccucagcauugugauucuucagagugcaagaguagcccaagauguaagaggacuguacuggacgauugcggcuguugccgggugugugcggcugggcgcggagaaacgugcuaucgaaccgucuccgguauggacggcaugaaaugugggccgggacuacguugccaacccucuaacggcgaggauccuuucggugaagaguuugggaucuguaaggaacacgacauggccucgggagauggcaauauugugagagaggagguugugaaagaaaacgcagccggcucaccagucaugaggaaguggcucaauccccgguga

SEQ ID NO: 55899 - RNA, 6363 nt, Artificial Sequence
  derived and/or modified sequence opt3 from ESPL1__Homo_sapiens__NP_036423
augaggagcuucaagagagugaacuuuggcacccugcucuccucucagaaagaggccgaagaacuucugcccgcuuugaaggaguucuuaucaaauccuccagccggguuuccgaguagccgguccgacgccgagcgccgacaagcgugcgaugcuauccugcgugccuguaaccagcagcuaacagcaaaacucgccugccccagacaccugggaucucuucuggaauuggcugagcucgcaugugacgguuaccuggucucgacuccucagaggccaccccuguaucucgagcggauuuuauucguucugcuucgcaaugccgcugcccaaggcucaccugaagcgacguugagacuggcacagccacuacaugccugccucgugcaguguagcagggaggcugcaccccaagauuacgaagcaguagcucgggggaguuuuucccugcuuuggaagggagccgaggcgcuguuggagcgccgagccgcauucgcugccagacucaaagcucugagcuuuuuagugcugcucgaagacgagagcaccccuugcgaagucccacacuucgccuccccgacagcauguagggccguggcugcgcaucaacuuuuugaugcaucaggccacggucugaacgaggccgacgcugauuucuuggacgaucuacugagucggcauguuauacgugcccucgugggggaacgcggaucuucuuccggccugcuuucaccccagagagcacugugcuugcucgagcugacuuuagagcacuguaggcgguuuugcuggagccgacaccaugacaaggccaucagugcugucgaaaaggcccacucuuaucugcgcaauaccaaccuagcaccuucccuccagcugugucagcuuggcgugaaauugcugcaaguaggggaggaaggaccacaggcgguugcuaagcuccugauuaaagccagcgcagugcuuucgaagucuauggaggcccccuccccuccacugagagcuuuguacgaaucaugccaguucuuucucaguggucuggagaggggcacaaaacggcgcuauagauuagaugccauccugagccuauucgcauuccucgggggauacugcucccugcuucaacaguugagggacgauggcgucuauggugggucuagcaagcagcagcaaucauuucugcagauguacuuccagggacuccaucuguacaccgugguggucuaugacuuugcucagggcugucaaauuguugacuuagccgaucugacucagcuuguggacaguugcaaguccacaguaguguggauguuggaggcgcucgaaggccugagcgggcaggagcuaaccgaucacaugggaaugacggccucuuacacuucaaaucuggcuuauaguuucuacagccacaaacucuaugcagaagccugugcuaucuccgagccccugugccagcaucuugguuuggucaagccgggcaccuacccugaagugcccccagagaaacugcaccguuguuuucgguuacaaguugagucucucaagaaacuggggaagcaggcccagggaugcaaaauggugauacuuuggcuggcagcguugcagccuuguucgcccgaacauauggccgagccagucacauucugggugcgaguaaagauggacgcugccagagcaggcgauaaggaacuccaacugaaaacucuaagggacagccuguccgguugggaucccgagacccucgcucugcuuuugcgcgaggaacugcaggccuauaaggcaguucgggccgacacagggcaggagagauuuaacaucauuugcgauuuacucgaacugucaccugaggaaaccccagcuggcgcgugggccagggcaacgcaccuuguggagcuggcucaaguccuauguuaccaugacuucacucagcagacaaauugcagugcccucgaugccauccgcgaggcucugcaguugcuggacucugugcgaccggaagcacaagcccgggaccaguuacucgaugacaaagcgcaggcucugcuuuggcuguacauuuguaccuuggaggccaagaugcaggaaggaaucgagcgugauagaagggcacaagcccccggcaaccucgaagaguuugaggucaaugaccugaacuaugaagauaaacuacaggaggaccgcuuccuguacagcaauauagcuuuuaaccuugcagccgaugcggcucaguccaagugccucgaccaggcccuggcauuguggaaggaacuguuaacuaaagggcaagccccugcugugcggugccuccagcagacagccgcaucacugcaaauucuugcugcccuguaucaguugguugcgaagccaaugcaggcccucgaggugcugcuacugcuuagaaucguaagcgaaaggcucaaagaucacucuaaggcagcuggauccaguugucacauuacccagcuguuguuaacgcuggguugccccagcuacgcccaacuccaucuggaggaggcugcaucuucccuuaaacaccuggaccagaccacagauacuuauuugcuacugucacucaccugugaccugcuucgaagucaguuauacuggacacaucagaaggucacuaagggcgugagccugcucuugucgguucugcgcgauccugcccuccaaaaauccucuaaggccugguaucugcuucgggugcagguccugcaguugguggcugcguaccuaagccugccaucaaauaaccucagucacuccuuaugggaacagcugugcgcacaaggguggcagacccccgagaucgcccuuaucgacucucacaaacugcucagaagcauuauauugcugcucaugggauccgacauccugucaacacagaaggcugccguagaaaccagcuuccuugauuacggcgagaaccuagugcagaaauggcaaguucugagugaggucuugucuuguuccgaaaaguuagugugccaucuggguaggcucgggagcgugucggaggcaaaggccuuuugucuggaagcucuuaaacugacuacgaagcuccagauuccgcgucagugcgcguuguuccugguccuaaaaggcgagcuggaacucgcccgcaaugacaucgaucuuugucaaucagaccugcagcagguuuuauucuugcuggagucuugcacagaguuuggaggcgugacccagcaccucgauagugugaagaaaguacaucugcaaaaggggaaacagcaggcacaggucccuuguccaccccaacuuccugaagaggaacuguuccuccggggacccgcuuuggagcugguggccacuguugcaaaggaaccagguccuauagcccccuccaccaacagcucuccaguguuaaagacaaaaccgcagccuauucccaauuuucuaagccacuccccaaccugcgacugcucacugugugcuagucccguccucacugccgugugccuuagauggguucuggugacagcgggcguaagguuggcaauggggcaucaggcccagggacuggaucuccugcaagucgugcuuaagggcuguccugaggcugccgagcgacucacgcaggcucugcaggccagcuugaaccacaaaaccccacccucucuggugccuuccuuacuagacgaaauccuggcccaggcuuauacucuccuugcccuggaggguuugaaucagccgucaaacgaaagucugcagaagguccuccagagcgggcugaaauucguugcagcgcggaucccacaccuugagcccuggcgcgccuccuuacugcucauuugggcuuugacaaagcugggcggacuaucuugcuguaccacacaacuguuugccucgagcuggggcuggcagccuccacucaucaagucagugcccggguccgaaccuaguaaaacucagggacagaagagaucuggcaggggucggcaaaaacuugcaagcgcuccgcugcgauugaauaacaccucccagaaggggcuggagggaagaggccuccccugcacgccaaaaccucccgaucgcauuaggcaggccgguccacauguaccuuucaccguguuugaggaagucugucccacagagucaaagccagaagugccgcaggcaccucguguucaacagcgggugcagacuagacugaaggucaauuucucugacgauagcgacuuagaggaucccgugagugccgaggcuuggcuugcggaggaaccaaaaaggcgcggcaccgccucccgagggagaggacgggcaaggaagggccugagccucaaaacagacgcuguuguggcccccgggucugccccuggaaacccaggccuaaauggucgcucacguagagcaaagaaagucgcuucccggcacugcgaagagaggcgcccccagcgagccagugaccaagcgagaccugggccggaaauaaugcggacuaucccagaggaggaacugaccgauaacuggaggaagaugagcuuugagauuuugcgcggaucggacggcgaagauucugcuuccgguggcaagacgcccgccccugggcccgaggcagccagcggagaaugggagcugcucagacuugacucaaguaaaaagaaacugccaucuccuugucccgauaaggaguccgacaaagauuugggcccaaggcugcggcucccuagcgcuccgguagcaacaggguuaucaacccuggacaguaucugcgauagccuuuccguggccuuccguggaaucucucauugucccccaagcggccuguacgcgcaccuaugccgcuuucucgcucugugcuugggucaucgagacccuuaugccacugcauuccugguuacagaauccgugucaauuaccuguagacaccagcuccuuacucaucugcacaggcaguuaucuaaggcccaaaaacaccgggggagucuggagauagcugaucaguugcagggacucucgcugcaggaaaugcccggcgacgucccacuagcccgcauccaaagacuuuuuagcuucagggcacuggaguccggucauuucccucagcccgaaaaggagucuuuucaggagcggcucgcucugauuccgucaggcgugaccguaugcguguuggcccuggcgacacuccagccagggacggucggaaauacccuucuguuaacucgacuggaaaaggacagcccucccguuuccgugcaaaucccaacaggccagaacaaauugcaccucagaagugugcugaaugaguucgaugccauucagaaggcacagaaagaaaacucuagcuguaccgacaagcgcgagugguggacagggaggcuagcucuugaucaccggauggagguccugaucgccucacucgaaaaauccgugcugggaugcuggaagggcuuguuacugcccaguagcgaggaaccugguccggcacaagaggcuucucgucuccaggaacuucugcaggacuguggguggaaguaccccgauagaacucuacugaaaauaaugcucuccggagccggcgccuugaccccacaagacauccaggcgcuggcuuauggccuuugcccuacgcagcccgagagggcacaggagcugcucaacgaagccguugggcgcuuacaaggacugacaguaccuucaaauagccauuuggugcugguccucgauaaggaccuucagaaacugccaugggagucgaugcccucucuacaggcucugccugugacccggcucccaaguuuucgauucuugcuguccuacagcauuaucaaggaauauggugccucacccguucuuucccagggcguggauccgagaucuacuuuuuacguccugaacccucacaauaacuuaagcaguaccgaggaacaauucagggcaaauuuuuccagcgaggccggguggcgcggagugguaggcgaggucccacggcccgaacaggugcaggaggcucucacaaaacaugaccuguacauuuaugcgggucacggggccggagcaagauucuuggauggccaggcuguucugcgucucucuuguagggccguggcacuucuguuuggcugcucaagugccgcucuagccguccgggggaaccuggaaggagcggguaucgugcucaaguacauaauggcaggcuguccuuuguuccuggggaauuuaugggacguuacugaucgcgacauugaccgauauaccgaggcccuucugcaaggauggcucggcgcugguccaggggcaccccuguuguacuaugugaaccaggcaagacaggcuccgaggcugaaguaccucaucggagccgcuccuauugccuauggccuucccgucucccugcgguga

SEQ ID NO: 55900 - RNA, 2475 nt, Artificial Sequence
  derived and/or modified sequence opt3 from ESPN__Homo_sapiens__XP_011540537
auggcccuggagcaggcucuccaagcagccagacagggcgaacuugacgugcugaggagcuugcacgcggcuggguuacugggacccucccuacgggauccucucgacgcccugccaguccaucacgcagcccgcgcugguaaacuucauugccugcgauucuugguugaggaagcagcccucccggcugccgcgcgugcaagaaacggcgccacccccgcucacgaugccucugcaacagggcaucuggcuugucugcaguggcucuuaucacagggaggcugcagggugcaagacaaagauaauaguggugccacuguacugcaccuugcggcccgguuugggcacccugagguggucaacugguugcugcaucacggaggcggcgacccaacggcagcuaccgauaugggggcccuacccauccauuacgcugccgcaaagggagacuucccuagccuccgccugcuuguggaacacuauccagaggguguuaaugcccagacaaagaacggcgcuacuccccuguacuuggcgugucaggaggggcaccucgaagugacccaguaucugguccaagagugcggagcagauccucaugccagagcucacgacggcaugacaccauuacaugccgcagcccagaugggucacuccccggugauuguauggcugguuucuuguaccgaugugucgcucucagaacaggacaaggauggggcuacugccaugcauuuugcagcgagcaggggacacacaaaaguccuuaguuggcuguugcuacacggcggcgagauauccgcugaccuguggggcggaaccccacuccaugacgccgcagagaauggugaacuggagugcugucagauccuuguggugaacggcgccgaacuggauguccgggaccgcgauggguacacggcugccgacuugucugauuucaauggacacagccauugcacucgauaucucagaaccguugagaaccuguccguggaacacaggguauuaucacgggacccuagugcagagcuggaggcuaagcaaccagauagcggcaugucuucccccaauacaacugugucaguccagccucuaaacuuugaccucagcaguccaaccucuacacuguccaauuacgauagcuguucgucuucccacucaaguauuaagggucagcaucccccgugcgggcuuagcuccgcccgugcggccgacauccaaucuuauauggauauguugaacccugaacugggccucccccgcggaaccauuggcaaaccaacgccucccccacccccucccagcuucccgcccccuccacccccuccagggacucagcugcccccgccuccacccggauacccugcucccaagccaccuguggguccccaggcagccgacaucuacaugcagacaaagaauaaacuuagacacguugagaccgaagcucugaaaaaggaguugucaaguugugacggccaugaugggcucaggcggcaagacuccagccgaaagccacgcgccuuuucuaaacagccgucaacuggagauuauuacagacagcuggggaggugcccuggugaaacauuagcagcgcggcccgggauggcccacagugaggaggcugcccugcuaccaggcaaccaugugcccaauggaugcgcagcugacccuaaggccagccgcgaacucccacccccuccgccacccccuccacccccucugccggaggcagccuccucucccccuccagcucccccacuuccuuuggaaucggcgggccccggguguggacagagaaggagcuccucaaguaccgguucuacgaaauccuucaacaugaugagcccaaccggcgauaacucagagcugcucgccgaaauaaaggcagggaaaagccugaagccgacaccucaaucuaaaggauuaacuaccgucuuuuccggcaucggucagcccgcuuuccagccagacaguccccugccuagcgugucuccagcccuuucccccguacguucaccuacaccgccagccgcuggguuucagcccuugcucaauggcagucugguuccugugcccccaacuaccccugcacccggaguccaacuagauguggaggcccugauuccaacacacgacgagcagggccggccuaucccggaauggaagcgacaggucauggugagaaagaugcagcucaaaaugcaagaggaagaggagcagaggcgcaaggaagaggaagaggaagcgcggcuggcuagcaugcccgccuggagaagggaucuuuugcgcaaaaagcuggaggaggaacgagagcagaaacggaaggaagaggaacgucaaaagcaggaggaguuaagaagggaaaaagagcagucggaaaagcuccgcacccugggguaugacgaguccaaacuugcaccauggcagcggcaaguuauucugaagaaaggagauaucgccaaguacuga

SEQ ID NO: 55901 - RNA, 1794 nt, Artificial Sequence
  derived and/or modified sequence opt3 from ESR1__Homo_sapiens__NP_001278159
augaccaugacacugcacacuaaggccagcggcauggcucuccuucaucagauccaagggaacgagcuggaacccuugaauagaccucaguuaaaaauuccacuggagaggccgcuaggagaaguguaccucgacuccucuaagcccgcagucuauaacuacccugagggugccgcguaugaguucaaugcugccgcagccgcuaacgcacagguuuacggccagacggggcugccauauggacccggcucagaagccgcugccuuugguaguaaugggcuuggaggcuucccuccacugaacagcgugucccccucuccuuugaugcuccugcacccaccgccccaacugucgccuuuucuccagccacauggccagcagguacccuacuauuuagagaaugaaccuucaggguacaccgugcgggaggcgggaccacccgcauucuaccgcccgaacagcgauaaucgacgucaagguggcagagaaaggcuggccaguacaaacgacaaaggguccauggcuauggagucugccaaggagacucgguauugcgcagucuguaaugauuacgcuagcggauaucacuacggcgugugguccugcgaagguuguaaagccuuuuucaagcgcucaauacaggggaacagacauaaugacuauaugugcccugcgaccaaccaguguacaaucgauaagaauaggcggaaaaguugccaggccugucgccuucgaaagugcuacgagguuggaaugaugaaaggcggcauuagaaaggacaggcgugggggacggauguugaaacacaagcgccaaagagaugacggugaaggcaggggagagguggggagcgcaggcgauaugcgggcugccaaccuguggcccucuccacuaaugaucaagcgauccaaaaagaacucacucgcucugagccuuaccgccgaccagauggucagugcacuguuggaugccgaaccucccauucucuauucugaguacgacccaacucgccccuuuuccgaggcuagcaugaugggucuguuaacaaaucuggcggauagagaacucgugcacaugaucaacugggcaaaaaggguaccuggguucguugaccuuacccugcaugaccaggugcacuugcuagagugugccuggcuggaaauacucaugaucggccuggucuggcggucgauggagcauccaggaaaguugcuguuugcuccgaauuugcuccuggaucgcaaccaaggcaaaugcguggaagggaugguggagauuuucgacauguuacuggccacgucuuccagauuuaggaugaugaaucuacagggagaggaguucgucugucucaagucaaucauucugcuuaacagugguguuuacacuuuucuuagcuccacccugaaaucucucgaagaaaaggaucacauccaccgugugcuggacaagauaacagauacucuuauucaucugauggcaaaagccggcuugacccuccagcagcaacaccagcggcuggcucaguuacugcuaauccucagccauauucgacacaugucaaauaaggggauggagcaucuguauaguaugaaaugcaagaacguagugccccuuuacgacuugcugcucgaaaugcuggaugcccacagauuacacgcaccuacauccaggggaggcgcgagcgucgaggagaccgaccagucucaucuggcuacggccgguucaacaaguagccacucccuucaaaaauauuacaucacuggggaagcagagggcuucccagccaccguguga

SEQ ID NO: 55902 - RNA, 1446 nt, Artificial Sequence
  derived and/or modified sequence opt3 from ESR2__Homo_sapiens__NP_001201831
auggacaucaagaacagccccuccucucuuaauucaccuaguagcuacaacugcucccagucuauucucccacuugagcacggcucgauauauaucccgucaagcuacguggauagucaucacgaauaucccgccaugaccuucuacuccccugcugucaugaauuauucuauuccaagcaacguuacaaaucuggaagggggacccgguagacaaacuacguccccuaacguguuguggccaacccccggccauuuaucaccucugguagugcacaggcagcuaagucaucucuacgcagagccacagaaaagcccguggugugaggcccggucucuggaacacacacuucccgucaaucgcgagacucugaagcgaaaaguguccgggaaccguugcgcgucaccuguuaccggaccaggcagcaagagagacgcucacuuuugugccgugugcagugauuaugcaucugguuaccauuacggggucugguccugugagggaugcaaagccuucuuuaagaggagcauccagggccacaaugacuauauuugucccgcuacaaaccaaugcaccaucgauaagaaucggcgcaaaucgugucaggcaugcagauugaggaaguguuacgaagugggcaugguaaaaugcgggucucggcgcgagcgaugcggauauagacucguuaggcggcagcguuccgccgacgaacagcugcauugugcugguaaggccaaacgcucaggcgggcacgcgccuagagugagggagcugcucuuagaugcacugaguccagagcaacuugucuugacucugcuagaagccgagcccccgcacgugcucauaagccggccuuccgcucccuucacagaagccucuaugaugaugagccugaccaagcuggcagacaaggagcuggugcauaugaucucaugggcuaaaaagauuccaggauuugucgaauugagucucuucgaucagguucgacuguuagaguccugcuggauggaggugcugaugaugggccucauguggcgcagcaucgaccacccugguaaacuuauuuuugcccccgaucugguauuggacagagaugaagggaaguguguggagggaauccuagaaauauucgacaugcugcucgcgacgacuucuagguuucgggagcugaaacuucagcauaaggaauaccugugcgucaaagccaugauuuugcucaacucaaguauguauccacuggugaccgcaacacaggacgcugauagcucccgcaaguuagcccaccuucuaaaugcuguuacugacgcccucgugugggucaucgcaaagucuggcauuucgagccaacagcaguccaugagacuggccaaccuuuugaugcugcucucacaugugaggcacgcucguuggggcgagaaacaauucauccaccugaagcugaguuga

SEQ ID NO: 55903 - RNA, 2034 nt, Artificial Sequence
  derived and/or modified sequence opt3 from ESRP1__Homo_sapiens__NP_001030087
augaccgccagccccgacuaccuggugguccucuucggcaucacagcuggggcaacuggagccaaacuugguuccgaugagaaggaacugauuuuguuauuuuggaagguuguggaccuggcgaacaaaaagguaggccagcuacacgaggugcucgucagaccugaucaacuggaacuuacggaggacugcaaagaagagaccaagauagauguggagucucugucaagugcuagccaguuggaccaggcccucaggcaguucaaucaauccguuucuaacgaacugaauaucggggugggaacaucguuuugucugugcacugauggccagcuccauguccggcagauuuuacacccagaggcaucaaagaaaaacgugcugcuuccggaauguuucuauagcuuuuucgacuugcgcaaggaguuuaaaaagugcugucccgguaguccugauaucgacaaacuggauguagccaccaugacagaguaccuaaauuucgaaaaguccucuagcguuucccgauauggggcuucacagguggaggacaugggaaacauuauccucgcaaugauaagugaaccauacaaucaucguuuuagcgaucccgagagagucaacuauaaguucgaaucugggaccugcuccaaaauggagcugaucgacgacaauacuguggugagggcccggggccuuccuuggcaaucaagcgaucaggacauugcucgcuuuuucaagggccugaacaucgccaaaggaggugcggcauugugucucaaugcccagggcagaaggaacggggaggcucugguccgguuuguuagugaggaacaccgcgauuuagcccugcagcgacauaagcaccacaugggaacaagauacauugaaguguauaaagcaaccggcgaggacuuccucaagaucgcuggugggacgucuaaugaaguagcccaauuccuuuccaaagagaaccaggugauagucaggaugcggggacugccauuuacugcgaccgccgaggaagugguugcauucuuuggccagcauugccccauuacaggcgggaaggagggaaucuuguucgugacuuacccugauggucguccaaccggcgacgcuuuuguccuauucgccugugaagaguacgcucaaaaugcccugcgcaagcacaaagaucuccuggggaagagauauauugaacuuuuuaggagcacagcagccgaggugcagcagguacugaaccgguucucgucugcuccguugaucccccucccuaccccacccaucauuccuguucugccacagcaauuugugcccccgacgaacguccgagacugcauacgcuuaagaggacugccuuacgcggcaacuaucgaggauauucuagacuuccucggcgaauuugccacagauaucaggacccauggugugcacaugguccugaaucaccaggggcggcccuccggcgacgcuuucauacagaugaaaucagccgaccgcgcauuuauggccgcucagaagugucauaaaaagaacaugaaggauagauauguggagguuuuccaaugcagugccgaagagaugaauuucgugcuuaugggaggcacuuugaacaggaaugggcugagcccaccucccugccucuccccacccucuuacacauuuccugcaccagcggcuguaauuccgaccgaggccgcaaucuaucagcccagcgucauccugaacccucgugcccuucagccaucaacggcuuacuaucccgccggaacccagcuguucaugaauuacacagcauacuauccuaguccacccgguuccccgaacagcuugggcuacuuuccuacugcugccaaucucucuggggugccaccccaaccuggaaccguugugcggaugcagggccuggcguauaacacaggugucaaagaaauuuuaaauuucuuucagggguaccaguaugccacugaggacggccugauccacaccaacgaucaagcucgaacacuacccaaggaauggguguguauuuga

SEQ ID NO: 55904 - RNA, 2154 nt, Artificial Sequence
  derived and/or modified sequence opt3 from ESRP2__Homo_sapiens__NP_079215
augacacccccuccaccgcccccuccacccccuggcccagaccccgccgcugauccugcagccgacccaugcccguggcccgggagccuggugguccucuucggagcgaccgcuggugcccuuggcagagaucugggguccgacgagacugauuugaucuuacugguuuggcagguaguggaaccuaggucucggcaagugggaacgcuacacaagucacucguccgcgcagaggccgcugcacugaguacccagugucgagaagccagcggccuuuccgcugacucucuggcccgugcggagccauuggauaaagugcuccagcaguuuucgcaacugguuaacggugacguggcacugcucgggggaggccccuacauguuaugcacagauggccagcagcugcuuagacaggucuugcauccugaagccucaaggaagaaucuggugcuaccagacauguucuuuagcuucuaugaucuccggcgcgaguuucacaugcaacaucccaguacuuguccggcuagagaccugaccguagccacaauggcacaggggcuuggacuggagaccgaugcuacugaagacgacuucgguguuugggaggugaaaacaauggucgccgugauuuugcaccuccugaaggaaccuuccucucaguuauuuagcaaacccgaggugauaaagcagaaguacgagaccggcccaugcuccaaagcggaugucguugacucagaaacggugguaagggcccgggggcugccuuggcaaaguagcgaucaggacguggcacgcuucuuuaagggacucaacgucgcucgaggcgguguggcccuuugucugaaugcucaggggagaaggaacggagaggccuugauccgguucguugauucugaacaacgugaccuagcacugcagcgccauaaacaccacaugggcgugagauauauugaggucuacaaggccacuggcgaagaguuugugaaaaucgcugggggaaccucccucgagguagcgagguuccugucacgggaagaucagguuauucuucgacugcgcgguuugcccuuuagcgcaggcccaacagacgugcucggguuccugggacccgagugcccugucacuggcgguaccgaaggguuacuguucgugagacauccagauggcaggccgacaggagacgccuuugcucuauucgccugugaggaacucgcacaggccgcucugcggcgccacaagggcaugcuugggaagagauauaucgaguuguuuaggaguaccgccgcagagguccaacaggugcugaaucguuacgcgucuggaccccuccugccuacgcuuacugcuccacuguugcccauaccuuucccacucgcccccgguacaggccgggauugcguucgacugagaggguuaccguauaccgcaacuaucgaagacauucuguccuuucuaggagaggccgcugccgacaucaggccucauggcgugcacaugguacucaaccagcagggucgcccaagcggggaugcauucauucaaaugacaucggcugaacgggcccuggcggccgcucagagaugucacaaaaaggucaugaaagagagguacguggaaguugugcccugcucuaccgaggagaugucccgcguccuuaugggcggaacguugggccgaucagggaugaguccucccccauguaagcugccuugccucagucccccaaccuacacaacuuuucaggcaaccccgacacugaucccuacugaaaccgccgcuuuauaucccuccucugcccugcuuccagcagcgcgggugcccgccgcuccuacaccaguagccuacuaucccggaccugcaacccaguuguaccucaauuauacugcuuacuauccgagcccacccgugucaccuacgacaguugguuaccugaccacuccaaccgccgcacuagccagugcucccacauccguccugagccaaucuggcgcgcucgugcguaugcagggggugccuuacaccgccggaaugaaagaccugcuuucagucuuccaggcauaucaguugccggcugaugacuacacuagccugaugcccguuggcgauccaccuagaacaguguuacaagcccccaaggagugggugugccucuga

SEQ ID NO: 55905 - RNA, 1272 nt, Artificial Sequence
  derived and/or modified sequence opt3 from ESRRA__Homo_sapiens__NP_001269379
augagcucccagguggucggcaucgagccccuguacauuaaggccgaaccugcuucuccagacucaccgaaagggaguagcgagaccgaaacagagcccccuguugcacucgccccaggacccgcgccuacuagaugccuuccaggucacaaggaagaggaggauggcgaaggggcuggacccggcgagcaaggugggggaaaacugguguuguccucuuuaccuaagaggcugugucuaguaugcggcgacguggccucgggcuaucauuacggggucgcaucaugugaagccugcaaggcuuucuuuaaacggacgauacagggaagcaucgaguauaguuguccagcauccaacgagugcgaaauuaccaagcgccgacguaaagccugucaggcuugcagauucacaaagugucucaggguggguaugcugaaagagggcguucggcuugaucgcgugagagggggaaggcagaaguacaaacggcgcccggaagucgacccccugccuuuuccaggccccuucccugccgguccauuggcgguggcagggggaccccgaaagacugccgcuccgguaaaugcccucguuucucaucugcugguggucgagccugaaaagcucuaugcaaugcccgauccagcuggcccugacggccacuuacccgccguggcgacccugugcgaucuuuuugacagagagaucguggucacaauuagcugggccaaauccaucccaggguucucaaguuugagccugucugaucaaauguccguucuacagucaguguggauggagguacucgugcugggagucgcacagaggagccuuccccugcaggacgaauuggcuuuugccgaggaucucgugcuggacgaagagggugcucgggccgcaggcuuaggggaacugggagccgcucuccuucaacugguucgucgcuugcaggcgcuaagacuggagagggaggaauacgugcuccugaaggcacuugcccuggcuaacagugauucuguccacauagaggacgccgaagcaguggagcaguugcgggaagcccuccaugaggcucuguuagaguaugaagccggccgagcagguccugggggcggagcggagcgcagaagggcuggccggcugcuacucacccugccacuuuugcgccagacugccgggaaaguacuggcacacuucuacggaguuaagcucgaagguaaagugccgaugcacaagcuguuucuugagaugcuggaggccaugauggacuga

SEQ ID NO: 55906 - RNA, 1527 nt, Artificial Sequence
  derived and/or modified sequence opt3 from ESRRB__Homo_sapiens__NP_004443
augagcuccgacgauagacaccuggggucuucaugcggcaguuucaucaagaccgagcccagcuccccuucuucgggaauugacgcccucucacaucacagcccaagugguuccucugaugcuagcggcggguuuggacuugcacugggcacacaugccaacgguuuggacuccccgcccauguucgcgggggcuggauuaggcggcacuccuuguaggaaaucauacgaagauugcgccagugggauaauggaggacagcgcaaucaagugugaauauaugcugaaugccauuccaaaacggcuaugccucguguguggagauaucgcuucugguuaccacuauggcgucgcauccugcgaggccuguaaggccuuuuucaaacgcacgauucaggggaacaucgaauacucaugccccgcuaccaaugagugugagauaacaaagcgacguagaaagagcugccaagcguguagguuuaugaaaugccugaagguuggaaugcuuaaagaaggcgugcggcuggaccgcguaagaggugggaggcagaaguauaaacggcgcuuggauagugagucuuccccuuaccucagccugcagaucucgccacccgcaaagaagccucugacuaaaauugugucuuaucucuuagucgccgaaccagacaagcuguacgcuaugccgcccccuggaaugccagagggcgauaucaaagcccuuaccacauugugcgaccuggcagaucgagagcuagugguuauuaucggcugggcuaagcauauacccggguucuccucacucagucugggagaccagaugagccuucugcaauccgccuggauggaaauuuugauccucgguauuguguacagaucucugccuuaugacgauaaauuagucuacgcggaggacuauaucauggaugaggaacacagcaggcuggccggccuccuugaacuguaccgggcaaucuugcagcuagugcgucgcuauaagaaacugaagguagagaaggaggaauuuguuacccucaaagcucuggcccuugcuaacucagacaguauguacauugaggaucuggaagccgugcagaaguugcaggaccuccugcacgaggcauuacaagauuaugaacugucccagagacaugaggagccauggaggacugggaaacuacuccugacacuucccuugcugcggcagaccgccgcuaaggcgguccagcacuucuacagcgugaaacuccaaggaaaggugccgaugcauaagcuguuucuugaaaugcuggaggcaaaagucggccaggaacaguugcgagguucuccuaaggacgagcgcaugucaagucacgaugggaaaugucccuuccaaagcgccgcuuuuacguccagagaccagucuaauucgccaggcauaccuaaccccaggccaagcucccccacuccucucaaugaacggggacgccagaucucaccaaguaccagaacaccgggcgggcagggaaagcaccugugguuaacuauguga

SEQ ID NO: 55907 - RNA, 1191 nt, Artificial Sequence
  derived and/or modified sequence opt3 from ESRRG__Homo_sapiens__NP_001230436
augagcaacaaggacagacacaucgauuccucuugcucaaguuucauuaaaaccgagcccagcuccccugccucucugacagacucggugaaucaucacucaccaggcgggagcagugaugcuuccggaucuuacagcuccacuaugaacggucaucagaauggccucgacucaccgccccuuuauccuagugcaccaauacugggagggagcggccccgucaggaaguuguacgaugacuguucuuccacgaucguugaagauccucaaaccaaaugcgaguauauguuaaacucaaugccaaagcggcugugucuagugugcggugacauugccagcggguaccacuauggaguagcgaguugugaggcuugcaaagccuuuuucaagcgcacaauccagggcgugcgacucgaucgugucagaggcgggaggcagaaguacaaacggcgcauugacgcagaaaauucucccuaucugaacccucagcuugugcaaccagccaagaaaccguacaauaagaucguuucccaucuguugguggcugaacccgagaaaauauacgcaaugccugauccaacuguccccgacagcgauaucaaggcccucaccacacugugugaccuggcugacagagagcucgugguaauuaucggaugggccaagcacauuccugguuuuucgaccuuaucucuggcggaucagaugucccuuuugcagucagcauggauggaaauccugauacuaggcguuguguauaggagucucagcuucgaggacgaacuggucuacgccgaugacuauauuauggaugaggaccaguccaaacuugcugggcuguuggaucucaacaaugccauccugcaauuagugaagaaauacaagucuaugaaacuggagaaggaagaguuugugacucucaaagcaauugcucuugccaacagcgacucaaugcacaucgaagaugucgaggcgguucagaagcugcaggacguguugcaugaagcccuacaggauuaugaggcaggacaacacauggaggacccacggcgcgcuggcaagaugcugaugacacucccccugcuucgacagaccaguacgaaagccguacagcauuucuacaauaucaagcuggaagguaaagugccgaugcacaaguuguuucucgagaugcuggaagcuaaagucuga

SEQ ID NO: 55908 - RNA, 1221 nt, Artificial Sequence
  derived and/or modified sequence opt3 from ESX1__Homo_sapiens__NP_703149
auggagagccugagaggcuacacccacuccgacaucggguauaggucucucgccgugggagaagauauugaggaagucaacgacgagaaacuuacaguuacuucacugauggcucgggguggcgaagaugaggagaauacgcgcaguaagcccgaauacgggaccgaggcagaaaacaaugugggaacagagggcagcguaccuuccgacgaucaggaccgagagggugggggaggccaugaaccagagcaacagcaggaagaaccgcccuugacuaagccugaacagcaacaggaggagccacccuuacuggaacuaaaacaggagcaggaggagccuccacaaaccacaguggaaggcccccagccugccgaggggccacagaccgcggagggaccgcagcccccugaacguaagagaaggcggcgcacugcuuucacacaauuucagcuccaggagcuggaaaacuucuuugaugagucucaauauccagacgucguggccagagaaaggcuugcagcccggcugaauuugaccgaggaucgcguucaggugugguuccagaacagacgagcuaaauggaagaggaaucagcggguccucaugcugcguaacacggcaacugccgaccuggcucacccccucgauauguuuuuagguggcgccuacuaugcggccccugcccuggacccagcucuuugcgugcauuugguaccccaacugccgcgcccucccguucuaccagugccucccaugccacccagaccuccaauggucccgaugcccccuaggccacccauagccccuaugccacccauggcaccggugccuccagggucgcggauggcucccgugccucccggaccacgaauggccccuguucccccauggccgccuauggcgcccgucccacccuggccuccaauggcccccgugccuaccggcccgccaauggcacccguaccuccaggucccccuauggcucgcgugccgcccgggccaccuauggccagagugcccccaggaccucccauggcuccacucccgccugggcccccaauggcaccccugccuccaggacccccuauggcaccgcuuccacccggcccucccauggccccacugccucccaggucacacgucccacauacaggcuuggcuccuguucacaucacuugggcgccggugauuaauagcuacuaugcaugucccuucuuuuga

SEQ ID NO: 55909 - RNA, 3345 nt, Artificial Sequence
  derived and/or modified sequence opt3 from ESYT1__Homo_sapiens__NP_001171725
auggagagaagccccggcgaagggccuuccccaucuccgauggaccagcccucagccccuagugauccaaccgaccaacccccugcugcacacgccaagccagaucccggaagcgguggccagccugcggggccaggagcugccggcgaggcacuggccgugcucacauccuucgguaggcggcuucuggucuugaucccgguuuacuuagcuggggcagugggacugucuguaggcuuugugcuauucggccucgcccuguaucuuggguggcgccgaguccgugacgaaaaagagagaucgcugagggcugcccggcaguugcucgaugacgaggaacagcugacugcgaagacgcuguacaugucacaucgcgagcuccccgcaugggugagcuuuccugauguugaaaaagccgagugguuaaacaagauuguggcucaagucuggccauuccugggacaguauauggaaaaacuuuuggccgagaccguggcacccgcuguaagagguaguaauccucaucugcagacauuuacuuucaccaggguugagcuaggcgaaaagccacuccggauaaucggggugaagguccaccccggacagcgcaaagagcaaauucugcuugaccugaacaucuccuacgugggcgaugugcagauugacgucgaaguuaagaaauauuuuugcaaggccggugugaaagggaugcaguugcacggaguacuccgagugauccuggagccguuaauaggcgaucugccuuucgucggcgcggugucuauguuuuucaucagaaggcccacacucgacauuaauuggaccgggaugacuaaccuucuggauaucccaggauugagcucccuaucagacacaaugauuauggacaguaucgccgcauuucugguucucccuaaucggcugcuugugccccuggucccagauuugcaggacguggcucaacuccguagcccccugccucgcgguauaauuagaauccauuuacuggccgcuaggggccuaucuuccaaggauaaguacguaaaagggcucauugaaggaaagucagacccauaugcccugguucggcuuggcacccagacguucuguagccgagugaucgaugaggaguugaacccgcaguggggugaaacuuacgaggucauggugcacgaaguccccgggcaagagaucgaaguggagguuuuugacaaagauccugacaaggaugacuuccugggccgcaugaaacucgaugugggaaagguacugcaggcaaguguccuugacgacugguucccacugcagggcgggcagggacaagugcacuugagacucgaguggcugucuuuacuguccgaugccgaaaaacuagagcagguucuccaguggaauuggggugugagcucgaggcccgacccuccaucugcugcgauucuggucguguaccuugaucgggcacaggacuugcccaugguaaccuccgaacuguauccgccucaacucaagaagggcaacaaagagccaaaucccauggugcagcugucaauacaggauguuacacaggaaaguaaggccgucuacagcacuaacugcccugugugggaggaggcuuuucgcuucuuuuuacaagacccccagucccaggaacuggaugugcaggucaaagacgauucuagagcccuuaccuugggggcacucacacugccacuagccaggcugcucaccgcuccugagcugauccuugaccaaugguuccaguugagcucaaguggacccaauucccgucuguauaugaaguuaguuaugcggauucucuaccuggauagcucugaaaucuguuuuccaacggugccgggcugcccuggugccugggacguggauucagagaacccccagcgagggaguagcguagacgcaccacccagaccuugucauacuacaccagacucccaauucggcaccgagcacguccuuaggauacaugugcuggaagcgcaggauuugauugcuaaagaccgcuuucucggaggccugguuaaggggaagucugaucccuaugugaaacuaaagcuggccggacggucguucagaagccacgucgugagggaggaccucaauccucgcuggaacgaaguuuuugaggugaucguaacuuccgucccgggucaggaacuggagguggagguguucgauaaagaccuugauaaggacgacuuuuugggccgaugcaaaguccggcugacaaccguuuuaaauucaggguuccucgaugaauggcugacgcuugaggaugugccaaguggacgucugcaccuaagacucgaaaggcugacaccccgcccuaccgcagccgaguuggaagagguacuacaggugaacucuuuaauccaaacucaaaagagcgcugagcucgccgcagcucugcuuuccauuuacauggaacgggccgaggaccugccauugagaaagggcaccaaacaucucucacccuaugcgacacugacugucggugauagcucucacaagaccaaaacaaucucccagaccagugccccugugugggacgaaagcgcuucuuuucuaauuaggaagccgcauacugagucccuggaacuucagguucgaggggagggcacgggagugcucggcucacugaguuugccccugagcgaguuacucgucgcagaccagcugugucuugaucgcugguucacacugucguccgggcagggacagguguugcuccgggcccagcugggcauacugguuucucaacacagcgguguggaagcucauucacacaguuacucccacucuagcuccucacugagcgaggaaccagagcuuagugggggaccuccccauaucaccucuuccgccccagagcucagacagaggcugacucacgucgacagcccuuuggaagcacccgcgggcccauuaggucagguaaaacugacccucugguacuauucggaggaacguaagcuggugucaauuguucauggcugccgcucucuucggcaaaacgggagagauccgccugaccccuacgugagucuguugcuacugccagauaagaauaggggaacaaaacgacggaccucccagaagaaacgcacucucagccccgaguucaacgaaagauuugagugggagcugccucuugacgaagcccagaggcggaaguuagaugucucugugaaaagcaauuccucauucaugagucgagagagagaacugcucggcaagguacaguuggaccuggcugagacagaucucagccaagggguggcccgcugguaugaccugauggauaacaaagacaagggaucuuccuga

SEQ ID NO: 55910 - RNA, 2682 nt, Artificial Sequence
  derived and/or modified sequence opt3 from ESYT2__Homo_sapiens__NP_065779
augacacccccuagcagagccgaggcuggcgugaggcggucccgcgucccaucugaagggcgauggcguggagcagagccgcccgguaucucagccaguacccagccugcgagcgcuggcagagccgcaaggcacugcggggccauguccggagcucggggcgaagguccagaggcaggggccggaggcgcuggcgggcgcgccgcgcccgaaaacccuggagguguucugucuguggagcucccaggccuucuggcacaauuggccagaucguucgcuuuacugcuacccguauacgcccucggguaucugggacuuucauuuagcugggugcuguuggcacucgcucugcuggccugguguaggcggagucgcggccucaaggcguuacgacugugcagagcccuugcauugcuggaggacgaagagagggucgugcggcuagguguucgugcuugugaucucccugccugggugcauuucccagacacugaacgcgcugaguggcugaauaaaacggucaagcacauguggccguuuauuugccaguucauagagaaacuuuuuagagaaaccaucgagcccgccgugaggggagcaaacacacaucuguccacuuucucuuuuaccaagguagauguuggacagcagccuuugcggauuaauggcgugaaagucuacacagaaaacguggacaagcgacaaaucauucucgaucugcagaucagcuucgugggcaauugugagauagacuuagaaaucaagcgcuauuuuugcagagccggggucaaauccauucagauccacggaaccaugaggguuauucuggagccacucaucggugauaugccccuugugggcgcucugucaauauucuuuuugcggaagccucuacuggagauuaacuggacugggcucacaaaucugcuugacguaccaggacugaacggcuugagugauaccaucauucucgacaucaucagcaauuaccugguguuacccaaccgcauuacggucccgcuggugucugaaguucagauagcgcaacuaagauucccugugcccaaagguguccucaggauccauuuuauugaggcacaggaucugcaggggaaggacacuuaucuuaaaggcuuggugaagggaaaguccgauccauacggcaucauacguguagggaaucagauuuuccaaucacggguuaucaaagaaaaccugagcccuaaguggaaugagguguaugaagcccucgucuacgagcaccccggacaggagcuggaaaucgagcuuuucgacgaagacccagauaaagacgauuuucuggguaguuugaugauugaccucaucgagguggaaaaggagcgacuguuagaugagugguucacccuggacgaaguccccaaaggcaagcuacaccucagacuggaguggcuuacauugaugccuaacgcuucuaaucuggauaaagugcucacugacauuaaggccgauaaggaccaggcaaacgaugggcuguccagcgccuuacugauacuuuacuuggacucggcuaggaaccucccaucugggaaaaagaucuccucaaauccgaaccccguugugcaaaugaguguaggccauaaagcccaggaaagcaagauucgcuauaaaaccaaugagccugucugggaggaaaacuuuacauucuuuauccacaauccaaagcggcaggaccuggagguggaaguuagagaugagcagcaucaauguucccuagguaaccugaaggugccccucucucagcugcuuaccagcgaagacaugacggucucacagagguuccaguugaguaauuccgggccuaacagcacuaucaaaaugaagauugcacugcgcguguuacaccucgagaaacgagagcggccacccgaucaccaacauucugcgcagguaaagcguccgucagugaguaaagaaggcagaaagacaagcauaaagucccacaugucuggaucgccuggcccagggggaagcaauaccgcucccuccacuccuguuaucgguggcucagacaaacccgggauggaggaaaaggcccagccaccugaggcaggaccccagggccugcaugaucuugguaggaguucuagcucccuguuggccucaccagggcacauuagcgucaaagaaccgacaccuucuaucgcuuccgacauuagucuccccaucgccacccaagagcugcgccagcggcuaagacagcuggagaacggcacgacccucggacagagcccacugggccaaauacagcuuacaaucaggcauucuucccagcgaaauaaguugauuguggugguccacgcaugccgcaaccugaucgcuuuuucagaagaugggagugaccccuacguucggauguauuuacucccugauaaaagaaggagcggacgucgcaagacucacgugucgaagaaaacccugaauccaguguucgaccaauccuuugauuucucuguaagccuucccgagguccagcggagaacacuggacguggccguuaagaacucaggcgguuuucuaaguaaagauaaggggcuccugggaaaaguguuggucgcgcuggccuccgaagaguuagcuaagggcuggacucagugguacgaccucaccgaagacgguacaaggccucaggcaaugaccuga

SEQ ID NO: 55911 - RNA, 2661 nt, Artificial Sequence
  derived and/or modified sequence opt3 from ESYT3__Homo_sapiens__NP_114119
augagagccgaggaacccugcgcuccuggcgcaccaagcgcccugggggcgcagaggaccccgggacccgagcuccggcuuuccucucaacuguugccugaauuauguacauucgugguccgcguucuguuuuaccuagguccaguguaucucgcuggcuaccuggggcuuucaaucacuuggcuguugcucggagcccugcuguggaugugguggcgacguaacagaaggggcaagcucggucgguuagcagccgcuuucgaguuucuggacaaugaacgcgaguucauuaguagagagcuuagggggcagcacuugcccgcauggauacauuuuccugauguagaacggguggagugggccaacaaaaucauuagccagacguggccauaucuguccaugaucauggaaucuaaguuccgcgagaaacuagagcccaagauucgagaaaaaucgauccaccucagaaccuuuacauucacuaagcuguacuuuggacagaagugcccuagggucaauggcgugaaagcucauaccaacacauguaaucggcgucgcguuaccguggaccuucaaauaugcuauaucggcgauugugagauuucagucgaacugcagaagauccaggccggggugaacgguauucaguugcaaggaacucucagaguaauccuggagccauuacugguugacaaaccguucgugggcgcggucacaguguuuuuccuccagaagccccaccuucagauaaauuggaccgggcugacgaacuugcuagaugcaccuggaauuaaugacgugagcgauagucugcucgaagaccugaucgccacucaucuuguccugccaaacaggguuaccgugcccgugaaaaagggcuuggaucucacaaaucugcgguuuccuuuaccaugcggugugauucgaguccaucugcuagaggcugagcagcucgcccaaaaggacaacuuccuggggcuucgcggaaaauccgaucccuacgcaaaggugucuaucggcuugcagcacuucagaagcaggacuaucuaucggaaucugaacccgaccuggaaugaaguuuuugaguucaugguguacgaagucccuggccaggaccucgagguggaucuguacgacgaagacacagaucgcgacgauuuucuugggucccugcaaauuuguuugggagacguaaugaccaacagaguuguggaugagugguucguccucaacgacacgacuucagguaggcugcacuuacgucuggaguggcuaagucuccugacagaucaggaagugcuuaccgaggaccacggcggguugagcacugcuauacuggucguguuucucgaaucugccugcaaucugccccggaacccauucgauuauuuaaauggagaguaccgagcgaaaaagcuguccagauuugccaggaacaaaguuucaaaggacccuagcaguuaugugaaacuuucuguaggcaagaagacacauaccuccaaaacguguccccacaauaaggauccagucuggagccagguguucucguuuuucguucacaacguggcaaccgaacgcuugcaucucaaaguccuggacgacgaucaggagugcgcucuagguaugcuggaggugccccucugucaaauccugccuuacgccgaccuuacauuggaacagcgguuucagcuggaucacucuggguuagacucccucauuucaaugagacugguacuuagguuccugcagguagaggaacgcgaguugggcaguccauauacuggaccggaggcucucaagaaaggcccccugcuaaucaagaagguugccaccaaucaagggccuaaagcacagccacaggaagagggacccacagaucugccuugcccacccgacccggccagcgauacuaaggacgucucccgaucuaccacaaccacuacgagcgcuacaaccguggcgacugaaccuaccucacaggagacagguccagaacccaaaggcaaggauagugcaaaacgguuuugcgagccuauaggggagaagaagucccccgccaccauuuuccucacugugccaggaccucauagccccggcccaaucaaaucuccgcguccuaugaagugucccgcuucaccauucgccuggcccccuaaaagacuggcaccaaguaugagcucccuuaacucuuuggccucgagcugcuuugaccuggcugauaucuccuuaaauauugaagguggggaccucaggcgccggcaacugggcgagauccagcuuacagucagauacguuugucugaggcgaugccuaucagugcucauuaacggaugucgcaaucugacgcccugcaccaguucuggcgccgauccuuaugugcggguauacuugcugccggaaagaaagugggcauguaggaaaaagacuagcgucaagcguaaaacauuagagccacucuucgacgaaaccuuugaguucuuugugcccauggaggaaguuaagaaacgcucccuggacguggcggucaagaacucacggccucuugggagccacagaaggaaagagcugggaaagguguugauagaucucucuaaagaagaccugaucaaggguuucucccagugguacgagcuaacaccaaauggccagccccgaaguuga

SEQ ID NO: 55912 - RNA, 2781 nt, Artificial Sequence
  derived and/or modified sequence opt3 from ETAA1__Homo_sapiens__NP_061875
augagcagaaggcggaagcacgacgauucccccucuccuaaaaagaccccacauaaaacaguggccgcugaggaaugcggcucagucguugagccggggcgccgacgucugagaagugcaaggggaagcuggcccuguggugcccgggaaggcccuccagggcccgugcgccagagagagcaaccuccaacugcggcucucugcuccaagucuaaccccgaagagagguacgagacgccuaaacgggcccuuaagauggacucgcugucaagcaguuucuccucuccaaaugauccggacggacagaacgauaucuuuugggaccagaauagccccuugaccaagcaguuaggcaaaggucgcaagaaacaaauuuauacaacugauuccgacgaaauaucacacaucguaaaccgaauugcaccucaggaugagaagccaaccacaaauaguaugcuggacauguggaucggggaaaccgccauucccuguacuccuagcguggcuaaaggaaagucuagagcaaagaucuccugcacaaaacuaaagacccagucacaggaggaggaacucaugaaacuggccaagcaauucgauaaaaacauggaggaacuugacgucauacaggagcagaauaagaggaacuacgauuuuacgcagaugaucagcgaaacugagauucugaguaauuauaaagacaacauccaaauguggucuuugcauaauauugugccagagaucgacaacgcuaccaagaagcccauaaaaggcaauacaaagauuuccguugccaacaaucagaacagcucgcagaaaccguucgaucaaaucgcggaagcagccuuuaacgcuauuuucgacggcucuacucagaaguguuccgggcagcucucacaggagcugccugaagccuuuuggaguaccagcaauacaaccuucgugaaaacgaacgcacugaaggaggaaaagaucaucacuaaugagacacucgucauugagaaauuauccaacaagacuccccggucucugagcucacaaguggauacuccaauaaugacaaaaaguugcguaaccuccuguacgaaggaaccugagaccagcaauaaauacaucgacgcuuuuacaacuucugauuucgaagacgauugggagaaccuuuugggaucagaacccuuugccaugcagaauauugacaugccagagcuguuccccaguaagaccgcgcacguuacagaucagaaggagaucugcacuuuuaacagcaaaaccgugaagaauacaucccgugccaacaccucuccugacgcacgccuaggugauucgaaaguccuccaggaccugagcuccaagacuuaugacagagaacuuauagaugcugaguacagguucucaccaaauaguaacaaaucuaauaagcugagcacgggcaacaagaugaaauucgaaaauuccucaaacaagauugugauccaagacgagauccagaacuguauugugacaagcaauuugaccaaaaucaaggaggauauucucacuaacucuaccgaagccuccgagcggaaaagugcucugaauacacgauauagcaacgaacagaagaauaaaugcauauuaaaccagucuaucaaggccccggucaauaccgaccuguuuggguccgcaaaccucggaucaaagacuuccguuagcaaucccaaccaaacaucggccuccaaagugggcucuuucuuugaugacuggaaugauccuagcuucgcuaacgagauuaucaaggcgugucaucagcuugacaauacgugggaagcagaugacguagaugacgaucuguuguaccaggccugcgacgacaucgagcgccuaacccagcaacaggauauuagaaaagacucaaagaccagugaguccauaugcgaaaucaacaauaacucugagcacggugcuaaacugacacagcaacaggauauuaggaaggacagcaagaccuccgaaucaaucugugagauuaacaauaacagcgaacacggggccaaaaauauguuugcaaucaguaagcagggaucuaaccucgugcaguccaaacaucugaauccaggcagcauaucgguccaaacaucacuuacuaacucuagucagaucgauaagcccaugaaaauggagaagggcgagauguacgggaauaguccucgguuccugggagccaccaacuugacgauguauagcaagauuucuaauugccagaucaacaaucuccacgugagcuacaccaacacagacguuccaauucaggucaauuccucaaaacugguguuacccgguaguagcucucugaacgugacuuccgaucauaugaauaccgaaaucacaacuuauaagaaaaagcuaucaaccaaccaaccgugucacaaaacgguaacagacgaggcucagaguaaccucaauaccacuguuggcuuuagcaaguucacauuuacccgcaugaagaacucccagauacugucucaguucaaucaaaacugcauuacugggucgaugagcgauaccaaaaucacacagggaguggaaaagaaaaagggcgucaauccucuuuuggaggaagccgugggucagcaaucacuggucaaacucuccgagagucugaagcagucuagcaaagaggaagaggaaaagaacagaaaguguuccccagaggagauucagaggaaacgucaggaagcacuugugcggcgaauggcgaaggcuagagccucaucuguuaaugcagcccccacgagcuuucuguga

SEQ ID NO: 55913 - RNA, 1272 nt, Artificial Sequence
  derived and/or modified sequence opt3 from ETF1__Homo_sapiens__NP_001269114
augaagcaggacgugcugaacugcaccgagggccccauccacagcaaugggacauccaugauuucucucauaaucccuccaaaagaucaaauuucaagagucgccaagaugcuugcugacgaguucggaacugcaaguaacaucaaaagcaggguuaaucggcuguccguguugggugccauuacgucuguacagcagcgcuuaaagcuguacaacaaagugccgcccaauggccuagucguguauugugggaccaucguuacagaagaaggaaaggagaagaaagugaacauagauuuugaaccuuucaagccaaucaauacuucgcucuaccugugcgacaacaaauuucauaccgaggcgcuuacagcucuguugucagaugacagcaaguucggcuuuauugucaucgaugguaguggggcccucuucggaacccugcagggcaauacucgagaggugcugcacaaauuuacaguagaccuccccaagaagcauggccgugggggacaauccgcauuaagauucgccaggcugcggauggaaaaacgccacaacuauguuagaaagguggcugagaccgcaguccagcuuuuuauuucuggugauaaagugaauguggccggcuugguccuggcugggagcgccgacuucaagacggaacuaucccagucagauauguuugaccagaggcuccaaaguaaaguucugaaacuuguggauaucagcuacggaggcgagaacgguuucaaucaggcgauagagcugucuacugaaguauuguccaacgugaaauuuauucaggagaagaagcucaucgggcgguauuucgacgaaauuucacaggacaccggaaaauacuguuucggcgucgaggauacacugaaggcauuagaaaugggcgccguggagauccugaucguuuaugagaaucucgacauuaugcgcuacgugcuucauugccaagggacugaagaggaaaagauacuguacuugaccccugagcaggaaaaggauaaaagccacuuuacagacaaggagaccggacaggagcacgaacuaaucgagaguaugccacugcucgaaugguucgcuaacaacuauaagaaauuuggugccacgcuggagauugucacugauaagucucaagaaggcucccaguucgugaaaggguuuggaggcaucggugggauacuucgauacagaguagacuuccagggcauggaguaucagggaggcgaugacgaguuuuucgaucuggacgauuacuga

SEQ ID NO: 55914 - RNA, 1002 nt, Artificial Sequence
  derived and/or modified sequence opt3 from ETFA__Homo_sapiens__NP_000117
auguucagagccgcugcacccggccagcugaggcgggccgcgagccuccuucgcuuucaauccacccuggugaucgcugagcacgccaacgacucuuuggcaccuauuacauuaaauacuauaacggccgcuacccgacuagggggagaagucucaugccugguugcagguacaaagugugauaaaguggcccaggaccucugcaagguagcuggcaucgccaaagugcuggucgcgcagcaugauguguacaaggggcuucugccagaggaauugacuccgcucauucuggcaacccagaaacaauucaacuauacacacaucugugccggagcuagugccuuuggcaagaaucugcucccccguguugcagcuaaguuagagguggccccuauuagcgacaucauagcgaucaaauccccagauaccuucgucagaacuauuuacgccgguaacgcacugugcacagugaagugugacgaaaaaguaaagguguuuucugugagggggaccucguucgaugcugccgcuacgucaggaggcagcgccaguuccgagaaagcaucuagcacuucccccgucgagaucucagaauggcuugaccagaaguugaccaagagugaucggccugagcugacaggcgccaaagugguggucagcgggggacgcggucuaaagucuggcgaaaauuuuaaacuccuguaugaccuugcugaucagcugcaugcggcaguuggggccuccagagcugccguggacgcaggauucguaccaaacgauaugcagguuggccaaacugguaagauugucgcccccgaguuguacaucgcuguggggauaucaggagccauucagcaccucgcaggcaugaaagacagcaagaccaucguugcgauuaauaaagacccugaggcuccaaucuuucagguggccgauuauggcaucgucgcagaccuguucaaggugguaccggaaaugacagagauuuuaaagaaaaaguga

SEQ ID NO: 55915 - RNA, 1041 nt, Artificial Sequence
  derived and/or modified sequence opt3 from ETFB__Homo_sapiens__NP_001014763
auguaccugagccucugggugaccaucaacacagucaaucuuagaaacacucuguccggcuugaggggagccguuacgaccguggggaugauuaagucugacguacccgguacacaggagugguuagaugaacggcgccgacaaggcgaccugccucuaccaacuaauucaaacccggugcucagucuggagcuuugcgaucccgggcagggaccugcuccauuccaggcagucgugguucugauacagcccggccgugguuuggcccucagaccuccacccagcugucuguuuccuccagacccgacccccuccccuccagcggggcaaaucagggugaaacccgaucggacaggagucgugaccgacggcguaaagcacucuaugaauccuuucugcgaaauugcuguugaggaagccgugcgccugaaagagaagaaacucgucaaggaggugaucgcagugucguguggcccagcccagugccaggaaacuauuagaacagcuuuagcaaugggggccgauaggggaauccaugucgagguucccccggcugaagccgagcggcuggguccucuucagguggcgcgcguauuggcaaagcuggccgagaaagaaaagguggaccuaguccuccugggcaaacaagcuauagaugacgauuguaaccagaccgggcagaugacggccggauuucuugacuggccccagggcacuuucgcaucacaagugacccuggagggugauaaguugaaaguugaacgagagaucgacgggggacucgaaacacugagauuaaagcugccagcuguggucacugccgaccucaggcuuaaugagccucgguaugcgacccugcccaacauuaugaaggccaaaaagaaaaagaucgaggugauuaaaccaggcgauuugggcguagaccuaacaagcaagcugaguguuaucuccguggaagaucccccucagcguaccgcaggggucaaaguggagacgacugaagaccucgucgcuaagcugaaggagauaggacgcauuuga

SEQ ID NO: 55916 - RNA, 1713 nt, Artificial Sequence
  derived and/or modified sequence opt3 from ETFDH__Homo_sapiens__NP_001268666
augcuggugccccucgccaaacuuagcugccugggcgucaacauggagagauucgcugaagaggcagacguugugaucguaggggccggaccugcggguuuguccgcugccgugagguuaaagcagcuggcagucgcccacgaaaaggauauucgggugugucuaguugagaaagcugcacaaauaggcgcccauacccucucuggggcuugccuggacccaggagccuuuaaggaacuuuucccggauuggaaagagaagggcgcgccccugaauacaccugugacugaggaccgcuuugguaucuugacggaaaaguaccgaauaccaguccccauccucccugggcugccaaugaacaaucacggaaacuauauugugcgucugggccaucucguaucauggaugggcgagcaggcagaagccuuagggguugagguguaccccggauaugcugccgcagagguccuguuccacgaugacgguagugugaaaggcaucgcuaccaaugauguggggauacagaaggacggagccccuaaagcgacauuugaaagaggccuugaguugcaugccaaggucacuaucuucgcagaagguugucacgggcaccuggcuaaacagcuauacaagaaguuugaucucagggccaacugcgagccacaaaccuauggaauuggccugaaagaacuuuggguuaucgacgagaagaauuggaaaccgggccggguggaucauacaguaggguggccccuggaccgccacaccuacggagguagcuucuuguaucaucucaacgagggcgaaccucugguggcuuuagggcuggucgugggacucgauuaccagaauccauaccuuucccccuuuagagaguuccagagguggaagcaccacccuucuauucggccaacucuggaaggcgguaaacgcaucgccuauggggcacgagccuugaacgagggcggauuucagucgauacccaagcuaacauucccgggcgggcugcucauuggauguucaccugguuuuaugaauguucccaaaaucaagggcacccauacggcuaugaaaagcgggauucuggcggcagaaaguaucuucaaccaacuuacuuccgagaaucugcagucuaagaccaucggauugcacgugacagaguacgaagacaaccucaagaauagcugggucuggaaagagcuguauuccgugagaaacauuaggccaucaugccauggcguauuagguguuuacgggggcaugauauauacuggaaucuucuacuggauucugcggggcauggaaccuuggacccuaaagcacaaagggagugacuuugagcgucucaagcccgccaaggauuguacaccaaucgaauaucccaaaccugacggacagauuagcuucgaucugcuuucuuccguggcuuugucagguaccaaccaugagcacgaccagccagcccaccugacgcuccgcgaugacagcauuccggucaauagaaaccugaguaucuacgauggccccgagcaaagguuuugcccugcagggguguacgaguucgucccaguggaacagggagacggcuuucggcuucagaucaaugcccaaaacuguguucauugcaagacuugugauauuaaagaccccucucagaauaucaacugggugguaccugaaggugggggcggaccagcuuauaauggcauguga

SEQ ID NO: 55917 - RNA, 765 nt, Artificial Sequence
  derived and/or modified sequence opt3 from ETHE1__Homo_sapiens__NP_055112
auggccgaggcugugcugagagucgcaaggcggcagcucagccaacgcggcggguccggagcccccauccuucugcgacagauguucgaaccuguuucuugcaccuuuacauacuuguuaggugaccgugagucaagagaagcggugcugauugauccaguacuagagacugcuccgagggacgcccagcucauaaaggaacugggccuucggcuguuguaugcagugaacacgcacugucaugccgaucacaucaccgggaguggacuccugcgcagccugcuccccggcugccaguccgucauuucuagauuaucgggugcucaagcagaccugcauaucgaggauggggacucaauuagguucggacgguuugcccuugagacacgcgcuagcccuggccacacuccaggcugugugaccuucguuuugaaugaucauaguauggccuuuacaggggacgcgcugcuaauccgaggaugcgguagaaccgauuuccagcagggcugugcaaaaacucucuaccacuccgugcacgaaaagauauuuacacugcccggggacugccuuaucuauccugcccaugauuaccacggauucaccgucucuacgguggaggaagagaggacucugaacccacgguugacccucagcugugaggaauuuguaaaaauuaugggcaaucugaacuuacccaagccucagcaaaucgacuucgcuguuccagccaauaugcguugcggugugcagacaccgacugcauga

SEQ ID NO: 55918 - RNA, 777 nt, Artificial Sequence
  derived and/or modified sequence opt3 from ETNK1__Homo_sapiens__NP_001034570
augcugugcggcagacccaggagcuccucugacaaccggaauuuccuccgcgagcgagccgggcuuucaagugcugcagugcagacccguauuggaaacagcgccgcguccagaaggucuccugcugcccggccaccgguccccgcaccuccagcccugccccgcgguagaccuggcacagaagggucgacuucauugagcgcuccagcaguuuuagugguagccguggcugucgugguuguggucgugagugccguagcgugggcaauggccaauuacauucacguucccccuggauccccagaggugccgaagcugaacgucacggugcaagaucaggaggaacauaggugucgggaaggcgcucuaucucuccugcagcaccuucgcccccauugggacccucaggaggugacccugcaauuguuuacagaugguauaacuaauaaacucaucgggugcuaugucggaaacaccauggaggacguugugcugguacgaauuuacggcaauaagacagaacugcucguggauagagacgaggaagucaaaucuuucaggguguuacaggcccacggcugugcaccacagcuguauugcaccuuuaacaaugggcuuuguuacgaguucauccagggagaggcuuuggaucccaagcauguuugcaacccugccaucuuuucccugucaagucuaacucucuguaaagguaagacaacccggugcuucggccugacggggugucguggaagccgccuucuguugagcuuuuucuga

SEQ ID NO: 55919 - RNA, 1185 nt, Artificial Sequence
  derived and/or modified sequence opt3 from ETNK2__Homo_sapiens__NP_001284689
auggccgugcccccuagcgcuccacagccgagagcauccuuccaccugaggcggcauacccccugcccucaauguucuuggggcauggaggaaaaggccgcggcuucagccaguugccgcgagccacccgggccuccacgagcagccgcugucgcauacuuuggaaucagcguugaccccgaugacauucucccuggugcccuucgucugauacaggaauugagaccacacuggaaaccggagcagguaaggacaaagcgguucacugauggcaucacgaacaaauuaguagcuuguuauguggaagaggacaugcaggauugcguccuggugcgcguuuacggggagagaaccgaacuacucguggacagggagaaugaaguccggaacuuucaacugcuucgcgcccauuccugugcgcccaagcuguauugcacauuccagaauggauuguguuacgaguauaugcagggcguggcacucgagccugaacacauucgagagccaagacuguuuaggcugaucgcccucgaaauggcuaaaauucauacuauccacgccaacgguucuuuacccaagccuauacuguggcacaagaugcauaauuacuucacccuugugaaaaacgagaucaauccaucguugucagcagauguucccaagguggaaguccuggagcgggagcuagcuuggcucaaagaacaccugagccagcuugagaguccggugguguuuugccauaacgaccuguuguguaagaauauuaucuaugauuccauuaaagggcacguccguuucaucgacuacgaauacgccggauauaacuaccaagcguuugauauaggcaaucacuucaacgaguuugccggcguuaaugaaguggacuauugccucuacccugcacgcgagacacagcugcagugguuacauuauuaccugcaggcucaaaaggggauggccguaacccccagagaggugcagaggcucuauguccaggugaacaaguucgcucuuggaccaucuuguguuagcuccacuaugacagccucacugcaaugcugccggguggguaaucgacacggcgaaauugcacgcuugacccuaagugggcuguuuccuggagucagccuccugcuuggcucucuggguccccauccagagcccguguugcaccauagacucuga

SEQ ID NO: 55920 - RNA, 1482 nt, Artificial Sequence
  derived and/or modified sequence opt3 from ETNPPL__Homo_sapiens__NP_001140062
augugcgagcuguacagcaagagagacacccucggccuuaggaaaaagcacaucgggcccuccuguaaaguguucuuugccucugauccuauuaagauaguccgggcucagcgccaauauauguucgacgaaaacggagagcaguaccuggauugcaucaauaacguugcacauggugugguaaaagccgcguugaagcagauggaauuacugaauacaaacucacgauuucuacacgacaauauuguggaguaugcuaagcgucucagugccacucugccagaaaaacuuagcgucuguuacuucacgaacuccggcucugaggcaaaugaucuggccuugagacucgcuaggcaguuucgggggcaucaagacgugaucacccuggaucacgcauaucauggacaccugucgucacucauugagaucagcccguacaaguuccagaaaggcaaggacguuaaaaaggaauuugugcacgucgcccccacaccugauacuuaucgcgguaaguacagagaggaccaugcugauagugccuccgcguacgcagacgaagugaaaaagauaaucgaggaugcccacaacucugggaggaaaauugcugccuucaucgcagagagcaugcaguccugcggaggccagauuaucccacccgcuggcuauuuucaaaagguagccgaauacguucauggggcgggagguguguucauagccgacgagguccaggugggcuuugggcgggugggaaaacacuucuggucauuucagauguauggcgaagacuucgucccugauauuguuaccauggguaagccaauggggaauggacaccccguggcauguguagugacaaccaaagagaucgcugaagccuucaguagcucuggcauggaguacuuuaacacuuauggcgggaauccugucuccugcgcugugggauuagccguucuggacauuaucgagaacgaagaucuucaggguaaugcaaagcgcgugggcaacuacuugacagagcugcuaaagaaacaaaaggccaaacauacccucaucggggacauucgaggaauaggccuguucaucgguauugaucuugucaaggaccaccugaaaagaacgccagcuacugcggaagcacagcauaucauauauaagaugaaggagaaaaggguguugcucucagccgaugggccgcaccggaauguacugaagauuaaacccccuauguguuuuaccgaagaggacgcuaaguucaugguugaucaguuagaccguauccugacagugcucgaggaagccaugggcacuaaaaccgagagcgucacaagugaaaacaccccaugcaagacgaagaugcuuaaagaggcacauaucgaacuguugcgcgauucuacuacagacuccaaggagaaccccagcagaaaaaggaauggaauguguaccgacacucacucgcuacugucuaagcggcucaaaacauga

SEQ ID NO: 55921 - RNA, 1458 nt, Artificial Sequence
  derived and/or modified sequence opt3 from ETS1__Homo_sapiens__NP_001137292
augagcuacuucguggacuccgccgggucuucacccgucccuuauagugcuccaagaccggcaguugugaggcagggccccagcaacaccuacgaggauccucggaugaauugcggauuucaauccaacuaucaccagcagcgcccauguuaccccuucugggacgaaauggccacacaggagguaccuacuggucuggaacauugcgugucugauauggagugugcggacgucccacuccuuacgcccucgucaaaggaaaugaugagccaagcucugaaagccaccuuuaguggcuucacaaaggagcagcagcgauuggggaucccuaaagauccacgucaguggacugagacccacgugagagacuggguuaugugggcagugaaugaauuuuccuuaaagggagucgauuuccaaaaauuuugcaugaacggcgccgcucugugugcacuagguaaggacugcuuccucgagcuggccccggauuuugugggggacauucuuugggaacaucuggagauauugcagaaggaggauguaaaacccuaucagguuaauggagugaacccugcuuacccagaaucuagguauacaagcgacuacuucaucuccuacggcauugagcacgcccagugugucccaccuucagaauuuagugagcccagcuucaucaccgaaucuuaucaaacucuccaucccauuuccucagaggagcugcugagccucaaguacgaaaaugauuauccgagugugaucuuacgggacccucugcagacagacacccuucagaacgauuacuuugcgauaaaacaagagguggucacgcccgacaauaugugcaugggccgcacuucuagagggaaguugggaggucaggauuccuucgaaagcaucgagucguaugacucuugugauaggcugacccaguccuggucaagucagagcuccuucaacucucuacaacggguuccaagcuacgacucauuugauagugaagacuauccugcagcccuccccaaucacaaaccaaagggcacauucaaggauuacgugcgcgaccgagcugaucugaacaaagacaagcccguaauuccugccgcagcucuugccggguacacuggauccggcccaauccagcuguggcaguuuuugcucgagcuguuaaccgacaaaagcugccagucuuucauuucauggacaggugaugggugggaguuuaagcugagugacccggaugaaguggcgagaagguggggaaaacggaagaauaaacccaagaugaacuaugagaagcucagccguggccuucgcuacuauuacgacaaaaauaucauacacaagaccgccggcaaaagauaugucuacagguucgugugugaucugcaauccuugcuaggguauacgccugaggaacugcaugcaaugcucgacguuaagccagaugcugacgaauga

SEQ ID NO: 55922 - RNA, 1830 nt, Artificial Sequence
  derived and/or modified sequence opt3 from ETS2__Homo_sapiens__NP_001243224
augggcagcgcccaguuccaagggcugaucacccaggcuagacuccccuuuggagcaacauccacuacggccccuucucuuaggaacucaaagggucgguucggcgugcgcgcgcuggcuccagagcgaaccccgagugcaccccguaaagucagcgccagauugccugggaggacauuagcccggacuuggggacgcggcccagcucccggugcauccgggccugccggagaaggcccaucuagaguuaccgcuggcgggggagguaagcugagggcccccggcgcggcacggccugccucggggcuaccagaccgccucuggccggcucccucaccuagcccaggagcccaccgagcagcugccggcgcggagcagcccccuaguagaccauccgccggucccgcaaggucugggcggaugaaugauuuuggaauuaaaaacauggaccagguggcuccgguagccaauagcuaccguggcacacugaagcgccaaccugcuuucgauaccuuugacggcucccuuuucgccguguuucccucacugaacgaagaacagacuuugcaggaagucccaacagggcucgauaguauaagccaugacucugcaaauugcgagcugccucugcucacccccuguuccaaagccgugaugucacaggcuuuaaaggcgacguucagcggauuuaagaaagagcaaagaaggcuggguaucccaaagaaccccuggcuuuggagugaacagcagguuugccagugguugcugugggcaacuaaugaguucucucuagugaacgucaaucuccaacgguuuggcaugaacgggcagaugcuguguaaucuuggaaaagaacgauuccuggaguuggccccugauuuugugggcgacauucucugggagcaccuggaacagaugaucaaggagaaccaagagaaaaccgaggaucaguaugaagaaaauucccauuuaacaagcguaccacacuggauuaacucgaauacucuggguuucgggaccgagcaggcuccguacggcaugcagacacaaaacuaucccaagggaggccuccuugacucuaugugcccugccuccaccccaucaguucugaguagcgaacaggaguuccagauguuucccaagucccgcuugucuagcgugucagucacguacuguagugugucccaggauuucccugggagcaaccuaaaucugcucacuaacaauucuggaacaccaaaagaccaugauucacccgaaaacggugcagacaguuuugagagcuccgacucucugcuucaaucguggaauagccaguccucacuguuggaugugcagagagucccgaguuucgaaucuuuugaggacgauugcagccagucccucugucugaacaagccuaccaugucauucaaagacuauauccaagagaggagcgauccaguugaacagggcaagcccgugauaccugccgcuguauuagccggguuuacuggaucuggccccauccagcuguggcaguuccuacucgagcugcuuuccgacaaaaguugccagagcuuuauuucuuggacaggugaugggugggaguucaaguuggcagacccagaugagguggcgcggcgcuggggcaaaagaaagaauaagccuaaaaugaacuacgaaaagcuguccaggggacuccguuauuacuacgacaaaaauaucauucacaagaccucaggcaaacgguaugucuaccgauuugugugugaucugcaaaaccuucugggguucacgcccgaggaguugcacgcuauccucggaguucagccagacaccgaagacuga

SEQ ID NO: 55923 - RNA, 1365 nt, Artificial Sequence
  derived and/or modified sequence opt3 from ETV1__Homo_sapiens__NP_001156619
auggacggcuucuacgaucagcaagugcccuauauggucaccaacagccagagagggaggaauugcaacgagaagccuacaaauguucggaaacgcaaguuuaucaaccgagaccuggcccacgauuccgaagaacucuuccaggaccuuucucagcugcaagagacuugguuggcugaggcacaggugccagauaaugacgaacaguuuguaccggauuaccaggccgagucauuagcguuccauggacugccccuaaaaauuaagaaagagccucacaguccauguagcgaaauauccucugcuugcucgcaagagcagcccuuuaaguucucauauggugaaaagugucucuacaacgugagcgccuaugaccagaaaccucaggucggcaugcguccaaguaaucccccuacgccauccucuaccccggugagcccccugcaucacgcauccccuaacucaacacauacuccaaagcccgauagagccuuuccugcucaccuuccacccagucaaagcaucccggacucuuccuacccuauggaucacagguuccggcgccagcugucagagcccugcaauagcuuuccaccuuugcccaccaugccaagagaggggaggcccauguaucagcggcaaaugagugaaccuaacauuccauucccgccccagggauuuaaacaggaguaccaugacccuguuuacgaacacaauacaauggugggcucugcagccucccagagcuucccacccccucucaugaucaagcaagagccacgcgauuuugcuuaugacucggguuguauguucgaaaaagggccccgacaguucuacgacgauaccugcgucgugccggagaaguuugacggagauauuaagcaggagccuggcauguauagagaaggcccaacuuaccagaggcgggggucucugcaacuguggcaguuccucguagccuuacuggacgaucccuccaacucacauuuuaucgcguggacaggacgugguauggaguucaaacuuauagaaccugaggaaguugcacgcagauggggcauccagaagaauaggcccgccaugaacuaugacaaauugagucggagccugcgauacuauuacgagaaggggauuaugcagaaaguggcuggagagcgcuacgucuauaaguuugugugugauccagaagcccuauucuccauggcauuuccugacaaucaaagaccccuccugaaaaccgauauggagaggcacaucaacgaagaggacacggugccacuuucucacuucgaugaaagcauggcuuacaugccggagggcgguugcuguaacccucaucccuauaaugagggguacgucuauuga

SEQ ID NO: 55924 - RNA, 432 nt, Artificial Sequence
  derived and/or modified sequence opt3 from ETV3__Homo_sapiens__NP_005231
augaaggccggcugcagcaucguggagaaacccgaagggggagguggcuaccaguucccugacugggcuuauaagaccgaguccucuccagggucaagacaaauucagcuguggcacuuuauacucgaacuucugcagaaagaggaguucaggcaugucaucgcauggcagcaaggagaauacggcgaguuuguuauuaaggauccggacgaaguggcccgguuguggggucgccgaaaauguaagccccagaugaacuaugauaaguuaagucgugcgcugagauacuauuacaauaaaaggauccuacacaagacaaaagggaagcgguucacuuauaaauuuaacuucaauaagcucguaaugccuaacuacccauuuauuaauauccgcagcuccggaaagauacagacgcugcuugugggcaacuga

SEQ ID NO: 55925 - RNA, 1455 nt, Artificial Sequence
  derived and/or modified sequence opt3 from ETV4__Homo_sapiens__NP_001073143
auggagagaaggaugaaggccggcuaccuggaccagcaagugcccuauaccuucagcuccaaaucuccugggaacggaucacuccgggaagcucuuaucgguccacugggcaaguugauggauccggggaguuuacccccucuggacagcgaggaucuauuucaggaccucucccacuuccaggaaacauggcuggcagaggcccaggucccagauucugacgaacaauuuguucccgauuuccauucggagaaucuugcguuucacucaccuacuacgcgcauuaaaaaggagccacagagcccccgaaccgacccugcucugaguugcucccguaaaccaccguugcccuaccaucacggagaacagugucucuauucuagcgccuacgauccuccaagacagauagcaaucaagucccccgccccuggcgcucugggucaaucaccacugcagcccuucccgagggcagagcagcggaacuuucuccgcaguagcgggacaucucagccucaucccggacacggcuauuuaggcgaacacuccucaguguuccaacagccacuggacauuugccauagcuuuaccagucaagggggagguagagagccucuucccgccccauaccagcaccaguugucugagcccuguccuccauauccgcagcaguccuucaagcaagaauaccaugauccccuguacgagcaggcuggccagccugccguagaccaagggggagugaauggccacagguauccaggugcgggggucgugaucaaacaggaacagacugauuuugcauacgacagcgacguuacaggaugcgccucgauguaucuacacaccgagggcuucucuggccccuccccuggggauggagcuauggguuacggcuaugaaaagccacuccggcccuuuccggacgaugugugugucgugccugagaaauucgagggggacauuaagcaggaaggaguaggcgccuuccgcgaggguccacccuaccagcgaagaggggcacugcaacuuuggcaguuucugguugcuuugcucgaugacccuacuaacgcccauuucaucgcguggacaggcaggggaauggaauuuaaacugauagagcccgaagagguggcccgguuauggggcauccagaagaaucguccagcaaugaacuaugauaagcugucacgcagucucagauacuacuaugagaaagggauuaugcagaaggucgcuggagaaagguacguguauaaauucgugugcgagccugaagcccuuuuuagccuggcuuuccccgacaaucaacggccagccuugaaggcagaguuugaucgaccggucuccgaagaggacaccguuccucuaucucaccuggaugagagccccgccuaccucccagaacuggcuggucccgcgcagccuuucggcccaaaagggggauauucauacuga

SEQ ID NO: 55926 - RNA, 1533 nt, Artificial Sequence
  derived and/or modified sequence opt3 from ETV5__Homo_sapiens__NP_004445
auggacggcuucuacgaucagcaagugcccuuuauggucccuggcaagagcagauccgaggaaugcaggggacggccaguuaucgaccgcaaacgaaaguuccuggauaccgaccucgcccacgauucugaggaacuuuuucaggaccugucacaguugcaggaggcuugguuagcagaagcccaagugccggaugacgagcaguucguacccgauuuucagagugacaaccuggugcuacaugcgccuccacccacaaaaauuaagcgugagcuccacagcccuuccucugaacugucgucauguagccaugagcaggcucuuggugccaauuauggcgaaaaaugccuguacaacuauugugcauacgauagaaagccacccaguggguucaagccuuugacuccaccgacgacaccccucuccccuacccaccaaaauccacuguuucccccuccacaggccacucugcccaccucuggacaugcuccggcagccggcccuguccaggguguggggcccgcuccagccccucacagccuccccgagccaggaccccagcaacagacauucgcgguuccuaggccaccgcaccagcccuuacaaaugccuaaaaugaugccagagaaccaguaucccuccgaacagcgguuucagcgccaacugucagagccuugccauccauuucccccgcagccuggcgugccaggcgacaauagacccaguuaccacaggcagaugagcgaaccuauaguccccgcagccccaccucccccacagggguucaagcaagaguaucaugauccgcuuuacgaacacggagugccugguaugcccggcccacccgcucacggguuccagucuccuaugggaaucaaacaggagccacgggacuacuguguagacuccgagguucccaacugccagucaagcuauaugcgcggcgguuacuuuaguucuucccaugaaggguucagcuaugagaaggauccucgauuguacuucgacgauaccuguguggucccggaaagacuggagggaaaagugaagcaagaaccaacuauguauagggaggggcccccuuaccagcggcguggcucgcuacagcucuggcaguuucuggugacacuucuggacgauccagccaaugcacacuucauugcuuggaccgggcgcggaauggaguuuaaguugaucgaacccgaggaagucgccagaaggugggguauucagaaaaaccggccugcgaugaauuaugacaagcucucucgaucccugcgcuacuacuaugagaaaggcaucaugcaaaagguugccggggaaagauacguguauaaauucguaugcgauccggacgcauuauuuucaauggcuuuccccgauaaccagaggccauuucugaaggccgagagugagugucaucucagcgaagaggacacgcuuccucugacucacuucgaagauucccccgcuuacuugcuagacauggaccggugcucuagccugccauaugccgagggauuugcauacuga

SEQ ID NO: 55927 - RNA, 1359 nt, Artificial Sequence
  derived and/or modified sequence opt3 from ETV6__Homo_sapiens__NP_001978
augagcgagacccccgcccagugcuccaucaagcaagaaagaauuucuuacacaccuccagagucaccggugcccaguuaugcuagcuccacuccucugcacgucccaguucccagggcacuccggauggaagaggacucuauacgccuuccugcccaucugcgauugcagccaaucuacuggucgcgugaugacguggcgcagugguuaaaaugggcugaaaacgaguucucacugagacccauugauagcaauacguuugagaugaacggcaaggcccuacuccugcuuaccaaagaagacuucagguaucggaguccucacuccggggauguacuguacgaguugcuccagcauauccugaagcaacgcaaaccaaggauucuguuuucuccguucuuucaccccggaaauagcauccauacacagccugaagugauacuccaccagaaccacgaggaggacaauuguguccagagaacuccacggcccuccguggauaacguucaucacaauccuccaaccaucgaauuacugcaucgcucacgaagucccauuacaaccaaccacagaccgagcccugaccccgagcaaaggccacuucggucuccuuuggauaauaugauccgucgccugucccccgcagaaagagcccaggguccaaggccccaccaggagaacaaucaucaggaaucauauccucuaagcgugaguccaauggagaacaaucacugcccggcuucuuccgagagccaucccaagccuucgucuccacggcaagaauccacucgagucauucagcucaugcccucaccuaucaugcacccacugauacuuaacccccgccauaguguggacuucaagcagagcagacuguccgaggauggcuugcacagggaagggaaaccgauuaaucucucucaccgggaggaccuggcauacaugaaccauaucaugguaagcguuucaccuccagaagaacacgccaugcccauuggacgcaucgcugauuguagauuacugugggacuauguguaccaacuccuuagugacuccagguacgagaacuuuauccguugggaagauaaggagagcaaaauuuuccggauagucgacccuaauggccuggcccgauugugggguaaccauaagaauagaacaaacaugaccuaugagaaaaugucuagggcgcuacgccacuacuauaagcugaauaucauucggaaggagcccgggcagagacuccuguuuagguucaugaaaacgccagaugaaaucaugucaggacgcacugaccgacuugagcaccuggagagucaggaauuggaugagcagauauaccaagaagacgagugcuga

SEQ ID NO: 55928 - RNA, 954 nt, Artificial Sequence
  derived and/or modified sequence opt3 from ETV7__Homo_sapiens__NP_001193964
augcaggagggcgaacuggccaucagccccauuuccccuguggcugcaaugccaccgcucgggacccacguccaagccagaugcgaggcgcagauaaaccuucugggagaagguggcaucuguaaguugcccgggagguuacggauucagccugcucuguggucucgcgaggacguucuacauuggcuccgaugggccgaacaggaguacucacugccaugcacagcagagcacggauucgaaaugaauggccgugcccuuuguauccugacuaaagaugacuuuagacauagggcucccaguagcggugauguguuguaugagcuccugcaauacauuaagacgcagcggcgcgcacugguaugcgggccuuucuuuggaggcaucuucagacucaaaaccccaacacagcacucccccgugccuccagaagaggucacuggcccgucucagauggacaccaggcgggggcauuuacugcaacccccugauccaggacuuacaucgaacuuuggucacuuggacgaucccggccuggcccgcuggaccccugggaaggaggaaucacuaaaucucugucacugcgcugagcugggaugucgaacucagggcgugugcagcuucccagccaugccccaggcgccgauagacgguagaaucgcagauuguaggcuucugugggacuauguuuaccaguugcuccuggauacacgguaugaaccuuacauuaaaugggaggacaaggaugccaagaucuuucguguggucgaccccaacggguuagcucgccuguggggaaaucauaaaaacagagugaauaugaccuaugaaaagaugaguagggcccuccggcacuacuacaaacuuaacauuaucaagaaagagccaggccaaaagcuguuguuccgaaauggccuacagcugauauuuauuuucaucugguccuuucaguga

SEQ ID NO: 55929 - RNA, 459 nt, Artificial Sequence
  derived and/or modified sequence opt3 from EVA1A__Homo_sapiens__NP_115557
augagacugccccucagccacuccccugagcauguggaaauggcccuucugucuaacaucuuggcugcauacucauucgucagugagaauccagaaagggccgcguuauauuuuguuagcggcgugugcauugggcugguacuaacccucgcugcccuggugauacggaucuccugucacacagacugccgccgacguccgggaaagaaauuccuucaggauagagagucuucgucagacagcagugauuccgaagacgguucugaggauacugucagcgaccuguccgugaggcggcaucgcagauuugagaggacguugaacaagaauguuuucaccucagcagaggaacucgaacgggcccaacgccuggaggagcgagaaagaauuaucagggagauuuggaugaacggccagcccgaagugccugggacacggagucugaaucguuacuauuga

SEQ ID NO: 55930 - RNA, 1326 nt, Artificial Sequence
  derived and/or modified sequence opt3 from EVA1C__Homo_sapiens__NP_478067
augcugcuccccggcagagccaggcagccuccaaccccgcaacccgugcagcacccugggcuucggcgccaggucgagccacccggacagcuguugcgauuauucuacugcacaguucugguguguagcaaggaaaucuccgcucuaacugacuuuucugguuaucucacgaaacugcuucaaaaccauaccacauacgcaugcgauggcgacuaucugaauuugcaguguccucgucacucaacuauuaguguacagagcgccuucuacgggcaggauuaucaaaugugcuccucucagaagccagcgucgcagagagaggacucacucaccuguguggcugccacaaccuuucagaaaguccuggaugaaugccaaaaccagagggcaugucaucugcucgugaauagccggguuuucggacccgacuuaugcccuggcaguuccaaguaccugcuugugucuuuuaaaugucagccaaacgaguugaagaauaagacugucugcgaagaucaagagcugaaacuacacugucaugagagcaaguuccucaacauauauuccgccacauacggucgcagaacccaggaaagggacaucugcucaaguaaagcugagcggcugccgcccuuugauugccuuagcuacucugcacugcaaguguugucccgccgauguuaugggaagcagagaugcaaaauuaucguaaauaaccaccacuucggaucaccuugucucccaggcguuaagaaguaccugacggugacuuaugccugcguccccaaaaauauuuuaaccgcuaucgacccugccauagcgaaccugaagccaagccucaaacagaaggauggcgaauacgggaucaauuuugaccccaguggaucuaaagugcuuaggaaggaugguauucugguguccaacagcuuggcagccuucgcuuauauccgggcccauccggagcgugcagcucuacuguuugucucgucuguuuguauuggccucgcccugacacuuugcgcgcuggugauccgcgaguccugugccaaagacuucagagacuugcagcucgggagggaacagcugguaccuggaucagauaagguggaggaagacagugaggaugaagaggaggaagaggaccccagcgaauccgauuuuccaggcgaguuaucugguuucugccggacuagcuacccuauauauucaaguauugaagcagcugagcuggccgagcgaaucgaacgcagagagcagauuauccaagaaaucuggaugaacuccgggcuagacaccagccuccccaggaauaugggacaguucuacuga

SEQ ID NO: 55931 - RNA, 3687 nt, Artificial Sequence
  derived and/or modified sequence opt3 from EVC2__Homo_sapiens__NP_001159608
augaucuggcccaagguggagugcugucacuucaaaaccgccgucgaagcuccucugggcaugaagcucgacaaaaagauggagguuuuuauuccacuuagcacauccgcagccucuucagggccgugggcgcauagucuguucgcuuuuauacccagcuggccuaaaaagaacuuguucaagagagaauccccaaucacucacagguuauacggagauauuucucgggaggugcaggguacgucggaaaauggcguaaucuuucaaaaaugcgcccuggugucagggagcagugaggcacagaccgcccgcauuuggcuacucgucaacaauacaaagacuaccuccucugcuaaccugagcgagcuucuguugcucgacuccaucgcaggacugacaauaugggauucagugggcaaucgaaccagugaagguuuccaggccuuuagcaaaaaguuccugcagguuggggacgcuuuugccgugucuuaugcggcaacucuccaagccggagauuuaggcaacggcgagucccugaaacuucccgcucaguugacauuccagucaagcagucguaauagaacccagcugaagguccuauuuucuaucacggccgaagagaacgugacuguacucccucaucacgggcugcaugcagcuggauucuuuauugccuuccuucuguccuugguucucaccugggcggcccuguucuuaauggugagguaccaaugucugaaggguaauaugcucacacggcaccgcgucuggcaguaugagagcaaacuugaaccacugcccuuuacuucggcagacggcgugaacgaggauuugucucuaaaugaccagaugaucgauauucuguccucagaagacccugggaguaugcuccaggcucuggaggaacuugagaucgccacccugaacagagcugaugccgacuuggaggcaugcaggacacaaauaagcaaggauauuaucgcccuccuguuaaagaaucugaccuccucuggacaccuaagcccacagguggaacggaagaugucagcugucuucaaaaagcaguuucuccugcuugagaacgaaauucaagaggaauacgaccgcaaaaugguugcguugacggcagagugugaccuggagacucgaaagaagauggaaaaucaguaucagagagagaugauggccauggaagaggcugaagaacuccugaaaagggccggcgagcggagugcaguggaaugcuccaaccuucugcguacauugcauggucucgagcaggaacaucugcgcaagagcuuagcccugcaacaggaggaggauuucgcuaaagcccacagacagcuagcaguauuucagaggaacgaacuccacucuaucuucuuuacccaaaucaagucagcgauuuucaaaggggagcugaagccggaagcugccaagaugcuuuugcagaauuacaguaaaauacaggagaacguggaagaacugauggacuuuuuccaggcaagcaagcgguaucaccucuccaaacgauuuggacaucgcgaguaccugguccaaaauuuacagucuucggaaacuagagugcagggccugcuuagcacagccgcugcccaguugacccaccucauccaaaagcaugagagggcaggcuaccuggaugaagaccagauggagaugcuacuggaacgggcucagacggagguuuucuccauuaaacaaaagcucgauaacgaccugaagcaggagaaaaagaaacuucaccagaaguugaucaccaaacgcagaagggaacuguuacagaagcaucgugagcaacggcgagaacaggccucagugggggaggcguuuagaacagucgaagaugccggacaguaucuccaccagaagaggagucugauggaggagcacggugcuacucuugaggagcugcaagaacgcuuggaccaggcagcccucgaugaccugcggacccuaacacugucucucuucgagaaagcuacugaugagcugagaaggcuucagaauagcgccaugacccaggaauugcugaagcgcggcgugcccugguuauuccuccaacagauacuggaggaacaugggaaagagauggcagcgcgagccgaacagcuugagggagaggaacgggaccgugaccaagagggcguacaguccguuagacagaggcugaaggaugacgcuccugaagccgugacagaggaacaggcagagcuacgccggugggagcaccucauuuuuaugaaacuguguucaagcgucuucucuuuguccgaagaggaacuguuaagaaugaggcaagaggugcaugguugcuuugcucagauggaucgaagucucgcccugccaaagauccgcgcacggguccuucugcagcaguuccaaaccgccuggagagaagcugaguuugugaaauuggaccaggcgguugccgcacccgagcuccagcagcaaagcaaggugaggaagucucguuccaaaucaaagaguaaaggggaacugcuaaagaaauguaucgaggauaagauucaccugugcgaggagcaggcuagcgaggaccuuguagaaaagguccgcggcgagcuccugcgggaaagagugcagaggauggaggcccaggaaggaggcuucgcccaaucguugguugcucugcaguuucagaaagcaucccgagugacugagacguuaucugccuacacagcgcuccugagcauccaagaucuucuguuggaggaacucucagcuagugagaugcugaccaaguccgccuguacucagauucuagaaucucacagccgggagcugcaggaacuugagcgcaaacucgaggaccagcugguccaacaggaagcagcccagcagcaacaggcuuuggcauccuggcagcaguggguggccgaugggccuggaauauuaaacgagccaggugaaguagacucagagagacaagugagcaccguucugcaucaggcgcucaguaagucucagacacugcuugaacaacaccagcagugccugagggaggagcagcaaaauuccgucguguuggaagaucuacuggagaacauggaagcugacaccuucgccacucucugcagccaggagcugcggcuugcaucguauuuagcccgaauggcuauggugcccggcgccacacugagacgccucuugucagucguucugccgacggcaucucagccucagcuccuggcccuucuggauagugcuaccgagaggcauguggaccacgcggccgaauccgacgggggagcagagcaagcugaugugggccgucggagaaaacaucagagcugguggcaggccuuggacgguaagcuacgcggggaucugaucucuaggggccucgaaaagauguuaugggcucgaaaaagaaagcagagcauucugaaaaagacuugucuuccccugcgggagaggaugaucuuuuccggaaaaggcucauggccacaccucaguuuggaaccuaucggggagcuggcacccguaccaauugucggagccgagacaauagaccuccugaauaccggugaaaaacuuuucaucuuucgcaaccccaaggagccugaaauuagccuacacgugccaccgcguaaaaagaaaaauuuccugaacgccaagaaagcuaugagagcguugggcauggauuga

SEQ ID NO: 55932 - RNA, 2979 nt, Artificial Sequence
  derived and/or modified sequence opt3 from EVC__Homo_sapiens__NP_714928
auggccagaggcggggcugcaugcaagagcgacgccaggcugcuccuuggacgggaugcgcugcgccccgcuccugccuuguuagcaccagccgugcugcuaggugcugcacucggccuggggcuuggacugugguugggcugucgagccggucgucagagaaccaggcaccaaaaagacgauacacagaaccuccugaagaaucuggaguccaacgcucagacuccgucugaaacggggucacccagucggcgcagaaaaagggagguccagaugagcaaggacaaagaagccguugaugagugcgaaccuccauccaauucuaacaucaccgcguucgcacucaaggccaaggugauuuaccccauaaaucaaaaauuucggccuuuagcugacggaucgucaaacccaagccugcaugagaaucuuaagcaggccguauugccccaccagccuguggaggcaaguccauccucuagccugggcucccuaucacagggcgaaaaagaugacuguaguucuagcuccucaguccauagcgcuacaagugaugaccgcuuccucucucgaacuuuucugagagugaacgccuucccggagguucuugcgugcgaauccguggaugucgaccuguguaucuauagcuugcaccucaaggaucuguuacaucuggacaccgcccucaggcaagagaaacacaugauguuuauucagaucuucaagaugugccuucuggacuugcuacccaagaaaaagucggaugacgagcuguaccagaaaauucucucuaagcaggaaaaagaucuggaggaacuugagaaggggcugcaagugaaauuguccaauacagaaaugucaggagcuggugacagugaguauaucacccucgcagauguagagaagaaggaacgggaguacagcgaacagcugauagacaacauggaggccuuuuggaaacagauggcuaauauccaacacuucuuaguugaucaguuuaaguguuccucuagcaaagcccgucagcugaugaugacucuaacagaacgcaugauugcagccgagggccuccugugcgacucacaggagcuucaggcuuuggaugcgcuggaaagaaccauggggagggcacauauggccaaggugaucgaguuccucaaacugcagguccaggaagagacgcggugucgacuugcugccauuagucacggacuggaauugcucgcaggcgaggguaagcuguccgggcgccagaaggaggaauuacugacucaacagcauaaagccuuuuggcaggaggcugaaagauucagcagggaguuugugcagcggggaaaggaccuagugaccgccucucucgcacaccaagucgagggcacagcgaaacugacucuugcucaggaagaggaacagcgcucauucuuggccgaggcacagccuaccgccgauccagaaaaguuccuggaggcuuuucacgagguucucgaaagacaaaggcugaugcagugcgacuuagaggaagaggaaaacgugcgugccacagaggcaguaguggcucugugucaggagcuuuauuucaguaccgucgacacguuucaaaaauucguggaugccuuguuucuccagacucugcccggcaugacagggcuaccuccagaagagugcgacuaccugcggcaggaaguucaggagaaugcggccuggcaacucggaaagagcaaccgauucagaaggcagcaguggaagcuguuucaggaacuuuuggagcaagaucaacagguguggauggaggaaugcgcucuguccucugucuuacagacccaucuccgcgaggaccacgaagguacuauccggggcgugcuggggagacuuggaggccugacagaggagucgaccagguguguauugcaaggucaugaucuccugcuacgcagcgcacugcgacggcucgcccugcgugggaaugcucuugccacguugacccagaugagacuguccggcaaaaagcacuuacuccaggaacugagggagcaacgcgcacuugaacagggaucaagucagugccuggacgagcaucaguggcaacuacuccgggcgcuggaagccagaguuuuggaggaggcuucuaggcuggaagaggaagcccagcagacacgauuacagcuccaacagcgccugcuugcagaggcucaggaagugggccagcuguugcaacagcacauggagugugccauagggcaggcacuccugguccacgcccggaacgcugcgacuaaaagcagagccaaggauagggacgauuucaaacguacccuaauggaggcagcuguggaauccgucuaugugacaucagccggaguuagccgccuggugcaggccuacuaccaacagauuggucggaucauggaggaccaugaagagagaaaacuucagcaccucaagacucugcaaggcgaaaggauggagaacuauaaguugcgaaagaaacaggagcugucuaaucccuccagugggagccggaccgcuggaggcgcacaugaaacaucucaggccguacaccagcgcauguuaucccaacagaagagauuucucgcgcaguucccgguccaccagcaaaugaggcugcaugcucagcagcagcaagccggugugauggaucuucuggaggcacaguuggaaacccagcuccaagaggccgagcagaacuuuauuucagaacuggcugcacuagcccggguuccucuggcggagaguaaacuucuccccgcuaagcgagggcuguuggaaaaaccauuaagaacuaagcgcaagaaaccucugccccaggagaggggcgaccucggagugccaaauaacgaagaucuggccagcggcgaccagacgucggggucccuuucuagcaagcgucugucacaacaggagagugaggcaggagacuccgguaauucuaaaaagauguugaaacggagaagcaaccuauga

SEQ ID NO: 55933 - RNA, 780 nt, Artificial Sequence
  derived and/or modified sequence opt3 from EVI2A__Homo_sapiens__NP_001003927
augcugcucagaagcugguucggcaacaaggacuuucaggcccuucccauccuggcuagguugccuuccaugccaaccgauauggagcacacagggcauuacuuacaccuggcauuccuaaugacuacgguguuuucucucucaccgggaaccaaagccaauuauacacggcugugggcgaacaguacuagcuccugggacucugucauucaaaauaagaccggucgcaaccagaaugaaaacauaaauacaaaccccaucaccccugagguugauuacaaaggcaauucgacuaacaugccagaaacaucacauauuguggcucuuaccagcaagagugagcaggaacuguauauccccuccguagugucuaauagcccuuccacgguccagucaauugagaacaccaguaaaagccacggggagaucuucaagaaggacgugugcgccgaaaauaacaauaacauggcaauguugauaugucucaucauuaucgccguucuguuucugauuugcacuuuccucuuuuuaucuacagugguccuggcuaacaaaguguccucacuucgacguagcaagcaaguaggaaaaagacagccaaggaguaauggcgauuucuuggcaucuggucuguggcccgccgaguccgacacuuggaagcggaccaaacagcuaacagggccuaaccucguuaugcagagcaccggagugcugacggcuacucgcgaaagaaaggaugaggagggcacagaaaaacuuaccaauaagcaaaucggcuga

SEQ ID NO: 55934 - RNA, 1347 nt, Artificial Sequence
  derived and/or modified sequence opt3 from EVI2B__Homo_sapiens__NP_006486
auggaccccaaguacuucauccugauucucuuuugcggccaccuuaacaauaccuucuuuagcaaaacagagacuauaacgaccgaaaagcagucccaaccuacacuguucacuucuucaaugagucagguguuggccaacagccagaauaccacagggaacccauuaggacagccgacccaauuuuccgauacuuucucuggucagucgaucucacccgcuaaagucacagcaggccagccuaccccagccguuuauacgagcagugagaagcccgaagcgcauacuuccgcugggcagccucuggccuacaauaccaaacaaccaacacccauugcaaacacuucuagccagcaggccguguuuaccuccgcuagacagcuaccuucagcaaggacaaguaccacgcaaccaccaaagagcuucguauauacuuuuacacagcagucuuccucagugcaaauccccagccggaagcagauuaccguccacaauccuaguacucagccaacaucuaccgugaaaaacagcccccgcuccacgccuggauucauccucgacaccacaucgaauaagcagacuccacagaaaaacaauuacaacucuauagccgcuauccugauuggcguucuucugaccuccauguugguggccaucauuaucauaguccucuggaagugucugcgaaaacccgugcugaaugaucaaaacugggcgggucguucaccguuugcagacggggagacaccugauauuugcauggacaauaucagagaaaacgagauuaguacuaagaggaccagcaucaucucccucacacccuggaagccaucuaaaagcaccuuacuggccgaugaccuugagauuaaguuguucgaaucaagugagaacauagaagauuccaauaacccuaaaacugagaagaucaaagaccagguaaauggaacgagcgaggauucugcugacggcucaacaguuggcaccgccgugaguagcuccgaugacgcagaccugcccccacccccuccacuacucgaucuggaagggcaggagucuaaccaaucggacaagccgacuaugaccauugucagcccccuuccuaaugauuccacaucacugccacccaguuuggacugucucaaccaggauugcggagaccauaaaucugaaaucauacagagcuuuccuccacuggauuccuuaaaucugccccucccgccuguggacuucaugaagaaccaggaggauucaaaucuugaaauucaaugucaggaguucagcaucccacccaacucugaccaggaucugaaugaguccuugccucccccgccugcugaacuacuguga

SEQ ID NO: 55935 - RNA, 2685 nt, Artificial Sequence
  derived and/or modified sequence opt3 from EVI5__Homo_sapiens__XP_011540402
augaccagcggcgccucccugaagcucacaucuggguuccccguggcuacugacaaagucgcagagaagcugucaaguacgcugagcuggguuaaaaacaccgugucccacacaguaucucagauggccucgcaaguggcgucaccuagcaccaguuugcauacuacauccucuagcaccacuuuauccacaccagcucugucaccgaguagccccucucagcuauccccugaugaccucgaacugcuugccaagcuggaggaacagaauagauugcucgagaccgauucaaaaagccugaggagugucaacggaucucggcgcaauuccgguagcucgcuggugucuuccucaagugcaagcuccaaccucucucacuuagaagaggacagcuggauccuguggggccgaauuguuaaugagugggaagaugugcguaagaagaaagagaagcaggucaaaccauuugaaugcugggugcuuuaccaucacucacaauuguguagauuccagguacauuaucugaagaggagucacacggaggagcuaguucacaaagggauaccccaucacuuucgggccaucguguggcagcuccugugcuccgcucagagcaugccuauuaaggaccaauacucugaacuucugaagaugacuucaccaugugagaaauugauccgcagagauauugcaaggaccuaucccgaacauaacuucuuuaaggagaaagacagucucggacaggaaguccuguucaaugugaugaaggccuacagcuuaguggaucgggaggucggcuauugccaggguuccgcuuuuaucguugggcugcuccuuaugcagaugccugaggaagaggccuucuguguguuuguaaaacugaugcaagacuaccgcuugcgagaacuauucaagccaucuauggcggagcugggacucugcauguaucaguuugaauguaugauacaggagcaccuuccggagcuuuucgugcacuuucaaucgcagagcuuccauacauccauguacgcaucaaguugguuccugacuaucuuuuugaccacauucccccucccuauugccaccagaaucuuugauauuuucaugucugaaggccuggagaucgucuuuagggugggcuuagcucugcuacagaugaaccaggccgaacucaugcaacuggacauggaggggaugcuucagcacuuccagaaaguuauaccacaucaguuugauggagugcccgacaaguugauucaagcagcuuaccaggucaaguauaauagcaaaaagaugaaaaagcuggaaaaagaguacacgacuaucaagacaaaggagauggaagaacagguggagauuaaacggcuccguaccgagaaccgccugcuuaagcagagaaucgagacucuggaaaaagaguccgccucauuggcggacaggcucauccaaggucagguaacacgggcccaggaagcagaggaaaauuaucugauuaagcgagaguuagcuaccauaaaacagcaaagcgaugaggccucugcuaagcuggaacaggccgagaacacgauccgcaagcuacagcaccaacagcaguggcauaaaugcuccaguaauuacaacgaagacuucguucuccagcuggagaaggaacuugugcaagcaagauugagcgaggccgagucucagugugcucugaaagaaaugcaggauaagguccucgacauugagaaaaggaauaacucccugccugaugaaaacaauaucgcgcgguuacaggaggaacugauagcagugaaacuucgcgaggccgaggcuauuaugggcuugaaggaacucagacaacaggucaaggaccuggaggaacacuggcagaggcaccuagcccguaccacagggcgguggaaggauccacccaaaaagaacgcaaugaaugagcugcaggacgagcucaugacuauccgacugagagaagccgagacccaagcugaaaucagggagauuaaacagcgcaugauggaaauggagacacagaaccaaaucaauucaaaccaucuucggagagccgagcaggaagugauuaguuugcaggagaagguucaguaucugagcgcacaaaauaaaggauuacucacucagcugucggaagcgaagaggaagcaggcugagauagaaugcaaaaacaaggaggaggugauggccguacgccuucgagaagcagauuccaucgccgcugucgccgagcugcggcagcacauugcagaauuggagauccaaaaagaagagggcaagcuccagggucagcugaauaaaucugacagcaaccaguacaucggggagcuaaaggaucaaauugcugaacugaaucaugagcuccguugucugaagggacagagaggcuuuucaggccagccgccuuucgacgggauacacaucgugaaccaccuuauuggagacgaugaaaguuuucauuccucugacgaggauuucaucgacaauagcuugcaggagaccgguguuggcuuuccccugcacgggaaauccggaucaaugagcuuagauccagccguggcggacggcagugaaucugagacagaagauuccguccucgagaccagggaaagcaaccaagugguacagaaggagcgcccuccccggagaagggagucguauucaacuacgguguga

SEQ ID NO: 55936 - RNA, 1257 nt, Artificial Sequence
  derived and/or modified sequence opt3 from EVL__Homo_sapiens__NP_057421
auggccaccagcgagcaguccaucugccaagcuagagcaucugugauggucuacgacgauacaucaaagaaauggguucccauuaagccuggccagcagggguucaguaggauaaacaucuaucacaauacugccagcaacacguuucgggugguaggagugaaacugcaggaccaacaggucgugauuaauuacuccaucguuaagggucucaaauauaaccaggcgaccccaacauuccaucaguggcgcgaugcucgacaaguguacggccuuaauuuugccucuaaggaagaggcaacuaccuucucgaacgccaugcuguuugcuuugaauauuaugaacucacaggaagggggaccgagcagucagcgucagguccaaaauggccccuccccugacgagauggauauccagagaaggcaagugauggaacagcaccagcagcagcggcaagagucuuuagagcgcagaacaagcgcaaccgguccaauacugcccccugggcauccauccucagccgcuagugcccccguaagcuguucuggaccuccaccgcccccuccacccccuguuccacccccgccuacuggcgcgacacccccaccucccccaccccuaccugcaggcggggcccagggauccucacacgacgaaagcaguaugucuggucucgcugccgcaaucgcuggcgccaagcugaggcgggugcagcgcccagaggaugcguccgggggaagcucgccgucuggcaccuccaaaucagacgccaaccgagcaaguagcggugggggaggcggcgggcuuauggaagagaugaauaagcuguuggcuaaaagaaggaaggccgcuucccagucugauaaacccgccgagaagaaggaagacgagagccaaauggaagauccuucaacgaguccaucccccggaacucgggcagccagccagccuccaaacucuucagaggcuggucguaaacccugggaacgcaguaauagcgucgagaagccgguguccucuauucucucgagaaccccuagcguggcgaaauccccagaggcaaagucaccccugcagagucagccucauucuaggaugaaacccgccggcagcgucaacgacauggcucuggaugccuucgaccucgaccggaugaagcaagaaaucuuagaggaaguugugcgagagcugcacaaaguaaaggaagagauuaucgaugcaauacgccaggagcuuuccgggauuucaacaacuuga

SEQ ID NO: 55937 - RNA, 6102 nt, Artificial Sequence
  derived and/or modified sequence opt3 from EVPL__Homo_sapiens__NP_001979
auguucaagggccugagcaaagggucccagggaaaggguucucccaaaggcagcccugccaaggggaguccaaaaggaagcccguccagacacucuagggcugcaacacaagaacucgcccuucugaucucgcggaugcaggcgaacgcugaccagguggaacgcgauauuuuggagacacagaagcgauuacaacaggaccgucugaacucagaacagagccaggcccuacaacaccagcaggaaacuggcagaagucucaaggaagcagagguacugcuuaaagaucuguuuuuggacguugauaaggccaggcggcucaaacacccccaggcugaggaaauagagaaggacaucaaacaacugcaugaacgcgugacgcaggagugcgcagaguacagagcccuguaugaaaagaugguacucccuccagaugugggucccagggucgacugggcucggguguuagagcagaagcaaaaacagguuugugccgggcaguacggaccuggcauggcggaacuggagcagcaaauugcagaacacaacauccuucagaaggagauugaugccuauggccagcaguugcgcucccugguggggccagacgcugccaccauccgaucucaauacagagaucuacucaaagcagcuagcuggaggggacagucccuggguucacuuuauacacaucugcagggcugcacucggcaguugagugcccucgcggagcaacagcgucgcauacugcagcaggacuggagcgauuuaauggccgaccccgcaggggucagaagggaauacgagcacuucaagcaacacgaacugcucucucaggagcaguccgugaaucaacuugaagacgauggagagcggaugguagagcugcgacauccugcuguuggcccaauccaggcccaccaggaggcuuugaaaauggaguggcagaacuuucuaaaucuguguauuugccaagaaacacagcuccagcauguggaggacuaucgcagauuccaggaagaggccgauucagucagccaaacacuggcaaaacuuaacaguaaucuggacgccaaauacucuccggcucccggugggccuccaggagcgcccaccgaguugcuccagcagcuggaagcagaggaaaagagguuagccgugacugagcgggcuacaggcgaucugcagcgcagauccagggacguggccccucuaccacaacgucggaaucccccgcagcagccucuccacgucgauagcaucugugacugggauucgggcgagguucaacugcuucagggggaacgauacaaguugguggacaauaccgauccccacgcauggguagugcagggaccagguggcgagacgaaaagagccccugcugccugcuuuuguauucccgcaccagaccccgacgcggucgcuagggccucucgccuggcauccgaacuccaggcccugaagcaaaaacuugcuacugugcagucacggcugaaggccagugcaguugagagcuugagaccuucccagcaggcuccaucugggagcgaucucgccaacccgcaagcgcagaaacuguuaacccagaugacaaggcuggacggagaucuaggccagaucgaacgccaagugcucgccugggcucgagcaccccugucacggccuacuccacuugaggacuuggagggucguauacauagucacgaagggaccgcccagagacugcagucccucggcacagagaaggaaaccgcucagaaggagugcgaagccuuccugagcacgaggcccgucggaccugcagcguuacaacugccaguggcccuuaauucugucaagaacaaguuuucagauguucagguguuguguagucucuauggcgagaaagcuaaggccgcacuggaccuagagcgccagauucaagaugcugaccgggucaucagaggguucgaagccacucuggugcaggaggcacccauuccggccgaaccuggagcucuccaggagagggucagcgaacugcagcgacaacgccgggagcuuuuggagcagcagacaugcgugcugagauuacauagggcgcucaaagccuccgaacacgcaugugcugcccugcagaauaacuuucaagaguucugccaggaucuuccacgucagcagcgccaaguucgggcccugaccgacagauaccaugcugugggugaucaguuggaccucagggaaaagguaguccaggaugcagcccugacuuaucaacaguuuaagaauugcaaagacaaccuaucuucguggcuggagcaccucccccgaagccaggugcggccuuccgacggccccucacagaucgcguacaagcugcaagcucagaaacgccuuacacaggagauccagaguagagaaagggaucgggccaccgcaucucacuugagccaagcccugcaggcugcauuacaggacuaugagcuccaggccgauacguaccgauguucccuggaaccaacccuugcgguuucagcuccuaagagaccccgcguggccccacugcaagagagcauucaggcacaggagaagaaccuagccaaggcuuauacagaggucgccgcagcucagcaacagcuccugcagcaauuggaguucgccaggaagaugcuggagaagaaggaguuaucugaagacauacgucggacucaugaugcgaaacagggguccgagaguccggcccaggcaggaagagaaagcgaggcucucaaggcccagcuggaggaagagaggaaacgcguggcucgaguacaacacgaacuugaggcacagagaucucagcuguugcagcuccggacccaaaggccucuggaacgccuagaggagaaggaagugguugaguuuuaccgugacccccagcuggaaggcucccuuucaagagucaaagcccagguggaggaggaagguaagcggagggccgggcuccaggcugaucuggagguggcggcacaaaaggucguucaguuggaaaguaaacgcaagacaaugcagccacaucuguuaacuaaagaggugacccaaguggaacgagaccccggccucgauagccaggccgcucagcugagaauccagauucaacagcuucggggagaggacgccguaaucucggcaaggcuggagggcuugaagaaagaacuccuggcccuagagaagcgcgaagucgaugugaaggagaaaguuguggucaaggaagugguuaaaguggagaagaaucuggagaugguaaaagcugcgcaggcccuuagacuccagauggaagaggacgcagcuaggcggaagcaagccgaagaggcagucgccaagcugcaggcucguauagaagauuuggagcgcgccauuuccucuguggagccuaaagugaucgucaaggaaguuaaaaagguggagcaggacccaggguuacugcaggaaagcucacgacucagaagucugcuugaggaggaaaggaccaaaaacgcgacccuggcacgggaguuguccgaccuacacucuaaguacagcguaguggaaaagcaacgccccaaaguccagcugcaggagagagugcacgaaaucuuccaaguugauccugagacugagcaggaaauuacgaggcucaaggccaaacugcaggagauggcuggaaagcgguccgguguggaaaaagaggucgaaaaacuuuuaccggaccuggaggugcuccgagcccagaagccaacaguugaguauaaggaagugacccaagaggucguaagacaugaacgcucacccgagguguugagggaaaucgaucggcugaaggcucagcucaaugagcugguuaacagccacggccguagucaggagcagcuuauuagacugcaaggggaaagggacgaguggcgccgggaacgagcaaaaguggagacuaagaccgucucuaaagaggugguaagacaugaaaaggauccuguguuggagaaagaagccgagaggcuacgccaggaaguccgggaggcugcccagaagagacgugcagcggaggacgccguuuacgaacugcaguccaagaggcucuuacuggagcggcgcaaaccagaagagaagguggugguccaagaagugguuguaacacagaaagaucccaaacuucgagaggagcacagcagacugucgggaucacucgacgaagaggugggcaggcggcgccaguuggaacuggagguccagcaacucagagcugguguggaagaacaggaggggcugcuuucuuuccaggaagauaggaguaaaaagcuagccguugagcgagaacugcggcaauugaccuuacguauacaggagcuggagaagagaccuccgacugugcaggagaaaaucauuauggaggaagucgugaagcucgagaaagaccccgaucuggaaaaguccacagaggcacuucgcugggaccuggaccaggagaaaacgcaaguaaccgaacucaauagggagugcaagaacuugcagguccagaucgaugugcugcagaaggcuaaaagccaagaaaagacuaucuauaaagagguuauucgggugcagaaggacagaguccuagaagaugagcgcgccagggugugggagaugcugaaucgagaacggacagcaagacaggccagggaggaagaggcucgccgucuccgggaaagaauagacagggcggagacccuuggccgcacauggucucgagaggaaagcgagcugcagcgggccagagaucaagcagaccaggaauguggaagguuacagcaagaguugcgcgcucuggagagacagaaacagcagcaaacucuccagcugcaggaagaguccaaacuucugucacagaagaccgaaagugagcggcaaaaagccgcccagaggggccaggaacucagccguuuggaggcagcuauccugcgagagaaggaucagauuuacgaaaaagagcgcacguuaagagaccuacaugccaagguuucucgggaagaacugucccaagaaacccagacaagggagacuaaccucucaaccaaaaucaguauucuugagccagaaacagggaaggauaugagcccuuaugaggcguacaaacgcggaaucauagacagaggccaguaucugcaguugcaagaacuggagugcgauugggaagaggugacuaccuccggucccuguggggaggaaucuguccuccuggaccggaagucgggaaagcaguacagcaucgaggcugcccuuaggugccgacguauuucaaaagaagaguaccaccucuauaaggauggccaucugccaaucuccgaguuugcauugcugguggccggugaaacgaaaccuaguucuagcuuauccauuggcucaaucauaucuaagagcccccuagcuaguccagcaccgcaguccaccucauucuuuucuccuucauucucccuggggcucggagacgacaguuuucccauugccggcaucuacgauaccacuacagacaauaaauguagcauuaagaccgcgguagcuaagaacaugcuugauccaaucacugggcaaaaacuguuggaggcccaggcagccaccggaggcauaguggaccugcucucgagagaacgcuauucuguucauaaggcuauggagcggggucugaucgaaaauacauccacgcagaggcuuuuaaacgcccagaaagcauucaccgggauugaggaucccgucacuaagaaaagacugagcgugggagaggcugugcaaaagggcuggaugccucgcgaaucaguccucccacacuugcagguacagcaucugacagguggccuaaucgaccccaagcggaccgggaggauuccuauccagcaagcccugcucaguggaaugauaucugaggaacuugcgcagcuguugcaggaugaguccagcuacgaaaaagaccugacagauccgauuucaaaggagcgacucaguuauaaagaggccaugggcagaugccggaaggacccacugagcggguuacuucugcuccccgcagcucuagaaggauacagguguuaucgcuccgccucuccuacugugccccguagccugagauga

SEQ ID NO: 55938 - RNA, 678 nt, Artificial Sequence
  derived and/or modified sequence opt3 from EVX1__Homo_sapiens__NP_001291449
augagaagguaccggaccgccuucacacgcgagcagaucgcucgacuggaaaaggaguuuuaucgugaaaacuacgugagcagacccaggcggugcgagcucgcagccgcgcuuaaucugccugaaacuacgauuaaagucugguuccaaaaccgcagaaugaaggacaaaaggcagcgguuggcuaugaccuggccacacccggccgaucccgcauuuuauacauacaugaugucccaugccgcugcagccggcggguuaccuuauccauuccccucucaucugccucuaccauacuauucacccguuggacucggugcugccagugcggcaagcgccgcugccuccccuuuuucuggcucgcugcgcccacuugacacuuuccgagugcugucacagccguaccccagaccugaguugcucugugcauuuaggcacccaccccuguacccugggccagcucacggacugggcgccagcgcgggugggcccugcaguugucucgccugccauuccggaccggcaaauggcuuagcuccucgggccgcugccgcaucugauuucaccugugccagcacaucccguucagacaguuuucugaccuucgcucccagcguacuuucuaaggcguccucaguggcauuggaucagcgcgaggaagucccacugacuagauga

SEQ ID NO: 55939 - RNA, 1431 nt, Artificial Sequence
  derived and/or modified sequence opt3 from EVX2__Homo_sapiens__XP_011509410
augauggagagaaucaggaaggaaaugauucugauggagcggggccuccacagccccaccgccgggaaacgcuucuccaaccuuucuaauucagcuggaaacgcagugcuggaagccuuggagaauagucagcauccugcgcgauuaagcccacgucugccguccgcuccccuacacucugcccucggugaacugccugcaaagggcaaauuugagauagacacacuuuucaaccugcaacauacugggucggagucaacggucagcagugaaaucuccucugccgcugagagcagaaagaaaccaggacacuacuccgaagcagccgcugaggccgauaugucaagugacguugaggugggcugcagcgcguugaggucucccggugggcucggagcagcccagcugaaggaaaauaacggcaagggcuaugcugaguccgggucagccgcaggaaccacaacuagcgcuagugguucuggccuggggucccuccauggaggcagcggugggucgggaggcucugccgcguuaggcggguccggaucaggugccgaucagguacggcgcuacagaaccgcauuuacaagggaacagauugcucggcuggagaaagaguucuaucgcgaaaauuacgugagucgaccuagaaggugugagcuugccgcugccuugaaccugccagaaaccacuaucaaggucugguuucaaaaucggcguaugaaagacaagcgccagagacuagcaaugagcuggccccacccugccgauccauccuucuauacauacaugaugacccacgcugcggcaacgggcucucucccguaucccuuucauagccacgugccucugcauuacuacccacacguuggggugacugccgcugccgcagccgcugccgcaucaggagcggcugccgcagccaguucccccuucgcuaccagcauuaggccucuugacacauuucgggcccugucucacccauauucacgacccgaguugcucugcaguuuccgccauccgggccuguaccaggcacccgcugccgcggccgguuuaaacagcgcugcauccgccgcugccgcagcggccgcugccgcagcugccgcaucuucggccgcugcggccggggcacccccaagcggcggauccgcuccuuguucaugccugaguugucacucuagccaguccgccgccgcugcagccgcggcugccgcagccgcucucggcucaagagggggagguggcgggggaggcggugggggcggaggcgggggagguggcgcaggggccggaggcgguagcgauuuugggugcucugcggcugcccccagguccgaaaguggcuuccuuccauauagcgcagccguccugucuaaaacugcuguguccccuccugaccaacgggaugaggccccauugacccgcuga

SEQ ID NO: 55940 - RNA, 1968 nt, Artificial Sequence
  derived and/or modified sequence opt3 from EWSR1__Homo_sapiens__NP_001156757
auggccagcaccgacuacuccacauauucucaggcugcagcccaacagggcuacucagcguauacugcucagcccacgcagggguacgcccaaaccacacaggcauauggacagcagaguuacgguacuuauggccaaccuaccgaugugagcuacacacaggcccagaccacugcuacauacgggcagaccgcauaugccacguccuacggacaaccaccgacuggcuauaccacacccacugcuccucaggccuacucucagccaguccaagguuaugggaccggagcguacgacacaaccacggcaacuguuacaaccacucaggccucguaugcugcccagucagcauacggcacacagcccgcuuacccugccuauggccaacagccagcggccaccgcacccacgagaccucaggaugggaacaagccaaccgagacaagccagccgcaaaguuccacuggagguuacaaucagcccucucugggcuaugggcagagcaacuacuccuauccucaggugccaggaucauaccccaugcaaccuguaaccgcuccacccaguuauccgccuacaagcuacucuuccacucagcccaccucauacgaccagagcaguuauucucagcaaaauacauacggccagccauccagcuauggucagcaaucgucuuacgggcagcaguccucauauggacagcaaccucccaccaguuacccaccccagacuggcagcuauucccaggccccuucucaguacagccaacagucaaguuccuacggccagcagagcucuuucaggcaagaucacccaucaaguauggggguguauggacaggaaagcgguggcuuuuccgggccgggagagaaccggucuaugucgggccccgacaaucgcggucgagggcguggcggauucgauagaggcgggaugagcaggggaggucggggcgggggacgcggcgguaugggggcuggcgaaagaggaggcuuuaacaaaccugggggaccaauggacgagggucccgaucucgaccuuggcccuccagucgaucccgacgaagauuccgacaauucagccaucuacgugcaggggcugaacgacaguguuacguuggaugacuuagcagauuucuuuaagcaaugcggaguggucaaaaugaauaagaggacaggccagccgaugauucauauauaucuggacaaagagaccgguaagccuaagggggaugccacugugucuuacgaggacccacccaccgcuaaagcggcaguagaaugguucgauggcaaggacuuucagggaagcaaacuaaagguuucccucgcccggaaaaagccucccaugaacucaaugcgcggcgggcugccaccucgagagggaagaggcaugcccccaccgcuuaggggugggccuggaggccccgguggcccagggggacccaugggccggaugggagggcguggcggugaucgcgggggauucccuccaagaggccccagggguagccggggcaauccuucugggggaggcaacgugcagcaccgagcuggggacuggcaauguccgaauccaggaugcggcaaccagaauuuugccuggcgcacagaauguaaccagugcaaggcacccaaaccugaggguuuccugccacccccuuuuccgcccccagggggagauagaggcagggguggcccugggggaaugcggggcgggcgcggaggcuugauggacagaggugggcccggaggcauguucaggggcgggcguggaggugaccggggcggguuucgaggaggcagagguauggaucgcgggggauucggcggcgggaggcggggagguccaggcgggccucccggaccacucauggagcagaugggcgguagacgcgggggaaggggcggcccggggaagauggacaaaggagaacaucgacaagagcggcgugauagaccuuauuga

SEQ ID NO: 55941 - RNA, 1866 nt, Artificial Sequence
  derived and/or modified sequence opt3 from EXD2__Homo_sapiens__NP_001180292
augagcagacagaaccugguggcccucaccgucacaacucuucugggcguugcuguagggggauucguguuguggaaggguauccaaaggcggcgccgauccaaaacgucucccgugacccagcagccucagcaaaaggucuuaggcucacgugagcugccaccgcccgaagacgaucagcuacacaguagcgcaccuagauccucuuggaaagagaggauucucaaggccaaagugguuacagugucgcaggaagcggagugggaccagauagaaccacugcuucggucagagcuggaggauuuucccgucuuggggaucgacugcgaaugggugaaucucgagggaaaggcuagcccucugagucugcuccaaauggccuccccaucuggcuuauguguacugguucgccuucccaaguugauuugcggugggaaaacucugccuagaacccuacucgauauccuggcagacggaacaauucuuaaggugggcgucggcuguagcgaagaugccuccaaacuguugcaggacuacgggcucguggugaggggaugccuggauuuacgguaucuggcuaugcgccagcgaaacaaucuccuuuguaacggucugucauugaagagucuagcagagaccguccugaauuucccacucgacaaaagccugcuucugagaugcucuaacugggaugccgagacuuugacagaagaccagguuaucuacgcugccagggaugcgcaaauauccguggcacucuuucugcauuuacugggcuauccguucucacggaauagccccggggagaagaacgacgaccacaguucuuggcguaagguacuagaaaaaugucagggaguggucgauaucccuuuucgcuccaagggcaugagcagacucggugaggaagugaauggggaggccaccgagucgcagcaaaaaccaaggaacaagaaaucuaagauggacggaaugguucccggcaaucaucagggccgggauccucgaaaacacaagcgcaagccacugggggugggauacuccgcuagaaaaucaccccuuuaugacaacugcuucuugcaugccccggauggucagccucuguguacgugcgacaggcggaaggcacagugguaccucgauaaaggcauuggggaacuggucagugaggaacccuuugugguaaaacuucgcuucgagccagcuggaagaccugaaagccccggcgacuauuaccugaugguuaaggagaauuuguguguggucugcgguaagagggauuccuacauccguaagaacgugauuccacacgaguaucggaaacacuuucccaucgaaaugaaggaccauaauucucacgauguccuccuguuaugcacuagcugucaugccauaucaaacuacuaugacaaccaccugaaacaacagcuagcgaaggaguuccaggccccuauugggagugaagagggccuccgacugcuugaagacccagagagacgccaggugagguccggagcacgggcuuugcugaaugccgagagccucccgacccaaagaaaagaggaacuguuacaggcucugagggaauuuuacaacacagauguugugacugaggagaugcuucaggaagccgcaucuuuggagacccgcaucucaaaugaaaacuauguaccccacggccucaaggucgugcagugccauagucaagggggacugcgaagccuaaugcagcuggagucccgguggcgucagcacuuccucgacucuaugcagccuaagcaucugccacaacaguggucgguugaucacaaucaucagaaacuuuugagaaaguuuggugaagaccugcccauucaauuaagcuga

SEQ ID NO: 55942 - RNA, 2631 nt, Artificial Sequence
  derived and/or modified sequence opt3 from EXD3__Homo_sapiens__NP_060290
auggaccccggcgauccugccggggacccagcugcaggagagagacacaggaugggucgggauccgcugcuccuucugcaggccuugcaaaccuuauggagcacacgcgaacgaaagcagcugcgugaggaagcguggagaggcuucgcugcccuagacgauccccucgcagggcugcuugacaugcuggaguccugcaggggacagcggggcgaagguccuucuuuggccgcuuggaucucacaucagcuccaauguuggcugcaggcacagccaugccccagucuggcccagcacagccuccgcuuaaaacaacugcaggcuagagccgugaagguccuuacugaguccccuccaucuuuggcggcaccccuggccucgauuuuucagcuacaggaugcugacaggucaugucuccuggcccauguucaccggcuucaucacgaggggcgcuuccgagaagcagcuacgcugggagccaccuugaaacuccaaagcgagcugggcguggaaaagaugaguauaccuuuacugcuccaggauaaaguagcgcuuguggagagauacgucgccggcuuuccagaccugcagaggcgguugcuagugcugauggauuccuggugccaaccgggguucgacaucaaggauguugcacgucgcuaucccgaggugacaucucucagccuggaaaaacuuuccccuaaggcucugucaagacaggucuugaggcuccaggagcgguacggaguggccccagcucugugucccaacgccgcaauucagcaacgauuagccgcucugcgccaccuaugccauaagagauuuguagagaaaagucucagccaggagaauuggacugaccacguucagggucuggugggccagucuccuuggcuucaagaacaguugucccagcugcucgucucacauagcgacccagugaccgcggcacagugugccauggagcugcuucugcccgaggaaagguugccggcugccguggcagucgagcuccggcgcuucagacugcaagggagggccacagaagcugauagucguuuagagguuaaggacaugaaagaucgguauuaccagcugccuaucccccgagaaaacgugcaccuacucgccucuugggaggaccugaccagacacgagggagcacuuuugcagugccaucagguagugggcgucgauguggaauggacuccaguuuuuguggcgggugggaggccucgccccucccugcuccaagucgcuguggagggacacguauuccuguuagacguucuggcccuuagccagccacccacaggccagggcgcacaagccuuuucgcgguugguggcucagcuccugucugauccuuccauuaccaagcuaggguauggaauggucggugaccugcagaagcucggcacgucauguccagcccuggcacauguggaaaaacagauccuugggggaauggauuugcuguuaguccacagacaaaugaggguggcuaguguuccggcccccgcgguggaccgcgcccgagagcuccggggccugagccuucugguacagcaggucuuggguacugcucucgauaagacccagcaacuguccaauugggaccguagaccucuaugcgaagaacaggugauauacgcagccgcugacgccuauugucugcucgagguucaucaggcacugugcagggaaccagcgcgcuuccaccuuucugaggauuuggccgggagccggagacccaggcaccgagaacgcccuggcgcucggaaaccacccggacugcagaaggccucagcaccggcugccccuagacaagugccagucgcaguggccguaagugagggcgcugcgccccagaucccugccagggcauuucgugugguuugcgacaacauguuacaggggcucgcucgcucccugcggugucuuggagucgaugccagaaugcuggguaauggcgaggaccauaggcgagccgcugaaguggcacggcaagaggggcgcauuauccuaacaagcggacagcccuuccacaaacucagagcccaggugggcgcggguaggugccugucugucgauuguucauugaaggcucagcaacaggccaaagcaguucugaagcauuuuaacgugcgggugacucacgccgacauuuucagucgaugccaggcuuguaauugcgaucaguacuuaaagguaagcagagacaugaugaaacaacucauguggcuguccucucaccaggaagggccacgcucgagcggcgaugaggcaacccagucccaggccguccaagaaccuggacccgcgccagacgcugccccggagggcuguacauacgauaggccuugccguuggcuucagauggcagaccugcgggccgagacccccgauauguuggcugacgggacgagacuccagcuggccggagugccaguuggugugcuaaggacucccggccugcgcuguuucuauugcuguacagggugcggaaaggucuuuugggacggcucacaucuuggucgaguggcaacccacuucagagauaugcucgaaagugcuccuucuccaugcgagcccagcccugccccguccccagcgucaagccccuuuuga

SEQ ID NO: 55943 - RNA, 2412 nt, Artificial Sequence
  derived and/or modified sequence opt3 from EXO1__Homo_sapiens__NP_003677
augggcauccaggggcugcuccaauucauuaaggaggccagcgaacccauacacgugagaaaauacaagggacaggucguugcuguggacaccuauugcuggcuucauaaaggugcaaucgccugugcggagaagcuggcuaaaggcgaaccuacagauagguacguaggguuuugcaugaaguucgugaacauguuguuaucccacggaauuaagccaauccuggucuuugacggcuguacucuaccgucuaaaaaggagguggaacggucacgccgagagcguagacaggccaaucuccugaaagguaagcagcuucugagggaggggaaaguuagugaagcacgggagugcuucacgcgcagcauuaacaucacccaugccauggcucacaaggugauaaaggcagccagaucccaaggagucgauuguuugguggcucccuaugaagccgacgcgcagcucgcauaccugaauaaagccggcaucguacaggcuauuaucacagaggauucugaccugcucgccuuuggcugcaagaaaguuauuuuaaagauggaucaguucgggaacggacuggagaucgaccaagcaaggcuugguaugugucggcaguugggcgauguguuuacugaagagaaauuccgcuauaugugcauacugucggggugugacuaccuaucaagccuccgaggaauuggccuggcuaaggccugcaaaguccuuagacuggcgaauaacccugauaucgugaaggugauuaagaaaaucggucauuauuugaagaugaauaucaccgucccagaagacuacauuaacggguuuauaagggccaauaacacauuccucuaccagcugguuuuugaucccaucaaacggaaguuaauuccucugaaugcauaugaggacgacguggauccagaaacccucaguuacgcuggacaguauguagacgauuccaucgcccuucaaauagcucugggcaacaaagacauuaauacuuucgagcagaucgaugacuacaaccccgauacagccaugccugcacacucucguagccacuccugggacgauaagaccugucagaagucagccaaugugaguagcaucuggcaucgcaacuauucuccaagaccggaguccggcacggucucagacgcuccccaauugaaagaaaacccuagcacuguggggguugagagggugauuaguaccaagggacuaaaucugccacggaaaucuuccaucgucaagcgaccccgcagcgcggaacucucggaggaugaccugcuuucucaguacucccugucauuuaccaaaaagacuaagaaaaacaguagcgaagguaauaaguccuugucuuucagcgagguguucguaccugaccucguuaacggcccaaccaauaaaaagucagugaguacacccccgagaaccaggaacaaauuugcaacguuccugcagcggaagaaugaggaauccggggccgucguggucccuggaacucgcagcagauuuuucuguucuucagauaguacagacugcgugagcaacaagguuuccauucagcccuuagaugagaccgcugugacugacaaagaaaauaaccugcacgagucugaauauggcgaucaagaggguaagaggcuaguagacacagaugucgcccguaauucgagcgacgauauaccaaacaaucauaucccuggggaccacauucccgauaaagcaaccguguuuacggacgaggaauccuacucauucgagaguucuaaguuuacccggacaaucagcccacccacucucggcacccugcgauccugcuucucauggagcggaggccuuggggauuuuucuagaacaccuuccccaaguccgagcacugccuugcagcaguucaggcgcaaaucugacucccccaccucacugccugaaaacaauaugagugacguuagccagcucaagucggaggaguccucugaugacgaaagccacccacugcgggaggaggcuugcucaagucaaucccaggaaucuggagaauuuagccuucaguccucaaacgccagcaaacugagucaguguucuuccaaggauagcgacucggaggagucagauugcaacaucaaguugcucgacucucaaagugaucagacauccaaacugagauuaagccauuucucuaagaaagacacaccccugaggaauaaggugccuggucuauacaaaagcuccucagcagauagucucagcacuacgaagauuaagccacugggccccgcgcgcgcuucugggcuuuccaaaaagccggccucaauacagaaacgaaagcaccauaacgcagaaaauaaaccuggauugcagaucaagcugaacgagcucuggaagaauuuuggcuucaaaaaguucuga

SEQ ID NO: 55944 - RNA, 2685 nt, Artificial Sequence
  derived and/or modified sequence opt3 from EXOC1__Homo_sapiens__NP_001020095
augaccgccaucaagcacgcucugcagagagacauuuucacacccaacgaugagaggcuccuuagcauagugaaugucugcaaagcaggcaagaaaaagaaaaacuguuuucugugcgccacuguuacgaccgaacggccugugcaaguaaagguggucaaggugaaaaaguccgacaaaggggauuucuacaagcgccagaucgcgugggcuuugcgagacuuagccguuguggaugcaaaagacgccauuaaggagaauccagaauuugaucugcauuucgagaagaucuauaaaugggucgcuucuucaacagcagaaaagaacgccuuuauuaguuguaucuggaaacuaaaucagcguuaccucagaaagaaaauagacuucgugaacguaagcucccagcugcuugaggagucuguuccgucgggagaaaaucaaucagugacugguggcgaugaggaagucguggacgaguaucaggagcugaacgcuagggaagaacaggauaucgaaauuaugauggaggggugcgaauacgccaucagcaaugcggaggcauuugccgagaaguugagucgggaacuccaggugcuggacggagcuaacauucaauccaucauggccucugagaaacaggucaauauacugaugaagcucuuagaugaagcacugaaggagguugaccagauugaacuuaaauugagcuccuaugaggagaugcugcagucagugaaggaacaaauggaccagaucagugagagcaaccaccuaauucaucucucuaauaccaacaauguaaaacugcuuuccgaaaucgaguuccuggugaaccacauggauuuggcuaagggccauaucaaagcccuccaggaaggugaccuggcgucaagccgcgggauugaggccuguacaaacgcagcugaugccuuacugcaaugcaugaaugucgcucucagacccggacacgaccuucuguuggccgugaagcagcagcagcaaagguuuagugaucuacgggagcuguucgcacgccgacucgccucucaccugaacaauguuuuugugcagcagggccaugaccaguccagcacccuugcucaacacucggucgaacugacuuugccuaaccaucacccauuccacagagaucuccugagguacgcgaaguuaauggaguggcugaaaucuacagacuauggcaaguacgaagggcuaaccaaaaauuacauggauuaucucucccggcuguacgagcgugagauaaaggacuuuuucgaaguggcaaaaaucaagaugacgggaacuaccaaggagagcaaaaaguucgccacacuuccccgcaaagaaagugcuguaaagcaggagacugaaucauugcaugguuccucuggcaaacugaccgggagcacaucaagucucaacaagcuguccguucagagcucuggaaauagaaggucacagaguagcucccuucuggauaugggcaacaugucugccucggacuuggacguggcagaucggaccaaguuugacaaaauuuucgagcaaguccucagcgagcuggaaccuuuaugucuggccgagcaggauuuuaucuccaaguucuuuaaacuacagcagcaccaaucaaugccagguacgauggcugaagccgaggaccucgaugggggaacucugagucgacagcauaauugcggcacaccccuuccugugucuagcgaaaaggacaugauacgccagaugaugauuaaaaucuucagauguaucgagccagaguugaacaaucugauugcacucggcgauaagaucgacuccuuuaacucacuguauauguuagucaaaaugagccaccauguguggaccgcgcaaaauguugauccggcuucuuuccuguccacuacacuugggaacguguugguaaccgucaagaggaauuuugacaagugcauuaguaaccagauacggcagauggaagaggugaaaaucagcaagaaaucuaagguugggauucuccccuucguggccgaauuugaggaguucgcaggucuggccgaguccaucuuuaaaaacgcugagcgcagaggcgaucuagacaaggccuacacgaagcugaucaggggagucuucgugaauguagaaaaaguggcaaacgagucacagaagaccccucgugauguugucaugauggaaaauuuccaccacauuuuugcuacacucagucggcugaaaauaagcugucuugaggccgagaagaaagaagcgaagcaaaaguauacugaccauuugcagucguacgugaucuauucccugggacagccauuagagaaacucaaccacuucuuugaaggcguggaggcccgagucgcucaggguauuagagaagaggagguuucuuaccaacuggcauucaauaagcaggaacuuaggaaagugaucaaggaguaccccgggaaagaagugaagaagggccuggacaacuuguauaaaaagguagauaaacaucucugcgaggaagagaaucugcuacaggucguguggcacagcaugcaggacgaguuuauucgccaauacaagcacuucgaaggacugaucgcccggugcuauccuggcucagggguuaccauggaguuuacaauacaggauauccucgacuacuguaguuccauugcucagucucauuga

SEQ ID NO: 55945 - RNA, 2775 nt, Artificial Sequence
  derived and/or modified sequence opt3 from EXOC2__Homo_sapiens__NP_060773
augagcagauccaggcagcccccucuggugaccggcaucucuccaaacgaggggauuccguggacaaaggucacuauacggggagaaaaucucgguacgggccccaccgaccuuaucgggcugacaauuugcggacacaacuguuuguuaacugccgaguggaugucagcuaguaaaaucguuugccgcgugggccaagcaaagaaugauaaaggugacauuaucguaaccacaaagagcgggggacgaggcaccuccacugugucuuucaaacugcuaaagccugaaaagauaggcauccucgaucagucggccgucuggguggacgagaugaacuacuaugauaugcguacagacagaaauaaagggauuccaccccugucacuuaggccugcgaacccacugggaaucgaaauugaaaagagcaaauuuagucagaaggauuuggagaugcuguuccaugguauguccgcugacuuuaccucugaaaauuucagcgccgcaugguaccucaucgagaaccacuccaauacgucauuugaacagcugaaaauggccguuacuaaccucaagcggcaagcuaauaagaaaagugagggcagcuuagcauaugugaaagggggacugucuaccuucuuugaggcccaggaugcucuuuccgccauacaucagaaauuggaagcggacggcacagagaaggucgaagguucaaugacucagaaacuggagaacgugcuaaaucgcgcaagcaacaccgccgauacacucuuccaagaaguacuggggagaaaggacaaagcugauaguaccaggaaugcccuuaacguucugcagcgguuuaaguucuuguuuaaccucccccugaauauugagcgcaacauccagaagggagacuacgacguggucauuaaugauuaugagaaagcaaagucuuuauucggcaaaacggaaguccagguguuuaagaaauacuaugcugagguggaaacucgaaucgaggcccugagagaacuccuucuggacaaguugcuagagacaccuuccacccugcacgaucaaaagagguacauccgguaccucagcgaccugcaugcgucgggcgauccagccuggcaguguauuggggcacagcacaaauggauacuucaacugaugcacucuugcaaggagggauauguuaaagacuugaaggguaacccgggccuccauucccccaugcuggauuuagacaaugauacucguccuucagugcuggggcaccuaagucagacagcuagccucaaacgcggauccucuuuccagagcggcagagacgauaccuggagguacaagacgccacaucggguagccuucguggaaaagcugaccaaacuugucuugucacagcugcccaacuuuuggaagcucuggaucaguuaugugaaugguucccuguucagcgagacagcugaaaaaucugggcaaauugagcgaucaaagaacguucgccagagacagaaugacuuuaaaaagaugauccaggaagugaugcacagucuugucaagcugacuaggggcgccuugcucccucugagcauacgggacggagaggcaaaacaauacggcgggugggaggugaagugugaauuauccggacaguggcuggcccacgcuauucagaccguacgccuaacacaugagucucucacugcgcuggaaaucccaaacgaucuuuugcagaccauccaagaccugauucucgaucugagaguuaggugcgugauggcaacauuacagcacaccgccgaggagaucaaacgucuggcugaaaaggaggacuggauugucgauaaugaaggucuuacuucguugcccugucaguucgagcagugcauaguguguagccuccaaucccugaaaggcguccuagaaugcaagccgggggaggccucaguguuucagcagccuaaaacgcaagaggaaguuugucagcugaguaucaacauuaugcaaguguucaucuauugccucgagcagcugucuacaaagcccgacgcagauaucgacaccacucaucuuagcguagaugucuccucaccagacuuguuuggaagcauucacgaagauuucucucugaccuccgagcagcgguuacucauagugcugaguaauugcuguuaccuugaacgacauacauuucugaacaucgccgagcacuucgagaagcacaauuuucagggcauugaaaagaucacccagguuagcauggcuucuuugaaggagcucgaccagagacuguucgaaaacuauauugagcuaaaagccgauccuaucguggguucccuggaacccgggauauacgcaggcuacuuugacuggaaggacugccucccacccacuggagucaggaacuaucugaaagaggcgcuugugaauaucauugcuguacaugccgagguguucacaaucucaaaggaauugguuccucgcguccugaguaaggugauugaggcagugagcgaagaguuaucgcggcucaugcaaugugucuccucuuucagcaaaaacggcgcccugcaggcuagacuugagaucugcgcccugagggauacgguugcaguguaccuaaccccagaaucaaagaguuccuuuaaacaggcucucgaggcccugccgcaguugucuagcggggcggacaagaaacuguuagaggagcuccugaauaaguucaaguccucaaugcaccuucaacugacuuguuuucaggccgcuagcaguacaaugaugaaaaccuga

SEQ ID NO: 55946 - RNA, 2241 nt, Artificial Sequence
  derived and/or modified sequence opt3 from EXOC3L1__Homo_sapiens__NP_848611
auggacagcgccgcuaaggaugagaugcagcccgcacuguccccuggcccagaauggccggagcaagaaagagccgagcagcucgcgaggggagcugcccuuaaaugggcaucugggaucuucuaccggcccgaacagcuggcccgcuugggucaguaucgaucacgugaggugcaaagaaccugcaguuuagagagcaggcugaaguccgucaugcagucuuaccuagaaggcguucagacagggguguggcagcucgcucaagcaauugagguagugcagggaacucgggaagcccugucgcaggcucgcggccuucugcaggguaugucacaagccuugcagacgcucgagccucugagagagagggucgcgcagcacaaacaacugcaggcacucagccauuuacugccacggcuucgcgccgugcccgcugccguuagucacacccagacauugauagacgggcagcaauuucuggaagcauaugugucccuacgagagcucgaacagcugagagaggauacuugggcuccucuuggaggccuggaauugccagucuuccagggccucgaccuguuauuugaggcccuggggcaggcgguggaggccgcagcuggagccgcugguaagcucgccagggaagaucccgcacuucugguagccgcuguucggguggcggaggucgaaaccggccguacaaccccuuuggggcaagugccacgcgacuggagacagaggugucuacgggcacugcaggagggacucgaacaggcccauuucggcucuccgcugcuucccgcuccuggugcccugccagggugguuggaggcacuccgaguggcccugcccgucgaguuagcuacugccgaagcacugguugcgccuugcuguccaccccaauacaacgugguacagcuaugggcucacacacuccauagcggacugcgcagaucccuucagaauuugcuggccggcccggagcucgaagcagccgaugcuuuugcccugcuucacugggcacugcacguguauuugggccaggagaugauggggucacucgaacugggaccugaggcugacgucagucaauuagagccccugcuaacccucgaaaacaucgagcagcuggaagccacguucguggcgaauauucaggccagcguuucucaauggcuucagaacgcuuuggauggugagguggcagaguggggcagggaacaugggccaaauacugacccuuccggaucauacuauagccccaugccagccaucguccugcagauucucgaggaaaacauccggguggcuagucugguaucugaguccuuacagcaacgcguucacggcauggcccugagcgaacuugguaccuuuuugagaucguucucugaugcacucauaagguuuucccgugaccauuuccgggggaaaucaauggcgccccacuacgugccuuaccugcuagccgcucugaaucacaagagugcccucagcuccucugucagcgugcugcagcuugauggcgcaccaucaggagcuuuggccccggucgaggcagcccuggacgaguuacagcgaagaaucuauaggcucgugcuggaagcgcuucaggcugagcugcaacccuuguuugccgaccucccuagucgccaguggcuguccagcccagaacuacugcagucuguuugcgagcggacaggcagauucuguagggauuuuuggcgcgugcgaaaccccacuguacagcuccugcuugcagaagcugagcgggccgucguguugcaauaccugucagccuuaaugcaggggcgucucguuugcagaggagcugacgagaggacccaggcagccgaacgccugcggcaugaugcggcucaacuucagcagcuguuccuaagucucggucuggaggaaaaugcccacugugcaccuguguugcuggccuuaagagagcuccugaaccuuagggacccagcucuguugggccucgaagucgcagggcugcgacagcaauuccccgaugugagcgaggaccauguauccgcccuacugggacuucgcggcgaucucucucgggagcagcaccuggcggcuuugucgagccugcaggccgcauuaccgccuuccccaagagccucaaggcgugugcucuuuagucugguucccgcuccugcccuugcacccgcuucuugccugccaagcgguuccugugcccgcgcguugcuccuggccgaauga

SEQ ID NO: 55947 - RNA, 1230 nt, Artificial Sequence
  derived and/or modified sequence opt3 from EXOC3L2__Homo_sapiens__NP_612635
auggccgcucuggagaacggcgaacucgggccccuucugagcccuggaaccuugagagguuuagaggacgaaugcgugacagaugucaaggcacagacuagggccgcgcugcuacggguucuccaagaggacgaggaacacuggggcucccuggaggaucagccaucuucacuugcucaggacgugugugaacuguuggaggaacauacggagcgcgccccgcgaaucagucaggaguucggggaacguauggcacacugcugucucggaggccuggccgaguuucugcagagcuuccaacagagaguagaaagguuucaugagaaucccgcugugcgggaaaugcucccugauaccuacauuuccaaaacaauagcauuagucaacugcgguccaccccugcgcgcccuugcugagagauuggccaggguggggccuccagagucugaacccgcgcgggaggcaucggccucagcucuggaccacguuacucgccuaugucaucgaguggucgccaaucuccuguuccaggaacuucaaccucacuuuaacaagcugaugagaaggaaaugguugagcaguccagaggcacucgauggaaucgugggcacccugggcgcucaggccuuagcgcugcggcguaugcaggacgaaccguaucaggcccucguagcagagcuucaccgcagagcucugguugaguacgugaggcccuugcuacgggggcgacugcgcugcuccucugccagaacaaggagccgggucgcuggacgccucagagaagaugccgcacaacugcagaggcuuuuccgucggcuggagucccaggccucaugguuggacgcuguggugccucaucucgcggaagucaugcaacuggaggauaccccaaguauucagguugaaguggguguauuagugcgagacuaucccgauaucagacagaagcacgucgcagcccugcuagacauuaggggccuccgcaauacugcugcccggcaggagauccuggcaguggccagagaccuugaguugagcgaagagggggcucugucuccuccaagggaucgcgccuuuuucgcagacauacccguuccgcgaccuuccuuuugucucucacugccccuuuuccugggacgguugccacucagccgucuggcgagaccuaguuuagcuugccugcccaggccacggcccccuucucuagcccgcccaagagcacaaagguga

SEQ ID NO: 55948 - RNA, 1422 nt, Artificial Sequence
  derived and/or modified sequence opt3 from EXOC4__Homo_sapiens__NP_001032203
auggccgcugaggcagccggcgggaaguacagaagcaccguguccaaaucuaaggacccaucaggacugcucaucagugucauuaggacacuuagcacuuccgaugacguugaagaucgggagaacgaaaaaggucgccuggaggaagcguaugagaagugcgaccgagauuuggacgaguuaauagugcagcacuacacggaacugaccacagcuauccguacuuaucaaucuauuaccgagagaaucacaaauucgaggaacaaaauuaagcagguaaaggaaaaucuacucucauguaaaaugcugcuucauugcaagcgggaugagcugcgcaaauuguggaucgagggcauagaacacaagcaugugcucaaccugcuggacgagaucgaaaauauuaaacaggucccucagaagcucgagcaauguauggccagcaagcacuacuuaagugcaaccgauaugcugguguccgccguugaaucucuugaggggccauugcuacagguggagggacugagcgaccucagacuggaacuucauuccaaaaagaugaaccugcacuugguccucaucgaugagcugcacaggcauuuauauauuaaaucaacaagucgggugguacagcgcaauaaggaaaaaggcaagaucagcucucugguuaaagacgcuuccgugccgcucauagaugucacuaaccuucccaccccucgaaaguuccuggacacgucacacuacagcacugcagguaguucuuccgugagagagauuaauuugcaggacaucaaggaagaucuagagcuggacccagaggaaaacagcacccucuuuauggggauucugaucaaaggacuugccaagcugaaaaagauccccgagacagugaaagcuauuauagaaagguuggagcaagaacucaagcagaucgucaagcggucgacuacccagguugccgauucuggcuaucagcguggcgagaaugugacaguagagaaccaaccucgccuguuacuggaacuacucgagcugcuuuucgacaaauuuaaugcgguggcagccgcucauuccgucguguugggguaccugcaggauaccguugugacgccacucacucagcaagaagacauuaagcuguacgauauggccgacgucugggugaaaauccaggauguacuucagaugcuguugacagaguaucucgacaugaagaacaccagaacugcaucagagcccagugcucagcugagcuacgccuccacaggaagggaguucgcggccuuuuucgcuaaaaagaagccucaacggcccaaaaauucuuuauuuaaguucgaaagcucaagucacgcaauauccaugagcgccuaucugcgagaacagcgcagagagcuauacucuaggucaggugaacuccagggcuga

SEQ ID NO: 55949 - RNA, 2127 nt, Artificial Sequence
  derived and/or modified sequence opt3 from EXOC5__Homo_sapiens__NP_006535
auggccaccacagcugagcuguucgaagaacccuuuguggcagacgaauacaucgagagacucgucuggaggacuccuggcgggggaagccgggguggcccagaagccuucgauccgaagcgccuucuggaggaguuuguuaaccacauucaggaauugcaaauaauggacgagcgaauccagcguaaaguggaaaaguuagagcagcagugccaaaaagaggcgaaggaguucgcuaaaaagguacaggagcugcagaaguccaaucagguggccuuucaacauuuccaggaacuagaugagcacauuucuuaugucgcaacgaaagugugucaucucggggaccagcuggaaggaguuaacacccccagacagagggccguggaggcucaaaaacuuaugaaauacuuuaaugaguuccuggauggcgaauugaagucagacgucuuuacaaacagugagaaaaucaaggaagcagccgauauuauccagaagcuccaccugauagcucaggagcugccuuucgaccgguuuagcgaagugaaauccaagaucgccucuaaauaucaugaucucgagugccaauuaauucaggaguucacuucggcgcagcgcagaggugaaaucucaaggaugcgggagguagcagccguucugcuucacuuuaagggguacagccacuguguggacgucuauauuaaacagugccaagaaggagcuuacuugcgcaaugauaucuucgaggacgccggcauacugugucagcgagugaacaaacaggugggcgauauuuucaguaauccagaaaccguccuagcaaagcucauccagaacguuuuugagauuaagcugcaauccuucgugaaggagcagcuugaagagugcagaaaaucugacgcugaacaguaucugaagaauuuguacgaccucuacacaaggaccacuaaccugagcuccaaauuaauggaguuuaaucuggggacagauaagcagaccuuccucucaaaacuuaucaagaguaucuuuauuagcuaucuggagaacuacauagaaguagagacgggauauuugaagucucgguccgccaugauccuacaacguuacuaugacucaaagaaucaucagaagcgcagcauugguacuggcgggauccaggaucugaaagaaagaauaaggcagcggaccaaccucccccugggaccuaguauugacacacacggcgagacuuuccuuucucaagaaguggucgugaaucuguugcaggagaccaagcaggcguuugagcgaugucaucgccucuccgauccaagcgaccugcccagaaacgccuucaggaucuuuacaaucuuaguugaguuccugugcauugaacacaucgauuacgcacuagaaaccggucucgcugggauuccuucgucugacucccggaacgccaaucuguauuuucuugaugugguccaacaggcuaacacgauauuccacuuguuugacaaacaguucaaugaucaucugaugccacucaucucaaguagcccgaagcuguccgagugucuucagaagaaaaaggaaauuaucgagcaaauggagaugaaacuggacacuggaaucgaccgcacauugaacugcaugauuggccagaugaagcacauacucgccgcagaacagaaaaagaccgauuucaagcccgaggacgaaaauaacgugcugauccaguacacuaaugccuguguaaaaguuugcgcuuacgugagaaagcaagucgagaaaauuaagaacucuauggauggcaaaaauguggacacagucuuaauggaacugggggugagguuucaucgucuaaucuaugagcaccuccagcaguacagcuauucaugcaugggagguaugcuggcgauuugugauguugcagaguaccggaagugcgccaaagacuucaagaucccuauggugcuucauuuguuugauacccugcacgcucucuguaaccuguuaguagucgccccagacaaucugaaacaggugugcaguggcgaacaacuugcaaacuuggauaagaauauacuccacuccuucguucagcugcgagccgacuauagaagcgcuaggcuagcccgccauuuuucuuga

SEQ ID NO: 55950 - RNA, 2055 nt, Artificial Sequence
  derived and/or modified sequence opt3 from EXOC7__Homo_sapiens__NP_001013861
augauucccccucaggaggccagcgcuagaaggcgggaaaucgaggacaagcugaaacaagaagaggaaacacucuccuucauacgcgauucucuugagaagucagaccagcugacuaaaaacauggugaguaucuugagcuccuuugagucucgauuaaugaagcuggaaaauucgauuaucccaguccacaaacagacugagaaccuacagcgucuccaagaaaauguugagaagacgcugucaugccuugaucaugugauuagcuacuaucacguagcaagugacaccgagaagaucauaagagaaggcccgacagggaggcuggaggaauacuugggauccauggccaaaauccagaaggcgguggaguauuuccaggauaacucucccgacagcccugaacucaauaaagucaagcugcuguuugagcgggguaaagaggcucucgaauccgaguuccgcucauuaaugacuagacauaguaaggugguuagcccagugcugauucuugauuugaucucuggcgacgaugaccuggaagcccaggaggaugucacccuagaacaccuccccgaguccgugcugcaagacguaauuaggaucucacgguggcuuguugaguacgggcgcaaccaggauuuuaugaauguguauuaccagauacgaagcagucagcuggacagaucuauuaagggauugaaagaacauuuccacaaguccagcucgucuuccggcgucccuuauucaccagcaauccccaacaaaaggaaggacacaccuaccaaaaagccagugaaacggccggguacuauucguaaggcccaaaaucuccugaagcaguacagucagcacggguuagauggcaaaaagggaggcagcaaccugaucccccucgaggggcgcgacgauaugcuugacguggaaacagaugcuuacauccauugugucuccgcauuuguuaaacuggcccaaucugaguaucaguugcuagcugacauuauaccugaacaccaucagaagaaaaccuucgauagccugauccaggacgcccucgauggacugaugcuugagggugagaauauugugucagcggcaagaaaggccaucguaaggcacgacuuuaguacggugcugacugucuucccaauauugcggcaccucaagcaaaccaaacccgaauuugaucaggugcugcagggcacagcugccuccacuaagaacaaauuaccugggcugauuaccagcauggagacaaucggagcaaaggcucuagaagacuucgccgacaauaucaaaaacgauccagacaaggaguacaauaugcccaaggauggcaccguucaugagcucacgucuaacgcgauucuguuucuucagcaauugcuggacuuccaggaaacugccggugcaaugcucgcuucacaggagacaaguagcuccgccaccucuuauucgagcgaguucuccaaacgacugcuuucaacuuacaucugcaaggugcuggggaacuugcagcucaaucuguuaaguaaaucuaaggucuaugaagauccggcucugagcgccauuuuucuacacaacaauuacaacuauauacucaaaucccuggaaaagucagagcuuauccaauugguggcaguaacacagaagaccgccgagcgcagcuacagagaacauauugagcagcagauccaaacguaccagaggucuuggcugaaaguuaccgacuauaucgcugaaaagaaucucccuguguuccagcccggagucaaacugcgggauaaggagcgccaaauuauaaaagaaagauuuaagggcuucaacgacggcuuagaggagcuguguaaaauccagaaggcgugggcaauuccagauacagaacagagggaccguauccggcaggcccaaaagacuauugugaaagagaccuacggggcuuuucuucagaaguucggauccgucccuuuuaccaaaaaucccgaaaaguauaucaaauacgguguggagcagguuggcgauaugauagaccgauuguucgauacaagugccuga

SEQ ID NO: 55951 - RNA, 957 nt, Artificial Sequence
  derived and/or modified sequence opt3 from EXOG__Homo_sapiens__NP_001138936
auggccaucaagagcauugcuuccagacugaggggcucucggcgcuuccucucaggguuuguggcaggagccgucguuggugcggcuggcgccgggcuugcagcccugcaguucuuucgaagucaaggagcugagggcgcauugaccgguaaacagcccgacggggaugccgaccguaagcacugcaaauucaagccugauccaaacauaccgcccacauuuagcgcuuucaaugaagacuacgugggauccggcuggucuagaggccauauggccccugcggggaacaauaaauuuucgucaaaggcaauggccgagacuuucuauuuaagcaacaucguaccacaggauuuugacaauaacaguggauacuggaauaggauugaaauguauugucgggagcugacggaacgcuucgaggaugugugggucguguccgguccccuaacccucccucagacaagaggcgacgggaagaaaaucguuucuuaccaagugauuggagaggauaacgucgcugugccaagccaccuguauaagguaauccuugccaggcgguccucaguuaguacugaaccccuggcauugggcgcuuuuguggucccuaaugaggccauagguuuccagccacagcucaccgaauuucaggugagccugcaagaccuggagaaacucucuggguuaguguucuucccgcaucuggaucgcacauccgacauccgaaacauuugcucagucgauaccuguaaacuuuuggacuuucaggaguucacucuguaccuaagcacaagaaagaucgaaggagcgaggaguguucuccggcuggagaagauuauggaaaaucuuaagaacgccgagaucgaacccgacgauuauuuuaugucucguuacgagaaaaagcuggaggaauugaaagcaaaggagcaguccggcacccagauacgcaaaccuagcuga

SEQ ID NO: 55952 - RNA, 588 nt, Artificial Sequence
  derived and/or modified sequence opt3 from EXOSC1__Homo_sapiens__NP_057130
auggcucccccugugagauacugcaucccaggcgagaggcuguguaaccucgaagaggggagcccgggauccgguaccuauacacggcacggcuacauuuucucuucacuugccgggugccugaugaagaguagcgaaaauggagcauugcccgucguuuccgugguacgcgagacugaaucucaguuacugccugacgugggcgccauagucacguguaaagugucgucaaucaacagccgauuugcgaagguucauauucuauauguggguaguaugccacucaaaaauuccuuccgugggaccaucagaaaggaggaugucagggcuacagagaaagacaagguggaaauuuacaagucuuuucggcccggagauaucguacuggccaaaguuauaagccuuggcgacgcacaauccaacuaucuguugacuaccgccgagaaugaacucggcguggucguggcucacucagagagugggauccagauggugccuauuagcuggugcgagaugcaguguccaaagacacauaccaaagaguuccgcaaggucgcaagaguucagcccgaauuucugcaaacuuga

SEQ ID NO: 55953 - RNA, 804 nt, Artificial Sequence
  derived and/or modified sequence opt3 from EXOSC2__Homo_sapiens__NP_001269637
auggccauggagaugagacugcccguggcuaggaagccucucagcgaacggcuuggccgcgacaccaaaaagcaccuggucguuccaggggauacaaucacuacggacaccggauucaugcgaggucauggcacauacaugggggaggaaaaauugauugcauccguggccggaucuguagagcgugugaacaaguuaauaugcgucaaagcgcugaagacuagauauaucggcgaagugggugauauuguuguggggaggaucaccgagguccagcaaaagcgguggaaaguggagacaaauucacgccuagacaguguacuccugcuuagcuccaugaaccugccgggaggcgaauugagaaggcggucugcugaggaugaacucgccaugcgcggcuuucugcaggagggggaccugauuucgggaguucucgugcaggucucacccagcuuagugaagcgacagaaaacccacuuccaugaucugccuuguggugcaagugugauccuuggcaauaacggguuuauauggaucuacccaacucccgagcacaaggaagaggaagccggaggcuucauugcuaauuuggagccugucucccuggcagacagagaaguuaucucuaggcuacggaacugcauuaucagccucgugacacaacguaugaugcuguaugauaccuccauacuuuacuguuaugaggccucacugccacaucagauuaaagacaucuugaagcccgagauuauggaagagaucguaauggaaacgcgccagagacuccuggagcaggaagguuga

SEQ ID NO: 55954 - RNA, 495 nt, Artificial Sequence
  derived and/or modified sequence opt3 from EXOSC3__Homo_sapiens__NP_001002269
auggccgagcccgcuagcguggcagccgaaucccuggcgggcucuagagcuagggccgcacggaccguccucgggcagguugugcuuccuggagaggaacuguuguuaccagagcaagaagacgccgaggguccgggcggggcuguagagcgcccccugucacuaaacgcacgagccugcagucgugugagagucguguguggaccuggccucaggcggugcggugaucgccugcuuguuacaaagugugggagacugaggcacaaagaaccaggaagcggcuccggcgggggaguguacugggucgacucucagcagaagcgguaugugcccguaaaaggugaucauguuaucggcauugugacugcuaagucgggggacauauucaaagucgaugugggaggcucagagccugccagcuugaguuaccucuccuuugaaggugcgacgaagcgcaaucgaccaaacgugcaggcaaucucuagcagacuguga

SEQ ID NO: 55955 - RNA, 738 nt, Artificial Sequence
  derived and/or modified sequence opt3 from EXOSC4__Homo_sapiens__NP_061910
auggccggccuggagcuccuuagcgaccagggguacagaguggauggaaggcgggcuggugaacugcgcaagauccaagcacgaaugggcgucuucgcccaggcggacggguccgcuuauauugagcagggaaacaccaaagccuuggcaguuguguacggcccccacgaaauacgugguucuagagccagggcuuuaccugaucgggcacugguaaauugccaguauucaagugccacauuuagcacuggggagcgcaagagaaggccacauggagaccggaaauccugugaaaugggccuacaacuccgccagacguucgaggcugccauccugacccagcuucacccgcgaucucagauugauaucuacgugcaaguccugcaggcggacggcgggacauaugcagccugcgugaacgcugccacuuuggcaguucucgaugcugguauucccaugagagacuuugugugugccugcucggcgggauucgucgauggcaccgcccuggcagaccugucacauguggaggaagcugccgggggaccucagcucgcuuuagcccugcuuccagcaagcggccagaucgccuugcuggagauggaugcuaggcuacacgaagaccaucucgagcggguacuggaggcggcagcccaagcugcccgugauguucacacacuucuggaccgcguggucagacagcacgugagggaagcaaguauauugcucggugacuga

SEQ ID NO: 55956 - RNA, 708 nt, Artificial Sequence
  derived and/or modified sequence opt3 from EXOSC5__Homo_sapiens__NP_064543
auggaggaagagacccacacagacgccaagaucagagcugaaaacggcacugggagcucccccaggggaccugguugcucucugcggcauuucgcaugugagcagaaucuccuuucacgcccagauggcagugccagcuuucugcaaggggacacguccguguuggcgggagucuacggcccggcugaaguuaaagugucuaaggagauuuucaacaaagccaccuuagagguaauacugcgacccaagaucggucuaccugggguggcagaaaaaucgcgugagagacucauuaggaauacaugcgaagccgucgugcugggaacucuucacccacggaccucaaucacaguugugcugcaggucgugagcgaugcuggcaguuugcucgcauguugccugaacgccgcuuguauggcccugguagacgcgggcguucccaugcgcgcacucuuuugcgggguggccugugcuuuagauuccgacggaacccugguccuugauccuacuucuaagcaggagaaggaggccagagcaguguugacauucgcucuggacagcguggaaaggaaacuacucauguccucaaccaagggucuguauagugauacggagcuucagcaaugccuggccgcggcccaggcagcuagccagcaugucuuucgguucuaccgcgaaucuuugcagcgaagauauuccaaaucauga

SEQ ID NO: 55957 - RNA, 819 nt, Artificial Sequence
  derived and/or modified sequence opt3 from EXOSC6__Homo_sapiens__NP_478126
augcccggcgaccacagaaggauccgggggccugaggaaagccagccaccgcaacuguacgccgcugaugaggaagaggcacccggaacccgcgacccuacacgacuccguccaguguaugccagagcgggucuucugucccaggcuaagggcucugccuacuuggaagcagggggaacuaaagucuuaugcgccguuucaggccccaggcaggcugaggguggggagcggggaggcggcccugcaggggccggaggugaagcuccagccgcgcugcgcggcagacuacucugugauuucaggcgggcacccuuugccgggcgccgaagaagggcuccuccaggaggcugcgaggaacgggagcuggcccuugcacugcaggaggcuuuggaaccggccgugcgucucggucgcuaucccagagcgcaacuggagguaagugcccugcucuuagaagacgggggaagcgcacuggcugccgcucuuacggccgcagccuuggcucuggcggaugcaggcguggagauguacgaccuagucgugggcugugggcucucccuggccccuggaccagcucccaccuggcuucuggauccuacaagguuggaagaggagcgggccgcagccggucucacuguugcucugaugccaguguuaaaccaggucgccggccugcucgggucuggagaaggcggucuuaccgagucgugggcagaagcggugcgacugggguuggagggcugccagcgccuauaucccguacugcagcaaucacucguuagagcugccaggcggcgcggagcagccgcucagccguga

SEQ ID NO: 55958 - RNA, 876 nt, Artificial Sequence
  derived and/or modified sequence opt3 from EXOSC7__Homo_sapiens__NP_055819
auggccagcgugacccuguccgaggcugaaaaggucuacaucguucacggcgugcaggaggaccucagaguagaugggaggggaugcgaagacuaucgguguguggaggucgaaacagaugugguuucuaacacuucagguagugcacgcgugaaacuuggccauacggacauucuggucggggugaaggccgagaugggaacccccaaauuggagaagccuaaugaaggcuacuuagaguucuuuguagauugcagcgcguccgcuacaccagaguucgaaggucgagggggagacgaucugggcacugagauagccaacacccuauaucguaucuuuaauaacaaaucuucgguugaccucaagacacuguguauuucaccgagagaacacugcugggugcuuuacgucgaugugcuguugcucgaguguggcgggaaucuguucgacgcaaucagcauugccgugaaggcugcacuguuuaacaccaggaucccccggguccgcguucucgaagaugaggaaggaaguaaagacauagaguuauccgaugacccuuaugacugcaucagacugucuguggagaauguaccauguauugugacucuuugcaagaucgguuacaggcaugucguggaugccacauugcaagaagaggcuuguagccuggccucccuacucguuucagugaccaguaaaggcgucgugacgugcaugcggaagguagggaaaggaagccuggaccccgaaucuauuuucgagaugauggaaacuggcaagcgcguugguaaggugcuucacgcgucccugcagucagucgugcauaaagaggagagcuuggggccuaagcgacagaaagucggauuucucggcuga

SEQ ID NO: 55959 - RNA, 831 nt, Artificial Sequence
  derived and/or modified sequence opt3 from EXOSC8__Homo_sapiens__NP_852480
auggccgcuggcuucaagaccguggagccccuggaauacuauagaagguuucucaaagagaacugccggccugacgggcgcgaacuuggagaguuccgaacaacuacggucaauaucgguagcauuuccaccgcagauggcucugcccugguuaaguuggggaacacaacugugauauguggaguaaaagcggaauuugcugccccaucaaccgacgcaccggauaagggcuacgugguccccaauguggacuuaccuccacugugcaguagccguuucagauccggucccccuggggaggaggcccagguugcuucucaauuuaucgcagaugugauugaaaacucgcagaucauucagaaagaggaccuauguaucucaccaggaaagcucgucugggugcuguauugcgaucuuauaugucuggacuacgauggcaauaucuuggacgccugcacauucgcucuccuggccgcgcugaagaacguacagcuccccgaaguuaccauuaaugaggagacugcauuagccgaagugaaccugaaaaagaaaagcuaucuuaauaucaggacacacccugucgcuaccaguuuugccguguucgaugacacguugcugauuguggauccaacuggcgaggaggaacaucuagcaaccgggacacucacuaucgucauggacgaagagggaaagcuguguugccuucacaaaccggguggcuccgggcugaccggagcuaaguugcaagacuguaugucucgggccguuacacgccauaaggaggugaaaaagcucauggaugaaguaauaaaaagcaugaagcccaaauga

SEQ ID NO: 55960 - RNA, 5970 nt, Artificial Sequence
  derived and/or modified sequence opt3 from EXPH5__Homo_sapiens__NP_055880
augaccaaggugcccccugccuucgacuuuagcuuccugaacgaugaggaagcuagaaaaauccuccagguccuugagaggaaugaagagcugcaacgggcagaaaaggaccgcauuuccaaauugcagaagacaaaacgagauauacguugguuacagggcguuacuggggagugguuugaggaaauccagagaaagaaguucugcaacgagacggacgugucucaaaugcugaaacagccacuaaccuacaggcucucaaaggaaauggccaaaaaugauccgauugagcugcccacaagucggagcaagaacguaacuaaucagaaaaagccuaccccauuuuccucucgcaugucguucagaucaagcuuugcgagucuuuucuccuuuaggaagucuggaaaagagacaagcaagcugcccuccuugggucagaaaggcugugacgggcacgcuggaccuccaaugcccgugcggggcgccgcaguccaagccaagaucuauaacucaccucucgaaaaucaucugguggauaguaccuucguuccaaaaccggcugugaugcgcgaggaaagcgguaugcccccuccaugggacgcaucucugcucgagaacgaauuuuuccaggucuuagaugaccuggauuccaagcuugcccaggagcagucagcuagcagugugaauacucgaacacccuugaacuacgggucuagaacccaauuuggacacuucuauuccagcggcaauaggcauggcaacauuacggagcggcacaaaaagcauuacaaugaaacuucgaacaugucuaucuaugacauacugcguccugggaccccacgcgagggauucaagacauuuucccccagaacuucaaccaucuacgauauguauaggacacgggaaccgcgaguauucaaagaggacuacguucagaagaauaccuuugguaguacgagccuaugcuucgacucccgccagagaucugcccucccugcgacuggccacuuuacagcaaggagccugcacuuccccgccaccacucaaucaaaaaguggguuuauuccaccucggcaucagcagucccccaagcgcacaccacuuagcucuaucauuuggaacagaucagauaguagcagggaccgugaaaaccaggaggaguuccugcgggcucccuccccuauggaaaucgauccagccgacaaauacguguauccgcgaggauuucaagagaauaagagauacgaaucuuaucacucgcagaacgucuaccagagggugagcuugaaugcacccauggagaacgcuauguccccugauaccuucgaaaauucagagaacaugccauuuuaucaucagaguaauacguucacccgcucuuuuuucagcaacacauucggccgguccggugagcaaagaagguuugggcagggacccuucuggggccaggaaaagggccacucauuuuggagcgacuuccaccgcucucgaaaauccuuuaguagcucugaucgggacuucgagaugauauccauggaagccaauucagugagugcgauucaugggcacaacgucagcucggagcauugggaguccuuuucuagcggauacgguacugauguuucacguggccaggaagagccucacccauggcaauucgacuuucagagaaguacccucgauuccauggugguaucucaugggaaugaaacacagcugacuccccacuucggaaccccgaacguguguagcaugacaggcuccucauaucacgucaagagcagugaguuagugucucagcaagacuccagcccuguugaagugcauaucaauaaagaggccucgucauuugguauugcacagacccuggcuucuaguuucaagacuuccuuuagccagaucucugacgauaggcgcaacccacaaagccccaaucuccagaacccuacggucacacuucagaaaaucuuccccaacaagccagccucccacccuaugcggucacauaccgaggugacuguaaccaguagcaauucuguugacucccugcccuuggcuaagucacagccaaacauucuagugacagaagucaauaacgagaaagaucugaaugaaaguauaagcgaggaagacaagcaacucuccaaaauggaucagaccaacaaggccggggagaucccgcagccugugucucagacuggcauuucgaauagccugcccgacuuccaaaacccacuuucacaggauuccgcaaaaaguaauggauuuggcuucaacgccucuacaaucauaagcuccaagaagucacccagagucuuuucuaggaaagacacgagcaagauguacauuccucacaccgauaaaaguaaugacaucaagcaggauaaacgauucacugagaaccgcaagcugggguccacagcuagcuugccauuuauccaggaacaccggacccccccuucuuucccgagaacagaccaaggaugccaucaggagcucacugugaauaacgaagauauuucaaggaucauuaccaauaaccacugguccagugcgcugacggacacccagaacgcacaauacagcaaauguaaguuaacaccaggucauaagacuucgugcgacucucuggaucuauccagcgccgcucuccccgacucaaguccuucuaaaaauuccagccuggaugccccaguugugcccucaaccacaguauuuagucgucgcagcccuuccgacaaggauccgucucuuggcgagcgggaagagaaagacaacgcagggaagaaucagaaaaaccaguucauagucagccacuccgagaaucaggaaagaaacgauucacccgugccaacucaugacgagguuguggaugucaagugucacucucacaguccuuuuaggaaugaacgaggaaagggcaaaauccggcaucacauuucgugcaucgagaaguugagcaaaaccgaguccaucucugugcccacgucagaccaucgcagccugauugaagccaaccaauccaauaguaagguaucugagcucgauacaauauauuguacccugccaagaaaaagcucauccuuccuuauccacgguaggcagagugggagcaagauuauggcugccucucugcggaacggcccucccccauuucagaucaagaauaacguggaagacgcaaugggaaauuacauguugaacaaauucuccccgucaagcccugagucggcgaaugaaugcucuaagguucucagugauuccgcucuggaggcccccgaggcaacugaacgaaugacaaacgucaaaagcucaggcuccaccucugugagaaaggggccauuacccuuccugauuaaccgcgccaugagcuguccuaguggagagccacaugcuuccacugguagggaaggccguaaaaagccccuaaccagcgggauggacgccucugagcucacaccucgggcaugggaaagaaucauaucaccgguggagagugacuccagcgucagggauugcucucugacgaagcgccagcaccaaaaagagaauuuucaggaauauaccgagaaggaaggaaaaauggcugccucgcgaagaucaguuuucgcgcuuagcaacgaggacccauugcccuuuugcuccgaucugaguggcaaggaacgggguaaaacucuccacaaggugaaaacaaccucuacauucagcguguccggggacgaggauaauguaaagugucuggaggucgugucaaucuacuauacuuuaccuaggaagcccaguaaaaaguuuugcaaccugcuucagcaguacacccaaaauacgaacuugcucauugaaucuccacagguugagacagaaaccuucccuaaugcccuggagaaagacaagcagaacuauagcacucgcgagcaguccggcacccccucaugugaaaaucuaaaaaugagcgugaacucugaucaaacacugacuaccgagaauaugacagcuuuucgucucuccaacagaggaccacuggcaccuacgcuucaggaaauggccagugucgaggcugccgugagcuugccggaagaggagucgaaggcacgggaaaucuucuccgacaaucuggcgaagacccccuuaggcgauucugagaacaaaaaggaaagggggaaaaagcuccagucagagacucugcauacaagccuuaugcugcaacgcaaaaauguuagugaagagaaguccgagaacugccagcagucuauuaauagcucaaacuccggaccaaguagcuugccugcccucucugaagugaacaucggcaauucacagacccgaagauccagcugggaguguacugguucugggcgggcuauacccuuuacaggaaguggcaagugcccacaaaaagaccacaccucgacggccguaggugauggcuccagcgggucacagccuagggaaggacgcggcgacauugggacuaacugucagaagaugaccaauaaaacacugucucauagcgagucccaggucuucgcacuaacccccgcucugcacaagcuccaacugggagaagagacucagagugacgagccgaaccuugaaucauugcagucugagccaagagaacugccucagaggagccaagaggccaauaugacagagucccggaaagcagaagaugagaugcagaagagugccugggaccagcccagcuuaccagaaggcaacaagaauaaaaccaaccucgaugaccuggugaagggugagaaucguuccucugugaaacaccgccuugcugcgaugucaaaggccagccgaaaauuucccgcaaaggaugucucgccuagaaggcauguugcuacaaucuucccgcaauccgggagucggucuggauuugaccaccugagccuaggcacuguggaaugcaacccccucuucccagagccuacccccaagucagccgaguccauuggugaaucucgccugagugagaauggcaaacauguaaagaaaagcgaaaacuugcugccuaucacgguguuaccaaauagagagcccuccacacacgucucaaaccagaagagcaauucuauaagucagaggcaucagaacgaauucaaaaacguguccgagagcccuucaaagcacgagaauucuaaagauguuaccgccgcucaaaaccucgugcgggaauccggggcaccaucgcccaucacuuuuaccagccugcgagaggccgaauucagugacaaucagagacgccuuucuccgccuuuuccacuggagcccgcgcagaaguccagggucagcucaccuuuggcuaguuuccuccagcaacagcgguccgccagcucucuggaaugggagccagagccccaccuauaccguucaaagagccugaaauccauuaacgugcauggagaucuucucagaaagucucacccgccuaaaguuagggaacgccauuuuagugagucgacaagcaucgacaaugcacugucccgguugacucugggcaacgaauucucagugaauaacggguacucucgaagauuuaggagcuucagugaguuacccuccugugauggaaaugagucaugggccuaucgcucuggcaccaagacggguccacggagcgcuauuuccaucuacagaccuauagacuaugggauuuuuggaaaagaacagcagcucgcauuccuggagaacgucaagcguagucuuacacaaggcaggcuguggaagcccagcuuuuugaaaaauccagguuuccucaaggaugaccugcggaaccccccuaauccaucugaaucacuauccagcaacaguccgucuucccagguacccgaggacggccugucgccuagcgaaccacuuaauaucuacgaggaugaccccguggauucagacugcgauaccgacacuacaaccgaugacgaguauuaccucgaugaaaacgacaaagaguccgaacuguga

SEQ ID NO: 55961 - RNA, 2241 nt, Artificial Sequence
  derived and/or modified sequence opt3 from EXT1__Homo_sapiens__NP_000118
augcaggccaagaaaagauacuucauccugcucagcgcuggcuccugccuugcacuguuguuuuauuucgggggauuacaauuuagggccucucggucacacagucgccgagaggaacauagcggucguaacggccugcaccaucccuccccugaccacuucuggccaagauuuccggaugcgcuaaggcccuucgugccuugggaccagcucgagaaugaagauucuucgguccauauuucaccacggcagaagcgcgacgcuaacagcaguauauacaaagggaagaaauguagaauggaguccugcuuugauuucacccuguguaagaagaauggauuuaaaguuuauguguacccccagcaaaagggcgagaaaaucgccgaaucuuaucagaacauucuugcagccaucgaggguagcagguucuacacauccgacccuucacaggcuugccuguuuguauugagucucgauacucuggaccgggaucagcugagcccacaauaugugcacaaucuccgcucuaagguccaguccuuacaccuguggaacaaugggcgaaaccaucuuauuuucaauuuguacucaggaacguggcccgacuacaccgaagaugugggcuuugacaucggccaggcaaugcuggccaaagcuagcauaaguacagagaacuucagaccuaauuucgauguuucuaucccacuauuuuccaaggaccacccgaggacugggggagaacgggguuuccucaaguuuaacaccauucccccucugcguaaauauaugcuuguguucaagggcaaacgcuaccugacagggaucggaagcgacaccagaaaugccuuguaucauguccacaacggcgaggaugugguacuccugacuacauguaagcacgguaaagacuggcagaagcauaaagauucgaggugcgaccgggauaauaccgaguacgaaaaguaugacuaccgagagauguuacacaacgcgacguuuugucugguuccacgcgggagaaggcucggaucuuuccgguuucuugaagcacugcaagccgcuugcgugcccgucauguuguccaacggcugggagcuaccuuucucagaagugauuaauuggaaccaggccgcagugaucggcgaugagcgccugcuccugcagauaccaaguacuauuagaagcauccaucaagacaagauucuugcucugaggcagcagacccaguuuuugugggaggccuauuucuccucugucgagaaaaucguucucacaacucuggaaaucauucaagaucguauauuuaagcacaucagccgaaauucauuaauuuggaacaaacaucccgggggacuguucgugcuaccgcaguacaguuccuaccucggugacuuuccuuauuacuaugcgaaucugggccuuaagcccccaagcaaauucaccgccguaauccacgcagugacaccuuuggucucucagucacagcccgugcugaagcuccugguugcugccgcuaagagucaauacugugcccagauaauugugcuuuggaacugcgauaaaccacugcccgcaaagcaccgguggccugccaccgcugucccagugguaguuaucgaaggggagagcaaagugauguccucuagauucuugccguaugacaauaucauuacggacgcgguccucucgcuggaugaagacacuguguuaagcacaaccgaggucgauuuugcauucacuguguggcaguccuuucccgagaggaucguuggauacccugcccgcucacauuucugggacaacaguaaggaacgguggggcuauacaucuaaauggaccaaugauuacagcauggugcugacgggugcugccauuuaccacaaguauuaccauuaucuauacucccacuaucucccagcaucacugaagaacaugguagaccagcuugccaauugugaggauauauugaugaacuuucuggucagcgcugugaccaaacugcccccuaucaagguuacacagaaaaagcaauacaaagaaacuaugauggggcagaccucuagagccuccaggugggcagacccagaucacuucgcgcagcgccaaaguugcaugaauacauuugcuagcugguucggcuauaugccccucauucauucucagaugcgauuagacccggugcuguuuaaggaucaggucuccauccuucggaagaaauaccgugacaucgagagauuguga

SEQ ID NO: 55962 - RNA, 2256 nt, Artificial Sequence
  derived and/or modified sequence opt3 from EXT2__Homo_sapiens__NP_000392
augagcugcgccuccggcucugggggaggucugagacacccccucaggugucagaagccuugggacgaggaaugcgaggaagaggcugugugugucaucaugugcgcaucaguuaaauacaacauucggggcccagcccuuauaccgcgcaugaagaccaaacaucgaaucuauuacauuacacuguucaguaucguguuguuagggcugauugcgacuggaauguuucaauucuggccccacagcaucgaauccucuaaugauuggaacguagagaagcguucgauaagagacgugccugucgugaggcuaccagcugauucacccaucccugagcggggcgaccucagcugucgcaugcauacgugcuuugauguuuauagaugugguuucaauccgaaaaacaagauuaagguguacaucuaugcccugaaaaaguacgucgacgauuuuggggugaguguauccaauaccauuucuagggaauauaacgagcuucugauggcaaucagcgacuccgauuacuacacagacgauauaaaucgggccugcuuguucguucccucaauugacgugcucaaccagaauacucugcgcaucaaagaaaccgcucaggcaauggcccagcugagucgaugggauagaggaacaaaccaccucuuauuuaauaugcugccuggcggcccaccggacuauaacaccgcucuugacguccccagggaucgggccuugcuggcagggggagguuucagcacuuggacauaccgucaaggcuaugacgugucuauuccuguguacuccccacuaucagcggaggucgaucuccccgagaaggggccuggaccacgccaguauuuucugcuuagcagucagguuggccugcaucccgaauacagagaggacuuggaagcccuccaggugaaacacggugagucuguacugguguuagauaaguguaccaaucuguccgaagggguccucagcgugaggaagcggugccacaaacaucaaguuuucgacuauccacaggugcuucaggaggcuacguuuugugucgugcugcgaggagcccgcuugggccaggcaguacuaucggauguucugcaagcuggcugcgugccugucgugaucgccgacucuuacauccuccccuucuccgagguccuggauuggaagagagcgucagugguugugccagaagagaaaaugagugacguauacagcauucuucaguccauaccucagaggcaaaucgaagagaugcagcggcaggcccgcugguuuugggaagcauauuuccagucuauuaaggcuaucgcccuggcuacuuugcaaauaauuaacgauagaaucuaccccuaugccgcaaucagcuacgaggaguggaaugacccacccgccgucaaaugggggucagugaguaacccucucuuccugccauuaauuccgccccagucccagggauuuaccgcuaucguucugacauaugacaggguggaaagccuauuccgugucauuacugaggugucuaagguaccuucacucaguaaacugcuugugguuuggaacaaucagaacaagaauccacccgaagauagcuuguggccuaagauacgggucccacugaaaguggugcgaaccgcggagaacaagcucuccaauagauuuuuccccuacgacgaaaucgagacagaggcaguccuggccauugaugacgauaucaucaugcuuaccucugacgaacugcaauuugguuaugagguuuggagggaguucccggaucgcuuggugggcuacccugggcggcuccaccugugggaccaugaaaugaacaaauggaaguacgagucggaauggacgaaugaggugagcaugguauuaacuggagcugccuuuuaucacaaauacuucaacuaucuguacacauauaagaugccaggcgauauuaagaauugggucgacgcacacaugaacugcgaagauauagccaugaauuuucuaguggcuaacguuaccgguaaagccgugaucaaggucacucccaggaaaaaguucaaauguccugagugcacagcaauugacgggcucucccuggaucagacccauaugguggaaagaucagaguguaucaauaaguuugcgaguguuuucggcacgaugccccuuaaggugguagagcaccgcgcugacccagucuuguacaaagacgauuuuccugaaaagcugaaaucuuuccccaacauuggaagccucuga

SEQ ID NO: 55963 - RNA, 1014 nt, Artificial Sequence
  derived and/or modified sequence opt3 from EXTL2__Homo_sapiens__XP_011539298
augagaaccuggaacagcggcgggacaaagugcugucacaucugcaaacugcccggaagggugauggguauucggguccuccgccuuucccugguugugauauugguauuacugcuaguggccggcgcucucacugcacugcuuccuucugucaaggaggacaaaaugcugauguugcgacgugaaaucaagucacaggggaaaaguacgauggauagcuucacccucauuaugcaaacauacaauagaacugaccugcugcucaaguuacugaaccauuaucaggccgugccaaaucuucacaagguuaucguggucuggaacaauauuggagagaaagcgccggaugaauuguggaacucccugggcccccauccuaucccagugauauuuaagcagcagaccgcuaauaggaugcggaaccgccuacaaguauuccccgagcucgaaacaaauguucugaugguggacgaugacacccuuaucucuacuccugaucuggucuuugccuucucgguguggcagcaguuuccagaccagauuguggguuucguccccagaaaacacguuucaacaagcagugggaucuacuccuauggaucuuuugagaugcaagcaccuggcagcggcaacggggaucaguacuccaugguguugauuggagccucauucuuuaauaguaaguaucucgagcuguuccagaggcagccagcugcaguacaugccuuaaucgacgauacccaaaacugugacgauauagcuaugaauuuuauuaucgccaaacacauugguaagacgagcggcaucuucgugaagccggucaacauggacaaucuggaaaaagagacuaacucuggguacuccggaauguggcaccgggcggaacaugcacuccagcgcucauauugcaucaacaaacuugugaauauuuacgacagcaugccccugcgauacaguaacauaaugaucucucaguuuggcuucccuuaugccaauuacaagagaaagauuuga

SEQ ID NO: 55964 - RNA, 2760 nt, Artificial Sequence
  derived and/or modified sequence opt3 from EXTL3__Homo_sapiens__NP_001431
augaccggcuacacaaugcugagaaacgggggagccgguaauggcgggcagacuugcaugcucagguggagcaaccggauccgccuuacguggcuguccuucaccuuguuugugauuuuagucuucuuuccccugauagcucacuauuaccuaacaacucucgacgaggcagaugaagccggaaagcgaaucuucggcccucguguugguaaugagcugugugaagugaaacauguacuugaccugugcagaauuagggagucugugucagaagaguugcuccaacuggaggcgaagcggcaggaacugaacagugagaucgcuaaacucaauuuaaagauugaagccuguaaaaagagcaucgagaacgcaaagcaggaucugcuucaguugaaaaaugucauaucccaaaccgagcacucuuauaaggaacugauggcccagaaccagccaaaacuaucgcucccgauccgccugcuucccgagaaggacgaugcugggcugccuccacccaaagcaacaagaggaugcagguugcauaauuguuuugacuacucacggugcccucucaccagcggcuucccaguguauguuuacgauagugaccaguuuguguucggcuccuaucuggaucccuuagucaagcaagccuuucaggcuacugcccgcgcgaacguguacguaacagaaaaugcagacauugccugucuguacguuauccucgugggggagaugcaggaaccugucgugcuucgaccagcugagcuggagaagcaguuguauucucuaccgcacuggagaaccgauggacauaaccacgugauuaucaaucugagcaggaaauccgacacgcaaaaccuccuguacaaugucucaacuggucgggccaugguugcacagaguaccuucuauacagugcaguaccgucccggcuuugaucuuguagugagcccucugguccacgcuaugucugaaccaaacuucauggagauacccccucaagugccaguuaagcgcaaauauuuguuuacuuuccagggggaaaagauugagucccucagaucaagccugcaggaagccaggaguuucgaggaggaaauggagggagaucccccggcggacuacgacgaccggaucauugccaccuuaaaagcagugcaggauucuaagcuggaccaaguccuaguggaauuuacaugcaaaaaccagccuaagcccucccucccaaccgagugggcucuguguggcgaacgagaggaucgccuugaguugcugaagcucagcacguucgcccugaucaucacuccuggugaccccagacuuguaauuucgucugggugcgcuacaaggcuguuugaagccuuggagguuggagcagugccagucgugcucggcgaacagguccagcugcccuaucaagauauguuacaguggaaugaggccgcucuggugguuccuaaaccacgggugaccgagguacauuuccuacuccgcucccugucagacagugaucuuuuggcgaugagaaggcagggccguuuucugugggaaacuuacuucagcacagcagacuccauauuuaacaccguccucgccaugauccggacgcgaauccagauuccggcugcccccauaagagaggaagcagccgcugagauuccucacaggucugggaaggccgcaggaaccgauccaaauauggcggacaacggugaccuggauuuaggccccguggaaacagagccuccauacgcuagcccccgcuaucugcggaauuucacucuuaccguuacagacuuuuacagaucauggaacugugccccggggccuuuccauuuguuuccacacacucccuucgauccugugcuccccagugaggcaaaauuucugggauccggcaccgguuucaggccaaucgggggcggagccggcgggagcggaaaggaauuucaagcugcccuagguggcaaugucccucgcgagcaguuuacagugguaaugcugaccuaugaacgagaggaagugcucaugaacucucuggagcggcuuaauggguugcccuaccugaacaaaguugucgugguguggaacucaccaaaguuaccgagugaggaccuccuguggccugauaucggaguccccauuaugguugugcguacugaaaagaauagccuuaauaacagauuccugccauggaaugagaucgaaacggaggcaauuuuguccauagacgaugacgcucaccucaggcaugaugaaaucauguuuggcuuccgcguguggcgggaggccagagacaggauuguagguuuucccgggcgauaucacgcgugggauaucccucaucagucuuggcuguacaacucgaacuauagcugcgagcuauccaugguccugacaggcgccgcuuucuuucacaaauacuacgcauaucucuacucauaugugaugccacaggccauccgcgacaugguugaugaauacauuaauugcgaggacauagcuaugaacuuccuggugagucauaucacccggaagcccccuauuaaagucacuucuagauggaccuuuagguguccgggaugcccacaagcccuuagccacgacgauucccacuuccaugaacgucacaaguguaucaauuucuucgugaaaguuuauggcuacaugcccuugcuguauacacaguuucgcguggacucaguauuauucaagacccggcucccucaugauaagacuaaaugcuucaaguuuauuuga

SEQ ID NO: 55965 - RNA, 1779 nt, Artificial Sequence
  derived and/or modified sequence opt3 from EYA1__Homo_sapiens__NP_000494
auggagaugcaggaccugaccagcccccacuccagacucucuggcucaagugaaagcccuuccgggccaaaacuuggaaacucucauaucaauucgaacucaaugacaccgaaugguacugaggugaagacggaacccaugagcaguuccgagaccgccucuacaacugcugauggcagccugaacaauuucuccgggucagcaauuggaaguagcucuuuuuccccuaggccaacccaccaauucucacccccucagauauacccaagcaaccggcccuauccucauaucuugccaacaccgaguucucagaccauggccgcguacggccagacucaauuuacaaccgguaugcagcaggcuacggccuaugcaacuuacccccagccugggcaaccauauggaauuuccagcuacggcgccuuaugggcuggcaucaagaccgaagggggacugucgcagucucagucccccggucagacaggcuuccuaucauaugggaccaguuuuagcacuccucaaccaggacaggcacccuacuccuaccagaugcaaggcucuagcuucacaaccucaagugguauuuauacggggaauaacucccucacuaauagcucuggauuuaacucaagucagcaggacuacccgagcuauccuuccuucggccagggccaauacgcccaguauuacaauucuucgcccuauccagcucacuacaugacaagcuccaacaccucaccuacuacacccaguaccaaugccacguaccagcugcaggagccacccucugggaucaccagccaagcggucacagauccuacugcagaguauuccaccauacauucaccaagcacaccgaucaaagacucugauuccgaccgccuucgacguggaagugaugguaagagcagaggcagggggcggcgcaacaauaaccccucuccuccacccgacuccgaucuggaaagaguuuuuauuugggacuuggaugagacuaucauuguguuccacucacuccugaccggaaguuacgccaacagguauggccgggacccuccaacaagcguaucgcugggucuccgcauggaagagaugaucuuuaauuuagcugauacccaccuguucuuuaacgaccuugaggaaugcgaccaggugcauauagaugacgucuccucugaugacaaugggcaggauuugagcacuuacaacuucggcacggacggauuccccgccgcagcuacaucagccaaucugugucuagcgaccggcgugcgagggggaguugauuggaugagaaaacucgccuuuagguaucggcgugugaaggagauuuacaacacuuauaagaauaacgucgguggccugcuugggccggcaaaacgcgaggcuuggcugcaguugagagccgagaucgaagcucucaccgacaguuggcugacauuagcccugaaggcacucucccuuauucacucuaggaccaauugcgugaacauccugguaacuacaacgcaauugaucccugcccuagcuaaaguucugcucuacggacugggcauuguguucccaauagagaauaucuacagcgcgaccaagauugguaaagaguccuguuuugaacggaucauacagcgauucgggcgcaaggucguguauguggucauuggcgauggaguugaggaagaacagggcgcaaagaaacaugccaugcccuuuuggagaaucucaagccacagugaccuuauggcucugcaccaugccuuggaacucgaguaccuguga

SEQ ID NO: 55966 - RNA, 1617 nt, Artificial Sequence
  derived and/or modified sequence opt3 from EYA2__Homo_sapiens__NP_005235
augguggagcuggucaucagccccucccucaccguuaacucugacugccuugauaagcugaaauucaauagagccgacgcugcaguguggacauugucagauaggcagggcauuacuaagagugccccuuuacggguaagccaacuguuuucccgcucuuguccacgagugcuaccgcgucagcccucgacggcgauggcugccuacgggcagacccaguauucagcaggaauacaacaggccacaccuuacacugcuuauccacccccugcacaggccuacgguaucccaagcuauaguauuaaaaccgaagacucccucaaccacucucccggccagagcggguuccuguccuacggaucaaguuuuagcacaucuccuaccggccaauccccauauacuuaccagaugcaugguacaaccggguucuaccagggaggcaauggccuugggaacgcugccggauuugguucaguccaccaggauuauccgagcuaccccggcuucccucaaagucaguauccacaguacuaugggucuuccuacaaucccccuuaugugccagcgagcucgaucugccccucuccgcuguccacgucaacuuacguuuugcaagaggcaagucauaacgugccuaaucagagcuccgaaucucucgccggagaguacaacacccacaauggccccagcacaccagcuaaggaaggugacacugauagaccucauagggccucagacgggaaacugcggggacgcaguaagagauccagcgaucccucuccagcaggcgacaacgagauugagagggucuuugugugggaucuggacgaaaccaucauaaucuuccacucacucuuaacaggcaccuuugcuagucgguaugggaaggauacgacuacaagcguacgcauuggacugaugauggaggaaaugaucuucaaucuugccgacacccacuuguuuuucaacgaccuggaggauugugaccagauucauguugaugacguguccucugaugacaauggucaggaucuaucgacuuacaacuuuagcgcggacggcuuccacuccucagcccccggggcaaaucucugccugggaaguggcguccauggugggguggauuggaugcgaaaacuugcuuucagauauaggcgggugaaggagauguacaacacauauaaaaacaaugucggcggacugaucggcaccccuaagcgugaaacgugguugcaacuccgcgccgagcuggaagcauuaaccgaccuguggcucacacacucucuuaaagcccugaacuugauaaauagcagaccaaacuguguuaaugugcuaguaacuaccacacagcugauuccggcacucgccaaggugcugcuuuacgggcugggauccgucuuucccaucgagaacauuuauucagcuacuaagaccgguaaagaaagcugcuucgagaggaucaugcagcgguuuggccgaaaggcgguguacguugugaucggggauggagucgaggaggaacagggcgcuaaaaagcacaauaugccuuucuggcgcauuucuugucaugccgacuuggaagcucucagacacgcccuggaguuagaauaccuguga

SEQ ID NO: 55967 - RNA, 1920 nt, Artificial Sequence
  derived and/or modified sequence opt3 from EYA4__Homo_sapiens__NP_004091
auggaggacagccaggaucugaacgaacaauccgugaagaaaaccugcacagagucugacgucucacagagucagaauagcagauccauggaaaugcaggaucucgccucuccccacacucuuguuggcgggggagacacgccugguucgucaaagcuggagaaaagcaacuugaguuccaccucugugacaacuaauggcaccgggggagaaaacaugacaguauuaaauaccgcugauuggcugcuaagcuguaacacuccauccucagcaacaaugagucuccuggccgugaagaccgagccgcuuaauagcucugagacgacugcgaccacaggcgacggugcucuggauacuuucaccggguccgucaucacaucaagcggauacagucccaggucugcccaucaauauuccccucaguuguacccaagcaaacccuauccucacauucucucgaccccagcagcccagacgaugucugcuuacgcaggccagacucaauauuccggcaugcagcagcccgccguguacacagcuuauucacagaccgggcaaccuuacagucugccaacuuacgaccugggaguuaugcucccggccauaaagacagaaagcgguuuaucccagacccagucuccccugcaaagcggcugccuuucauauaguccuggguuuuccacgccacagcccggacagaccccuuacagcuaucagaugccagggucuucauucgcgcccaguagcacaaucuacgcaaacaauuccgugucuaacucgacuaauuuuagcgguucccaacaggauuauccgucauacaccgccuucgggcagaaccaguaugcucaauacuacagugccucuacauauggagcauacaugacuagcaauaacaccgcugacggcacaccuuccucaaccagcacuuaucaguugcaggagucucugcccggccuaacgaaucagccaggggaauuugauacaaugcaauccccuaguacccccauuaaggaccucgaugagcggacuugucgcagcucuggauccaaaucacgaggucguggcagaaagaacaacccaagucccccuccagacagcgaccuggagagggucuucgugugggaucuugacgaaaccaucauuguauuucauucgcuguugacaggguccuacgcccagaaauauggaaaggauccgcccauggcgguuacccucggccugcggauggaggaaaugaucuucaauuuagccgacacucaccuguuuuucaacgaucucgaggaaugcgaccaggugcauauagaugacgucucuagcgaugacaauggucaggaucuuucaacauacaguuuugcaacggacggguuccacgcugccgcuuccucugccaaccuguguuugccuaccggcgugcgcggaggcguggacuggaugagaaaacuagcauuuagguaucggcgcgucaaggagcuguacaauacuuacaagaacaauguugggggacuccuggguccagccaaacgagaugcuuggcuucaacugagagcggagaucgaaggcuugacagacagcuggcucaccaacgcacugaaguccuuaucaauuaucagcacaaggaguaauugcauuaacgugcugguaacuaccacgcagcuaauccccgcccucgcuaaagugcugcuuuauucuuugggcggagccuucccuauagagaauauuuacuccgcaaccaagaucggcaaagaaagcuguuucgagcggauuaugcagcguuuuggucgcaaggucguguauguugugaucggggauggcgucgaagaggagcaagccgcuaaaaagcacaacaugccauucuggagaaucucgucacauucugaccugcucgcccugcaccaggcacuugaacuggaguacuuguga

SEQ ID NO: 55968 - RNA, 9435 nt, Artificial Sequence
  derived and/or modified sequence opt3 from EYS__Homo_sapiens__NP_001136272
augaccgacaagagcaucgugauucugucccucauggucuuccacucuucauuuauaaacggaaaaacuugccggaggcagcuuguugaagaauggcacccccaaccuaguagcuacgugguaaauuggacucugacggagaacaucuguuuggauuucuaucgggacugcugguuuuuaggggugaauaccaagauugauacuuccggaaaccaggccgucccacagaucuguccgcugcagauucaauuaggugacauccucgugauuucuucggaacccucacugcaguucccugagaucaaucuuaugaacguuagcgaaacaaguuuugugggaugcguccagaauaccacgaccgaggaucagcuguuguucgggugucgccucaaaggaaugcacacugugaacuccaaguggcugucuguaggaacacauuacuuuauuaccguuauggcuagcgguccaucccccugcccucuggggcuccgauuaaaugugacggucaaacaacaguucugucaggagucacugaguagcgaauuuugcucuggacacggcaagugucuuuccgaggcauggucaaagacuuauagcugccauugucagccacccuucaguggcaaauacugccaagaauuggacgccugcucuuuuaagccuuguaaaaacaauggguccugcaucaacaagcgugagaauugggaugagcaggcguaugaaugugugugccacccaccguucaccggcaagaacuguagcgagauuaucggucagugccaaccccacguguguuuucauggcaauugcucgaacauaacaucuaacuccuucauuugugaaugcgacgagcaguucucagggccuuuuugugaagucagugcuaagccaugcguuagccugcuguucuggaagagaggaaucugccccaauuccucuagcgccuacacuuaugaguguccuaaaggcucaaguucccagaacggugagaccgaugugagcgaauuuucucucguaccaugccagaaugggacagacuguauuaagaucucaaacgaugugaugugcaucuguagucccauuuucaccgaccugcuuugcaaaagcauacaaacguccugugagucuuuuccgcugaggaauaacgcaacuugcaagaaaugugaaaaggauuacccuugcucguguaucagcggauucacagagaaaaauugcgaaaaggccauugaccacugcaaguugcucuccaucaacugucugaaugaggaguggugcuuuaacauaauuggccgguucaaauacgucuguauccccggcugcaccaagaauccauguugguuucuaaagaacguguaucugauccaucagcaccucugcuacugugggguuacuuuccacggaauuugccaggacaaggguccugcucaguuugaauauguguggcaacuuggcuucgcagggucagagggagaaaaaugucagggcgucaucgaugccuacuuuuuccuggcugccaauugcacagaggacgcgaccuaugugaacgaucccgaagacaauaacaguucuuguugguucccacaugaggguacgaaggagauuugcgcaaacgggugcagcuguuuguccgaagaggauucacaggaauaccgcuaucuuugcuuucugagaugggccggcaauauguaccucgagaacaccacagacgaucaggagaaugaaugucaacacgaggcuguaugcaaggacgaaauaaacaggccccgguguagcugcucucuguccuacaucggacgccuuuguguugugaaugucgauuauugccugggcaaccauaguauuagcgugcacggguugugucucgcccugucucauaauugcaacuguuccggauuacagcgauacgagagaaauaucugcgaaaucgacacugaggauugcaaaucagcaaguuguaagaacgguaccacaagcacucaccugaggggcuauuucuuucggaaaugcgucccuggguucaagggaacccagugugagauugacauagacgaaugcgcuucgcacccauguaaaaauggcgccacaugcaucgaucagccggguaacuacuuuugucaaugcgugcccccuuucaagguuguggacggguuuuccugucuaugcaauccaggcuauguaggcauucguugugagcaggauaucgacgauugcauucucaacgcgugcgaacauaauucuaccuguaaggaccugcaccuuagcuaccagugcgucuguuugucagauugggagggcaacuucugcgaacaagagaguaacgaguguaaaaugaaucccugcaagaacaauuccacuuguacggaccuguauaaaucuuaccgcugcgaauguacaagcggguggaccggacagaacugcuccgaggaaaucaaugagugugauucagacccuugcaugaacgguggccucugucaugaaagcacuauaccagggcaguuugugugccugugcccaccgcuuuacaccggacaguucugucaccaaagauauaaucugugcgauuugcuccacaacccuuguaggaauaacaguacaugccuggccuuaguugacgcaaaucagcauuguaucugccgggaggaguuugaaggcaagaacugugagauugaugugaaagacugccuguuccuaucuugucaggacuacggugauugcgaagacauggucaauaacuuucgauguaucugccgcccaggguucuccggcagccucugcgagauugagaucaaugaauguucgucagagcccugcaagaacaacggaaccuguguggaucugacuaauagauucuuuugcaacugugaaccugaguaucacggccccuucugcgaacuugacguaaauaaguguaaaauaucuccaugcuuggaugaggagaacuguguguacaggacagacggguauaauugccugugugcuccuggauacacgggcauuaacugcgaaaucaaucucgaugagugccugagugaacccuguuuacaugacgguguuugcauugaugggaucaaccacuauaccugugacugcaaguccggauuuuucggcacucauugugagacaaaugccaacgauugccugagcaauccaugucuucacggucggugcaccgaauugauaaacgaguacccguguucuugcgacgcugauggcacaagcacucaguguaaaaucaagauuaaugacugcaccuccaucccuugcaugaacgagggguuuugucaaaaaucagcccacggauucacgugcauuuguccccgcggcuacaccggggcauauugcgaaaagaguaucgacaauugugccgagccagaacucaacagcgucauaugccugaauggaggcauuuguguggauggucccgggcauacauuugacugcagaugucuaccuggauucucuggccaguuuugcgagaucaacaucaacgaauguuccucaaguccaugccugcacggugcugauugcgaggaccauauuaauggcuacguguguaaaugccagcccggguggagcggacaccauugugagaacgaacucgagugcaucccuaauuccuguguccacgaacugugcauggagaacgagccgggcucuacuugucuuugcaccccaggguucaugacauguucgauuggauugcugugcggcgaugaaauaaggcguaucacuuguuuaacccccauuuuucagcggacggacccuaucagcacacaaaccuauacuauuccacccucagagacacucguuuccaguuucccuucuaucaaggcgacccgaauaccggcaaucauggauacuuaccccguggaccaggguccaaagcagaccgggauugugaaacacgauauccugccuacaacgggacuugccacccugagaauuagcacucccuuggaauccuaucuccugcaagagcuaaucguaacaagggaacugucagcuaagcauucucuccugagcagugccgacgucuccagcucucgcuuccuuaauuuuggcauacgggauccagcacagauugugcaggacaaaaccucaguuucccacaugccuaucagaacaagugccgcuacuuuggguuucuuuuuccccgacaggcgcgcccgaaccccauuuaucaugagcucgcugaugucugauuucauuuuuccgacgcaguccuuacucuucgagaacugccaaacaguggcacugagcgcgaccccuacuaccucagucauacggaguauccccggcgcugacauugagcuuaaucgucagucucugcuauccagaggguuucuccugaucgccgcaagcauuucagccacaccagugguuaguaggggagcucaggaagauaucgaggaauacagcgccgacuccuugauaucucgccgggagcauuggagacuguuaagccccuccaugucaccuaucuucccagcaaaggugauuaucucuaaacagguaacuauucucaacaguucggcucugcacagguuuagcaccaaggccuucaaucccuccgaauaucaagcgaucacagaggccucuucaaaccagcgacuuacgaauauaaagagccaggcugcagauucccugcgcgaguugagucagaccugcgccacuuguucuaugacagaaauuaaaagcucacgggaguuuuccgaccaaguccuccacaguaagcagagccauuucuacgaaaccuucuggaugaacucugcuauccuggccuccugguacgcacuaaugggcgcgcagacuaucacaucagggcacagcuuuucgucugccaccgagauuacgccuaguguggcuuucacugaagugccgucccuguuuccaagcaaaaagucagccaaaagaaccauccuuuccucuagccucgaggagaguauaacacuguccagcaauuuggaugucaaccugugcuuagacaagaccugucucucuauuguucccucacagacuaucaguuccgaucugaugaauagcgaccuuacaucuaagaugaccacagaugaacugucggugucagagaacauuuugaaacuccugaagaucaggcaauauggaauaacuaugggcccuaccgaaguacuaaaccaggagagccugcuugacauggagaaauccaaggguagucauacacucuucaaacugcaccccucugauagcuccuuggacuuugaauuaaaucugcagauuuacccagacgugacacucaagaccuauucagagaucacucaugcaaacgauuucaagaauaaccugccuccccuuaccgggagugucccagacuuuucugaagugacaacuaauguugcuuucuacaccgugagcgccacgccugcacuguccauccaaacaucaagcucuauguccgucauucguccggauuggcccuauuuuaccgacuacaugacaaguuugaaaaaggaggugaaaacaagcucggaaugguccaagugggagcuacagccaucuguucaguaucaggaguucccuaccgccucacgccaucugcccuuuacucggagccucacacugaguucccuugaaucuaucuuagcuccacaaagacugaugauuagcgauuucucaugcgugagguacuacggagacuccuaucucgaguuucagaacgucgcguugaauccucagaacaauauaagucuggaguuccagaccuucagcucuuacggccuccugcuuuauguaaaacaagauucaaaccugguggacggcuuuuucauccaguuguuuauugagaaugggacgcuaaaguaccacuucuauugucccggagaagccaaauuuaaguccaucaacacuaccguucgaguggauaauggucagaaguacacacugcucauccggcaggaguuagacccgugcaacgcagagcugaccauucuuggccgcaauacacaaauaugugaaagcaucaaccauguccuggggaaaccacucccuaagucuggaaguguguucauuggcgguuuucccgauuugcacgggaaaauccagaugccaguacccgugaagaacuucacuggaugcauugaggucaucgaaauaaauaacuggagaucguuuaucccuuccaaagcuguuaagaauuaucauauuaacaauuguaggagccagggcuucaugcugucaccgaccgccucuuuuguggacgccagcgaugugacgcaaggcgucgacacaauguggacuuccgugagucccucaguugcugcaccaucuguaugccagcaggacgugugucacaacgggggaaccugccacgccaucuuccucagcuccgguauugucaguuuucagugcgauuguccucugcauuucacaggccgguucugcgagaaggacgcggggcuauuuuuccccagcuuuaauggaaacuccuaccuagaacugccuuucuugaaauuuguguuagagaaggagcacaaucgaaccguuacuaucuaccugaccauaaaaacaaacucucucaauggcacgauucuguauucaaacgguaauaacugugggaagcaauuccuucaucuguuucucguggaaggaagaccaagcgucaaauacggcugcggcaauucgcagaacaucuugacuguguccgcuaacuauaguauuaauaccaacgccuucacacccaucaccauacgcuacacuacaccuguagggucuccaggagucguguguaugaucgagaugaccgcagaugguaagcccccgguucagaagaaagacacggaaauuagccacgccucacaggcuuauuuugaguccauguuccugggccauaucccugcaaaugugcaaauucacaagaaagccgggccagucuacggauuuaggggcugcauccuagaucugcaagugaacaauaaggaguucuuuauaauugacgaagcgcgucacgguaaaaacaucgagaauugucauguucccuggugcgcucaccaucucugucggaacaaugggacuugcaucucugauaacgaaaaucuuuucugugagugcccuagacuguauaguggaaaguuaugccaguucgccagcugugaaaacaauccaugcggcaacggcgcaacaugugugcccaaguccgggaccgacauugucugcuuguguccguacggaaggucagguccucugugcaccgaugccaucaauauaacucagccccgcuuuagcggcacagacgcuuucggguacaccucuuuucucgccuauagucgaauuuccgauaucagcuuccacuacgaguuucaccugaaauuccaacuugcaaacaaccauucagcucugcagaauaaccucauauuuuucacaggacagaagggccacgguuugaauggggacgacuuucuggccgugggauuacuaaacggcucuguaguguauuccuacaaucugggcucggggaucgcgagcauaagaagugagccacucaaccuuucucugggaguucauacuguccacuuggguaaauucuuucaggaaggcuggcugaagguggaugaccauaaaaauaaguccaucauugccccugggcggcucgugggacugaacgucuucagccaauuuuauguaggcgguuacucagaguauacgcccgaucuucucccaaauggggcagacuucaagaacggcuuccagggauguaucuuuacccuacaggugaggacagaaaaagauggccacuuccgcggguugggaaaucccgagggucacccuaacgcuggccguaguguugggcaaugccaugccuccccauguagccugaugaagugcggaaauggcgguacuuguauugaaucugggaccucaguguacugcaacugcacaaccggcuggaaaggcuccuuuuguacugagacggucucuaccugcgacccggagcacgaucccccucaucacuguagcagaggcgcuacaugcaucaguuuaccacauggguacacuuguuucugcccccuaggaaccacagguauuuauugugaacaggcacugucgaucagcgacccuuccuuucggucaaaugagcucucuuggaugagcuucgccaguuuucacgugaggaagaaaacccacauacagcuucaguuccaaccacuggccgcugauggcauuuuguuuuacgcggcacagcaucugaaggcccaguccggggacuuccucugcaucucacugguuaacucuagcgugcagcuucgcuauaacuuaggagaucgaacuaucauucuggaaacacuccaaaaagucacgauaaauggcuccaccuggcacaucauuaaggcugguagagugggggccgagggcuacuuggaccuggauggaaucaacguaacugaaaaggcaaguacaaaaaugagcucucuagacaccaauaccgacuuuuauauuggcggggugucaucccugaaccucguuaaucccauggccaucgagaacgagccugucggauuccagggcuguauaagacaggugaucauuaauaaccaggaacuucaacugacagaguuuggugcuaaagggggaagcaaugugggcgauugcgacgguacugcguguggcuacaacacgugcaggaaugggggagaaugcaccgucaacggcacaacuuucaguugucgcugcuugccggauugggccgggaauaccuguaaccagucuguuuccugccugaauaaccucugucugcaucagucguuaugcaucccagaccagagcuucucauauuccugucuuugcacacugggaugggugggcagauacugugagaacaaaaccucuuuuaguacugcaaaguucauggguaauagcuacauuaaauauaucgaucccaacuacaggaugcggaaucuccaguuuacgacaauaucacuaaacuucuccaccacuaagaccgaggggcugauuguauggaugggaaucgcucagaaugaagagaacgacuuuuuggccaucggccugcacaaucagacacucaagauugcagugaaccuuggugaacguauaagcgucccuaugucuuauaauaacggcacuuucugcuguaauaaauggcaccaugugguugugauccaaaaccagacccugauuaaggccuacaucaauaacaguuugauucuguccgaggauaucgacccccacaaaaauuuugucgcucucaacuaugaugggauaugcuacuuaggaggcuucgaauaugggcgcaagguaaacaucgugacacaggagauuuuuaaaacgaauuucguuggaaagaucaaggacguggucuuuuuccaggagcccaaaaacauugaacugaucaaacuugagggcuacaauguguacgauggugacgaacaaaacgaggucaccuga

SEQ ID NO: 55969 - RNA, 2244 nt, Artificial Sequence
  derived and/or modified sequence opt3 from EZH1__Homo_sapiens__NP_001982
auggagauccccaacccuccaaccagcaagugcauuacauacuggaaaagaaaggugaaauccgaauauaugaggcugcggcagcucaagcgccuucaagccaauaugggcgcuaaagcacuguacgucgccaacuucgcgaagguucaggagaagacucagauauugaaugaagaguggaaaaaguuacgagugcagccgguacaaucuaugaaacccgugucagggcacccuuuucugaagaaauguacgaucgaaaguauuuucccaggauuugcuagccagcauaugcuaaugcguucccucaacaccgucgcccuggugcccaucauguauucuuggucgccucuucagcagaauuucaugguugaggacgagacagugcugugcaacauuccauacaugggugaugaagucaaggaggaagacgagacuuuuaucgaggaauugauaaauaacuaugauggcaaggugcacggggaggaagagaugauccccggaucaguacucauuagcgacgcaguuuuccuggaacugguggaugcccucaaucaauacagugacgaggaggaagagggccauaacgauaccuccgacgguaaacaggaugacucuaaggaagauuuaccugucacaagaaaaaggaagcggcacgcuaucgaggggaauaaaaagagcuccaaaaagcaguuuccaaacgacaugauuuucucagcaaucgccaguauguuuccggaaaauggagugcccgaugacaugaaggagcgcuauagagagcugaccgaaaugagcgacccuaacgcccuuccaccccaguguacuccuaauauagauggcccaaacgcuaaaucugugcaaagggagcaguccuugcauucauuccacacacuguuuugccggcgcuguuucaaguacgacugcuuucuacaccccuuccaugcgaccccgaacgucuacaaacgaaagaauaaagaaauuaagaucgagccugaacccuguggcacggauugcuuccuccugcuugagggggcaaaggaguaugccaugcugcacaacccaagaagcaaauguaguggaaggcggcgucgcagacaucacauuguuucugcuuccugcagcaaugccucggcaucugcuguggccgaaacuaaggagggugacuccgauagggacaccggcaacgauugggcgucaaguagcuccgaagccaauucucggugucagacaccuacuaaacaaaaggcaagccccgcuccaccccaguugugcguaguggaggccccuucagagccagucgaauggaccggggcugaggaaagucucuuucgaguguuccacggaacauacuuuaacaauuucugcuccaucgcccgccuguuaggcaccaaaacguguaagcagguuuuucaguucgcagugaaggagagccugauccucaaacuuccgacugacgaacugaugaaccccucucaaaagaaaaagagaaaacauagguugugggccgcucacugccggaagauucagcuaaagaaagauaauucaaguacacaggucuauaacuaccagccuugugaccauccagaucgccccugcgacagcaccuguccuugcauaaugacucaaaauuuuugugagaaguucugccaguguaacccagacugccagaauagauuucccgguuguaggugcaaaacacagugcaacaccaagcaauguccgugcuaucuggcggugcgugagugugauccugaccucugccugacguguggggcauccgaacacugggauugcaaaguaguuucuuguaagaauugcucgauccagcggggacuuaaaaagcaucuguugcucgccccaagcgacguggcuggcuggggcaccuucauuaaggaguccguccagaaaaacgaauuuaucucagaguacuguggggaacugauaagucaggaugaggccgaccgaagaggaaagguguaugauaaauacaugucuagcuucuuauuuaaccugaauaacgacuucgucguggaugcaacaaggaaggguaauaaaauucgcuucgccaaccacuccguuaaucccaacugcuacgcuaaggugguaauggucaauggcgaccaccggaucgggaucuuugccaagagagcaauucaagcgggagaggaacuauucuuugauuauagguacucacaggcugacgcccucaaauaugugggcaucgagcgcgaaacugauguucuguga

SEQ ID NO: 55970 - RNA, 2265 nt, Artificial Sequence
  derived and/or modified sequence opt3 from EZH2__Homo_sapiens__XP_005250019
augaucuacuucauuagaauaaucaugggccagaccgggaagaaaagcgagaagggacccgugugcuggaggaaacgggucaaguccgaauauaugcgccugcgacaacucaaacguuuuagaagggccgacgagguuaagucuauguucucaaguaaccggcagaagauucuugaacgcacagagauccugaaucaggaauggaaacagagaaggauucaaccugugcacaucuugacuagcguauccucuuuacgggguacgcgcgaguguucggugaccucagaucuggacuuuccaacacaggucauaccgcuaaagacucucaacgcuguggcaagcguucccaucauguacaguugguccccucugcagcagaauuucaugguggaggaugaaaccguccuucauaacauuccauauaugggcgacgaggugcuggaucaagacgggacauuuaucgaagaguugauuaaaaauuacgauggaaagguacacggcgaccgagagugcgguuucaucaacgaugaaauauuuguugagcucgugaaugcccuggggcaguauaacgacgaugacgaugacgacgauggagacgaucccgaagagagagaagagaaacagaaggaccuggaggaucauagggacgauaaggaaucucggccuccacguaaauuccccagcgacaagauuuuugaggcgaucuccucaauguucccugauaaaggcaccgcugaagaacucaaggaaaaauacaaggaguuaacugagcagcaacugccaggcgcccuuccgcccgaauguacaccuaauauugacgggccaaacgcaaaaaguguccagcgcgagcagagcuugcacucuuuucauacccuguucugcagaagguguuuuaaguaugauugcuuccuacaccccuuccacgccacgccuaauacuuacaagcggaaaaacaccgaaacagcucucgacaauaagccauguggaccccaaugcuaccagcaucuggagggugcaaaagaauuugccgcugcccuuacugcggagcgaaucaagaccccgccuaaacgccccggcgggagaaggcggggacgccugccaaacaauuccucaagaccuagcacacccaccaucaacguguuggagaguaaggacacggauucugacagggaagcaggcacugagacagguggggaaaacaaugauaaggaggaggaagagaaaaaggacgaaaccuccagcucgucugaggccaacucccguugucagacuccaauuaaaaugaagcccaauauagaaccuccagagaacguggaguggucaggagcugaagccaguauguuccggguccucaucggcacauauuacgauaauuuuugcgcaauugcucgacugaucggcaccaaaacguguagacagguuuaugaguucagggugaaggaaagcuccauaauugccccggcgcccgccgaggacguagauaccccuccacgcaagaaaaagcggaaacacagauuaugggcagcucauugcaggaagauccaacugaaaaaggacgggucuagcaaccacguguacaauuaucagcccugcgaucacccucgccagccaugugacucaaguugccccugugucaucgcccagaacuuuugcgaaaaguucugucaaugcuccagcgagugucagaaucgauuuccgggaugccgguguaaagcucagugcaacacaaagcaguguccuugcuaccucgccgugcgugagugcgauccagaccuuugucugacuugcggugcagccgaucauugggacucuaaaaauguuucauguaagaacugcaguauucaaagaggcagcaaaaagcacuugcuacuggcucccuccgacguggcgggguggggaaucuucauuaaagauccuguccagaagaaugaauuuauaucugaguauuguggcgaaaucauuucgcaggacgaggcagauaggcgcgguaagguguacgacaaauacaugugcagcuuccucuuuaaccugaauaacgauuucguaguugacgccacccggaaggggaacaaaaucagauuugcuaaucauuccgugaaccccaauuguuaugccaaggucaugauggugaacggcgaucacaggaucggaauuuucgcaaaacgagccauacagacaggcgaggagcuuuucuuugacuaccgcuauucacaagcugaugcccugaaguacgucgggaucgagcgggaaauggagauuccauga

SEQ ID NO: 55971 - RNA, 1761 nt, Artificial Sequence
  derived and/or modified sequence opt3 from EZR__Homo_sapiens__NP_001104547
augcccaagccuaucaacgugagagucaccacaauggacgccgagcuggaguucgcuauucagccaaauacuacgggcaaacaacucuuugaucagguugugaagaccauagggcuuagggagguaugguacuucggacugcacuauguggacaacaaagguuuuccgacaugguugaaguuagauaaaaaggucagcgcacaggaagugcggaaggagaauccccugcaguucaaauuucgcgccaaguucuacccugaagacguugcggaggagcuaauccaagauauuacucagaaacucuuuuuccuucaggugaaggaaggcauccuguccgacgagauuuauugcccacccgaaaccgcuguccuguuggggucuuacgccgugcaggcaaaauuuggagauuauaacaaggagguacauaagucaggcuaccucaguagcgagcgacugaucccucaacguguuauggaccagcacaaacugacaagagaucagugggaagacaggauacagguguggcaugccgagcaccgggguaugcucaaggauaaugcuauguuagaauaucugaaaaucgcacaagaccuugagauguacgggauuaacuacuucgaaaucaagaauaaaaagggaaccgauuuguggcugggcgucgacgcccuaggccucaacauuuaugagaaagacgauaagcugacuccaaagaucggguuucccugguccgagauacgcaauauuucuuucaacgacaaaaaguuugugaucaaaccuauugauaagaaagcuccagacuucguguucuacgccccgagacuuaggaucaauaagcggauccugcaguuguguaugggaaaccaugaacucuauaugcgccgaagaaagcccgauacaauugagguccagcaaaugaaagcgcaggcaagggaagagaagcaccagaaacagcuggaacggcaacaguuagagaccgagaagaaacgucgcgaaacgguugagagagaaaaggagcagaugaugagggaaaaggaggagcugaugcuccggcuucaggacuacgaagagaaaacuaagaaagccgaacgagagcugucggagcaaauacagcgcgcuuugcagcuagaagaggaaagaaagagggcccaggaggaagcagagcggcuggaggcugaucgcauggccgcgcucagagccaaagaagaacuggaaaggcaagcaguggaccagaucaagucacaggagcagcuugcugccgaacuggcugaguauaccgccaagauugcauugcucgaggaagcccgucggcgaaaagaggaugaaguagaggaauggcaacacagagcuaaggaggcgcaggacgaucuggugaaaacaaaggaggaauuacaucuggucaugacugcaccuccacccccuccacccccgguguacgagccuguuagcuaucacgugcaggaaagucuacaagacgagggugccgagcccaccggcuacuccgcugaacucucuagcgaggggaucagggacgaucgcaaugaagagaaacggauaacagaagccgagaagaacgagagaguccagaggcagcugcuuaccuuguccucagaacugagucaggcacgcgacgagaauaaacgaacgcauaacgauauuauccacaacgaaaauaugcggcaaggacgugacaaguacaagacucucagacagaucaggcagggcaacacaaaacagcgcauugaugaguuugaagcccuguga

SEQ ID NO: 55972 - RNA, 1467 nt, Artificial Sequence
  derived and/or modified sequence opt3 from F10__Homo_sapiens__NP_000495
augggcagaccccugcaccucgugcuucugagcgccuccuuggcuggguuacugcuacucggagagucucuguucaucaggcgggaacaggcaaacaauauucuugcccgcgucacccgagcgaacucauuucuggaggaaaugaagaaaggucauuuggagcgugaaugcauggaggagacauguaguuacgaagaggcuagagaaguuuucgaggacagcgauaagacuaaugaguuuuggaacaaauauaaggacggcgaucaaugcgaaacguccccuugucagaaucaggggaaaugcaaggacggacucggcgaguacaccuguacaugccuggaagguuucgaggggaagaacugugaacuguuuacuaggaaacucugcucuuuagauaauggagacugugaucaguucugccacgaggagcaaaacucggugguauguucaugcgcccggggcuauacccuggcagacaauggcaaggccugcauaccaacagggccguaccccuguggaaaacagacccuugaacgcagaaagaggagcguggcucaggcaacuucauccucuggugaggccccugauagcaucacauggaaaccauaugacgcugccgauuuggaccccaccgaaaacccuuuugaucugcuagacuucaaucagacgcaaccagagcggggcgacaacaaucucacucgcauugucgggggacaggaaugcaaggauggcgagugucccuggcaggcgcugcuuaucaacgaggaaaaugaggguuuuugcgggggaaccauucuguccgaguucuacaucuugacagcagcccauugucucuaucaggcuaagcgauuuaaagugagaguuggcgacaggaacacugaacaagaagagggcggggaggccgugcacgaagucgaggugguaauaaagcauaaccgguucaccaaagaaacauacgauuuugacaucgcaguucugcguuuaaagaccccuauuacguuccgcaugaauguggcuccagccugccugccggagagagauugggcggagucaacucucaugacacagaaaaccggaaucgucagugguuucggcaggacucacgaaaaggggcggcagagcacacgacuuaaaaugcuggaggugcccuacguggaccgcaacucuuguaaguuguccaguagcuuuauuaucacccaaaauauguucugcgccggauaugauacgaagcaggaagacgcaugucagggcgauaguggugggccucacgucaccagauuuaaagacacauacuucguuacuggcauagugucuuggggagagggcugcgcuaggaaggggaaauauggaauuuacaccaagguaacagccuuucuaaaauggaucgaucgguccaugaagacucgcggucugccaaaggcuaaaagccaugcccccgaagugauuaccucgucuccucucaaguga

SEQ ID NO: 55973 - RNA, 1878 nt, Artificial Sequence
  derived and/or modified sequence opt3 from F11__Homo_sapiens__NP_000119
augaucuuccuguaccaggugguccacuuuauucucuucaccagcguuuccggcgagugcgugacacaacuucugaaggacacuuguuuugaagggggagauauaacgaccguauucacacccucugccaaauauugccagguggucuguacuuaccauccuagaugcuuguuauuuaccuucacagcugagucaccaagugaagacccgaccaggugguuuacuugugugcugaaggauagcguuacagagacccuaccccgggugaaccgcacggcagccaucuccgguuauucuuucaaacagugcucgcaccagauuucagcguguaauaaggacaucuacgucgaucucgacaugaaaggcauuaacuauaauagcaguguggcuaaguccgcccaagaaugccaggagcgauguacugaugacguacauugccacuuuuucaccuacgcaacacgucaguuuccuucucuggagcauagaaacaucugucuucugaagcacacucagaccgggacaccaaccaggauaacgaaauuggauaagguugugagcggauucucccucaaaucaugcgcccugaguaaucuggcuugcauccgggacauuuuucccaacacugucuucgcagauagcaauaucgacucugugauggccccugaugcuuucguguguggccgcauuugcacacaccauccagguugucucuuuuucaccuuuuucucccaagaauggcccaaggagucacagagaaacuuaugccugcuuaaaacuagcgaaaguggguugccuucuacaaggaucaagaaguccaaagcccugagcggauuuucgcuacagucuugucggcacuccauaccagucuucugccauucaaguuuuuaucacgacaccgacuuccucggcgaggagcuggauauuguugcggcaaagagccacgaagccugucagaaacuuugcacgaaugcugugcgcugucaauuuuucaccuacacaccggcccaggcauccugcaacgagggcaaggggaaauguuaccugaaguugucuagcaauggaucacccacuaaaauccuccauggucgaggcgggauuaguggauauacccugagauuaugcaagauggacaacgaaugcacaacuaagaucaaaccuaggaucguaggcgguaccgcuuccgugcguggggaguggccauggcaggucacacugcacaccacuagccccacgcaacggcaucucuguggaggcucuauuauaggcaaucaguggauccuuacagccgcgcacugcuuuuacgggguggaaucaccuaagauucugcgcguuuauaguggaaucuugaaccagagcgagauaaaagaggauaccuccuucuuuggugugcaggaaauuaucauccaugaccaauacaagauggccgagucuggcuaugauauugcacuacugaaacucgaaacuaccgucaauuacacagacucgcagagaccaaucugucugcccagcaagggggauaggaacgugauuuauaccgacugcuggguaacuggauggggcuaccggaaacuucgagauaagauacagaacacacugcagaaggcuaaaaucccguugguuacgaaugaggaaugucaaaagcgcuacagaggucacaaaauuacccacaagaugaucugcgccggguauagggagggcggaaaggacgcuuguaaaggcgauuccgggggaccucucucaugcaagcauaacgagguguggcaccuggucgguaucacaaguuggggcgaagggugugcccagcgggagcgccccggaguguacacuaaugucguggaauauguugacuggauuuuagagaaaacccaggcaguguga

SEQ ID NO: 55974 - RNA, 900 nt, Artificial Sequence
  derived and/or modified sequence opt3 from F11R__Homo_sapiens__NP_058642
augggcaccaaggcccagguggagagaaaacugcucugccuuuucauccuggcuauuuuguuauguagccuggcacuaggguccgucacaguucacucuucagaacccgaggugaggauaccugaaaacaauccaguaaagcucaguugcgccuacagcggauuuuccucuccgcggguggaguggaaauucgaccaaggugauacuacgcgccuggucuguuauaacaauaagaucaccgcgucguacgaagaccgagugacauuucuucccacuggcauuaccuucaaaucaguuacacgugaggauaccgggacuuauacaugcauggugagcgaggaaggaggcaacaguuacggugaggucaaggugaagcugaucguauugguuccuccauccaaacccaccgugaauauuccuucuagcgcuacgaucgggaacagagccguccucacuuguuccgaacaggacggaucaccacccagugaguauaccugguuuaaggauggcauagugaugccuacaaauccaaaaagcacuagggcauucucuaacuccucauacgugcugaauccgaccacaggcgagcuggucuuugacccccucagcgccagugauaccggggaauauucuugcgaggcucggaacggauacgguacgccuaugacuuccaaugcaguucgcauggaagccguggagagaaacguaggcgugaucgucgcugccguguuaguuacacugauucuuuuggggauccugguguucggaauuugguuugcguacagcaggggccauuucgaccggaccaagaaagguacuucgucuaagaaggucaucuauucccagccaucagcacgcagugaaggggaguuuaaacagacaagcuccuuccuaguguga

SEQ ID NO: 55975 - RNA, 1848 nt, Artificial Sequence
  derived and/or modified sequence opt3 from F12__Homo_sapiens__NP_000496
augagagcccugcuccuucugggcuucuuguuagugagccuggaguccacccuaucuauucccccuugggaagcuccaaaggagcacaaauacaaggcagaggaacauacagucguucucacugugacgggggaaccgugccacuuucccuuccaguaucauaggcaacuguaccacaaauguacccauaagggacggccugguccacagcccuggugcgccacaacuccuaacuuugaccaggaucagcgcuggggcuauugucuugagccaaagaagguaaaggaccacugcucaaaacacagucccugucaaaaagggggaaccugcgugaauaugccuagcggcccacauugucugugcccgcagcacuugacagguaaccauugucagaaagagaagugcuucgaaccccagcuccugcgauuuuuccacaaaaaugagaucugguaccguaccgaacaagcggcugucgccagaugucagugcaaggggccugaugcacacugccagaggcuggccucccaggcuugucggacuaacccaugccuccauggaggccgcuguuuagagguggagggccacagacugugccauugucccguuggguauacaggagcauuuugcgacguggauaccaaggccucuuguuacgacgguaggggccuuucguaucggggguuggcucgcacgacucugucaggagccccuugccaaccaugggcgagcgaagcaaccuaccgaaaugucacagccgagcaggcuagaaacuggggccuaggugggcacgccuucuguaggaaucccgauaacgacauacggccguggugcuuugugcucaaucgugaucgccugaguugggaauacugugaccuugcacagugccaaacuccuacccaggcugcgcccccaacaccuguaucccccagacugcauguuccauugaugcccgcccagccugccccaccgaaaccccagccuaccacgaggacuccaccccaaucucagacaccuggagcacucccagcuaagcgggagcagcccccgagccugacccgaaacggcccuuuauccugcggccagcgccugagaaaaucacucaguagcaugacuaggguggucgggggacuuguggcccugcggggugcucacccauauaucgccgcauuguacuggggccacucuuucugugccgggucccuaauugcucccugcugggugcugacagcggcacauugucuccaagaucgcccugcccccgaagaccugaccgucguucuuggacaggagagaaggaaucacucaugcgagccaugucagacgcuggcugugcguagcuaucgguugcaugaagccuuuaguccuguaucuuaccagcacgaucucgcacuguuacgacugcaagaggacgccgacggcuccugcgcucuacucagccccuaugugcagccagucugucugccgucgggugccgcaagaccuucugaaaccacacuuugccagguggcgggguggggccaccaguucgagggagcugaagaguacgccuccuuuuugcaagaggcacagguucccuuccugucacucgaaagguguagugccccagaugugcauggcagcuccauccugcccgggaugcuuugcgcuggauuccuggaggguggcacugacgccugucagggggauucuggaggcccuuuggucugcgaagaccaagcagcugagcgccggcucacccugcaggguauuaucagcugggggucaggcugcggagauagaaacaagccaggcguguauacagacguagccuacuacuuagcguggauaagggaacacacuguuaguuga

SEQ ID NO: 55976 - RNA, 2199 nt, Artificial Sequence
  derived and/or modified sequence opt3 from F13A1__Homo_sapiens__NP_000120
augagcgagaccuccagaacagccuucggcgggaggcgggcugugcccccuaacaauucuaacgcagccgaagacgaucugccaacugucgagcuccagggaguugugccgcgcgguguaaaucuucaagaauuucugaacgugacgucaguccacuuguucaaggagcgaugggacaccaauaaaguggaucaucacacagacaaguacgaaaacaauaaauuaaucguucguagaggccagaguuuuuaugugcagauugauuucagcaggcccuacgacccucggcgcgaucuguuuagagucgaguaugugauagggagguacccacaggagaacaagggaacuuauauccccguaccuauuguuuccgaacuacaaucuggcaaauggggugcgaagaucgugaugcgggaggaccgcucgguccgacucucaauucagagcaguccaaagugcaucguggggaaauucagaauguacguggcugucuggacccccuauggaguucugaggacaucccggaauccugaaaccgauacuuacauacuuuuuaacccauggugugaggacgaugccguguaccuggacaaugagaaggaacgugaggaauauguauugaacgauaucggcgugauuuucuacggcgaggucaaugacaucaaaacacgcucuuggagcuaugggcaguuugaagacgguauucucgauaccugccuguacgugauggacagagcacagauggaucuguccggaaggggcaacccgaucaagguuucacggguggggagugccauggucaaugcuaaagacgaugagggagugcucguaggcagcugggacaacauauaugcauacgguguucccccuucugccuggacgggguccguggauauuuuacuggaguaucgaucaagcgaaaacccaguccgcuacggacaauguuggguguucgcuggcgucuuuaauacuuuccuuagaugcuugggcauccccgccaggauugugaccaacuacuuuagugcgcaugacaaugaugcaaaccugcagauggacaucuuccuagaggaagaugggaauguuaacucuaagcucacaaaggacuccguguggaauuaucacuguuggaacgaggccuggaugacucggccugaccugccaguaggauucgguggcuggcaggcugucgauagcacaccccaggaaaauucggacgggauguaccgcugcggaccggccucugugcaagcaaucaaacauggccacguuuguuuucaguucgaugcuccuuuuguguucgccgaggucaacuccgaccuuauuuauauaaccgcgaagaaagaugguacccacgugguagagaauguggacgccacgcauaucgggaagcugauuguuacuaaacagaucggcggagauggcaugauggacauaacagauaccuacaaguuucaagaagggcaggaggaagagagauuggcacucgaaacugcucugauguauggagccaaaaagcccuuaaacacagagggugucaugaagucaaggaguaauguggacauggauuucgagguggaaaacgcuguccugggcaaagacuuuaagcucagcauuaccuuccguaauaacucccacaaccgguacacgaucaccgccuaucuuucugcaaauaucacauuuuacacugggguuccaaaagccgaguucaagaaagaaaccuuugaugugacacuggagccuuugagcuucaagaaggaggcugugcuaauucaggcgggagaauacaugggccagcugcucgagcaagcaucacugcauuucuucguaacugcccgaaucaacgaaaccagagacguccuugcuaaacagaagaguacagugcugaccauucccgagauaaucauuaaaguuagggguacucagguggucggguccgacaugacggugacaguugaauuuaccaauccauugaaggagacucuccgcaacguguggguacaccuggauggccccggagucacccggccuaugaaaaagauguuuagagagaucaggccaaauagcacagugcagugggaagaggugugccgcccgugggucucuggccaccgaaaguuaaucgccucaaugaguagcgacucccugcggcauguuuauggggaacuagaugugcaaauucagcguagacccucuauguga

SEQ ID NO: 55977 - RNA, 1986 nt, Artificial Sequence
  derived and/or modified sequence opt3 from F13B__Homo_sapiens__NP_001985
augagacugaagaaccucaccuucaucauuauacuuaucauuagcggcgagcuguacgccgaagagaaacccugcggguuuccucacguggaaaauggaaggaucgcucaguauuacuauacauucaaguccuuuuacuucccaaugucuauugacaaaaaguugucauuuuucuguuuagcagguuauacuacggagaguggccggcaagaagaacagaccacaugcacuaccgagggguggagcccggaaccccgcuguuuuaaaaagugcacaaagccugaucuguccaacggauacaucucugacgucaaacuacucuauaagauacaggagaauaugcgauacggcugugccucggguuacaaaaccacugggggaaaggaugaagagguugugcagugccugucagacggcuggagcagucaaccaacaugucguaaagagcaugaaaccugccuugcgcccgagcuguauaacggcaauuacuccacgacucagaagaccuucaagguaaaagauaaggugcaguaugaaugugcuacaggguacuauacugccggagguaaaaagaccgaggaagucgagugcuugacauacggcuggucucucaccccuaaauguacgaagcugaaaugcagcucccugagacucaucgagaacggguauuuucacccagugaagcagacuuacgaagagggagacguugugcaauucuuuugccaugaaaauuacuauuuaucaggcagugaucugauucaguguuacaacuucgguugguaucccgagagcccugucugcgaagggaggcggaaucgcuguccaccgcccccucuuccaaucaacucuaagauucagacacacuccaccacuuacagacauggagagaucgugcacauagagugcgaauugaauuuugagauucacggcucagcagaaaucaggugugaggacggcaaauggacagaacccccuaagugcauugaggggcaggagaaaguagccugugaggagccacccuucaucgaaaacggagcugcaaaucugcauagcaagaucuauuacaacggugauaaaguuaccuaugccugcaagaguggcuaccuacuccacgggucuaaugagauuacguguaaccggggaaaguggacccugccgccugagugcguggaaaacaaugagaacuguaaacaucccccagucgugaugaauggcgcuguggccgacgguauacuugcguccuacgcaacagggagcucggucgaauaucgcugcaacgaguacuaucuguugcgaggcucuaagaucuccagaugcgaacaaggaaaauggucaaguccucccguuugucucgagccaugcacugugaauguagauuacaugaacaggaauaacauugagaugaaguggaaauaugaaggcaaggugcugcacggggacuuaaucgauuucgucuguaagcagggauacgaccugagcccccucaccccucuuuccgagcugucugugcagugcaaucggggugaaguuaaauauccauuguguacacguaaggagagcaaaggcaugugcacuucaccgccccuaauaaagcacggggugauuaucaguuccaccgucgacacauacgaaaacggaagcucuguggaguaccgcuguuuugaucaucacuuccuggagggcucaagagaagccuauugccucgacgguauguggaccacuccuccacugugucuugagcccugcacgcugaguuuuacagaaauggagaaaaauaacuugcuccugaagugggauuucgacaauaggccucauaucuuacacggggaauacauugaguuuaucugucggggcgauaccuauccagcugagcuguacauuacuggaagcauacuacgaaugcaaugcgaccgcggccagcucaaguaucccagaugcaucccgaggcaguccacccugucuuaccaggaaccucuucggacauga

SEQ ID NO: 55978 - RNA, 1869 nt, Artificial Sequence
  derived and/or modified sequence opt3 from F2__Homo_sapiens__NP_000497
auggcccacgugagaggccugcagcuccccgggugccuugcucuggcagccuuguguagcuuaguccauucccaacacguuuuccuggcgccucagcaggcuaggucucuacuccagcgggugcgccgagccaacaccuuucuggaggaaguacguaagggaaaucuugagagagaaugcguggaggaaacauguucauacgaggaggcauucgaagcccuggagaguagcacugcuacggacgucuuuugggcaaaauauaccgccugcgaaacagcuaggacuccacgggauaaguuggccgcgugucucgaggguaacugcgcagagggccuggggaccaauuaccgcggacaugugaacaucacaagauccggcauugaaugucaacuguggaggucucgguauccgcacaaacccgagauaaauucgaccacucauccuggugccgaccuccaggaaaacuucugccgcaauccagauucaagcacaaccgggcccugguguuacacgacugacccuaccguucgaagacaggagugcaguaucccaguguguggacaggaucaagucacaguggcuaugacucccagguccgaaggcucuagcguaaacuuauccccuccacuggagcagugcguuccggaccggggccagcaguaucaagggcgucuugccgugaccacacacggauugcccugccuggcaugggcuucagcccaggcgaaggcccuaaguaaacaccaggauuuuaauagcgcaguccaacucguggagaacuucugucgcaauccugacggugaugaagagggcguguggugcuacgucgcugggaagccaggagacuuuggcuauugugaucugaacuacugcgaagaggccguugaagaggagaccggugacgggcuugaugaagacucugacagagcuauugagggaaggacggccacuuccgaauaccagacauucuuuaauccccggaccuucggcucaggcgaggcagauugugggcugcgaccuuuguuugaaaagaaaagccucgaggacaagacugagcgcgaacuguuagagaguuauaucgauggaagaauuguggaagguucugacgccgagaucggcauguccccauggcagguaaugcuguucaggaaaagcccccaggagcuccuuugcggggcuucgcugauaucugaucgguggguguugacagcggcacauugucuacuguacccgccuugggacaagaacuuuaccgaaaaugaucuccugguccgcaucggaaaacacuccagaacgagguaugagcguaacauugaaaagaucucaaugcuugagaagauuuacauccauccccgguauaacuggcgagaaaaucuggacagagauauagccuugaugaaacucaagaaaccaguggcuuucagugacuacauucacccuguuugccugcccgauagggagaccgccgccagcuuacugcaagcaggcuauaagggucgcgugacaggguggggcaaccuaaaagagacuuggaccgcuaaugucggaaagggccagccauccgugcuccagguaguuaaccugcccaucguggaacggccugucuguaaagacucuacaagaauuaggaucacugacaauauguucugcgccggguacaagccagaugagggaaagcgcggugacgcaugugaaggcgauagcgggggaccguuugugaugaaaucacccuucaacaaucgaugguaccagaugggcaucgucaguuggggugaggggugcgaccgggauggcaaguauggauuuuacacccacguguuccgucuuaaaaaguggauucaaaaaguuauagaccaguuuggcgaauga

SEQ ID NO: 55979 - RNA, 1278 nt, Artificial Sequence
  derived and/or modified sequence opt3 from F2R__Homo_sapiens__NP_001983
augggccccagaaggcugcuccuuguggccgcuugcuucagccugugugggccuuuguuauccgcacggacccgcgcccgacguccagagucuaaggcgacaaacgcuacucuggacccgagaucauuucuacucaggaaucccaacgauaaauacgaaccuuucugggaggacgaagagaagaaugaaaguggacugacggaguaucggcuugucagcaucaacaaauccucuccacugcagaagcaauugcccgccuuuauuucggaggaugcaucagguuaccucaccagcaguuggcugacacuguucguuccuuccguguauacuggcguauuuguggucucucucccauuaaauauaauggccaucgugguuuucauucugaaaaugaaggugaagaaacccgcugucguguacaugcuucacuuggcaaccgccgacguacuguuuguuagcgugcuaccuuucaagaucuccuauuacuuuucagggagugauuggcaguucggaagcgaacucugccgcuuugucacagcugccuucuauuguaacauguacgcgucuauucugcuuaugaccgugaucuccauagacagauuucuggcaguggucuacccaaugcagucauugagcuggaggacucucggccgggccaguuucacaugccuggcuaucugggccuuagcaauugcugguguugugccgcugcuccuuaaagagcagaccauccaaguacccgggcugaauauuacgacuugucaugauguguugaacgaaacccuacuggagggauauuacgccuauuacuucucugcguuuuccgccgucuucuuuuucgugccucucaucauaagcacaguuugcuaugugucgauuauccgcugucugucuuccucagcagucgcuaaucgaaguaagaaaagcagagcccuuuuucuguccgcugccguguucugcauuuuuaucaucuguuucggcccaacuaacguauugcucauugcacacuacucuuuucugagccauaccucaacaaccgaggccgcuuauuucgcguacuuacugugcguuugugugaguuccauaagcugcugcaucgacccccuaauuuacuauuacgcaucuucagaaugucagagguaugucuacaguauccucugcuguaaggagagcuccgauccuucuucguauaauagcuccggccagcugauggccucaaagauggacacgugcaguucuaaccuuaauaacagcauauacaaaaaguugcugacuuga

SEQ ID NO: 55980 - RNA, 1194 nt, Artificial Sequence
  derived and/or modified sequence opt3 from F2RL1__Homo_sapiens__NP_005233
augagaagccccuccgccgcuuggcugcucggcgcagccauccuucuggcggcuucuuugucaugcagugggaccauucagggaacaaacaggagcuccaagggucggucuuuaauaggcaaaguggacgggacuucgcacgucacgggaaagggcguuaccguggagacaguauucucaguggaugaauuuagcgccaguguccugacugguaaacuaaccacaguguuccucccuaucguuuacaccauuguguuugucguggggcugccauccaauggaauggcacuuuggguauuccuguuucgcacuaagaaaaagcauccggccguuaucuauauggcuaacuuggcacucgccgaccugcugucugugauuugguucccccucaagaucgcuuaccacauacauggcaauaacuggaucuauggcgaggccuuauguaauguccugauuggguuuuucuacggaaacauguauugcagcauccuuuuuaugacauguuuguccgugcaacgauacugggugauugucaauccuaugggucacucacguaaaaaggcgaacaucgcaauaggcauuagucuggccaucuggcuacucauucugcuuguuaccaucccacuguaugugguaaaacagacgaucuucauucccgcuuugaauauaacuaccugccaugaugugcucccugaacagcuguuagucggggacauguuuaacuacuuccugagccucgccaucggaguguuucuuuucccagcauuccugacagcuucugccuacguuuugaugauuagaaugcuaagguccucagcgauggaugagaauagcgaaaagaaacggaagcgcgccaucaagcugauagugacuguccucgcaauguaucugauuuguuuuacccccaguaaccuucuguuggugguacacuacuuccucaucaaaucucagggccaaucccacguuuaugcucuguacaucguggccuuaugccugagcacacuaaauucguguauugacccuuuugucuauuacuucgugucucaugauuuuagagaccacgcuaagaacgcccuccugugcagguccguccggaccgugaaacagaugcagguuucacuuacgaguaagaaacauagccgcaaguccucuagcuauucaaguuccagcacuacagugaaaaccucuuacuga

SEQ ID NO: 55981 - RNA, 1059 nt, Artificial Sequence
  derived and/or modified sequence opt3 from F2RL2__Homo_sapiens__NP_001243495
auggagaacgacaccaauaaccuggccaagcccacacucccuaucaaaacuuucagaggcgcuccaccgaauagcuuugaagaguuccccuuuuccgcacuugaaggguggacgggagccaccauuacagugaagauaaaaugcccugaggaaucugcgucacaccuucaugucaagaacgcuacuauggguuacuugaccaguagcuuauccacaaaacugaucccagccauuuaucuacucguuuucgugguaggcgugcccgcaaaugccgucacccuguggaugcuguuuuucaggacucggucuaucuguacaaccguguuuuacacgaaccuggcuauugcagauuucuuguuuugcguuacucucccuuucaagaucgccuaucaccugaaugggaacaauuggguguuuggagagguccugugucgcgcuaccacagugauauucuacggcaacauguauugcucgauccucuuacuggccuguauuucaaucaaucgauaccuugcgauuguacauccauuuacuuaucgugguuugcccaagcacaccuacgcacugguuacaugcgggcuagugugggccaccgucuuccucuacaugcugccuuucuuuauccuuaaacaggaguauuaccuggugcaaccagacauaacgacuugucaugaugugcacaacacaugcgaaagcaguuccccguuccaguuguauuacuuuauuucucucgcuuucuuuggauuccugauccccuuugucuuaauuaucuauuguuacgccgcaaucauuagaacccugaaugcuuaugaccacagguggcucugguacguuaaggccagccuucugauauuggugaucuucacuauuugcuuugcgccuuccaacaucauacuaauuauccaucacgccaauuacuauuacaacaacacagauggccuguauuucaucuaccucauugcacugugucuuggcucacugaauaguugcuuggacccauuucucuauuuccugaugagcaaaacccggaaccauucuacggcuuacuuaaccaaguga

SEQ ID NO: 55982 - RNA, 1158 nt, Artificial Sequence
  derived and/or modified sequence opt3 from F2RL3__Homo_sapiens__NP_003941
auguggggcagacugcuccuuuggccccugguguugggguucagcuuauccggagguacccagacaccuucugucuacgacgagucaggcaguacugggggaggcgaugacagcacgccauccauccugccggcccccagggguuauccugggcaaguuugcgcuaacgauucugacacccuagaacucccagauucgucacgggcacugcuucugggaugggugcccacacgcuugguaccugcccucuacggccuggugcuggucgugggccucccagcgaauggguuagcucuguggguucuugccacucaggcaccccgauugccuagcaccaugcugcuaaugaaccucgccgcugcagaccugcuucuggccuuggcucucccaccgcguauugccuaucaccugagaggacagagguggcccuuuggugaggcggcaugucgguuagccacagcugcccuguacggccauauguaugggagugugcuccuucuggcagcugucuccuuggaucgcuaccuagcccuggugcacccucucagagcgagggcccugcggggacgccgacuugcacugggcuugugcauggcugccuggcucauggcugccgcacuggccuuaccacugacccuacagagacaaacuuucaggcucgcucggucugaccguguacugugucaugaugcgcuucccuuggacgcacaggccagccacuggcagccugcuuuuacaugccuggcccuccuggguuguuuccuuccacuguuggcaaugcuccugugcuauggggccaccuuacauacgcuggcugccuccggacgcagauacggccacgcacuaaggcucacugcgguugugcuggcuucagccgucgcauuuuucgugcccaguaaucuuuugcugcuccugcacuacagcgauccgucuccuuccgccuggggcaacuuauauggggcuuacgugcccucacuggcccuuagcaccuugaauaguugugucgacccauuuauauauuacuauguuucugcagaguuccgggauaaggugcgagcuggacucuuucagcgcuccccuggugacacaguagccagcaaagcgucggccgaaggcgggucuagaggaaugggcacucauuccucacugcuacaauga

SEQ ID NO: 55983 - RNA, 6675 nt, Artificial Sequence
  derived and/or modified sequence opt3 from F5__Homo_sapiens__NP_000121
auguuccccggcugcccuagacugugggugcucgucguucuugggaccagcugggugggaugggguucccagggcacagaggccgcucaacugaggcaguuuuacguagcagcccaggggaucucuuggucauaucggccagaaccgacuaacaguagcuugaauuuauccgugacgucuuucaagaaaauugucuaccgcgaguaugaacccuacuuuaagaaagagaagccucagucgaccauaucaggacugcuaggcccaacacucuaugcggaagugggugacaucauuaaaguucacuucaagaacaaggcugauaaaccccugagcauccauccucaagggauucgauacaguaagcuuuccgagggagccucuuaucuggaccacacuuuuccagcagagaaaauggaugacgccguggcucccggccgugaauacaccuacgaguggagcaucuccgaagauucaggcccuacacaugacgauccaccguguuugacccacauauauuacagucaugagaaucucaucgaggacuucaacagcgggcugauuggaccccugcucaucugcaagaaagguacuuuaacagaaggcgggacccagaagacguuugauaagcagauuguccugcuuuucgcaguguuugacgagucuaaauccuggucacagagcaguucuuugauguauacuguaaauggauacguuaacggcaccaugccugauaucacagugugugcccacgaccacauauccuggcaucugcuagguaugagcucggggccagaacucuucucuauucacuuuaauggacaaguccuggagcagaaccaucacaagguguccgcuaucacucuugugucagccaccaguacaaccgcgaauaugacggucggccccgaaggcaaauggauuaucagcucccugacuccuaagcacuugcaggcagggaugcaggccuauaucgauauuaaaaacugcccaaagaaaacaagaaaucucaagaagauaaccagggagcaacggcgccauaugaaaagaugggaguacuucaucgcugccgaagagguuauuugggacuaugcacccgugaucccggcuaacauggacaagaaauacaggucucagcaccuggauaauuuuagcaaccagauaggaaagcauuacaaaaagguaauguauacucaauacgaagacgagucauucacaaagcacaccgugaauccuaacaugaaagaagaugguauuuuaggccccaucauccgggcccagguccgcgacacgcugaagauuguguucaaaaacauggcgagucgaccauauuccaucuacccucaugggguuaccuuuagccccuaugaggaugaggugaauucuucauucacaaguggaagaaacaauacuaugauuagggccguccagccaggcgaaaccuacacauauaaguggaacauacucgaguuugacgaacccacugagaaugaugcacagugucuuacccggccuuacuacagcgacguggauaucaugcgugacauugcuuccggucugaucggguugcuacugaucugcaaaucucgcucgcucgauagaaggggcauucaacgggccgcugacauagaacagcaggccguauucgcaguuuuugacgagaacaagagcugguaucuggaggauaauaucaacaaguucugugaaaauccagacgaggugaaacgagaugacccgaaguuuuacgaauccaacauuaugucaacaaucaauggauauguccccgagaguauuaccacucuuggcuucugcuuugaugacacggugcaguggcacuucuguucugucgggacacaaaacgagauccugaccauacacuuuacuggacauagcuucaucuacgguaaacgccacgaagauaccuugacacucuuuccuaugagaggcgaguccgugaccguuacuauggacaauguggggacauggaugcugacgucaaugaacagcucuccaagguccaagaaauuacggcugaaguuccgcgauguaaagugcauucccgacgaugacgaagauaguuaugagaucuucgaaccuccagagagcaccgucauggccacuagaaaaaugcaugacaggcuagagcccgaagacgaggaaucugaugcugacuacgauuaucagaaucgucucgcggcagcccugggaauucgguccuuucgaaacucaagucuuaaccaggaggaagaggaguucaauuugacagcucuggcccucgaaaacggcaccgaguuugugagcucgaauacagacaucauaguugguuccaacuacucuagcccgucaaauauuaguaaguucacugugaacaaucuggcagaaccucagaaagccccaucccaccaacaggcuaccacggccgggucuccccuuagacaccugaucggcaagaacagcgucuugaauuccucaaccgcagagcauagcaguccuuacucugaagaucccauugaggacccacuccagccugaugugacaggaaucaggcuguuaucccugggcgcgggggaguuuaaaagccaggaacacgcuaagcauaaaggacccaagguagagcgcgaccaagccgcaaagcaccgguucucguggaugaaacuacucgcccauaagguggguagacaccugucacaggauacuggcucuccaagugggaugaggccgugggaagaccuuccuucccaggauaccggaagccccucucgcaugcgaccauggaaagaccccccuagcgauuugcugcuccugaagcaauccaacucaaguaaaauauuaguuggccgguggcaccuggcuagcgagaaggguucuuaugagaucauucaggacacagacgaagauacugccgucaauaacuggcuuaucuccccacagaaugcaucacgugcuuggggggagaguacccccuuggccaacaagccuggcaaacagagcggacauccgaaguuuccaagagugaggcacaaaucccuccaagugcgccaggacggcgggaagucucggcugaaaaagucgcaguuccuaauuaagacgagaaaaaagaaaaaggaaaaacauacacaccaugcgccccugagcccuaggaccuuucacccacuccgaucagaggccuacaauacuuucuccgaacgccggcugaagcacagucuugucuugcauaagucuaacgagacaagccugcccaccgauuuaaaccagacucucccuuccauggacuuuggauggaucgcuucacugccggaucacaaucaaaacucuagcaaugacaccggccaggcaaguugucccccaggucuuuaucagacaguuccucccgaggaacauuaccagacguucccaauacaagauccugaccagaugcacuccaccagcgaucccucucacagaucauccaguccagagcugagcgaaauguuggaguaugacaggucgcauaaaucuuuuccgacugauauuucccagaugagcccuucaagugaacacgagguguggcaaacagugaucucucccgaccucucccagguaacccugagcccagagcuaucacagacaaaccugagucccgaccucagccauacuacccuguccccugaacuuauccagcguaauuugucuccagcccuggggcaaaugcccauuagcccugauuuaucccacacgacacucucaccggaccugucucauaccacucuuagucuggaucuaucgcagaccaaccucagcccagagcugucccagacaaauuugucucccgcucugggacagaugccuuuaucacccgaccucagccacacuacccugucccuugauuucagucaaacaaaccugucuccagaauugagccacaugacgcucucaccugagcugucccagaccaaucuaagucccgcccugggccagaugccaaucagcccugaccuuucucauacuacacucucccuggauuucucacagaccaacuugagcccggaacugucgcaaacuaauuuaucucccgcacucggucagaugccacugaguccugaccccucccacacaacccuuagccuggauuugucacagacgaaccucuccccagagcugucucagacuaaucuaagcccugaccugagugagaugccccuuuuugcggaucucucccaaauuccgcugaccccagacuuggaucagaugacauuaagcccugaccugggcgaaaccgaccucucucccaacuucgggcagaugucacugaguccagaucuuucccaagucacucugagccccgacauaucugauacaaccuugcuaccugaccugucgcagaucucaccgcccccagaucucgaccagauuuuuuacccuagcgaguccagucagucucugcuuuuacaagaauucaaugagagcuuucccuauccugaucugggacagaugccaucccccucaaguccuacacucaacgacacuuucuugucuaaggaguuuaacccacuggugaucguuggccucagcaaagaugggaccgacuacauugaaaucauacccaaggaggaagugcaguccucagaggaugacuacgccgaaaucgauuaugucccguacgacgacccuuauaaaacggaugugcgcacaaauauuaacagcucucgggacccagauaauaucgcugccugguaccugagauccaacaauggaaacaggcgaaauuauuacauugcagcugaggagaucaguugggacuauagcgaauucguucagcgggagaccgauauagaagacucggaugacauucccgaggauacuaccuacaagaaagugguauuucgcaaguaccuugacuccacauucacuaagagagauccuaggggcgaauaugaggagcaucuggguaucuuggggccaaucauucgggccgaagucgacgacgugauacaagugcgauuuaaaaaccuagcaucuagacccuacucacugcacgcccacggacucagcuaugagaagaguuccgaaggcaaaaccuacgaggaugacucuccggaaugguucaaggaggauaaugcuguccagccuaacagcucauauacguacguuuggcaugcgacagagcgcuccggucccgaaaguccaggcagcgccugcagggcaugggcuuauuacucugccgugaauccugagaaagacauccacucaggguuaauuggaccccugcuuaucugccagaagggcauucugcauaaggauuccaacaugccaauggacaugcgugaauucguacucuuguuuaugaccuucgaugagaaaaagagcugguacuaugagaaaaagucucggaguucguggagacugacuuccagcgaaaugaaaaagucacacgaguuucaugccaucaaugggaugauauacucucuccccggacugaagauguaugaacaggagugggugaggcuucaccuacugaacaucggcgguagccaagacauucacgucgugcauuuccacgggcagacauuguuagaaaauggaaacaaacagcaucaacugggcguuuggccucuccugccagguuccuuuaagacccuugagaugaaagcuaguaagccgggcugguggcugcucaauacugaggugggggaaaaccagcgcgcaggaaugcagacacccuucuugaucauggaucgagacuguagaaugccuaugggccugucaaccgggauuaucucugauagccagauaaaagccuccgaguuucuaggauacugggaaccacggcuggcgaggcucaacaauggcgguaguuauaacgcuuggagcgucgagaagcuugccgcagaauucgccuccaagcccuggauucaaguggacaugcagaaagagguuaucaucacggggauucagacucagggagcuaagcacuaccugaaaucuugcuauaccacagaguuuuacguggcauacucaagcaaucaaaucaacuggcagauauucaagggcaauucgacccgcaacgucauguauuuuaauggcaacuccgaugccaguacaauuaaagaaaaucaguucgacccuccaaucguagcgcguuacauuagaaucucucccacucgggcuuauaacaggccuaccuuacgcuuggagcugcaggggugugaagugaauggaugcagcacgccgcucgguauggagaacggcaagauagaaaauaagcaaauuacagccucauccuuuaaaaagucuugguggggggacuacugggagccauuccgagcaagacugaacgcccagggacggguuaaugcuuggcaggccaaagcaaacaacaauaagcaguggcuugagaucgaucugcucaaaaucaagaaaauuacugcuaucauuacccaaggcuguaagaguuugagcuccgaaauguaugugaagucauacacaauacacuauagcgagcagggugucgaauggaaacccuacaggcugaagucuaguaugguggacaaaaucuucgaggggaacaccaauacuaagggacauguaaaaaacuuuuucaauccucccauuaucucccgcuuuaucagagugauuccaaagaccuggaaccagagcauagccuuaaggcuagagcuguucggcugcgauaucuacuga

SEQ ID NO: 55984 - RNA, 1401 nt, Artificial Sequence
  derived and/or modified sequence opt3 from F7__Homo_sapiens__NP_000122
auggugagccaggcccugagacuccuuugccuguuguuaggccugcaagggugucuagcugcaggaggugucgccaaggcguccggcggggagaccagggacaugcccuggaaaccuggaccacaccggguuuucgugacacaggaagaggcucauggcguacuccaccgccgacguagagccaacgcauuucuggaggaacuuaggccggguucucuggaacgggagugcaaggaggaacaguguucauucgaggaagcccgcgagaucuuuaaagaugcugagagaacuaaguuguucuggauuaguuacagcgacggggaucagugcgcauccucucccugucaaaauggaggcucgugcaaagaccagcuccagucauauauauguuuuugccugccugccuucgaaggcaggaacugugagacgcauaaggaugaccagcugaucugcgugaaugaaaacgggggaugugagcaauacugcagcgaucacaccgguacaaagcggaguugccgcugucaugaaggcuauucccucuuagcugacggggucucuugcacuccaaccguggaguaccccuguggaaaaauuccuauccuggagaagcgaaaugccagcaaaccacagggcagaauuguuggugggaaggugugccccaaaggagaauguccuuggcagguccuuuugcuggugaacggcgcgcagcuaugcggcgggacacucaucaauaccauauggguaguuuccgcagcccacuguuuugauaagaucaagaacuggaggaaucugauugcugugcuuggagagcacgaccugucagaacaugauggugacgagcaaagucggcgugucgcccaggugaucauuccaagcacuuaugugccgggcacaaccaaccacgauaucgcauugcuccgccugcaucagcccgucguuuuaacggaccacgugguaccucugugccucccagaaagaacuuucucugagaggacccuugcuuuugugcgguucucccuggucucaggguggggacaauugcuagaccgaggcgccacagcgcuggagcucauggugcugaauguuccccgccuuaugacucaggauugucugcagcagagcagaaaagugggugacaguccuaacauaaccgaauacauguuuugcgccggguauucugauggcuccaaggacagcuguaaaggagauucgggcgggccacacgcaacacauuacaggggaaccugguacuugacggguauugucucuuggggccaagggugcgcuacugugggacacuucggcguauauacacggguuucccaguacaucgaguggcuccagaagcugaugcgcucagaacccagaccggguguguuacugagggccccuuuucccuga

SEQ ID NO: 55985 - RNA, 7056 nt, Artificial Sequence
  derived and/or modified sequence opt3 from F8__Homo_sapiens__NP_000123
augcagaucgaacugaguaccugcuucuuucucugucuucugagauucugcuuuuccgccacaaggcgguacuauuugggagcuguggaauuaucuugggacuacaugcaaucagaucugggggaacugcccgucgacgcacgcuucccuccacgaguucccaagagcuuuccguucaauacuagcgugguauauaaaaagacgcucuuuguggaguucaccgaucaccuguuuaauauugccaaaccucguccacccuggaugggacuucuggguccuaccauacaggcggaagucuacgacacugugguuaucaccuugaagaacauggcuucccauccagugucucuccacgccgucggcgugucguauuggaaagcaucagaaggggccgaauacgaugaccagacaagccagagagaaaaggaagaugacaagguauuccccggaggcagucauaccuauguuuggcaagugcugaaagagaaugguccuauggcuuccgauccacugugucucacuuacucuuacuuaagccacgucgaccuggugaaggaucuuaacuccggguugauuggagcacugcucgugugcagggaaggcucacucgccaaagagaagacacagacccugcauaaauuuauccuucuguucgcugucuuugacgagggcaagaguuggcacagcgaaacgaaaaauucuuugaugcaggaucgggacgccgcguccgcacgcgccuggccgaaaaugcacacuguuaacggguaugugaauagaucacuccccggacugauugguugucauagaaagagcguauacuggcacgugaucggcauggggaccacaccugagguccauaguauauucuuagaaggacacacuuuccuggugcggaaccaccgccaggcuucucucgagaucuccccaauuaccuuucuuacagcccaaacccuguugauggaccuaggccaguuccugcucuuuugccauaucagcucgcaccagcaugaugguauggaagcauauguuaaaguggacucuugucccgaggagccucagcugcgaaugaagaauaacgaagaggcugaagauuacgacgaugaccuuacggauuccgagauggacgucgugagauucgaugacgauaauucaccaaguuuuauucaaaucaggagcguagccaaaaagcaccccaaaacuuggguucauuauauagcggccgaagaggaggacugggacuacgcaccgcugguguuggcuccugaugaccgguccuauaagucucaguaccucaacaaugggccccagcguauuggacgcaaguacaaaaaggucagauucauggccuauacagaugaaaccuuuaaaacuagggaggcuauccaacacgaaagcggcauucugggcccauuacuguacggggaggugggagacacacuacucaucaucuucaagaaccaggccucacggccuuauaauauuuacccccacgguauaaccgauguccgaccacuguauagucgcagacuucccaaaggcgugaagcauuugaaggacuuuccuauccugccaggggaaauuuucaaauacaaguggacgguuaccguggaggauggaccgacaaaauccgaccccaggugccucacucgguauuacagcucuuuuguaaacauggagcgcgaucuggcaucaggccuuaucgguccucuguugauauguuacaaggaaagugucgaccagagagggaaccagauuaugagcgauaaaaggaaugugauccucuucuccguuuuugacgagaaccguucuugguaucugaccgaaaauauccaacgguucuuaccaaaccccgccggcgugcagcuggaggauccugaguuccaggcuucgaauauuaugcacagcaucaacggauacgucuuugacucccuacagcucucagugugccugcaugaaguagcguauugguacauucuuaguauaggcgcacaaacagacuucuugucuguguuuuucagcggguauacuuuuaagcacaagaugguuuacgaggauacccugacacucuucccauuuuccggagaaaccgucuucaugucaauggagaaucccggucuguggaucuuaggcugucacaacagcgacuuucgaaauagagggaugacugcccugcuuaaagugucuuccugcgauaagaacacgggagacuauuacgaagauaguuacgaggacauuagcgcuuauuugcucucuaaaaauaacgccaucgagccgagguccuucucacagaauagucgccauccuagcacacggcagaagcaguuuaacgcaaccacuaucccagaaaaugauauugagaaaaccgaccccugguucgcccacagaacaccuaugcccaagauacaaaacgugucguccucugaucugcuaaugcugcucaggcagagcccaaccccucauggccugucacuuagugacuugcaggaagcuaaguacgagacuuuuuccgaugaccccucuccaggugccaucgauagcaacaauucccugucagaaaugacacacuuccgcccgcaguuacaucacagcggggacauggucuucacgccugagaguggccuccaacugcgacuuaacgagaaacugggaaccacugcagcgacagaauugaagaaacucgacuuuaagguuucuuccaccagcaauaaccugauuucgacaauccccucagauaaucuagcugccggcacugacaacaccucuagucuggggccacccuccaugccugugcacuaugauagccagcucgacacgacccuguucggcaaaaagucuagcccacuuacagaguccgguggccccuugucacugagugaagagaauaacgauagcaaauuacucgaaucugggcugaugaacucccaggagucaaguuggggaaagaacgugagcuccacugagucuggccggcuuuuuaaggguaaacgugcacaugggccugcccugcuaaccaaggacaaugcucucuucaaaguaucgauuagccuguugaagacaaacaaaacuucaaauaacuccgccaccaauagaaagacgcacaucgauggcccgagucuguuaauagaaaacucuccaagcgucuggcaaaacauccucgaguccgacacagaauuuaagaaagugacaccccugauucaugauaggaugcuuauggacaagaaugcaacugcucugcgcuugaaccacaugucaaauaaaacaaccucuagcaagaacauggagaugguucagcagaaaaaggagggaccuaucccacccgaugcccagaauccugacaugaguuucuuuaagaugcuauuccugccggaauccgcgcgguggauucaaagaacucauggcaaaaacagccuaaauucugggcagggacccucaccaaagcagcuggugucccuuggcccugagaaaagugucgaaggucagaacuuucucagcgagaagaauaaagugguuguggggaagggagaguucaccaaggacguaggccugaaagagauggucuuucccucgucuaggaacuuguuccugacaaauuuagauaaccuccacgagaauaacacgcacaaucaagaaaagaaaauccaggaggaaauagagaagaaagaaacccugauucaggagaacguggugcuuccacagauccauacugucacagguaccaagaacuucaugaaaaaucuguuuuugcucuccacacgacaaaacguugagggcagcuacgacggggccuaugcuccugugcugcaggauuuccgcucacuaaaugacaguacuaaccggaccaagaagcacacggcacauuuuucuaaaaagggagaagaggaaaaucuggagggccuugggaaccagacaaaacaaauuguagaaaaguacgccugcaccacuagaaucucccccaauaccagccagcagaacuucgugacacagaggucaaaacgugcucucaagcaauuucgccugccauuggaggagacugaauuagagaagcggauaaucgucgaugacaccaguacacaguggagcaaaaauaugaagcaccugacgccguccacccucacucagauugauuauaacgaaaaagagaagggagccaucacacagucuccucugagcgacugucuuaccagaucccacucaauuccccaagcaaauaggucuccacugcccaucgcgaaagugaguucguucccuagcauacgaccaauuuacuugacucggguucuauuucaggauaacuccucucaucugcccgccgcuucauaccgcaagaaggacagcggcgugcaggaguccagucacuuccuccagggugccaaaaagaauaaccugucucuugcaaucuuaacacuggaaaugaccggggaucaaagagaggucggaagccucggcacgucagcuacuaauuccgugaccuauaaaaagguugaaaacacaguguugccuaaaccggaccugccaaagaccagugguaaggucgagcuccugcccaaaguacauaucuaccagaaggaucuuuuuccuacugaaacaagcaauggcucucccgggcaccuggacuugguggagggaucccuacugcagggcaccgagggggccauuaaauggaacgaagcaaacaggccaggaaagguuccuuuccuccggguggccacagagucaagcgcuaaaacucccucgaaguuacuggacccacuugcgugggauaaucauuauggcacccagaucccuaaggaagaguggaaaucucaagaaaagaguccggagaaaacggccuuuaagaaaaaggacacaauucugucccucaacgcaugcgagagcaaucacgcuauagccgccaucaacgaaggucagaauaaacccgagauugaagucaccugggcuaagcaggggcgaacugagagauuguguucacaaaacccaccugugcugaagcgccaccagagggaaaucacccguacaacucuccaguccgaucaggaggagauugacuacgaugacaccaucucuguagaaaugaaaaaggaggauuucgacauauaugaugaagacgagaaucaaagcccccggaguuuucagaaaaagacgagacauuacuucaucgcagccguggagaggcugugggauuauggaauguccagcucuccacacguccuucgcaaccgagcgcagucaggcaguguuccucaguucaaaaaggugguguuucaagaguucacagacgguuccuuuacccagccccuauacagaggcgagcugaaugaacauuugggguuacugggaccguacauucgggcugaggucgaagauaacaucauggugacuuucaggaaucaggccagccgcccauauucuuuuuacucgucacucauuagcuaugaggaggaccagcgucaaggcgcagaaccuagaaagaacuucguuaaacccaaugagacaaagaccuacuuuuggaaaguacagcaccacauggccccaacuaaggacgaguucgauugcaaggcuugggcauauuuuuccgacguggaucuggagaaggacguccauagugggcuuaucggaccccugcucgugugucacacaaacaccuugaauccugcccauggccggcagguuacggugcaagaguucgcgcuguuuuucacuauauuugaugagaccaagucuugguacuucacagagaacauggaaaggaacugccgcgcuccguguaauauucagauggaggaccccaccuucaaagaaaacuaucgauuucacgccaucaaugguuacaucauggauacacuaccagggcuggucauggcacaggaccagaggauucggugguaccuccuuagcaugggauccaacgagaauauacauucaauccacuucaguggccacguguuuacuguaaggaagaaagaagaguauaagauggcccuguacaacuuauauccuggcgucuucgagaccguggaaauguugcccucuaaagcugggauuuggcgcguugagugccugaucggagaacaucuccacgccgguaugagcacgcuguuucuuguguacuccaauaagugucaaacaccucugggcauggcaucagggcauauuagagauuuccagaucacugcuagcggacaguauggccagugggccccaaagcucgcgagguugcacuacucugguuccauaaacgccuggaguaccaaagagcccuuuagcuggaucaaggucgaccuguuagcaccuaugauuauccacgggauuaaaacacaaggagcucggcagaaguucucgucccuauauaucucucaguuuauaauuauguacucacuggauggcaaaaaguggcagaccuaccguggcaauagcacugggacccucaugguguucuuuggaaacguugacaguuccgguaucaaacauaauaucuucaacccacccauuaucgcccgcuauauacgacuucacccgacacauuacucuauuagaagcacgcugaggauggaguugaugggcugcgaccuaaauucauguuccaugccucucgggauggaaaguaaggcuaucagcgaugcacaaauuacugccucuucauauuuuaccaacauguucgccacaugguccccaagcaaggcucggcugcaccuucagggacgcucuaaugcguggagaccccaggugaacaacccuaaagaguggcuccaggucgacuuccaaaagaccaugaaagugacuggcguaacaacccagggugugaagagucuguugacgucgauguacguuaaagaauuucugaucuccagcucacaggaugggcaucaauggacuuuauucuuucagaauggaaaggucaagguguuccagggcaaccaggacucuuuuacaccaguggucaauagccuagaucccccgcugcucaccagguaucuucggauacacccucaauccuggguacaccagauugcacugcgaauggagguguugggcugcgaagcccaggaccuguacuga

SEQ ID NO: 55986 - RNA, 1386 nt, Artificial Sequence
  derived and/or modified sequence opt3 from F9__Homo_sapiens__NP_000124
augcagagagugaacaugaucauggccgagagccccggccugauuaccauaugccuccuuggguaccuguuguccgcugaauguacagucuucuuagaccacgagaaugcaaacaagauccugaauaggccuaaacgguauaacucuggaaagcuagaagaguuuguucaagguaaucucgaacgcgagugcauggaggaaaaauguucauucgaggaagcccgagagguguuugagaacacugaacguacgaccgaguucuggaagcaguacguagauggcgaccagugcgaaaguaauccaugucugaacgggggaagcugcaaagaugacauuaauuccuaugaguguuggugcccguuuggcuucgaagguaagaacugugagcuugaugugacaugcaauaucaagaacgggagaugugagcaguuuugcaaaaauucugcggacaacaaggucgugugcucguguacugaaggauacaggcuggcugagaaucaaaaaucaugcgaacccgccguuccuuucccauguggccgggugagcgucagucagaccuccaaguugacacgcgcagagaccguguuucccgauguagacuauguuaacucuacugaagccgagacaauucucgauaacaucacccagagcacgcaguccuucaaugacuuuacuagaguggucggcggggaggaugcuaaaccuggacaauucccauggcaaguggugcugaacgguaaggucgacgcauuuugcggcgggucaauaguuaaugaaaaguggaucgugaccgccgcucauuguguagagacaggagugaaaauuacugucguggccggcgaacacaacaucgaggaaaccgagcauacagagcagaagaggaauguuauucggaucauaccccaccauaacuacaaugcggcaauuaacaaauauaaucacgauaucgcccugcucgaauuagacgagccucuggugcuuaacaguuacgucaccccaauuugcaucgcugacaaggaauacacgaauaucuucuugaaauucgguagcggguaugugucuggauggggccgcguauuucacaagggccgauccgcccugguucuacaguaccucagagugccgcuggucgauagggcaacuugucuucggucaacaaaauucaccauuuauaacaauauguuuugcgcuggguuccaugagggaggucgugacagcugucagggcgauagugggggaccccacgugacugaggucgaaggcacaucuuuucugaccgguauaaucuccuggggcgaggaaugcgccaugaaggggaaguacggaauuuauacgaaagugagccgcuacguuaacuggaucaaggagaaaaccaaguugacauga

SEQ ID NO: 55987 - RNA, 1119 nt, Artificial Sequence
  derived and/or modified sequence opt3 from FA2H__Homo_sapiens__NP_077282
auggcccccgcuccuccaccggcagccagcuucucccccucugaggugcagagaaggcuggcggcuggcgccugcuggguccggcgcggggcacgacucuacgaccuuucaaguuuuguucgucaccauccuggaggugaacaacuguugagagccagggcuggccaggauaucagcgcagacuuagaugggccaccccaccggcauuccgccaacgcucgcagauggcuggagcaguauuacgugggagaacuaaggggcgagcagcaagguucuauggaaaaugagccuguagcccucgaggaaacccagaagacagacccagcgauggagccccgguucaaaguggucgauugggacaaggaucugguggacuggcgcaaaccucuucuguggcagguugggcacuugggagaaaaguaugaugagugggugcaucagccagucacucgaccgauuagacucuuucacucggaccugauagagggccugucaaaaacggugugguacagcguacccaucauuuggguuccucucguguuauaucugaguugguccuacuauaggaccuucgcacaaggcaacguccggcuuuuuacaucuuucacuaccgaauacacaguggccgugccaaagagcauguuucccggguuguucaugcugggaaccuuucuauggucccucaucgaguaccugauucaccguuuccuuuuucauaugaagccuccaucagauaguuauuaccugaucauguugcacuucgucaugcauggucagcaccacaaagcucccuuugacggcagccgccucguuuucccgccugugcccgccucucugguaauagggguguucuauuuauguaugcagcugauccucccagaagcagucggaggcacuguguuugcuggugggcuucugggauacguuuuguaugauaugacacauuacuaucuacacuucggcuccccucauaagggcucauaccuguacagccucaaagcccaccaugugaagcaccacuuugcgcaucagaaaaguggguucggaauuucuaccaagcugugggacuauugcuuucacacgcuuacucccgagaagccacaucugaaaacccaauga

SEQ ID NO: 55988 - RNA, 1599 nt, Artificial Sequence
  derived and/or modified sequence opt3 from FAAH2__Homo_sapiens__NP_777572
auggcccccagcuucaccgcuagaauccagcuguuucuccuuagggcacugggcuucuugauuggguuagugggacgggccgcgcugguccuagguggcccuaaguuugcuuccaaaacaccacgcccgguuacugaaccccuccugcuucugucugggaugcaauuggccaagcucauacgacagcguaaagugaagugcaucgacguagugcaggcauacauuaacagaaucaaagaugucaauccuaugauuaacggaaucgugaaguauagguucgaagaggccaugaaggaagcucacgcaguugaccagaaacuggccgagaagcaagaagaugaggcuacgcuggagaauaaauggccauuucucggcgugcccuuaaccgucaaggaagccuuccagcugcaggguaugccuaacucaagugggcuuaugaaucggcgcgacgcgauagcaaaaacagaugccacugugguagcuuugcugaagggagccggcgcaaucccacuaggcauuaccaacuguagcgagcucugcaugugguacgaauccucuaauaagaucuaugggagaucgaacaaucccuacgaccugcagcauauuguuggagguucaagcggcggggagggauguacacuugcugccgcgugcagugugaucggcgucgguuccgauauagggggaucuauuaggaugccugccuuuuucaacggcaucuuuggccacaaaccaagcccggggguggugcccaauaagggacaauucccucuggcagucggugcucaggaguuguuucucuguaccggcccaaugugccgguaugccgaagaccuggcucccauguuaaaaguuauggccgggccuggaauuaagcgccugaaacucgauacuaaggugcaucuuaaagaccugaaguucuacuggauggagcacgauggcgguuccuuuuugaugucaaagguagaccaggaucuaaucaugacacagaaaaagguggucgugcaucuggaaaccauccucggggcaaguguucaacacgugaaacugaagaaaaugaaguauagcuuccagcuuuggauugccaugaugucugcuaagggccacgacggaaaagagccagucaaguucguggaccuguugggcgaucaugggaaacacguaucaccccucugggaacugauaaagugguguuuaggacuguccguuuacacgaucccgagcauuggucuagcgcuccuggaggagaaacuucgauacaguaacgaaaaguaucagaaguuuaaagcaguggaggaaucuuugagaaaggagcuggucgacaugcucggcgaugacgggguguuccuguacccuucccaucccacugucgccccaaaacaccacgugccucuuaccaggcccuuuaauuucgcuuauacaggaguuuuuagcgcccugggcuugccagugacucaaugcccccucggucugaacgcaaagggguuaccucugggcauccagguagucgccggaccauucaaugaucaucuaacccucgcuguggcccaguaccuggagaaaacauuuggcggguggguuuguccgggaaaguucuga

SEQ ID NO: 55989 - RNA, 384 nt, Artificial Sequence
  derived and/or modified sequence opt3 from FABP1__Homo_sapiens__NP_001434
augagcuucuccggcaaguaccagcugcaaucucaggagaacuuugaagccuucaugaaagcuaucgggcuccccgaggaacuuauucagaagggaaaagacauaaagggugugucagagaucguccagaauggcaaacacuuuaaguucaccauuacagcagggaguaagguuauccaaaacgaauuuacugugggagaggagugcgaacuggagacgaugaccggcgaaaaaguaaagacagugguccaguuggagggugauaauaaauuagugacuaccuucaagaacauuaaaagcguuacagagcugaauggggacaucauaaccaacacuaugacacuaggagauaucguguuuaagagaauuuccaagaggaucuga

SEQ ID NO: 55990 - RNA, 399 nt, Artificial Sequence
  derived and/or modified sequence opt3 from FABP2__Homo_sapiens__NP_000125
auggccuucgacagcaccuggaagguggauagauccgagaacuacgacaaauuuauggaaaagaugggcgucaauaucguuaaaaggaagcuggcugcacacgauaaccucaaacuuacaauuacucaggaggggaauaaguucacggugaaggaaucuucaaccuuucggaacauagagguaguguucgaacugggagucacauuuaauuauaacuuggccgacgguacugaguuacgcggcaccuggagucuggaggggaauaaacuaaucggaaaguucaaacgaacagauaacggcaaugaacucaacaccgugcgugagauuaucggugacgaacugguucaaacuuacguguaugagggggucgaggcgaagagaauuuuuaaaaaggauuga

SEQ ID NO: 55991 - RNA, 399 nt, Artificial Sequence
  derived and/or modified sequence opt3 from FABP4__Homo_sapiens__NP_001433
augugcgacgccuucgugggcaccuggaagcuggucagcuccgagaacuuugaugacuacaugaaagaaguuggggugggauucgcuacaagaaagguagcagguauggccaaacccaauaugaucauuucugugaacggcgaugucauaacuaucaagucagagaguacguuuaaaaauaccgaaauuagcuucauccucgggcaggaguuugacgaagugacagcggaugacaggaagguuaaguccacuauuacccuugauggaggcgugcugguccacgugcaaaaaugggacgguaagucuacaaccaucaaacggaagcgcgaggaugacaaauugguaguugagugugugaugaagggggucacuucgacacgaguguaugaacgugcuuga

SEQ ID NO: 55992 - RNA, 408 nt, Artificial Sequence
  derived and/or modified sequence opt3 from FABP5__Homo_sapiens__NP_001435
auggccaccgugcagcaacuggagggcagauggaggcucgucgacagcaagggguucgaugaauacaugaaagagcuuggaguugguaucgcucugcggaagaugggcgcaauggccaaacccgacugcauuauaacaugugaugggaagaacuugacuaucaaaacggaauccaccuuaaagacaacucaguuuucuugcacccugggagagaaguucgaagagacaaccgcggacggccgcaaaacucagacaguguguaauuuuaccgauggugcucuaguacagcaccaagagugggacgggaaggaaucaacgauuacucgaaaacucaaggauggaaaacugguggucgagugcgugaugaacaauguuaccuguacacguaucuaugaaaagguggaguga

SEQ ID NO: 55993 - RNA, 534 nt, Artificial Sequence
  derived and/or modified sequence opt3 from FABP6__Homo_sapiens__NP_001124430
augaagaccgugacaaugaugauggucguugagaugcaggcccugacucaagugcucagagcuguacuuagcgcaugcacguggguguccaggaaaggcgaccugcagcggaugaagcagacccacaaagggaagcccccuucuucaauggccuucacaggaaaauuugaaauggagagugaaaagaacuacgaugaguucaugaaguuguuagguaucagcuccgacgucauugaaaaagcgcgcaauuuuaagauagugacugagguucagcaagauggccaggacuucaccuggucucagcauuauucagggggacacacaaugaccaacaaauuuacugugggcaaggagucgaauauccagacaaugggugggaaaaccuucaaggcuacgguccaaauggaaggaggcaagcuggugguaaacuuuccaaauuaccaucagacuagcgagauuguuggcgauaagcuaguggaagucaguaccaucgggggagugacauaugagcgaguguccaaacgucucgccuga

SEQ ID NO: 55994 - RNA, 399 nt, Artificial Sequence
  derived and/or modified sequence opt3 from FABP7__Homo_sapiens__NP_001437
augguggaggccuucugcgcuaccuggaagcugacaaacagccagaauuuugacgaauacaugaaagcacucggcgucggguucgccacuagacaaguuggaaacgugacgaagcccaccguaaucauuucccaggagggugauaaaguggucauaaggacacuuucuacuuuuaagaauaccgaaaucucauuccagcugggcgaggaauuugacgagacaaccgcggaugaccggaacuguaaaagugugguuagcuuggauggggacaaguuagugcacauucagaagugggauggaaaagagacuaauuucguccgcgaaaucaaggacggcaaaauggugaugacacugaccuuuggugauguaguugcugugcgacauuaugagaaggccuga

SEQ ID NO: 55995 - RNA, 399 nt, Artificial Sequence
  derived and/or modified sequence opt3 from FABP9__Homo_sapiens__NP_001073995
augguggagcccuuccugggcaccuggaagcucgucagcuccgaaaacuuugaggacuacaugaaagaacuugggguuaauuucgccgcuagaaacauggcaggacuggugaagccuacaguaacuaucucuguggaugguaaaaugaugacgauuaggaccgagucaaguuuucaggacacaaagaucagcuucaaauugggcgaagaguuugaugagacuaccgccgacaaucggaaggucaaguccacaauaaccuuagaaaacgggucuaugauucacgugcaaaaauggcugggaaaggagacuacaaucaaacgcaagauuguugaugagaaaaugguggucgaaugcaagaugaauaacaucgugucgacccgaauauaugagaagguauga

SEQ ID NO: 55996 - RNA, 627 nt, Artificial Sequence
  derived and/or modified sequence opt3 from FADD__Homo_sapiens__NP_003815
auggaccccuuccuggugcuccuucacagcgucuccucuucacugaguagcuccgaguugaccgaauuaaaguuucugugccuaggcagaguugggaaaaggaagcucgagcgggugcagucuggacuggaucuuuucucgaugcuguuggaacaaaacgaccucgagccuggucauacagaacugcugcgcgagcucuuagccucacugcgacgucacgaucuuuugagaaggguagacgauuuugaggcuggcgcagccgcgggggcugccccaggagaagaggaccugugugcagccuucaaugugaucugcgauaacgucggcaaagacuggcggcgccuagcuagacagcucaaggugagcgauacuaaaauugacaguauagaagauagguacccgcggaaucugacggagcgcguucgagagucccuuagaaucuggaagaacaccgaaaaggagaaugcaacaguggcccaucuggucggugcuuugaggucuugucagaugaaccucguggccgaccugguacaggaaguucaacaggcgcgggauuuacagaaucguagcggggcaaugucccccaugucauggaacagugacgccagcacuucugaggcuuccuga

SEQ ID NO: 55997 - RNA, 1506 nt, Artificial Sequence
  derived and/or modified sequence opt3 from FADS1__Homo_sapiens__NP_037534
augggcaccagagccgcuaggcccgcagggcugccuugcggagccgagaacccagcgcggcgccgacucgcucuuggugcccgucagcaaauccacagcugguccccgagaacacccucuacuaggcugacggcuccugccggcccagcucgcgggguggcacggcccgccauggcuccugacccagucgccgcggaaaccgcagcccagggacccacaccuagauacuucacuugggaugagguugcucagaggucaggcugugaggaacggugguuggugauugaccgcaagguauauaauauaagugaauuuacccgaagacauccaggugggagcagggugaucucccacuacgccggacaggaugcaacagacccguucgucgcuuuucauauuaacaaaggcuuagugaagaaauauaugaacucucugcuaaucggcgagcucucgcccgagcaaccuucauucgaaccaaccaagaauaaagagcugacugaugaauuucgggagcuucgugccacaguugagcgcauggggcugaugaaggcgaaucacguguucuuuuugcucuaccugcugcauauucucuuacuggacggagccgcauggcuuaccuugugggucuucgguacgagcuuucugcccuuccuacucugcgcugugcugcuuagugccguacaggcucaggccggcuggcugcagcacgauuuugggcacuuguccguuuucucuacuagcaaguggaaccaucuccugcaccauuuugugaucggacacuuaaaaggcgccccugcauccugguggaaucacaugcauuuccaacaccaugcuaagccaaacuguuucagaaaagaccccgauauaaauaugcacccguuuuucuuugcgcuggguaagauccucucagucgaacuugggaaacagaagaagaaauauaugccuuacaaccaucagcacaaguauuucuuucugauuggacccccagcauugcuaccucuguacuuccagugguacaucuuuuauuucgugauucaaaggaaaaaguggguggaccucgccuggaugaucaccuuuuacguccgguucuuucugacauauguuccccuucugggcuugaaagcauuccucggccuguuuuucauagugcgauucuuagagaguaauugguuuguaugggugacucagaugaaccacauuccaaugcauaucgaucacgaccgcaauauggauugggucagcacccagcugcaagccacaugcaacgugcauaagucugcauucaaugacugguuuuccgggcaccuaaacuuccagauugaacaccaucucuuucccaccaugccuagacacaacuaccauaaaguugccccacuggugcagucacuuugugcuaagcacggaaucgaguaucagagcaagccguugcugagugccuucgcagacaucauucauucucucaaagaauccggucaacuguggcuugaugcguaccugcaccaguga

SEQ ID NO: 55998 - RNA, 1269 nt, Artificial Sequence
  derived and/or modified sequence opt3 from FADS2__Homo_sapiens__NP_001268430
augcacggcagagaggccgggcccuucgugugcgucuguguucugcucgcuagcaucccuaccccacagacaccgcuucugcaagcauccuugcccccuuuucauccagccucugcgggacaccccauuacuggucagcaggacgcuuucagggccuuucauccugauuuagaguucgugggcaaguuucugaaaccacuacucauaggggagcuggcacccgaagaaccuucacaggaccacggaaagaacaguaaaaucacggaagauuuccgggcccuucgcaagaccgcugaggacaugaaucuguuuaaaacaaaccauguauucuuuuugcuccugcuggcacacauuaucgcccucgagagcauugcuugguucacuguguuuuacuucggcaaugguuggaucccaaccuuaauaacagccuuuguccuggcgaccucccaagcacaggccggguggcuucagcacgauuauggacauuugucuguguaccgaaagccgaaguggaaccaccugguucauaaauucgugaucggccaccuaaagggcgcuucggccaauugguggaaccaccgucauuuccagcaccaugcaaaacccaauauuuuucacaaggacccugaugucaacaugcuccauguguucguacugggggaauggcaaccaaucgaguauggaaagaagaaacuuaaauaccugcccuauaaucaccagcacgaauacuuuuucuugauugguccuccacuccugauccccauguauuuucaguaccagauaauuaugacuaugaucguucauaagaacuggguggacuuagcuugggccgucucauacuauauuagauucuuuaucacauacaucccguucuauggcauucugggggcgcuccuuuuucugaauuucauaagguuuuuggagagccacugguucgugugggugacccaaaugaaccauaucgucauggagauugaucaggaagccuaccgggacugguuuaguucccagcuaacggcaacuugcaauguugagcaaucuuucuucaacgauugguuuagcggacaccugaauuuccagaucgaacaccaucucuuuccuaccaugccccgccacaaccugcauaaaauagcuccacuugugaagucccugugugccaaacacggcauugaguaucaggaaaagccuuugcucagagcucuguuagacaucaucaggucacugaaaaagagugguaagcuauggcucgaugccuaccugcauaaauga

SEQ ID NO: 55999 - RNA, 1338 nt, Artificial Sequence
  derived and/or modified sequence opt3 from FADS3__Homo_sapiens__NP_068373
augggcggggugggagagcccgguccuagagaaggcccagcccagccgggggcuccccugccuaccuucugcugggagcaaaucagggcacacgaccagccaggagauaaguggcucgucauugaacggcgcguuuacgacauaagccgaugggcccagcgucaucccggcgguuccagacuuaucgggcaccauggagcggaggaugcuacagacgccuuuagggcauuccaccaggaucugaacuuugugcggaaauucuugcaaccuuuacugauuggcgaacuagccccagaggagcccucucaggacggcccucucaaugcucagcugguagaagauuuucgcgcacuucaucaggccgcugaggacaugaagcuguucgaugccucaccaacguuuuucgcguuuuugcucgggcacauccuggcaauggaagugcuggccuggcucuuaauuuaucugcuuggaccggguuggguccccagugcuuuggccgcauucauccuggcuauaagccaagcccaguccuggugucuacagcacgaccucggccaugcgucuaucuuuaaaaagucgugguggaaccacguggcccagaaauucguuauggggcaacugaagggauuuucagcacauugguggaauuucagacacuuccagcaccaugcuaagccuaacauuuuucacaaagauccagacgugacugucgcccccguguuccuucugggcgagagcaguguagaguacgguaagaaaaagaggcgguauuugccuuacaaucagcaacaucucuacuuuuuccugaucgggccacccuuacugacccucguuaacuuugaaguggagaaucuugcuuauaugcuggucugcaugcagugggccgauuugcuaugggcagccuccuucuaugcucgcuuuuuccugucuuaccucccguuuuacggagugccuggcgugcugcuuuucuuugucgcgguucgagugcuggaaagccacugguucguauggauuacacagaugaaccauauccccaaagagauaggccacgaaaagcacagagacuggguguccucacaguuggcagccacuuguaaugucgagccaagucucuuuaccaacugguucagcgggcaucugaauuuccaaauugagcaccauuuauuuccuaggaugccccggcacaacuauucucguguggcuccacugguuaagucccuaugcgccaaacacggacucucauacgaagugaagcccuuccugacagcacuugucgacaucgugcgcagcuugaaaaagaguggugauauuuggcuggacgccuaucuccaucaguga

SEQ ID NO: 56000 - RNA, 1338 nt, Artificial Sequence
  derived and/or modified sequence opt3 from FAF2__Homo_sapiens__NP_055428
auggccgcucccgaggaaagagaccugacccaggagcaaacagaaaagcuccuucaguuccaggaucugacuggcaucgagagcauggaccagugcaggcacacguuggaacaacauaacuggaacauugaggcagccgugcaggaucgguuaaacgagcaggaaggggucccuuccguuuuuaauccaccgcccucucgcccucuacaggugaacaccgcggaccaccgaauauacucauauguagugagucguccacaacccagaggacugcucgguuggggcuacuaucugaucaugcuuccuuucagguuuacauacuauacuauucuggauaucuuccgguuugcuuugcgcuucauuagaccagaccccaggagccgggucaccgauccugugggggacaucguuuccuuuaugcauucuuucgaggaaaaauacggacgcgcccacccaguguuuuaucagggcacauacucgcaggcacucaaugaugccaagcgagagcugagauuccugcucgucuacuuacauggugacgaucaccaggacucagaugaguuuuguaggaacacccugugcgcuccggaagugauaagccuuaucaauacucggauguuguucugggcauguaguacaaacaaacccgagggguaucguguaucccaagcccugcgcgaaaauaccuacccuuuucuagcuaugauuaugcucaaggacagaaggaugacgguugugggacggcuggagggccuuauccagccagacgaucugauuaaccaguugacuuucaucauggacgccaaucaaaccuaucucgucucugaacgacuggagcgcgaggaaagaaaccagacacagguguuaaggcagcaacaggaugaggcguaccuggcaagccuccgggccgaccaggaaaaagagcgcaagaagagagaagagagggagcguaaacggcgaaaggaagaggaagugcagcaacagaaacuugcugaggaaagaaggcgccagaaucugcaggaggagaaggaacggaaauuggagugccuacccccugaaccaucccccgaugacccggagucagucaagauaauuuucaagcugccuaacgauaguagaguugagaggcgcuuucacuucagccaaucucucacugugauccaugacuuucuguucucccuuaaagaaucacccgagaaguuucagauugaagccaauuucccacgacggguacugccuuguauccccagcgaggaauggccaaaucccccuaccuugcaggaggcaggccucagucacacagaggugcuguuuguccaggauuuaaccgacgaauga

SEQ ID NO: 56001 - RNA, 945 nt, Artificial Sequence
  derived and/or modified sequence opt3 from FAHD2A__Homo_sapiens__NP_057128
augcuggugagcggcagaaggcggcuccuuaccguccuguugcaggcccaaaaguggcccuuccagccuucccgcgacaugcgauuaguucaguuucgugcuccacaccugguggggccgcaucuaggacucgagacagguaacggcgggggaguaaucaaucugaacgcauucgaucccacucuuccuaaaacgaugacccaguuucuggaacaaggcgaggccacauugucuguggcgagaagggcucucgccgcacagcugccaguccugccccggucagaagugacuuuccucgccccuguuacccgcccagacaagguggucugcguggguaugaauuacguagaucacuguaaagagcagaacguucccgugccuaaggaaccaauuauauuuaguaaauucgcuagcuccaucgucgggccguaugacgaggugguguuacccccucagucucaagaggucgauugggaaguugagcuggcagugguaauuggaaagaagggcaaacauaucaaggccacagacgcuauggcccacguggcgggcuuuaccgucgcacaugaugugucggccagagacuggcagaugaggcggaaugggaaacaguggcuuuugggaaagacuuucgauacauuuugcccacugggucccgcucuaguuaccaaagacucaguggccgauccucacaaccucaagauuuguugccgcgucaauggcgaagugguacagagcgggaacacgaaucaaaugguuuucaagacugaggaccugaucgcaugggugagucaguuugucaccuucuacccaggagaugugauacuuacaggcacucccccgggugucgggguguuucgaaaaccucccguuuuccugaagaaaggagacgaggugcagugugaaaucgaggaauugggcguaauuaucaacaaggucguguga

SEQ ID NO: 56002 - RNA, 1260 nt, Artificial Sequence
  derived and/or modified sequence opt3 from FAH__Homo_sapiens__NP_000128
augagcuucauccccguggccgaggacuccgauuuuccuauucacaaccugccauacggcgucuucucuaccagaggggacccgaggccccggauaggaguugcuaucggugaucagauucucgaccuuucaaucauuaagcaucuguuuacaggcccuguguugaguaaacaccaagauguauucaaucagccaacuuuaaacagcuuuauggggcugggacaggcagccuggaaggaagcgcgcguguuccuacagaaucuccuguccgucucucaagcucgacuucgugacgauacggagcugagaaaaugcgccuuuaucucgcaggcaucagccaccaugcauuugcccgcuacaauaggcgacuauacugauuucuacagcaguaggcagcacgcaaccaacguggguaucauguuucgggacaaggaaaaugcccucaugccuaacuggcugcaucugccaguuggguaucacggacgcgcuuccucuguggucgugagcggcacacccauuagaaggccuaugggccagaugaaaccagaugacuccaagccgcccguauacggggccuguaagcucuuagauauggagcuggaaauggcguucuuuguuggaccugguaaucggcuuggcgagccaauccccauuucaaaagcacacgagcauaucuucgggaugguguugaugaacgacuggagugcccgcgacauacaaaagugggaauaugucccucugggaccauuucuaggcaagagcuucgguaccacugugucucccuggguggucccgauggaugcucucaugccuuucgccguucccaauccaaaacaggacccucgaccccugccauaccuuugccacgaugagcccuauacauuugacauuaaccuguccgugaauuugaaaggggaaggaaugucacaggcagcuaccaucuguaagagcaacuucaaguacauguacuggacgaugcuccagcaacugacucaucacaguguaaauggcugcaacuuaagaccuggcgaucugcucgccucugggaccauuuccggaccagagccggagaauuuugguagcaugcuugaacugucguggaaaggcacaaagcccaucgacuuggggaacggacagacuaggaaauuccuacuggauggcgacgaggugaucauuaccgguuauugucagggggauggcuaccggauaggauuuggccaaugcgcggggaagguccucccugcccugcuuccaucuuga

SEQ ID NO: 56003 - RNA, 951 nt, Artificial Sequence
  derived and/or modified sequence opt3 from FAIM2__Homo_sapiens__NP_036438
augacccagggcaagcugagcguggccaacaaagcucccgggacagagggacaacagcagguccacggugaaaagaaagaggccccugcaguuccauccgcgccgcccucuuacgaagaggcuacuucaggcgaagggaugaaggccggagcauucccuccagcccccacggcugugccucuccauccaaguugggcauauguagaccccagcuccucuucgucauacgauaauggcuuuccuaccggugaccacgagcuuuucacaacuuuuagcugggaugaccagaaagugagaagggucuucgugcggaagguuuauaccauccuguugauucaauuacuggugacacuagccgucguggcucucuuuaccuucugcgauccaguaaaggacuacguucaggccaacccggggugguauugggcgaguuacgcaguguuuuucgccacuuaucugacacuugcuuguugcuccggaccccgccgacauuuuccuuggaaucugauauugcucaccgucuucacgcugucuauggccuaccugacuggcaugcucagcuccuacuauaacaccacaucaguguuacugugucuuggcaucacugcauuggugugccugagugucaccguuuuuagcuuccagacaaaauuugauuucaccucuugucagggggugcuauucguacuccugaugacgcuguuuuucuccggacuuauuuuggcuauccuccugccauuucaauacgugcccugguuacacgccgucuaugcggcccugggugcaggcguguucacucucuuucuugcucuggacacacaguugcuaauggggaaucguagacauucacugagcccugaggaauacauuuucggagcccucaacaucuaucuggauauaaucuacauuuuuaccuucuuucuucagcuguucggcacuaauagggaguga

SEQ ID NO: 56004 - RNA, 837 nt, Artificial Sequence
  derived and/or modified sequence opt3 from FAIM3__Homo_sapiens__NP_001135945
auggacuucuggcuguggccccucuacuuucuuccugaguaugaaccaagcugggaggaacagccgaugcccgagaccccuaagugguuccaucugccauacuuguuucaaaugcccgccuaugcuuccucuucaaaauucgugacaagagucacuacgccugcacagaggggcaagguuccacccgugcaccacaguagcccuaccacacagaucacucaucggccacgcguaucccgagccucuucgguggcgggggauaaaccgcguaccuuuuuacccucaacaaccgcuagcaagauuagugcccuggaaggacuacucaaaccucagacuccauccuacaaccaccauacaagacugcacaggcaacgggcacuugacuaugguucucagagcggccgcgaggggcagggauuccacauacugauccccaccauuuugggccucuuucugcuggcccucuuaggucuggucgugaagagagcuguugagaggcggaaggcacuuucccgccgagccagaagguuggcugugcggaugcgugcccuggaaucaagucagcgcccuagagggagcccaaggccccggucucaaaauaacaucuacuccgcgugcccgcgacgcgcaagaggagccgaugcugccggcacgggcgaggcaccuguccccgggccaggagcuccucuacccccagcgccccuccaggugucagaaagcccuuggcugcaugccccaagucuuaaaacuucuugugaguauguaucccuguaccaccagccggccgcaaugauggaggacagcgauucggacgauuacauuaauguucccgcuuga

SEQ ID NO: 56005 - RNA, 1155 nt, Artificial Sequence
  derived and/or modified sequence opt3 from FAM102A__Homo_sapiens__NP_001030331
auggccuuccugaugaagaaaaagaaauuuaaguuccagaccacauuuacucucgaggaacuuacggcugugcccuucgucaacggcguucuguuuugcaaagugagauuguuagacgggggagauuucguaagccuguccucuagggaggaagugcaagagaauuguguccgguggcgcaagcgauuuaccuucgugugcaagaugucagcaaacccugccacaggucuacucgacccauguguuuuucgugugagugucagaaaagaacugaagggcgggaaagcguacagcaaacuuggauucgcugaucugaauuuggccgaguuugcaggcuccgguucuacugugaggugcugucuccuggagggguaugacaccaagaacacacggcaggauaauucgauccugaagguaaccauuggaauguuccucuuaucaggcgacccgugcuuuaagacucccccuagcacagccaaaaguauauccaucccaggccaggauucuagccugcagcuuaccuguaaagggggagguacguccucaggcgggaguagcacuaacucuuugaccggauccagacccccuaaggcucgcccaacaauucugucaagcggccuacccgaggaaccugaccaaaaucucaguucuccagaagagguuuuccacuccggucauagcaggaacucgucuuacgcaucccagcagucaaagaucaguggguauagcacugagcacucccggucuagcucacugagugaucuuacccaucgccgaaauacauccaccucuagcucagccaguggaggccugggcaugacgguggaagggccggagggaagcgaaagagagcacaggcccccugaaaaaccaccccggccuccacgucccuugcaucucuccgaccgcucuuucagaaggaagaaagauucggucgagagccacccgacuuggguggacgauacacggauugacgcugacgccaucguggagaagauaguccagucccaagauuuuaccgacgguucaaacacugaagauaguaaucugcgauuauucguuucucgcgacggcagcgcgacacuguccgggauccagcucgcaaccagagugucaagcggaguauacgagccuguggucauugaaucucacuga

SEQ ID NO: 56006 - RNA, 357 nt, Artificial Sequence
  derived and/or modified sequence opt3 from FAM103A1__Homo_sapiens__NP_113640
augaccgacacagccgaggcugugcccaaguucgaagagauguuugcaagcagauucacugaaaacgauaaagaguaccaggaauaucugaagaggccuccagaguccccgcccaucgucgaggaauggaacucucgggccggcgggaaucaacgcaaucgaggaaaccgucuccaggacaauagacaguuuaggggucgggauaaccgcuggggcuggccuucagacaauagaaguaaccaguggcacgggaggagcuggggaaauaacuacccacaacaucggcaggagcccuauuacccucagcaguauggccacuacgguuauaaucaacgcccacccuacggguacuauuga

SEQ ID NO: 56007 - RNA, 1071 nt, Artificial Sequence
  derived and/or modified sequence opt3 from FAM105A__Homo_sapiens__NP_061891
auggccgcuaccagaagccccacaagggcacgggagcgcgaacgauccggcgccccugcggcugggucugaccaggugcacucauggaugcuggccacgagucaagcacucgauacugucuggcguauggccaagggauucguuaugcuugcugugagcuuucugguagcagccaucugcuacuucagaagguugcauuuauauuccggucacaaacugaagugguggauuggcuaccuacagcggaaauuuaagcgcaaccucucuguggaggcugaagucgaccugcuuucguauugugccagagaguggaaaggggaaaccccaaggaauaagcugaugcggaaggcguacgaggaguuguucuggcgccaucacauaaaaugcgugcgacagguuagaagggauaacuaugacgcacuccggucagugcuguuucagaucuucagccaaggaauuaguuuuccguccuggaugaaggaaaaagauaucgucaagcugcccgagaaacucuuauucucucagggcuguaauuggauucagcaguacagcuuugguccugaaaaguauacaggguccaacguguucggaaagcugcguaaauacguagagcuuuugaagacucaauggaccgaguuuaauggcauccgcgacuaccauaaaagaggcucaaugugcaacacacuguucagugaugccauacuagaauauaagcucuacgaggcucugaaauuuaucaugcuuuaucagguuaccgaaguguacgagcagaugaagacuaaaaaggucauuccaagccuguucaggcucuuguucucucgggaaacauccucagacccccugagcuuuaugaugaaucacuuaaacagugugggggauaccuguggacuggagcagaucgacauguucauucucgguuauucucuugaggugaagaucaaagucuuucgacuguucaaguuuaauucccgcgauuucgaaguuugcuacccugaggaaccauugagagacuggcccgagauaagccuacugacggaaaacgauaggcacuaucauauuccuguguuuuga

SEQ ID NO: 56008 - RNA, 519 nt, Artificial Sequence
  derived and/or modified sequence opt3 from FAM107A__Homo_sapiens__NP_001269642
auggcccagagacugggcgagugggcuagggggcccagcgacgcaaccggacucuaccgggccgugcuucugcgcuccgcggcuauguauucugaaauccaacgagagcgugccgauauugguggcuugauggcaagaccugaauacagggaguggaacccagaauuaauaaagccgaaaaagcugcuaaaucccgucaaagccucacggagucaccaggagcuccaucgcgagcugcuuaugaaccacagaagggggcugggaguugacagcaagccugaauugcagcgggugcucgagcaucgccgaagaaaucagcugaucaaaaagaagaaagaggaacuggaggcuaagaggcuccaaugcccauucgaacaggaguuacugcggcgucagcagcgccuuaaccaauuggaaaaacccccugagaaggaagaggaucacgcaccagaguuuauuaaaguaagagaaaaucugaggcggaucgccacacuaacuuccgaggaacgagagcucuga

SEQ ID NO: 56009 - RNA, 396 nt, Artificial Sequence
  derived and/or modified sequence opt3 from FAM107B__Homo_sapiens__NP_001269625
auggccgagcccgacuacaucgaagaugacaacccugagcugauuagaccacagaagcucauaaauccggugaaaaccagcaggaaccaccaagaucuucaucgggaacuguugaugaaucagaagcgcggcuuagcuccccagaacaaaccugagcugcagaaggucauggaaaaacgaaagcgugaccaaguuaucaagcagaaagaggaggaagcacagaagaaaaaguccgaucuagagauugaacuccugaaaagacagcaaaaacuugagcagcuggaguuggaaaagcagaagcuccaggaggaacaagagaaugccccagaguucgugaagguaaaagggaaccugaggcggacaggacaggaaguggcgcaggcucaagagucuuga

SEQ ID NO: 56010 - RNA, 789 nt, Artificial Sequence
  derived and/or modified sequence opt3 from FAM109A__Homo_sapiens__NP_001171467
auggcccccggcagcccuccagggccggcuaucgcaaccaugaagcugaacgagagaucccucgccuucuacgcgacaugcgacgcucccguggauaaugccggauuucuuuauaaaaaggguggcaggcacgcagccuaccaucggcgcugguucguccugcgagggaacauguuguuuuauuucgaagacgcugcaucucgugagccuguuggagugauuauauuagaaggcuguacuguagagcugguggaagccgcugaggaguuugccuucgcggucagauuugcagguacgagggcccggaccuacgugcuagcugccgaaucacaggaugcaauggagggguggguuaaagcucucagucgcgccagcuucgacuaucugagacuuguggucagggaacuggagcaacaguuggcggccgugcggggaggcggcgggauggcacucccacagccccagccucaaucccugccacugcccccuucucucccaucggcuuuagccccgguacccucacugccuagcgcuccagcccccguuccugcacuuccauugccccgccgaccgagugcccugccucccaaggagaauggaugcgcugugugguccacagaagcgacuuuuagaccagguccugagcccccacccccuccaccgaggcggcgugcaucugcuccccacggcccucuagauauggccccauucgcccgccuccaugaauguuacgggcaggagaucagagcacugaggggacaguggcuuagcucccggguccagcccuga

SEQ ID NO: 56011 - RNA, 888 nt, Artificial Sequence
  derived and/or modified sequence opt3 from FAM110A__Homo_sapiens__NP_001276075
augcccgugcacacccugagcccuggcgccccauccgcuccggcacuccccugcagacuuaggacacgggucccuggguaccuguugcgcggaccagccgacgguggcgcgcgaaagcccucugcuguugagcguuuagaagccgauaaagcaaaguaugugaaaucacugcauguagccaacacuagacaggagccugugcaaccacuacucaguaagcagccccuguucagcccugaaacgaggcggaccguccuuacaccaucccgcagagcucugccggggcccuguaggcggccucaguuggaccucgauauccugucuucgcugauugaccucugcgauucaccagugagccccgcagaggccagucgcacuccuggacgagcugaaggcgccgguagaccacccccggcgaccccucccaggccaccucccuccacaucugcaguucggcguguggacguccgcccauuacccgccagcccugcuagaccauguccgucccccgggccugccgcagcuucaaguccagccaggcccccuggacugcagcggagcaaaucugaucuuuccgagcgauuuucacgcgcggccgcagacuuggagagauucuuuaauuucugcggccuggauccagaagaggcuaggggccuagggguggcccaccucgcucgggccagcagugacauaguaucucuggcaggacccuccgccgguccgggcagcucggaagggggauguucucgcagauccucaguuaccguggaggagagggcucgugaacgggucccuuacggcgugaguguggucgagcgaaacgcgagaguuaucaaguggcuuuauggucugaggcaagcacgcgaaagcccagccgcugagggguga

SEQ ID NO: 56012 - RNA, 1113 nt, Artificial Sequence
  derived and/or modified sequence opt3 from FAM110B__Homo_sapiens__NP_671722
augcccaccgagacacugcagacuggcagcauggugaagccugucuccccagccgggacguucaccucugcuguuccgcucagaauccuuaacaaaggacccgacuacuuuaggcggcaagcagaaccuaauccaaagcgccugucagccguggagcgauuggaagcggauaaagcuaaguauguaaaaagucaggaggugauuaacgccaagcaggaacccgucaagccugcaguguuagccaaaccacccguuugcccugcugcaaagcgugcccuggguagcccaacacuaaaaguguucggcaaucacgcuaagacugaguccgggguccagagagagaaccucaaacuggaaauacuuaagaauaucauuaacucuucggagggaucaagcaguggcuccggucauaagcacucuagcaggaauuggccgccccaucgguccgaagccaccgaccugcaccgccauucauuugcggagaguuugaaaguguacccuacacaagggagaaggagcccacaggagggaggcucucacguaggccggcgccuccuggaacaguccgcagagucauuccugcacguuagccauaguucuuccgauauccgaaaggugaccagcgucaaaccccucaaggccauuccuuguucgucuuccgcuccacccuuaccgccuaaacccaagaucgccgcaauagcuucaaugaaaaguccagaagccgacccuguggagcccgcgugcggggugagcagaaggccaucccugcagcggucuaagagcgaucuuucagaccguuauuuucgcgucgaugccgacguugaaagauucuuuaacuacuguggauuggaucccgaggagcuggaaaaucuagguauggagaacuucgcaagggcuaauagugacaucauuucccucaacuuucggagcgccucuaugaucucaagugauugcgaacaaagccaggacuccaauucugaucugcgaaacgacgacucggcuaaugaucgcgugccuuauggcauuagcgccaucgagagaaacgcaaggauaauuaaguggcuuuacuccaucaaacaggcccgggaaucacagaagguaagucacguguga

SEQ ID NO: 56013 - RNA, 966 nt, Artificial Sequence
  derived and/or modified sequence opt3 from FAM110C__Homo_sapiens__NP_001071178
augagagcccuggcugcacucagcgcgcccccuaacgagaggcuucugccacgggacccggccgcuacccgcgaucccgacgccgcacgaccugcccguagauccgcuguggaaagguuggcagccgaucgggcuaaguacguccgcggcagaccagggacaggaagggguguugccucugagggcucagggcccggagcgaucaaaugcccuggcaaugacccaggucccccugcacgggccccagcuccgguggcccgccgagcaauugcuagaaagcccuuaaggccugauagucugauaaucuaucggcagaaaugugaguucguacgugggagcggagccgacggcccacgcgcgucccuagugaagaaacucuuucaaggccccgggaaggauaaggccccugucccaagaacuggagacgaggguaaagcaggcaaccccgaaacggugccgaccacaccugggcccgcugccgauccagcuauuccugagacucccgccccagcagccaggucugcugcgcccucgucaguuccugcagccccaccgggacccgagccucgggugguccgacgcagaggccugcagaggagccagagugaccuuuccucucgguacagcgcugcccuggcagaauccgauaccuucuuucaguauugcgguuuggacccagaggugguagaagcccucgggcgcgagaauuucacagcuggaucagauuguguuacccugaaggugagaagugucagcguggccacuucuggcuccggcuuuucaaggcacagcgggggagacgacgagggucugcaagaagaggaacucaucgaacaggugcccaguacaaccucugucauugaacguaacgcacggaucauaaaaugguuauacacgugcaagaaagcgaaggagacuccuucccaggagcagagccgaaccagaggcucgaagccaucuagguga

SEQ ID NO: 56014 - RNA, 2115 nt, Artificial Sequence
  derived and/or modified sequence opt3 from FAM111B__Homo_sapiens__NP_001136176
augaagcagacccacgccgacacacccguggaucauugccugagcggcaucagaaaauguuccucuacuuucaagcucaaaucagaggucaacaagcacgaaacggcucuugagaugcaaaauccuaaccugaauaacaaagaaugcuguuuuaccuucacauugaaugggaacaguaggaaguuagaccggagcguuuuuacugcauacggaaagccauccgagucuauuuauucggcccugucagcgaaugauuacuucagcgaacgcaucaaaaaccaguuuaauaagaacauaauuguguaugaggagaaaaccaucgacggucauauuaaucuaggcaugccgcucaagugccugcccagugauucccacuucaaaaucacauuugggcagcgaaagucuagcaaggaagacggacauauacuucgucagugugagaacccuaauauggaaugcauccuguuccacguaguggcuauuggcagaaccaggaaaaagaucgucaaaauuaacgaguugcacgagaaggguuccaaacucuguaucuacgcccugaagggggaaacuauagagggagcacugugcaaagauggccgguuucgcucagacauuggcgaguucgaguggaagcucaaggaagggcauaaaaagaucuauggaaaacaaaguaugguggaugagguuagcgguaagguguuagagauggacauuucuaaaaagaaggcccugcagcagaaagauauccacaagaaaaucaagcagaaugaauccgcuacagacgagauuaaccaucaaucacuuauacagagcaaaaagaagguccacaaaccaaagaaagauggcgaaaccaaggacguggagcacaguagagaacagaucuugcccccucaggaccugucucauuacauuaaagauaagacgaggcaaacuaucccacggauacgcaacuauuacuuuuguucccuaccccgaaaguacagacagauuaauagccagguaaggcggcguccucaccucgggcgcagauaugcaaucaaccuggacguucaaaaagaggccaucaaucuucugaagaacuaccagaccuugaaugaggcuauuaugcaucaguauccaaacuucaaagaagaggcccagugggugaggaaguacuuucgggaagaacaaaaacgaaugaaucucucgccggcgaagcaguucaacaucuauaaaaaggauuucggaaagaugacagcaaauucugucuccguggccacuugcgaacagcugaccuacuauucaaaaagugugggcuuuaugcagugggacaacaaugguaacacagggaaugcuaccuguuucgucuuuaacggaggcuacauuuucacgugccgccacguugugcauuuaaugguaggcaagaauacucaccccagccuguggccugauauaaucuccaaaugcgccaaggugacauuuaccuacacugaguucuguccaacacccgacaacugguuuucuauugagccuuggcucaaagucagcaacgaaaaucuugauuaugcaauccugaaguugaaggagaacgggaaugcuuucccacccggacuauggagacaaaucucaccgcagccuaguaccggucugauuuaccucauaggccaccccgaagggcagaucaaaaagauugacggaugcacggugaucccacugaacgagaggcuuaaaaaguauccuaaugauugucaggacggccugguugauuuguacgacaccacauccaacguguauugcauguuuacucaacggagcuuccucucugaggucuggaauacccauacacugucauacgacacuuguuuuagugaugguagcuccgggucucccguguucaacgccucgggcaaauuaguagcgcugcacaccuuuggacuauucuaucagcgcggcuucaauguucaugcccucauugaauuuggguacagcauggacuccauccugugcgauauaaagaagacaaacgagucacuuuacaaaaguuugaaugacgaaaagcuggagaccuaugaugaagagaaaggaaagcaggagucuagccuccaggaccaccaaaucgaaccaauggaguguuga

SEQ ID NO: 56015 - RNA, 1692 nt, Artificial Sequence
  derived and/or modified sequence opt3 from FAM114A1__Homo_sapiens__NP_612398
augagcgacgaugccggcgacacccuggcuacaggggauaaggcagaggugacugaaaugcccaacuccgacucucucccugaggaugccgaaguccacugcgacucagcggcuguuagucaugagccaacgccggccgaucccagaggagaaggucacgagaaugcagccgugcagggcgcuggggcagccgcuaucggaccuccaguacaaccccaggacgccaacgcgcuugagccuccacugaauggcgaugugaccgaagacacauuggcagaguguauugauagcgucuccuuagaagccgagcccaggucugagauaccucugcaggaacagaacuaccuagcuguggacucgccaccgucaggugggggaugggccggcuggggcagcugggggaaaagucuccuguccucugcaagcgcuacuguuggacauggucuuaccgccgugaaggagaaagcgggcgccacacugcggauccacggggucaauuccggaucaagugaaggcgcacaacccaacaccgagaauggugugccugaaauuacugaugcugccacagaccaggggccagcugagucucccccuaccagcccauccucagccagccgcggaauguugagugcaaucacgaacguaguucagaauacuggcaagucugugcucaccggcgggcuggacgcccuggaguucauugguaaaaagacaaugaacguccucgcugaauccgaucccggauuuaagcgaacuaaaaccuuaauggagcguacagugagccugucgcagaugcuuagagaagcgaaggagaaagaaaagcaaagguuggcacagcagcugaccauggagcggacggcccauuauggcaugcuauucgacgaguaccaggggcucucucaccuggaagcucuugagauccuguccaaugaaucagagaguaaagugcagagcuuuuuggccucccucgauggagaaaagcuggaguuacugaagaacgaccucauaucuaucaaagauauuuucgcagccaaggagcuugaaaaugaggaaaaccaagaggagcagggccuggaagagaaaggugaagaguuugcucgcauguugacugaacuacuguucgagcuccacgucgccgcaacaccggacaagcugaauaaagcgaugaagagagcucaugauuggguugaggaagaccaaaccgugguaagcguggaugucgccaaagugucagaggaagagacuaagaaggaagagaaagaggaaaagagucaggacccucaggaggauaaaaaggaagagaaaaagacaaagaccaucgaagagguuuauauguccagcauugagucucuugcagaagugacggccaggugcaucgagcagcugcacaaagucgcugaauugauacuccaugggcaagaggaggaaaagcccgcccaggaccaggcaaaagugcugauuaaguuaaccacagcuauguguaacgagguagccucacugaguaaaaaguuuacuaacagccuaaccacaguuggcuccaauaagaaagcggaagugcucaacccaaugaucucuucgguccugcuugagggaugcaauagcacuaccuacauucaggacgccuuccaauugcugcucccugugcugcaggucucccacauccagacaucaugucuuaaggcucagcccuga

SEQ ID NO: 56016 - RNA, 2769 nt, Artificial Sequence
  derived and/or modified sequence opt3 from FAM120B__Homo_sapiens__NP_001273308
auggacagacagaugauccugagcagguccucugugaugggcguccgggggcuccaaggauucguugguucaaccugcccccacauuuguacagugguaaacuuuaaggagcuugccgaacaucaccgcaguaaauacccuggcugcacuccaacgauaguggucgaugcuauguguugccugcgauauugguacaccccggagagcuggaucugugggggacaguggcgugaauauuucuccgcauugagagacuuugugaagacauucacugccgcgggcauuaaauuaaucuuuuucuuugaugguaugguugagcaggacaagagggaugaaugggugaaacggcgccugaagaauaacagagagauuucuaggaucuuccauuacauaaagucgcacaaagagcagcccgggcggaauauguuuuucaucccuucaggacuagcugucuuuacccgcuucgcccucaagacacugggccaagaaacccuuugcagccugcaggaggcagacuaugaaguggccaguuacggcuugcagcauaacugucucgggauucugggagaggauacugacuaucugaucuacgauacaugcccauacuuuuccauuucugagcucuguuuagaaagccuggacaccguaaugcuuugccgagagaaauugugugaaucccugggucuaugcguugcugaucucccccugcuugcaugccuguugggcaaugacaucauaccugaggggauguucgaaucauucagauauaagugucucaguagcuacacgucugugaaagagaacuuugauaagaagggaaauauuauccuggccgucuccgaccacauuucaaaaguguuauaucuguaccagggcgagaagaaacucgaagagauccuuccacugggucccaacaaggcuuuguucuauaaagggauggccagcuaccuacugccuggacaaaagaguccaugguuuuuccagaaaccgaagggcgugaucacucucgacaagcaggucauuucuaccuccagcgaugcggaaucgagggaggaaguucccaugugcucugacgcagagucccggcaggaggugccuauguguacaggcccagaaucacgucgcgagguacccguguauacugauagugaaccuagacaagaggucccaaugugcagcgaccccgaaccgaggcaggaggugccuaccuguacagggcccgagucccggcgagaaguuccaaugugcucugauccugagccccgccaggaagugccaauguguaccggacccgaggccagacaagaggucccuauguacacggacagcgaaccaaggcaggaggugccgauguacacugauucagaaccccggcaggagguaccuauguauacagguagugaaccacgccaggagguucccauguacaccggcccugaguccagacaagaagugccaauguauacugggcccgagagcaggcaggaaguccugauacguacagacccggagucucggcaggaaaucaugugcaccggacacgagucaaaacaggaggugccuauuuguacggauccaaucaguaagcaagaagacagcaugugcacccaugcugagauaaaucagaaacuucccgucgccacagauuuugaguucaagcuggaagcauugauguguacuaacccugaaauuaaacaggaggaccccaccaaugugggcccagagguuaagcagcaagugacaaugguauccgacacugaaauccucaaggucgcucgaacccaccaugugcaggccgagucuuaccugguuuauaacaucaugucgagcggugaaauugagugcuccaauacauuagaggaugaacuggaccaggcgcuaccuucacaggccuuuaucuacagacccauuaggcaacgcguguauagucuccugcuugaggauugccaggacgucaccucuacuuguuuggcagugaaagaaugguucguauacccagggaacccgcugcggcacccugaucucgugagaccccugcagaugacgauaccaggcggaacacccagccuuaagauccugugguugaaucaagagccugaaauucagguuaggcgccucgacacccuguuagcuugcuuuaaccuguccucaagccgagaggagcuacaggccgucgaaucuccauuccaggcucucuguugccugcuuaucuacuuguuugugcaaguggauacucugugucucgaggaccugcacgccuucaucgcacaggccuuaugccugcagggcaaauccaccagucagcuugucaacuugcaacccgauuauauuaauccucgggcuguucagcucgggagccugcuagugcguggacugacaacccucgugcugguaaacucugcgugugguuuuccguggaagacuuccgacuucaugccauggaaugucuucgauggcaaacuuuuucaucagaaguacuugcagucagaaaagggguaugcaguggagguucuguuagaacaaaacagaaguaggcucacaaaauuccacaaucugaaggccguggucugcaaggcuuguaugaaagagaaccgccggauaacgggcagagcccauuggggaagccaccaugcagguaggugggggcgacagggcucguccuaccaccgcaccggaucuggcuauagccggucaagucaggggcaacccuggagagaccagggaccugguuccaggcaguacgagcacgaucaguggcgucgcuauuga

SEQ ID NO: 56017 - RNA, 3291 nt, Artificial Sequence
  derived and/or modified sequence opt3 from FAM120C__Homo_sapiens__NP_060318
augggcgugcagggguuccaagaguuucuggaaaagagaugccccggagccgucguuccuguggaccuccuuaaacuggcuaggaccguaagccggcagcagcagcaacagcacuugcaucgccaguuaccaccgacagcagcccuggcgcccggugcuccucgagccgcacguggcuccgugccacuacagcccccucucccacccgccgcucugggggcauacucuggaggcgccgguccuacuagacaccaucacccagcucaucacuuccaccaucacgggcaagcccagccgggacuucaucccccucugccacccccuccacccccgcaguugccuggcgcgaggguccucguggaugcaggcucagcccugccccggcuguaugggggauaccagacggacuggguuugugguggccaauggaacgcuaugcucggguauuuaagugcccugugccaggcaugugcuuacccaggaggcgauggucuugaguugguggucauguuuccugggggacugggcaaggaccgccuagccgaauggggcagaaggugccaggcggagcggcaaaccgcccagcucaucguggggcacguaggaaauaaagguacacccccaccccgcgcaugguuccugccuccagcuugucuuagccacugcguucgacuggccuugauuagauuuagggugaaggucuuccagucccucgaagaucaucaccuggaggugguggccuuuuuccgggagaacggcuuucauggguuacuggcucacgacucugaauaugcacucuacaauauaccgucguauuacucaagccaugcccuuaaacugaguuggaacggaaagaauuugacuaccaaccaguuccuaaugcaagaggucgcuaagcagcugggccucaaacguaugaauuuucccaucuucgcggcacugcuugguaaccacauucugccugaugaagacuuggccgcuuuucacuggucccuccuggggccagagcaucccuuagccucucugaagguucgcgcacaccagcuagugcucccuccaugugauguagugaucaaagccgucagcgaguacguguccucaauuaaggaccccaguaaucuggauguugugggcaaagacgucuucaagcagagccaaucuagaacagaagauaagaucgagagguucaaaaaggcuguggaauauuacuccguaaccacuaaacuuagcagcuugccgguuggaccuaguuuucugggcuuccggaacaaucgacucgggaacccaccccugccucgcaaucaggugggaacaauaucugccgguaagcccauguuuucccaucaggucccacagaaagugaaguauccucccccauucccggucggcccuaacagcucgcuucuguuuucuucccacgcauugggggagucacacgcguucagugaagaccccaugcuccaaaauagcccauuugcuaacugggccguguccuacgacucuagcgcaucacaguuccccaacuaucugccuaguaaagccuccccacccuuaggaccugauagcucucauucaaguagcuccgacggcgaugagccgaauggugcuucuucggaccacaucaccgaggccuuucaucaccagccagaaugggggaaccccaauagagauaggggcagcugggcacagccuguugacacgggaguguccgaggcuucacugggcgauggggaaccacauauucccagucuacucucuaugagcacucggaaccacauggacaucaccauuccuccgcugcccccaguagccccugagguccuucgcguggcggaacacagacauaggcguggauugauguaccccuauaucuaccacguucugacaaagggugagauaaagauuccagugugcaucgaggaugaauguaauauggagcucccucccgccgcucuguuauuccgguccgcacgacaauacgucuauggcgugcuguuuucacuugccgaaacucagagaaaaauggagagguuggcuaugcgccggagacucccaguagaagugccgagcguuauucugaaggaguggucugccuacaaagggaaguccccucagacccccgagcuagucagugcacugacauucagggaauggaccugcccaaaccucaaaaagcuguggcuuggaaaggcgguggaggacaaaaaucgccgaaugcgggccuuuuuggcuuguaugaaaagcgauacgcccucuaugcugaacccugccaaugugccaacucauuuacuccugaugugcugcguccuucguuauaugguucaauggcccggcgguagaauccugcacaggcaugaauuggacacauuccucgcacaggcuguguccacccagcuguacgagccugaccgccuacaggagcugaagaucgaaaagcucgaugcccgggggauucaacuggcagcccuuuucaugucaggcguggacacugcuuuguuugcgaacgaugccuguggacagccgguaccaugggagcacugcugucccuggauauauuucgacggcaaacuguuucagaguaaguuaaucaaggcagggagagaaagggucagccucguggagcugugcgauggacaggcugaccuugccacaaaaguugaaaagaugcgacaaucgauucuggagggcgugaauaugaaccacccucccccauccgcccuacucccuucucccaccuucgucccaccuauggugccgagccuguaccccguuucauuguauagucgcgcuauggguuccaugccacugccuccccaggggcggucuagaggauuugcaggcuuacauccaaucccuccccaggguggcaaacucgagauagccgggauggugguaggacagugggcgggcagcagguccucacgugggcgcggaucauucggcaugcaagucgugagugugggugggccgggaaagggccacgguaaagaacagacgggccgggggucuaagggacauaagaaaggcaauaagcagggguccagcgauggagucucgaaaucacuggagcuucaccaaggcagaucuaggagucagguuaacgguaauuccggggcucugauuaaggaagagaaaagcgaccaccgauugccagccccuucucagugugcacucagccgggauuccaacgaaugcaacaauggaaaccgcuaccugcccaugaauaacagagagaagaaucaucuacaggagcaaaaacuggaaaccguggcccagaggaaggaggacuga

SEQ ID NO: 56018 - RNA, 1368 nt, Artificial Sequence
  derived and/or modified sequence opt3 from FAM124B__Homo_sapiens__NP_001116251
auggacgagacccagggcccccuggccaugacagugcaccuccuugcuaacagcgggcauggaucccuguugcaaagaacuuuagaucagcugcuagacugcaucuguccugaagucaggcucuuucagguuucugagcgggcaucaccagugaaguacugcgagaaaagucacagcaagcgcucccgauuuccggguaugucuguacugcuuuuccugcaugaaucgcccggcgaagaucguuuguuuagagugcucgacucacugcagcacagcccuuggcaauguuauccaacgcaggauaccagggggcggcugugccccuacuucuuugccaaucaggaguucuauagucucgacucccaguuaccuauuuggggaguccgccaagugcauuguggcucugagauacugagaguuacacuuuacugcagcuuugauaacuaugaagacgcgaucagguuguacgagaugauucugcagcgggaagcuacucuacagaaauccaauuucuguuucuucgugcucuaugccucaaagaguuuugcacugcagcuuagccugaaacaauugccacccgguaugucugucgauccuaaggaguccucagugcuccaguucaagguacaggagaucgggcaacugguuccauuacugccgaaccccugcaugccuauuagcaguacccgcuggcagacacaggacuacgauggaaauaaaauccuccuucaggugcaacugaacccagaauugggcgucaagaauggcauacuaggggccggaaugcugccccucgguucucgacugaccuccgugagcgcuaaaagaacuucggagccuaggucucagcggaaccagggcaagcguucccaggggcacucacuugaacugccagagcccaguggaagcccgacauccgaccgcugugcaggcaccucuuggaaaagcccugguagaucauuucaagugaguucccccgccaugggggcucacuugcaucucagcucucaccaucuggaaucaggagccaggaugaaggucuuaaaucgggagaacaguuuccagaagcuggaggcggaaacgaauguugauacuggccuaaccaucauuaacagcgagccacgacagacauacuucggcggguuuccucgcgaccuccagacuucccaacccccauucugccugcccgcaucuucgcuuggaguggccaccagcaaaaauaacuccguauugaaggaaagagugucaccucugccacucgcuggucagagggaccugggcacacggaaaaccaucagugagugucuucugcacuugcagguccagggggaagagaaggaggaagaugaggaagaguuuuucauuuga

SEQ ID NO: 56019 - RNA, 1566 nt, Artificial Sequence
  derived and/or modified sequence opt3 from FAM126A__Homo_sapiens__NP_115970
auguucaccagcgagaagggcguggucgaagaguggcuguccgaauuuaaaacacuccccgagacuucucuuccuaacuacgccacgaaucugaaggacaaaucaaguuugguuagcuccuuauauaaggugauccaggaaccacaaucugagcugcuagagccgguaugccaccaacucuucgaauuuuacagaucgggggaggaacagcugcuucaguucacccugcaguuuuugcccgagcucauuugguguuaucuggcugugucagcaagcaggaacguccauaguuccggaugcauagaggcccugcucuuagguguguacaaucuggaaaucguugauaaacagggccacacaaaggugcuuucuuucacuauuccuagcuuguccaagccaucagucuaucaugagcccaguagcaucgggucuauggcgcugaccgaauccgcucuaucacagcacggacucagcaaagugguauacaguggcccucauccacagcgggagaugcugacagcccaaaaccgcuuugaaguucuuaccuuccuguugcucuguuauaaugcagcccugacuuacaugcccucuguguccuuacagagccugugccagauuuguucgcgaaucugcgucugugguuacccucgucagcacgugagaaaguauaaagggauaucuuccaggaucccagugucaaguggauuuaugguccaaaugcucacaggcauuuacuucgcuuuuuauaacggcgagugggaccuugcacagaaggcccuggaugacaucauuuaccgggcucaguuggagcuauauccggaaccccugcucguugccaaugcgaucaaagcaagccugccucacgggccaaugaaguccaacaaggagggaacccgcugcauacaaguggaaauuacgcccacuucuagcagaaucucaaggaaugccguaaccaguauguccauucggggucaucgcuggaaacgacacggcaacacagagcuuacugggcaggaggaacugauggagaucagcgaaguggaugagggauucuacucuagagcugccucaaguaccagccaguccggcuugucuaauucgagccauaacuguuccaauaagccuucaaucgguaaaaaccacaggcggagugggggaucuaagacaggcggcaaagaaaaggagaccacgggggaaagcugcaaagaccacuuugcacguaagcagacucaacgcgcucaguccgagaaucucgagcuguuaucacugaagagacuaacacucaccacuagccagucucugccaaaacccuccagucauggacuugccaagacagcggccaccgucuucagcaaaucuuucgaacagguguccgguguuacggugccgcacaacccuucaagugcagucggcuguggggcuggaaccgaugccaacagguuuagcgcuugcucguugcaagaggaaaagcugauuuauguguccgagcggacagagcuccccaugaaacaucagucuggccagcagcgaccaccuagcauaucaaucacucugaguaccgacuga

SEQ ID NO: 56020 - RNA, 2787 nt, Artificial Sequence
  derived and/or modified sequence opt3 from FAM129A__Homo_sapiens__NP_443198
augggcgggagcgccuccucucagcuggacgagggaaagugcgcuuacaucagagguaaaaccgaagcagccauuaagaacuucucacccuauuacaguaggcaauauagcguggcguuuuguaaucacguccggacagagguugaacagcagcgcgaucucacuucccaguuccuuaaaacgaagccuccacuggcuccgggcaccauauuguacgaggccgaauuaucucaauuuucggaggacaucaaaaaguggaaggagcgauaugugguagugaaaaacgauuacgcagucgaaucauaugagaauaaggaagccuaccagcguggggcugcacccaaaugcaggauucugccugccggaggcaaggugcuaacaagcgaggacgaguacaaccuccugagugauagacauuucccagacccccuugcuuccucugaaaaagagaauacucagccuuuuguugugcugccaaaggaauuucccgucuauuuguggcagccuuucuuccggcacgguuacuuuuguuuccaugaggccgcggaucaaaagcgcuuuagcgcacuccuguccgacugcgugagacaccugaaccaugauuauaugaaacagaugaccuucgaagcccaggcuuuucucgaggccguacaguucuucaggcaagagaaggggcacuacggaucaugggaaaugaucacaggcgacgagauucagaucuuaaguaaucugguuauggaggagcuuuugccaacccugcagacugaucuacucccgaaaaugaagggcaaaaagaacgaccggaaacgcacauggcuggggcuucuggaagaggcauauaccuuggugcaacaccaggucagcgagggacucucugcucugaaggaagagugucgagccuuaacgaagggucuggaaggcacuauaagauccgauauggaccagaucgugaauagcaaaaacuaccucauugggaagaucaaagcgaugguggcccagcccgcagaaaagagcugccuugaaaguguccaaccuuuucuggcuucuauuuuggaggagcuaaugggaccaguuuccagcggcuucucggaagugaggguacuguuugagaaagaagugaaugaggucucucagaacuuccagaccacaaaggacuccgugcagcucaaggagcaucuggaucggcuuaugaaucugcccuugcacucaguuaaaauggaaccuuguuauacuaaggugaaccuccugcaugagcguuuacaagaccugaaaagucgcuuuagauucccacacaucgaucuagucgugcagaggacccagaauuacaugcaggaacucauggagaacgccguauuuacauucgaacaacugcuuagcccccacuugcagggugaggcuuccaagaccgccguugcaauagagaaagugaagcugcggguccucaagcaguacgacuaugauucuagcacgauucgaaagaaaaucuuucaggaagcccuggugcaaauuacucuuccgacaguccagaaagcucuggcgucaaccugcaagccugaguugcagaaauacgaacaauucaucuuugcagaccauacuaacaugauccacguggagaauguuuaugaagagauucuccaucagauacuguuagaugagacacugaaggugaucaaggaagccgcuauucucaaaaagcacaaccuauucgaggacaauauggcccugcccagugaauccguaagcucucuuaccgauuugaaaccaccuacggggucaaaccaggcaagucccgcccgcagagcuagcgccauccugccaggaguccucggcuccgagacccugucuaaugaaguguuucaggagucggaggaagagaagcaacccgaaguuccuagcuccuuagcaaaaggcgagucacugagucuuccagggccgucucccccuccagacggaacagaacaggugauaauuagcagggucgaugaccccgugguaaacccuguggcgacugaagacaccgcugguuugccaggcacauguuccucagagcucgaguucgggggaacucuggaggaugaggaacccgcccaggaggaaccggagccuaucaccgcaagcggcucucuaaaggcccugcggaaacuccugacagcuuccguugaagucccaguggacagugcccccgugauggaggaagauaccaauggugagagccaugucccucaggagaacgaagaggaagaggaaaaggagcccucucaagcagcugccauccacccagacaauugcgaggaauccgagguuucagaacgcgaggcgcagccucccuguccagaggcccacggggaggaacuuggcggauucccggaagugggcaguccugcuucacccccagcauccgggggauugacugaggaaccccuggguccuauggagggcgaguuaccaggggaagccugcacgcucacagcucaugagggaagaggcgguaagugcaccgaagagggggaugccucgcagcaggaaggcuguacucugggaucugaccccauuugccuuagcgagucacaagugagugaggaacaggaggaaaugggcgggcaguccucugcagcgcaagccaccgcuagcguaaacgccgaggaaaucaaagucgcaaggauucacgagugucagugggugguugaggaugcuccuaauccggacgugcuguugucccauaaggaugacgucaaagaaggagaggguggccaggaaucauuuccagagcuccccagcgaggaauga

SEQ ID NO: 56021 - RNA, 2202 nt, Artificial Sequence
  derived and/or modified sequence opt3 from FAM129B__Homo_sapiens__NP_001030611
augggcuggaugggggaaaagaccggaaaaauccugacagaauuucuccaguuuuacgaggaccaauaugguguggcccuuuucaacagcaugagacacgaaauugagggcacugggcugccccaggcucaguuguuauggaggaaggucccucuggaugaacggauaguuuucuccggaaaucuauuccagcaucaagaggacucuaaaaaguggcgcaaccgauuuucacucgugccacacaauuacggccugguacuuuaugagaacaaagcagccuacgaacgucaggugccgcccagagcggucaucaauagugcugguuauaagauucugacgagcguggaucaguacuuggagcucaucgggaacucccugccuggaaccacagccaagucuggcucggcaccaauucugaaaugccccacucaguucccucucaucuuauggcauccauaugccaggcacuacuacuuuuguaugaugaccgaagcugagcaagacaaguggcaggcaguucugcaggauugcauacggcauuguaauaacggcauccccgaggacucaaaaguggaagggccugccuucacagaugcuauucgcauguauagacagagcaaggagcuuuacggaaccugggaaauguugugcgguaaugagguccaaauccugaguaaccuagugauggaggagcucggcccagagcugaaagccgaacuugggccgaggcugaagggaaagccccaggagcggcagcgccaauggauucagaucuccgacgcgguauaucacaugguuuacgaacaggcaaaagcccgauuugaggaaguguugucuaagguccagcaagugcagccugcuaugcaggccgugauaagaacugauauggaccagauuaucacaagcaaagagcaccucgcauccaagauuagggcuuucauccugccaaaagccgaggucuguguucggaaucaugugcaacccuauaucccuucaauuuuagaagcgcugaugguaccaaccagucagggcuuuacggaggugcgugaugucuucuuuaaggaagugacugacaugaaccucaauguuauaaacgagggugggaucgauaaacuuggagaauacauggagaagcugagccgcuuggccuaucacccccuaaagaugcagucuugcuacgagaaaauggaaucccugagacucgacggccugcagcaaagguucgacgugucaagcaccagugucuucaagcagcgggcacagauucauaugcgagagcagauggauaaugcuguguacacauuugaaacucuucugcaccaagaguugggcaaagggccgaccaaggaggaacucuguaaaucuauccagcgcguacuggagagaguuuuaaagaaguaugacuacgauuccagcucggugaggaaacgguucuuucgcgaagcccugcuacagauaucuauuccuuuccuccugaagaaacuugcucccacaugcaaguccgaguugccaagauuucaagaacugaucuucgaggacuuugccagguucauccucgucgagaacaccuaugaagaggugguccugcagacggugaugaaagauauucuucaggcaguuaaggaagccgcugugcagcguaagcacaaccuguaccgggacucaaugguaaugcauaauagugauccuaacuugcaccuccuggcggagggagcacccaucgacuggggugaagaguauagcaauuccggcgggggaggcucuccaagccccucaacuccugagagugccacauuauccgaaaaacgaagaagggcuaagcaagucgugagcguugugcaggaugaggaagucggucugccauuugaggccucuccggaaucacccccuccagcaagucccgacggggugaccgagauucgcggccuacucgcccagggacugcggccugagagcccacccccggcuggcccucuuuugaacggggccccagcaggagaauccccacagccuaaagcggcucccgaggccucuucgcccccugcaagcccccugcaacaucuccugccagguaaggccguagauuuaggcccgccuaaacccuccgaccaggaaacuggggaacaggugucaaguccaucuagccaccccgcucugcauacaaccacggaggacuccgccggaguucagaccgaguucuga

SEQ ID NO: 56022 - RNA, 1494 nt, Artificial Sequence
  derived and/or modified sequence opt3 from FAM134B__Homo_sapiens__NP_001030022
auggccagccccgcuccuccagagcacgcagaagagggcugcccggcccccgcggcugaggagcaggccccuccaucucccccuccaccccaagcauccccugccgaaagacagcagcaggaggaggaagcucaagaggcaggggccgcugaaggagccggucuccagguggaggaggcggcaggcagggccgcugccgcagucaccuggcugcuuggggaaccaguucugugguugggaugucgggcugacgaguuacugucauggaagcgcccgcuacgaagucuccugggcuucguggccgcgaaccuucuguuuugguucuuggcccucacacccuggcguguauaccaucugaucagcgugaugauucuggguagagucauaaugcagaucauuaaagauauggugcucuccaggacucggggugcacaguuauggcgcucucugucggaaucaugggagguuaucaauagcaagccugacgaaagaccaaggcuuagucacugcauugcugaguccuggaugaacuuuucuaucuucuugcaagagaugagccuguuuaaacagcagucccccggaaaguucugucuacucgugugcucagucuguacguuuuucaccauacugggcaguuauaucccuggcgugauucuuagcuaccuguugcuccugugcgccuuuuuauguccacuguucaaaugcaaugauaucgggcagaagauuuauucuaagaucaaauccguacuccuuaagcuggacuuuggaauaggugaauacauuaaccagaaaaagcgggagcgcucagaagcugauaaagaaaagagccauaaggacgauagugaauuggacuucucugcccuaugucccaaaaucucccugacaguugcagccaaggagcucagcgugucggauacugacgucucugagguguccuggaccgauaauggcacauuuaaccugucagaaggguauaccccgcaaacugacacaagugaugaccuugaccgaccuagcgaggaaguguucuccagagaucugucugacuuccccagcuuggagaauggaaugggcaccaacgaugaagacgagcucucacuggguuuaccaacggagcugaaaaggaagaaagaacagcuagauagugggcaccggccuuccaaggagacucaaagcgcugcgggacucacccugccccuuaauucugaccagacauuucauuugaugucaaaccuggcaggcgaugucauuacugccgcuguuaccgccgcaaucaaagaccagcucgaaggcgugcagcaagcccugagucaggcugccccaauccccgaggaggauacagacaccgaagagggggaugacuucgaacuucuggaccagagcgaguuggaucagauugaauccgagcucggacugacgcaagaccaggaggcagaagcgcagcagaauaagaagucuucgggguuuuuaagcaaccugcuaggcgggcacuga

SEQ ID NO: 56023 - RNA, 3960 nt, Artificial Sequence
  derived and/or modified sequence opt3 from FAM135A__Homo_sapiens__NP_001099001
augaccgaggugcaggccauggucgaguucagcguugaacugaacaaguuuuacaauguggaccucuuccaaagaggcuuuuaucagaucagggcuuccaugaaaauucccucucggauaccucaccgcguagaagcaucacuucugcaugccacagggaugacuuuggcguucccagcuagugugcacgauagcuuaaucugcuccaagacguuucagauucuguacaaaaacgaggaagucgugcuaaaugacguuaugaucuucaaggugaaaaugcuccuggaugagcgaaagauugaggaaacccuugaggaaaugaacuuucuguugucucucgaccugcauuucacagauggagacuauucggccgaugaccugaaugcacuccaguuaaucucaagccguacucugaagcuacacuuuaguccgcauagagguuugcaccaccaugucaacgugauguucgauuacuuucaccuguccguaguuucugugaccguccaugccagccuaguggcucuccaccaaccccugauauccuucccuaggccagugaaaacaaccuggcuuaaucggaacgcacccgcccagaauaaggacucagucaucccuacucuggagaguguuguguuuggcauuaacuauacaaaacaguugagcccagauggguguucuuucaucauugcugacuccuuccuccaccaugccuaccgcuuucacuauacccugugcgcgacguuacugcucgcauucaagggacuucauucauacuuuaucacuguaaccgaggaaauacccagcugucagaaacuggaguuggaagagauggauguggaagccagacuaacagagcugugcgaggaagucaagaagauugagaauccugacgaacucgcugagcugaucaacaugaaucuugcccaacuguguaguuugcucauggcacuguggggccaguucuuagaagugauuacucugcacgaggagcuaaggauccuccuggcucaggaacaucacacccuucggguucgccgauuuucugaggccuucuuuugcuucgaacacccaagagaggcggccaucgcauaccaggaauugcaugcucaaucccaucugcagauguguacagccauuaaaaacaccagcuuuugcucgucucucccgccccugccuauagaguguuccgagcuugacggugaucuuaauucauugccaaucauuuucgaagacagguaucucgauagugugacggaggggaagcuggacaucagccaggaugacuccgaaauaacucaaauggagcacaacuuagcuucucggcguagcucagaugacugccacgaucaccagacaacccccagucugggaguccgcacuauugagaucaaaccuuccaacaaggacccauuuagcggcgaaaauaucacagugaaacuaggccccuggaccgagcucagacaggaagagauucugguagauaaccuuuugccgaauuucgaaucucuggagucaaacgggaagaguaaaagcaucgagauuacguuugaaaaggaggcccuccaggaagcaaagugucuguccauaggagagucuuuaaccaaacugaggucgaaucuuccugcccccagcacaaaggaauaccauguuguggucuccggugacacuaucaaauugccagacauuucagcuaccuaugcgaguucucgguucagcgauuccggcguggagucagagccuagcucuuucgcaacacaccccaacacugaccucgucuuugaaaccgugcaagggcagggaccaugcaauuccgagcgacuguucccccagcuacugaugaagccugauuacaacguuaaauuuagucucggcaaucauugcacagaaagcaccucugccaucuccgagauccagucaagucugacuagcauuaacucgcuuccauccgacgaugaauugucuccggacgagaauagcaagaagucagugguacccgagugucaccugaacgauaguaaaacggucuuaaaucucgguacaaccgaccugccuaagugcgaugacacuaaaaaguccucuauaacccuucaacagcagagcgugguuuucuccgggaaccuggauaaugaaacaguggcuauccauucauugaacagcaguauuaaagacccacuccaguuugucuucucugaugaggaaaccuccagcgacgugaagucgucauguucuaguaagcccaaccuggacacuaugugcaaaggauuucaauccccugauaagagcaauaacucuacaggcacggccaucacccuaaauagcaaacugauuugucucggcacuccaugcguaaucuccgggucaauaaguagcaacacagacgugucugaggaucgcaccaugaagaaaaauuccgacguucugaaccuuacacagauguauucagagauccccacugucgaaagugagacccacuugggaacgagcgauccguucuccgcaucuaccgacauugugaagcagggucugguggaaaauuacuuuggcucgcagagcucaacagauaucuccgacacuugugccgucaguuauucuaacgcuuuaagcccucaaaaggagaccuccgaaaaagagauuucaaaucuccagcaggagcaagauaaggaagacgaggaagaggaacaggaucagcagaugguucaaaacggguacuacgaggagacagacuauucugcccuggauggaacuaucaaugcacacuacaccagcagagacgaacuuauggaggaaaggcugacgaaaagugagaagauaaacuccgacuaucuacgggauggcauuaauaugccaacagugugcaccagcgguugucucucuuuccccucagcgccucgcgaaucccccugcaacgugaaauacaguagcaagucgaaauuugacgcuaucacuaagcagccaucuuccacaagcuauaauuucaccucaaguauuucuugguacgaguccagcccuaagccccagauccaggccuuucugcaagcaaaagaggaauugaagcuguuaaaacucccaggguucauguauucagagguaccgcugcuugccaguagcgucccuuacuucuccguggaagaggaggauggcucugaagacggaguucaucugauaguguguguccacggcuuggaugggaacagcgcugaccucagacuggugaagacuuacaucgagcuaggacugcccgguggcaggauugauuuucuuauguccgaacguaaccagaaugacaccuucgccgauuuugacucaaugacagaucggcuccuggacgagaucauucaguauauccagauauacucuuugacgguuaguaaaauuucguucaucgggcauagccugggaaacuuaaucauucgauccgugcucaccagaccaagguuuaaguauuaccugaauaagcugcacacuuuccugucuuugucaggcccccaucucgguacacuguauaacagcuccgcacuuguaaauaccgggcugugguuuaugcaaaaauggaagaaaaguggcucucuucuccagcugacaugccgcgaccacagcgauccucggcagacuuucuuguacaaguuaucaaacaaagcuggacugcacuauuuuaagaaugucgugcucgugggcucccugcaagacagauacgucccauaccauagugccaggaucgaaaugugcaagaccgcgcuuaaagauaagcagagcgggcagauuuauucugagaugauacacaaccuguugcgccccguucuacaguccaaagacuguaaucuggugcgauacaacguaaucaaugcccucccuaacacggcugauucacugauuggacgggcagcccauaucgcugugcuugacagcgagauuuucuuagaaaaguuuuuccuggucgccgcacucaaauauuuccaauga

SEQ ID NO: 56024 - RNA, 4221 nt, Artificial Sequence
  derived and/or modified sequence opt3 from FAM135B__Homo_sapiens__NP_056996
augagcgagauccagggcaccguggaauuuuccgucgagcugcacaaguuuuacaacguugaccucuuccaaagaggguauuaccagauuagggugacacuuaaaguaucuucacggauaccccaucgccugagugccagcaucgcuggacagacugaauccucuucguugcacucagcaugcgugcaugauagcacgguccacagucgaguguuucagauuuuauaucguaaugaggaaguuccuaucaacgacgccguggucuucagagugcaucugcuacucgguggcgagaggauggaggaugcgcuguccgaaguagacuuucaacuuaagguugaucugcacuucaccgacucugagcagcaguugcgggauguggcuggggccccaauggucagcucccgcacacucggacugcacuuucauccgagaaauggccugcaccaucaggugcccgugauguucgacuacuuucaccucucagucauuaguguuacugugcacgcagccuuaguagcucugcaacagccucuuaucagcuucaccaggccaggucgggggucuugguugggaaaaggcggccccgauacagggcaggaacaguccauaaucucacuggagaaccuaguguuuggagcagguuauuguaagccuaccagcagugagggcucuuucuacauuacuuccgaaaauugcaugcaacaugcccacaaauggcaucgcgaccucugucugcuucuguugcacgcuuaucgagggcucagacugcauuucuuagucaucaugagggauauuccagagcugccccacacagaacucgaggcccuugcgguggaagagacccugagccaguugugcucggagcuacagaugcugaacaauccugaaaagaucgcagagcaaauaucuaaggaccucgccuggcugacgucccacaugaugacucuuuggacccaguuccuggauacaguuacuuugcauucacaggugaccacauaccucacccaggaacaccauacgcugcggguccgucgcuucagugaggccuuuuucuacauggaacaccaaaaauuagccgugcugacuuuucaggagaaccuaauucagacacacagccagcucucccuggacaucagaaauucugaguaucuuaccagcaugccaccguugcccgcagaaugucuggacauugauggagacuggaacacucucccuguaaucuucgaggauagguacguugacugcccagcuacaggccauaaucugucaguguaucccaacuuugaugucccugugaccaguccaacgaucaugaaucuuaaggacaaagaagauaacuguauggucaauuccaaccugagcuuccgggaggacuuggugcucucuaccauuaagcccucacaaauggauagugacgaagagguuauacgaugcccggagccuggugaaaacguggccacacagaaucacauggauauguguagcgagucccagguauacaucucuauuggggaauuucagaacaaagcgggaguccccgaggacgagugcuggacuggccaaaccucggacgccggcacauauccaguggcagauguugacacuagccgcagauccccugggcccgaagauggacaggcuccagugcugaccuacaucgacgucaagucaaguaauaagaaccccucuagggccgagccuuuaguggcuuucaaugcccagcaugaaagccgguccucacgcgauaaauauggucuggacagaacaggccuaagcaagguagugguugggggaucucaccagaacgcaauauccagugauaaaaccacucuccaugagcugagcacgcuuggcaaggguauugaccaagaagggaaaauggucuugcugucucucaagcugacaccauccgagccgugugaucccuuaucaaguacccugagggagccucuugacauccguagcucguugaaagauucccacacugaagaacaggaggagcucucugugcugagcggcgugaucaagcggucaaguuccauuaucucugacagcggaauugaauccgagccaucaagcgucgccuggagugaggcucgaucuagagcgcuagaacugcccuccgauagggagguucuccacccuuuugugcgccggcaugcacugcacagaaauagccuugaaggcgggcauaccgagucgaacacaucauugccaucuggaauacaggccagucugaccuccaucagcucuuuacccuucgaagaggacgagagggaaguggcucucacuaagcugacaaaaagcguauccgccccgcacauuucaaguccugaggaagcagccgaggacgcugauacgaagcaacaggacgguggcuuugccgagccaagcgauaugcauucuaaaucccaggggucacccggaaguugcagccagcuuugcggcgacuccgguaccgaugcaggggcggaccacccucuggucgaaaucguguuggaugcugacaaucaacagggccccggauacaucgauauuccaaagggcaaagggaagcaguucgacgcccagggacacugucucccugauggucgcacugagaacacacccggcguugaaaccaaggggcugaaucuaaaaauaccacgagugaucgcacuggagaacccgcggacacguucucuccauagagcccuggaagagacuccuaagggaaugcccaaagaccuuaaugucggccaacaggcuuugucgaacagcgguauuucagagguggaagggcugucccagcaccagguuccagaguuaaguugcaccucugccgcagaugcuaucaauaggaacagcacgggccaacagucccagucaggaucucccuguauuauggacgacaccgccuuuaaccgcggcgugaaugcguucccugaagccaagcauaaagcugggacaguaugcccaacugucacccacagcgugcacagucaagugcucaagaaccaggagcugaaggcaggaacauccaucaugggcagccaucuuacuucugccgaaaccuucacgcuggauucacuaaaagcugucgagguugugaaucucuccguaaguuguacagcuaccugccugcccuuuagcucggugccuaaggagacuccggcacgggcggguuucucuuccaaacagacauuguuuccaauaacccaccagccccuggggagcuucggagucgugucaacucauaguucuaccuuagacgaagagguuuccgaaagaauguuuagcuucuaccaagccaaggagaaauuuaagaaggaacucaaaaucgagggcuuccuguauucagaucuuacagugcuggcuagugacauuccuuacuuuccacccgaggaagaggaagagaacuuggaggaugguauccaccucgucguguguguucauggccuggacgggaauagcgccgaucuaaggcuggugaagacguucauugaacuuggacucccuggcgggaaacuggacuuuuugauguccgagaagaaccagauggauaccuucgcagacuuugauacuaugacagaccgacuguuagacgaaaucauacagcacauucagcucuauaaucugucuaucagccgcauuuccuucaucggacacucacuuggcaacauaaucauucggucuguccugaccagaccgagguuccguuacuauuugaauaaacuccauacauuucugagucuaucggguccccaccuggggacucuuuacaacaauagcacccucguauccacgggacugugguugaugcaaaagcugaaaaagucuggcucauuacuccagcugacauuccgcgauaacgcugaccuucggaagugcuuucuguaucaguugagccagaaaaccggucuacaauacuucaagaaugugguucugguggccuccccacaggauagauacgucccuuuucauagugcaaggaucgagauguguaaaacugcccucaaggaccgacacaccggccccguguaugcugaaaugauuaacaaucugcuugggccauuaguagaggcgaaagauugcacacugauccggcacaacguguuccaugcccucccuaacacugcaaauaccuugauaggacgcgcugcccacauugccguccuggacucugagcucuuucuggaaaaguucuuucuuguugcuggccugaacuacuucaaguga

SEQ ID NO: 56025 - RNA, 417 nt, Artificial Sequence
  derived and/or modified sequence opt3 from FAM136A__Homo_sapiens__NP_116211
auggccgagcugcagcaacucagagugcaggaagcugucgagagcaugguuaagucccuugaaagggagaacauccggaaaaugcagggccugauguuccgcugcucugcaucauguugcgaagacagucaggccagcaugaagcaagugcaccaguguauugagcgaugccauguacccuuggcgcaggcucaggccuuagugaccuccgagcuggaaaaauuucaagaucgucuagcaagauguacaaugcacugcaaugacaaggccaaagauucuauagacgcugggucgaaggagcuccaggucaagcagcagcuggauucaugugugacuaaaugcguugacgaucauaugcaccuuaucccuacgaugaccaagaaaaugaaggaagcacuguugagcauuggaaaauga

SEQ ID NO: 56026 - RNA, 2094 nt, Artificial Sequence
  derived and/or modified sequence opt3 from FAM13A__Homo_sapiens__NP_001015045
auggccugcgagaucaugccccugcagagcucccaagaagacgagagaccucucucuccauucuaccuuucagcucacgugccgcaggucaguaacguuagcgcaaccggcgaacuguuggagaggacaauucgguccgccguggaacagcauuuauuugauguaaauaacucugggggacagucgucagaggacagcgagagugguacucuguccgcgucuagcgcuacguccgcccgccaacgacguagacagucaaaggaacaggaugaggugaggcacggccgggacaaagggcuaauaaauaaggaaaacacccccaguggauucaaucaucucgaugacuguauccugaacacacaggaggucgagaaagugcacaagaauacuuuuggcugcgccggugaacgcagcaaaccuaagagacaaaagucuuccaccaaacuuucagagcugcaugauaaccaggacggguugguuaauauggaaagccucaacaguacaaggucucacgagcggaccggaccagaugacuucgaauggauguccgaugagcgcaagggcaaugagaaagacggcgggcacacucagcauuuugaaagccccacaaugaagauucaggagcacccuucgcugucugauaccaaacaacagcgaaaccaggacgcaggagaccaagaagaguccuucgugucagaagucccacagagugaucugacggcucucugugacgagaagaauugggaggaacccaucccugcauuuagcuccuggcagagagagaacucugauagcgacgaagcccauuuaucaccacaggcugguaggcugauucggcaacuuuuggaugaggacagugauccgaugcugagcccccguuucuaugccuacggccagucccgccaguaucuagacgauacugaagugccuccaucucccccuaauucacacaguuuuaugagaaggcggagcuccucucucgggucguacgacgaugagcaggaggaccugaccccagcgcaacuuacacgacgcauccagagccugaagaaaaagauaagaaaauucgaagacagguuugaggaagagaagaaauaucggcccucccacucagauaaggcagccaacccggagguauugaaauggacuaacgaccucgcuaaguuccgcagacagcugaaggaaaguaaauuaaagaucucugaggaagaucugaccccuaggaugcgucagcggagcaauacacuccccaaauccuuuggaucacaacuugagaaggaagacgagaaaaagcaggagcugguugauaaggccauuaaaccaagcguggaagcaaccuuggagucuauccagcgaaagcuacaggaaaaacgggcugaguccaguaggccugaagacauuaaggauaugacgaaagaccaaaucgccaacgagaaggucgcgcugcagaaggcccuccuguacuaugagagcauacauggccgccccgugacuaaaaaugaaagacaggugaugaagccacuuuacgauagauacaggcuggucaaacaaauuuugucucgcgcaaacacaauccccauuaucgguuccccuucaaguaagcgacggagcccacuccugcagccgaucauugagggggaaaccgcuucguucuucaaagagauaaaggaagaggaggaaggauccgaggacgauucuaauguuaagcccgacuuuauggugacuuuaaaaacagauuucagcgcccguugcuuucuggaccaguucgaagacgaugcugacggcuuuaucucaccuauggaugacaagauuccaaguaaauguucccaggauaccggccuaucuaaccuccacgccgcaagcauccccgagcugcuugagcauuugcaagaaaugagagaggaaaagaaaaggauacgcaagaaacugcgggacuucgaggauaacuuuuucagacagaaugggaggaauguacagaaggaagaccgaacgccuauggccgaggaguauuccgaauacaagcacauuaaagcuaagcuccgccugcuugaggugcugaucucaaaacgggauaccgacagcaagaguauguga

SEQ ID NO: 56027 - RNA, 1464 nt, Artificial Sequence
  derived and/or modified sequence opt3 from FAM13C__Homo_sapiens__NP_001001971
auguucagcugcuuuuguuucucccugcaggacaacucuuuuucaaguaccacagugacugagugcgaugaagaccccgucagccuccacgaggaucaaacggacuguuccucucuuagagaugaaaauaacaaggagaauuacccugacgccggcgcucugguugaagaacaugcaccaccgucgugggagccccagcagcagaacguggaagccaccguauugguggauucagucuuaaggccuagcauggggaauuucaaaagucggaagccaaaauccaucuuuaaggcggagucuggacgcagccacggugaaucccaagagacagagcaugugguuucaagucagagcgaaugccaggugcgagcuggcacucccgcccacgagucuccucagaacaaugcauucaaaugucaagaaaccguccgucugcagccaagaauugaccagaggacagccauaucccccaaggaugcuuuugagacccggcaggaccuaaacgaagaggaggcagcccaagugcaugggguaaaggauccugcuccagccucaacucagagcguucucgcggacggaacagauagugcagacccgucucccgugcacaaagacggccagaaugaagccgauuccgcuccugaggaccugcacagcgucgguaccucgcgccuucuguaucauaucacggauggggacaacccauugcucucucccagaugcuccauuuucucacaaagucagagguuuaaucuggauccugaaagcgccccaucucccccguccacucagcaguucaugaugccucggagcucaagucgcuguuccugcggagacggcaaggagccccaaaccaucacacagcugacuaaacacauucagagccucaagcgaaaaaucagaaaguuugaagagaaguucgagcaggagaaaaaguacagggugaccaaacaagauaagaacuuaauaaaaccacuguaugaccgguaccguaucauuaagcagauccuuucuacaccuucauugauucccaccauccaggaggaagaggauagugacgaagaucgcccacagggcagccaacagcccucccuggcagacccugcuucucaucuaccagugggggaccaccucacguauucgaaugagacugagccggucagagcccugcuucccgaugagaaaaaggaaguuaagccuccagcgcugagcauguccaacuugcacgaagccacaaugcccgugcuccuggaccauuuaagggagacccgggcagauaaaaagcgacugcgcaaagcucucagagaguuugaggaacaguucuucaagcagacuggaaggucaccucaaaaagaagaccggauaccaauggccgaugaguacuaugaauacaagcacauuaaggcuaaacuucgccuguuggagguacuaaucaguaagcaggacguggccaaaacaauuuga

SEQ ID NO: 56028 - RNA, 1449 nt, Artificial Sequence
  derived and/or modified sequence opt3 from FAM149A__Homo_sapiens__NP_056213
augcuguucgagggcaaggugaacccccagacccaaagccuccuugccgaaugcggggaguggacaagaaggucccugcacuugcgggucuuaggacgccagcugauccuaccuacugacaaagguguucagcauuuucagggcucuacgccagcuucagcagugcaccgaccgccccucagugccugugggcauagcuccaauauucgugaacugugcauaucuggaucgcaaaucguaccugcggcucuuucagccagcgcacugccaggccccgaugacaccgguguggccgauuugacagcuagaaguucccucgaggaagaggucuaccacguggacgggaagauugaggaauauuucgcauuugauaggaaagaggacgaugacgaaugucuggagcagaagccugcccagccaggacggaaauggcgcaagcugggccuucccccuguuucuccaagagauugcgugaaggacgcugucgccgcggagguguucgaucauguauggacuaacaugguugaauuacuggaggaacuuaucaggaaacacugggagaccacauugaccgaaggcaagaaacagcgggagacucugaagguggcagggaaucgcuuuccgcacguccuagugccccaugcccacgcugacggagccagcgguccuccauccggccaugcagaggcucacgggauuucacucgccagucgacugaaucccccucaaauccaccauuucucuagcuccuuuuacucagauaugaacggagugaugacaauacaggcgaaaccacuucagagaaggcccgccuauuucgcagaccggacccagaacgaaaaggaggacaaggcuagcggcgguggggccggagcucugaguucugccccgcaccguuugggccgcgcauccgauacgcauggccucagcccuucggccaaaaagacucccgucccauggagacugccuucuuuagcuuccgacucacaaaggcugaaaacccccaauaucuacagugaugaaguucuccgggggacaaagcucccaacuggaguggaccacauggcgagcccccugguacagaccucccgaucucgcuuuccuccauuggugacagagaccagaggucagaacacggcagucccgggcuguaggcuagugagcuaucgggggcgccaucugcaaaauagaguucucucagccaugcccgauggaacugaaaggagucgucugcgggagcgaacagcuacccuugagagacuguccaggccuagcacuacacacaccuuccgccagucugacacgccacggaaaucaaguuugacccagauggaauuugccgcacacacauggacuggccagagcauucucaccgguucccaauacgugcccaagucuuuccagagaacaacucugaccuuuaaaaggcgcuuccaggucacaucguga

SEQ ID NO: 56029 - RNA, 459 nt, Artificial Sequence
  derived and/or modified sequence opt3 from FAM150B__Homo_sapiens__NP_001002919
augagaggccccgggcacccucugcuccuuggacuguuguuagugcugggugccgcuggcagggggcggggaggcgcagagccacgcgaaccggccgacggucaggcgcuacuccgacuggucguugagcuugugcaagaacugcguaagcaucacagcgcugagcauaaaggguugcagcuccugggaagagauugcgcccugggcagggcagaagccgcuggccucgggcccuccccugagcagcggguagagaucgugccacgcgacuuaagaaugaaggauaaauuccugaagcaccuuaccggacccuuguacuuuucuccuaaauguucaaagcauuuccacaggcuguaucacaacacacgggacugcacuauuccagcauacuauaagcgcugugcccgacuacucacgagacuggcugucagucccgugugcauggaagauaaacaguga

SEQ ID NO: 56030 - RNA, 1377 nt, Artificial Sequence
  derived and/or modified sequence opt3 from FAM155A__Homo_sapiens__NP_001073865
augaccagaggcgccuggaugugcaggcaguacgacgaugggcugaagaucuggcucgcugcaccccgggagaacgaaaaaccuuucauugacagcgagcgcgcccaaaaguggcgacuuucccuggcgucuuuguuauuuuucacagugcugcuaucagaucaccucugguuuugugcugaagccaaacugacucgugcaagagacaaggagcaucagcagcagcaaaggcagcagcagcaacagcagcagcaacagcggcagcgccaacagcagcagcaacagagaaggcagcaggaaccaaguuggccggcccuucuggcuagcaugggagaguccucucccgcagcccaagcucaccgguugcucucggccucaagcaguccuacgcugccacccuccccuggugauggcgggggaggcggugggaaaggaaaucgcggcaaggacgaucgaggcaaggcgcuguuccucgggaacucugcaaaaccagucuggagauuagagaccugcuauccccagggagccagcuccggucaguguuuuacaguugaaaaugcugacgccgugugcgcaaggaacuggucacggggcgcugccgggggagauggccaggagguacguaguaagcauccuacuccacuguggaaucuuagcgacuucuacuugucuuuuuguaacuccuauacccugugggaacuauucucaggucucagcaguccgaauacacugaacugcucucuugaugugguccugaaagaagggggagagaugaccacuugucgccaaugcguggaggcguaccaggacuaugaucaccaugcccaggagaaguacgaagaguuugaauccguuuugcacaaauaucuccagagcgaggaguacucggugaagucuugucccgaagacugcaagauagucuacaaagcauggcuguguucccaauauuucgaggugacacaguuuaauugcagaaagaccaucccuugcaaacaguacuguuuagaaguacaaacgaggugcccauucauucugcccgacaacgaugagguuaucuauggcggccucucaaguuuuauuuguacugggcuuuacgaaaccuuccugacaaaugacgagccugagugcugugaugugcggcgagaagaaaagagcaacaauccauccaaaggaacugucgagaagucugguagcugccaccgcaccucauugacagugaguuccgcuaccagacuauguaacagcaggcugaaacucugcgugcugguccuuauccuguugcauacgguucucacugccucugcugcccagaauacagcaggccugucauucgggggaauaaacaccuuagaggaaaacaguacuaaugaggaguga

SEQ ID NO: 56031 - RNA, 2217 nt, Artificial Sequence
  derived and/or modified sequence opt3 from FAM160B1__Homo_sapiens__NP_001128523
auguucagcaaguuuaccuccauccugcagcacgccguggaggcucucgcacccucucuuccucugcaagaagacuucgucuaccauuggaaagccauuacacacuauuacauagagacuucagaugacaaggcgccaguuacggauaccaacaucccgagucauuuggaacagauguuagacauucuggugcaggaggaaaaugagagagagagcggcgaaacagggcccugcauggaguaucuacuccaccauaaaauccuggaaacucuuuacacccugggaaaggcugauuguccuccagguaugaaacagcaaguauugguguuuuauacaaagcuccugggcaggauucggcagccccugcucccucacaucaacguccaccgcccagugcagaaguuaauacgacugugcggggagguucuugccacccccacugagaaugaagagauccaguucuuguguauugugugcgcaaaacugaagcaagacccuuaccuagucaacuuuuuccucgaaaauaaaaugaagucccuggccucuaaaggagugccaaacguaaucucggaggauacacuuaagggccaggacucacugagcaccgauacgggucagagucgucagccggaagaguuguccggggcuacuggaauggagcaaaccgaacucgaggacgaacccccucaucagauggaucaccugucuacaucguuagacaaucuguccguuacuucacucccagaggcaaguguggucugucccaaccaggauuauaaucuugugaacagccuguugaaucuaaccagaucuccugacggcaggauugccgugaaggcuugcgaaggccugaugcuccuggucucccuuccagagcccgccgcggcaaaaugucugacacaaucaaccugcuugugugagcuccugacggaccgguuagccagccuguacaaggcucuaccgcagaguguugauccucucgacaucgaaacuguggaggccauaaacugggggcuggauucuuacucccauaaagaagacgcaagcgcuuuucccggaaagcgcgcccuuauuucguucuugucuugguuugauuauugcgaccagcugaucaaagaggcgcagaagacagccgcaguagcucucgccaaagcugugcacgaaagauucuuuauuggugucauggagccacaacugaugcagaccuccgagaugggcauccuuacuucaacagcccuguugcacaggaucgugcggcagguuaccagugaugugcuccugcaggaaauggucuucuuuauuuuaggggagcaacgcgaaccugagacgcuggcagagauaagccgacauccccuaagacacaggcucaucgaacauugugaccacauuuccgaugagaucucuauaaugacccugcggauguucgaacaucuuuugcagaagccaaaugagcacauucuguacaaccucgugcugcguaauuuagaagagagaaacuauacagaguacaagccccugugcccugaagacaaagauguaguugagaacggacuuaucgccggcgcuguggacuuggaagaggacccacucuucacugauaucagcccggaaaauacccugcccaaccaggaguggcuaucaaguuccccuccagcgacacccgaccacccuaagaaugaugguaaaacugagguccauaagauugugaacagcuuucugugccucgucccagacgaugcaaaaucuucauaucacguggaagggaccggauacgacacauaucugagagaugcccauaggcaguuccgggacuacugugcuaucugccuucgaugggaguggcccggcaguccgaaggccuuggaaaaguguaaucuggaggcagccuuuuucgaaggccacuuuuuaaaaguucucuucgaucgcauggggcgcauucuggaccaaccuuacgaugugaaccuucagguaaccagcguccuguccagguugucucucuuuccacacccccauauacacgaguaucugcuagacccuuacgugaaucuggcucccggaugccggagccucuucagcguuaucgugcgcgucgugggugaucugaugcuuaggauucagagaauccaggacuuuacuccaaaguugcuguuaguacguaaacggcuccugggccuugagccugaagggcccaugcaaacgcugccauccuggugguga

SEQ ID NO: 56032 - RNA, 2151 nt, Artificial Sequence
  derived and/or modified sequence opt3 from FAM161A__Homo_sapiens__NP_001188472
auggccaccagccacagaguggcuaagcuggucgcauccucucuccagacacccguuaacccuaucacuggcgccaggguggcgcaauacgagcgggaagacccacuuaaagcucuggccgcagccgaggcuauuuuggaagaugaggaagaggagaagguagcacagccggccggggcuucagccgacuuaaauacgaguuucagcggaguggaugaacaugcgcccauauccuaugaggacuuugucaacuucccugauauccaccauucuaaugaagaguacuuuaaaaagguggaggaacugaaagcagcccacauugagaccauggcuaagcuagaaaagauguaucaggacaaacuccaucugaaggagguucagccaguggucauccgcgaagauucgcuuucagacagcagucgauccgugucugagaaaaacagcuaccaccccguaucccugaugacaucauucagugagccugauuugggucaauccucuucccucuauguuucaagcagugaagaggaacugccaaaucuggagaaggaauacccccguaaaaacagaaugaugacuuaugccaaggagcucauuaauaacauguggaccgacuuuugcguggaggauuacaucagguguaaggacacaggcuuccacgcagcugaaaaacggcgcaagaaaagaaaggagugggucccuaccauaacugugccagaaccguuucagaugaugaucagggagcagaaaaagaaagaagagucuaugaaguccaagagcgauauugagauggugcauaaagccuuaaagaaacaggaagaggaccccgaauacaagaaaaaguuccgggcgaauccugucccagccucgguuuuucugccccuuuaucacgacuuggugaagcaaaaagaggagcgccgaagaucucugaaggaaaaauccaaggaggcacuacucgcuucacagaaaccuuucaaguuuaucgccagggaagaacagaagcgggcugcccgugaaaaacagcugcgcgauuuccuuaaguacaaaaagaaaacaaacagauuuaaggcaaggccaauuccccggaguaccuaugggagcacgacuaaugacaagcugaaagaggaggaauuguaccgaaaccuccgcacccaacugagagcccaggagcauuuacagaauagcucuccgcugccuugcaggagcgcuuguggaugccggaacccccgcuguccagaacaagcgguaaagcucaaaugcaagcacaaagugagauguccuacacccgauuucgaggaccuuccagaaagguaucagaagcaccugucagagcauaaaagucccaaguugcuaacugucugcaagccuuucgaucugcacgcauccccacaugccagcaucaaacgugagaagauacucgcugacauugaagccgaugaggaaaaucugaaagagacccgguggccguaccuuucuccccgaagaaagucaccugugaggugugcaggcguuaacccagugcccugcaacuguaauccuccaguccccacagugaguagccgcggucgggaacaggccguaagaaggucccuggaggagaaaaagauguuggaagaggaacgcaaccgaauccucaccaagcagaaacaacggaugaaggagcugcagaaauuacugacgacucgugcuaaggccuaugacucucaccagucgcuagcacagauuagcaaauccagaguuaagugccucaggaagucagagaaagaacgcaugcgggaguaccaaagagaacuggaggaaagggaggagaaacuuaagaagcgaccguugcuguuugaacgcguggcgcagaaaaaugcucggauggccgcagagaagcauuacaguaacacacucaaggcccuggggaucucugaugaguucgucagcaaaaagggacaguccggcaaagugcuugaguauuuuaauaaccaggaaaccaagucagucacugaggacaaagagagcuucaaugaagaggaaaagaucgaggaaagagagaacggcgaggaaaauuacuuuauugauacaaacucucaagacuccuauaaagagaaggacgaagcuaaugaggagagugaagaggaaaagagcguggaggaaucucacuga

SEQ ID NO: 56033 - RNA, 504 nt, Artificial Sequence
  derived and/or modified sequence opt3 from FAM163A__Homo_sapiens__NP_775780
augaccgccggcacaguggucaucacuggggguauucuggcuacgguuauacuccuuugcaucauugcagugcuguguuacugcagauugcaguauuacuguugcaagaaaagcggaaccgagguagccgacgaagaggaagagagggaacacgauuuacccacacauccucggggcccaacuuguaacgcgugcuccucucaagcucuggacgggcgcggaucacuagccccgcucaccagugagcccuguagccagccuugcggcguggcagccucccacuguacaaccugcucuccauauucgucacccuucuacauccgaacugcugauauggucccuaauggugggggaggcgagcgucugagcuuugcaccaacauauuacaaggaaggcgggcccccuagucuuaaacuggccgcuccacaguccuauccggugaccuggcccggaucugguagagaggccuucacgaacccuagggcgauuagcacugacguuuga

SEQ ID NO: 56034 - RNA, 501 nt, Artificial Sequence
  derived and/or modified sequence opt3 from FAM163B__Homo_sapiens__NP_001073984
augaccgccggcacaguggucaucacuggggguauucuggcuacgguuauacuccuuugcaucauugcagugcuguguuacugcagauugcaguauuacuguugcaagaaagacgagagcgaagaggaugaagaggaacccgacuucgccguacacucccauuuaccuccacugcacucuaacaggaaucuagugcucaccaacggaccggcgcuguaucccacagcuucaaccaguuuuagccaaaaguccccucaggcccgggcacuuugucgcucuugcucgcauugugagccacccacuuucuuucugcaggagccuccagaagaggaagaggaugucuugaauggcggggagcgagugcucuacaaaucaguuagccaggaagacguggagcugcccccuggaggcuucggugggcugcaagcccucaacccaaaucguuuaagugcuaugagagaagcauuugccaggucccggucuaucagcacagaugucuga

SEQ ID NO: 56035 - RNA, 645 nt, Artificial Sequence
  derived and/or modified sequence opt3 from FAM167A__Homo_sapiens__NP_444509
augagcgugccccagauccacgucgaggaaguuggcgccgaggaaggggcuggagcagccgcgccuccagacgaucaucugagaucccucaaggcucuuaccgagaaacugagguuggaaacacggcgcccgucuuacuuagaguggcaagcccgacuggaggaacacacuuggcccuucccucguccagcagccgagccccaggcuucacuagaagagggugagagaggcgggcaggaaccucuccugccacuuagggaggcaggacagcaucccccuagugcccggagcgcuucccaaggcgcccgcccacugucuacggguaaguuggaaggguuucagucgauugacgaggcgauagcauggcucagaaaagaacugaccgagaugaggcugcaggaucagcaacucgcccggcaguuaaugcgccugcgaggagacaucaacaaacuuaagauugagcacacaugcagauugcauaggcggaugcugaaugaugcuacuuaugaacuagaggaacgugacgagcucgccgaucuguucugugacucaccgcuugcaagcaguuuuucccugucuacccccuugaagcucaucggcgugacaaagaugaacauuaauagccgcagauucucccugugcuga

SEQ ID NO: 56036 - RNA, 735 nt, Artificial Sequence
  derived and/or modified sequence opt3 from FAM168A__Homo_sapiens__NP_001272979
augaaccccguguacagcccuguccagccaggcgccccguaugggaaucccaagaacauggcuuacaccggauauccuacagcauacccagccgcggcucccgccuauaauccuucccuguacccaacuaacucucccucauaugcaccugaguuccaauuucuccacagugccuacgcuacgcuucugaugaaacaggcauggccacagaauagcuccucuugcgguaccgaaggcacauuccauuugccgguugacacugggaccgagaacagaacauaccaggccucgucagcugccuuuagguauaccgcgggaacucccuacaaggugccuccaacacaaagcaauaccgcacccccuccauauagucccuccccgaacccuuaccagacggccauguaucccauccggucugcuuacccacagcagaauuuauaugcccaaggcgcauacuacacucagccuguauaugcugcccagccccacgugauucaucacaccacagucgugcagccaaacagcauacccuccgcgaucuacccugccccaguugcagcuccgcgcacuaaugguguggccauggggauggucgcuggaaccacaauggccaugucagcaggcacccugcuaacgacuccccaacauacagccauuggcgcucacccugugaguaugccaaccuaucgagcgcaggggacucccgcauacagcuauguaccuccacacugguga

SEQ ID NO: 56037 - RNA, 588 nt, Artificial Sequence
  derived and/or modified sequence opt3 from FAM168B__Homo_sapiens__NP_001009993
augaaccccguguacagcccuggcuccucuggggucccauaugccaaugcuaagggaaucgguuacccggcaggcuuccccaugggguaugccgcggcugccccugcauacucaccaaacauguaucccggagccaauccuaccuuucagacaggcuacacuccagguacgcccuauaaaguuaguugcagcccuaccuccggggcugugccaccguacucuucgucacccaacccuuaccaaacagcaguauauccagugagaagcgccuacccccagcagaguccuuaugcucagcaaggaacuuacuauacccagccacuguacgccgcgcccccgcacgucauucaucacacaaccgugguucagccuaauggcaugcccgcaacuguguauccagccccuauacccccacccaggggcaacggggucacaaugggaaugguggcugguaccacgauggccauguccgcaggcacucuccuuaccgcucauucuccuacaccaguagccccgcaccccguuacugugccuaccuaccgggcgccagggacacccaccuacagcuaugucccuccacagugguga

SEQ ID NO: 56038 - RNA, 579 nt, Artificial Sequence
  derived and/or modified sequence opt3 from FAM169B__Homo_sapiens__NP_872368
augaaggugcagagcuucggcgagagagucguucuguuuauccucaacgccauuauauucgggaggcuugaacggaaucuggacgaugacgauauguuuuucuugccccacuccgugaaagagcaagcuaagaucuuauggcgccgaggagcagccguagguuuuuacaccacaaaaaugaagggccgucugugcggggacggaacuggcgcguguuaucuacucccuguguucgauacggucuuuauuagaaggaaacauuggcaccggggucuggggaccgcuaugcuucgcgacuucugcgaaacauuuccagaggaugaagcccugggagugucuuguucaaugaguccggcaauguaccaggcccaucccggcaacagcgaggacguuuccagacacgcuaggacuucucagaaugaucggccucgccagccagcacccggcgacgggucgaaggagcgaaugugcggagaagaguuggaagauaccaaggacgauccugagugugguguggaggaagaggacgccggccucgcugggcaaccacccggaaaacugacaagaucaagcccuuga

SEQ ID NO: 56039 - RNA, 849 nt, Artificial Sequence
  derived and/or modified sequence opt3 from FAM170A__Homo_sapiens__NP_001157463
augaagagaaggcagaaacggaagcaccuggagaacgaagagagccaagaaaccgccgagaaaggcgggggaauccagcgcauucaucgagacucuccccagccucaguccccacucgcucaagugcaggaacguggugagacaccgcccagaucacagcacgucagucuuagcuccuacucuucguauaagacuugcguuucaagccugugugugaauaaagaggaaaggggcaugaagauauacuauaugcagguacaaaugaacaaggggguggcagucaguugggagacggaagagaccuuggaguccuuagaaaaacagccucggauggaggaagugacacugucugagguugugcgcgucggaacuccacccagcgauguguccaccagaaaucuacucucagacagugaaccuagcggcgaggagaaggaacaugaggaaaggacagagucugauucccugccagguucacccaccguagaagacacuccucgggccaaaacaccagauuggcuuguuaccauggagaacggguuccgcugcauggcguguugccgaguguuuacgacuauggaggcucugcaggaacacguccaguucggaaucagagagggcuuuagcugucauguguuccacuugaccauggcccaacucacaggcaauauggaaagugagucuacucaggacgaacaggaggaggaaaacgggaaugagaaggaagaggaggaaaaaccggaggcaaaggaagaggaaggacaacccaccgaggaggaucugggucugaggcgguccuggagccagugcccuggcuguguguuucacucgccaaaggaccguaacuga

SEQ ID NO: 56040 - RNA, 1113 nt, Artificial Sequence
  derived and/or modified sequence opt3 from FAM172A__Homo_sapiens__NP_001156889
augaagaaagacgagcccccucuggauuucccagacacccucgaaggcuuugaguacgccuucaacgaaaaggggcagcuuagacacaucaaaacaggagagccguuuguguucaauuauagggaagaucugcaucgguggaaccaaaagcgcuacgaggcuuugggugagauuauaacuaaauaugucuacgaauuacuggagaaggacugcaaucuaaagaaaguuagcauccccguggaugcaacggaauccgagccuaagucuuuuauuuucaugucagaggacgcccucaccaacccacagaaacugaugguacuuauccacggcaguggggugguccgagcgggacagugggcucguagacugauuaucaaugaagauuuggacagcggcacacagauacccuuuaucaagagggccguggcagaggguuaugggguuauugugcucaacccuaaugaaaacuacaucgaggucgaaaaaccaaagauucaugugcaauccucuucggauucaagcgacgagcccgccgagaagcgggaacgcaaagauaagguaaguaaagagacuaagaaaagaagggacuucuaugaaaaguaccggaauccucagcgcgagaaagaaaugaugcagcuguacauccgagagaacggauccccagaggaacacgcuauauauguuugggaucauuuuauugcacaggccgcugccgagaauguguucuuugucgcgcacucuuacggcggccuggcauucguggaacucaugauccaaagagaggccgacgugaagaacaaggucaccgcuguugccuuaacagacagcgugcacaauguauggcaucaggaagcagggaaaaccauuagggaguggaugcgggagaacuguugcaauuggguguccucaagugaaccgcuggauacuagcgucgagucuaugcuucccgacuguccucguguguccgcuggaacagaucgccacgaauugaccucauggaagaguuuuccaagcaucuucaaauucuuuacggaggccucugaggcgaagacuuccagccugaaacccgccguuaccagaaggucgcaucggaucaagcacgaggaacuauga

SEQ ID NO: 56041 - RNA, 702 nt, Artificial Sequence
  derived and/or modified sequence opt3 from FAM173B__Homo_sapiens__NP_954584
auggagggcgggggagguaucccccuggaaacccucaaggaggaaagccaguccagacacgugcuuccugccucuuucgaggucaacucacugcagaaaaguaauuggggcuuuuuguuaacagggcugguuggaggcacucuaguggcuguauacgcaguggccacgccauucgucaccccggcgcucaggaaggugugccugcccuuuguuccugcuacaacuaaacaaauugaaaacguggucaagaugcuucggugucgccgagguagccugguggacauaggguccggagauggccguaucguaauugccgcagccaaaaagggcuucaccgcuguuggguaugaguugaauccauggcucgugugguacucuagauauagggcauggcgggagggaguccaugguucggccaaguuuuacaucucagaccuguggaaagugacauucagccaguauaguaacguggucauuuuuggcguuccccagaugaugcugcaacucgaaaagaaauuagagcgcgaacuggaggaugacgcuagagugaucgccugcagguucccuuuuccacacuggacccccgaucauguaacuggggagggaauagacacagugugggcguacgaugcauccaccuuccggggccgcgaaaagcgaccuuguacgucuaugcacuuucagcuuccaauccaggccuga

SEQ ID NO: 56042 - RNA, 573 nt, Artificial Sequence
  derived and/or modified sequence opt3 from FAM174A__Homo_sapiens__NP_940909
augaaggccagccagugcuguugcugucugucccaccuccuugcuucugugcuguuguuacugcuacuccccgagcugucaggcccucuugcaguccuguugcaagccgcggaagcugccccagggcucggaccgcccgacccuagaccaaggacccugcccccucugccacccgguccuacaccagcacagcagccgggccgggggcucgccgaggcugcaggaccccgcggcagugaaggugggaacggaagcaauccuguugccggcuuagagacugaugaccauggcgggaaagcuggagaagguuccgugggcgggggacuggccguaucuccaaaccccggcgauaagccuaugacgcagcgagcgcuuaccguguugauggucgugucgggugcaguucugguguacuucgucgugcguacaguaagaaugaggcggcgcaauagaaaaacuaggcgguaugggguucuagacaccaacaucgagaauauggagcucacaccacuggaacaagaugacgaggaugacgauaacacccuuuuugacgccaaucacccccgccgauga

SEQ ID NO: 56043 - RNA, 1230 nt, Artificial Sequence
  derived and/or modified sequence opt3 from FAM175A__Homo_sapiens__NP_620775
auggagggcgaaagcaccuccgccgugcugucuggguucguccucggagcucuugcauuucagcaccugaacacagacucagauacugaggguuucuuguuaggcgaaguuaagggggaggccaaaaauaguaucacggacagccaaauggaugacguggaaguaguguacaccauugauauacagaaguauauccccugcuaccagcuguuuuccuucuauaacucuucgggagaggucaaugagcaggcgcuaaagaagauucucucaaacgugaaaaagaauguugugggcugguacaaguuuagaaggcauagcgaccaaaucaugacauuccgggaacgccugcuucacaaaaaccugcaggagcauuuuaguaaucaggauuuggucuuccuccugcugacuccuuccauuaucaccgaaucuuguagcacacaccgacucgagcauuccuuauauaagccacagaaaggucuguuucaccgugugccgcuuguaguugcuaacuuggggaugucagagcaacugggauacaagaccgugaguggcagcugcaugucuacuggcuucuccagagccguccagacacacucaagcaaauuuuucgaagaggacgggagucuaaaggaagugcauaagauaaaugagauguaugcaucucuccaggaagaacugaaauccaucuguaagaaaguggaggauagcgaacaggccgucgacaaacuuguuaaagaugugaacaggcugaagcgggagauugaaaaacgcagaggagcucaaauccaggcagccagggagaagaauauucagaaggacccccaagaaaacaucuuuuugugccaggcucuccggaccuucuucccuaauucggaguuucugcacucuuguguaaugucccugaaaaaccgccaugugucaaagaguagcugcaauuacaaccaccacuuagaugucguggacaaccucacgcuuaugguugagcauacugacauaccagaagccucccccgcgucuaccccucagauuaucaaacacaaggcacuggauuuggacgaucgauggcaguucaaaagaagcaggcuacuggacacacaagauaagcggucaaaggccgacacugguaguuccaaucaggauaaagcuagcaagaugucuucaccagagaccgacgaagagauugagaaaaugaagggcuuuggggaguacagucguagccccacauucuga

SEQ ID NO: 56044 - RNA, 1248 nt, Artificial Sequence
  derived and/or modified sequence opt3 from FAM175B__Homo_sapiens__NP_115558
auggccgcuagcaucuccggcuacaccuucucugcagugugcuuucacucagccaacaguaaugcggaccaugagggguuccugcucggagaagucagacaggaggaaacauuuagcauuuccgauucucaaauaucgaacacugaguuccuucagguuaucgaaauucacaaucaucagcccuguucaaagcuguuuagcuucuaugacuacgcuaguaaagugaacgaggaguccuuggauaggaucuuaaaggaccggcgcaaaaagguaauugguugguaucgauuucguagaaauacgcagcaacagaugucuuacagggaacaggugcugcacaaacagcuaacccggauccucggcgucccugaucugguguuccuucuguuuagcuucauauccacagccaacaauucaacucaugcauuggaguauguucucuuucgcccaaacagaagguacaaucaacggaucagucuggccauuccgaaccuggggaauaccagccagcaggaauauaaggugucuuccguccccaacacaucacagagcuacgcuaaggugaucaaagagcacggaaccgacuucuuugauaaggacggcguaaugaaagauauucgcgcaaucuaccaaguuuauaaugcccuccaggagaaggugcaggcugucugcgccgacguggagaaaagugaacgaguggucgaaucuugucaagcggagguuaacaaguuaagaaggcagauaacucagcggaagaaugaaaaagagcaggagcgucgccugcaacaggcagugcuuuccagacagaugccuagcgaaucguuggauccagccuucucucccaggaugccuuccucagguuucgcugccgaggggcggaguacacugggagacgcagaagcuagcgauccacccccuccauacuccgacuuucacccgaacaaccaggagucuacccuaagccauucacgaauggaacgcaguguauucaugcccagaccucaagccgugggcuccagcaauuaugcgucuacgucagccggccucaaguacccagggaguggagcagaccugcccccuccacagagggcugccggugauagcggcgaggacuccgaugacucugauuaugagaaccuuauugaccccacugaaccgucgaauagcgaguacucccacucaaaagauagucggccuauggcucaucccgacgaagauccacgcaacacccagacaucucagaucuga

SEQ ID NO: 56045 - RNA, 642 nt, Artificial Sequence
  derived and/or modified sequence opt3 from FAM177A1__Homo_sapiens__NP_001072987
auggaccaggagcccgugggcggggucgaaagaggagaggccguugcugcaagcggugccgcggcugccgcagccuucggcgaauccgcugggcaaaugucuaacgagaggggauuugaaaauguggagcugggcguaaucgguaagaaaaagaaagugccucggcgcgucauucacuucgugucaggggagaccauggaagaguacaguacagaugaagacgagguugauggacucgagaagaaagacgugcuuccaacugucgauccgacgaagcugaccuggggccccuauuugugguuuuacauguuacgagcagccacaagcacucuguccgugugcgacuuccuaggcgaaaagauagcuucuguacucgggaucucgaccccuaaauaucaguacgccauugaugaguauuaccguaugaagaaagaagaggaagaggaggaagaggaaaacagaaugucagaggaagcggagaagcaguaucagcaaaauaaacugcagacagacagcaucguucagaccgaucagccagagacugugauuaguuccucuuuugucaacgugaauuucgaaauggagggagacagcgaagugaucauggaguccaagcaaaaccccgucucaguuccuccauga

SEQ ID NO: 56046 - RNA, 477 nt, Artificial Sequence
  derived and/or modified sequence opt3 from FAM177B__Homo_sapiens__NP_997351
auggagaucgacggcuuccagcaacuggaucucgaaaagagcgugcccuccaaaaagaccacaccuaaaagaauuauacacuuugucgacggggauaucauggaggaauacucuacugaggaagaggaggaagaggaaaaggaggagcagucaacgaacaguacccuugacccaagcaaacuguccuggggaccguauuugagguucugggccggucggauugcuucuacaucguuuucaacuugcgaauuuuuaggcgggcgcuucgcaguuuucuuuggacugacccagcccaaguaccaguaugugcuaaaugaguucuaccgaauccaaaacaagaaaagcgauaauaagagugaacguagaggcuccaaagcccaggcggcugagguaccuaacgaaaagugucaucucgaggccggugugcaggaguaugggacaauucagcaagacgucaccgaagcaaucccacaguga

SEQ ID NO: 56047 - RNA, 3561 nt, Artificial Sequence
  derived and/or modified sequence opt3 from FAM178A__Homo_sapiens__NP_001129595
augaccagaaggugcaugcccgcccggccuggcuucccaagcuccccggcucccgggucuucaccuccacgcugucaucugcgacccggaaguacagcacacgccgcggcugguaagcguacugagagcccuggcgacagaaaacaguccaucauugacuuuuucaagccagccucuaaacaagauaggcacaugcucgauucgccccagaagucaaacauaaaauacgggggaagccggcuuaguaucacgggcaccgaacaguuugagcgcaagcuguccucuccuaaggaaagcaaaccaaagagagugccgcccgagaaauccccuauuaucgaagcauucaugaagggugucaaagagcaucacgaggaccaugggauucacgaaucaaggcggccaugcuugaguuuagccagcaaguaucuggcuaagggaacaaauaucuacguucccucuuccuaucaccuaccuaaagagaugaagucacucaaaaagaaacaucgcagcccagaacgaagaaagagucuguuuauacacgagaacaaugagaaaaacgauagggaccggggcaagacuaaugcagauucuaagaaacagaccacaguggccgaagcugacaucuucaacaauuccagccguucgcuuucuucccgcucaagucugagcagacaucaccccgaggaauccccguugggcgccaaguuucaacucucucuggcgagcuacuguagggagcgggaacugaaacgacuccgcaaggagcagauggagcagagaauuaacucagaaaauaguuucuccgaggcaagcucuuuaucacugaaaaguagcaucgaaaggaaguauaagccucggcaggagcaacgcaaacagaacgauauuauccccgggaagaauaaccuuuccaauguagaaaacggacacuugucuagaaaaaggucgagcuccgacucaugggagccaaccagugccgguucuaagcagaauaaauuuccugagaagcguaagcggaacagcguggauuccgaccugaaaucaacucgagaaagcaugauacccaaggcuagagagucuuuccuagagaaaaggccagauggcccccaucagaaggagaaauuuauuaagcacaucgcccucaagacaccuggggacguccugcgccuugaagacauuuccaaagagccaagugaugagaccgacggaagcucugcaggccuggcuccguccaacucagguaauagugggcaucacagcacgcggaacucggaucaaauccagguggccggaacuaaggaaaccaaaaugcagaagccccauuugccucucucccaagagaaaucugcgaucaagaaagccagcaaucugcagaagaacaagacagcaucaaguacuaccaaagaaaaggagacaaaauuaccacugcucuccagaguucccucugcuggcagcucccuugugccucugaaugccaagaacugcgcuuugccagucucaaagaaggacaaggagaggagcaguucuaaagaauguuccggccacagcaccgagucgacgaagcacaaagaacauaaggccaaaacuaauaaggcagauucaaacgugucuagugggaagauuuccggagguccccuacgcagcgaguacggcacaccgaccaaaucuccuccagccgcucuggaaguaguucccugcauaccuagccccgcggcaccauccgacaaggccccuucagagggggagaguagcggaaauucuaacgcuggcuccucagcccucaaacgaaagcugcggggugauuucgacagugaugaagagagccuuggguauaaucuggacuccgaugaagaggaagagacuuugaaaucucucgaggaaaucauggcacugaacuuuaaucagacacccgccgcuaccggcaagccaccggccuuaucgaagggacugcguagccagucauccgacuacacgggccacgugcauccugggaccuacacaaacacucuagagagacucgucaaagaaauggaggacacccaaaggcuggaugaacuucagaagcaguugcaggaggacauucgccaaggacgggguaucaaaagucccauaagaauuggcgaggaagauucuacagacgaugaggacgggcugcucgaagaacacaaggaguuccugaaaaaguucagcgugacuaucgaugcaaucccagaccaccaucccggagaagagauuuuuaauuuccuuaacuccggcaaaaucuuuaaccaguauacccuggauuugagggacucagguuucauugggcagucugcgguggaaaagcucauauuaaagagcggcaaaacagaucagaucuuucugaccacucaaggauuccugacgagugcuuaccacuauguccaguguccuguuccagugcuaaaguggcucuuucgaaugauguccguacauacagacugcauugugagcguccagauccugucuacccuuauggagaucacuauucgcaaugauaccuucucagacucccccguguggccuuggauaccgaguuugagcgacguugccgcaguguuuuucaacaugggcaucgauuuucggucgcuguucccacucgaaaaucugcagcccgacuuuaacgaggauuacuuagucucugagacacaaaccacuuccagagggaaagaaagcgaggacucaaguuauaagccuauuuucucuacacugccagaaacgaauauccuuaacgugguaaaauucuugggacucuguaccuccauucaccccgaggguuaccaggauagggaaaucaugcugcuaauacugaugcucuuuaagaugagccuggagaagcagcuuaaacaaaucccuuugguugacuuccagucacuguuaauuaaucucaugaagaacauccgugauuggaauacuaaagugccggagcugugccuuggcauuaacgaacugaguagccauccccacaauuugcucuggcugguccagcuagugccaaacuggacaucccgcgggcggcagcugagacaaugucucucucuggucaucauaagcaaacuuuuggacgagaaacacgaagaugugccuaaugccuccaaccugcagguuucaguguuacauagguaucucguacagaugaagcccucugaccugcuuaagaaaaugguccugaagaaaaaggcugagcagccagauggaauuaucgacgauagucuacaccucgaacuggagaaacaagccuacuacuugaccuauauucuguuacaucucgugggcgagguuucgugcagccacuccuuuucuucaggucagcgaaagcauuucgugcugcuuugcggggcacuggaaaagcacgucaaaugugacauccgggaggacgcucgcuuguuuuacagaacaaaggugaaagaucucguagccaggauacacggcaaguggcaggaaaucauucagaauugccggccuacucaagugagcuucuguuauaccaucuccugcauucugaacaguuuugcggaguggcauucuagcuacugucuaaaauga

SEQ ID NO: 56048 - RNA, 2040 nt, Artificial Sequence
  derived and/or modified sequence opt3 from FAM178B__Homo_sapiens__NP_001116118
auguggcccagacugccuggcgccgggcucgcuccacagcuuaggcggcaagaccagcgccugcacuucaccggacagaugagccaugguuugcagauggcaggcccgcaagagacaguguuagcccugccccuacgagaagggguccaggcggcugccacuguuccuauccuccuguacaaccuugaggauggacuguccgaccacccauuggaucagggcccccguugcccugcaagaaggccauguucucccgccucagcuccugcaccaacgaguccgaagaaacccaagauucaggccccuggugaaaccuuuccaacagacuggagcccucccccaguggaguuccucaauccccggguacugcaggcuucccgcgaagccccggcgcaaagaugggugggggucgugggaccucagggccugaggcggcucgcaggcgaguuacccgaggaacuggagcaggaacaucuugauuuggacccaaaacgcgggcuggcccuaccugagaagcucuuuuggaacacuucuggacugucgcaacaggcugccgcacccgaguucucaugggguggcagcgggaguuauuuuaauaaccuugauuaccuguugcaggaaaaacgagagcaagcucucgaacaggagagagaaaggcuguuacugcaggagugccucaaucuuaacucccuggacuuggaugaggaagagguuccacuaacccccgaacaccggaugcugguggagaaguauucugucagccuccagacaauaccuccagugcauccgggagaaaccguauuccugccccguugucacccucuuccaugcauccuggacuccucauugcucaagccccgcagucaccuggagggcuuauuucugagcucuccuccagcccaacagcuauccuuccucagaucaggucugcuuaauauuuuguaccugcauaugcccgauuguccgguuagccuccugcaguggcuuuuucagcuguugacuuggccuccagagacaagucucggggcguucggacuguuaugggaccugaucguggauggcauuuuucuacaacccgacgaagacaaacaccucuggugcccuucucugcaggaggucagggaagccuuccauucccuuggcgcacacagccccgcuuuguauccacuggggccuuuuuggcacggaggucgggugcuccccggcgaggccgggcugaacgaaaaugaggagcaggaugcuccacaggaaaucgccuuagacauaucgcugggacauaucuacaaguuccuugcauugugugcccaagcucagccgggcgcguauaccgaugagaaccucaugggucugauugaacuacugugccgaacgucucucgacguggggcugcgccuuuugccuaaagucgaucugcagcaguuacuccugcuucuguuggagaauaucagagaguggcccggcaagcuccaagaacuguguugcacucuauccuggguuucagaccaccaucacaaccugcucgcacuggugcaguucuuuccagauaugaccaguaggagccggcgccuuagaucccaguugucucugguagugauugccaggauguuaggacaacaggagaugcucccccuguggcaggagaaaacacagcuuagcucacugagucgucuacucggccugaugcggccuuccagcuugcgacaauaccuggacucugucccauuacccccuugucaggaacagcagccgaaggcuucagccgaacucgaucauaaggcaugcuaccugugccacagucuucugauguuggccggggugguugugagcugucaagacaucacuccagaucaguggggagagcuccagcugcuaugcaugcagcuggacagacacauauccacccaaauuagggagucuccccaggcuaugcaucgcacaaugcuuaaagaccucgccacccagacguauauccgguggcaagaacuguugacucacugucagccucaggcacaguacuucucgccauggaaggauauuuga

SEQ ID NO: 56049 - RNA, 5163 nt, Artificial Sequence
  derived and/or modified sequence opt3 from FAM179B__Homo_sapiens__NP_055906
auggccgcugcacccagcgcccugcuccuucugccuccauucccgguguuguccaccuacagauuacagucuaggucacggcccagugcgccugaaacagacgauagccgcgucggcgggaucaugcgaggagaaaagaacuauuacuuucguggugcugccggcgaccacggguccugcccaacuacgaccucuccccuggcaucggcccugcucaugccuucagaagcuguuagcaguuccuggucugaaagcggaggcggucuguccgggggagaugaggaagacacaagacuucugcaguugcucaggacugcacgggauccaucagaggccuuccaggcucugcaggccgcgcugccccgcagaggcggcaggcucggguuuccucggcgcaaagaggcauuauaucgagcccugggaagagugcuuguagaagguggcagugacgagaagagguugugucugcagcuacucagcgaugugcugcgggggcaaggagaagcuggccagcuugaggaggccuucucucuggcauugcucccacagcuggucguguccuuacgugaagagaauccggcucugcgcaaagacgcccuccagauucuucauauaugccugaagagaucacccggugaaguuuugaggacccuaauccaacaggggcuggagagcacagaugcgcggcuccgagccaguaccgcacugcuucugccuauuuugcucacuacagaagaccuguuacugggacuagaucucaccgaggugaucauuucucuggcucgcaaacuuggcgaccaggagacggaagaggaauccgagacugccuuuagcgcuuugcagcaaaucggcgaaagacuggggcaggauagguuccagucguacauaucucggcucccauccgcccugcgcagacacuauaacaggcgucuugagucacaauuuggaagucagguccccuacuaucuggaguuggaagcaagcgguuucccugaggacccacuccccugugccgugacccuguccaauucuaacuuaaaguuuggcaucauuccgcaggaacugcauagccggcuacucgaccaggaggauuacaagaaucgaacacaagcuguagaagaacugaaacagguucuugggaaguucaacccuucaaguacuccccacuccagcuuggugggauuuaucucucugcucuacaaucuguuagacgauucaaacuucaaagucgugcauggcacccuggaggugcuucacuugcucgucauuagacugggugaacagguucagcaauuucuagggccagugaucgcggcaaguguaaaggugcuggccgacaauaaacucgucauaaagcaggaguauaugaagauuuuccugaaacuuaugaaggaagugggcccucagcagguuuugugccuguuacucgagcaccugaaacauaagcacagcagggugcgcgaggaagucgugaacaucuguauuugcucccuucugacauaccccucugaggauuucgacuugccaaaacucucguuugaucuggcucccgcccuaguagacagcaagcggagaguuaggcaagcagcccuggaggcuuucgccgugcucgcauccucaaugggaaguggcaaaaccucuauccuguuuaaggcggucgauacgguggagcuucaggacaauggggauggagucaugaacgcugugcaggcccgcuuggcacgaaagacucugccucgguuaacagaacaggguuucguugaguaugccgugcucaugccaagcuccgcuggcgggcguucaaaucaucuggcccacggagcagacaccgacuggcuucuggcuggcaacagaacucaaagcgcccacugucauugcggugaucacguaagggacucuaugcauaucuacggguccuauaguccgacaauuuguacccgccggguccuaagcgcgggcaaaggaaagaauaaacuccccugggagaacgaacagccuggcauaaugggggagaaccagacgucuaccuccaaggauaucgaacaauuuucaacauacgacuucauuccaagugccaaacugaaguugagccagggaaugcccgugaaugaugaccugugcuuuucgagaaagaggguuucccgaaacuuauuccaaaauucucgcgauuuuaacccugacugucucccacugugcgcugcagguacuaccggcacacaccagacuaaucuuagcgggaaaugcgcccaacugggauucucacagaucuguggcaagaccgguagugugggguccgauuugcaguuucucggcacaaccucuagccaucaggagaaagucuaugcuucccugaacuucggaucaaagacucaacagacguuuggcagccagacagaaugcaccaguucuaaugggcagaaccccuccccgggagccuacauacuaccuagcuacccagugucgucaccccggacuucuccuaaacacaccaguccccugauuaucuccccuaaaaagagccaagacaauucuguaaacuucagcaauuccuggccacuuaaaucauucgagggccucaguaagcccagcccacagaaaaagcuggugucucagaaauccucagauccgacagguagaaaccacggggagaauagucaagaaaagccucccguucaguugaccccagcacuggucaggagccccuccucucgucgcggauuaaacggcacuaagccugugccacccaucccucgggguauuucgcuccugccggacaaagcggaucuuagcacagugggccauaagaaaaaggagccagacgacaucuggaaaugugaaaaggauucacugcccauugacuuguccgagcucaauuuuaaagauaaggaccuggaucaggaagagaugcacaguucucuaagaagccugaggaacuccgccgcuaagaaacgagccaaacuuucagggucuacgagcgaccucgagaguccugauuccgcaaugaaacuggacuugaccauggauagcccaucuuuaucauccagucccaacauaaauagcuauucggaaucuggagucuacucccaggagagccugacuucaagucucucuacaaccccucaaggcaagcggaucauguccgacauuuucccgacauuugggagcaaacccugcccaacucgccugucaagugcuaagaagaaaaucagccauaucgccgaacaguccccuucugcaggaagcuccucaaacccccagcagauuucuaguuucgauuuuaccacgaccaaggcccuuucggaggacagcguuguggugguaggcaaaggugucuucgggucccugucuucagcuccagcgacauguagccaauccgugauaaguucuguugagaauggagauacuuuuagcaucaagcagucaauugaaccucccuccggcaucuaugguagaagugugcagcagaacauuagcucuuacuuggacgucgagaaugaaaaagacgccaagguguccaucucaaagagcaccuauaacaaaaugaggcaaaagcggaaagaggaaaaggagcuauuccacaauaaagauugcgagaagaaggagaagaacucgugggagcgaaugagacacacaggcacugaaaagauggcaucugagagugaaaccccaacgggggcuauaucccaguacaaagagcgcaugccgagcguuacacauucaccugagaucauggaccuguccgaacucaggcccuuuucuaagccagagauugcccugaccgaagcccuucguuuacuggcugaugaggacugggagaagaagaucgagggacucaauuucauucgguguuuggcagccuuucacagcgagauccugaacacuaaacuccaugaaacaaauuucgcggugguacaggaggucaagaaccugagaaguggcguguccagggcugccguggucugccuuagcgaucuguuuaccuauuugaagaaaucuauggaccaggaacuagauacuaccguuaaggugcugcuccacaaagcaggggagucaaauacauucauacgcgaggacguagauaaggccuuacgagcuauggugaacaaugucacgcccgcaagagccgugguuagucugauuaacggaggccaacgguacuacgguaggaaaaugcuuuucuuuaugaugugucauccuaacuucgaaaagaugcuggagaaguaugugccauccaaagaccuccccuacaucaaggauagcguccgcaauuugcagcagaaagggcugggagaaauuccucucgacaccccgucugcgaagggccguagaucgcacacugguucagugggcaacacacggagcuccaguguuucuagggacgcuuuuaauagcgccgagcgcgcagugaccgaaguccgagagguaacaagaaaauccgugccacggaacucacuggagagugccgaauaucuuaagcuaaucacugggcuguugaaugcuaaggauuucagggaccgcauaaacggaaucaaacaauuacugucugauaccgagaauaaccaggaccucguugugggcaauauugucaagaucuuugaugccuucaaaagcagacugcacgacuccaacucaaaggugaaucuuguagcacuggaaacgaugcauaaaaugauuccccucuugagggaucaccugagcccuaucauaaacaugcuaauucccgcuaucguggacaauaaccuaaauucuaagaacccagggaucuacgccgcggccacaaacgucguucaggcacucucccagcauguggauaauuaucuucuguuacaaccuuuuugcaccaaggcucaguucuugaacggaaaagccaagcaggacaugacugagaaacuggcugauauugugaccgaacucuaccagcggaagccccacgcaacagagcaaaaaguccuggugguucuuuggcaucugcucggcaauaugacuaacagugguagcuugccaggggccggaggcaauauccguaccgccacagcuaagcugucgaaggcguuauuugcacagaugggccagaaccuacugaaucaggccgcuucccaaccuccgcacauuaaaaagucucucgaggaacuucuggacaugacgauauugaacgagcuguga

SEQ ID NO: 56050 - RNA, 522 nt, Artificial Sequence
  derived and/or modified sequence opt3 from FAM180A__Homo_sapiens__NP_995327
augcacuggaagaugcugcuccuucuguuguuauacuauaacgccgaggcuagcaugugccauagaugguccagggcagugcuguuccccgccgcgcaccggccuaaacgaucuucaagucuaccacucaauccgguccugcagaccagccuugaagagguugaacuguuguacgaguuucuccuggcugaacuggagaucucccccgaccuccaaauuucuauaaaggaugaggaauuagccucgcugcgcaaagcaucagacuuccguacaguguguaacaauguaaucccuaagagcauuccagauaucagaaggcuuagugccuccuugucuagccaucccggcauucugaaaaaggaggacuuugaacggacugugcuaacgcucgcuuauaccgcauaccgcacagcccugucccacgggcaucagaaggauaucugggcucagucacuugucagucuguuccaggccuugagacacgaccucaugaggagcucucaaccuggagugccacccuga

SEQ ID NO: 56051 - RNA, 2916 nt, Artificial Sequence
  derived and/or modified sequence opt3 from FAM184A__Homo_sapiens__NP_001093881
augaagcagcaagcccugaccgaguucgaggcuuacaaacacagaguggaggacaugcagcucugcgcagaagcccagcauguccagaggaucguuacaaugagccgggagguggaagagauucgccgaaaguuugaggaaaaacuucguuccuucggccaacugcagguacaguuugagaaggauaaaagauuggcguuagaagaccugcaggcugcccacaggcgggagauacaagagcuacucaagucucagcaggaucauucagcaagugugaacaaggggcaggaaaaagccgaggaacugcaccgcauggaggucgaaagccuuaauaagaugcuggaggaguugagacucgaaaggaaaaagcugaucgaggacuaugaaggaaaacugaacaaggcucaauccuucuacgagcgggaacucgauacuuuaaagcgcucucagcuguuuacggcagagucgcuucaggccucaaaagagaaggaagcugacuugcgaaaagaguuccaaggucaggaagccauucugagaaagaccaucggcaaacuaaagacagagcuccagauggugcaggaugaagcggggagccugcuugacaaaugucaaaagcugcagacugcauuggccauugcugagaauaacguucaggugcuccagaagcaacuggaugacgccaaagagggagaaauggcauuacugaguaagcauaaagaggucgaauccgagcucgcugccgcgagggagcggcuucagcagcaggccucugaucugguguugaaggcaagccacaucggcaugcuacaagcuacccagaugacacaggaaguaaccauaaaagaccuggaguccgaaaagucacguguuaaugagcgccucagucagcuggaagaggagagagccuuucuuaggagcaagacucaaucucuggaugaagaacagaaacagcaaaucuuggaacucgagaagaaagugaacgaagcuaagcggacacagcaggaguauuacgagcgagaacugaaaaauuuacagucccgccuggaggaagaggucacccaacuaaacgaagcccacucaaagacgcucgaggagcuggcauggaagcaucacauggccauugaagcugugcauagcaaugcgaucagagacaaaaagaaacuucagauggacuuggaggaacagcacaacaaggauaaacugaaucucgaggaggacaagaaccagcugcaacaggaacuugagaaucugaaggaaguguuggaggauaaacucaacacugcaaaucaggaaauuggucaucugcaggacauggucaggaagagugagcaaggguuaggaucugccgagggccugaucgcuucccuacaggauagccaggaacggcuccaaaacgagcuggaccuuaccaaagauucguugaaggaaacaaaagacgcccugcucaacguugagggcgaacuggagcaggagcgccagcagcacgaagagacuauagcagccaugaaggaagaggaaaaauuaaagguggauaagauggcucacgaccuggagauuaaauggaccgagaaucuuagacaagaaugcucuaaguugagggaggaacuccgucugcagcaugaggaggauaaaaaguccgccaugucacagcuacugcagcucaaagaccgggaaaagaacgcagcgcgagacaguuggcaaaagaaaguagaggaucugcuuaaucagaucagcuugcugaagcagaacuuagaaauucagcucucccaaucucagacaagccugcagcagcuucaagcucaguucacccaggagagacaaaggcugacgcaggaauuggaggagcucgaagaacagcaccagcaacgccauaaaucacugaaggaagcccacgugcuagcauuucagacuauggaggaagagaaagagaaggaacagcgggcccuggagaaucaccuccagcaaaagcauagugcugaacugcagucccuuaaagacgcccacagagagagcauggaaggguucaggaucgagauggagcaggaauugcagacacugcgcuuugaguuagaagaugagggaaaggcaaugcucgcuucucugcgaucagagcuuaaccaucaacacgccgcggccaucgaccugcuacggcacaaucaucaccaggaacucgcugcagccaaaauggagcuggaacguaguauugauauaagcagaaggcaguccaaggagcauaucugucgcauuaccgacuugcaagaagaacugcggcacagagagcaucacaucucugaauuagauaaagagguccagcaccuccaugaaaacauaucggcucugacuaaggagcuugaguucaaggguaaagagauucugaggauccgaagcgaguccaaucagcagauccgcuuggaagagauggaagagaaguaucucaugcgggaaucaaaacccgaggacauucaaaugaucacagagcugaaggccaugcuaaccgaaagagaucagauuaucaaaaagcugauagaggacaacaaauuuuaccagcuugaacucgugaauagggagacgaacuucaauaagguuuucaacaguucuccuaccgugggcgucauuaauccacuggcaaagcagaaaaagaaaaacgauaagagcccgacaaaccguuuuguguccguacccaauuugucagcgcuggagagcgggggaguuggcaacggucacccuaaucgcuuagacccaauccccaacucuccugugcaugauaucgaguucaauuccaguaaaccacucccccaaccugucccaccgaaggggcccaagacuuuucugagcccugcccagucugaggcuuccccaguggccucacccgacccucagcggcaggaaugguucgcaagauauuuuaccuucuga

SEQ ID NO: 56052 - RNA, 3183 nt, Artificial Sequence
  derived and/or modified sequence opt3 from FAM184B__Homo_sapiens__NP_056503
auggccagcgcucugaacuccaagaucaaucccccugggaccugccagggcucuaaagcagacggaggugccggcuggagaauggauugugacccacaaaugcacgugaagaugugcaaaaagauugcgcagcucacaaaagucauauacgcucuuaacacuaggcaggaugaggccgaagcaucaauggaggcccugcgggaagcucaucaggaggaauugcaaaaugcaguugccgagacgaaggcucgcuuacugcaggagcaggggugugccgaagaggaagcgcuacuccagcgaauccaagcacuggagagugcccuugagcugcagaagcguuugaccgaagaggcucucgccgaaagcgcauccugcagacuggagacaaaagaaagggagcugcggguggaggcugaacacgccgagcgcguacucacuuuaucuagagaaaugcuggagcuuaaggcggacuaugaaaggcgguugcagcaucugaccucgcacgaggccacaccgcagggacgccuaccccaagagucaccugaaaccaaaagcgagccaggccagggucccgaaaugcaggaggugcuccuggaaguccaacgacuuagaguggagaaccagcagcugaguaaggauuacgcaaggaaagcugaggaauugcaggccacuuaugagcgggaaaaugaggcuauucgucaagccaugcagcaguccguuucucaggcacucuggcaauggcaggagaaggaaagcgaccugcgcaagaacuuccaggugcaggaguccgccuuacaagcucaggucagaaaacuggaaggggaucucgagcauaggggacggaagaucucagaccuuaaaaaguacgcgcagaaacugaaggaacgcauucaggauuuggacgugcaacuaaaagaggcacgacaggagaauagugaacugaagggcacagccaagaaacucggcgagaagcuggcuguagccaaagauagaaugaugcuucaggaauguagggggacccaacagacggacgcaaugaagacugagcugguuagcgaaaacaaaguguugcgggaggagaaugaucucgaagccggaaaccugcacccucagcaggaccaaucuugcuuaaaggaguguccaugcaugaaggguggcaccgacaugcagacaaagaaggaggcuuccgccgaaacugaauauaugaaacagcaguacgaggaggaucugcgcaagaucaaacaccaaaccgaagaggaaaagaagcaucuaaaagaccagcucgucaagagacuggaggaucuugugaaaaagcacacaguggagauaaaaucagucaggagcaguguugaagcagagcguaagaaguugcagcgggaaguggaggcgcagcuggaagagguacgaaagaagucugagaaagaaaucaagcaacucgaggaagagaaagcugcccugaaugugaaacuucagaacucccuguuggaaguccucagacuggaggaguuuauucagcaaaauaaaaccaggcccacgggggcagaagagagcccucaggaauuaggacgccagcauuguucgauccuggagacucaggacccaugccuaaagcucgaugaaacaucuccgcggggcgaggaguaucaagacaagcuggccgcugaagaggguaccuccucagaugaagaggagagaacuaaagugcuuuugaaggaagggagugacccccagccuccacugggaagccuccugaaagagaagacauccaaaauucagagguuagaagaggauuggcagucucaaaaggccaagcugcaggcacagguuagccagaugcaacaggcucuugaacaguguaccucaaacuaccgcgaggacuugcaggcccucaaacaacugagugaucuagagcgagaaaagcugcagcgggagcuccaggaaacgacccaacagaaucacgcgaugaaagcccagcuggaggcuucccaccagcgugcacuuagaauguuggaaaaggccaggcaucaagagcugaaagcuacagaggaacgcuuaaagaaggagagcucucacucacuccagauccagcaucagacucaccggcuggaacuucaagcccuggaggaaaaagcaagacaggaguugcaggaggaaagggagcgaaugcaggcgcaacaggcccuccugcuagaaagucugcgccaggagcucagcgagcaacaggcugccugcuccggccaucagaaggaccuggaagcacuucaggcugaguugcgggcccugggcagacaacaggcaucuucgcagugccccggggacagcaaagaucacauaauugccaccgaagagaggggagguccuggccaggcuggguccccacccggagcggccggccaagguucaggggaaggcuguggauuaugggaggagaacgcacagcuccaggacgcugugcgucgccugcgggccgaagucgagcagcaccaacaggaagcccagaaacuuagagaucagaggcgauuccuggaggaaacacaacaggcucagcgggcacgcgagguggagacucuaagacaagaacauaggaaagagaugcaggccaugguagcggacuuuaguucugcucaggcccagcuccaagcacggcuggccgcuuuggaagcagagcugaaggauagcggcgaaaagccggggaaaggagccucccgaccugaggacuuacagcucaucgguagacugcagacccgccuuaaggagagggaagauauuaucaaacagcugacagaggaacgucgguuccacuacgcggcuuuucccucagccaugagccauagaaacaggucuuucuccuuuaauccacacccuggcuauuugacccccaguaugaagaaaaagaaaguugaggacgugccaagccgcgucgugucuguccccaaccucgcauccuacgccaagaauuuccugucaggggaucuaaguagccgaaucaacgcuccuccaauuacuacgucgccgucccuggaccccucuccuagcugcggaagaacauauaagccaaaucaaucaaccgaugccaaaacugcaacccggacacccgacggcgagaccgcucaggccaaggaagugcagcagaaacaagguaguccucaccaggagugguuuacuaaguacuucuccuuuuga

SEQ ID NO: 56053 - RNA, 1110 nt, Artificial Sequence
  derived and/or modified sequence opt3 from FAM187B__Homo_sapiens__NP_689694
augcccccuaugcuguggcuccuucugcacuucgccgcuccagcauugggcuuuuacuucagcaucuccugcccgucugggaagcagugucaacaggccuuacugucaggaaacgacauucuacucuauugcaauaguagcggugcgcauugguacuaucuguuuacccagggcaaaaaggggagacuuacaucccugacuaacauaucuaauauggagaucaugcccgaaggaucguugcucauuaaagauccucugccaucacagacgggccuguaccacuguuggaacaagaaugguaggcaagugguccaguaugagaucgacuuccaggauguuaccacacuccauauuacucacaaagacuuagggcagcggccccugcaaaacgaaacccuucauuugggaagcaagcagcugaucuuuacauggugggagccuuggcaggauugcaaucgcugugaagaaccaggcgagugcaagcgacuaggcuaccguuauauagaggagccccucgaagaggcuaugccuuguuggcuguaccuuggggaggugcugguauggaguuccagauugaggccagaacuccagguggaggccugccacguccaauguaccaacaauacucagcugcggguggacuacguuaucuucgauaacuuucgcuuagacgaaaagacagaguucguguggcuggauugcccgcucggaucuauguauagacccgucaauuggagggcaaacgacaccccucuuacgugggaaagccagcuguccggucaagauuuuacuaccuucuuggacccaucaacaggcgggcggcagcuacagguguuucagcccgccguauacaaauguuucguucaacaggagcugguggcucaguuuaaaccugcagccagucucgagacucuggaagcucaguggcgcgagaaugaugcccaauggcgagaagcgagaaaggcacuuaggggacgggccgacagcguccugaaaggcuugaagcucgugcuguuaguggucaccguucuggcucuacucggugcccugcuuaagugcauucacccaucucccgggcgucgcuccacacagguguugguagugaaauga

SEQ ID NO: 56054 - RNA, 1338 nt, Artificial Sequence
  derived and/or modified sequence opt3 from FAM188A__Homo_sapiens__NP_079224
augagcgagcugaccaaggaacucauggagcuuguguggggcacaaaauccucucccgggcugucagacacuaucuucugcagauggacgcagggauuugucuucagugaaagcgaggguuccgccuuggaacaauuugagggcgggccuugugcuguuauugcaccagugcaggccuucuuacugaagaaacuacucuuuucuucggagaagucaagcuggagggauugcagugaagaggaacagaaagagcugcuuugucacacccugugcgacauauuggaguccgcguguugcgaucauucuggaagcuacugucucguauccuggcugcggggcaagacaacugaagagaccgcuucaaucagugguagcccggccgaaucuuccugccagguggagcacucaagcgcacuggccgucgaggaacucggguucgagcgcuuucaugcuuuaauucaaaagcgaaguuuccguucucugcccgaacuuaaagacgcaguguuggaucaguauuccauguggggaaacaaguuuggcguucugcuauuccucuacagcgugcugcuuacaaaaggcaucgagaauauuaagaacgaaaucgaggacgccucggaaccucugauagauccagucuaugggcacggaucucaguccuugaucaaucuccuguuaaccggucaugcugugucaaacguaugggacggcgauagagaguguagugggaugaaacugcucggcauucacgagcaggccgcgguuggauuucuuacucugauggaagcauugagguacugcaagguggguagcuaucuaaagucccccaaauucccuaucuggauugucgggucugagacacaccugaccguguuuuucgccaaggacauggcucucguggccccagaagcacccagcgagcaagcucggcgcgucuuccagacguacgauccugaagacaauggauuuaucccagauucacugcuugaggacguuaugaaagcccuggacuuggugagugauccggaguauauaaaccucaugaagaauaaacuggaccccgaaggcuuaggcauuauccugcuagggccuuuccuccaggaguuuuucccagaucagggauccagcggucccgaaucuuuuacuguauaccauuacaacggccugaagcaaucaaauuauaacgagaaagugauguacgucgaggggaccgcggugguuaugggauucgaagacccuaugcuucagacagaugacacuccaauuaagagauguuugcagaccaaguggcccuauaucgagcugcucuggacaaccgauaggaguccgagccugaauuga

SEQ ID NO: 56055 - RNA, 2274 nt, Artificial Sequence
  derived and/or modified sequence opt3 from FAM188B__Homo_sapiens__NP_115598
auggacagccuguucguggaggaagucgccgcuucccucguuagagaguuucuuucuaggaagggccugaaaaagaccugcgugacaauggaucaggaacggccccgcucagacuugaguaucaacaaucgaaacgauuuacguaaaguacugcaccuagaguuccucuacaaggaaaauaaagcaaaggagaacccucugaagacuagccuugagcugauuacgagauauuuucuugaccauuucgggaauaccgccaacaauuuuacacaagauacuccaauaccggcgcucuccgugcccaaaaagaacaauaaagucccuucuagguguucggaaaccacacuggugaacaucuacgaccugucagaugaggacgcuggauggcggaccagccucagugaaacuuccaaggcccgccacgauaauuuagacggugauguucugggcaacuucgugucuagcaaaagaccaccccauaaguccaagccuaugcagacagucccaggggagacccccgugcuuacgucagcaugggagaaaauugacaaguugcacagugaaccuagccuggauguaaaaaggaugggagaaaauucucggccaaaguccggccuaaucguucgcgguaugaugucagggccgauugccagcaguccccaggacucuuuucaucgacacuaucucagaagguccagcccuucgucuuccucaacucagccacaagaggagagucggaaagugcccgaacuguucgucugcacccagcaggacauccuugcuagcuccaacucuagcccuucacguacaagucugggacaguuguccgagcucacuguggagcgccaaaagaccacagcaagcucuccaccccaucugccgucaaaaagauuaccucccugggauagggcccggccacgagacccuagugaagauacccccgcuguggacggcagcacggauacugaccgcaugccacugaagcucuaccuucccggcggaaauuccagaaugacacaggagaggcuggaacgggccuuuaagcgccaggggucucagccugcgccagucaggaaaaaccaauugcuaccgucggauaagguugacggugagcugggcgcacucaggcuggaagauguggaggacgagcuuauacgugaagagguaauccugagccccgugccuuccgucuugaaacuccagaccgccucaaagccaauugaucugaguguggcuaaagaaaucaagacuuuacuguucgggucuagcuuuuguugcuucaacgaggaauggaagcuacaguccuuuucauucagcaauacagccucucucaaauauggaauuguucaaaacaagggcggucccuguggggugcuggcagcuguccagggaugcgugcuucagaaauugcuguucgagggcgacuccaaggccgacugugcgcagggccuccaaccuagugaugcccaccggacccgaugccugguacuugcacuggcugacaucguuuggagagccgggggaagggagcgcgcuguggucgccuuggcaagccggacgcagcaguuuucuccaaccgguaaauacaaggccgauggcgugcucgaaacacugacuuuacacucccugaccuguuaugaggaccuagucacauuccuccagcaaucaauacaucaguuugaaguggggcccuacggaugcauucugcuuacuuugagugcuauccugagcagaucgaccgagcucauuaggcaggauuucgacguuccgacaucccaccugaucggcgcgcacgguuacuguacccaggaguuagugaaucugcuuuugacugggaaggcaguaucuaacgucuuuaaugaugugguugaacucgacagcggcgauggaaacaucacgcugcuacgcggcauugccgcucgaucagacauaggguuccugagucucuuugagcauuauaauaugugccaagugggaugcuuccugaaaacaccucgguuuccaaucugggucguguguuccgaaucucacuucagcauuuuguuuuccuugcagcccggucuguuacgugauuggagaaccgagagacucuucgaccuguacuauuacgauggccuugccaaccagcaggaacaaauccgccugacuauagacaccacacagaccauuucagaggacacugauaaugacuugguaccuccccucgagcugugcauccggacaaaguggaaaggggcaagcgugaacuggaauggaagugauccaauccuauga

SEQ ID NO: 56056 - RNA, 1953 nt, Artificial Sequence
  derived and/or modified sequence opt3 from FAM189B__Homo_sapiens__NP_001254537
augaugcccagcccuuccgacucuucaagaagucugaccagcaggccauccacacggggccucacucaccuucgccugcaucgaccgugguugcaggccuuacugacgcuagggcucgugcaaguccugcuuggaauccugguugugaccuucucuaugguagcuucgucagugacaacuaccgagagcauuaagcguaguugccccuccugggcagguuuuucuaucagcuucuuuuccuugcucucaguccugugugugaugcugaguauggccggcagcguucucucuugcaagaacgcgcaguuagcuagagauuuccagcaguguucccuggaagggaaggugugcgucuguugcccuucagugccacuuuugaggcccuguccugagagcggacaagaacugaaaguagccccaaauaguacaugcgacgaggcacggggcgcccuaaagaaccuccuguuuucuguuuguggucuuaccauaugcgcugcaauuaucuguacucuguccgccauugugugcugcauccagauauucagcuuggaucucguccacacacagcuggcucccgaacgcucggugucugggccuuuaggaccacugggcuguaccuccccgcccccugccccacuccuucauacgaugcuggacuuggaggaguuugugcccccugucccacccccgccuuacuaucccccagaauacacuugcucaagugagaccgaugcgcagagcaucacauauaauggcuccauggacucuccuguuccccuauacccaacugauugucccccuagcuaugaagcagugauggggcugagaggagacucacaagccacccucuucgauccacagcugcacgacgguaguugcauuugugagaggguagcuuccaucguggaugucagcauggacucuggcucacuugugcugagugccauuggggauuugccgggaggcagcucccccucugaggacucgugccuccuggaauuacaggguagcguucgguccguggacuacguccuguuucgcucaauccagcgaaguagagcaggguauugucuaucucucgauugcggacugaggggcccuuucgaggaaagcccacuuccccggcguccuccacgcgcugccagauccuacucauguagcgcgcccgaggccccgccuccauugggcgcacccacagcugccaggucuugccaucggcuggaaggguggccucccugggugggaccauguuuuccugagcuccgacgcagaguacccagggguggcgggcggccagcugccgcaccgccuacccgcgcccccacgagaagguucuccgacaguagcggaucucugacuccacccggccaccguccuccacaccccgcuuccccuccgccacuucuguugccccggucacauagugauccugguauaacaaccagcucggacacugcggauuuucgagaccucuacacaaaaguucuggaggaagaggcagccuccgugucuagcgcugauaccggguuaugcucagaagccugccuguucagacuagcaagguguccaagucccaagcuccugcgcgcccgguccgcugagaagagaaggccugucccgacguuccaaaaagugccccuuccaucuggcccugcccccgcacacagcuugggagaccugaagggcuccuggccagggcgcggacucgucacccgauuucugcagauuucacggaaagcgccugaucccagcgguacaggcgcucaugggcacaaacaggugccacguaguuuauggggaagaccgggcagggaaucucugcaccuucgcuccugcggugacuugagcucgucaucuagucuccggagacugcuauccgggaggcgacuggagcgcggcacucggccucauagccucucucugaacggaggcagcagagagaccgggcuuuga

SEQ ID NO: 56057 - RNA, 2469 nt, Artificial Sequence
  derived and/or modified sequence opt3 from FAM193B__Homo_sapiens__NP_001177875
augaccagaaggcggagccgccccuccggcggggccggacgacgugagagagcuagggcagccgguccucagaagccacaagcgccggaacccccuccacccccuucucuggaggcuggcgccggggcaggaccacccgaagccccugcugagccagaccacgauggcccgcgggaagacgaugagcccaaccucgugccugguccacagguucccccugcaucaagucagccaguccagacaugcugucuucugugccaccgcgagagaaaagggugggaagagggacccagccaaaauggcuugguguuacagggcgaaaagcugccgccugacuucaugcccaaacugguaaagaaccuccugggggagaugccacuuugggugugucaguccugcaggaaaucuauggaggaagaugagcggcagacuggacgcgaacacgccgucgcuaucucgcugucacauacgagcuguaagagucaauccugcggugacgauucucacagcuccucaaguucuagcuccucaagcaguucuuccagcucgucuuccuguccuggcaauucaggggacugggaucccaguagcuuuuuguccgcccauaagcucucuggacuguggaacagcccacacucaaguggcgcgaugcccgguuccagccuggggucuccuccaaccauuccgggagaggcauuccccgugucagaacaccaucagcacagugaccucacagccccuccaaauagccccacuggccaucacccucagccagcuuccuuaauacccucucacccgucgagcuuuggcuccccuccacauccccaccuacuuccuaccacacccgccgcaccauucccugcucaggccucagagugccccguugcggccgcaaccgcuccacauacuccggggccuugucaaaguucucacuugcccagcacauccaugccacugcuaaaaaugcccccuccauuuucaggaugcagccaucccuguucuggucacugcggcgggcacugcuccggaccucuccugccgccacccaguagccagccucuuccaucuacccaucgagaucccggcuguaagggucacaaauucgcccauuccgggcuggcuugccaguugccucaaccgugugaggccgacgaaggccucggagaggaagaggauucaaguagcgaaagaucguccugcacgucuagcucaacucaccagagggacggcaaguuuugugacugcuguuacugcgaguucuuugggcacaacgcagagaaagaaaaggcccagcuggcugcggaggcauuaaagcaggccaaucgggugaguggaucccgugaaccccgcccagcuagagagaggcugcucgaauggccugaucgggagcuugaccgagucaacucuuuccugagcucccgcuugcaagagaucaaaaauaccgugaaggauucaauuagagccagcuuuaguguaugugaacuaucuauggacuccaacgguuucagcaaagagggcgcagccgaacccgagccacagucgcugccucccucaaaucucucugggaguuccgagcagcagccagauaucaaccuggaccuuagcccgcugacauugggaucuccucaaaaucauacucuccaggcucccggcgaaccagccccaccuugggcagagaugagggguccacaucccccuuggaccgaaguucgggggccgccacccggcauugugccugagaacggacugguccgcagauuaaauacagugcccaaccugagcagggugaucugggucaagaccccaaaaccuggcuaucccuccucagaggaaccaaguagcaaggagguuccuucuugcaaacaggaacuaccggagcccguguccucagggggaaagccacagaaggguaaacgucaaggcagucaggcgaagaaaagcgaagccuccccugcuccccggcccccugcaucucucgagguacccucggccaagggacagguggcugggccgaaacagccaggccgaguccuggaacuuccuaagguggguagcugugccgaggcaggggagggcucaagaggauccaggcccggcccagggugggcuggaagucccaagacggaaaaagagaagggcucuagcuggcgcaacuggccuggugaagccaaagcgcggccgcaagagcaggaauccguucagcccucagggccagccagaccucaaucuuugccccagggaaagggcaggagccgccgaagucggaauaaacaggagaagccugcuuccagccuggaugacguguuucucccaaaggauauggacggugucgagauggaugaaacugaccgugagguggaauacuucaaaagauucugccuggacucugcaaagcagacaaggcaaaaaguagccguuaacuggaccaauuuuucacuuaagaaaacuacacccuccaccgcucaguga

SEQ ID NO: 56058 - RNA, 1440 nt, Artificial Sequence
  derived and/or modified sequence opt3 from FAM196A__Homo_sapiens__NP_001034851
auggugagcaaggacaccggcaaaugcauccugacaacuuccgagucugaagucgagcccgccgcuugucucgcacuugaaaugaaguacgcccuggauccuaacagacagauuaaaaagaggaauaaagcguugcaaguucgguucaaggacauaugcgaggcucagaacgaacagcgcgauacgcaguuaucaagugggcaacugggagagaagcgagaggccaaaccagugagcugucgugcagccuauagaaaguacaugaccguaccggcuaggcgguccauccccaaugugacaaaaucuacugguguccagaccucgccugaccuaaagaaaugcuaucagacauuuccacucgaucgcaagaagggcaaccugaaaucacuucccgcagccgacccuuucaagagccagaauaacggguuucugaccgaugcuaaagaaaagaaugaggccggaccaauggaagaggcgagacccuguggcgcagguagggugcacaaaacuacagccuugguuuuccauaguaaccaacacaugaauaccguggaccagccucucggggucaacugcacggagccauguaaguccccggaaccccugucuuacggagaggcugcccugcagaauagcacucggccuccauccgaagaacccgauuaucagcucuuaggccgcgcaaaacaagaccgaggcagaccuaacucagaggagccagcucccccggcccugaggcggguguuuaagaccgagguagcgacaguuuacgccccugcacuuagugcucgugcccccgaaccaggguugagcgauucugcugccgcaucccaguggucacugugcccugccgacgaugagcgcagaagggcuacucaucuaaauggacuccaggcgcccagcgaaaccgcacuggccuguaguccacccaugcaaugccuuucuccugaguguuccgaacagccaagccagacacacaccccgcccggucugggcaaccagccuucgccaacggcuguggccgcaggggaggagugccaacggauugucccccauacugaagugguggacuugaaggcccagcuccagaugauggagaaucugaucucuuccucacaggaaacaauuaaagucuuacugggaguuauccaagagcucgaaaagggcgaggcucaccgagagggucuuaguuaucgcaccgggcaggacacugccaacugcgauacauguagaaacagcgcaugcauaaucuacuccguggaacuggacuucaaacagcaggaggauaaguugcaaccuguacuaaggaaacugcacccaauugaagagacccaggugauccccucuccguacagccaggagacguauucaaguaccccuaagcagaaguccaaaacagaaagcaagaaacauggacgguggaagcucugguuucuguga

SEQ ID NO: 56059 - RNA, 1608 nt, Artificial Sequence
  derived and/or modified sequence opt3 from FAM196B__Homo_sapiens__NP_001123363
auggcccagcaaaacaugaagguaagacccguccugcucaaaaggaauagccuugaguccguugaguucgugaagcagccucaccaucggcgcucuaaaucacagcagguacgauuuaaggaagacggcaccacuaaaaacccaacagggcuggcugaaguggauguccaaacgccggaggaccccgcagugaugggaaagacccaggccacacgucaccauuugccuccaacuuacaguuuauccuuccccagaucccagaaggcggguggcuuuaggaauaucgcuauucagaccucuccuucgcugcggaaacacuucccaguuuuuaagcgcaaaagacuaacagccucaaagagccucguggaaaugcccaccgcaagucaauccgccauacaggucaacgggaaucugucugagcaggauaucgugagcuccgaccuugcuuaucugagguuggcacagcaucucgaggauggaccucggcgcguaaaaguuucacacgccuuccugccacgagugccgaagguccaaaguaacggccccgugagcauuugccuggaagcugguacuuggagaucucucgagaaggccacagcggcaauccaggugccugacgauauuuaccacuccccaucaugggaagccagggagagcgcuuuaagucccgaccggucugccgaggucuccaauagcauccauccucuggaugacacccguccaggggauggacgcagaguuacgccccuugacucggaaaaaucuacuuccuguuugaacgcaaccucaguggcuagucacacaccgggcacugaggaacugaagccugagcuacuccugcccaaagauaauagcgacgacaaggaucuuggcucccugucuagccagucaaaagaaaccugcguaccaaguuccccuaggacacauagcucucccucacaagggagucacagccagccagcccaccccggacgggcguccgacuguccuucuucgagcaacaaucaucagaacuuggugucccucaagaccaauucagccaguaaaucugcaccagguugccaggagcaaacggcuaacaauccgacugagagcgauacacuggaauuucccaacuguccuggcuccaaccacuuaccaucaagccugucucgauccgagaccaagcuccagaguaaucgcgaaauaagcgacaucaaccagauucaucuugccagaggggagcugugcgauuugcagggaaggcuacaaucugucgaagagucccugcacucaaaucaggagaagaucaaagugcuccugaacguuauucaggaccuugaaaaggcucgggcccugacugagggccgcaauuucuauagaacaggucaggauuugaacaauuguaguaccugccaaaacacggcauguaucauauacagcguggaauaugacuuuaggcagcaggaggggcguuuccaugaaguccuccagucgcuggaggaggccgaacccguggaggaagcuagcccuccacccaaaucuccggcggagccuccagcacccgagaagcaagauuuacggcgaaaaaccaagaaggugaaaaagaaaugcuuuugguggauuuga

SEQ ID NO: 56060 - RNA, 1584 nt, Artificial Sequence
  derived and/or modified sequence opt3 from FAM198B__Homo_sapiens__NP_001026870
augaccugccccgacaagccuggccagcugaucaacugguucauuuguagccucugcgugccaagagucaggaaacuuugguccucucggcgcccgcgaacacguagaaaucuguuguuagggacugccugugcuauauaccugggauuucuaguuucacaaguggguagggcaagucuccagcacggccaggccgcggagaaggggccccaucggagccgcgauacggcugaaccuuccuucccagagaucccccuggacggaacccuugccccuccagaaucucagggcaacgguucgacacugcaacccaauguaguguauauuacuuugagaucaaaaaggagcaagccugcaaacauccgggggaccgucaaaccaaagcgccgaaagaaacacgccguggcuagugcagccccgggacaggaggcucucguuggccccucccugcagccucaggaagccgcgagagaggcagaugccguggcuccaggcuacgcccaaggggcaaaucuggucaagauuggagagaggcccuggcggcucgugcgugguccuggcguacgcgcugggggaccagacuuuuuacagcccucuagcagagaauccaacaucaggauauauucagagagugccccgagcuggcugucuaaagaugacauccggcgaaugcgccuuuuggcggauuccgccguugcaggccugagaccugugucaagcaggaguggugcucggcuacucguccuggaagggggagcccccggcgcugugcuucgcugcggcccaucuccuugugggcuguugaagcagccccucgacauguccgagguguucgccuuucaucuggauagaauuuuaggacugaauaggacacucccaagcgucucgcguaaagcagaguucauccaggccgcugcggcagccugccuuucuaugcggcuggcuuucuucauuuuucccgccugggaagacaugcgaguuccugguaaguguugcaucggccacgcaagauugaccugggggacuuaccaacagcuacugaagcagaaauguuggcaaaacggaagggugccaaagccggaguccggcugcacagaaauacaucaccacgaguggucaaaaauggcccucuucgauuuucugcuucagauuuauaaucgccuggacaccaacuguugcgguuuccggcccagaaaggaagaugcuugcguacagaauggguugaggccuaaaugugacgaccagggcagugccgcacucgcgcauaucauucaacgcaagcacgauccacgacaucugguguuuaucgacaacaaaggauucuucgaucggagcgaggacaauuuaaacuuuaagcugcuagagggcaucaaggaauuucccgcuuccgccgucucugugcucaaaagccagcaccuucgucagaagcuguugcagucacuguuucucgauaaaguuuacugggagagucaagggggaagacaggguauugaaaagcugauagacgugaucgagcacagggcaaaaauucuuaucacguauauaaaugcccauggcgucaaggugcugccuaugaacgaauga

SEQ ID NO: 56061 - RNA, 402 nt, Artificial Sequence
  derived and/or modified sequence opt3 from FAM19A1__Homo_sapiens__NP_998774
auggccauggugagcgcuauguccuggguccuguaccucuggaucucugcaugcgccaugcuucugugucacggcucauugcagcauaccuuccaacagcaccauuuacacagacccgaagggggaacaugcgagguuauugcggcucauagguguugcaacaagaaucggauagaggaacgcagucagacugugaaauguagcugccugccugguaagguagccggcacgacccgaaaccguccauccuguguggacgcaucuaucgucauugggaaaugguggugcgagauggaaccgugucuagagggagaggaaugcaagacacuccccgauaauucgggcuggaugugugccacugguaacaaaaucaagaccacaaggauucacccuagaaccuga

SEQ ID NO: 56062 - RNA, 396 nt, Artificial Sequence
  derived and/or modified sequence opt3 from FAM19A2__Homo_sapiens__NP_848634
augagcaagagauaccugcagaaagccaccaagggcaaacuccuuaucauuauauucaucgugacacugugggggaaggucguuuccucugcuaaccaccauaaagcacaccaugugaagacuggaacgugcgagguaguggccuugcacagguguugcaauaagaacaaaauugaggaacggucacaaaccgucaaguguaguugcuuucccggucagguggcgggcacaacucgcgcugccccuagcuguguugacgcauccaucguggaacagaaaugguggugccauaugcagccauguuuagagggggaagagugcaagguccugccggaucgaaaaggauggucuuguucgucaggcaauaaggugaagaccacacguguaacccacuga

SEQ ID NO: 56063 - RNA, 423 nt, Artificial Sequence
  derived and/or modified sequence opt3 from FAM19A4__Homo_sapiens__NP_001005527
augagaagccccaggaugcgggugugcgccaaguccguccugcucucucacuggcuuuuccuggcuuacguuuugaugguguguugcaaauuaaugucagcaaguagccagcaucugcgcggccacgccgggcaucaccaaaucaagcagggaaccugugagguaguggcgguccaucgaugcuguaacaaaaaucguauugaagagagaucccagacagugaagugcucuuguuuuccuggucagguugcuggcacuacgagggcccaaccaucgugcguggaagcaucaauagucauccagaaaugguggugucacaugaacccgugccuagagggggaagacuguaaggugcuccccgauuauagcggauggaguugcuccucuggcaauaagguaaaaaccacaaagguuacucgguga

SEQ ID NO: 56064 - RNA, 399 nt, Artificial Sequence
  derived and/or modified sequence opt3 from FAM19A5__Homo_sapiens__NP_001076436
auggcccccagcccuagaaccggcuccaggcaggacgcuacagcacugccaucuaugucaaguacuuucugggccuuuaugauccucgcgagccuucugauugcuuacugcucccaauuggccgcagggacgugugagauagugaccuuagaucgggacucuucgcagccgcgccgaacaaucgcccgucagacugcuagaugcgcauguaggaagggacagauugccgguaccacacgggcucgccccgccugcgucgaugcgagaaucauuaaaaccaagcaauggugugacaugcugccuugccuagaaggcgaggggugugaucuccugaucaacaggucaggauggacuugcacacagccaggcggucggauaaaaaccacgacuguuagcuga

SEQ ID NO: 56065 - RNA, 702 nt, Artificial Sequence
  derived and/or modified sequence opt3 from FAM204A__Homo_sapiens__NP_071346
auguggagcggccugcuucccccugggcucaacgaguccgacgccgaaucuaauucagaggaugaagcuacccuggagaacaguggauugaauuuacaggaagacaaggaggaugagagcaucagaaaaacagaaauuauagacuucuccacugaugagccaaagacggaaaccgagucuaacgugaaugcauacgaggaaugcccgucggguauccccauugacauguggaacaaauuucaagagcugcacaagaaacauucagaacagaagaguacaacuagcagguuccggggcaagcgccgaaaacguuccagaaaggauaaacuaaagaaugagaaagaacuccacucugagccuagcuccaacgagacccaguggaaggaacugacacaguauuuuggggucaaugacagguucgauccacccguuaagcggaaaaagguggagaaaucaggacuugaaaagcgcaucgaccaagccguagaggaauggaacauugagaaagcggaggaacugaguaaucaguuggcuaccagagagcucggcgugaagaucgccaaagcagucgccugucauaacuuugugaaggcuaagaaagaaguugagaauagccaggcagccaggaagaaaaagaaacuggcuugggguuucgaagccaagaagcggugggagacuaaaucuaacaugggguacauguga

SEQ ID NO: 56066 - RNA, 4008 nt, Artificial Sequence
  derived and/or modified sequence opt3 from FAM205A__Homo_sapiens__NP_001135389
augcugagccccaccuucgugcucugggaggucggcuacccucuuuauaucuacggguccauuuuuauaguuaucgugauuaucuggcagguaaagagaucucaccaugaacugucaagugagccaaaaaggagcugcugucggugccaccaaaaggugcgccagcgagcccgugacgcugcauccacagccagaaggcggucucgcgaagaggcggaaaaaccgcagaaguuguuaucgauuaucaaaucacagggauggcugccccuagagagaagcgucaggcggauacucugugcugauccuugcugucaaaucugcaacaguguggcccuggagauucagcagcuucugguuggugaaaauaaccagaucuccuugacucucucuggcccacugcaagggagcuccugucuggagaugcucucaacgaguagcaugucuuuagaccagucccuggaguuccauucauggcacacccgcgaacuuagcuugaguucugugacacccacucugucccagcuaaccgaucaaaagagccucacacaaucggcagcccagucuaccuaugcugacgggauucaggauuacugggcagaccaucugcaacuuggccaggaguuucaggucccugaugugcugcgagguccaaauacuaucgccuccucaagaauagaaaagcccagggcuccuuugaaccaggaggaaaugacacaaaguaauccaagccucguacaggggaaccagggacagcaccacuuaaauucccaaguuucuuuacugagccucaacccggagacccuuaaucggaugcaucccauggcccugcacaugguguugccugcgcaucuaccauuccugucacccgaaguccuccgucugcuugaggugcacgugaaaaaguggaugcacuuucagcgcuggggccugccuagaagggucgaggaaaguuugcggcagcucaugccaaaucccccgcuguauuaccagccuggcaacgaccaacccguuuccuucaaccugaaaaauacgccacaggugagccugcaucgauuugagacuauuucucuacagaccuggugcucauguguagcagggcagccuauccaaacauucugggugagugaauggagcacuaugaaccccgagcagcgccaccauugccagcaaaccccaaaucccauggcccucgcucugccuuccccagcccuuaaggcauugucuggaccgcacccccagucggguggccaggauaacgacagcggguccgaucugcagcaaaaauauucacagcucuuuuguggacugccuagucuucauucugaaagccuggucgcuacauucaugggcucccaggguuugccaaagauugagaacgugcccaagccuccacucaaagaccccuuucuguucaaugaguuaucauuuccgcagcugcuaccuaagaccagcccacaaucugcgcccccuuccaguccccucagcccaaacuggaugucuccuuccgaucaccagagagcccagaucaauguucccuuccugacgcuugccgaauacgaggcauuggaauggcaucugcuccagaggcaacugcaguuacaguggggguggccagcugcccugcaacggucacagcacacucagugccuuaugcagcacgagccgugcggaaaagcucaaaguccugaaacaaccacugccagccagacaggcaagucgaucuccguguugacccgcgagcuccuguucuuucccgagcaugcaagaaaacuacuggaguuccacauucagaagcagcucauaaggcaccguuggggccugccacagaaaauccagcagucuauucagcuuuugcugacgagcaccgaccaacagacagucucaaguuccucuacugccuuagcuaacgugagcaucccccagccuguagcgcucgaagcaaauggggccugugacguucuguccccaauagcugcccccgugucaauuccucggccgcaucuucugacccaggucaaggcaaucuugcaaagccacaucgauaguaagugcggacagauucaucaggguaaaaucccagccugugugcaccgaucuugggacugcagaauuuccggcguccucgcuguggcccccuuuccuuguauaccagaaagccaauuccuggagcuacagacagcaucggaucccgaccugcaucacaagguuaugccuuggaugccgacugcgcucgaucagcagcaacaggcucugcccgggaccgugacagagcacccaaaacuuuugaggguacugucagucgaagccaucgagaaguuagaaaccacucuccgccauaaacaccuggcauuucuuucuggacugccugcccuauacuauguggcucucccccgggcccuggcaccagcuguuacgagucaguccgugauuacagagauggaaccuagccccgucgagaucccagccgagccguugauccagauggugucuuucgaggaacaaugcauuagccugggcccuuguccccaggguaacaaugaauccugcaccgacguagcgaaggaguuucagccagccgugcccguuaaggggacuauggaaaccuuaccucucgagucacagacacauccaaccaguccccacagccugcaaacucauauacuuacaaaacugaacuuccacuugagaaagaaaguccucgagauccaguggggcauuccuaucagggcucgcaagucucgagaacagacgguggcagccccggagaauauuuccacccaaaaaucacuggaaagucuaaaccaccagggagagacucugcuucaggaacucccaauacccccugauacacugcccgcuccaaauccugagggcgugcauuugaaggagcagcuggccaacgacuuaaaggcaguccaacagaaucagaaacagagcaacuccaaggcgguuccccaagggucugcccacucggugagcaaaaucucacagccauccggagauaugaccgaagcucauaugccuugugugcagguagaggccaaugucaacaagccgagucucgaggaacccugcgguccagagccucagucucccagcaaauccaaggacccagcacacgugccuaugcuggcuggcaaccgggaagaucccgaggaaacaaaggccgcacgugaccacagagagggggacgccggauuuggcaggucaucuacucgcgaggaacggagaccggcugaggaucaaaggccagcggguaugcuuccuaauaaaacgccccgagggagcuggcgcuggagucgguccuuccaucuggccgacccaugucagcacagcccccagcaucacccucaguugaagcucccgcaacugcccccaagaguuccuggcgaaaaagagucugaaaaggaucuacaggacucacagaccaaacugaccgugauccuugagcccgcaacaauuccugaaaacgcucaaacuguccucccacaggccucccagggacagcccuuucugagucaaccuacccaggccaagccauugcagggccagacauuacaaggacaggugcugcauggacucguuaugcccgugcacgcucagaaaaagccgagccugacugagucgucuuucaggaauaagaucaaaugcuuucuucagcacauuaacccuaagaccaaagguaagggccaugaggauuccauguucagcgcagccgcgaaaguagcuaagacgcguaaggaaaaugucgccaaaucacuggcaccagccaagagucccguggggcgcucuaaaacagagaagccuaccggaugcuccaaagcucaaagccggccagcacagaaguuggugggccccgccuuccuagacgguccgcagucacuggaugacaagcucagacugcacaguaggcaaccugggagcgcguccgcucuuggcuacccccgacauuguccacggcacugcccucgcgaagccugugcaaacaaacccggacacccaacuuga

SEQ ID NO: 56067 - RNA, 1212 nt, Artificial Sequence
  derived and/or modified sequence opt3 from FAM20A__Homo_sapiens__NP_001230675
auguacagagagcagaugaaccugaccagccucgaucccccucuucaacugagguuggaagccuccugggugcaguuccacuuaggcaucaaucggcaugggcuguauucucgcucaaguccagucguuagcaagcuacuccaggauaugcgacacuuuccgacaauuuccgcugacuacucucaggaugagaaagcacugcuuggagccugcgacuguacucaaauagugaagcccucggguguacaucugaaauuggugcuccguuucucagauuuuggcaaggcgauguucaaaccuaugagacagcagagggacgaagagacgccagucgacuuuuucuauuuuaucgacuuccagcggcacaacgcugaaauugccgcauuucaucuggaucgcauccuggacuucagaagggugcccccuaccguugggcggauugugaaugucacaaaggagauccucgaggugacuaagaacgaaauauuacaaagcguauuuuucguuaguccagccuccaaugugugcuuuuucgcuaaaugucccuacaugugcaagaccgaguaugcagucuguggaaacccucaucugcuugaaggcucuuugagcgccuuccugccaucccuaaaucucgcuccgcgccugucagugcccaacccuuggauccgaaguuacacacuugccgguaaagaggagugggaagugaauccacuguauugcgauaccgucaagcagauuuaccccuacaacaauagccagagauugcucaacguuaucgacauggcgauuuuugauuuccugaucgggaauauggacaggcaccacuaugagauguuuacuaaauucggagacgauggcuuuuuaauacaccuggacaacgcacggggcuucgggcgucauucucacgaugaaauuuccauccucucaccucuuagccaguguugcaugauuaagaagaaaacacuguugcaccuacaacugcucgcccaggcugacuaccgccugagugaugugaugagagagucucuucuggaagaccaguuguccccaguacucaccgagccccaucuguuagcccuggauaggcggcuacaaacgauccuccgaacuguggagggauguaucgucgcacacggucagcagagcgugauuguugacggcccgguggaacagcuggcuccugauucggggcaagccaaucuuaccucuuga

SEQ ID NO: 56068 - RNA, 1230 nt, Artificial Sequence
  derived and/or modified sequence opt3 from FAM20B__Homo_sapiens__NP_055679
augaagcugaaacagagagugguccuccuugccauccuguugguuauuuucauauuuaccaagguguucuuaaucgacaaccuggauacaagcgcugcaaauagggaggaccaacgggccuuucaccgcaugaugacuggccuacgaguagaacucgcgcccaaacuggaucauacgcuucaguccccuugggagauugcugcccaguggguggucccacgugaaguguacccggaggaaacccccgagcugggggcaguuaugcacgccauggcuacaaagaaaaucauuaaggcagacgugggauauaaggguacucaguugaaagcccuccugauccuggagggcgggcaaaaggucguguucaaaccuaagagauacucuagggaucauguaguugaaggagagccauaugcuggcuacgaccggcacaacgccgaaguggcggcauuucaucucgaucgcauauuagguuuccacagagcuccccuggucguggggagguuugugaaucuucggaccgagaucaaaccugucgccacagagcaguugcugucaaccuuccuaacuguuggaaacaauacaugcuuuuauggcaaguguuacuauugccgcgaaaccgagccagccugugcagacggcgauauuauggaagggagugugacgcucuggcugcccgacguauggccucuucagaagcaccgacauccauggggaagaacuuacagggaggguaaacuggcucggugggaauacgaugagagcuauugcgacgccgugaagaaaaccuccccguacgauucuggcccccguuugcucgacaucauugacacagcggucuucgauuaucugaucgggaacgccgaccgccaccauuacgagucguuucaggaugacgaaggagcaucaauguuaauacugcucgauaaugcuaagagcuucggcaacccuagucuugacgagagauccauucuggccccauuguaucaauguugcaucauuagggugucuacuuggaaucggcuaaacuaccugaaaaaugguguucucaagagcgcucugaaauccgccauggcacacgaucccaucucaccugugcuuagugacccacaccuggaugccgucgaccagcgauugcucagcgugcuggcuaccguaaagcaguguacagaucaguuugggauggacaccguuuuaguggaagaccgcaugccccugucucaucuauga

SEQ ID NO: 56069 - RNA, 1755 nt, Artificial Sequence
  derived and/or modified sequence opt3 from FAM20C__Homo_sapiens__NP_064608
augaagaugaugcuggugagaagguuccggguccucauccuuaugguuuuucugguggccugcgcuuugcacauugcauuagaccugcuaccccgccucgagcgacguggcgccagaccuagcggggaaccaggauguuccugcgcgcagccggcugccgagguagcagcccccgguugggcucaagugaggggccggccuggggaaccacccgcagccucuucagcugccggagaugcgggcuggccuaacaaacauacccugcgcauacuucaggacuucaguagcgauccauccucuaaucugucgucacacagcuuggagaagcugcccccugcagccgaaccagcugagagagcccucaggggucgggacccgggggcacugcgcccccaugauccugcucaccgaccacucuuaagagaccccggaccuaggcggagugaguccccacccggcccgggcggggaugccucucugcuugcgcguuuguuugaacauccucuguaccgcgucgccgugcccccacuaacagaggaagacguucucuucaacgugaauagcgauacuagacuguccccuaaagcagcugagaaccccgacuggccacacgccggagcugagggugccgaauuucuuucacccggcgaggcagccgucgauaguuauccuaauuggcugaaguuccacaucgggauuaacagguacgaauuguauagccggcauaauccagcuaucgaggcgcuccugcacgacuuaucuucccagcgaauuacgucaguggcaaugaaaagcggaggcacccagcugaagcucaucaugacauuucaaaacuacggucaggcccuuuucaagccgaugaaacagacucgcgaacaggagacacccccugacuuuuucuauuuuagugauuacgagagacauaaugcugaaauagccgcauuccaccuggacaggaucuuggauuuucggcgcguaccacccguugccgggagaauggugaacaugaccaaggagauuagggacgucacccgugauaaaaagcuauggcggacuuucuucaucucuccugcuaauaacauuuguuuuuauggagaaugcuccuacuacuguagcacagagcacgcccugugcggcaaaccagaccaaaucgaaggcucgcucgcagcguuccugcccgaucuuucucuggcuaagcgaaagaccuggagaaauccguggaggcgcuccuaucauaaacggaagaaagccgagugggagguggacccugauuacugugaagaggugaagcagacgccacccuaugacucaagucacagaauauuggaugucauggacaugacuauuuuugauuuccucauggggaacauggacaggcaucacuacgaaaccuuugagaaauucggaaaugaaacauuuaucauucaucuggacaacggucgcggcuucgggaaguauagccacgaugaguuauccauccugguuccucuacagcagugcugucgaauccggaaaucuacuuaccuccgucugcaacuuuuggcaaaggaggaauauaagcugagccuccugauggccgagucacuuagaggagaccagguggcucccguacuguaccagccacacuuggaagcccucgauaggcgccugcggguggucuuaaaagcagugagagacugcguugagaggaacggccugcauaguguggucgaugacgaucuagacaccgagcaccgagcugccuccgcgcgcuga

SEQ ID NO: 56070 - RNA, 579 nt, Artificial Sequence
  derived and/or modified sequence opt3 from FAM210B__Homo_sapiens__NP_543011
auggccggccugcucgcacuucuggggcccgcuggaagagugggugccaggguccggccucgcgcgaccugguuguuaggcgcuacagccccaugcgcaccgcccccucuggcccuagcucuccugccaccccgacuugacgcacgucuguugagaacugccaggggagauugucgggggcaccaggacccuagccaagcuacgggcaccacagguuccucuguuucaugcacugaggaaaagaaacagaguaagagccagcagcucaaaaagaucuuccaagaguacgggaccgugggaguaucccugcauauuggcauaucucugaucucgcucggcaucuuuuauaugguggucucaagcgggguggauaugccagccauuuuacugaaacuuggauucaaggaaaguuugguucaguccaagauggcggcagguacaucuaccuuuguggucgccuacgcuauucacaaacuguucgcccccgugcgcaucagcauaacucuaguauccguuccucucaucgugagauauuuuaggaaggucggcuucuuuaaaccaccggcagcuaagcccuga

SEQ ID NO: 56071 - RNA, 690 nt, Artificial Sequence
  derived and/or modified sequence opt3 from FAM213A__Homo_sapiens__NP_001230707
augagcuuccugcaggaccccuccuuuuucaccaugggcauguggucuaucggggccggagcucucggugcagccgcgcuugcucuguuguuagccaacacagauguguuucugucaaagccucaaaaagcagcccuagaguaccucgaagacauugaucugaagacucuugagaaagaaccaagaacguucaaggcuaaagagcugugggaaaagaauggcgcagucauaauggccguuaggcggccggggugcuuuuugugucgcgaggaggcugccgaccucaguagccugaaguccaugcuggaucagcucggagugcccuuauaugcgguagugaaagaacacauccgaaccgaggucaaggacuuccagccuuacuuuaaaggcgaaauuuuccuggaugagaagaaaaaguuuuaugguccacagcguagaaagaugauguucaugggguuuaucaggcuuggagugugguacaacuucuuucgggcauggaauggcggcuucucugggaacuuggagggagaagguuucauucugggcgggguuuuuguggucggaucgggcaaacaagguauccuacucgagcaucgcgaaaaggaguucggggacaaagugaaucugcuuucaguacuggaagccgcuaagaugauaaaaccccagacauuggccagcgagaagaaauga

SEQ ID NO: 56072 - RNA, 3252 nt, Artificial Sequence
  derived and/or modified sequence opt3 from FAM214A__Homo_sapiens__NP_001273424
augguguucagcggcaacaaggggcugcacagagaggacacccucgaugaauacuuugaguaugacgccgaagaguuccuugucucccuggcuuuguuaaucacagaaggaaggacucccgagugcucuguuaaaggucggacggagucauuucauuguccuccagcacagaguugcuacccggugaccacaaagcacgaauguagcgauaaacuggcccaaugccgccaggcgcgacguacuagauccgagguaacccuacucuggaagaauaaccugcccauuaugguggaaaugaugcuucugccugacuguugcuauucugaugacggcccaacaaccgaggggauagauuugaaugaccccgcuaucaaacaggaugcccuccugcuggagagguggauucucgaaccugucccacggcagaacggagaccgcuucaucgaggaaaagacuuuacugcuugcagugagaucguuuguuuucuuuucacaauugagcgccuggcugagugugucccauggcgcuauucccaggaauauccuauaccggauaucugcagccgaugucgaccuccaguggaacuucagccagacaccuaucgagcacguguuuccaguaccgaauguuucccauaacguggcucugaaggucucagugcagagucuuccccgccaaagcaauuauccugugcugaccuguucuauucacacgaacaucgguuuguacgaaaaacggauucagcagcacaagcucaaaacucaucagcaccauaauccaaacgaggccgagcaaugcgggaccaauuccucacagagacuguguagcaagcagacauggacuauggcgcccgaaagugucuuacacgcaaaaucuggaccuuccccagaguauaccgccgcuguuaagaacaucaagcuguaccccggcacaggcagcaaaucggaucacgggaccucucaagccaauauacucggauucuccgguauuggcgacaucaagucacaggaaacgagugugaggacucuuaagagcuuuuccaugguagacucuagcauuucaaaccggcagaguuucuggcaguccgcaggggagacaaacccgcugaucggcagcuugauccaagaacgucaggagauuauagcucgcaucgcccagcaucuaauucacugcgauccuucuaccucacaugugaguggaagacccuuuaauacucaggagagcuccucucugcacucgaaacucuucagggucagccaagaaaacgagaauguggguaaagggaaggaagcguucuccaugacauuuggaucaccagaguucaguucuccugaagacaccaacgagggcaaaauccggcugaagcccgagacgccacgaagcgaaaccuguauauccaaugauuuuuacucacauaugcccguuggcgagacaaacccucuuauugggagccuguugcaggaacgccaggacgugaucgccagaaucgcacagcaccucgagcacauugauccaacugcuucucauaucccgaggcaauccuucaauaugcacgacaguagcucugucgccuccaagguguuucggucaaguuaugaggauaaaaaccuguuaaagaaaaauaaggacgaaagcucgguauccauuucucauaccaaaugcagccugcuaggagauauaucagacgguaagaaccucguucccaauaagugcuucacaaguuuuaaaaacaauuccaaggagaaauguucucugaagcaccagacucgcaaccagugccagaauaacccuagcgaaaucauucaauccaccuaccaggagacacagaacaaaucaagcagucuuucuaccuccagcaucuugucgcaacacaaggaaaauaaccuggaucucacuucaagauucaaggagcaggagaugucuaauggcaucgacaaacaguauaguaacuguacgacaauugacaagcagauaugcaccaauaaauacaaggagaaaaucauuaacgaaaauuauaacccaaaguuuuucgggaaucugcaauccgaugacagcaagaaaaacgauucuaagaucaaagugacuguccuugaaaugagcgaguaccugaauaaguaugaauccaugucaaguaacaaagacagcaagaggcccaaaaccugugagcagaauacacaguugaacucuauugagaauuaccucaacaaggauaacgaaggauuuaagugcaaaaaguccgaccagcugaaaaaugagcaagauaagcaggaagacccuaccaacgagaaaucacagaauuacagucagcgucggagcaucaaggauuguuuauccacuugcgaacaaccaaagaacacagaggugcugcgaacgacccuaaaacauucuaaugucuggagaaagcacaacuuccauucgcucgacggcacuagcacaagggcuuuucacccccagaccggucugccgcuuuugucauccccugugccacagcgcaaaacacaaaguggguguuucgaucuggacucuagccuccugcauuuaaaguccuucucaucucggagccccagaccuugccugaauauagaggaugaccccgacauccacgaaaaaccauuucuuaguuccagcgccccucccauuacuucuuugucacuccugggcaacuucgaggaauccguucuaaauuauagguuugauccacugggaaucguggacggcuucaccgcagagguaggggccaguggagcuuuuuguccgacgcaccucacccugccugucgaggugagcuucuacucgguuucugaugacaacgcgcccuccccauauaugggugugauuacacuugagagcuugggcaagcgcggguaccgagugcccccuucaggaacuauccaggucacccuguuuaauccaaacaagacaguagugaaaauguucguugucauauaugauuuacgggacaugcccgcaaaucaucagacuuuucuccgucagagaaccuucagugugccugugaagcaagaagucaaaaggucuguuaacaaggaaaauauucgccacacggaggaacggcugcuuagauaccugauccauuugagguuucaguccagcaaaucaggcaagauuuaucuccaccgagaugugcgccugcuauucagucgaaagagcauggagguggacuccggugccgcuuacgagcugaaaucuuacacagaaagcccgaccaacccacaguuuucccccagaugcuga

SEQ ID NO: 56073 - RNA, 822 nt, Artificial Sequence
  derived and/or modified sequence opt3 from FAM216A__Homo_sapiens__NP_037432
augcugggccagcuccuuccccacaccgccagagggcugggagcugcagagaugccuggucaaggcccagggagcgacuggacagaaagguccucuucagccgagccgcccgcgguggcuggaacugaaggcggugggggaggcagugccggcuacagcugcuaucagaacuccaaggggucugaucggaucaaagacggauacaaggucaauucgcauauugcaaaauugcaggaguuauggaagacgccucagaaccaaaccauacaccugucaaaaagcaugauggaagccaguuucuuuaagcauccagaucuaacaacuggucagaagcgcuaucucuguuccaucgcuaaaauuuacaaugcaaacuaucugaagaugcuuaugaaacgacaguacaugcacguucugcagcauucuagccaaaagcccggcguguugacccaccaccguuccagacucucaaguagguauagccagaaacagcauuacccuugcacaaccuggcggcaccagcuggagcgcgaggacucuggguccucagauaucgccgcugccagcgcgccagaaaugcugauucaacauagucucuggagacccguaaggaauaaggagggaaucaagacuggcuacgcaucuaaaacacgguguaaguccuuaaaaauauuccgccgaccuagaaagcuguuuaugcagaccgugagcucggacgauucugaaucccacaugucagaggagaaaaaggaagaggaccuuuugaacaauuucaugcagaguaugagcaucgaggaacaaggugaacaccugaugcuaacguga

SEQ ID NO: 56074 - RNA, 780 nt, Artificial Sequence
  derived and/or modified sequence opt3 from FAM220A__Homo_sapiens__NP_001032240
augagagacaggcggggcccccuggggaccugccucgcccaggugcaacaggcuggagguggcgauagcgacaaacuuuccuguucucugaagaagcgcaugccugaggggccauggccggcagaugcccccucauggaugaacaaaccugucguugacggaaauagucagagcgaagcguuguccuuagagaugcgaaaggauccaucuggcgcuggucuguggcuacacucagggggacccgugcucccuuacguacgugaaucggugagaaggaacccagccagcgcagccacacccaguacugcugucggccuguucccugcaccaacggagugcuuugcccggguguccuguucuggcguugaagcucuugggcgcagagacuggcugggagguggcccgagggccaccgaugggcaucggggacagugccccaaaggcgagccucgcgugagccgauugccaagacaccaaaagguccccgagauggguuccuuccaggacgauccuccaucagcguuucccaaggggcucggaagugaacuggagccggcaugucugcauagcauccucucugccacauuacacguguauccugaaguacugcuuuccgaggagacuaaaaggauuuucuuggaccggcugaagcccauguuuucaaaacagaccauagaguucaagaaaaugcuaaagagcacaagugauggccuccagaucacccugggccuucuggcuuugcaaccauuugaacucgccaauacucugugccauucuuga

SEQ ID NO: 56075 - RNA, 1527 nt, Artificial Sequence
  derived and/or modified sequence opt3 from FAM227B__Homo_sapiens__NP_689860
auggccggccagagaaccugccaaaggcggagcucccgcgcugggcccggaaagaugcaggagccuccaaaaucuaucgaagaguuccugaaguuucagaacugggacuacuggccgcgagaaauucacuuccgugaugacgauaaauggucauguacacucaagaaaauaaaggaggacaguagcuuuguguccaucuauacucaucuuugggaaaauguccccagaauuuucgaggcacuguugaucauggagucuaaguuaaaagaauacucgcugauucuacagaaccacacgucagagaucuuuaaguggaaaagcaugauaagugaaaccuccucuuauaggaagcucgagcgguacggugaguuccugaaaaaguaucauaagaaaaagaaaaucaugcuuagcgaugaaauggagacagaaaagaauauugagggcugcuccuuuacuggguucaaagccaacgaacugacccaauugccucgccaccucgacgcggagcagaucuaccuguuuauucugaaggcucauaauuucgaugagagaguuuuuaaaaucuggaagacacacuuccucucagaagccaguauagcauuacugcacgacagcuuuugguggugguuccuucauaaguucaggccagaucgggagaaccaggacuguuuguuugaucgcauuucugaauccuaugugacccuguucaugucaaucccccuaagccgaaaagacgccuuuuuccagauuuacccugauugccucgcucaagcaaucuacgccacuuuucacgaggcuuucccagaaaguucuuaucuguuuaaugacgaguucaaggaggaccuuggaaacaauaucuuucugugguguuccggcuugaaaccccagaaggguuucuggauucauuggaaacucaaggaacugagcacaaccacgauacacgggucgaagaaagccccugcgaagucuguaaaagagagaaucgcagauucccaggaacacauuucaaccaguaucgacuuuaacauaauuaagaucuuaaauaacccaagggccuacacucugccgaucagcaaagaggaaucccggcucucucgucuugcuacaaagagccauuauucaaguacuggacccgaguucaaucgcgugcuguuuaacuucggcggccaguccccuuugauucuauacuaucugaagaugcacgagcucgccgggaucagcaaagcaccaaagaaaaccaagauuaaacugacaaagauauuccaagaaccccuuccugcuccaaccuacagagaugucaucaaggaggccaaaaggcaguuugcgcggaaucagaaggacuuccgcauucugcaagccaaagcaacgaagaaaccccaugaagugaagcaggauuuugagaaauucuugcacaagcuccgaucugaggcugaaaucgagagagaaugcguugccucacugaguagcuccucuucgagcuccccgucaaguacugacaacuauaacuuugaggaagaggaguacuga

SEQ ID NO: 56076 - RNA, 339 nt, Artificial Sequence
  derived and/or modified sequence opt3 from FAM32A__Homo_sapiens__NP_054796
auggaggccuacgaacaggugcaaaagggcccccugaaacucaagggggucgcugagcuuggaguuaccaaaagaaagaaaaagaagaaagacaaggauaaagcaaagcuguuggaagccauggguacaagcaaaaagaacgaggaagagaagaggcggggcuuagacaaacgcacuccugcgcaggcugccuucgagaagaugcaggaaaaacgacagauggagcguauccugaagaaagcauccaagacgcacaaacaaagaguggaagauuuuaauaggcaucuagacacccucacagagcacuaugauauuccaaagguaucuuggacuaaguga

SEQ ID NO: 56077 - RNA, 579 nt, Artificial Sequence
  derived and/or modified sequence opt3 from FAM3A__Homo_sapiens__NP_001164604
augagacuggccggccccgagagcuccgugaccgcugcaccuagggcccggaaguacaaaugcgggcucccacagccgugucccgaggaacaccuugcguuccgcgucguuucuggagcugccaacgugaucgguccuaagauuugccuggaagacaaaauguugaugucaaguguaaaggauaaugugggccgaggguuaaacauagcacuggucaauggagugagcggcgagcuaaucgaagcccgugcuuuugacaugugggccggugauguuaacgaccuccugaaauucauuagaccacuucaugaggggacacugguguuugucgcauccuaugaugaccccgcuacuaagaugaaugaggaaacgaggaaguuguucucugagcucggaucgcggaacgccaaagaacuggcguuucgcgauucauggguguucguaggcgcaaagggcguucaaaauaaaagcccuuuugagcagcacgugaagaacaguaaacauuccaauaaguacgagggguggccagaagcccuggagauggaaggauguauccccagaaggucuaccgcuagcuga

SEQ ID NO: 56078 - RNA, 708 nt, Artificial Sequence
  derived and/or modified sequence opt3 from FAM3B__Homo_sapiens__NP_478066
augagaccccuggccggcgggcuccuuaagguggucuucguuguguuugcuagccugugcgcaugguacuccggauauuuguuagccgagcugaucccugacgcgccacuaucuucagcugccuacaguauuaggagcauaggugaacggccgguacucaaagcacccgugccuaagcgccagaaaugugaucacuggaccccaugccccuccgacacauaugccuaccgacugcuuucuggcgggggacguucgaaguaugcuaaaaucuguuucgaggauaaccuguugaugggcgaacaacucgguaaugucgcaagagggauuaacaucgccauugugaauuacguuacuggaaacgugacggcuaccaggugcuuugacauguaugagggcgauaauucaggcccuaugacaaaguucauccagagcgccgcgccaaagagucugcuguuuauggucacuuacgacgauggguccacccggcucaacaaugacgcuaaaaacgccauagaagcauuaggaucuaaggagauccgcaauaugaaauucagaagcuccuggguguuuauugccgcaaagggucuggagcuucccucagaaauccagagggagaaaauuaaccauagugaugcuaagaauaaccgguacagcggcuggccugccgaaauccagauagagggguguauuccaaaggagcgcucuuga

SEQ ID NO: 56079 - RNA, 684 nt, Artificial Sequence
  derived and/or modified sequence opt3 from FAM3C__Homo_sapiens__NP_055703
augagaguggccggcgcugcaaagcuggucguugccguggcgguauuccuccuuaccuuuuacgugaucagccaggucuucgagauuaaaauggacgcuucccuggggaacuuguuugccaggucugcauuagauacagccgcucggucaacuaagcccccucgcuauaaaugcggaauaaguaaggcauguccagaaaaacacuucgccuuuaagauggcuagcggugccgcgaaugugguuggcccgaagaucugccuggaggacaacgugcuaauguccggggucaaaaauaacgugggacgaggcauuaauguagcacucgccaacgguaagacgggggaaguucuggauaccaaauacuucgacauguggggaggcgauguggcucccuuuaucgaguuccuuaaggccauucaagacggcacaaucguccugauggggacuuaugaugacggagcaaccaaauugaaugaugaagcucguagacucauagccgaccuggguucuacaucgaucaccaaccugggcuuuagggauaauuggguguucugugggggaaagggcauuaagacuaaaucaccuuuugagcagcauaucaagaacaauaaagacacaaacaaguacgaggguuggccagaaguggucgagauggaagggugcauuccccagaaacaggauuga

SEQ ID NO: 56080 - RNA, 675 nt, Artificial Sequence
  derived and/or modified sequence opt3 from FAM3D__Homo_sapiens__NP_620160
augagagugagcggcguccugaggcuccuugcccugaucuucgcuauuguuaccacauggauguuuauacgguccuacaugucuuucucaaugaagacuauccgcuugccccgaugguuagcagccaguccuacgaaagagauucaggugaagaaauauaagugcgggcugaucaaaccauguccggcgaacuacuuugcuuucaagauuugcagcggagccgcaaauguagugggucccaccauguguuuugaagaccguaugaucauguccccugucaagaacaaugugggcagagggcuaaacauagcccucguuaauggaacaacuggcgcugugcugggucaaaaagcauucgauauguauucuggggacgucaugcaccuugugaaguuucugaaagagaucccaggaggcgccuugguacucguugcuucguacgaugaccccggcaccaagaugaacgaugaaucaaggaaacuguucagcgaccuggggaguuccuaugccaagcagcucggauuucgggauucuuggguguucauuggugcgaaggacuuacgcggcaaaagcccuuuugagcaguuccugaaaaauuccccagauacaaacaaguacgaaggguggcccgagcuuuuggagauggaaggaugcaugccuccaaagccguuuuga

SEQ ID NO: 56081 - RNA, 1329 nt, Artificial Sequence
  derived and/or modified sequence opt3 from FAM46A__Homo_sapiens__NP_060103
auggccgagggcgaaggguacuucgcuaugagcgaggacgaacuggcaugcucccccuauaucccucucggaggugauuuuggcgggggagacuucggcgguggggauuuuggaggcggcgacuucgggggagguggcucuuuugggggacacugucuugauuacugcgagucaccaaccgcccauuguaacgugcugaauugggaacagguccaaagauuggacggcauuuuaagugagacaauaccgauccacgguagggggaacuuccccacucuggagcuacagccuagccucauuguuaaggugguacggcgccgacuggcggaaaaacguaucggagugagagaugucaggcuuaauggcuccgcugccucucaugugcugcaccaggacucgggcuugggguauaaggaucucgaccugauuuucugcgcagaucugcggggagagggugaauuucagacgguuaaagacgugguccucgauuguuuacuggacuuucuuccagagggcgugaacaaggagaaaaucacccccuugacacugaaggaagccuacguacaaaagaugguuaaagugugcaaugacucagaucgcuggagccuaauaagucucuccaacaauucugggaagaacgucgagcugaaauucguggacagccuuagaaggcaguuugaguucuccguggauucauuucagaucaagcuggacaguuugcuccuguucuaugaauguagcgaaaauccuaugacugagaccuuccauccaacaauuaucggagagucugucuacggcgauuuucaggaggcuuucgaccacuuaugcaacaaaauuaucgcaacccggaaucccgaagaaauacgcggugggggccugcucaaguauuguaaccuucugguucgaggauuuagaccugccuccgaugagauuaagacuuugcaaagguacaugugcucacgguucuuuaucgacuucagcgauauuggcgaacagcagcguaaacuagagaguuaccugcagaaucacuuuguggggcucgaggaccgcaaguaugaauaccugaugacacuucauggaguagugaacgagucuaccgucugucugaugggucacgaaagaaggcaaacguugaaucucaucacuaugcuggcuauccggguguuagccgaucagaacguuauuccaaacguggcgaaugugaccugcuauuaccagccggcacccuaugucgccgacgcuaacuucuccaauuacuauauagcccaaguacagccuguuuuuacaugccagcagcaaacuuacagcaccuggcugccauguaacuga

SEQ ID NO: 56082 - RNA, 1170 nt, Artificial Sequence
  derived and/or modified sequence opt3 from FAM46D__Homo_sapiens__NP_689843
augagcgagaucagauucaccaaccugacaugggaccaggugauuacucucgaucaaguccuugacgaaguuauacccauccacggcaaggggaauuuuccuacgauggaggugaaaccaaaggauauuauccauguagugaaagaccagcugauuggacaggguaucauagucaaggaugccagguugaacggcuccguggcuucuuacaucuuagcaucacacaaugggauuaguuauaaagaccuggauguuaucuucggaguggaacuaccgggcaacgaggaauuucaggucgugaaggacgccguacucgauugccugcuugacuuccugcccaaggauguuaaaaaggagaaauugagcccugacauuaugaaggaugcguacgugcaaaaacucgucaagguguguaauggucaugacugcuggucccugaucucucugucgaacaauaccgggaagaaccucgaguuaaaauuugugucaagccugcggcgccaguucgaauuuagugucgacuccuuccagauaguucuugauccaauguuggacuuuuauucugauaagaaugcuaaacugacaaaggagagcuaccccgugguaguggccgaauccauguauggagacuuccaggaggcaaugacucaccuacaacauaaacucauuuguacccgaaagccugaggaaauccguggcggcgggcugcuuaaauacugcucacuguugguccacggauuuaagccagccuguaugagugagauuaagaaccucgaaagauauaugugcagcagguucuuuaucgauuucccccacaucgaggaacagcagaaaaagauugagucuuaccugcauaaucacuucauaggugagggcaugacaaaauacgacuauuuaaugacccugcauggggugguuaacgaauccacugugugucucaugucauacgagcggcgccagauccuucaccugauuacaaugauggcuuugaagguccuaggagaacugaauauccucccuaacacccaaaaagugacgugcuuuuaucagccagcaccguacuucgccgcugaggccagauaucccauauacguaauuccugaaccacccccuguuagcuuucagccauaucacccccugcauuucaggggcaguaaugguaugucuuga

SEQ ID NO: 56083 - RNA, 972 nt, Artificial Sequence
  derived and/or modified sequence opt3 from FAM49A__Homo_sapiens__NP_110424
augggcaaccugcucaaggugcuuaccagagagaucgaaaauuacccccacuucuuucuggacuucgagaacgcccagccuacagaaggggagagggaaauuuggaaucaaauaagcgcugucuugcaggauuccgagucuaucuuagcagaccugcaggccuauaaaggagcggguccagagauucgggaugcuauccagaacccgaaugacauucaacuacaggaaaaggccuggaacgcaguuugcccccucgugguacgccugaaacgauuuuacgaguucucaauccgucuugaaaaggcccugcagaguuugcucgagagccugacuuguccuccauauacgcccacccagcaucuggagagagaacaagcucucgcaaaagaguuugccgaaauauuacacuucacacugagguuugaugagcuuaagaugcggaauccugcuauccagaacgacuucuccuacuaucgcagaacuauuucuaggaaucggaucaacaauaugcauuuggauauugaaaacgaggugaauaacgagauggccaaucgcaugucgcuguuuuacgcggaagcaaccccaaugcuaaagacacucucaaacgccaccaugcacuucgucagcgagaacaaaacucugcccaucgaaaauacaaccgacugccuuaguacgaugacuuccguguguaagguuaugcuggagaccccugaauaucgaucuagauuuacaagcgaggagacuuugauguucugcaugagggugauggucggcgugauaauucucuacgaucauguacacccaguuggggcuuuuuguaaaaccuccaagaucgacaugaaaggaugcauuaaggugcugaaggaacaggccccggauucagucgagggcuuacugaacgcacuccgguucacaaccaaacaccuuaaugacgaaaguacgagcaagcagauccgugcuaugcugcaauga

SEQ ID NO: 56084 - RNA, 975 nt, Artificial Sequence
  derived and/or modified sequence opt3 from FAM49B__Homo_sapiens__NP_001243692
augggcaaccugcucaaggugcuuaccugcacagaccuggagcaggggcccaauuucuuuuuggauuucgaaaacgcccaaccuacugagagcgaaaaagagaucuacaaucaggucaacguuguguuaaaggacgcugaagggauucuggaggaucuacaguccuauagaggugcaggccacgagauaagggaagccauccagcauccagcggacgagaaacuccaagaaaaggcuuggggagccguagugccgcuggucggaaaacuuaagaaguuuuacgaguucucucagcggcuggaggcagccuugcgcggccuccugggugcucugacgucaacccccuauaguccuacacagcaccucgaacgagagcaggcauuagccaaacaauuugcugaaauucugcauuucacucuucguuuugaugaguugaagaugaccaauccagccauccagaacgacuucagcuacuauagaaggacacugucccggaugcgcauuaauaacgugcccgcggaaggggagaaugagguuaacaaugaacuagcaaacagaaugucucucuuuuacgccgaggcuaccccuaugcugaaaacucuuucggaugccacaaccaaguucgugucagaaaauaaaaaccugccaaucgagaauacgacugacuguuugagcaccauggcaagugucugcagggugaugcucgaaacacccgaguaucggucccgcuuuacuaacgaggaaaccguaucuuucugucugcgaguuauggugggagucauaaucuuauacgaucacgugcauccugugggcgcuuuugccaagacaagcaagauugacaugaaaggcugcaucaagguccugaaagaucagccaccgaacuccguugaggggcuccuuaaugcgcugagauacaccacgaagcacuugaacgacgaaacuacaucaaaacagauuaagaguaugcuacaauga

SEQ ID NO: 56085 - RNA, 978 nt, Artificial Sequence
  derived and/or modified sequence opt3 from FAM50B__Homo_sapiens__NP_036267
auggcccaguacaagggcaccaugagagaggcugggagggcaaugcaucugcucaaaaagcgggaacgccaacgagagcagauggaagugcuuaaacagcguaucgccgaggaaacaauucuuaagagccaggucgacaaaagauucuccgcgcacuaugaugcuguugaggccgaguugaagucuucaacugugggauuaguaacgcugaacgacaugaaggcaaggcaagaagcccuagugcgggagcgcgaaagacagcucgcuaaaaggcagcaccuggaggagcagcggcuucaacaggaacgccagcgagagcaggaacaaagaagggagcggaagcguaaaauaaguugccugagcuuugcauuggaugaccucgaugaccaggccgaugcugccgaagcgcgcagagcagguaaucugggcaagaaccccgacgucgauaccuccuuccugccugacagggaucgggaggaggaagagaaucgacuccgcgaagaguuaagacaggaaugggaggcccaaagggagaaagugaaggacgaagagauggaaguuacauuuucuuacugggaugggucgggacaucggcgcacugugagagucaggaagggcaacaccgugcagcaguuccugaaaaaggcucugcaggguuugcguaaagacuuucuggagcuacggucagccgggguagaacaacucauguucaucaaggaggaccugauucuuccacacuaucauacauuuuacgauuucaucauugcacgagcuagaggaaaaagcggcccgcuguuuaguuucgacguucacgaugacgugagguugcucuccgaugccaccauggagaaggacgaaucucacgcgggcaaagucgugcugcgcagcugguaugagaagaauaagcauaucuuucccgccucccggugggaagcauacgauccugagaaaaagugggacaaauauacuauaagauga

SEQ ID NO: 56086 - RNA, 1269 nt, Artificial Sequence
  derived and/or modified sequence opt3 from FAM53B__Homo_sapiens__NP_055476
auggugaugguccugagcgagucccucucuaccagaggcgccgacucaaucgcuugcgggacauucaguagggaacuucacacucccaagaaaaugagccagggaccuacgcuguuuuccugugguauuauggagaacgaucgguggcgcgacuuggaucgaaagugcccauuacaaauagaccagccgucuaccucgaucugggaaugucugcccgagaaagauucaagccuauggcaucgugaagcaguuacagccugcgcggugacuucccucauuaaggaccuguccaucucugaucacaauggcaacccuagcgcuccacccuccaaaagacaguguaggucacuuaguuucagcgacgagaugucuuccugccggaccucauggcgcccucuggggagcaagguauggacaccaguggagaagagaagguguuacaguggaggcucuguccagcgguauuccaaugguuuuagcaccaugcaacgcucgucuuccuucucauugcccagucgagccaacgugcucagcuccccuugcgaucaggcagggcugcaucacagauuuggaggccagccaugucagggcguuccggggucugcccccugcggacaagcuggugacacuuggagcccugaucugcauccagugggcgggggaaggcucgacuuacagcggucacugaguuguucccacgaacaguucagcuuugucgaguacugucccccuucugcaaauucaacaccagccaguacccccgaacuugcucgucgcagcuccggcuugucuagaucgaggagccagccgugcgugcugaacgauaaaaagguagguguuaaacggcgacgcccugaggaggugcaagaacagagacccucccuagaccucgccaagauggcgcagaauugccaaacguucucaagucugucuugccuuagcgcagggacugaggacuguggaccacaguccccuuuugccaggcacgucucaaacacccgggcuuggacagcccuguugagcgcaucuggccccggcgggcgcacuccagcuggaacccccgugccugaaccacucccgcccuccuucgaugaccaucuggccugccaggaggauuuaaguugugaagagagcgacucuugcgcgcuggaugaggacugugguagaagggccgaaccugcagcugccuggcgugaucggggcgcuccagggaauagucucugcucacuugacggagagcuggauauugaacagaucgagaaaaacuga

SEQ ID NO: 56087 - RNA, 774 nt, Artificial Sequence
  derived and/or modified sequence opt3 from FAM57A__Homo_sapiens__NP_079068
augcugcucacccuugccggcggggcucuguucuuucccggauuguucgcauuaugcacaugggcccugagaaggagccagccugguuggucccggacugacugugugaugaucucuacgcgccuagucucaaguguucacgcggugcucgcuaccggcagcgggauuguaauaauccgauccugcgaugacgugauuacaggacgucauuggcuggccagagaguacgucugguuucuuaucccauauaugauuuacgauucuuaugcaauguaccugugugaauggugcaggacucgggaccaaaaccgcgccccgucguugacccucagaaauuuccugucaaggaaccggcugaugaucacacaccaugcugugauacucuuuguuuuagugcccgucgcacagcgccugcgaggcgaucuuggugacuucuuugugggguguaucuucaccgccgaguugagcacuccuuuuguaagucugggaagaguucuaauucagcucaagcagcaacacacacugcuuuauaaagugaauggcauccugaccuuggcuacguuccucuccugcaggauucuguuauuuccauucauguacuggucuuauggccggcagcaggggcugagccuccuucagguccccuuuuccaucccuuucuacuguaacguggccaaugcguuccugguggcaccacaaauauacugguuuugcuugcuaugucguaaggccguccgccuguucgauacuccccaggcuaaaaaggacggauga

SEQ ID NO: 56088 - RNA, 687 nt, Artificial Sequence
  derived and/or modified sequence opt3 from FAM58A__Homo_sapiens__NP_001124469
auggaggcccccgaaggcgggggagguggcccugcugcaagagggccagagggacagccggcccccgaagcgagggugcacuuccgggucgcucgcuuuaucauggaggccggcguuaagcuggguaugcgaagcauuccuauagcaaccgccugcacaaucuaccauaaauucuuuugugaaacuaaccucgacgcuuaugauccauaccuuauugcaauguccucuaucuaucuggccgggaagguggaggagcaacacuugcguacgagagacauuaucaauguaucaaacagguacuucaaucccaguggagaaccuuuagagcuggauagccgguuuugggaacuacgcgacuccauagugcagugcgagcuccugaugcuuagaguccugagguuccaggugucuuuucagcauccacacaaauauuugcuccauuaccugguuucgcugcaaaacuggcucaaucggcacucauggcagcgcacccccguggcugucacagccugggcguuacugcgagauagcuaucacggcgcacuuuguuugagauuccaggcccagcauaucgcuguggccguacuguaccuagcacuccaaguuuacggcguggaggucccugcugaaguggaggccgaaaagccaugguggcagauuuauacuauggacaccgagaucccguga

SEQ ID NO: 56089 - RNA, 666 nt, Artificial Sequence
  derived and/or modified sequence opt3 from FAM60A__Homo_sapiens__NP_001129284
auguucggcuuucacaagcccaaaauguacagaagcaucgaggggugcuguauuugcagggccaaguccucuucaagucgguucaccgacagcaaacgcuaugaaaaggauuuucaguccuguuucggacugcaugagacacgaucuggugacauaugcaacgcuugugugcuccuugucaaacguuggaagaagcugccugcaggcucgaaaaagaauuggaaccacguuguggaugccagagcggggccaucauugaaaacuacguuaaagccgaaaaagguaaagacccugagcggaaauaggaucaaaaguaaccaaauuuccaagcuacagaaagaauuuaagcggcauaauucugacgcucacagcacaacuuccucagccagucccgcacagagcccuugcuacucuaaccaguccgaugacggcucagauaccgagauggccagcgguaguaaucgcacaccaguguucucuuuucucgaccugaccuauuggaaaagacaaaagaucuguugcgggauuaucuacaaaggaagguucggcgaaguccuuauagauacucaucuguuuaagcccuguugcuccaacaagaaagcugcagccgagaagccugaggaacagggcccagagcccuugccuaucagcacacaggaaugguga

SEQ ID NO: 56090 - RNA, 1866 nt, Artificial Sequence
  derived and/or modified sequence opt3 from FAM63B__Homo_sapiens__NP_001035540
auggagagcucccccgaaucucugcagccucucgagcacggcguggccgcugggccagcaucaggaaccgguaguagccaagaaggccuucaggagacaagacuggccgcgggggacggaccgggcgucugggcugccgaaacuuccggugggaacggauugggcgcagccgcugcaaggcggucuuuacccgauucggccagcccugcuggcucaccagagguucccgggccuugcaguuccucugccggacuggaccuaaaggauagcggucucgaguccccagcggcagccgaagcuccccugcgcggccaguacaaagugacggccucaccugagaccgcaguagcuggggugggacaugaacuuggcacagccggugacgcgggggcccgaccagaucuggcaggaacuugucaggcugaguugaccgccgcuggcagugaggaaccgagcucugccggcgggcucuccucaagcugcagugaccccucuccuccaggagagucccccagccuggauucgcuggaaucuuucuccaaucuccacucauuuccuaguagcugugaguucaacuccgaagagggugcagagaaucgugucccagaagaggaagagggcgccgcuguguuacccggggcgguuccgcugugcaaggaagaggagggagaagagacagcacaagugcuugccgcuucuaaagaaagauuuccuggccagagcgucuaucauaucaaguggauucaguggaaagaggaaaacacccccauaaucacucagaaugagaacgguccauguccuuugcuggccauucuaaaugugcuccugcuugcauggaagguaaagcugcccccaaugauggagaucauuacagccgaacaauugauggaguaccucggggacuauaugcuggaugcuaaacccaaggaaaucucagagauacagagguuaaacuacgagcagaauaugagugacgccauggcaauccugcacaaacuccagaccggccuugauguuaacgugcgguucacgggaguccgcguguuugaauauacuccugagugcauuguguucgaccuguuggauaucccacuauaccauggcuggcuggucgacccgcaaauugacgauaucguuaaggcgguggggaauuguuccuauaaccagcucguagagaaaauaauuagcugcaagcagucugacaauucagaacuggugagugaaggauuugucgcugagcaauuccuuaacaauaccgccacacagcugacuuaccacgguuugugugagcucaccagcacagugcaggaaggcgagcugugcguguuuuucagaaacaaccacuuuuccaccaugacgaaguacaaagggcaguuauaucugcuaguuacugaucaaggauuccucacagaagagaaggucgugugggaaucucugcauaauguagacggcgaugguaacuuuugugacucggaguuccaccuuaggcccccuagcgauccagagaccguuuacaaagggcagcaggaccagaucgaucaagacuauuugauggcacugucccuccagcaggaacagcaaucacaggagauuaauugggaacagauccccgagggcaucagugaucuggaacuugccaagaaacugcaggaggaggaagaccggcgcgcuucucaauacuaucaggagcaggaacaagccgcagcugccgcggccgcugcaagcacucaggcccagcagggacaaccugcucaggccuccccaucaagcggccgacagucugggaacuccgagagaaagaggaaagagccccgggaaaaggacaaggagaaagaaaaggagaaaaauaguugcgugauuuuguga

SEQ ID NO: 56091 - RNA, 747 nt, Artificial Sequence
  derived and/or modified sequence opt3 from FAM64A__Homo_sapiens__NP_001182157
auggccagcagauggcagaacaugggcaccuccgugaggcggcgcucucugcaacaccaggagcagcucgaagacucaaaggagcuucagcccgucguuagucaucaagaaacaagcgugggggcucugggauccuugugccgacaguuccagcguagauuaccucugagggcaguaaaucuaaaccuccgggccgguccaucuuggaaacgccuggagacuccggaacccggccagcaagggcuucaggcggcugccagaucggcaaagucagcccugggagcugugagccagaggauccaggagaguugucaauccggcacgaaaugguuggucgagacccaggugaaggcacggcgccgaaaaagaggugcccagaaggggucuggaagcccuacacacucccucucacaaaagaguacuaggcugagcggcgcugccccagcgcauucugcagccgaucccugggaaaaagagcaccaucggcuguccguucguaugggcucacacgcucacccucuccgcagaagcaggcgggaagccgcauuucgaaguccauacucuuccaccgagcccuuaugcagcccuucggagucugacuccgaucuggaaccagugggggcugguauucagcaucuucagaaguugucacaggagcuggacgaagccauaauggcggaggaacgcaaacaagcccuaagugauagacagggauucauccucaaggacgucuaugcaagcccguga

SEQ ID NO: 56092 - RNA, 3144 nt, Artificial Sequence
  derived and/or modified sequence opt3 from FAM65B__Homo_sapiens__NP_001273374
augcaguucuuugacgccgaggaacugcucguggaugaggaagacgaugucuucggcgaggggcuucccaccagacugccugaaaucauguugguuggaagccaauccuuuucuccagguggcccgaacgggauuauaaggucacagaguuucgcuggauuuagcggcuuacaggagcggcgcucccgaugcaauucuuucaucgagaacucgucagcacugaagaaaccccaggccaagcucaaaaagaugcacaaucuaggucauaaaaacaauaacccuccaaaggaaccccaaccuaagcguguggaggaaguauacagagcgcugaaaaaugggcuugacgaguaucuggaggugcaccagacagaauuggauaagcucacugcucagcugaaagacaugaagaggaacagccggcugggaguccucuacgauuuagacaaacagauuaagacgaucgagcgcuauaugagaaggcuggaauuucauauuaguaagguggaugagcuuuacgaagccuauuguauccaacggcgcuugcaggacggcgcauccaaaaugaagcaggccuucgcuaccucuccagcaagcaaagccgcucgagagucccugacagagauaaauagaucauuuaaggaauacacugagaacaugugcaccaucgaaguugagcuagaaaaucuccugggcgaguucaguauuaaaaugaaggggcuugccggauuugcgaggcugugucccggugaucaguaugagaucuucaugaaauacggccggcaacguuggaaguugaaggggaaaauugaagugaacggaaagcagagcugggacggcgaggaaacagucuuucucccucugaucguggguuucauaucuauuaaaguaaccgaguuaaaggggcuggcaacucacauccucguuggauccgugacaugcgaaaccaaagagcuuuucgccgcucgcccacaggucguggccguggauauuaaugaccugggcacgaucaaguugaaccuagagaucacuugguacccguuugacgucgaagauaugaccgcaucaagcggcgcugggaauaaggccgcggcccugcaaagaaggaugaguauguauucucagggaacacccgagacuccuaccuucaaagaccauuccuuuuucagcaaccucccagaugacauuuuugaaaacgguaaggcagcugaggagaaaaugccccugucgcuuucuuucuccgaucugccuaauggcgacugugccuugacaucacacaguaccgggagcccauccaacucuacgaaucccgaaauaacuaucacaccggcugaguuuaaccucagcucacuggccagucagaaugaaggaauggaugacaccuccagcgcaucuucacggaacaguuuaggcgagggucaggaaccuaagagccaccugaaagaggaggaucccgaggaaccacgaaagccugccuccgcucccucugaagcgugccgcagacaaucgagcggggcaggcgccgagcaucuauuccucgaaaaugacguugcugaggcccugcuucaggaguccgaagaggcaucagaauugaagccaguggagcuggauacaagugaaggaaacauuacuaaacagcucguaaagaggcugaccucugccgaggugcccauggcuacggaccggcuucugagcgagggcuccgucgggggagaaucagaggguugucgcagcuuuuuggacggcucucucgaagaugccuucaaugggcuguuacuggcacuagagccucacaaagagcaguacaaggaauuucaagaccucaaccaggaggugaugaaucuggaugacauccuuaaaugcaagccagcgguuuccagaaguaggucaucuuccuugucacugaccguggaaagugcucucgagagcuucgauuuucugaacacaucggacuucgaugaagaggaggacggagaugaagucuguaaugugggcgguggggccgacuccguauucucugauacugagaccgaaaagcauagcuaucguucaguucacccggaggcacggggccacuuaagugaagcccugacagaggacacuggagugggcaccuccgucgcugggucuccccuuccuuugacaaccggaaacgagagccucgauauaacuauugugcgacaucugcaguacugcacgcagcuaguccaacagaucguguuuuccucaaaaacaccauucguugccagaagccugcucgaaaagcugaguaggcagauccaggugauggagaaacuugcagcuguaucugacgaaaauauugguaacaucuccagcgucguggaggccauucccgaauuucacaagaaauugucgcuguuaucauucuggaccaaguguugcucuccuguuggcguguaucauaguccagcggaccgcgucaugaaacaacucgaggccuccuuugcucggacugugaacaaggaguaccccgggcuggcagauccgguauucagaacccuugugagccagauacuggacagggccgaaccuuugcucucuagcucccugucaagugagguugucacaguguuucaguauuacagcuacuucaccucucacggaguguccgaucuagaaucauaucugagucaacucgcucgccaggucagcaugguucagacucugcagucccuucgagacgagaaguugcugcaaacaaugucugauuuagccccaucgaaucuccuggcacagcaggaggugcuucggacgcuggcgcuacuccugacccgugaagacaacgaggugagcgaagccguaacuuuguaccuggcugccgcaagcaaaaaucagcauuuuagagagaaggcuuuacucuauuacugcgaagcccugacaaaaaccaaccuucaacugcagaaggcagccuguuuggcucucaaaauccuggaggcgacagaguccauuaagaugcuagucacucugugccagagugauaccgaagagaucaggaauguggccucugaaacgcuucucagccugggcgaggacggucgcuuggcauaugaacagcuggauaaguucccccgggacuguguuaaagucgggggcagacacggaaccgagguggcuacagccuuuuga

SEQ ID NO: 56093 - RNA, 1260 nt, Artificial Sequence
  derived and/or modified sequence opt3 from FAM69C__Homo_sapiens__NP_001037834
auggccagagcugcaggcgccagggggcccgcgggauggugccggcgccgaggucguuguggcagagggacccugcucgcuuucgccgcauggacagccggaugggugcuugcugcagcccuguuguuaagggcucacccuggcguccugagcgagcggugcacugacgaaaagucccgcagaauccuagccgcgcucugucaggauuaccaaggugggacgcuggcaggagaccuuugcgaggaucuguguguugccggcgaauugcucuuucagaggugccugcauuauaaccggggcaaaaaggugcugcaggcugacuggcgcgggcgaccaguagugcucaaaucuaaggaggaagccuucucaaguuuuccgcccuuaagccugcuugaggaggaagcaggagaggguggccaggauaugccugaagcugaguugcugcuaauggucgccggggaggugaaauccgcgcucggacuggaacuuucuaauucgucacugggcccaugguggcccgguagaagggggccucgguggcguggacaauuggccagccucugggcacuguuacagcaggaggaauacguuuauuucagucugcuccaggaccuuuccccacacgugcugcccgucuugggcucuuguggccauuuuuacgcuguggaguuccuagccgcugggagcccucaccaucgcgcccuguuuccacucgauagagcaccgggagcccccgguggcgggcaagcuaaggcgauuuccgacauagcacugucauuccuugauaugguaaaccacuuugacagugauuucagccacaggcugcauuugugcgacaucaagccugaaaauuuugccauucggucugauuucaccguuguggcuaucgacgucgacauggccuuuuucgagccaaaaaugcgagagauucucgaacagaacuguacaggagaugaggacugcaauuucuuugauuguuucucccgcugcgaccugagagugaacaagugcggcgcacagagggugaauaacaauuuacaggucaucugugauaaaauauuucggcacugguucucagcuccccuaaagagcagugccguuucuuuucaacugcagcuccagcugcaagaagccgugcaggagugcgcagacccugguguaccauccgggaacacucgcagagcggcuagcucgguguucuggaaacuuaggcaguugcugcaggccacccuccgugaacugcaagaggcagagaaguga

SEQ ID NO: 56094 - RNA, 1035 nt, Artificial Sequence
  derived and/or modified sequence opt3 from FAM71F1__Homo_sapiens__NP_115988
augcugagcuccuucccccacagaaagaccuggaggaaaucuaagaaaacagugaaggucacucggucauacccuacguuuccaagucucaacgccugggaggaguuccgcggccuucugccgguugacggggaacccaauccuggagcugguuugggcguggaagagggguuacugugccgaguagugcauagcccagaauuuaaccuauuccucgauuccgucguguuugagucuaauuucauccagguuaaacguggaagaaacuggagggacguguauaaggcaucgaauaccauggcccugggcgucacaucaagcgugcccugucuuccucugccaaacauuuugcucauggcgaguguaaaguggcaccaaggucagaaucagacuuggaaccggcccuccauagcuccuaauaucuuucugaaacgcauucugccacucagauucguugaguuacaggugugcgaucauuaccaaaggauccugcagcuucggaccgucacagaaaagauuuauuacuugaaacugcacccggaccaucccgagaccguguuucacuucuggauccgccuagugcagauacuccagaaggggcugucuaucacuacaaaagauccucgaauccuugucacccacugucugguuccaaagaacugcagcucccccucaggagacaguaaguuggugcagaaaaagcuccaagccagccagccuucugaaucccugauucaguuaaugacgaaaggcgagucagaggcacugagccaaauuuuugccgaucuccaucagcagaaucaacuuaguuucagaucuuccaggaagguagaaacuaacaaaaauagcucgggcaaggacucuucccgggaggauucaaucccauguaccugcgaccugcguuggcgcgcuaguuuuacauauggggaaugggagagagaaaaccccagcggauugcagccgcuaucccugcucucuacucuggcagccagcaccgguccucagcuugcucccccaauaggcaauucaauuuga

SEQ ID NO: 56095 - RNA, 930 nt, Artificial Sequence
  derived and/or modified sequence opt3 from FAM71F2__Homo_sapiens__NP_001012457
augagcaagaucagaggccugcccccugaggugagggaaccagggccgggagucgagcucgguguugaaaacggccuucugugccaguugauucacucccccgaguucaauuuauuuucuaacucagugguauucgaaaguaauuuuauacaaacccaugugccugaggccgacuuccaggucacaaaaccagggaacuggcgggaugugugugagggaagcgcuacuguuauccugggcgugacguccucuguccccucgcuaccucucccaaaugugcugcuuauggcaaacguaaccuggccccaggguccuuuuacaacuuggucaaccccaggggacgccccgguuauuaaucugagccgcuugcucccccugaaguacguggaacugcgaaucuaugaucgucuccagagaauuuuaaggguccggacagugaccgagaaaaucuacuaucugaaacuucacgaaaagcauccugagauaguguuccaauuuuggguccgcuugguuaagauccugcagaagggacuaaguauuacuacaaaagacccaagaaucaaguucacccacugccucgugcccaaaaugccuacgaacuccacugagaccacaccagaaaauucucugcuuagcaguccccagccgucagagccucugguauugcucgcggcugaacagacuuccggcagcuuuucucaacuguccggcaagccccaguuaaccgccgauaggaacaaugacacagcaauugagaucgauaacuguucaagcuacaaaauaccaaguccuguggccucucccauuaaucugaacaucccaaugcgggcugcacucucccauagccuuugggaacaggaggacuggaaugagcaccuguugcagguccacauugccucguaucuaggggaacauuuccugggagcuuga

SEQ ID NO: 56096 - RNA, 330 nt, Artificial Sequence
  derived and/or modified sequence opt3 from FAM72B__Homo_sapiens__NP_001307078
augagcaccaacaucugcuccuucaaggacucugccguggauuuuacaggcagauguuacuucacuaaaauuugcaaguguaaacugaaggacauagcuugccucaaaugugggaauaucgucggauaucacguuauugugcccugcucaaguugucuuccuagcugcaacaauggucauuuuuggauguuccacucccaggcaguauacgauaucaacaggcuggacucuacgggcgugaauauuuuguuaugggggaaccugccagagaucgaagagucgaccgaugaagacguccuaaauauaucagccgaggaauguauccgguga

SEQ ID NO: 56097 - RNA, 786 nt, Artificial Sequence
  derived and/or modified sequence opt3 from FAM78B__Homo_sapiens__NP_001017961
augggcugcauccagagcauuaccuguaaggccagaauaaggcgggagaacaucguggucuacgacguuugcgcuacaauugaucaaugucccacucgcaucgaagagacguccccuauugugcugcgauauaaaaccccauacuucaaggcaucugcccguguagugaugccgcccaucccuagacacgaaacaugggucgugggguggauacaggcgugcaaucagauggaguuuuucaacacuuauucagaccucggaaugaguagcugggaacuuccagaucugagggagggucggguuaaagcuaucuccgacucugauggcgugucguaccccugguaugggaauaccacagagaccgucacuuuggugggaccuacaaacaagauuucacgcuuuagcguaaguaugaaugacaacuucuacccauccguuaccugggccgugcccgucucugauagcaaugugccuuuacugacgagaaucaaaagggaccaguccuuuacuaccuggcuaguggcaaugaacacaacuaccaaggaaaagauuauccuccaaacaauaaaauggcggaugcgcgucgauauugagguugacccacugcagcuucugggccagcgagccagauugguggguaggacccagcaagaacagccgcggauccucucacguauggagcccauuccuccaaaugcucugguaaagcccaacgcaaaugaugcccaggugcugauguggcgcccuaaaagagggccaccccucgucgugaucccgccuaaguga

SEQ ID NO: 56098 - RNA, 1359 nt, Artificial Sequence
  derived and/or modified sequence opt3 from FAM81B__Homo_sapiens__NP_689761
augcagcugcaauuccucggcacccuugccagcuccgagaagaggaaaaagucucagagacuguuuuucaaaaacaucaagucaacuaaaaauaaggcugggaaggcaaguauuaugagcuccgacacaaacgugaauaaaucugccucgcccacggcgaccgcugaagaacagccugucgaaccagauggaccguugcccgguucagacaacaaucaggagaagaaaguucgguuaagcccugccaagaugaguacuaaaaacuccacagaucugguggaauacguagacaagucucacgcauuucuaccaauaauccccaauacccaacgcggccagcucgaggaucgacugaacaaucaggcccguacaauugcuuuccuucuggagcaggcauuuagaaucaaggaagacauuagcgccugcuugcaagggacccauggauucaggaaagaggaaucccucgcucggaagcugcuggagucacacauccagacuauaacaaguaucgugaaaaagcucagccagaacauugagaucuuagaagaucagauucgcgccagagaccaagcggcaaccggcacgaauuuugccguccaugagaucaacauaaaacaucugcagggugugggggaucuuaggggacggguugcucgcugugacucuuccauugugaaguugucaggcgauauccaccuguuccgacaggaacacagacaaauugagaaagccauccaggaauuugucccugcacuagagacucucagcaagaaucuggacaugaaggugaugcagcuucugggcaaaaucgagaccgcuaguucugaacagacauccaacuugaagaugguacaaggggauuauaggcacgagaugaaucuccuggaguucaaauuucauagcuuaucgucuaaccuguacgaggaaguugagaacaauaagaaauggacugagaaccaguuccucaaguaucggaaggaccaccuuggacauauuaaugaaugccugaaaguguugcaggagaagcuagaaaaauccgagaacaagauggaagagaaacugcuccagcugucaaguaaggucgagaauuuuauaaacacccaaaagcaggaaacacagcuuagcaaagugaagcacauggagaauaaacuguccaagaaaauggaacagauggagaagcaaaucuggggugaguuggaaaccaugcagaacgaguaccagucuggcuucaagagcauucacgacucacucaguucccugcagcaaauccagaaaacgaagauggauuuagaaaaauauaaggugcagaaagaccugaagaaacuacaacguaagauagucgagcuccaggaaguuuga

SEQ ID NO: 56099 - RNA, 885 nt, Artificial Sequence
  derived and/or modified sequence opt3 from FAM83A__Homo_sapiens__NP_001275516
augagcagauccaggcaccugggcaagauccggaaacgccucgaagacgugaagucucaguggguccgacccgcccgugcugauuucucagacaacgaaagugcaagacuugccaccgaugcgcuguuggacgggggaagcgaggcuuacuggaggguuuuaucccaagaaggugagguggauuuucugucuucgguagaagcccaguauauucaggcacaggcccgggagccuccaugcccgcccgacacacuaggcggggcugaggcaggaccuaaaggccucgauucaagcagucugcaauccgguacuuacuucccaguggccucugaagggagcgagcccgcccuucugcauuccugggcuucagcggaaaagccuuauuugaaagagaagaguagcgcaacggucuacuuucagaccgugaagcacaauaacauacgcgaccucguuagaagguguaucacacggacuucucagaauauuuccauccgcucaguggagggagaaauuuauugcgccaaaagcggccgaaaguucgcuggccagaucagagagaaauuuauaaucagugauuggagguucguccugucuggguccuacagcuuuaccuggcuguguggacaugugcaccggaacauucucucgaaguucacaggucaagccguagaauuauuugacgaggaguuccgucaucuguaugcaucuuccaaaccaguuaugggccuuaagucaccccgcuugguggcuccugucccaccgggggccgcgcccgccaauggaagacugaguagcuccucuggcagcgcaucagauaggaccaguuccaacccuuuuagcggucggucugcugggucacacccaggaacucgaacagacggcuga

SEQ ID NO: 56100 - RNA, 3036 nt, Artificial Sequence
  derived and/or modified sequence opt3 from FAM83B__Homo_sapiens__NP_001010872
auggagaccagcuccaugcugucuucacucaacgacgaaugcaagagugauaauuacaucgagccccacuauaaagaaugguacagaguggccauugacauacuuaucgagcauggccuggaagcauaucaggaguucuugguccaagagaggguuagcgauuuucuggcugaagaggaaauuaacuacauccugaagaaugugcagaaaguagcccaguccacagcgcacgggacugacgauucuugugacgauacgcuaucgucaggaaccuauuggccuguggagagcgacgucgaggcuccaaaccucgaucuggguuggccguacgugaugcccggccuuuuagggggaacacauauugaccucuuguuccacccuccacgggcccaucugcugacuaucaaggaaaccauacgcaaaaugaucaaggaggcacgaaagguuauugcccucgugauggauaucuuuacagacgucgauauuuucaaagaaaucguggaggcuaguacccguggcguauccguuuauauauuacuggacgaaucuaauuuuaaccacuuccuuaauaugacugagaagcaggguugcagcgugcaaagauugaggaacauucggguccgcacagugaaagggcaggacuaccuguccaagaccggagcaaaauuucacggcaagauggagcagaaguuccuacucguggauugucagaaagucauguacggcucauauaguuacauguggagcuuugaaaaggcccaucugucuaugguucaaaucauuacggggcagcuuguggaguccuucgacgaagaguuuagaacucuguaugcuaggucaugcguacccagcaguuucgcccaggaagagucugcgcgggugaaacacggaaaggcauugugggagaaugguaccuaccagcauuccgucagcucgcucgccucuguguccucacaacgcaaccuguuuggccgacaggauaaaauccacaaguuagacaguagcuauuucaaaaauagagggaucuacacacugaacgaacacgauaaguauaauauuaggucccauggauacaagccucacuucguuccaaacuuuaauggccccaacgcuauacggcaguuccaaccuaaccagaucaaugagaacuggaaacgucauucuuacgccggugaacagccagagacugugccguaucuccuucugaaucgcgcauugaacagaaccaauaaucccccugggaacuggaagaaaccaagcgacucacuaagugucgcuuccagcucuagggaaggauacgugucacaccauaacacacccgcccagaguuuugcgaaucggcuggcccaacgaaagaccacgaaccucgcagaucgcaauagcaacguaagaagguccuucaauggcacugacaaccacauucgguuucugcagcagcgcaugccuacacuugagcacaccacuaaaucuuuccugagaaauuggaggaucgagucguauuugaacgaucauagcgaagcuacaccagacuccaacggcucagcccucggggaucguuuugagggauacgacaaucccgaaaaccugaaggcuaaugccuuauauacccacagucggcugcgaucuagccuaguuuucaagccgacgcucccugagcagaaagaggugaacuccuguaccacagguucaagcaauucuacuauaauuggcucccaagggagugaaacccccaaggaggucccagacacaccuacuaacgugcagcaucugaccgauaaaccccuuccagaaagcauccccaaguugccucugcagucugaggcaccaaaaaugcacacacuccaggucccggaaaaucacuccguggcccugaaccaaaccacuaauggacauacggagucaaacaauuacaucuauaagacacuuggcguuaacaagcagaccgagaaucugaaaaaccagcagacugaaaauuugcucaagagaaggaguuuuccccuguucgacaacagcaaagcuaacuuagauccugguaauucgaagcacuacguguacuccacccugacacgcaaccggguaagacaaccagagaaacccaaggaagaccuacucaagucuagcaaaucaaugcauaaugucacccacaaccuggaggaagaugaggaggaagugacuaagaggaauaguccuuccgggacaacgaccaaaucuguuagcauugcggcacuuuuggacgugaacaaggaggaauccaauaaagagcuggccucaaagaaagaagucaagggcagcccaaguuuucucaagaaaggaucucagaagcugcgcuccuuacugagccuuacucccgauaaaaaggagaacuugucgaaaaauaaggcuccggccuucuaucgacucugcucaucuagugacacacugguguccgagggcgaagagaaccagaagccuaaaaagagcgauaccaaaguagacucuagcccacggcguaagcauuccucaaguagcaauucucaaggguccauccacaaaucaaaggaagaugugacaguuagucccagccaggagauuaacgcaccucccgacgagaauaagagaacuccauccccuggacccgucgaaucuaaauuucuagagagggccggugaugcuucggccccacgcuucaacaccgaacagauacaguaccgggacagcagagagaucaaugcaguggugacgccggaaaggcgaccuaccucaaguccccgcccaacauccucugagcugcuccggagccacuccacugacagaagggucuauucacguuucgagcccuuuuguaagauugaaucuagcauccaaccuaccaguaacaugccaaacacauccaucaaucgccccgagauuaaaagcgcgacuaugggcaacucuuacgggcggucauccccucugcuuaauuauaacaccggaguuuacagaaguuaucagccgaaugaaaacaaguucaggggcuuuaugcagaaauucgguaauuuuauacauaagaacaaguga

SEQ ID NO: 56101 - RNA, 1758 nt, Artificial Sequence
  derived and/or modified sequence opt3 from FAM83D__Homo_sapiens__NP_112181
auggcccugcucagcgagggccuugacgaagugcccgcugcaugccuguccccuugugggccaccgaaccccaccgaguuguucucugaaucaagaagguuagcccuggaggaauuggucgcgggagguccugaggcuuuugccgcauuccuccggcgcgagcgacuggcccguuuucuuaauccagaugaaguucacgcuauccugagagcagccgagaggcccggcgaagagggggcugccgcggcagccgcugccgaggacaguuucggaagcucccaugauuguucuucgggcacauacuuuccugaacagucagacuuggagccaccccuccuggaacuggguuggccugcauucuaucaaggggcuuaccggggagccacucgcguggagacgcacuuucagccaagaggcgcgggcgaagggggaccguaugguugcaaggaugcccucaggcagcaguuacggagcgcacgcgagguaauugcuguggucauggacguguucaccgauauagacaucuuucgagaucugcaagagauuugcagaaaacagggcguugccguguacauccuuuuggaccaggcucugcuaagucaguuccucgauauguguauggaccugaagguccaucccgaacaagagaaacuuaugacagugaggacuauuaccgggaacaucuauuacgcccgguccggaacaaagauaaucggcaaaguacacgaaaaguuuacccugauugaugguauccguguugcaacugggucuuauagcuucacauggaccgacggaaagcuaaauuccucaaaccucgugauucugaguggccaggucguggagcauuuugacuuagaguuccgcauccuguacgcccagagcaaaccuauaucuccaaagcuccuuucccacuuccagucaagcaauaaauuugaucaccugacgaacagaaagccccaaaguaaagaauugacucuaggcaaucugcucaggaugcggcuggcucgacuuucuuccaccccucgcaaggcggaccuggauccagagaugcccgcagaagggaaggccgagagaaaaccgcaugacugcgaaagcucgacagugucugaggaagauuacuucuccucacacagggacgaguugcagagucggaaggcuauugaugccgcaacucagaccgagccuggagaagagaugcccggucucagcgucuccgaaguuggcacacaaaccucuaucacgacugccugugcugggacacagaccgccgugauuacucgcaucgcaagcucacagacaaccaucuggaguagauccacgaccacacagacugacauggaugagaacauucuguuuccaaggggaacccaaagcacagagggcucuccuguaucaaaaaugagugugagccguuccucuucguuaaagagcuccucaagugucucuagccaggguuccguggcgucaagcacugggucucccgcuuccauacggaccacagacuuccauaauccaggcuaucccaaauaccugggaaccccucaccuagaacucuaucugagugauagccuucgaaacuugaauaaggagagacaguuucacuucgccggcaucaggucucgccugaaccauaugcucgcaaugcugucccggagaacucuuuuuacggaaaaucaccugggguugcauucaggaaacuucaguaggguuaaucuccuggccgugcgcgacgucgcuuuauacccaagcuaucaguga

SEQ ID NO: 56102 - RNA, 3558 nt, Artificial Sequence
  derived and/or modified sequence opt3 from FAM83H__Homo_sapiens__XP_006725151
auggcccccggcccuaacauggcuagaaggagccaguccucuucacaaggggacaauccacuggcaccgggauaccugcccccucacuauaaggaguacuaucggcuugccguggaugcgcuggcugaagguggcagugaggccuacagccgcuucuuggcaaccgaaggggccccagacuuuuuaugccccgaggaacuggagcaugucucccgacaccuacguccuccacaguauguuacaagagagcccccugaaggaucucuccuggauguggacauggauggcucgucagguacuuacuggccaguaaacagcgaccaggcugugccggagcuugaucugggguggcccuugacguucggauuucagggcaccgaagucacaacucucgugcaaccuccacccccugacaguccauccaucaaagaugaggcaaggcggaugauucgcucugcccagcagguuguggcugucgugauggacauguucaccgauguagaccugcugagcgagguucucgaagccgcggcaagaagggugcccgucuauauauuacuggaugagaugaaugcccagcauuuucuugacauggcugacaagugucgggugaacuugcaacacguggauuuccugcgcguccgaacaguugccggcccgaccuacuacugcagaacugggaaauccuuuaagggacaugugaaagaaaaguuccuacucguagacugugcaguggucaugucagguaguuauagcuuuauguggucuuucgagaagauccacaggucccuggcucacguguuucagggcgaacuuguuagcucauucgaugaggaguuucggauucuguucgcccagagugaaccuuuggugcccucugcggccgcacucgcucguauggacgccuacgcucuggccccauaugcaggggccggaccuuuagucggcgugcccgguguaggggcuccaacacccuucuccuuuccuaaacgcgcgcaucuccucuucccaccgcccagagaggaaggacuuggcuuuccuagcuuccuggauccagacaggcacuuuuugucggcauuccggcgagaggaacccccucgcaugccaggcggggcccuagagccccaugcuggacugagaccgcucucuaggcggcuggaggccgaagcagguccugccggcgagcuugcuggggcccgcggauuuuuccaggcaagacaccuggaaauggaugcguuuaagaggcacuccuucgcuaccgagggcgccggugcaguugaaaauuuugccgcugcccgucaagugucacggcagacguucuugagucauggggacgauuuucgauuccagacuagccacuuccauagagaccaacucuaccagcagcaguaucaaugggauccacagcugacccccgcaaggccucagggcuuauuugagaaacugcgcggaggccgggcuggguucgccgaccccgacgauuuuacacuaggagcggguccaagauucccugagcucggccccgacgggcaccagaggcuggauuacgucccauccucugccagccgcgaagugcgacauggaucagacccggcuuuugcaccuggcccccggggucuugagccaaguggggcuccccguccuaacuugacucaaagauucccaugccaggccgccgcaaggcccggcccugauccggcgccagaagccgagcccgagcgccggggaggcccugaagggagagcuggacugaggcgauggcgccucgccuccuaucugagcgguugucacggcgaggacgggggagaugacggccuuccagcacccauggaagcugaggccuacgaagaugacguccuggcaccuggugggcgggccccggcuggcgauuugcuccccucugcguuuagagugccagccgcauucccuaccaagguucccgugccaggaccuggcucagggggaaauggccccgagagggaggguccagaggaaccggggcuggcuaaacaggacaguuuucguagccgcuuaaacccucugguacagcgguccucuagacuaaggucgagccucaucuucuccacaucacaagccgaaggagccgcuggcgcagccgcggcuaccgagaagguccagcugcuucacaaggaacagacggugagugagacuuugggucccggcggggaggccguucgaucugcagccagcacaaaaguggcugaacugcucgagaaguacaaaggaccagcacgggaucccggcgggggagccggcgcgauuaccgucgcuucccauucaaaggccgugguaagccaggcauggcgcgaagagguggccgcuccuggugccguugggggagaaagaaggucucuggaguccugcuuacuggaccuucgggacaguuuugcacaacaguugcaccaggaggcugaacgacaaccaggcgccgcgagccucacugccgcacagcugcuagauacacuggguagaucuggcuccgaccgccuccccucaagguuccugagugcucagagccauucgaccuccccucaggggcuugauucuccguugccacuggagggaagcggcgcccaccaagucuuacacaaugaaucaaaagggagucccacguccgcuuauccugagcguaagggaucucccaccccaggcuuuagcacacggagagguuccccuacuaccggguucaucgagcagaaaggaucacccacaagcgcauacccagaaaggcgcggcaguccugugccgcccgugccagagcgaagaucuuccccuguucccccaguuccugaacggagggguagccucacucugaccauaucgggcgagucacccaaggccgggccggccgaagagggaccaucuggcccuauggaggugcuucgcaaggggagucugcguuugagacagcuccugucccccaaaggagaacggaggauggaggacgaaggcgguuucccagugccccaggagaacgggcaaccugaaagcccgcgccgacuaucucugggacagggcgauagcacagaggcugcgaccgaggaaagaggcccccgggcaaggcucuccucagccacugcuaaugcccuguauaguagcaaccuucgcgacgauacgaaggcaaucuuggagcagauuucugcccaugggcagaaacacagagcuguaccagcgccuucccccggaccuacacauaauucaccagaacuggguaggcccccugccgcaggcgucuuagcuccagacaugagugauaaggacaaauguagcgccaucuuucgguccgauucucucgggacccaaggacgucugucgcgcacucuucccgcaagcgccgaggaacgagacagacugcuaaggcggauggagucaaugcgcaaggagaagagaguguacuccagguucgaagucuuuugcaaaaaggaggaagcuaguucuccgggcgccggugaggggccugcggaggaaggaacccgggauagcaaagugggcaaguucgucccaaaaauucucggcacauuuaaguccaagaaauga

SEQ ID NO: 56103 - RNA, 879 nt, Artificial Sequence
  derived and/or modified sequence opt3 from FAM84A__Homo_sapiens__NP_660158
augggcaaccagcuggacagaaucacccaccucaauuacagcgagcuucccacaggggauccuuccggaauugaaaaggacgagcugagggugggugucgccuauuucuuuucugaugacgaagaggauuuggacgaacggggccaaccagauaaauucgggguuaaggcuccgcccggaugcacuccuuguccagagucacccagucgccaucaccaucacuuacugcaucagcuagugcucaacgagacgcaguuuagcgcauuccgaggccaggaaugcauauuuuccaaaguaucuggugggccucaaggagccgaccugucgguguacgcggucaccgcccuuccagcucugugugagcccggcgauuugcucgaacugcuguggcuccagccugcaccagagccgcccgccccugcuccacacugggcaguguauguuggcgggggacagaucauucacuuacaucagggugagauccgucaagacucacuguacgaagccggcgcugccaauguggggagagucgugaacagcugguauagguaccggccccuuguagcggaguugguugugcagaaugcaugcggacaccugggccuaaagagugaagagauuuguuggacaaacuccgaaucuuucgccgcuuggugccgcuuugguaaaagagaguucaaggccgggggagaggucccugcaggcacucagccaccccagcaacaguauuaccucaaggugcaucugggcgaaaauaaagugcacaccgcuagguuucacagccuugaggaucugauccgggaaaagcgccgaauagacgccuccgggagauugaggguccuccaggagcuggcggauuuaguugacgacaaagaauga

SEQ ID NO: 56104 - RNA, 933 nt, Artificial Sequence
  derived and/or modified sequence opt3 from FAM84B__Homo_sapiens__NP_777571
augggcaaccagguggagaagcugacccaccucagcuacaaagaaguccccacagccgacccuacugggguugauagagacgauggaccaaggaucgguguguccuauauuuucucuaaugacgaugaggacguagaaccgcaacccccuccacagggccccgaugggggaggccuuccugacgguggggauggaccacccccuccacagccgcagcccuacgacccucggcugcaugagguggaaugcucagucuuuuaucgcgaugaguguauauaccaaaagaguuucgcuccaggcagcgcagccuuguccacguauacccccgagaacuuacugaauaaaugcaagccuggcgaccuaguggaauuuguuucucaggcgcaguacccacacugggcuguguaugucgggaacuuccaggugguacaucuccaccgacuggagguuaucaauucguuucuuacagaugccucacaaggacguagagguaggguggucaacgaccuguaccgguacaaacccuugagcaguuccgcaguggugcgcaaugcccucgcucaugucggcgcaaaggaaagagagcugucuuggaggaacagcgaguccuucgccgcuuggugucgguaugggaagcgcgaauuuaaaauuggaggcgagcugcgaaucgguaagcagccguacagacuccagauucaguuaucagcccaaaggagucacacucuggaguuccagagccuugaagacuugaucauggaaaaacggcguaaugaucagauagggcgcgcggcaguucugcaagagcuagccacccaccuccauccugcugagcccgaagagggagacucuaacguggccagaacaaccccaccucccggcaggccacccgcaccuuccucagaagaggaagauggcgaggcuguagcccacuga

SEQ ID NO: 56105 - RNA, 555 nt, Artificial Sequence
  derived and/or modified sequence opt3 from FAM89A__Homo_sapiens__NP_940954
augagcggcgccagagcugcacccggggccgcgggaaacggugcugugaggggccugcgggucgacgggcucccuccacuuccgaagucccugucuggauuguuacacucagccaguggcgguggggcaagcggaggcuggcgccaucuggagcgacuauacgcccagaaaucccguauccaggaugaacucucuagaggcgggcccggagguggcggggcuagggcagccgcucugccugccaagccacccaaucuugacgcggcacuggccuugcuccggaaagagaugguuggacugcgccagcuggauaugucgcucuuaugccagcuguauucacuuuacgaaagcauucaggaguauaagggcgcuugucaagccgcaaguuccccugacugcaccuacgcuuuggaaaacgguuucuuugaugaggaggaagaguauuuccaggaacaaaauucucugcacgacagaagggaucgggggccaccccgcgaccuaagccucccuguguccucacugaguagcucugauuggauacuugaguccaucuga

SEQ ID NO: 56106 - RNA, 756 nt, Artificial Sequence
  derived and/or modified sequence opt3 from FAM92A1__Homo_sapiens__NP_001269963
augaugagaaggacccuggagaaccggaaugcccagacaaagcaacuccagacugcugugagcaacgucgaaaaacacuucggcgagcuuugccagaucuuugcagccuacguucgcaagacggcgcgacugcgugacaaagcugauuuguuagugaaugaaauuaacgccuaugcagccaccgagacaccccaucugaagcuagggcucaugaauuucgcugacgaauuugcaaaacugcaggauuacagacaagccgagguagagaggcuugaagcuaagguggucgagccucugaagacuuauggaaccauagugaaaaugaagcgggacgauuugaaagccacacucaccgcgcgcaacagagaagcaaagcagcugacucagcuggagaggacacggcagcgcaauccauccgaccgacacguuaucucucaagccgagaccgaacuccagagagcugccauggaugcaucaaggacgagucggcauuuagaggaaacuauuaacaauuucgagcgucagaaaaugaaggacaucaagguguuucgcaacagccuguacgcuccggauuauuccucuagacuugacauugucagggccaauucgaaaucacccuugcagcggagccugagugcgaaguguguguccgguaccggccaaguaucuacaugccgacuacgcaaagaucagcaggccgaagacgaugaggacgacgagcucgauguuacugaagaggaaaacuuccugaaguga

SEQ ID NO: 56107 - RNA, 915 nt, Artificial Sequence
  derived and/or modified sequence opt3 from FAM92B__Homo_sapiens__NP_940893
augaacaucguguucagcagagacucccaggucaggguuauggagaauaccguggccaacacagaaaaguacuuuggccaauucugcucucugcucgcugcauauacucggaaaacggcccgccuucgagauaaggcggaccagcugguaaaacaguugauugauuuugcuaauucagagaaccccgaauuacgugccaccaugagaggguucgcagaggaccuggccaaggugcaggauuacaggcaagcucaggucgaacggcuagagacaaaagugguuaauccucucaagcuguauggagcacagauaaagcagacucgcgccgagaucaaaaaguuuaaacacgugcaaaaccaugaaauuaagcagcuugagaaacuggaaaaguugagacagaagaguccaagcgaccagcaaaugaucucccaggcugagaccaggguccagcgggccgcgguggauucuucgcgcacaacccuccaacuggaggaaacuguagacgguuuccagcgacagaaacugaaggaucuccagaaauuuuucugugacuuuguuacaauugagaugguguuccacgcaaaggccgucgaaguguacucaagcgcuuuucaaaccuuagagaaauaugaucuggaaagagaccuuuuggauuucagggccaagaugcagggcguguacgggcauuaugacacgcggcugcuagcaaauaccaguccgcccccuuccguccuccagucucuggcuagccagggaacucuucaaguucagcugucccgugccaacgaggacccagagcacccccaugcgaaucacggccgcuuuucauugugcgaaugggugguaaaaggucagccugcccacugugugugcgggcagggaggccaucucaugcugccaggccacaguuuauga

SEQ ID NO: 56108 - RNA, 561 nt, Artificial Sequence
  derived and/or modified sequence opt3 from FAM9B__Homo_sapiens__NP_995321
auggccgcuuggggcaagaaacacgcagggaaggaccccgugagagaugagugcgaagagaggaaccgguucaccgaaacacgcgaggaagacgucacugaugagcauggagagcgagaaccuuuugccgagacggacgaacacaccggugcgaauacuaaaaagccagaggauacagcugaggaccugaccgccaaacguaagagaaugaagauggauaaaacauguagcaagaccaaaaacaaguccaaacaugcacucaggaagaagcagcuuaaacggcaaaagcgcgacuacauccacucucugaaauuguuaaauguucuggaagaguauauuacugaugaacagaaggaggaagaggaggaagagggcgaagaggaggaacuaauaagaaucuuccaggagcagcagaaaaaguggcaacaguacaggucagugcggcgcgaacgacucaaagagaugaagcugcuuagagaccaguuuguaaaggcccuggaagauuucgaggacuugugcgauaggguguuuagugacgaagacagcgagcucgauaacuga

SEQ ID NO: 56109 - RNA, 1602 nt, Artificial Sequence
  derived and/or modified sequence opt3 from FAN1__Homo_sapiens__NP_001139568
augaugagcgagggcaagcccccugacaaaaagagaccaaggcggucccugucuaucagcaaaaacaagaaaaaggccaguaauagcauuauauccugcuucaacaaugcuccgcccgcaaagcucgccuguccugugugcucuaaaauggucccacgcuacgaucuuaaccgacaccuggacgaaaugugugcgaauaacgauuuuguucagguggaccccgggcaaguaggauugaucaauucgaacgugucaauggucgauuuaaccagcgugacacuggaggacguuacuccuaagaaaaguccacccccuaagacgaaucuaaccccaggucaguccgauucugcuaaacgugaagugaagcagaagauuagcccguauuucaaauccaacgacgucgugugcaagaaucaggaugagcucagaaacaggucaguaaaaguuaucugucugggcagucuugccagcaagcugucucggaaauacgugaaggcaaagaaguccauugacaaggaugaagaguuugccgggucaagcccccaaaguucuaaauccacagucgugaagucauugaucgacaauucgucugagauagaagaugaggaccagauccucgaaaacuccucacagaaagagaauguguucaagugcgacagucugaaagaggaauguauuccugagcauaugguccgcggaagcaagaucauggaagcugagucccagaaggcaacuagagaaugcgagaaaucugcccugaccccaggcuuuagcgauaacgcuauuauguuauucucacccgacuuuacacucaggaacacccugaagaguacuuccgaggauagccuuguuaaacaagaauguaucaaggaggugguagaaaaacgggaggccugccacugugaagaggugaagaugacagucgcgucugaggcaaagauacaguugucagacagugaagccaaaagccauuccucugcugaugacgccucggcauggagcaauauucaggaggcuccucugcaggaugacuccugccuaaacaaugauaucccacacucaauuccccucgaacaagguaguucuugcaacgggccgggacagaccacgggccauccuuauuaccugcgcagcuuccuugugguucugaagacuguguuggagaaugaagacgauaugcuccuguuugacgagcaggagaaaggcaucgucaccaaguucuaucaauuauccgccacagggcagaaacuguacgugcgacucuuucagagaaaacuuucauggaucaagaugacuaaacuggaauaugaggaaauugcguuggaccuaacccccguaauagaggagcugacaaacgccggauuccuccagaccgaaagcgagcugcaagaacuuucugagguucuggaauugcucuccgcaccagagcugaagaguuuagcuaaaacguuucaccuggugaauccuaacggucagaagcagcagcuagucgaugccuuccucaaacuggcuaagcaaaggagcguguguacuuggggcaaaaauaagcccgggaucggagccgucauucuuaagcgguucugcugguugcugcuccaguga

SEQ ID NO: 56110 - RNA, 4368 nt, Artificial Sequence
  derived and/or modified sequence opt3 from FANCA__Homo_sapiens__NP_000126
augagcgacuccugggugcccaacucugccucaggccaggauccugggggaagaaggcgggcuugggcagagcugcucgccggucgcgucaagcgagaaaaauacaauccagagcgugcgcaaaagcugaaagaaagugcuguuagacuguugaggagccaccaggacuuaaacgcccugcuacucgagguggaaggcccgcugugcaagaaacuuucccugucuaagguaaucgauugugacucgucagaggcauaugccaaucauagcaguuccuucauugggucugcuuugcaggaucaggcaagccggcucggagugcccgucggcauacuguccgccgguaugguggcuucaaguguugggcaaaucugcaccgccccugcggagacaagccacccagugcugcucacugucgaacagcgcaagaaauuaucuucccugcuugaguuugcacaguacuugcuggcccauucaauguucagcagacuaaguuuuugucaggaacucuggaagauucaaucuucccugcuucuggaggcuguguggcacuugcauguacagggaaucguuagccuccaggagcuguuagaaucgcaccccgacaugcacgccgugggcucuuggcuguucaggaaccucugcugucuuugcgagcagauggaagcauccugucaacaugcugaugucgcccgggcgaugcugucagacuuugugcagauguucguguugcgcggcuuucagaaaaauagugaucuacgaagaacggucgagccugaaaagaugccacaaguuaccguggacguacugcagaggaugcucauuuucgcccuggaugcacuugcugccggggugcaggaggagagcuccacacacaaaaucguccggugcugguuuggaguguucucuggucauacucugggcagcguuauaucaaccgaccccuugaagagauuuuucagucacacacucacccagauccugacucacuccccuguguuaaaggcuagcgaugccguccaaaugcagcgcgaauggucuuuugcaagaacacauccacugcuaaccucacucuauaggcggcuguucgugaugcuuagugccgaggaauugguagggcaucugcaggagguucucgaaacgcaggaggugcacuggcaacgaguccugagcuucguguccgcucuugucguguguuuuccggaggcgcagcagcuguuggaagacuggguugcacgccucauggcccaggcuuucgagucuugccaacuggacucgauggugacugccuuuuuaguagucagacaggcagcccuggaaggacccagcgcuuuccuauccuacgccgauugguuuaaagcaucauucggcaguaccagggguuaucacggguguucuaagaaagcgcucguguuucuguucacauuucuuagcgaguugguuccuuucgaauccccacgguaccuucaggugcauauucuccacccaccucuggucccaggaaaguaucgcucauuacugacugacuacaucagccuugcuaaaaccagauuggccgaucucaaggugucuauugagaacaugggccuguacgaggaccuauccagugcaggcgauaucacagaaccccacagccaggcccugcaagacguagagaaagcuauaaugguguuugaacauaccgggaauauuccgguuacggucauggaggccucuaucuucaggcguccuuauuacgugucccacuuucuccccgcacugcuuacuccacggguguugccuaagguccccgauucacgaguugcuuucauugagagucugaagagagccgacaaaaucccacccagcuuauauucgacauacugccaggcgugcuccgccgcugaagagaagccugaagaugcagcccucggagugagggcugagccaaacucugccgaggaaccgcugggucagcuuaccgcagcgcugggcgaguugcgcgccagcaugacugaccccucacaacgggaugugaucagugcucagguagccgucauuuccgaaagacucagggcagugcuggggcauaaugaggacgacucuagcguugaaauauccaaaauccagcuaucaauuaacacaccucgccuggagccacgagaacacauggcuguggaucuccugcuuaccagcuucugucagaauuugauggccgcaaguucugucgcucccccugagcggcaaggaccaugggcugcgcuguuugugcguacgaugugcggcagaguuuuacccgccgugcucaccaggcugugucagcuucugcgccaccaggguccgucccuaagcgcaccucauguacucgggcuggcugccuuggccguccaccugggcgagucgcggucagcuuuaccagaaguggacgugggacccccugcacccggcgccgggcucccagucccugcgcuguucgauucucuucugacaugcagaacuagggacaguuuguuuuucugucucaaguuuugcaccgcugccaucuccuauagccuguguaaauucucuagccagucccgagauacacuaugcucaugucugagucccggacuuauaaagaaguuucaauuccucauguuucgccuguucagcgaggcacggcagccauugucugaagaggacguugccucccugucauggagaccguuacaucucccuagugcugauuggcagagggcagcccugagccuuuggacucaccguaccuuucgcgaagugcugaaagaggaggacguacauuugacauaccaggauuggcuccaccuggaacuagagauucaacccgaagcggacgcucuguccgauaccgagcggcaggacuuccaccagugggccauccaugagcacuuucuuccagaaucuucggcaagcgguggcugcgauggggaccuccaagccgcuuguacuauccuggugaacgccuugauggacuuccaucagucauccagaaguuaugaucacucugagaauagcgacuuagucuucggaggcaggacggguaacgaagauauuaucucccgacugcaggagaugguggcagaccucgaacugcagcaagaucuuauuguuccccuggggcauacaccuucacaggagcacuuuuuguucgagauauuucggcgcagacuacaggcucugaccucuggcuggagcguggccgcgagucuccagaggcaacgggaacugcuuauguacaagcgaaucuuacugagacucccauccagcgucuugugcggaucuucauuccaggccgagcagcccauuacugcacgcugcgaacaguuuuuccaccugguuaauuccgagaugaggaacuuuuguagucauggcggggcucucacccaagacaucacagcccacuucuuucguggacugcuuaacgcuugccugcggagcagagauccuucguugaugguggacuucauccuagcaaaaugucagaccaagugcccgcugauucucacuucugccuuagugugguggccaucccuggaacccguccuucuguguagguggcgccgacauugccagagcccucucccaagagaguugcagaaacugcaagagggucggcaguuugccucagauuuccucagucccgaagcugcgucuccugcaccgaaucccgacuggcuguccgccgcugcccuucacuucgcaauacagcaaguaagggaggaaaacauccgcaagcagcuaaagaaacuggauugugagcgugaagaguuguuaguguuucuguucuuuuucagccucaugggccugcuuucaagucaccugacaagcaauuccacgaccgaccucccaaaggccuuucauguuugcgcugcgauuuuggagugucuggaaaaacguaagaucucuuggcuagcccuguuccagcucacugagagcgaucuucggcuggggagguuauugcugcgcguggcaccugaccagcacacacgacuccugcccuuugcuuucuacucccuucugucauauuuucaugaagacgccgcaauuagagaggaggccuuccuccacgucgcuguggauauguacuugaaacugguacaauuauuuguggccggagacaccucuacagucagucccccugcgggccggucgcuagaacugaagggucaggggaaccccguugagcucaucacuaaggcaaggcuuuuccuguugcagcugauaccacgcugcccgaaaaagagcuuuucccauguggccgaacuccuggcugauagaggcgacugugauccugaggugucugccgcccuucagucaaggcaacaggcagcccccgacgcugaucucagccaggaaccacaccuguucuga

SEQ ID NO: 56111 - RNA, 2580 nt, Artificial Sequence
  derived and/or modified sequence opt3 from FANCB__Homo_sapiens__NP_001018123
augaccagcaagcaggccauguccucuaacgagcaagaaagacugcucugcuacaauggcgaggugcuugucuuccagcugucaaaagggaacuuugcugacaaggaacccacaaaaacuccuaucuugcacguuaggcggaugguguucgaucgcggaacgaagguauuugugcagaaaaguaccgguuucuuuacaauuaaggaggaaaauagccauuuaaagauaauguguugcaacugugucuccgacuuccgaacuggcaucaaucugccauauauugugaucgagaaaaacaagaaaaauaacguuuuugaguacuuccuacucauucugcacucuaccaauaaguuugaaaugcgucuuucguucaaacugggguaugagaugaaggauggauugagagugcucaacggcccgcugauccuguggaggcaugucaaggcauuuuucuuuauaucaagccagacagguaaagugguaaguguuuccgggaauuucucuagcauccaaugggccggagaaauugagaaccucggcaugguguuacugggccuuaaggagugcuguuuguccgaagaggaaugcacccaggagcccucaaaaagugacuacgcgaucuggaauacuaaguucugugucuauagccuggaaucucaggaggugcuauccgauauuuacaucauaccuccagcuuauucaagcguggucacauacguucacauuugcgccaccgagaucauuaaaaaccagcuccggaucagucugaucgcacuuacgcgcaagaaucaacugauuucuuuucagaacgggacucccaaaaacgugugucaguugccuuucggagacccaugcgccguacagcucauggauuccgguggcgggaaucuguuuuucguggucagcuuuauaucgaacaaugcuugugcaguguggaaggaaucuuuccaaguugccgcuaagugggagaaauuaucccuggugcucaucgacgauuuuauuggaucaggcaccgaacagguccuucuguuguucaaggacagucuaaacagcgauugccugacauccuuuaaaaucacugaccucgguaagauaaauuacucuagcgagcccucagauugcaacgaagacgaccuguucgaggauaaacaggagaauagauaucuugugguaccuccacuggaaaccggguugaagguuuguuuuaguuccuucagggagcuccggcaacaucuguuacugaaggagaaaauuaucagcaagucuuacaaagcccuaaucaaccucgugcagggaaaggacgauaauacaucaagugcggaagaaaaagagugccuggucccgcuuuguggcgaggaagagaacagcgugcacauuuuggacgaaaagcuguccgauaauuuucaggacucugagcagcucgucgagaagaucugguaucgcgugauugaugacucgcugguugugggcguaaaaaccacgagcucccuuaagcugucauugaacgaugucacucucagucuguuaauggaccaagcacacgauucucgauucagacugcuaaaaugccagaauagggugauaaagcucagcacaaaccccuucccugccccauaccugaugcccugugaaaucgggcuugaggcuaaacggguuaccuugacuccugacuccaagaaggaagagucauuugugugcgaacauccaagcaaaaaggaguguguccagauuaucacagccgugaccucucugaguccccuccugacguucuccaaauuuugcuguaccguauuacugcagaucauggagcgugaaagcggaaauugcccgaaggaccgcuaugugguuugugguagagucuuccuuucuuuggaggaucucuccacaggcaaauaccugcuaacuuuuccuaagaaaaagcccauugaacacauggaggaccuguucgcacuccuggcugccuuucauaagucaugcuuccaaauaaccaguccaggguaugcgcuuaacagcaugaaagugugguugcuggaacacaugaagugcgagaucauuaaagaguuuccugaaguguacuucugugagaggcccggaucguuuuacggcacauuauucacuuggaagcagcggaccccauuugaagguauccucauuaucuauucccgaaaccagacagucauguuccagugccugcacaaucuuauacgcauccugcccauuaacuguuucuugaaaaaucucaagucugggagcgagaacuuucugaucgauaauauggccuucacccuagaaaaggagcugguuacucucucaagucuguccucugcaauugcuaaacaugagagcaacuuuaugcaaagaugcgaaguguccaagggcaaaucaagcgugguagccgcugcccuuagugacaggcgggagaauauccacccuuaccgcaaggaauugcagagagagaaaaagaagaugcugcagacgaacuuaaaagucucuggagcacucuauagggagauaacacugaagguggccgaaguucagcuuaaauccgauuucgcugcgcaaaagcugagcaaucuauga

SEQ ID NO: 56112 - RNA, 1677 nt, Artificial Sequence
  derived and/or modified sequence opt3 from FANCC__Homo_sapiens__NP_001230672
auggcccaggacagcguggaucuguccugcgacuaccaauucuggaugcagaagcucucugucugggaucaggcuucaacccuugagacacagcaagacacuugucugcacguugcacaguuucaggaguucuugagaaaaauguaugaagccuuaaaggaaauggauaguaacacggugaucgagagguuucccaccauuggccagcugcuagcgaaagccugcuggaauccuuucauacucgcuuacgacgaaagccaaaagauccugauuuggugucuuugcugucugaucaacaaagagccacaaaauuccgggcagucuaaguugaacucguggauucagggaguacucucacauauccugagcgcacugcgguuugauaaggagguggcccucuucacacaggguuuaggcuaugcuccgauagacuacuaucccgggcugcuuaaaaauauggucuugagucuggcauccgaacuacgcgagaaccaccucaauggauuuaacacucagcgacguauggccccugaaagaguggcuucucugagcaggguuugcgugccacuuaucacccugacagaugucgaccccuugguggaggcccuccugauuugucauggccgggagccucaggaaaucuuacaaccagaguucuuugaagcgguaaaugaggcaauucugcucaagaaaaucucccuucccaugucagccguugugugccugugguugcgccaccuaccuagucuggaaaaggcuaugcuccaucuguucgagaaacuuauaagcucugagagaaacugucugaggcggauugaaugcuuuaucaaggauuccucauugccacaggccgcaugucacccggcuauuuuccgcgucguggacgagauguuucgaugcgcccuccuggaaaccgauggugcguuagagaucaucgccacuauucagguguucacacagugcuucgucgaagcacuggagaaggcuagcaaacaacuaagauuugcccucaagaccuacuuccccuauacgaguccuucucuggcuaugguucuuuugcaggacccacaggacauacccagggggcacuggcugcagacucucaaacauaucuccgagcugcuucgggaagccguggaggaucaaacccacggaagcuguggcggcccuuuugaaucgugguuccuguuuauucauuucgggggaugggcagagaugguagccgaacaguugcucaugucugcugcggagccacccacagcacuguuauggcugcuagccuuuuacuacgguccgcgugacggccgccagcagagagcucaaacuauggugcaggucaaggccgugcucgggcaucugcuugcaauguccaggucaaguagcuuguccgcccaggaucugcagaccguugcuggacaaggcacagacaccgaucuccgggccccugcacagcagcugauccgacacuuacugcuuaauuucuugcucugggcgcccggugggcacacgauagcuugggacgugauuacucugauggcccacacagcagagaucacccaugaaaucauuggauuucuagaucaaacucuguaucgcuggaacagacucggcaucgagucuccaaggagcgaaaaacuggcccgggagcuuuugaaggagcugcgcacacaggucuga

SEQ ID NO: 56113 - RNA, 4356 nt, Artificial Sequence
  derived and/or modified sequence opt3 from FANCD2__Homo_sapiens__NP_001018125
auggugagcaagagaaggcuguccaaaucugaggacaaggaaucacucaccgaggaugccaguaaaacacggaagcagccccuuagcaaaaagacuaagaaaucccacaucgcuaacgaagucgaggaaaaugacucuauuuucguuaagcuguugaaaauaucgggcaucauuuuaaagacgggggagucacaaaaccagcuggcaguggaucagaucgccuuucagaaaaagcuauuccaaacccuccgccgacauccuagcuacccaaagauuaucgaggaauuuguaaguggacuggaguccuauauagaagacgaggauucuuuccguaauugccuucugagcugugagagauugcaggacgaagaggcguccaugggugcuucauacaguaaaagccucaucaagcugcugcucggcauugauaucuuacagccggccauuaucaaaacacuguuugaaaaacuucccgaguauuucuuugaaaacaaaaauucugacgagauaaacauuccuagguugaucgugucccagcugaaguggcuagaucgggucguggacgggaaagaucucacuaccaagauuaugcaacugaucucaaucgcaccagagaaucuucagcacgacauuauaacaagccugcccgaaaucuugggagauagucagcaugccgacguuggcaaggagcucucugaccuguuaauugaaaacaccucccugacugugccuauccucgauguccuuagcucgcugcgcuuggacccaaauuuccuacugaaagugagacagcucguaauggauaagcugucuuccauaaggcuugaggaccugcccguuauuaucaaauuuaucuugcacucagugacagcuauggauacccucgaagucauuagugagcugcgggagaaguuagaccugcaacauugcgugcuaccuagccgccuccaggcaucccaggugaaacugaagucuaagggucgagccagcucaagugggaaccaagaauccagcggacagucuuguaucauucuuuuguucgaugucauaaaaucagcuaucagauacgagaagacgauuagugaagccuggaucaaagcgaucgagaauacugcaagcguuuccgaacacaagguguuugaccugguaaugcuguucauuauauauucuaccaacacacagacuaaaaaguacaucgauagggugcugcggaauaagauucguucgggcugcauccaggagcaacuucugcagagcaccuuuuccguccacuauuuggugcucaaagacauguguucaaguauucugucuuuagcccagagccugcuacauucccucgaucagucaaucaucagcuucggcucucugcuuuacaaguacgcuuucaaauuuuucgacacauauugccaacaggagguugugggggccuuggucacccacauauguuccggaaacgaagcagagguggacacggcucuggauguacuccuggaauuaguugugcugaauccaagugccaugaugaugaacgcggucuuugugaaggguauucuugacuacuuggauaacaucagcccgcagcagauucgcaaacucuucuauguccugucuacucuagccuuuuccaagcaaaaugaggcaucaagucauauccaggacgauaugcaccuggugauaagaaagcagcucagcucgacaguuuucaaauacaagcugauuggcaucauuggggcugugaccauggccggaaucauggcugccgacagguccgagucucccagccuuacucaggaacgggcaaacuugucagaugagcaaugcacacagguaaccagucuguuacagcucguccacuccuguucugaacaaagcccucaggccuccgcucuguauuacgacgaguuugcgaaucuuauacagcaugaaaaacuggauccaaaggcauuggagugggugggccacacgaucugcaacgacuuccaggaugccuuuguuguggacucaugugucgugcccgagggugauuucccuuuuccaguaaaagcucucuaugggcuggaagaguacgacacccaagacggaauugccaucaaucuacugccccuccuguucagccaggauuuugcaaaggacggcggcccggugacaagucaggaaucugggcagaaacuuguuuccccuuugugccuggcccccuacuuccgauuacuccgccugugcgucgagagacaacauaacggaaaucuugaagagauugauggucugcuagacuguccaaucuuccucacugaucuggagccuggcgaaaaguuggagagcaugucggcuaaggaaaggucauuuaugugcucucugauauucuuaacccucaacugguuucgggagauugugaaugccuucugucaggaaacaagucccgagaugaaagggaaggugcugacucgccuuaaacacaucgucgagcugcagaucauuuuggaaaaguaucucgcaguuaccccagacuacgugcccccucugggaaacuuugauguggagacacuagacaucaccccacauacuguaacggcgauuuccgcuaaaauaagaaagaagggcaaaaucgaaaggaagcagaaaacagaugguagcaagaccucuagcuccgacacucugucagaggagaaaaauagugaaugcgauccgacccccagccaccgugggcaacuuaacaaggaguucacaggcaaggaagagaaaaccucucuccuguugcacaauucccaugccuuuuuccgggaacuggacauugaggucuuuucaaucuuacacuguggacucgugacuaaguucauucuggauacagagaugcauacggaagcaaccgagguugugcagcuuggcccuccagaacuguuguuucuccuggaggaccuaagucagaaacuggaaagcaugcuuacucccccuaucgcccgaagagucccauuccucaagaacaaaggguccaggaauauaggauuuucucaccuccaacagcgcucggcucaggagaucgugcacugcguuuuccaguuguuaacacccauguguaaccaucuggagaacauucacaauuauuuccaaugccucgccgcagaaaaccauggugugguagacggcccgggggucaaggugcaggaguaccacaucaugagcucauguuaucagcggcugcuucagauuuuucauggacuguucgcuugguccggcuuuagucaaccugaaaaucagaacuugcuauacucugcccugcacgugcucagcuccagacugaagcagggugagcacucacagccacuugaagaguuacugucucaaagcguccauuaucuccagaauuuccaccagaguauccccuccuuucagugcgcguuguaccugauaaggcuccugaugguuauucuugagaaaagcaccgccucugcucaaaacaaggaaaagaucgcaucacuggcccgccaguucuugugucgaguguggccuuccggggauaaggagaaaaguaauaucagcaacgaccagcuacaugcucugcucugcauuuacuuagaacacacagagucgauacugaaggccaucgaggaaauugcaggcguaggagugcccgagcuuaucaauucuccaaaagaugcguccagcucaacuuuuccuacccugacgcggcauaccuucgucguguuuuuccguguuaugauggccgaacucgagaagacagugaagaaaauugaacccggcacugcugccgacagucaacagauccacgaggagaaguugcuguauuggaacauggcagucagagauuuuucuauacucaucaaucugauuaaaguguucgacucccacccaguucuucaugugugccuaaaguacgggaggcuguucgucgaagccuuuuugaaacaguguaugccguuacuggauuucagcuuucgcaagcaccgggaggacguacucucacugcuugaaaccuuccagcuggauacaagacucuugcaucaccugugcggacacaguaagauccaucaagacacuaggcuaacccagcacgugccucugcucaaaaagacgcuugagcuguuaguuugucgagugaaagcuauguugacacugaacaauugccgcgaagcauuuuggcucgguaaccugaagaaucgggaucuucagggcgaggagauuaaaagccagaacucccaagaaucuaccgccgacgagagcgaagacgauauguccucacaggcuucuaagaguaaggcgacugaggacggggaagaggaugaggucucggccggagaaaaagagcaggacagcgaugaauccuaugacgauucugacuga

SEQ ID NO: 56114 - RNA, 1611 nt, Artificial Sequence
  derived and/or modified sequence opt3 from FANCE__Homo_sapiens__NP_068741
auggccacccccgacgcuggccugccuggggcagagggaguggaaccagccccgugggcgcagcucgaggcucccgccagacuucuguugcaagcauuacaggccgguccugaaggcgcuaggcgggggcugggaguccuacgcgcacucggcagccgagguugggagccauucgauugggggcgucugcuugaagcccugugcagagaggagcccguugugcagggaccugacggcagguuggaacucaagccacugcugcuccgguuaccccgcaucugucagagaaaccugaugucccuuuugauggcuguaaggccuucucugccagagucaggccuacucagugugcugcaaauugcccagcaggaucuugcgccggaccccgaugcauggcugcgggccuugggggaacuccugcgccgagacuuaggagucgguacaagcauggagggcgcuuccccucugucugagagaugccagaggcaacuccagucgcuuugucgggggcugggauugggcggucgucgccuaaaaucaccacaggcccccgauccugaagaggaagagaauagagacagccagcaaccagggaagaggcggaaagauagugaagaggaggcagcuucccccgaaggaaagcgagugccgaaacgccugagaugcugggaggaagaggaagaccacgagaaggagaggccugaacauaagucucucgagagccuggccgauggcggcuccgcgucacccauaaaagaccagccaguuauggccgugaagacuggggaagauggaaguaaccuugacgacgcaaaaggucuggcugagagcuuggaacucccuaaggccauccaggaucaacugccccgguuacagcagcugcuaaaaacgcucgaggagggccuggaagggcuugaggacgcuccacccgucgaauugcagcugcuccacgaguguucuccuucccaaauggaucugcuuugcgcccagcugcaguugccacagcucucagaccugggauuacugcgccuauguaccuggcuccuggcacuuagcccggauuugagucugucuaaugccacagugcucacuagaucccuguuuuuaggcaggauucugagccuuaccucgucugcuucccguuugcucacaaccgcgcugacuucauucugcgcaaaguacacauaucccguauguagugcccuacuggacccuguucuccaagcuccagguaccgggcccgcccagacggagcugcuuugcuguuuggugaagauggaaagccuggagccugaugcacaggucuuaaugcucggccagauccuggaacuuccauggaaagaggaaacuuuucugguguugcaaucccuccuggagcgacagguggagaugacccccgaaaaguucucuguccuaauggagaaacugugcaagaaaggacucgccgcuacaacuagcauggccuacgcaaagcugaugcuuaccguuaugacaaaauaucaggcgaacauuaccgaaacgcagcgguugggccuggcuauggccuuagagccgaauacuacauuucucagaaagucacugaaggcagcccuuaaacaucuggggccuuga

SEQ ID NO: 56115 - RNA, 1125 nt, Artificial Sequence
  derived and/or modified sequence opt3 from FANCF__Homo_sapiens__NP_073562
auggagagccugcuccagcaccuugacagguucuccgaacuguuggccgugucuucaaccacauacgucaguacuugggaucccgcuacgguuaggcgggcauuacaaugggcccgcuaucugcgacauauccaccguagauuuggcaggcaugggccuauucggaccgcgcuagagcgcagacuccacaaccaguggaggcaggaaggagguuucggccgggggccagugccgggacuggcuaauuuucaggcccuuggccauugcgacguacuguugagccuccgccugcuggagaaccgagcacucggugaugccgcuagauaccacuuagugcaacagcuguuccccgggccuggagucagggacgcagaugaagagacacuucaggaguccuuggcccggcuggcucgucgcagaucugccgugcacaugcuaagguuuaauggcuaucgggaaaacccaaaucuccaggaggacucgcugaugaagacucaagcggaacuucuguuggagcgacuccaggagguuggcaaagcagaagccgagcgccccgcuagauuccugucaagccuuugggaaaggcugccucagaacaauuuucucaaggugauagccgucgcacuucugcagccacccuugagucggcgcccucaagaggaacuagagccagggauccauaaauccccgggagaggguucucaggugcugguacacuggcuccugggcaacagcgaaguuuucgcugccuuuuguagagcgcuucccgccgggcuguugacccucgugacauccaggcauccugcacugucaccagucuacuuaggacugcuaaccgauuggggccagcgucuccacuaugaccugcaaaaggguauuuggguggggacugagagucaggaugugcccugggaagaguuacacaaucgguuccagagcuugugccaggcuccuccaccccugaaagacaagguccucacagcccuggaaaccuguaaggcucaagauggagacuuugagguuccgggccuuucuaucuggacggaucuguugcucgcccugcgauccggcgcauucagaaaaagacagguguuagggcugucagccggacuaagcaguguauga

SEQ ID NO: 56116 - RNA, 1869 nt, Artificial Sequence
  derived and/or modified sequence opt3 from FANCG__Homo_sapiens__NP_004620
augagcagacagaccacauccguggggucuucaugccuggaccucuggagggaaaagaacgaucggcuuguccgccaagccaaaguugcucagaauaguggccugacuuugcgacgucagcaguuagcacaagacgcccuggaaggacuaagaggucuccugcacagccuucagggccugcccgcggcugugccuguauugccacucgagcugacggugaccuguaacuucaucauucugagggccucccucgcacagggguuuacagaagaucaggcccaagacauacagcggucuuuagagcgcguccuggaaacucaggagcagcaaggaccgagacuugagcagggcuugagggaacugugggauucggugcuacgggcuucaugccuccugcccgagcuucugagcgcauugcaucgccucguuggucugcaggccgcuuuauggcugagugccgaccgacucggggaucuugcgcuguugcuagaaacccugaauggaucccaaucuggcgcaagcaaggaccuccugcuucuguugaaaacaugguccccuccagccgaggagcucgaugcuccccugaccuuacaggacgcccagggccugaaggaugugcuacucacugcauucgcuuacagacaggggcugcaagaacuuaucacaggaaacccugacaaagccuugucaagucugcacgaggcggccagcggucucuguccaaggcccguccuggugcagguauauaccgcacuuggcucuugccaucggaagauggggaauccucagcgugcucuguuguaccucguugccgcucugaaggaaggauccgccuggggcccaccguuacuggaggcaucacgccuauaucagcaacucggugauacgacugccgaacuggagagccuugaguugcugguggaagcucucaacguccccuguaguucuaaagcgccucaguuucugauugagguggaauuacugcuuccacccccugacuuggcauccccacuccacugcgggacccagagccagacaaagcauauccuggccucgagaugucuacaaacuggaagggcuggcgacgccgcagagcacuaccuggaucuccuggcccuuuugcuggacucuuccgaaccccgguucucaccgccucccaguccaccuggccccugcaugccagagguguuuuuagaggcugccgucgcacucauucaggcggggcgagcucaggaugcccugacccuuugugaagaacuguugagccgcacauccucucuccugcccaaaaugagcagacuaugggaagacgcaaggaagggaaccaaagagcugccuuauugcccacucuggguuucagccacgcaucugcuucagggucaggcuugggugcaauugggcgcccagaagguagcaaucagugaguucucccggugucuggaguuacucuuucgcgcuacuccggaggaaaaggagcaaggggccgcguucaauugcgaacagggaugcaaaagcgaugccgcucugcagcagcuuagagcagccgcucugauaucuaggggccuagaguggguggccucaggucaagacacaaaggcacuccaggauuuucuguugaguguccagaugugucccgggaaccgugacaccuacuuccaccuguuacagacucucaaacggcuggaucgaagagacgaggcgacagcccuuugguggaggcuggaagcucaaaccaagggcagccacgaggaugccuuguggucccucccucuguaucuagaaucuuaccugucguggauccgcccaagcgaccgggacgcauuucuugaggaguucagaacgucccuccccaaaucaugcgaucuguga

SEQ ID NO: 56117 - RNA, 3987 nt, Artificial Sequence
  derived and/or modified sequence opt3 from FANCI__Homo_sapiens__NP_001106849
auggaccagaagauccugagccucgccgcugagaaaaccgcagauaaguugcaagaauuucugcagacauugagagagggcgacuuaacuaaccugcuacagaaucaggccgugaaagggaaggucgcgggagcucuccugagggccauuuuuaaagguucccccugcucugaagaggcaggcacgcuucggcgccgaaagauauacaccuguugcauccaacugguugaaucaggggauuugcagaaggagauugccagugagaucauuggacuccugaugcuggaagcucaccauuucccuggcccacucuuaguggagcuggcaaacgaauuuaucagcgccguacgugaggguucccuugugaaugggaaaucuuuggagcugcuaccgauaauccucacagcucuggccacuaagaaagaaaaccuugcguauggaaagggcguccugucgggcgaggaauguaaaaagcaguugauuaauacccucugcucagggagaugggaccagcaauacgugauccagcugacaagcauguucaaggauguucccuuaaccgcagaggaaguggaguuugucguggagaaagcccugaguauguucuccaagaugaaccuccaggaaauuccuccacuuguauaucagcuguugguucuaucuagcaaaggauccaggaagucagugcuggaggguaucauagcuuucuucagugcccucgacaaacaacacaaugaagaacagagcggcgaugaacugcuugacgucgugacugugcccucuggggagcugcggcaugucgagggaacaauuaucuugcacauuguuuuugcaaucaagcucgauuacgaacugggccgcgaguuagugaaacaucugaagguaggucagcaaggggacuccaacaauaaccuaucaccuuucagcaucgcucuccugcuuagugugaccaggauucagagauuucaggaucaggucuuggaccugcucaagacgucugugguuaaauccuucaaggaucugcaacuucugcagggaagcaaauuuuugcagaaucucgugccacaccggucguaugucucuacuaugauacuggaagugguaaagaacuccguucacucaugggaccaugugacccagggcuuagucgagcugggcuucauccuaauggacaguuacgggcccaaaaaggugcucgauggaaagacaauugaaacuagcccuucccugucucgcaugccaaaucaacacgccuguaaacuuggugcgaacaucuugcuggagaccuucaagauacaugagaugauucgacaggaaauccucgagcagguccugaauagagugguuacaagggccagcucaccgaucagucacuuuuuagaccugcuuuccaacauugugauguaugcacccuugguacuccagagcuguucuucaaaagucaccgaggcuuucgauuaccugaguuuucuaccucugcaaacggugcagcggcuccugaaggccguucagccacuuuugaaagugagcauguccaugcgugacugccugaucuuaguccuccgcaaggcuauguucgccaaccagcuggaugcaagaaagucugccguggcuggcuuucuucuguugcucaaaaauuucaagguacuggggucgcuaagcuccucacaaugcagucagucucugagcgugucccagguucacgucgacgugcauucacacuacaacagcguggcgaaugagacuuuuugucucgagauuauggauucucugaggcggugccuuucccaacaggcagacguccgauugaugcuguaugaaggauucuacgauguuuuacgcagaaacagucagcucgccaauagcgugaugcagacacugcuuucucaacugaaacaguuuuaugagcccaagccugaccuacucccaccccugaaauuggaggcuuguauacugacccagggcgauaagaucuccuuacaggaaccgcucgacuaccugcuuugcugcauucaacauugucuggccugguauaagaacacugugaucccuuugcagcagggugaagaggaggaagaggaagaggaagcauucuacgaggaccucgaugacauccuggagucaauuacaaauaggaugauaaaaagugaacuagaggauuuugaacuggacaagagcgccgauuucucgcaguccaccucuaucgggauuaaaaacaauaucugcgcuuuucuuguaaugggcgucugugaggugcucauugaauauaacuucagcaucucaaguuucuccaagaaucgguuugaggacauacugucuuuguucaugugcuacaaaaagcugagcgauaucuuaaacgagaaagccggaaaggcaaagacgaaaauggcgaauaagaccuccgacucacuccugagcaugaaauuuguuaguucucuucugacagcuuuguuccgcgauuccauucaaagccaccaggaaucgcucucagugcugagaucuaguaacgaguuuaugagguacgccgucaauguggcacuacagaagguucaacagcugaaagaaacuggccauguguccgggcccgacggacagaacccagagaagaucuuccagaaccuuugugauauuacccguguacuccuguggcgguauacaagcaucccuacuucugucgaggaaagcgguaagaaagagaagggcaaauccauaucauuguuaugccuggaagggcuccaaaagauuuuuagugccgugcagcaguucuaccagcccaaaauccaacaguuucugcgagcucuugacgugaccgauaaggagggagaagagagagaggacgccgacgucagcguuacacagaggaccgcauuccagauucgccaauuucagcggucucuguugaaucuacuguccucacaggaagaggauuucaacaguaaggaagcucuccugcuugugacuguauuaacgagccuguccaaacucuuggagccaucuucgccccaguuugugcaaaugcugagcuggacaucaaagaucuguaaagaaaauuccagagaggacgcccucuucugcaagagucugaugaaccuucuguucucuuugcacgucagcuauaaauccccugugauacuacugagggaucucucacaggacauccacggccauuuaggugauauugaccaggauguugagguggaaaagaccaaucacuuugcgaucgucaaccugcgcacugccgcuccaaccgugugucuucugguucucucucaagcagagaagguguuggaagaggucgacuggcugauuacaaaacucaaggggcagguaagccaggaaacccugagugaggaggccuccagccaggcuacucuuccgaaucaacccguggaaaaagccaucauaaugcagcuaggcacacuguugacguucuuucaugaguuaguucagaccgcacugccuucuggaucaugcguggauacucuccugaaggaccuuuguaaaauguacacaacccugacagcgcucguccgauauuaccuucaggugugccaauccaguggcgggauuccaaagaacauggaaaaacugguaaagcuaagcggaucgcaccugacuccccucugcuauucuuucaucuccuacgugcagaauaagagcaaaucacuuaacuacaccggugagaagaaagagaagccugccgcugucgccacggcaauggcucggguucugcgugaaaccaaaccaauccccaauuuaauuuuugccaucgagcaguaugaaaaguucuugauucaccugaguaagaaaucuaaggugaaccucaugcagcauaugaaacuguccacaagcagagauuuuaagauaaaaggcaauauccuugacauggugcugagggaggauggggaagacgagaacgaggaaggaacugcaucagagcacggcggucaaaauaaggaaccggccaagaaaaagcgcaaaaaguga

SEQ ID NO: 56118 - RNA, 1143 nt, Artificial Sequence
  derived and/or modified sequence opt3 from FANCL__Homo_sapiens__NP_001108108
auggccgugaccgaggcuagccugcucagacagugcccccuucuguugccucaaaacagguccaagacagucuacgaaggcuucaucucugcacaggggcgggacuuucacuuacgcauuguucugccagaggaucuacagcucaaaaaugcccgacugcuuuguucauggcagcugcguacuauauugaguggauaucauagaaucgugcaacagaggaugcagcacagcccggaccucauguccuucaugauggaacugaagaugcugcucgagguagcgcuuaaaaaccggcaggaacuguacgcuuuacccccuccaccccaauuuuauucuucguugauugaggagaucgguacgcugggcugggauaagcuaguguacgccgauaccugcuucucaacaauuaaacucaaggcagaagacgccagcgggcgcgagcaucugaucacucuuaagcugaaagcuaaguauccugcagaaaguccagacuacuuugucgauuuccccgugccuuuuugugccuccuggaccccacagguuaauucuccgcagagcuccuugauaucaaucuauagucaguuccucgcugccauugagagccugaaagcguuuugggacgugauggaugagaucgacgaaaagacaugggucuuagagcccgaaaaaccuccaagaucugcaaccgccaggcggauugcucugggaaacaauguguccaucaacauagagguagauccccgccacccuacuaugcucccagaaugcuucuuucuuggcgccgaccauguugugaagccccuggguauuaaguugucacgaaauauccaccuaugggauccggagaacagcguccugcaaaaucucaaagacgugcuggagauugacuucccugcaagagcuauccuugaaaagagugauuuuacaauggacugugggaucugcuacgccuaccagcuggauggaaccauucccgaccaggugugugauaacucucaaugcggccagccauuccaccagauauguuuguaugaguggcucaggggccuguuaacgucccggcagagcuucaauaucauuuuuggggaaugcccuuacuguucgaaacccaucacucugaagaugucuggacguaaacauuga

SEQ ID NO: 56119 - RNA, 6147 nt, Artificial Sequence
  derived and/or modified sequence opt3 from FANCM__Homo_sapiens__NP_065988
augagcggcagacaaagaacccuguuccaaacauggggguccucuaucucacggaguagcggaacucccgguugcuccucuggcacggaacgcccucagucgccagggucaagcaaggccccgcuccccgcugcagccgaagcgcagcuugagagugacgaugacgugcuguuggucgcugccuacgaagcagagcgacaguuaugucuggaaaacggaggcuuuugcaccuccgccggugcuuuauggauuuauccuacaaauuguccaguucgugauuaccaacuccacauaucuagagcagcccuguucugcaacacucuugugugucugcccaccggguugggaaaaacauuuaucgcugccguggugauguauaauuucuacaggugguuuccuagcggcaaggucguguucauggcgccaaccaaaccccucguuacucagcagauugaggcaugcuaucaggugaugggcaucccucaaucccacauggccgagaugacagggucaacccaggcuaguacgcggaaggaaauuugguguagcaaacgcguccuguuucugacuccacaggugauggugaacgaccucucuagaggagccugcccggcagcugagaucaaguguuuaguuauagaugaagcccacaaggcgcuggguaauuacgccuauugccagguggucagggagcuugugaaauacaccaaccauuuccggaucuuggcacuguccgcuacacccggcucagacauuaaggccgugcaacaggucaucacuaaucuacucauugggcagaucgagcugcgcagcgaagauaguccugacauacuuaccuacucucacgagcgaaaaguugaaaagcugauugugccauugggagaggaacucgcugccauccagaaaacauauauucagauccuggaguccuuugcaaggagcuuaauccagaggaacguacugaugcggcgugauauucccaaucucaccaaguaccagauaauccuugcccgcgaccaauucagaaagaacccuucgccaaauauugugggcauccagcaggguauaauugagggggaauuugcuaucuguaucucucuguaucauggauacgaguugcuacagcaaaugggcaugaggucccuguauuucuuucucugcggcauuauggaugggacgaaaggaaugacucggucaaagaacgaacugggucgaaaugaggacuucaugaaacuuuacaaccaccuggaaugcauguucgcgcgcacaagaaguaccagcgcaaauggcaucuccgccauucagcagggggauaagaacaaaaaguuugucuauucucaccccaaauugaagaagcucgaggaggugguuauagaacauuucaaaagcuggaacgcugagaauacuacagaaaagaaaagggacgagacccgggugaugaucuuuucaaguuuccgcgacuccguccaggaaauugccgagaugcugagccaacaccagccgaucaucagagugaugacguuuguaggacaugcaucuggcaagucaaccaaagguuucacacagaaggagcaguuagaaguugugaagcaauuuagggaugggggcuacaacacucuggucaguaccugugugggagaggaaggccuagacauuggggaggucgaucucauaaucugcuucgacagccagaaauccccuauucgucuggugcagcggaugggacgaacagguagaaagaggcaaggccgcaucguuauuauccuuucugaggggcgggaagagagaauauacaaucagucgcagagcaacaaaagguccaucuauaaggccauuucaaguaaucgccagguguugcacuuuuaccaacgaucuccccggaugguaccagauggaaucaacccuaaacugcacaagauguucauuacucauggcgucuaugaacccgagaagccaagccguaaucuccagagaaaauccucaaucuuuagcuacagggacgguaugcgccagucuucccugaagaaagauugguuccuuagugaagaggaguuuaagcuguggaaccgguuguauagacucagggacagcgaugaaauaaaagagauuacccugccccaggugcaauucucuuccuuacagaaugaagagaacaagccugcucaggaaucaacaaccgggauccaccagcugagucuaagcgaguggcgacucuggcaagaccauccacugccgacucaccagguugaucauucggaccgcugucggcacuucauuggccuuaugcagaugaucgagggaaugagacacgaagagggcgaaugcuccuacgaguuggaaguggagucuuaucugcaaauggaggacgucacgagcacauuuauagcccccaggaaugaaucaaacaaucucgcaagugauaccuucaucacucauaagaaauccucuuuuauuaagaacaucaaucaggggagcuccucaagcgugauugagagugacgaagagugugcggagaucguaaaacagacccacauaaagccuacaaaaauugugucucugaagaaaaagguuuccaaggaaaucaaaaaggaucagcugaaaaaggagaacaaccauggaaucauugacagcgucgauaaugaccguaacucgaccguggaaaauaucuuccaagaggaucuaccaaacgacaaacgcacuucagauacagacgaaauugcugccacgugcaccauaaaugagaacgugaucaaggagcccuguguccuuuugacugaaugccaguuuacaaauaagucuaccaguucccucgcagguaacguucuggauagcggcuacaauucuuucaacgacgagaaaagcguguccucaaaucuauuucugccuuucgaagaggaacucuacauugugcggacagaugaccaguuuuauaacugucacagucugacuaaggagguacuugccaaugucgagagauucuugagcuacucuccacccccgcuguccggguuaucagaccucgaauaugagaucgcuaaaggaaccgcccuggaaaaccuucuguuuuugccuugcgcagagcaccucaggagugauaaguguacgugccugcuaagccauuccgcuguaaauucucagcaaaaccuggaacucaacucgcugaaaugcauuaauuacccaagcgagaagucaugucuuuaugacauccccaacgauaauauauccgacgagccuaguuugugcgauugugacguucacaagcauaaccagaaugaaaaccuggugcccaauaaccgaguccagauccaccggucuccagcccagaauuuagugggcgagaacaaucaugauguugacaacagcgaucucccugugcuguccaccgaccaagaugaaucacuucugcuauucgaggacguaaauacagaguuugaugacgucucucucagcccccugaacaguaaauccgagagcuugccagugucugacaagacugcgauuucagagaccccgcuggugucccaguucuuaaucagugaugaacuccugcuugacaauaacagcgagcugcaggaucagauuacacgcgacgccaacucguucaaaucuagagaucaaagggguguccaggaagagaagguuaaaaaucacgaggacaucuuugauugcucccgggacuuguucagcgugacuuuugaucucggguucuguucaccugacagugaugacgaaauacuggagcacaccucugacuccaaccgaccccuagaugaccuguacggcagauaucuugaaauuaaggagaucagcgaugcuaauuacguaucaaaccaggcacucaucccacgcgaccauaguaagaauuuuacgagcggaacagugauuauacccuccaacgaagauaugcaaaauccuaacuacguccaucugccauugucugccgcuaaaaaugaggagcuguuaagccccggcuauucccaguucucacucccugugcagaagaaaguuaugucuaccccgcugaguaagucgaacacucuuaauagcuuuuccaaaaucaggaaggaaauucugaaaacaccagacucuucaaaggagaaggugaacuugcagcguuucaaagaagcccucaauagcaccuuugauuacuccgaguucagucuggaaaagucuaaaagcucagggcccauguaucuacauaaguccugccacagugucgaggacggacaacugcuuacuagcaacgagucugaagaugacgagaucuuucggagaaaagugaagagggcaaagggcaauguucucaacuccccugaagaucagaaaaauucagagguggacagcccacugcaugcggucaagaaacgccgauuccccauuaacagaucggaguugucuaguuccgaugaaagcgagaacuucccuaagccguguucacaguuagaagacuuuaaaguaugcaaugguaacgcccggagggggaucaaggugcccaagcgccagucccaccugaaacacguugcucguaaguuccucgacgaugaggccgaacugucugaggaggacgcagaauacgugagcagugaugagaaugacgaauccgagaacgaacaagauagcucucuucuggacuuuuugaaugaugagacccagcuaucacaggcuauaaacgacagugagaugagagccaucuauaugaaaucccugcggagcccaaugaugaauaacaaguacaaaaugauucauaagacacacaagaauaucaacauuuucucucagaucccugaacaagaugagacguaucucgaagacucguuuugugucgaugaggaagagucaugcaaaggacagagcuccgaggaagagguguguguagacuucaaucugauaaccgaugacugcuuugcaaacaguaagaaauacaagacuaggcgcgccgugaugcuuaaagaaaugauggagcagaauugcgcucauucuaagaagaaauuaagccgaauuauccugcccgacgauuccucagaggaagagaacaaugucaacgacaagagagaaaguaacaucgcgguuaauccaucuacagugaaaaagaacaaacaacaggaucacugucucaauagcgugccuuccggcucaagcgcccagucuaagguccgguccacccccagggugaacccauuggcaaaacagaguaagcaaacaagccugaaucucaaggacacuauuucggagguuuccgauuucaaaccgcagaaccacaaugaaguacagucuaccacgccucccuuuacaaccguggacucacagaaggauugccgcaaauucccagucccccaaaaggacgguagcgcucuggaggauaguuccacuucuggcgccagcuguucaaaauccagaccucaucuugccgggacccacacaagucugagguugccacaggagggaaagggcacuugcauccuaguagggggacaugaaauaaccagcggccuggagguuauuucuucacuccgggcuauccacgguuuacagguggaagucuguccccugaacgggugcgacuacauuguguccaaucguaugguagucgagcgccgaagccagucugaaaugcuuaacagugugaauaagaacaaauuuaucgagcaaauacagcaucugcagucgauguucgagagaauuuguguuaucguggaaaaggauagggagaaaacaggagacacgucccggauguuucgcagaaccaagagcuaugacucacucuugacuacacugaucggcgcagguauuaggauccucuucucuagcugccaggaagagaccgccgaucugcuuaaagaacuaucccuggucgagcaacggaagaaugugggcauucacguuccuacuguggucaacaguaauaagucagaggcguugcaguucuacuuaucuauaccgaacaucagcuauauuacagcucugaacaugugucaccaguuuuccagugugaaacgaauggccaauagcucccuccaagaaaucucuauguacgcacagguaacccaucagaaggccgaggaaaucuauagauacauucacuauguguucgacauacagaugcugccaaacgaucuuaaucaagaccgccugaaaucagauaucuga

SEQ ID NO: 56120 - RNA, 1038 nt, Artificial Sequence
  derived and/or modified sequence opt3 from FANK1__Homo_sapiens__NP_660278
auggagccccagaagaucaugccuccaagcaaaccgcaucccccuguggucggcaagguuacccaccacuccauugaacuguacugggaccucgagaaaaaggccaaaagacaagggccacaggaacagugguucagguuuucuauagaggaagaggaucccaagaugcauacauauggaaucauuuacacugguuaugcuacgaagcacgugguagagggccuugaaccucggacccuguaccgcuuccgauugaaagugacaucaccaaguggggagugcgaauauagccccuuagucuccgugucuacuacccgugagccuaucucgucagagcaucugcacagagcaguuagcgugaacgacgaagaucuacucgucaggauucugcagggaggccgggugaagguagacguuccaaauaaauuugguuucacagcccuuaugguggcggcucaaaagggguacacccgccuggucaaaaucuuggugaguaacggaacugaugugaaucucaagaacggcuccggcaaggacucucugaugcuggccuguuaugcagggcaccucgaugucguuaaauacuuaagaaggcauggagccagcuggcaggcucgggaccuggguggcugcacagcacuucacugggccgcugaugggggacauuguuccgugauagaguggaugaucaaggacggcugcgaaguagauguggucgacaccgguucaggguggacgccguugaugcgcgugagugccguuagcggaaaucagcgaguggcgucucugcuaauugaugcaggcgccaacgucaaugugaaagacagaaacggcaagacuccccucaugguagcuguucugaauaaccacgaggaacuugugcagcuguugcucgacaaaggggccgaugcauccgucaagaaugaguuuggaaaaggugugcuggagauggcuagggucuucgaccggcaaucagugguuagcuuacuggaggaacguaagaagaaacagcgcccuaagaaaaguugugugugcuga

SEQ ID NO: 56121 - RNA, 2208 nt, Artificial Sequence
  derived and/or modified sequence opt3 from FAP__Homo_sapiens__NP_001278736
augaagaccugggugaaaaucgucuucggcguugccacaagcgcugugcuggcacuccuuguaaugugcauugugcugagacccuccaggguccacaacucugaggaaaauacuaugcgggccuugacguuaaaggacauacugaacgggaccuuuucauacaaaacauucuuuccuaauuggaucaguggacaggaguaucuacaucaaagcgcggauaacaauauugugcucuacaacaucgaaacuggucaguccuauaccauucugucuaaucgcacaaugcuuuggcgauacucguauaccgcuacuuacuauaucuacgaccugucaaacggcgaguucguucgugggaaugaauugccaagaccgauacaguaccucuguuggagccccgugggaaguaagcuggccuaugucuaccagaacaauaucuaucugaaacaaaggccuggcgauccacccuuucagauuacauucaacggucgggagaauaagaucuuuaacgggauuccugacuggguguacgaggaagagaugcucgcaaccaaguaugccuuauggugguccccaaauggaaaauuccuggcuuacgcagaauuuaacgauacggacauccccguaauagccuauucuuacuacggcgaugagcaguauccucgcacuauuaacaucccauacccgaaggcuggcgccaaaaaucccguugugagaauuuucaucaucgacaccacauauccugcguacgucgggccacaggaggugcccgugccugcaaugauugccagcuccgauuauuacuuuucauggcuuacuugggucaccgacgaaaggguuugcuugcaauggcugaagcgggugcagaacguaagugugcuaagcauaugugauuuccgcgaggacuggcagacaugggauugcccaaaaacccaggaacacaucgaggaaucucgaacgggaugggcugguggcuuuuucgucuccacucccguguucucauaugacgccauuagcuacuacaagaucuuuagugacaaggauggguauaaacauauacacuacauuaaggacacaguugagaaugcaauccaaaucaccucuggaaaaugggaggcuauuaacaucuucagagugacucaggauucccucuuuuauagcucgaaugaguucgaagaauacccgggcaggcggaacauuuaucguauaucuaucgguuccuacccucccucaaagaaaugugucacaugccaucugcgcaaggagagaugucaguauuacaccgccaguuuuagcgacuacgcgaaauauuacgcccuugugugcuaugggccaggcauuccuaucuccacgcugcacgauggaaggaccgaccaagaaaucaagauuuuggaggagaauaaggaacucgagaacgcacugaaaaauauacaguuacccaaggaagagaucaaaaagcuggaaguagaugagauuacacucugguacaaaaugauccuuccaccccaguucgaccggucuaagaaguauccucuguugauucagguuuacggcgggccauguagccaaucagugcgaagugucuuugcugugaacuggaucuccuaucuagccagcaaagagggaauggucauagcucugguggauggucgcggcacugccuuccagggggacaagcuccuguacgcaguuuacagaaaacuuggaguguaugaaguagaggaucagaucaccgccgucaggaaguuuauugaaaugggcuucaucgacgagaaacggauugcuaucugggguuggucuuacgggggcuaugugucaagucuggcguuggcaagcggaacaggccucuuuaagugcgggauagccguugcuccgguguccucuugggaguacuaugccucggucuacacugaacgcuucaugggacugcccaccaaggacgauaauuuagagcacuauaaaaacagcacagugauggcaagagccgaauacuuuaggaauguagacuaccugcuaauucaugguaccgcugaugacaacgugcacuuccaaaauuccgcccagaucgcaaaggcgcucguuaacgcucaggucgauuuccaggccaugugguauucagaccagaaccauggccugagugggcuuucuacuaaucacuuguacacgcacaugacacauuuucugaaacaauguuucagccucuccgauuga

SEQ ID NO: 56122 - RNA, 1548 nt, Artificial Sequence
  derived and/or modified sequence opt3 from FAR1__Homo_sapiens__NP_115604
auggugagcauccccgaguacuaugaaggcaagaacguccugcucaccggggccacaggauuccuugguaaaguucuguuggagaaguuacugagauccugcccuaaaguaaauucuguguacgugcuagucaggcagaaggcuggccaaacuccacaggaacggguggaggaaguucucucagggaaacuguuugaccgccuucgagaugagaacccggacuuccgugagaagauuauagcaaucaauagugaacugacgcagcccaaguuggcccucagcgaggaagauaaagaggugauuaucgacuccaccaacauuaucuuucacugugcggcuacagucagauucaaugagaaccugagggaugccgugcagcugaauguaauagcaacucggcaacucaucuuacuggcccagcagaugaagaaccuugaaguuuuuaugcaugugucuaccgcuuaugcauacugcaaucgcaaacacauugacgaggucguguauccuccacccguggauccuaagaaauugaucgacucgcuggaauggauggaugacgggcuagucaacgauauuacaccaaagcucaucggcgacagacccaauaccuacauauauacuaaggcccuggcugaguacguugugcagcaagaaggugccaaacuuaacguagcgauugugaggccuucaaucgucggggcaagcuggaaggagccauucccgggauggauugauaauuuuaacggccccaguggccuguucaucgccgcugggaaaggaaucuugcggacaauucgcgccuccaauaacgcacucgcugaccuggugccuguugacguggucgugaacaugucuuuagccgcggccugguacagcgguguaaaucgaccaagaaacauaaugguuuauaauuguaccacgggcuccacuaaccccuuucauuggggagagguggaauaccacgucaucucaaccuucaagaggaauccucuggagcaggcauuucggcguccaaacgugaaucucacaaguaaccaucuucuguaucacuacuggauugcugucagccacaaagcccccgcuuucuuguaugauaucuaccuacgcaugacuggaagaucuccgaggaugaugaagaccauaacacggcugcauaaagccaugguguuucucgaauauuucaccuccaauucauggguuuggaacacggagaaugugaacaugcugaugaaucagcuuaacccugaagacaagaagacuuucaauauugauguacgacagcugcacugggcagaguacaucgagaacuacugcuugggcaccaaaaaguauguccucaacgaagagaugagcggucugcccgccgcucgcaaacauuuaaauaagcugagaaacaucagguacggguuuaauacaauucuagugauccucauuuggcggauauucaucgcgcgcagucaaauggcaagaaacauuugguauuuuguugugucucuguguuacaaauuccuuuccuauuuuagggccagcucgacuaugcguuacuga

SEQ ID NO: 56123 - RNA, 390 nt, Artificial Sequence
  derived and/or modified sequence opt3 from FARP1__Homo_sapiens__NP_001001715
augggcgagaucgaacagagacccaccccugggagcaggcugggagccccagagaacuccgguauuucuacacucgaacggggccaaaagccgcccccuacuccaucagggaaacuugugaguauaaagauccagaugcuggacgauacgcaggaggcuuucgaaguccccaugguuagcuccucuucguuuuugaaagcaaccggaucaagcuggacaggcuggguguuacgcugcaguaugaagccuaaacaccauucccaccugauugagaaguucggugaggaccgaauccuaacucaucucaccgggucuauuagcuacacaaauugggccggaucccguucacuggcgguaaccgugacugaggaacuucugaacuuguuuuga

SEQ ID NO: 56124 - RNA, 1944 nt, Artificial Sequence
  derived and/or modified sequence opt3 from FARP2__Homo_sapiens__NP_001269912
augggcgagaucgaagggaccuacagagugcugcagacagccggaaugaggcucggugcucaaacucccgucggcguuagcacgcuugagccugggcagacccuguugccacggaugcaggaaaagcacuuacaucugcgcgugaaacuacucgacaacacaauggagauuuucgauauagaaccgaagugcgacggacagguacugcuuacucaaguguggaaacgacugaauuuggucgagugugauuauuuuggcauggaguuccagaacacccaguccuacuggaucuggcucgaacccaugaagccuauuauccgucagauuagaaggcccaaaaaugugguucugcggcuggcagugaaguuuuucccaccugacccaggucaacuccaggaggaauauacacgcuacuuauuugcccugcagcuuaagagagauuugcuggaggagaggcuaaccugcgcggacacuacagcugcccuccugaccucucaccuucugcagucagaaaucggggauuaugacgagacguuggaucgggaacaucucaaagucaacgaguaccugcccggacaacagcacuguuuagaaaagauacuggaguuccaucagaaacacgugggccaaacuccugcagagagugacuuucagguacucgaaaucgcccgcaaacuugagauguauggcauucgauuccacauggcuagcgauagagaagggaccaagauccagcuggcaguuucccauaugggaguguuggucuuucaggguacaacuaagauuaauaccuucaacuggucuaaggugaggaaacuaucguuuaagcggaaacguuuccugaucaagcuccacccagaggugcauggcccguaccaagacacacuggaauuucuucuggggucacgcgaugagugcaaaaauuucuggaagauaugugucgaguaccacaccuucuuuagauugcucgaccagcccaaaccuaaggccaaggcuguuuucuuuagcaggggaaguuccuuccgguauucuggccgaacgcagaaacagcugguggacuacuuuaaggauagcgguaugaaacgcauuccauaugaaagaaggcacuccaagacucauacaucaguacgggccuuaaccgcggaccugcccaaacaaaguaucagcuucccugaggggcuacgcacuccagcaucucccuccucagccaacgcuuuuuacagccucaguccgucuacacuggugccuuccggacuucccgaguucaaggauagcucgucuuccuugaccgacccacaggucucauaugugaagaguccugccgcagaaagaaggagcggcgcuguugccggcgggcccgauacgccauccgcgcagccccugggaccuccagcccuccagccgggucccggccugucuaccaaaagcccucaaccaucacccaguucccguaagagcccucuuucucugucaccagcauuucaggugcccuuggggccggcugaacagggaaguagcccucuccuguccccagucuuaucugacgccggcggugcugggauggauugcgaggagccccggcacaaacgagugccugccgacgaagcauacuucauuguaaaggagauccuggccacagaaagaacuuaucuaaaagaucucgagguuaucaccgugugguuuaggucggcugucgugaaggaggacgcgaugcccgcaacacugaugacucuuuuguucagcaauauugauccaauauacgaauuucaucgcggcuuccugcgggaggucgaacagagacucgcccugugggagggaccuuccaaggcucacaccaaaggcucacaucaaaggaucggggacauuuuacugcgcaacaugcgacagcuuaagguguuccaguugcacgaaggacacguugccggugugacaaaaauggaguga

SEQ ID NO: 56125 - RNA, 1356 nt, Artificial Sequence
  derived and/or modified sequence opt3 from FARS2__Homo_sapiens__NP_001305801
auggugggcagcgcccugagacgcggggcucacgcauacgucuaucucguuuccaaggccucucauaucucacggggacaccagcaucaagcgugggguaguaggcccccugcugccgagugcgcaacccagcgagccccaggcagcgugguagaacuucuggggaaauccuacccgcaggacgaucacucuaacuugacacguaagguguuaacuagagucggaaggaaucugcauaaccagcaacaccacccccuauggcucauuaaagagcgggugaaggaacauuucuauaaacaguacguuggccgcuuugguacgccucuguucucgguguaugacaaucuuucaccagucgugaccacauggcagaacuuugauagccuguugauacccgcugaccacccuaguagaaagaagggggauaauuacuaucucaacaggacucauaugcugcgggcacacaccuccgcccaccagugggaccugcuccaugcuggauuagaugccuuccugguaguuggcgacguguaccgccgagaucaaaucgacucucagcacuacccaauuuuucaucagcuugaggcggucagauuguucagcaaacacgaacuguuugcaggcaucaaggauggggagucccuacaacucuucgagcagucaaguaggagcgcccauaaacaggaaacacacaccauggaggcugugaagcugguggaauuugaccuuaaacagacucugacacgguugauggcccaccucuucggagaugagcuggagauucguugggucgacuguuauuuucccuucacccauccuucuuuugaaauggagaucaauuuccacggugaaugguuagagguucugggcugcggggugauggaacaacagcucguaaacuccgcaggagcucaggaccgcauaggcugggccuucggucuugggcuggagagauuggcgaugauccuauacgauauuccagacaucaggcuguuuuggugugaggaugaacgguuccucaagcaguuuugcgugucaaauauuaaccaaaaggucaaauuccagccgcugagcaaguaucccgccgugaucaaugacauaaguuuuuggcuuccuucugagaacuacgcagaaaaugauuucuaugaccugguucgaacgauuggaggcgauuugguggagaaagucgaccucaucgauaaguuugugcauccaaaaacucacaagaccucccacuguuaccgcauuacauauagacauauggaaaggacucugagccagcgggagguacgccacauccaucaggcuuuacaagaggccgcuguucagcugcuaggcguggaagggagauucuga

SEQ ID NO: 56126 - RNA, 1527 nt, Artificial Sequence
  derived and/or modified sequence opt3 from FARSA__Homo_sapiens__NP_004452
auggccgacggccagguggcugagcugcuccuuagaaggcuggaagcaagcgaugggggauuggacuccgccgaguuagcggcugaacuggguauggagcaccaagccgucguuggcgcagugaagucucuacaggcccucggggaaguaaucgaggcugagcugcggucaaccaaacauugggaacuuacagcagagggagaagagauugcccgcgagggcagucacgaagcucgaguguuccguagcauacccccugagggucuggcccaguccgaauugaugagacucccaucugggaaggucggauuuucgaaagcgaugucaaacaaguggaucaggguggauaaaagcgcagccgacggcccgcggguuuuccgcguggucgauaguauggaggacgaagugcagagaaggcugcaacugguacggggcgggcaggcugagaagcucggagagaaggaacgcuccgaguuacgaaaaagaaagcugcuugccgaaguuacuuugaaaacguacugggugucuaaggguagcgcauuuuccaccucaauuaguaaacaggagacagaacugagccccgagaugaucucuuccggcucauggagggaucggccuuucaagccauauaauuuucuagcucaugggguccuccccgacagcggacacuuacauccucuucugaaggugcguagucaguuccgccaaaucuuuuuggagaugggcuucacugaaaugccaaccgauaacuuuauugagucuuccuucuggaauuuugacgcccucuuccagccccagcagcacccugcgagagaucaacacgacacauuuuuccugagggauccagccgaagcauuacagcugccgauggacuacgugcagcgggucaaacgaacccauagccaagguggguauggaucgcagggcuacaaguauaacuggaaacucgacgaggcucgcaagaaucuucugagaacucacacaaccucugccuccgcuagggccuuguaccggcuagcacagaaaaagcccuucacgccuguuaaauauuuuucaauagaucgcguguucagaaacgaaacucuggacgccacccaucucgcugaguuucaccagaucgagggcguaguggcggaucacgggcugacacuuggacaucugaugggugucuugagggaguucuuuacuaagcucggcauuacccaacugcguuucaagccagcauacaaucccuacacagaaccuaguauggaaguguuuagcuaucaccaggggcugaaaaaguggguugaggugggaaacuccggcgucuuccggccagagaugcugcuacccaugggucucccggaaaaugugucuguaaucgccugggggcugagccuugagcgaccuaccaugauuaaauacggcaucaacaauauaagagaauugguuggacauaaggugaaccugcagauggucuaugacucaccccucugcaggcuggaugcugagccacgcccucccccaacgcaggaagccgcauga

SEQ ID NO: 56127 - RNA, 1008 nt, Artificial Sequence
  derived and/or modified sequence opt3 from FAS__Homo_sapiens__NP_000034
augcugggcaucuggacccuccuuccccugguguugacaagcgucgccagauuauccucuaagucaguuaacgcucaggugacugacauuaauaguaaagggcuggagcuaaggaagacgguaaccacaguggaaacucaaaaccucgagggacugcaccaugauggucaguucugccacaaaccuuguccaccgggcgaacggaaggcacgcgacugcaccgucaauggggaugagcccgacugugugccuugccaggaaggaaaagaguacacagauaaggcccauuuuagcuccaagugucgacguugcagacuuugugacgagggccacggucuggaaguugagauaaacugcaccaggacucagaauacaaaaugucggugcaagccaaacuucuuuuguaauucuaccgugugcgaacauugcgaucccuguacgaaaugcgagcacgggaucauuaaggaguguacuuugaccucgaacacaaaaugcaaggaagagggaucacgcagcaaucucggcuggcugugucugcucuuacugccuaucccacuuauugucugggugaagagaaaagaaguacaaaagacuugcaggaaacaccggaaggagaaccagggcagucaugaaucccccaccuugaauccugagacaguugcgaucaaccugucugacguggaucuaagcaaauauauaaccacgaucgcuggggucaugacucucucccaggugaagggauucgugcgcaaaaauggugucaacgaggccaagauugacgaaaucaagaaugauaacguucaggacacagcagagcaaaaagugcagcugcuucgaaacuggcaccagcugcauggcaagaaagaagccuacgauaccuugauuaaggaccucaaaaaggcuaaucuguguacuuuagcagagaagauccagacaauaauucugaaagacaucaccucagauagugaaaacagcaauuuuagaaacgagauucaaucucucguauga

SEQ ID NO: 56128 - RNA, 846 nt, Artificial Sequence
  derived and/or modified sequence opt3 from FASLG__Homo_sapiens__NP_000630
augcagcaacccuucaacuacccuuauccacagaucuacuggguggacagcuccgccucuucaccgugggcucccccuggcaccguccugccaugccccacaaguguuccuagaaggccagggcagcggcgacccccuccaccgcccccuccacccccucucccacccccgccucccccaccuccccuuccaccccugccuuugccaccguuaaagaaacgcggaaaucacagcacuggucugugucuacucgugauguuuuucaugguacugguggcacuugucggccugggguugggaauguuucaacucuuccaucugcagaaggagcuggccgaacuccgugaguccacgucucagaugcacaccgcgucgucauuagaaaaacagauuggccaucccagcccuccacccgagaagaaagaacugagaaagguggcucaccuuacagguaagaguaacuccaggucuaugccuuuggagugggaggauacuuaugggauaguucugcuaagcggagugaaauacaagaaaggcggccucgucaucaaugaaaccgggcuguauuuuguguacuccaagguauauuuccggggacagucaugcaacaaucuuccacugagucauaaaguuuacaugcgcaacagcaaguacccccaagacuuggugaugauggaggguaagaugaugucuuauuguacaaccggccagaugugggccagauccucauaccucggggcagucuuuaaucugacuagcgccgaucacuuauaugugaacgugagugaacugucucucgucaauuucgaggagucccagacauuuuucggacuuuacaaacuguga

SEQ ID NO: 56129 - RNA, 7536 nt, Artificial Sequence
  derived and/or modified sequence opt3 from FASN__Homo_sapiens__NP_004095
auggaagaaguggucaucgccggaauguccgggaagcugcccgaguccgaaaaccuccaggaguucugggacaaucuuauuggagguguugauauggugaccgacgaugacagaagguggaaggcuggccuguacggguugccucggcgcucuggaaaguuaaaagaucugucacgauuugacgcuaguuucuuuggcgugcacccaaagcaagcccauacaauggauccgcagcuacgucuccugcuugaagugacuuaugaggcgauagucgacggugggaucaaccccgauagccugagaggaacgcacaccggcguguggguuggcguguccgggucugagacaucggaggcuuugucaagggacccugagacucucgucggauacagcaugguggguugccagcgggccaugauggcgaaucgccugaguuucuuuuucgauuuuagaggcccauccauugcccuggacaccgcuuguucuagcucccucauggcauuacagaacgccuaucaagcuauccauucagggcagugccccgccgcgauuguuggaggcaucaauguucugcuuaaaccuaacacaagugugcaguucuugaggcuggguaugcuaagcccagaagggaccuguaaggcauuugauacugccggaaauggcuacugccggucugagggcgucguggcugugcuccugacaaagaaaucccuugcccgccgagucuaugcaaccauacugaacgcugggacgaauacugacggauucaaggagcaggguguuaccuuucccucaggcgacauccaagaacaguugauuagaagccucuaccagagugccgggguggcgccugagucuuucgaauauaucgaggcccacggaacaggcacuaaagugggugauccacaggaacugaacgggauuaccagggcauuaugugcuacacggcaagagccgcugcucaucggcuccaccaagagcaauaugggacaucccgagccugccucgggccuugcugcccuggcaaaaguguugcuaucucuggaacacgggcucugggccccaaaccugcacuuucauucccccaauccugagauaccagcacuucuggacggacguuugcaggucguggaucagccccucccgguucgcgguggcaacguggggauuaauucauucggauucggcgguaguaacguccacaucauucugagaccuaacacgcaacccccucccgcgcccgcaccacaugccacuuuacccaggcugcuacgggcuagcgggcgaacaccugaagccgugcagaagcuccuggagcagggccuucgccacucccaggacuuggcauuucugucuaugcucaaugauaucgccgcuguaccagccaccgcaaugccguucagaggauacgcgguucugggcggggaaaggggaggucccgaggugcaacaggucccugcuggcgagcggccacuuugguuuaucugcagcgggaugggaacucaguggcgcggcaugggucugucauugaugagacucgacagguuccgugauaguauucugcgguccgacgaagccgugaagcccuuuggguuaaaagucagccagcugcuacucucuacagaugagucaaccuucgacgauauagugcacaguuuuguuagccugacggcaauccaaauuggccuuaucgacuugcuguccuguaugggacuccgaccugacggcauaguggggcauucucugggagaaguagccugcggcuacgcugaugguuguuuaucgcaggaggaagccguccuggcagcuuauuggagagggcagugcauuaaggaggcccaccuuccacccggagcgauggccgcugugggcuugagcugggaggaauguaaacagaggugcccgccugguguugugccagcaugccauaacuccaaggacaccgucacaaucucaggcccccaagccccuguguucgaguuuguagaacagcuccgcaaagaggggguguucgcuaaggagguucggacuggaggcauggccuuucacaguuacuucauggaagcaaucgcgcccccacugcuacaggagcugaaaaaggucauuagagaaccuaagcccaggucugcccgcuggcucagcaccuccaucccagaggcucaguggcauucaagccuggcccgaacaucuuccgcagaauauaaugugaacaaucuugugaguccggucuuguuucaagaggcucuguggcacguuccugagcacgccgugguguuagaaauugcaccccaugcccuccugcaggcuguacuuaaacgggggcugaagccaagcuguacuauaauccccuugaugaaaaaggaucaccgugacaaccucgaguucuuccuggcgggaauuggcagacuacaucugucugguaucgaugccaauccuaacgcacucuuuccacccgucgaguucccugcuccgagggggaccccacugaucagcccacuuauuaaaugggaccacucauuggccugggaugugccugccgcugaggacuuuccaaauggaaguggcagccccucggcagccauauacaacaucgauacauccucugaaagcccugaccacuaucugguugaucauaccuuagacggucgcguacucuucccggcgacuggcuaccugucaauugucuggaagacgcuugcucgggcccuggggcuaggaguggagcagcuccccguuguguuugaggauguaguccugcaccaagcaacaaucuugccaaagaccggcacugugagucuggaagugagauuacucgaggccuccagggcuuucgaagucucugagaaugggaaccugguugugagcggaaaaguauaucagugggacgacccugauccccgacuuuuugaccauccagaauccccuacccccaauccaacagagccgcuguucuuggcacaggccgagguguacaaggaacuccgccugcggggcuacgauuaugguccucacuuucaggggauucuagaggcgucacuggaaggagacagcggcagacuucucuggaaagauaacugggucaguuucauggacaccaugcugcaaaugucuaucuuggguuccgcuaagcauggccuguacuuacccacuagggugacagccauacacaucgauccagcaacgcaccgucagaaacucuauacccugcaggacaaggcccagguugcugauguggucgugagccgcuggcuucggguuacuguggccgggggaguccauauuucgggccugcacacagagucagcacccagaaggcaacaggagcagcagguaccuaucuuggaaaaguuuugcuucaccccacauacagaggaagggugucucucugagcgagcugcccugcaagaagaacuacagcugugcaaaggacuugugcaggcgcuccaaacuaagguuacccagcagggccugaaaauggugguccccgguuuggacggggcccagauuccucgggauccgagucaacaggaguuaccacgccugcucuccgcagcuuguagacugcagcuuaauggaaaccugcaguuggaacuagcccaagugcuggcucaggagaggcccaagcucccugaagacccccugcuuagcggcuuacuggauucuccagcacucaaagccugcuuggacacggccguagagaacaugccuagccugaagaugaagguggucgaaguucucgcuggccacgggcaucuguacucccggauccccggacuucugucaccacacccuuugcuacagcugaguuauaccgcgacagaccgacacccgcaggcacucgaggccgcucaagccgaguuacagcagcaugauguggcacagggucaaugggaccccgccgauccagcuccuagcgcgcugggcucugccgaccuucugguguguaauugcgcagucgcugcccucggggaucccgcauccgccuugucaaacaugguggcugcccugagagaaggaggcuuucuccugcuucacacucuacugcgcggucauccauugggggacauaguugcguucuuaaccaguacagagccucaguacggacagggcauucugagccaagaugcaugggaaucccucuucucuaggguaucgcugcgucuugugggccugaaaaagagcuuuuaugggucaacucucuucuugugucggagacccaccccgcaggacuccccaaucuuucugccugucgaugacacgaguuucagguggguggagucucuaaaaggcauucuggccgaugaagacagcucccgccccguuuggcucaaggcuaucaauugcgccacaucagguguggucggccuugugaacugucugcgaagagagccagggggaaaucgguuaaggugcguauugcugucuaaccucagcaguaccucccacguccccgagguggacccuggcagcgcugaacugcagaaaguucuucagggugaucuggugaugaaugucuaccgcgacggggcauggggagccuuucgucacuuccucuuggaggaagauaagccggaggagcccacugcucaugccuuugugucuacacugaccagaggcgacuuaucauccauacgguggguuugcaguagccuaaggcacgcacaaccaacuuguccuggcgcgcagcugugcaccguguacuaugccucgcucaacuuccgcgauaucaugcuugcuacagggaaacugucucccgacgccauuccuggaaaguggacgucccaggauagcuugcuggguauggaauuuucaggccgagacgcaagugggaagagagucaugggacucgugccagcuaaaggccuggccaccucuguacuucucucccccgauuuccugugggacgugccuagcaauuggacuuuggaggaagcagccucaguuccagucguguacaguacagcuuauuacgcgcuggugguccgggguaggguacgccccggggagaccuuacuaauccauagcggauccggcggcguggggcaggccgcaauugcuaucgcccugucucucggauguagaguuuuuacaacuguggguagcgccgaaaagagggcauaucuucaagcucgguucccgcagcuggauuccaccucauucgccaacucucgugacacgaguuuugagcagcacgucuuguggcauacaggcgggaaaggaguggaucugguucucaauucgcuggcggaggaaaaacuucaggcuagcgugcgcugcuuagccacccacggccgauuccuggagauagguaaauuugaccucucccaaaaccacccuuuggggauggcaauuuuccugaagaaugucacuuuucauggagugcuacuggacgccuucuuuaacgaaucuucagcugauuggagagagguaugggcacucgugcaggccggcaucagggacggcguuguccggccacuuaaguguaccguguuccacggggcacagguggaagaugcuuuucgcuacauggcccaaggaaaacauaucgguaaggucguugugcagguacuggcagaggagcccgaagccguguugaaaggcgcuaagccuaaacugaugagcgccauuuccaagacauucugcccagcacacaagaguuauaucauugcugggggacucggcgguuuugggcuggaguuagcccaguggcuuauacagagaggcguccaaaaacuggugcucacuucuaggagcggaauccggaccggcuaccaggcgaagcagguucgaagauggcgcaggcagggggugcaaguccagguaucaacauccaauauuaguagccuagaaggagcccggggucugaucgcagaggcugcccaguugggccccguagggggaguuuucaaccuggcagugguccuccgugacggccuucuggaaaaccagacgccggaguuuuuccaagauguguguaaaccuaaguacucugguaccuugaaucuggacagagucacuagggaggcuugccccgaacucgauuauuucgugguauuuuccucagugagcugugggcgcggcaacgccggacagucgaauuacggcuucgccaacucugcgauggagcggauuugcgaaaaacgaagacacgagggguuaccaggacuggcuguacaguggggugcaaucggcgacguggggauacuugucgagacaaugaguaccaaugauacuaucguuuccggaacacugccucagaggauggccagcugucuagaagugcucgaccuguuuuugaaccaaccccauaugguccugucauccuucgugcucgcugagaaggccgcagccuaucgcgaucgggacucucagagagaucuuguagaagcuguggcgcacauucugggcauccgugacuuagccgcaguuaaucuggacagcaguuuggcugaucucggucuggacucccuaaugagcguggaggucaggcagacccuugaacgggagcugaaccucgugcugucuguccgcgaggugcgacaauugacgcugagaaagcuccaggaacuuucaaguaaagccgaugaggcauccgaacuggccugcccaacucccaaggaggacggguuagcucagcagcaaacccagcugaauuugaggagccuccugguuaacccugaaggcccaacacuaaugcggcuuaauucuguacagucgucagagcgcccgcuguuucucgugcaucccauugagggaagcaccacugucuuccacucccuggccaguagauugucuaucccuacauacggcuuacagugcaccagggcggcaccacuggauagcauacauucccucgccgcuuauuacauugacuguauccgacaagugcagcccgaagggccuuaucggguugccggauacucauacggcgcaugcguggcuuuugagauguguagucagcuucaggcccaacagucuccagcucccacacacaacagccuguuccuauuugaugguuccccuacuuauguccuggccuacacccagucauaucgugcaaaacucacgccggggugcgaagcggaggccgaaacagaggcuaucuguuucuuugugcaacaguucaccgacauggagcacaauagaguauuggaagcccugcuuccacugaagggacucgaggaacgcguggcagcugccguugauuuaauuauaaaaagccaucagggccuggacaggcaggaguugucuuuugcagcccgguccuucuacuauaagcugagagcggcugagcaauacacucccaaagccaaguaucacgguaacgucaugcuccuucgcgcaaagaccggcggggccuacggagaagaucugggcgcugacuacaaucuaagucaggugugcgacgggaaagugagcguccauguuaucgagggagaucacaggacacugcucgaaggcucggguuuggaguccauuaucucuauuauccacucaagccuggccgaaccucgagugaguguacgggagggguga

SEQ ID NO: 56130 - RNA, 2133 nt, Artificial Sequence
  derived and/or modified sequence opt3 from FASTKD2__Homo_sapiens__NP_055744
augcugaccacacucaagcccuucggcagcguguccgucgagucuaaaaugaacaauaaggccgggucauuuuucuggaaccuuagacaguuuaguacucugguuagcacguccaggaccaugcgguugugcuguuuaggacugugcaaaccuaagaucgugcacucuaauuggaacauucuaaauaacuuccauaaucgcaugcaaucgacagacauaauccgauaccucuuucaggaugcuuucauuuuuaaaucagacguagguuuccagacuaagggcaucagcacccugacagcacuucguauugaaagacuguuguaugccaagaggcucuuuuucgauaguaaacagucccuggugccagucgacaagucugaugacgagcugaaaaaggugaaccucaaucacgaaguuagcaacgaggauguguuaaccaaagaaacuaagccgaaucggaucuccucacgcaagcugagugaggaguguaacagccuuucugacgucuuggaugcguuuuccaaagcucccacauucccuucaagcaauuacuuuaccgccauguggacgauagcaaagagacugagugacgaucagaaaagguucgaaaagcggcuaauguucucucauccagccuuuaaccaacucugcgagcacaugaugcgcgaagcuaaaaucaugcaguauaaguaccugcuuuucucccugcaugcaauugugaaauuggggaucccccagaauacuauucucguacaaacccuguuacgaguuacacaggagagaaucaacgagugugacgaaauaugccugagcgugcucucgacuguccuugaggccauggaaccuuguaagaacgugcacgugcugaggaccggauuucggauuuuggucgaucagcagguuuggaagaucgaggacguguucacacuacaaguagugaugaaaugcauuggcaaggacgcuccaaucgcccugaaacguaagcucgaaaugaaagcgcugcgcgagcuugauagauuuucuguccugaauagucagcacauguucgagguguuggcagccaugaaccauaggucacucauccuguuagacgaauguaguaagguugugcuggauaauauucacgguugcccccuacggauaaugaucaacauucuccagagcuguaaggaccugcaauaucauaaucuugauuuguuuaaagggcuggcugacuacgucgccgcaaccuucgauaucuggaaguuucgaaaaguacucuucauacugauucuuuuugagaaccugggauuccgcccugugggcuugauggaccucuuuaugaagagaaucguugaagauccagagucccugaauaugaaaaacaucuuaucuauucugcacacguauagcucacuaaaucacguguacaagugccagaacaaggaacaguucgucgaggugauggcuagugcccucacuggcuaccugcauacaaucuccagcgagaaucuuuuggacgcggucuauucuuucugccugaugaacuacuuuccgcucgcccccuucaaucagcuguuacaaaaagauauuauaucagaacugcuuaccagugacgacaugaagaacgcauauaaauugcacacucucgauacaugucugaagcuagacgauaccguguaccugagggacaucgcucucagccugccucagcuuccacgggaguugcccuccucucauacgaaugccaaaguugcugaagugcugucgagcuuacucgggggagagggucacuuuuccaaggauguacaucugccucacaacuaucacauugacuucgaaauccgcauggauaccaacagaaaucagguccuuccacugucagacguggauacaacuuccgccaccgacauccagaggguugcaguguugugcgucucucguagcgccuacugucucggcuccucacauccccggggguuucuggcuaugaagaugcgacaccuaaacgcgaugggauuccaugugauucugguaaauaacugggagauggauaaacucgagauggaagacgcagugacauuucugaagacuaaaauauauagcguugaggcccuuccggucgcugccgugaaugugcaaucuacccaguga

SEQ ID NO: 56131 - RNA, 1569 nt, Artificial Sequence
  derived and/or modified sequence opt3 from FASTK__Homo_sapiens__NP_001245390
augagaaggccccggggcgagccugggccacgcgccccgcgacccaccgaaggagcuacaugcgcagguccuggcgagagcugguccccaucucccaacucaaugcugcgugugcuccuuagugcccagacuagcccugcgagacuguccggguuguuacugaucccacccguccaaccuuguugccuaggaccaucuaaguggggcgacaggccgguuggugggggacccucggcuggcccugugcagggccuccagcggcugcuugaacaggccaaaucaccaggggagcuguugcgcuggcucggacaaaaucccagcaagguaagagcacaccauuacaguguggcccugaggcggcugggucagcucuuaggcucccgcccucgaccacccccggucgaacaggugacgcugcaggaucuuucucaauugauuauaagaaacuguccuagcuucgacauccacaccauucauguuugccugcaccuagcugugcuccugggguuucccuccgauggaccacuugucugugcacuggagcaggagaggcgguugcgucucccucccaaaccacccccuccacugcagccguuacugcgcgaagccagacccgaggaacucacaccucaugugaugguacuucuggcucagcacuuggccaggcaccggcuacgagagccacaacugcucgaggcgaucgcacauuuccugguugugcaggaaacucagcuuucaaguaaggucgugcaaaaacugguguugcccuuuggccgccucaauuaucugccuuuagagcagcaguucaugccaugccuggaaaggauucuagccagagaggcuggugucgcaccccucgccaccguuaacauccugaugagccuuugucaguugcggugccugccguuucgcgcucuccacuucguguuuucuccuggguucauaaauuacaucuccggaacaccacaugcccugauuguaagaagguaucuuucacuguuggacaccgcgguggaacucgagcugcccggcuaccguggcccucgguuaccccgaagacaacaggucccaaucuuuccucagccccugauuacugauagggcccgcuguaaguauagccacaaggacaucguggcagaggggcuacggcagcuccugggagaagagaaauacagacaagaucuuacaguuccaccggguuauugcaccgacuucuugcugugugcuaguucuuccggcgccgugcucccugucaggacgcaggaucccuuucugccauaucccccucgcagcugcccacaggggcaggcugccucgucugcaacuacccgagaccccgcccaacgggugguauuaguucugcgugaaagauggcacuucugcagggauggacgcgugcuuuugggcucccgggcucucagagagaggcaucugggucuaaugggguaccagcugcucccucugccguuugaggaacuugagucacagcgaggcuugccacagcugaagaguuacuuacgccaaaaacuccaggcgcugggacuucgguggggccccgaagggggauga

SEQ ID NO: 56132 - RNA, 13767 nt, Artificial Sequence
  derived and/or modified sequence opt3 from FAT1__Homo_sapiens__XP_006714202
augggcaggcaccuggcccuccuucuguuguuacugcuacucuuccagcauuuuggggacagcgauggaucccagaggcuggagcagacaccccuucaguucacccaccuggaauacaacgugacuguccaggaaaauucugcugcaaagacguacguuggucauccugugaagaugggcguauacaucacccacccagccugggaagugcgguauaagauugucucaggggacagugagaacuuguuuaaagcggaagaguacauacucggagauuucugcuuucugcgcauccgaaccaagggcgguaauacugcuauucugaaccgugaggugaaagaccauuauacccucaucguuaaggccuuagaaaagaauacaaacguggaggcaagaaccaaagucagggugcaaguacuggauacuaaugaccuucggccguuguucagccccacauccuacucuguuucgcugccugaaaacaccgccauucgcacgucaaucgcuagagugagcgcaacugaugccgacauagggaccaauggagaguuuuauuacaguuucaaggauaggacagacauguuugcuauccacccaacuuccggcgucauugugcuaaccggccggcucgauuaccuggagacaaaacuuuaugaaauggagauccuggccgcggaccgcgggaugaaguuguacggaucuagcgguauuuccucaauggcaaaacucaccgugcacaucgaacaggccaacgagugugcucccgucauaacggccguuacucugaguccuagcgaauuagaucgagacccagcauaugcuauugugacaguagacgauugcgaccagggcgccaauggggauaucgcgucucuguccauuguggccggagaccuccuucagcaauucagaaccgucaggucauuucccggcagcaaggaguacaaggugaaagcaaucggugggaucgauugggacagucauccuuucggauauaaccugacuuugcaggcuaaggauaaaggcacaccaccgcaguuuucuuccguuaaggugauucacgucaccagcccccaguucaaagccggcccugugaaguucgagaaagacguauaccgggcugaaauaucggaguuugccccacccaauacgccuguugugauggucaaggcaaucccagccuauucucaucuacguuacguguucaaguccacccccgggaaagcuaaguuuucacugaacuacaauacaggacucauuaguauccuggaaccggucaaacgccaacaggcggcacacuucgagcuugaagugacuaccagcgauagaaaggccuccacaaaaguucuggugaagguauugggugcuaacucuaacccucccgaguuuacucagaccgccuauaaggcagccuucgacgagaaugucccaauaggcacaaccgugaugagccucucagcuguugauccugacgaaggggagaacggauacgugacuuauaguauugccaaucugaaccacguccccuuugcaaucgaccauuucacgggcgcgguguccacaagcgaaaauuuagauuacgagcugaugccaaggguauauacccuacggauccgagcuucugacuggggucuccccuaccgcagagaaguggagguucuggccacuauuacccuuaacaauuugaacgauaauacaccucuguuugagaaaaucaacugugaagggaccauuccaagggaccucggcgucggagagcaaauaacuacagugucagcaaucgaugccgacgaacugcagcuugugcaguaucagauugaggcuggcaaugagcuggauuucuuuaguuugaacccgaauagcgggguccucucccugaagcggucuuuaauggacggacugggugccaaaguuucguuccacagccuacgcaucacggcaaccgauggcgaaaacuuugcuacuccccucuacaucaauauuacaguggccgcgucccauaagcuggugaaccuucaaugcgaggaaaccgggguagccaaaauguuggcugagaagcugcuccaggcaaacaagcugcacaaucagggagaagucgaggacauauucuucgauucacauagugugaacgcccacaucccucaguuuagaucuacauuaccaacuggcauucaaguuaaagagaaucagcccguggguagcuccgucaucuucaugaacucaaccgaccuggauacgggguuuaauggcaaacuuguguacgcuguuagcggaggcaacgaagacucuuguuucaugauugacauggagaccgggauguugaaaauccucuccccucuggauagggaaacaacugacaaguauacccuaaauauaacaguguacgaucugggaaucccacagaaagccgcauggcgucuccugcacguagucgugguggacgcgaacgauaaucccccggaguuucuucaggaaaguuauuucgucgagguuagcgaggacaaggaagugcauucugagauuauccaaguagaagccacugauaaggacuuggguccuaacggccacgugaccuacuccauugucacggauacagacaccuuuucaaucgauagugugacugggguugugaauauagcucggccacuggaccgagaguuacagcaugaacacagccucaaaauugaggccagagaucaggcaagggaggaaccccagcuguucucgacagucgugguuaaggugucccuugaggacgucaacgacaauccucccaccuuuaucccaccuaacuaucgcguaaaagugcgggaagaucugcccgagggaacuguuauuaugugguuggaggcucacgacccagaucucggccaaucuggucaggugagauacagccugcuagaccauggggaaggcaauuucgaugucgacaagcugucaggagccgugaggaucguacagcaacucgauuuugagaagaaacagguguauaaccugaccguccgcgcaaaagacaaaggcaagccgguuagucuuuccucuacaugcuacguggaaguggaggucguggauguuaacgaaaauuugcacccucccguauucagcuccuuuguggagaaagggacggucaaggaggacgccccagugggaucacugguuaugaccgugagcgcucaugaugaagacgcgcgacgggacggcgagauacguuacaguaucagagaugguucuggggucggaguguucaaaauuggcgaagagacugguguaaucgaaacauccgacagguuagaucgcgagagcaccucgcacuauuggcucacagucuucgccacugaccagggcgugguuccccugucaucuuuuauugagaucuacauagaaguggaggaugucaacgacaaugcaccucagaccagugaaccaguguauuaccccgagauuauggaaaacuccccuaaggauguuagcgugguccaaaucgaggcuuucgacccggauucuagcuccaaugacaaacuuauguauaagaucacgucagggaacccacagggauuuuucaguauucaucccaagacaggccugaucaccacuaccagccggaaacuagauagagagcagcaggacgaacacauucucgaggugacaguaacugauaaugggucuccuccaaaguccaccauagccagggugaucguuaaaauucuggacgaaaacgacaauaagccccaauuuuugcagaaauucuacaagauccgacugccugagcgcgagaagccggaucgggaaagaaacgccaggcgugagcccuuauaucacgucauugcuacagacaaagaugaaggaccaaaugcagagaucucauacaguauagaagacggcaacgagcaugguaaguuuuucaucgagccuaaaacggggguggugagcuccaagcgcuuuucugccgcgggagaauacgauauucucucgaucaaagcugucgacaauggccggccccagaaguccucaaccacuagacugcacauugaguggaucuccaagccaaaaccuagucuugaacccauaucuuucgaggagagcuuuuucacauucaccguaauggaguccgauccaguggcccauaugauugguguuaucucaguggagccgccuggcaucccccugugguuugacauuacugggggaaacuaugauucucacuucgacgucgauaagggcacagggaccauaaucguggcaaaaccauuggacgccgaacaaaagagcaauuacaaccucacgguugaggcuacugauggaaccacaaccauucugacucaaguguuuaucaaagucauugacacaaacgaccauaggccccaguucaguaccuccaaguaugaagugguaaucccugaggauacagcaccagaaacugagauacuacagaucagcgccguggaccaagaugagaaaaauaagcugauuuacacccuucagucuucacgagacccccucucccugaagaaauuucgguuggauccugcgacgggcagucuguauacaagcgaaaaguuagaccacgaggcuguucaccagcauacccucacugucauggugcgcgaucaggacgugccggucaaaagaaacuucgccaggaucguugugaauguaucggauaccaacgaccacgcaccaugguuuacagccucuuccuacaagggucggguguaugaaagcgcugccgucgggucagugguucugcaagugacugcacuugauaaagacaagggaaagaaugcugagguccuguacaguauugagucuggcaacaucgguaauuccuucaugauagaccccguauugggcagcauuaaaaccgccaaggaacucgaucgaucaaaccaggcggaguacgaccugauggugaaagccacggauaaggggaguccucccaugagcgaaaucacauccguuagaaucuuugugaccauugcagacaaugcuucuccaaaauucacuagcaaggaguauuccgucgaacuaucagagacagugucuaucggaaguuuugucggcauggugaccgcccauucgcagagcuccguuguguacgagauaaaggaugggaacacuggagacgcuuucgauauuaauccucacucuggcacaaucauuacccagaaagcacuggacuuugaaacgcuucccaucuauacucucauaauucaagguaccaacauggccgggcugucaacaaauaccacaguauuggugcacuuacaggaugagaacgacaaugccccagucuucaugcaggcugaauacacuggacugaucagcgaguccgcgaguaucaacucuguugugcucaccgaucgcaaugucccucuggugauuagggcagccgacgcugauaaggacagcaacgcccuucugguauaucauaucguggaaccgucaguucacacguacuucgcaauugacuccaguacaggcgccauacauacuguguugagccuagauuaugaggagaccucuaucuuucacuucacaguccaggugcaugacaugggcacaccccgucuguuugcugaauacgcggccaacgucacugugcacguuauugauaucaaugacuguccaccuguauucgcaaaaccccucuacgaggcuucccugcuuuuaccaaccuauaagggggugaaagucaucacagugaacgccacggaugcagacucaagcgccuuuucgcaacugauuuacucuauaacugaaggaaauaucggugagaaguucaguauggauuauaagaccggcgcucucacaguucagaacaccacucaguugcgguccagauacgaacugacagugagggccagcgacgggcgcuuugcgggacucaccucagucaaaauuaaugugaaggaguccaaagagucucaccugaaguucacgcaggauguauauagcgcagugguuaaagaaaacaguacugaggccgaaacacuugcugucaucaccgccauuggcaauccuaucaacgagccccuguuuuaccauauauugaauccggaccgaagauucaagaucucccggaccagcggugugcuaucuacuacagggaccccauuugauagggagcaacaggaggcuuucgacguggucguugaggugacagaagaacacaagccuucagcaguagcccauguggucgugaaaguuauuguggaagaccagaacgauaaugcucccgucuuugugaaccugccauauuacgccguaguuaagguggacacugaggucggacacgugauccgcuacgugacggcagucgaucgugacaguggcagaaauggcgagguucacuauuaccucaaagaacaucacgagcauuuccaaauugggcccuuaggagaaaucucccugaagaaacaguucgagcuugauacccugaacaaggaauaucucgugacaguaguggcgaaagacgguggcaauccugccuuuagcgcugaggucauagugccgauuacuguuaugaacaaggccaugcccguguucgagaagccauuuuacucugcagaaaucgcugagucgauucagguccacucaccugugguacauguucaggccaacagccccgaaggguugaaaguguucuauuccaucaccgauggagacccuuuuagucaauucacaauaaauuuuaacaccggcgucaucaaugugauugcaccacuggauuucgaggcccaccccgcuuacaagcucucuauccgggcgacugacagccugacgggugcccacgcagaaguuuuuguggauauuaucgucgacgauauaaacgacaauccuccaguguucgcucagcaguccuaugccguaacccuuucagaggccagugugauugggacaucugucguucaggugagggcaacugacagcgauuccgagcccaaccgcggaaucucauaccaaauguuuggcaaucauagcaaaucucacgaccauuuccacgucgauuccaguaccggccuaaucagccuguugcgaacauuagacuacgaacagucgagacagcacaccauuuuugugcgggcuguagaugggggaaugccgacucuguccucugacgugaucguuacaguggaugucacggaccucaacgauaauccuccacuguucgagcagcaaauauaugaagccaggauuucagagcaugcgccccacggucauuucgugaccugcguuaaggcuuacgacgccgauagcagugacaucgauaaacuucaguauuccauucugucuggcaacgaccacaagcauuuugucaucgacagcgcaacugggauaaucacacucucaaauuugcaccgccacgcccugaagccuuucuacucccuaaaccugagugugagcgauggaguguuuagaucuucaacccagguacaugucaccgugauuggcgguaaucuccacuccccagcuuuccuucaaaacgaguaugaaguugagcuggcagaaaaugcccccuuacauacauuggugauggaggucaaaacuacggacggggauagcggaaucuacggccacgugaccuaucauauuguuaacgacuuugcgaaggauagguucuacaucaacgaacggggccagauuuuuacacuggagaaacucgaccgugagacuccggcugaaaaggugaucucuguacgccugauggccaaagaugcagggggaaaggucgccuucuguaccgugaaugugauacuuacagacgauaacgacaaugcuccucaguuucgagccaccaaguacgagguuaacauugguaguucggcagcuaaaggcacuuccgucgugaagguacuggccagcgaugcggacgaagggucaaaugccgacaucacguaugcaaucgaggcugauucugaaagcgugaaagagaaccucgagauuaauaaguuguccggagucauaacaaccaaagaaagucugaucggcuuagagaacgaguucuuuacuuucuuugugagagccguugacaaugguucacccucuaaggagagcgugguccuaguguacguuaagauucugccaccugaaaugcagcuccccaaauucuccgagccauucuauaccuuuacagugagugaggauguacccaucgggacugaaauugaccuuaucagggcagagcacagcggaaccguccuguacuccuuggugaagggcaacacaccugaaucuaaucgggaugagucauucguuauagaccgccaaagcggcagacugaaacucgagaagucgcuggaucacgaaacgaccaaaugguaucaguuuuccauccuugcuaggugcacucaggacgaucaugagaugguggccagugucgacgugucuauucagguaaaggaugccaacgacaauagcccaguguucgaaucauccccguacgaggcguuuaucgucgaaaaccuccccgggggaucucggguuauucaaauccgagcuagugaugcagacagcgguacaaauggccaggugauguauucccuggaccagucacagagcguggaggucauagagucuuucgccauuaacauggaaaccggguggaucacuacauugaaagagcuggaucacgaaaagagagacaacuaccaaaucaaggugguugcuagugaucauggagagaaaauucaguuauccagcaccgccauaguagacgugacggucaccgaugugaaugacucaccuccacgcuuuacagcagaaaucuacaagggcacuguuucugaggaugacccccaggguggggugauugccauccuauccaccacagaugcugacucggaggaaauuaacaggcaggucacuuauuucaucaccggcggagauccucugggccaauuugcgguggagacaauacagaaugaauggaaaguauacgugaagaaaccacucgaccgggagaagcgugauaacuaucuucugaccaucacugccacggacgggacauucagcaguaaggcaauugucgaaguuaaaguguuggacgcuaaugauaacucucccgucugugagaagacccuguacuccgacacuaucccugaggaugugcucccgggaaaacugauuaugcagaucagcgccaccgacgcagauauuagaucaaaugccgaaauaacauauacgcuuuuagguaguggcgcugagaaguuuaaacugaacccagacaccggggaacucaagacuuccacacccuuggauagggaggagcaagccguuuaccaucugcucgugcgcgcgaccgacggaggcggucgguucugccaggcaagcaucguacugacucucgaagaugugaaugacaacgccccugaguuuucugcugaucccuaugccauuacagucuucgaaaauaccgagccagggacacuucugacucgagugcaggcaaccgacgcugacgccggcuugaacagaaagauccuguacucacucaucgauagcgcugacggacaguucuccauuaaugaacugucuggcauaauccaauuagagaaaccucuugauagggagcugcaggccguuuacacgcucagucuaaaggcagucgaccaggggcugccccgccgguugaccgcgacaggaacugugauugugucgguacuggauaucaacgacaauccaccggucuuugaauauagagaguacggugccaccgugagcgaagauauucucguuggcacagaggugcuucaggucuaugcugccucccgugacaucgaagcaaacgcugagauaacuuacucaaucauuucugggaacgagcacggaaaauucagcaucgauaguaagaccggcgccguguuuauuaucgaaaaucuggacuaugaguccucacacgaauacuauuugacgguugaggcaacagauggugggaccccuucucugagcgacguggccacugucaacgugaauguaacagauauaaacgacaauacccccguguucucccaagacacuuacaccacaguuauuagugaagaugcgguccucgagcagagcgugaucacggugauggcugacgaugccgacggcccaucuaacucacacauucauuacuccaucauagauggaaaucagggcagcaguuuuaccaucgaccccgucagaggggaaguuaaagugacuaaguuacuggaucgggaaacaauuucuggauauacccuuacuguacaggcauccgacaacggcucgccuccacgcgugaauacaaccacggucaacaucgaugugagcgacguuaaugauaacgcccccguguucucacgagguaauuacuccgucauuauccaagagaacaagccuguaggguuuucugugcugcagcuaguugugacagacgaagauaguagccacaauggaccgccauucuuuuucaccauagucacuggcaacgacgagaaggcuuuugaggugaacccccagggugugcuccugaccucauccgccauuaagagaaaagaaaaggaccauuauuugcugcaagucaaaguugcagauaauggcaagccucagcucagcucucuuacauacaucgacaucagggugauugaggaaaguaucuauccacccgcuauacugccuuuagagauuuucaucacuuccagcggggaagaguacucaggaggcguaauugggaaaauccacgccaccgaucaggacguguaugauacacugacguacucuuuggacccccagauggauaaccucuuuucggucagcuccacuggaggcaagcugauagcgcacaagaaacuagacaucggucaauaccuucugaauguuagugugaccgaugggaaguucacaaccguggcugacauuacuguccauauccggcagguaacacaggagaugcucaaccacaccauugccauccgcuucgcaaaucugacgccagaagaguuugugggagauuauuggagaaacuuccagagggccuugcgaaauauucugggcguucggcguaacgacauccaaauagugucucuccagucaagcgaaccgcauccucaccuugacguccuguuauuuguggagaaacccgguuccgcucagaucaguacuaagcagcuguugcacaaaauuaauucuagcguuaccgauaucgaagagauuauaggcgugagaauccucaacgucuuccaaaagcugugcgcagggcuagacuguccauggaaguuuugcgaugagaaaguauccguggacgaaucagucaugagcacacauucuaccgcccgccuuuccuucgugacuccuaggcaccaucgggcggccguuugucugugcaaggagggaagaugucccccagugcaccauggcugcgaagaugacccuugucccgaggggagugaaugcgucucagauccgugggaggagaaacacacaugugugugcccaagcggacgcuuuggccaguguccugguucguccucuaugacccucacagggaauaguuacguaaaguauaggcugacugaaaacgagaauaaauuggaaaugaaguuaaccaugcgacugcggacguacagcacacacgcugugguuauguaugcaagaggaaccgacuacucaauucucgagauccaucacggcaggcuucaguacaaguucgauugcggcuccgggcccggaauugugucuguccaaagcauccaggugaacgacggucaguggcaugccguugcucuggaggucaauggcaacuaugcccgccuagugcuggaucagguacacacugcaagugggaccgcuccaggaacacucaaaacuuugaaccuggacaauuacguguuuuucggcggucauauacgucaacaggggacgcggcacggaagaagcccccaggucggcaacggcuuuagggggugcauggauagcaucuaucuuaauggacaggaacugccucucaacucuaagccgcgcucauacgcccacauugaggaauccguggacguuagcccagguuguuucuuaaccgcgacagaggacugcgccaguaaucccugucaaaacggcggggugugcaauccuucucccgcaggaggcuauuacuguaaaugcucagcucuguauaucgguacccauugugaaauuuccgucaacccaugcagcucgaagccuuguuuguacgggggaacuugcgugguagauaauggcggcuucguuugucagugccgagggcuguacacaggacagcggugccagcucucucccuauuguaaagacgagccaugcaagaacgguggcaccuguuuugauagucuugacggggccgugugccaaugugauuccggauucagaggcgagaggugccagagcgacaucgaugaauguucagguaauccuugccugcacggggcacuaugugagaacacucauggaucuuaccacugcaauuguagccacgaauaucgcggcagacauugcgaggacgccgcuccgaaccaguacgucuccacacccuggaauauaggccuggccgaagggauuggaaucgugguguuuguugcggguaucuuccucuuggucgugguauuugugcugugccggaagaugauuaguaggaaaaagaaacaccaggcugagccaaaggauaaacaucuuggcccugcaaccgccuuccugcaacgucccuauuuugacucaaaguuaaacaagaacauauacagcgauaucccaccucagguccccgugcgaccgauuuccuauacgccaucuaucccuagugacagccgcaauaaccucgauagaaauuccuucgaggggucagcuauucccgaacacccagaguuuucuacuuucaaccccgaaucgguucauggacaccggaaagccguggcagucuguagcguggccccuaaucugcccccaccuccgcccuccaacaguccaucugacagcgacucaauccagaagccuuccugggauuuugacuacgauaccaaaguaguugacuuggaucccugccugagcaagaaaccacucgaggaaaagccuucucaacccuacagugcuagggagucccuuucagaggugcagagccugucuucguuccaguccgaaaguugugacgauaauggcuaucacugggacacaagcgauuggaugccgucagucccucuaccagacauacaggaguuucccaacuacgaagugaucgaugagcaaaccccucuguauucugcggacccaaaugccauugacacugauuacuaucccgguggguacgacaucgaguccgauuucccuccacccccggaagacuucccugcagccgaugagcuacccccauugcccccugaauuuagcaaccaguucgagaguauucauccaccccgcgacaugccugcugcaggaucacugggcuccagcucuagaaaucggcagagguuuaacuuaaaucaguaucuuccaaacuucuacccgcuggauaugagugaaccccaaacaaaaggcaccggggagaauagcacgugccgagagccucacgccccauaucccccuggauaucagcgucauuuugaagcuccagccguugaguccaugcccaugucuguguacgcgucaacagcaagcuguuccgacgucucggccugcugugaaguggagucugaaguaaugaugagugauuaugagagcggugacgauggccacuucgaggaagugacuaucccgccucucgacucacagcagcacaccgaggucuga

SEQ ID NO: 56133 - RNA, 13050 nt, Artificial Sequence
  derived and/or modified sequence opt3 from FAT2__Homo_sapiens__XP_011535905
augaccaucgcccugcucggcuucgcuauuuuucuucugcacugcgcgacaugcgaaaagcccuuggaagggauauuaagcuccucugccuggcacuucacucacucacauuacaaugcgacgaucuaugaaaauaguagcccuaagaccuacguggaauccuuugaaaagaugggaauuuaucuggcugaaccacagugggccgucagauacaggaucauuucuggugacguugccaacguguucaaaacagaggaguaugucgugggcaauuuuugcuucuugcggauccgcacuaagucgucaaacaccgcccuccugaaucgagaaguccgugauagcuacacacuuauaauccaagcuaccgagaaaacucuggaauuggaggcacucacaagagugguugugcacauucuggaccagaacgaucugaagccgcucuuuagucccccuuccuauagggucaccaucucugaggacaugccauuaaagagccccauuuguaaagugacggccacugaugcugaccuggggcagaaugccgaguucuacuacgcguuuaacacccgguccgagauguucgcaauccauccuacaucaggaguaguuacuguggccggcaaacuuaaugucaccuggcgcgguaaacacgaacuacaggugcuggcuguggauagaaugaggaagauaagugaggggaacggauuuggcagccuggccgcacucgucguucacguggaaccagcucugcggaaacccccugccauugcgucuguaguggucacaccaccggacuccaaugauggcaccacguaugccacugugcuuguugacgcaaacucaagcggggcugagguggagagugucgaagugguaggaggugaucccggcaagcauuucaaggccaucaaaucuuacgcucgcuccaaugaguuuagccugguuucggugaaggacauuaacuggauggaauauuugcacggguucaaucucucucugcaagcccgauccggaucaggcccuuacuucuauagucagaucagagguuuucauuuaccacccagcaaacuguccucucucaaguucgagaaagcagucuacagggugcagcuuagcgaauuuucaccuccagggagucgggucgugaugguucgugugacacccgccuucccgaaccugcaguauguauugaagccuuccagcgagaacgucggauuuaaacugaaugcucgcaccggccugaucacuacaaccaagcucauggauuuccacgacagagcgcacuaccaacugcauauuaggacgucucccggccaggcaucaaccgugguugugauagacaucgucgauugcaacaaucacgccccacuuuuuaaccggaguagcuacgacgggacacuggaugagaauauuccucccggaacuuccguguuggcuguaaccgccacagaccgagaucauggugaaaacggcuaugugacuuacucuaucgcagggccaaaggcccuccccuucucgauagacccuuaucugggaauuaucagcaccuccaaaccaauggauuacgaguuaaugaagcgcaucuauacauuuagaguuagggcuucagacuggggcaguccguuccggcgcgaaaaagaggucucuauuuuucugcagcuaagaaaucucaacgauaaucagcccauguucgaagaggugaacuguaccgguagcaucaggcaagacuggccuguggggaaguccauuaugacuaugucagccauagaugucgacgagcugcagaaucuuaaauacgaaaucguuagcggcaacgaguuggaauauuuugaccugaaucacuucucuggagugauuucccucaagcguccauucaucaaccugacggcaggccagcccacaaguuacagccuuaagaucaccgcgucugaugggaaaaauuacgcuuccccuacuacccugaacauuacagugguaaaggacccacauuuugagguccccgugaccugcgauaaaacuggaguuuugacacaauucacgaagaccauacuccacuuuaucggucugcagaaccaggagucaagugacgaagaguucacuagcuuaucgacauaucagauuaaucacuacaccccgcaauuugaagaucauuucccucaguccaucgacgugcuggagucugucccaauuaacacaccccuagcccggcucgcagccacugauccugacgcuggcuuuaaugggaaacugguguauguuaucgccgauggaaacgaagagggcuguuucgacauagagcuugaaaccgguuugcugacgguggcagcuccccucgauuacgaggccaccaauuuuuauauccugaacguaacagucuacgacuuagggacuccacagaaguccucauggaagcugcuuaccgugaaugugaaagauuggaacgacaaugcgccucgauuucccccgggcggauaucaguugacaauuagugaagacacugaggucggcaccacgaucgccgaacucacaaccaaggaugcugacuccgaggauaacgggagaguuagguacacucugcuaucuccgacagagaaauuuagccugcacccucucaccggagaacuggugguaacuggucaucuugaccgcgaguccgaaccccgguacauuuugaagguggaggcaagagaucaaccaucaaaaggccaccagcuguucagcgucaccgacuuaaucauaacacucgaagaugugaaugacaacaguccccagugcauuacggagcacaauaggcugaagguuccugaggaucuuccacccgggaccgugcugacuuucuuggacgccucugauccugaccucggaccggcuggcgaaguccgcuaugugcugauggauggugcccaugggacauuccgaguugaccuaaugaccggcgcacugauccucgagcgggaacuggacuucgagcguagagcgggauacaaccuuuccuugugggccagcgauggcgggaggccacuggcucgccggacauuaugucacguggaggucauuguacucgacgugaaugaaaaccugcaucccccucacuuugccucguucguucaucagggacaagugcaggagaacucaccaucuggcacucaggucaucgugguagcagcucaggaugacgauaguggucuugacggggaacugcaauauuuucuaagagccggaaccggccucgcagccuucuccauaaaucaggauacggguaugauccagacacuggcucccuuggacagggaguuugcgagcuacuauuggcugaccguguuagccgucgaucgaggcucuguuccucucagcuccgugacugaaguguacauugaggucaccgacgcaaacgauaauccgccccaaaugucacaggcuguguucuauccaaguauccaggaggacgccccuguugggacaagcguacugcagcuugacgccugggaucccgacucuuccucaaagggaaaacugacuuuuaacauuaccaguggcaauuacaugggguucuuuaugauccacccagugacaggauugcucagcacggcucaacagcuggaucgcgaaaacaaggacgagcacauacuagaagucaccgugcuggauaauggcgagccuucccuuaaaucuacuucgcggguuguggucgguauucucgacgugaacgauaaucccccaaucuucagccauaagcuguuuaacguaagauugccggaaaggcugucaccugucucccccgggccaguguaccguuuaguugcaagugaccucgaugagggacugaauggccgcgugacauauucuaucgaggacagcgaugaagaggccuucuccauugaccuugucaccggugugguuucaucuagcaguacuuucacagcgggcgaauacaacauccugaccauuaaagcuacggauuccgggcagcccccuuugagcgccucugugcggcuccacauagaguggaucccauggcccagaccuucauccauuccgcuggcauuugacgaaacuuauuacaguuucaccgucauggagacagacccagugaaucauaugguaggagugaucagcguugagggcaggcccgggcuauuuugguucaacauuucgggaggcgauaaggacauggauuuugacaucgagaagaccacugguucuauagucaucgcccgaccucuggauacacggcgcagauccaauuauaaccuuaccguggaggugacagacgggagcaggacuauugcuacccagguccacaucuucaugauugcaaacaucaaucaucaccggccccaauuucucgaaacgcgauacgagguaagagugccacaggauacaguuccuggaguggagcuguugcgcguccaggccauagaccaggauaagggcaagucauuaauuuauaccauccacgguagucaagaccccggcucugcgucccuguuccagcucgauccaagcucaggggugcugguuacugugggaaaacuugaccugggcagugggccuagccagcauaccuugacagucauggugagggaucaagaaaucccgauuaagcguaacuuuguaugggugacuauacacguugaggacggaaaucuacaucccccacgguucacccagcugcacuacgaggcuuccgucccugacacgaucgcccccggcacagagcuccuacaggugagagcaauggaugccgacaggggugugaacgcugaaguccacuacucucuuuuaaaagggaauagcgagggauuuuucaacauuaaugcccugcucggcaucauuaccuuggcacagaagcuggaucaagcuaaccaugccccacacacucucacaguuaaagcggaggaccagggcuccccucaguggcaugaucuggccaccgugaucauacacguauaucccucagaccgcucugcaccgaucuuuaguaagucggaauacuucguggagauuccagaaagcaucccugucgggucccccauucuucuggugucugcuaugucaccaagcgagguuacuuaugaauugcgagagggaaauaaggaugguguguucuccaugaacaguuacucuggccuaaucagcacacagaaaaagcuggaccaugagaaaauaucauccuaucaacucaagauuagagggaguaauauggccggagcuuuuaccgaugucaugguagugguugacaucaucgaugaaaacgacaaugcacccauguucuuaaaaagcacguuugugggccagauuucugaggccgccccucuguacuccaugaucauggacaagaacaauaacccguucgucauacacgcuucagauagcgacaaggaagcaaauucgcuucugguguauaaaauucucgagcccgaagcauugaaguuuuucaaaaucgauccaucuauggguacucugaccauugucagugagauggacuacgaguccaugccuagcuuucaguucugcguguacguucacgaucaggggucacccgugcucuuugccccucggccagcucaaguaaucauacaugugagggacgucaacgauucucccccucgcuucagcgaacagauuuaugagguugccaucgugggaccaauccaccccggcauggaacugcuuaugguccgugcaagcgacgaggauagugaggugaacuacuccauuaagacaggcaaugccgacgaagcuguaaccauccauccggugacagggagcauuucuguucuaaacccugcguuucugggauugucaagaaaauuaacuauacgggccagugauggucuguaucaggacaccgcacucgugaagaucucccugacgcagguccuugauaagagccugcaauucgaccaggacguguacugggcugccgucaaagagaaucuccaggauaggaaggcauuggugauucugggcgcccaagggaaccaccuaaaugacacacugucuuauuuucuccuuaacggaacugauauguuccacaugguucagucggcuggcguacugcagacccgcgguguggccuucgaccgagaacagcaagauacacaugaguuagcggucgaagugagagacaaucggaccccacagaggguugcacagggguuggugcgcgucucaaucgaggaugugaacgacaaucccccuaaauuuaagcaucugccguacuauacuaucauucaggauggaaccgagcccggcgacguacucuuccaagugagcgccacagaugaagaccugggcacgaacggggcuguuacuuacgaguuugccgaagacuacaccuauuucagaauagauccguaccuuggagacaucucccugaaaaagccuuuugauuaucaggcucucaauaaauaccacuugaaggucauugcaagggacgguggcacacccagucugcagucugaggaagagguguuagugaccguccggaacaagagcaauccacuauuccaguccccuuauuacaaaguucgugugcccgagaacaucacucuguauacaccaauucuccacacccaagcccgcucacccgaagggcuucgacugaucuacaauauaguagaggaagaaccuuugaugcuguuuacgacugauuucaagacaggagugcucaccgucaccggcccacuggacuacgaaaguaaaacuaagcauguguuuacaguuagagcuaccgauacagcccuugguucuuucagcgaggcaacuguggagguccucguggaagacguaaacgauaacccgcccacguuuucccagcugguuuauaccacaucaaucagcgagggguugccugcgcagacuccagugauucaacuguuagccucugaccaggauuccggaaggaaucgggacgucaguuaccagaucguggaagauggcagcgacgugucgaaauucuuucagauuaacggcuccaccggggagaugucuacaguccaagagcuagacuaugaagcucagcagcacuuccacguuaaggugcgcgccauggauaagggagaucccccucugaccggugagacucucguaguggucaaugugucagauaucaacgacaauccacccgaguucagacagccucaauacgaggcaaacguuagcgaacuugcuacguguggccaucugguguugaaaguccaggccauagauccggacaguagggauaccucccggcuggaguaucucauucugucugggaaucaggaccgacacuuuuucaucaacagcucauccggaauuaucaguauguuuaaucuuugcaagaaacauuuagauagcucuuacaaccugagagugggcgcaucagacgguguauuccgcgccacaguuccaguguauauaaauacuaccaacgcuaauaaguacucccccgaguuucagcaacaccucuacgaagcggaguuggccgaaaacgcaauggucgggacaaaagugaucgaucugcuagcuauugacaaggauagcggaccuuauggcaccaucgacuacacuauuaucaauaagcuggccucugagaaauucaguauaaaccccaacggccagauugccacacuccagaaacuugacagggaaaauucgacggagcggguuaucgcaaucaaagugauggcucgugaugggggagguagagucgccuuuugcaccgugaagauuauccugacugacgagaacgauaauccaccucaguucaaagcguccgaauauacaguaagcauacaaucaaacgugucuaaggacagccccgucauucagguuuuggcuuacgaugccgacgagggccagaaugcagaugugaccuauuccgucaacccagaagaccuggugaaggauguaaucgagauuaauccggugaccgggguugugaaagucaaggacagucucgugggacuggaaaaccaaacauuagacuuuuucaucaaagcccaggacggcgguccuccccacuggaacucacuuguuccagucaggcuacagguggugcccaagaaaguaucucucccuaaguuuagcgagccacuauacacuuucuccgcucccgaggaccugccugaagggagugagauaggcaucgucaaggcaguggccgcgcaggauccgguuauuuauagcuuggugcgcggaacgaccccagaauccaacaaagacggcgucuuuucucuggaucccgacacaggggugaucaagguucggaaaccuauggaucaugagucaacuaagcucuaccaaauugacgugauggcucacugucuucagaauaccgauguagucagccuggugucggugaacauccagguuggagacgucaaugauaaccgaccaguguucgaggccgaccccuacaaagcaguauugacagaaaauaugccuguggguaccuccgucauucaggugacugccaucgauaaggacacgggcagagaugggcaaguuaguuauaggcugucugcugaccccggaagcaacgugcaugaacucuucgccauagacucagaauccggcuggauuacaaccuuacaggagcuggauugcgaaacuugucagaccuaccacuuucaugucguggcauaugaccacggucagacaauccaacuuucuagucaggcucugguucaggugagcaucacugaugagaacgacaaugccccacgcuucgcguccgaggaauaccgggggucaguagucgagaacagcgaaccgggcgagcuaguggccacccucaaaacacuggaugcagacauuucugaacaaaauagacagguuacgugcuauauaaccgagggagauccuuugggccaguuugggaucagucaggugggagacgaguggcguauuuccagcaggaagacucuggaucgggaacacacagcuaaguaccuccuucgcgucaccgccucagacgguaaauuccaagcaucugugacuguagagaucuuugugcuggaugucaacgacaauagcccccaguguucgcaguuacuguauacaggcaagguucaugaagauguguucccagggcacuuuauuuugaaagugagcgcuaccgaccucgacacggauaccaacgcccagaucacauacagucugcauggaccuggcgcccacgaguucaagcuagacccccauacuggugaacuuaccacacugacugcgcucgaucgagagagaaaagacgucuuuaaucugguggcuaaggcaaccgaugggggcggaaggucuugccaagccgacauaacauugcacguugaggauguaaacgacaaugcuccacgguucuuuccuucccacugugccguggcagucuucgauaacaccacugugaagacgcccguugccguggucuuugcucgcgacccggaucagggcgcgaaugcccaggugguauacagccugccagacucagcagaagggcauuucaguaucgacgcuacaaccggagugauuagacucgagaaaccucuucaggucaggccccaagccccacuggaauuaacuguucgagcauccgaucugggcacccccaucccuuugagcacacucgguacggugaccgucucugugguugggcuggaggacuaucuaccgguguuccuuaacacugagcacucaguacaggugccagaagaugcacccccuggaacagagguccugcagcucgcuacccugacucggcccggcgccgaaaagacagguuaccgugugguuagcggcaaugagcaagggagauuucgcuuggacgcgaggaccggaauuuuauaugucaacgcaucccuggauuucgaaacaucuccaaaauacuuucucaguaucgagugcucgcggaaguccuccucaucucuuagcgacgugacuaccgugaugguaaauauaacggaugucaacgagcauagaccucaguucccccaggacccauauaguacccgcgugcuggaaaacgcccuaguuggcgaugugauucugacagucuccgcuacugacgaggaugggccucucaauucagacaucaccuacucuuugaucggaggcaaccagcugggucacuuuacaauucacccgaaaaagggggaacuucaaguggccaaggcacuggauagggagcaggcuagcuccuauagucucaaauuacgagccacugacagcggacagcccccacugcaugaagacaccgauauagcuauccagguugccgacgugaaugauaacccuccccgguucuuucaauugaauuacucuacgacaguccaggagaacucaccaauuggcuccaaggugcugcagcucauccuuagcgacccugauagucccgagaaugguccgccauacucuuucagaauuaccaaaggcaacaauggguccgcauuuaggguaacuccugacggauggcuggugacagcggaaggccuaucgcgccgugcccaggagugguaucaacugcagauccaggcuagcgauucagggauacccccacucuccucuuugaccaguguucggguccacgugacugaacagagccauuacgcccccucagcacugccucuugagaucuucauuaccgugggagaagacgaguuucaaggcgguauggucgggaagauccacgcuacagauagagacccccaggauacgcugaccuauuccuuagccgaggaagagacucucggaaggcauuucagcguuggcgcaccagacggcaaaauuaucgccgcgcaggggcugccucgcggacacuacucuuuuaacgugacaguaagugaugguaccuucacuacaaccgcuggcgugcacgucuauguguggcauguugggcaagaagccuugcagcaggcaauguggaugggauucuaccagcugacgccggaggagcucguguccgaccacuggcgaaaucuucaacgguuucugagccauaagcuagacauuaagagagccaacauacaccuggcuucacuccagcccgccgaagcagucgcuggcguagauguguugcugguuuucgagggucacucugggacauuuuaugaguuccaggaguuagccucgaucauuacccauagcgcgaaagaaauggagcacuccgugggaguccagaugaggagugcuaugccaauggugccuugucaaggccccacuugccagggccagaucugucauaauaccgugcaccuugacccaaaggucgggccuacauacucuacugcccgccugucaauccucacccccagacaucaucugcagcggagcugcuccugcaacggaacagcaacgagguuuaguggucaaucuuacguucguuaucgagccccggcugcacgcaauuggcacauucauuucuacuugaaaacucugcagccucaggccauacuccuuuuuaccaacgagacagcgagcgugucccugaagcuagccucaggcguaccacaacuggaauaucacuguuuagggggauucuacggcaaccucagcucucagagacaugugaaugaucacgaguggcauuccauccuggucgaagagauggacgcuaguauucgguugaugguugauucaauggguaacaccagccuuguggugcccgaaaauugcagggggcugcgcccugagagacaccuccuguugggaggccugauccuacuccacucguccucuaacgucagucagggcuuugaggggugucuugacgcaguagugguuaaugaagaggcccuggauuuacuggcuccaggaaaaacuguggccggucuccuggaaacacaggcauugacccaaugcugucuucauagcgacuauugcucacagaacacgugucugaauggcgggaagugcuccuggacucacggagcuggcuacgucuguaaaugucccccucaguucucugguaagcauugugagcaggggcgggaaaacugcaccuuugccccaugccucgagggaggcacauguauucugagccccaagggcgcgaguugcaauuguccgcacccuuacaccggggauaggugcgagauggaagcccgaggauguuccgagggucacugccuagugacucccgaaauccaacguggcgacugggggcagcaggaguugcugauaaucacaguugcaguggcuuucauuaucauuagcaccgucggacuccuuuucuauuguagacgcugcaaaucucauaagccaguagccauggaggaucccgaccuguuagcacggucagugggcgucgacacacaggccaugccugcuaucgaacugaacccacucuccgccagcaguuguaauaaccugaaucaacccgagccuucuaaagcgucagugccaaacgaauugguuacuuuugguccaaauuccaagcagaggcccguggucugcagcgugccuccaagacuucccccugcugcaguaccaucgcacucugauaacgagcccgugauaaaacgcaccuggaguuccgaagagaugguuuacccagggggagccaugguguggccuccaacguauagccggaacgagaggugggaauacccccauucagaggucacacagggcccucugcccccaucugcucaccgacauagcaccccggugguuaugccugaacccaauggccucuaugggggauucccauuuccccuggagauggaaaacaagagagccccucuaccaccccgguacuccaaucagaacuuagaggaccugaugccuaguaggccaccgucaccccgcgagcguuuggucgcaccuugucucaaugaauauacugccauuagcuacuaccacucccaauucagacaggguggcgggggaccaugccuggcugauggcgguuauaagggggugggaaugcgacuuucuagggcgggccccaguuacgccguaugcgagguggaaggcgcaccucuggccgggcagggacaaccacggguacccccuaacuaugaggguagcgacaugguggaauccgauuacggcucaugugaggagguuauguuuuga

SEQ ID NO: 56134 - RNA, 13674 nt, Artificial Sequence
  derived and/or modified sequence opt3 from FAT3__Homo_sapiens__NP_001008781
auggacaucauuaugggccacugcguggggacccgacccccugccugcugccugauacuccuucuguucaaguuguuagcuacagucagccagggucugccagguacuggcccgcuaggguuucauuucacgcacuccaucuacaacgcaaccguuuaugaaaauucugccgcgagaacauacgugaacucacaaagucggauggggauuacucucaucgaucugagcugggacauuaaauaucgcaucguauccggcgaugaagaaggauuuuucaaggcugaagaggugauaaucgccgacuuuuguuuccuucguauuagaaccaaagggggaaauucugcaauccugaacagagaaauucaggauaauuacuugcucaucgucaagggcucggugaggggcgaggaccuggaggccuggacaaaaguuaacauacaggugcuggauaugaaugaccuccggcccuuauuuucaccuaccacuuauagcgucacaauugcugaaaguaccccacugcgcacguccguggcacagguaacugccaccgaugcugacaucgggucuaacggagaguucuacuauuacuuuaagaauaagguugaucuuuucagcgugcaucccacauccggugucauuucauugaguggcagacugaacuacgacgagaaaaauagguaugaucuagagauccucgccguggaccgggggaugaagcuguacggaaacaauggcgugagcucuacugcgaaacuuuauguccacaucgagcgcauuaacgaacaugcaccuaccauacacguugugacacacguaccauuuucccuggagaaggaacccaccuacgccguggucacgguggacgauuuggacgauggugcuaauggggagaucgaaucaguuagcauuguggccggagacccucucgaucaauucuuucuggcaaaagagggcaagugguuaaacgaguauaagaucaaagaacgaaagcagauagacugggagaguuucccauacggcuauaaccugacucuccaggcuaaagauaaggggucuccgcagaaaugcuccgcccuuaaggcggucuacauuggaaaucccacaagagacaccgugccuaucagguucgaaaaagagguauacgauguuagcaucucggaauuuucuccacccgguguggucguggccauugucaagcuguccccugagccaaucgacguggaguauaaguugucacccggcgaagaugcaguuuacuucaaaauuaacccgcggagugggcuaauagugacugcucguccucugaauacaguaaagaaagaggucuauaagcucgaagugaccaacaaagagggagaccugaaggcccaaguuacgaucagcauugaagacgcuaaugaucauacccccgaguuucagcagccacuuuacgacgccuaugugaacgaguccgucccugugggcacaucuguacugacugugagcgcaucagauaaggacaaaggugaaaauggguacaucaccuauaguaucgccuccuugaaccuccugcccuucguuauuaaucaguuuacaggcgucauaagcacuaccgaggaauuagauuucgagucuucaccagagaucuaccgcuuuauugugagagcuagugacuggggaagccccuacaggcacgaauccgaggugaacgucacaauccggauuggcaauguuaacgauaauucuccucuguucgaaaagguggcgugucaaggggugaucucguaugacuuuccaguaggaggucauauaaccgcagucagcgccaucgauauugacgagcuagaacucgugaaauacaagaucauuuccggcaacgagcugggguucuuuuaucuuaauccggauucaggaguuuugcagcugaaaaagagucucacuaacucuggcaucaagaacgguaauuucgcucugcgaauaacggccacagacggggagaaccuugcagaucccaugagcauuaauaucuccgugcugcacggcaaagucucaagcaagucuuuuuccugccgcgaaaccagaguggcccagaaauuggcugagaagcuccugauuaaagccaaggcaaacggaaaguuaaaucuggaagacggcuuccuagacuucuacaguaucaacaggcaagggccuuauuuugauaagagcuucccaucugacguugcggugaaggaggaucuccccguaggagcuaauauacugaaaaucaaggccuacgacgcagauuccgguuuuaacggcaaaguccuuuucacuauuucagacgggaauaccgauaguuguuuuaacaucgacauggaaacaggacaguugaaggugcugaugccuauggaucgggagcacaccgaccucuaucuguuaaauauuacuaucuacgaucugggcaacccacagaaaagcucguggcgccuuuugacaauaaauguggaggacgccaacgauaauucccccgucuucauucaggacucuuacagcguuaacauccucgaaucaagugguaucgggacggagauuauccaaguggaagcuagagacaaggaucugggcuccaacggagagguaaccuauucugugcuaacugacacacagcaguuugccauuaauagcuccaccggcauagucuacguggcagaucagcuggacagggaaucaaaggcuaacuauagccucaaaaucgaggcccgugauaaggcggagagugggcaacagcuguucucuguugugacacuuaaagucuuuuuggacgaugugaaugacugcuccccggccuucauuccuagcucguacucaguuaaggugcuggaagauuuaccagucggaacuguaaucgcuuggcucgagacccaugaccccgaucugggccuugguggacaggugcgguauucucugguuaacgacuacaauggacgauuugaaauugacaaagcaaguggcgccaucagauuguccaaggagcucgauuaugagaagcagcaauucuacaaccugacggugagggcuaaagacaagggucgcccugucagccuaucuagcguguccuuuguagaaguggaggucguugaugugaaugaaaaccugcacacccccuacuucccagacuucgccguggucggcucagugaaagagaauagucggauagggacaagcguucuccagguaacugcaagagaugaagacucuggaagggauggcgagauccaguauuccauucgcgacgggucaggacugggccgauuuaguaucgaugacgagagcggugugauuaccgcggccgauauccuugaccgggaaacaaugggguccuacugguugacugucuaugcuaccgaucguggagugguuccucuguacucuacgauagagguguauauugaagucgaggacgugaacgacaaugcccccuuaacaucggaaccaaucuacuauccgguagucauggagaacagcccuaaggaugugucaguuauccagauucaagcagaggaccccgauuccaguucuaaugaaaaacucaccuacagaauaacuagcggcaacccacagaauuucuuugcuaucaacauuaagacaggucugaucaccacuaccuccaggaaacuugaccgcgagcagcaagccgaacauuuccuggaggugacagucacggauggcgggcccucaccuaaacagucuaccauuugggugguugugcagguccuagacgaaaacgauaauaagccacaguuucccgagaaaguguaccaaaucaagcucccugagcgggacaggaaaaagaggggagaaccgauauaucgagcauucgccuuugaucgcgacgagggcccaaacgcugaaaucagcuacaguauuguagaugggaaugacgauggaaaguucuuuaucgaccccaaaacuggcaugguguccagccggaagcaguucacagcggguucuuaugacauucugaccaucaaagccguugauaacgggagaccucagaagucauccacagcaagguugcacauagaguggauuaaaaagccacccccuaguccgaucccccugacuuuugacgagccauucuacaauuucaccgucauggaaagcgaucgugugacggagaucgugggagucguaucggugcagccugcuaacacacccuuaugguuugacauuguuggcgguaauuucgauucugccuuugacgccgaaaaaggcguggggaccaucgucauagcuaagccacucgaugcagagcaacgcuccauuuauaacaugagcguggaaguuacugacggaaccaauguggccgucacacagguguucaucaagguacuggauaacaaugacaacggcccugaguuuucacagcccaauuacgaugugacuauuagugaggacguucuuccagacaccgaaauccugcagauagaggcgacagaucgggacgaaaaacauaaguugucuuauacgguccacuccagcauugauucaaucaguaugagaaaauucaggaucgacccgagcaccggggugcucuacacugcugagcgacuggaucacgaagcccaagacaagcauauucuaaacaucauggugcgggaucaggaguuuccuuaccgcagaaaucuggcaagggucauuguuaacguggaggacgccaaugaucacucccccuauuucacaaacccacuuuacgaggcuucuguauuugagagcgcagcccucggauccgcggugcugcaggucaccgcuuuggacaaagauaagggcgaaaacgccgagcugauauauacuaucgaagcagguaauacagggaacauguucaagauugagcccguguuaggaaucaucaccauuuguaaagagccugacaugacgacuaugggccaauuuguucucucaauaaaggugaccgaucagggcucuccacccaugagugccacagcuaucguccggauuucgguaaccaugagcgacaauucccauccuaaauucauccacaaggacuaccaggccgaagugaacgagaauguugauauugggacuucugugauccugauaucagcaaucagccaguccacacuuauuuaugaagucaaagacggagauaucaacgguauuuuuaccaucaauccguacaguggcgugauaacaacucaaaaggcucuggacuaugagcgaaccucuagcuaccaguugauuauccaggccacgaacauggcggggauggccucaaaugcaacagucaacauucagaucguggaugagaaugacaacgcuccaguuuuccucuucucccaauacaguggaagccugucugaagccgcucccauaaauuccaucgugagaucacuagauaacagcccucugguaauucgcgcaaccgacgccgauucgaauaggaacgcccuucucguguaucagaucgucgagucuacugcuaagaaauuuuucaccguugacaguuccacaggcgcgauucguacuaucgcaaaccuggaucacgaaaccauagcccauuuucacuuccaugugcacguccgggacagcgguucaccccaguugacggcugaguccccaguggaaguaaauauugaggugacagacguuaacgauaauccucccguguuuacccaggccgucuucgagacuaucuuacugcucccaacauacgugggggucgaagugcugaagguuucugcaaccgacccugauagcgagguaccgcccgaacuuacuuauagucugauggagggauccuuggaccauuuucuaaucgauagcaacucuggcgugcugacaauuaaaaauaacaaucucucaaaggaccacuacaugcugaucgucaaagugagugauggcaaguucuauuccaccagcaugguuacgauaauggugaaggaagccauggacucugggcuucacuuuacucaaucguucuacucaaccagcauuuccgagaacaauacaaacaucaccaaagucgcuauugugaaugcgguaggaaacagauuaaaugagccacugaaguauaguauccucaacccugguaauaaauuuaagauaaaaucuacaagcggcgugauccagacuaccgggguucccuucgauagggaagaacaggaauuguacgagcuggucguggaagccucccgcgagcucgaccaucugcgaguggcaagagucguugugcggguaaacauugaggauaucaacgacaauucaccaguguuugucggacuuccuuacuaugcugccgugcagguugaugcagaacccggcacgcugauuuaccaagugacagccaucgacaaggacaaggguccgaacggggaggucacuuauguguugcaggaugacuacggacacuucgaaauuaauccaaacaguggcaauguaauccuaaaagaggcuuucaacucugaucugagcaauauagaguauggcguuaccauucucgccaaggacgggggaaaaccuuccuuaucaacaagcguggaacugcccaucaccaucgucaacaaggcgaugccaguguuugauaaacccuucuacacugcaucugugaaugaggacauuaggaugaacaccccuauacuuuccaucaaugccacaaguccggaaggucagggcauuaucuauauuaucauagauggggaccccuuuaagcaauucaacaucgauuuugacacgggaguccugaaaguugugagcccacucgauuacgagguaacuucggcuuacaaguugaccauucgcgccuccgacgcucugacaggcgcacgugccgaagugaccgucgaucuccuggugaaugacguuaacgacaauccucccaucuucgaucagccuacuuauaacacaacccuuucugaggcuucacuaauugguacgccagugcugcaggucgugagcaucgacgccgauagugagaacaauaagaugguacauuaccagauaguucaagacacuuauaacuccacagauuacuuucacauugacucuagcucaggguugaucuuaaccgcaagaaugcuggaucaugaacucgugcagcacugcacccugaaaguccgguccaucgacaguggauuccccagccuuucuucagaggugcugguucacauuuauauauccgaugugaaugacaacccuccagucuuuaaucagcucaucuacgaaagcuaugugucugaguuggcgcccaggggccauuucguaacuugugugcaggccagugaugcugacucguccgacuuugaucgccuggaauacagcauucuaucaggcaacgaccgaacaucuuuccugauggauagcaaguccggggucaucacccucaguaaucacagaaaacaacggauggagccgcuuuacucacugaacguuucugugagcgacggauuauuuacauccacugcccagguccauauuaggguguugggugcaaaucuguauaguccugcuuucagccaguccacguacguagccgaggugcgcgaaaacguugcagccggcaccaaggugauccacgucagagcuacagauggggacccaggaacuuauggccagauaucuuacgcgaucauuaaugauuucgccaaagacagguuucucaucgauucaaacggucaagugauuaccacagagcggcuggaccgugaaaauccccuugagggggauguuagcaucuucguccgcgcacuggacggaggcggccgaaccacuuuuugcacggugagagugauuguagucgaugaaaacgacaaugcuccucaguucaugaccguggaguauagggccucgguucgggccgacguggggcgcggacaccucgucacacaggugcaagcaauagauccagacgauggugcuaacuccagaaucacuuacaguuuguauucugaggccagcguuucaguggcggaccuguuagaaauugaucccgacaacggcuggaugguaaccaaggggaauuuuaaccagcuaaagaauacaguccuguccuucuuugugaaagcuguggauggaggcaucccgguuaagcauucucucaucccugucuacauucacgugcuucccccagagaccuuccugccuaguuuuacucagagccaguacuccuucacaauagccgaagacacggcaaucgguucaaccguagauacuuugaggauucugcccagccaaaacgugugguuuucuacagucaauggggagcggccagagaacaauaaaggcggaaucuucgugauugaacaggagaccggcaccaucaagcucgacaaacgacuggauagagaaacaagucccgccuuucauuucaagguugcugcaacuauaccucuugacaagguggauaucgucuucacgguggacguugacauuaaagugcucgaucugaacgacaauaagccaguauuugagaccuccagcuaugauacaaucauuauggaagggaugccggucggaacuaaauugacccaggugcgcgccaucgacauggauuggggugcgaacggccagguuacauacucacugcacucugacucccaacccgagaaggugauggaggcuuucaauauagauucgaacaccggguggauuagcacuuuaaaagaccuagaucaugaaacggacccuacauuuaccuucagugucguggccucugaucugggagaggcauuuucccucagcucaacugcccuuguaagugugagggucaccgacaucaaugacaacgcuccaguuuucgcccaggaaguguaucggggcaaugugaaggaguccgaucccccuggugaagucguggcaguucugagcacaugggaccgugauacuucugacguaaacagacaggugucauaccacauuaccgggggcaacccaaggggacgcuuugcuuugggccugguccagagcgaguggaagguguauguuaaacggccccucgaucgagaggaacaagacaucuacuuccugaauauaacagccacggaugggcuuuuugugacccaggcgauggucgagguguccguaucugacgugaacgauaauaguccugucugcgaccagguugccuauacugcauuacugccggaagauaucccaucgaacaagauuauccucaaagugagcgcuaaggacgccgauauuggauccaaugguuacaucagauacucauuguauggcucugggaacagcgaguucuuucuggaccccgaaaguggagagcuaaaaacacuggcacuccuugacagggagcgcauaccugucuacucccugauggcuaaggccaccgauggcggugggcgguucugucagucaaauauucacuugauccuggaagacgugaacgauaaucccccaguauuuucuagcgaccauuauaacacuugcguguacgagaauacagccaccaaagcgcuccugacgagaguacaagcuguggauccugacaucggcauuaaccguaaggucguguauuccuuagcagauagugccggaggcguuuucagcaucgacucuucauccgggauaauuauccuugaacagccccuggauagggagcagcaaagcaguuacaauauuucuguccgggcuaccgaccaguccccaggacagucgcucagcucacuaacaacugugaccaucacagugcuggauauaaacgacaauccgccuguauucgagcgccgagauuauuuggucacugugcccgaagacaccuccccaggcacacagguucuggccguguuugcaaccucuaaggacaucgguacuaacgccgagauuacguaccucaucagaagugggaacgaacaaggaaaauucaagauuaaucccaaaacaggcgguaucagcgucucagaggugcuugauuacgaacuguguaagagguuuuauuugguuguggaggcuaaagacggcgggaccccugcgcuguccgccgucgcaacugugaacauuaaucucaccgauguaaacgacaauccacccaaguucagccaggauguguacucugcuguuaucagugaggacgccuuagucggagauuccgugauacugcuuaucgcagaagacguggauagccagccuaacggccagauucacuuuucaaucgucaauggggaccgggauaacgaguucacaguugacccggugcugggccuaguuaaggugaaaaagaaacucgaccgcgaaagagucucuggcuauucgcuguuggugcaagccguugauagcgguauuccagcuauguccaguacggccaccgugaauauagacaucucugaugucaacgacaauucacccguauuuacuccugcgaacuacacagcagugauucaggagaauaagccaguugggaccagcauccugcagcucguggucacugauagggacuccuuccauaacggacccccuuuuaguuucucuauucuuagcggcaaugaagaggaggaauuugugcuggauccccacgguaucuuacgauccgccguggucuuccagcacacagagucacuggaauauguuuugugcgugcaagcuaaagacagcggcaagccacagcagguaucucauaccuacauacgggugcgugucaucgaggaauccacacacaagccgacugccauuccucucgagaucuuuauuguuaccauggaggaugacuuccccgggggagugaucggcaaaauacaugcaacggaucaagacauguacgaugugcugaccuucgcucuaaagagugaacagaaaucacuuuuuaaggucaacagccacgacgggaaaauuaucgcccugggaggccucgacucggguaaguauguacugaacguguccguuucugaugggagauuccaggugccaaucgacgucgugguucauguggagcaguugguccacgaaaugcugcaaaauacaguaacuauucgcuuugagaacgugaguccugaggauuucgucggacuccacaugcauggcuuuaggcggacccuuagaaaugcugugcugacacagaagcaggacagcuuacgcauaaucucaauucagcccguugccggcacuaaccaacuggauauguuguucgcaguggaaaugcacuccucugaguuuuacaaaccagcguaucucauccagaagcugagcaaugccaggcgacaucuagaaaacauuaugcggaucagugcuauacuugagaaaaauuguuccgggcuggacugccaggaacagcacugugagcaaggacucagccuggauucucacgccuugaugaccuacucaacggcaagaaucuccuucgucugcccuagguuuuaucgcaacgugcguuguacaugcaaugguggcuuaugucccgggagcaacgacccgugcguagagaagccaugcccuggagauaugcagugugugaguuacgaggcuucucggagacccuuccugugccaguguccacccggcaaacucggugagugcucagggcauaccucccuuagcuuugccggaaauucguauauuaaguacaggcugucugaaaacaguaaagaggaagacuucaagcuagcacugcgccuccgaacuuugcaauccaauggcaucauuauguacacacgggccaacccuuguaucauacugaagauuguugauggcaaacuuugguuccagcuggacugcgggagcggaccggguauccucggcauuucagggagagcggugaaugauggaucuuggcacagcgucuuuuuagagcugaacaggaauuucaccuccuugagucuggacgacucauauguggagcgcagacgggcuccacucuacuuucagacucuuagcaccgaauccucuaucuauuucggcgcccugguucaggcagauaacaucaggagucuaacagacacgcgugucacccaagugcugagcgguuuucaggggugucucgauuccguaauuuugaacaauaacgagcugccccuucagaauaagcgaucaucuuucgccgaaguggucggacugacugaguuaaaacucggcugcgugcuguacccugacgcuuguaagcgcucgcccugccagcauggcgggagcuguacaggauugccauccgguggcuaucaauguaccugccugagucaguuuacugggagaaacugugaaucugagauaacagccugcuucccuaaucccugucggaacggaggcagcugcgauccaaucgguaauaccuuuauuuguaacugcaaagcagggcucacgggaguuacaugugaggaagacaucaaugagugcgaaagggaggagugugaaaacggcggcucaugcgugaaugucuucggguccuuucuuuguaacugcaccccuggauacgugggucaguauugcggccugcgcccgguaguugugcccaauauucaggcugggcacagcuacgucggaaaggaggaacuaaucggcauagccguggugcuguucguuaucuuuauucucgucguguuguucaucguauucagaaagaaaguguuucggaagaacuacucuaggaauaacauuacucugguccaagauccagcgaccgcugccuuacuuaacaaaaguaaugguauaccuuuccgaaaccugcguggguccggagacggcagaaauguguaucaggagguuggacccccacaggugccuguccgccccauggcauacacaccguguuuucagucagauagccggucuaaccucgacaagaucguggaugggcugggaggugaacaucaagagaugacuaccuuccacccagagucgccuaggauuuugacagccagacgcggcguaguugugugcuccgucgcucccaaucugccagcagugagucccugucggagcgacugcgacucaaucaggaaaaacgggugggaugccggaacggaaaauaagggcguugacgauccuggugaggugacuuguuuugcggggucuaacaagggauccaauagcgaaguccagagucucucauccuuccagagcgacucuggcgaugacaacgccuaucacugggauaccagugacuggaugcccggcgcucgacuuagcgauaucgaggaagugccaaauuacgagaaccaagacgggggauccgcacaucaggguucuacaagagagcuggaaucagauuauuaccuaggcggguaugacauugauagcgaguacccuccgccccacgaagaggaauuucugucccaggaccaguuaccaccuccccucccagaggacuucccugaucaauacgaggcccugcccccgucgcagccuguaucuuuggcuaguacccuuagcccagacugccggaggcgcccccaguuucauccuucacaguaucugccaccccacccuuucccaaaugaaacugaucucgugggacccccggccuccugugaguuuucuacauucgcagucagcaugaaccaaggcaccgaaccuacgggucccgcugacuccguuagucugucauugcauaauagccgugggacuucuuccagugaugugagcgccaacugcggcuuugacgauucagagguggcgaugucugacuacgaguccgucggagaacugucgcuagccagccuccacauaccauucguggagacccagcaccagacacagguuuga

SEQ ID NO: 56135 - RNA, 14946 nt, Artificial Sequence
  derived and/or modified sequence opt3 from FAT4__Homo_sapiens__NP_078858
auggaccuggcccccgauagagcuaccggcaggccuuggcucccacuucacacacugagcgugucccaguuguuacgggucuucuggcugcuaucucuccugccggggcaagcauggguucauggagccgagccccgccagguguuucagguacuugaagagcagccuccagguacucuggugggcacgauccaaacccgacccggguucacauaccguuugucagaaagucacgcgcucuuugcuauuaacagcuccacuggagcccuguauaccacaucuaccauagacagagagucgcugccuucagaugucaucaaucucgugguuuuaagcagugcaccaacuuaccccacagaagugaggguccuggugcgggaccuuaacgauaaugccccuguauucccagacccguccauuguugugaccuuuaaggaggauucuagcuccggccgccaggucaucuuggacacggcuacugauucagacauugguaguaacgggguggaucauagaagcuauaggaucauacggggaaaugaggcaggccgcuuccgacuggacaucacccuaaaccccucuggcgaaggggccuuucuccaccugguguccaaaggaggucuugauagagaggucacaccucaguaccagcuguugguugaaguggaggacaagggcgagccaaaaaggcggggguaucuccaaguaaaugugacuguccaggacauuaacgauaaucccccuguguucggaucaagccauuaccaggcuggcguuccagaagacgccguggucgguaguucugugcugcagguagcggcagccgaugcugacgaggggaccaacgccgauauccguuaucgcuuacaagacgaaggaacacccuuucagauggauccggagaccggccugauuacgguuagagaaccucucgacuucgaggcaaggcggcaguacucccuuacugugcaagcuauggaucgaggcguccccagccugacagggcgcgccgaggcguugauccagcuacuggacgugaaugauaacgacccagucgugaaguuuagauacuucccugccaccucgagguaugcaucuguugacgaaaaugcucaggugggaacuguagucgcccuccugacagugaccgaugcugacucccccgccgcaaacgguaauauaucaguucagauucuuggcgggaacgagcaacggcacuuugaagugcagaguagcaaagucccaaaccuguccuugaucaagguggccucugcucucgaucgcgagagaauucccagcuacaaucugacgguaucagugagugacaacuauggagcgccuccaggcgcagccguucaggcuagguccagcgucgccucuuuagugaucuucgugaaugauaucaacgaccacccgcccgucuucucacagcaaguuuaccgugugaaucugagugaagaggcaccuccagguagcuauguguccgggauuucugccaccgauggcgacucgggacuaaacgcuaaucuccgguacagcauaguauccggcaacgggcugggaugguuucauaucucagagcacaguggucuugucacaacuggcucuagcgggggauuggaucgagaacuggccucccagauugugcucaauaucucagcaagagaccagggcguucaucccaaggugagcuaugcgcagcuggucgugacccuucuggauguuaacgacgagaaaccuguguucucucaaccagaagguuacgauguauccgucguggagaaugcucccacagggacugaauugcucaugcugagggccaccgacggcgacuuaggagauaacggcacagugcgcuuuagucugcaggaggcagagaccgaccggagaagcuucaggcuagauccggucucugggcgccucuccacuauaucaagucuggaccgagaagagcaggccuuuuacagccuuuugguucuggcuacggaucucggaucgccuccacaguccucuauggcccggauuaaugugagccuguuagacaucaacgauaauucacccguauucuauccugugcaauacuuugcacacaucaaggaaaacgagcccgguggcaguuauauuacaaccgucuccgcuacugacccagaucuggggaccaacggaacagugaaauacucuaucagcgccggcgaccguuccagauuccagguuaaugcgcagucaggugugauuagcaccaggauggcccuugaucgcgaggaaaagacugcuuaucaauugcagauagucgcaacagacgggggcaaccuccagaguccuaaucaggccaucgugacgauuaccguucuggauacucaagacaaccccccaguguuuucucaggucgcuuacuccuucguaguguuugagaauguugcccuaggauaucacgugggcagcgucucggcaucaacaauggaccugaacucuaauaucaguuaccucaucaccacaggggaucagaaaggaauguucgcgauuaaccaggugacuggccaacugaccacggccaauguaauagaccgggaagagcaguccuuuuaccagcuuaagguggucgcuagcggugggaccguuacaggagauacuauggugaacaucaccgugaaggacuugaaugauaacucuccgcauuuccugcaggccauugaaagcgucaaugugguugagaacuggcaagcaggccacuccaucuuccaggcuaaagccguagacccugaugagggugugaauggcauggucuuauauucacucaagcagaaccccaaaaaccuguuugcaauuaaugaaaagaacgggacaaucagucuucugggaccauuggacgugcaugccggcagcuaccaaauagagauccucgcuucugauauggggguuccccagcuguccucaagugugauucuaacugucuaugugcacgacguaaaugauaacagcccugucuucgaccagcuguccuacgaagugacccucucugagucggaaccaguuaauagcagauuuuucaaagugcaggcgucagacaaggauuccggagccaacggcgagaucgcauauacgauugcugaggguaauacaggggacgccuuuggaaucuuccccgauggccaacuguacauaaaaagugaacuugacagggaguugcaggaucgauauguccugauggugguugccucugaccgcgcuguggaaccuuuaagcgcaaccgucaacgugacuguaauucucgaggaugugaaugacaaccggccgcuguuuaauuccacaaacuacaccuucuacuuugaagaggagcagagagccgguucauucguuggcaaggucucugcgguggauaaggacuuugggccaaauggagaagugagguauagcuucgagaugguccagcccgauuuugaacuucaugcuaucaguggcgagauuacuaacacccaccaauucgaccgugagucccugaugcgccggagagggacagccguauucagcuuuacggugaucgcaaccgaucagggaauaccucagccacuaaaagaccaggccacuguucacguguacaugaaggacaucaaugauaacgcucccaaauuccucaaggacuuuuaucaagcaacaauuucugaaucagccgcgaaccugacccaggucuugaggguguccgcuagugauguugacgagggcaauaacggucugauccauuacagcauuaucaaagggaaugaagagcgacaguucgccauagauucgacaucuggacaggugacuuuaauuggcaagcucgacuaugaagcaaccccugccuacucccuggucauccaagcuguggauagcgguacgaucccgcuuaacucaacaugcacccugaauauugacaucuuggaugagaacgacaauacucccaguuuuccaaagucuacccucuucguagaugugcuggagaacaugcggauuggcgaacuaguuuccagcgucacagccacugacucagauaguggggacaaugcagaccuguauuacagcauaaccggaacaaacaaucacggcacguuuuccaucucuccuaacaccgggagcauuuuccuugcuaaaaagcucgauuuugagacucagucccuguacaaauugaauaucacagccaaggaccagggacgccccccaagaucaucuaccaugaguguggugauucaugucagggauuucaacgacaauccucccucguuuccaccgggcgauaucuucaaaagcauaguugaaaacaucccuauugguacuuccgugaucucuguaacagcgcacgaccccgaugccgacauuaaugggcaacugucauauaccaucauacagcagaugccacggggaaaccacuucacgauugaugaggugaagggcacuaucuacaccaacgcagaaaucgaccgagaguuugcuaauuuauucgagcucacagucaaggccaacgaucaggcugugcccauugaaaccagacgcuaugcacugaaaaauguuacuauacuugugacagaccugaacgacaaugucccuauguuuaucagccaaaacgccuuggccgcugauccauccgcgguaauuggcagugugcucaccacaaucauggcagccgaccccgaugagggggcuaauggagaaauugaguacgaaaucauaaacggugacacugauaccuucaucguugacagguauucuggcgaucugcguguggccagcgcacuagucccuucacagcugauuuacaaucuuaucguguccgccacggaccucgggccggagcggagaaagaguacaaccgagcugacuauuaucuugcagggauuagauggcccagucuuuacccagcccaaauauauaacaauucugaaggaaggugagccuaucgggacuaacgugaucagcauugaagcugcgucucccaggggauccgaggccccaguugaguacuacaucgugucaguacgcugugaagagaaaaccgugggccgacucuucacgauaggcagacauacagggauuauccaaaccgcagcuauucuggaccgggaacagggagccugccuuuaucuggucgauguuuacgcaaucgagaagagcacugccuuuccuaggacacagcgcgcugaaguggagauaaccuugcaggacauuaaugauaaccccccagucuucccuacugacaugcuagaccugacaguggaggaaaauaucggugauggcucgaagaucaugcaacucaccgccauggacgcggaugagggggcaaacgcccugguaacguauacuauuaucucuggagcugacgauaguuuucguauugacccggaauccggcgaucuuauagccaccagacgguuagacagggagcgccgaagcaaauacucacugcucgugagagcugaugacgguuugcaguccucugauaugcggaucaauauuacaguuagcgacgugaacgaccacacccccaaguucaguaggccagucuauuccuuugauaucccugaagacacaauccccgggagccugguggcagccauucucgcuacugaugacgauucuggagucaacggcgagauaaccuacaucgugaaugaggacgaugaagacggcauuuucuuucugaacccaaucacggggguuuucaaucuuacacgccuguuggauuaugagguacagcaauacuacauucuaacugugagagccgaagacggagguggccaguucaccacaaucagggucuauuuuaacauacuggaugugaaugacaacccucccaucuucucacucaauaguuacuccaccagcuuaauggagaaccugccgguugggucuacugugcuugucuuuaaugugaccgaugcagacgacggaauuaacucgcagcugacauauucaaucgcgagcggcgauucccucggucaguucacgguagacaaaaaugggguguugaagguucugaaagcccucgaucgggaaagucaaucuuuuuacaaccuggucgugcaggugcaugaccuuccacagauuccugcuagccguuucacuuccaccgcccaggucucaaucauacuacuggauguuaaugacaaccccccaacauuuuugagucccaaguuaaccuauauuccugagaauacuccgaucgauacagugguauucaaagcacaagcuaccgaccccgauucuggaccaaacagcuacauugaguauacgcugcucaacccucugggcaauaaguuuuccaucggcacuauagacggggaagugcgccuuacaggagagcuggaucgagaagaggucucaaacuacacccucaccgugguugccacugacaagggucagcccagcuugucuuccaguacagagguggucgugaugguacuggauaucaaugacaacaauccuauuuucgcacaggcccuauacaaaguugaaaucaacgagaauacccugacaggcacugacauuauccagguguuugcugcggauggggacgaaggaacgaacggccaagucagauaugguauagugaaugggaacaccaaucaggaguucaggauugauagcgugacaggagccaucacugucgcaaagccacucgaccgggaaaaaacccccacauaccaccuuaccguucaggcuacugaucgcggcucgacgccuagaaccgacacauccacugugucuaucguacuguuagauauuaacgacuuugugccagucuucgaguugucacccuauagcgugaauguuccggagaaccugggcacccucccuaggacaauccugcagguggucgcccgggaugacgaucgagggaguaauuccaagcuuucuuacgugcuguucggagguaacgaagacaacgccuuuacccucagcgcaucaggcgaguuggggguaacucaaucccuggacagagaaacaaaagagcgcuucguuuuaaugauaacggcuaccgauaguggaagcccagcccuaacuggcacagguaccauuaaugugaucgucgacgaugugaacgacaauguucccaccuuugcgucuaaggcuuauuucacaacuauuccugaagaugccccaacggggaccgacgugcugcucgucaacgcaucagaugccgacgcuuccaagaaugcagugaucaggauaaucggcggaaacagccaguuuacaauuaaucccucuacuggccagaucauuaccagugcccuucuggaucgggagacaaaagacaacuacaccuugguaguggucuguucggaugcgggguccccggagccucugagcucaucuacuagcguucucgugacggucacagacgugaaugauaaccccccacguuuccaacaucacccuuauguaacccacauccccuccccaacucugcccggaaguuuuguguucgcuguuaccgugacagacgccgacauugguccuaauucagaacuucauuacucucucagcggcagaaacuccgagaaguuucacaucgauccacugaggggggcaauaauggccgcuggaccguugaauggcgccagugaagucacuuucagcgugcauguuaaagacgguggguccuuucccaagaccgauucuacaacggucaccgugcgcuucgugaacaaagcagacuuuccuaagguacgggcuaaggagcagacuuucauguucccagaaaaucagcccgucucaagccuggugacaaccauuacuggcucguccuuacgaggagagccuaugaguuacuauaucgccucuggcaaccuagggaacacauuucagaucgaucaacugaccggacagguuagcauuucacagccacucgacuucgagaaaauacagaaguacguggucuggaucgaagcgagagaugguggcuuucccccuuucuccucuuaugagaaacuugacauuacggugcuggauguuaaugacaacgccccgaucuuuaaggaagauccauucauuagugagaucuuggagaaucugagccccaggaaaauacucaccguguccgcaauggacaaggauucagggccuaacggacaacuggacuacgaaaucguaaauggcaacauggagaauagcuuuucuauuaaccacgcuacaggugaaauccgcaguguccggccccuugacagagagaaggugucccauuauguguuaacuauuaaaagcucagauaaggggucuccaucccagucgaccagcguuaaagucaugaucaauauacuggacgaaaacgauaaugccccucguuucagucagauuuuuucugcacacgugcccgagaacuccccacucggcuacacaguaacuagggugaccacaagcgacgaggauaucggaaucaaugcuauuucacgguauaguauaauggacgccuccuugccguucaccaucaacccuagcacuggcgauauugucaucucucgcccccugaaucgagaagacacggauagauacaggauucgggugucagcccacgacagcggguggacaguuuccaccgaugugacuaucuuugucaccgacauaaacgacaacgcgccacgcuucucuagaacaaguuacuaucuagauugccccgagcugacggaaaucggaucgaaggugacccagguuuuugcuacugacccugaugagggcagcaauggucaaguguucuacuucauuaaaucccagucagaauauuuuaggaucaacgcaacaaccggggagauuuucaauaagcagauccucaaauaccaaaacguaacuggauuuucuaaugucaacauuaaucgacauagcuucauagugacaaguuccgaccggggcaagccaucacuuaucucugagaccacaguuacuauuaacaucguggauagcaaugacaacgccccccaguuucugaaguccaaauauuucaccccugucacgaagaaugugaaaguagguaccaaguugauccgugugacagcuauugaugacaaagauuuuggccugaacagugaagucgaguacuucauaagcaaugacaaccaccucgggaaguuuaagcuggauaaugacacuggauggaucucuguugccucauccuuaauuagcgaucuuaaccagaacuucuuuaucaccgugacagcaaaagacaagggcaauccgccacugaguucucaggccacugugcauauuaccgucacggaagagaacuaucacacacccgaauucucccaaucgcacaugagcgcuaccaucccugagucacauuccauagggucuaucgugagaacuguuagugcgcgcgacagggaugccgcaaugaauggacucauuaaauacagcaucucauccggcaacgaggaagguauuuuugcuaucaauagcucuacagggauacuaacccuggccaaggcauuggacuacgagcugugucagaaacacgaaaugacuauuagugccaucgauggaggcuggguagcucggaccgguuauugcuccgugacagucaacgugauugacguuaaugauaacagcccaguguuccucucagacgauuacuuccccacgguccuugagaaugccccuucuggcaccacugugauccaucugaacgcgacagacgcagauucggggaccaaugccguaauagcuuauacugugcagagcuccgacagugauuuguuugucaucgaccccaacacaggaguuauuaccacgcagggcuuccuggauuuugagacaaagcaaucuuaccaccucaccgugaaggccuucaaugucccagacgaagagagauguucauuugcaacugugaacauccaguuaaaagggaccaaugaauauguuccgcgcuucgugagcaagcuguacuauuuugagauuuccgaagcugccccuaaaggaacaaucguaggcgagguguucgcuagugacagggaucuugguacugacggggagguccauuaccugauauuuggaaacucucgaaagaaaggcuuccagauuaacaagaagaccggccagaucuacgugagcgggauccuagaucgggaaaaagaggaaagaguuucccucaagguccuggccaaaaauuuuggaucaauuaggggugcagacaucgaugaggugacagugaacguaacggucuuggacgcgaaugaucccccaauauucacucugaacauuuauagcgugcaaaucucugaaggcguuccuauugggacccacgugacauuugucuccgccuucgacagugauucaauccccagcuggucgcgcuucuccuacuuuauaggaucuggcaaugagaacggugcuuucaguaucaauccacagaccgggcagauuacugugacagccgagcucgaccgugaaacccuuccuaucuauaaccugagcguuuuagcaguggauucaggaacgcccuccgcuacuggcucugccagccuguuggucacccucgaggacauuaaugacaacggcccgaugcugacagugagugaaggggagguaauggaaaauaagcggccaggaacccuagugaugacucuucaauccacagauccugaccugcccccaaaccagggucccuuuaccuacuaucuccugagcacaggcccugcaacuucuuacuucucauuguccaccgccgggguucugagcacgacaagagagaucgauagggagcagauugcggacuuuuaucucagugucgugaccaaagauucuggagugccgcagaugucauccacuggcaccguccacaucacaguuauagaccaaaaugauaacccaagccagucgcgcacuguggaaaucuucguaaauuacuacgguaaccuuuuucccgggggaauucugggcucugugaagccucaggaccccgaugucuuagacaguuuccauugcucccugacgagcggcgugaccucauuguuuucuaucccagggggaacaugugaucucaauagccagccucgauccaccgacgguacuuucgaucugacaguucuaaguaacgacggcgugcacucaaccgucacuagcaacauucggguauuuuucgcuggguucuccaaugccacaguggacaacucuauacuucugagacucggaguucccaccgugaaggauuuucugacgaaucauuauuugcacuucuuaaggaucgcaaguagccaacugacuggccucgguaccgccguccagcuuuacuccgcuuaugaggaaaacaaucgcacauuucugcuagccgcagugaaaagaaaccacaaucaguacgugaacccaucaggggucgcuaccuucuuugagucuauuaaggagauccugcuccggcagucgggaguuaaaguggaaagcguagaccaugauuccugcgugcacggcccuugucaaaauggcgggaguugcuugaggcgucuggccgucucuagcguucuuaagucacgagagucccugccggugauuaucguggcgaacgaaccccuccagccauucuuaugcaaaugucugccuggauaugcugguagcuggugcgagauagacaucgaugaauguuugcccucuccaugccauaguggcgggacuugucacaaucuggucggaggcuuuuccugcucauguccugacgguuucacagggcgcgccugcgagagagauauuaacgagugucuccagagccccugcaagaauggagcaaucugucagaacuuuccgggcucuuucaauugcguaugcaaaaccggcuacacggggaagaugugugaaucguccgugaacuauugcgaguguaacccaugcuuuaauggagguaguugucaaagcggcguugacucauacuacugccauuguccuuucgggguguuuggaaagcacugcgaacuuaacucuuauggcuucgaggaacuguccuacauggaguuccccagccuagauccaaauaacaauuauauuuacgucaaauuugccacaaucaagagucacgcucugcucuuguauaacuacgacaaucagacuggugaucgggcagaguuccuggcccuugaaauagcggaggaaaggcugcgcuuuucauacaacuuaggguccggaaccuauaaacucacaaccaugaagaaagugagcgacggccauuuccacacuguuauugccagacgggcuggcauggcagccucucugacgguggauaguuguagcgagaaucaggaacccggguacugcaccgucuccaacguagcugugucugacgacuggacauuggauguccaaccuaauagggugacuguuggagguauccgaucacuggagcccauccuccagcguagaggccauguggagagccacgacuuugucggguguauuauggaauucgccgugaacggacgcccacuugagccuucccaggcacuggcugcccagggcauacuagaucaaugcccgcggcuggaaggugcgugcaccaggucgcccugucagcacgggggcacaugcauggacuauuggucuuggcagcagugucauugcaaggagggacucaccggcaaguacugugagaaaaguguaacuccagauacagccuugagccuggaagggaagggaagauuagacuaucacaugucacaaaaugagaaacgcgaauaccuucugcggcagucccucaggggugcaaugcuggagccuuuuggcgugaacucuuuggaaguuaaguuccgaaccagaagcgagaauggggugcugauccauauucaggaguccaguaacuauacgacugucaaaaucaagaacggaaagguguacuuuacaucagaugcuggcauugccgguaaaguugaacggaauauccccgaggucuacguggcagacgggcacuggcauaccuuccucauaggcaagaacggaacugccaccguacuuagcguggauaggaucuauaaucgcgacauuauccacccaacacaggauuuuggcgggcuggacguccuaaccauuucucugggagguaucccucccaaccaagcucaccgugacgcccagacggcgggcuucgaugggugcauagcuuccaugugguacggaggcgaaaguuuaccguuuagcgguaaacauucacucgcaucuauuuccaagacagacccuucggugaaaaucggcuguagagggccaaauauuugcgccagcaaccccuguuggggagaucuguugugcaucaaucagugguaugcuuaccgauguguuccuccaggcgacugcgccagucaccccugccaaaacgggggauccugugagccuggccuucauucugguuucacuugcucauguccagauagccacaccgggaggacaugcgaaaugguggucgcaugucugggagugcucugcccccagggcaagguauguaaggccgguuccccggcuggccauguuugcgugcugucucaggggccugaggagaucagcuugccccugugggcggucccagccauugugggaaguugugcaacugugcuagcccuccuuguucugucauuaauacugugcaaucagugucggggcaaaaaggcuaaaaaccccaaggaagagaaaaagccuaaagaaaagaagaaaaagggguccgagaaugucgcauucgacgauccagacaacauccccccuuauggagaugacaugaccgugcgcaaacaaccagaaggcaauccgaagcccgauauuaucgagagagagaacccuuaccucauuuaugacgaaacagauaucccacacaauagcgagaccauacccucugccccucuggcuaguccagaacaggagaucgagcacuacgacauugacaacgccuccagcaucgcgcccucagaugcagacauuauacagcauuacaaacaguuuaggucgcacacuccgaaguucucuauccaacggcauagcccuuuggguuuugcccgccaguccccaaugccccuuggggcuaguucacugacguaucagccuucuuacggacagggccucagaaccagcucccugagucacagcgccugccccacaccaaacccgcuaucucgacacuccccugcacccuucucaaagagcucgacuuuuuauaggaauuccccagcucgggaauugcaucugcccauucgugaugguaacacccucgagaugcacggcgacacaugccaaccugggaucuucaauuacgccacccgccuuggaagaaggucuaaaaguccacaggcgauggccucacauggcagccggcccggguccagacugaagcagccuaucggacagauuccauuagaaucuagcccgcccguaggccugaguauagaggaaguggagcgccucaacacuccucgaccaaggaaucccucaaucuguuccgcugaucacggucggagcucuuccgaggaagacugcagacguccucugagucgcacaaggaacccagcagaugggauucccgccccugagagcucaucugacuccgauagccaugaaucguuuacguguagugagauggaauaugaccgggagaaaccgauggucuacaccucuagaaugcccaaguugucacaagugaaugaguccgaugcugacgacgaagauaacuauggagcacgacuuaaaccaaggcgcuaccacggccggagagccgagggcgggccuguuggaacucaggcugccgcacccgguacagccgacaauacccugccaaugaagcucggccagcaagcggggaccuucaacugggauaaucugcuaaacuggggaccuggcuuuggucacuacguggacgucuucaaggauuuagcuagccugcccgaaaaagccgcagccaaugaggaagggaaggcuggaacuacaaaaccagugccgaaggacggcgaggccgagcaguauguauga

SEQ ID NO: 56136 - RNA, 552 nt, Artificial Sequence
  derived and/or modified sequence opt3 from FATE1__Homo_sapiens__NP_149076
auggccggcgggcccccuaacaccaaggcugagauggaaaugagccuggcagaggaacucaaucacggaagacagggugagaaccaagaacaucuugugaucgccgagaugauggagcugggcuccaggucucgcggggcgucacagaaaaagcagaaauuggaacagaaggcugccggaagugcaagcgccaaacgggucuggaauaugacagcuacucgaccaaagaagaugggcucccaauuaccgaaaccccguaugcugagagagucuggucacggggacgcacaucuacaggaauacgccggaaacuuccagggcauuagguuucacuaugaucggaauccuggcacggacgcuguugcccagaccucgcucgaggaguucaacgugcuggaaauggagguaaugcgcagacaacuuuacgcggugaauaggcggcugcgcgcauuggaggaacagggggccacauggcgacauagagaaacucucauaaucgcuguccuggugucagccagcauugcaaaccuguggcucuggaugaaucaguga

SEQ ID NO: 56137 - RNA, 402 nt, Artificial Sequence
  derived and/or modified sequence opt3 from FAU__Homo_sapiens__NP_001988
augcagcuguucgugagagcgcaagagcuccacaccuuugaagucacaggccaggagacuguugcucagaucaaggcacauguggccagccuugaagggauugcgcccgaggaccagguagugcuguuggcuggagccccuuuagaagaugaggcaacgcugggucaaugcggcgucgaggcccuaaccacacucgaaguggcugggaggaugcugggaggcaaaguucacgguucccuugcacgggccgggaaggugcgcggacagacuccaaaagucgcuaagcaggagaaaaagaagaaaaagaccggccgagccaaacguagaaugcaguacaacaggcgguucgugaauguaguuccgacauuuggcaagaaaaaggggcccaacgccaauucuuga

SEQ ID NO: 56138 - RNA, 3402 nt, Artificial Sequence
  derived and/or modified sequence opt3 from FBF1__Homo_sapiens__NP_001074011
auggcccccaagaccaaaaagggcugcaaagugacacugccugagaagccagucaaacucgcuagccacacuagagacacgaccgggguuucccagauguucccgucuucaaaggcaaggacaaagagucuucugggagaugacguguuuagcacuauggccgguuuggaagaggcggaugcugaaguauccggcaucucugaggccgacccccaagcauuacugcaggccaugaaagaucuagacgggauggaugcugacauucucggacugaagaaaucgaacucagcaccuagcaagaaagccgcuaaggauccaggcaagggugaacuucccaaucauccuaaaccagccgggggagcgauacccaccaagaaaagucugccuuccccaucuagcuccggccaccagaaccggcgcuucucaagugaggacuuggaggauccgcuccgaggccugcugagcuacgacgaagggggaaucacaaagcagcccccugugacccaaucuaaaacugcauccgauaagucaccaagcacaguccgugaccagggucccaguauuccucucaccccaggcgacacgcccaucagaaagaaagaggaauuacuguuugaugacggggaugacauuauggccacucuuggauucggcgauucuccgaaggcugagaaaaggcagaucggugaccaggaggggccucggcccgcccgcuccaccuuggaugaacugcuaggaagaggcauggcaacaaagcuccuggcuaggccaggcacuggggagcaucgggaauuuaaacuugacaagaaauaucaacgcccucaggauagcgaggacauguggggagaugaagacuucaccuuuggugccuaccagcccacagugguuucgucugagggccgacaguccagaaggcaaucagugcgguucuuugcggacaguggggccgauccaaagggagagcccggcagcaagcaguccccuccaauggcaucuagcccgauacagccccguaaagguggggcugacuggcugggcuugaaggaugaagaccucgaucuguucccugccucaccaacccgcgaggcucacagagaaaguuccguccccgugacgccuagcguaccacccccggccucucaacauucaacuccugcaggauuaccacccaguagggccaaaccucccacagagggcgcugggagcccagcgaaggcaucccaggccucuaaacugcgggcuucgaaggaagagaaggaggacuggcucagccacgcccuuucccgcaaaaagucacagggacuggcacgagaacagcacgccgguaccagugagggcuugcaucuagcugggacugccggacacccucccucuggcagccaaccacugacauccacccagggucucgaacaugcagcggcugggggcucaagcggaacgaccgccagagagaggccguguguucggccuggcgugucugggucccccgucacacagaaucacgcagccagugcucugccaacuggaagccccaaacgcgguaccgccccuggcgaucuuucugcaacagaaccagcuacuugcuuucccuccacccagaagccuacagagccgucagugccagugcaaccccuguugccugagagucucgccagaagccuguuaccaucgaccgaauaucagaaacagcugcuagcggcccagguccaacuccaguguucccccgcugagcugcaggcagaacuuuugcacucucaggccaggcuggcugagcucgaggcccaaguucguaagcuggaacuugagcgggcacagcaugaacuguugcucgggagccugcagcaacagcaccaggcggacuuagagcugaucgaaucagcccaucgaaguagaauuaaggugcuagagacuuccuaccagcaaagggaggaacgccuccggagagagaacgaagaacugucugcuagguaucuuagccagugccaggaagccgagcaggcacgcgcugaguugacggcccaacaccagcgacggcuggcagccaucgcucaggaaaaagaucaggagauggaacgucucagagagcugcaaagggcguccauuuuagacaugcgccgggaucaugaggagcagcugcagagacuuaaguugcucaaagacagggagguagaugccgcaacaucagcuaccagccacacucgaaguuuaaauucuaucauacaccaaauggaaaaguucuccagcucgcuacaugagcugucaucucgcguggaagccagucaccucaccacaucccaggagcgggagcugggaauuagacagagggacgaacagcuucgugccuugcaagagcgccugggccagcagcagcgggacauggaagaggaaagaagcaggcaacaggaggucaucgguaaaauggaggcucgauuaaacgaacagucucggcuccuggagcaggaacgcuggagagugaccgcagagcaaagcaaggccgaauccaugcagagggcgcuugaggagcagcggaaaguuacugcucagcaaauggccauggaacgagcagagcuggaaagagccaagucagcuuugcucgaggaacagaagagugugaugcugaaauguggggaggagcgcaggcgucuagcagccgaaugggcggaguuuagcgcucagcaaaagcugucuaaagaacgggccgagagagaggcagaaagggcccuccaggucgauacacagcgcgagggcacgcugauuucccuugcuaaggaacaggccgaguugaaaauccgagcaucagaacugagagcugaggagaagcaauuagccgcggaacgggccgcacucgagcaggaaaggcaggagcugcgccuugaaaaggagcguaucaaugcuaccgcccugagagugaaacuacgggcugaggaaguagagaguaugagcaagguugcauccgaaaaauacgaggaaggagagagggcccuccgcgaggcccagcaagugcaggcugaacagcaggcgcgacugcaagcaguccagcagcaacaggagagauugcggaagcaggaacagcauaugcaccaagagcaccugucuuuagcccagcagaggcuccagcuggaccgcgcuagacaagaucuuccuucgagccuggugggcuuguucccgagggcccaggggcccgcagccucaucccagagugcucucaugccuccagcgcccacuacacgguggugcucucagccaccuaccggacuggaccccagcccacuacaucugcacgcccgucuugcacuccugcgccauauggcugagcaagaucgagacuucuuggaaaacgagcaguuuuuccuggaaacacugaaaaagggcuccuauaaucucacuucacacucugccuga

SEQ ID NO: 56139 - RNA, 966 nt, Artificial Sequence
  derived and/or modified sequence opt3 from FBL__Homo_sapiens__NP_001427
augaagcccggcuucagcccuagagggggagguuuuggcgggaggggaggcuucggugaccgcgggggacggggcggccgagggggauuugguggcgggcguggaagaggcgguggguucaggggacggggccgcggcgggggagguggcgggggaggcggugggggcggaggcagagggggagguggcuuucacuccgggggaaacaggggccggggucgcgggggcaaacgaggaaaucagucuggcaagaacgugauggucgagccacauagacacgaagggguuuucaucugcaggggaaaagaggaugcccuggugaccaagaaucucguaccgggugaaucaguguacggcgagaaacgggucaguauuagcgaaggggacgauaagauagaguaucgugcuuggaaccccuuucgcuccaaacuugcagccgcgauccugggaggcguggaccaaauucauaucaagccuggugcuaagguuuuguacuuaggggccgcaucuggcacaacugugucgcacgucucagauauugugggaccagacggccugguauaugccguugaguucagccauagaagugggagggaucuaaucaaucucgcuaaaaagcggacgaacauaauccccgugauugaagacgcacgacacccucacaaauaccgcaugcugaucgccauggucgaugugauuuuugcugacguggcccagccagaucagaccagaaucgucgcgcuuaaugcacauacauuccugaggaacggaggccacuuuguuauauccauuaaggccaauuguaucgacucuacugcuagcgccgaggcaguguucgcuuccgaaguaaagaaaaugcagcaagagaacaugaagccccaggagcaguugacccucgaaccuuaugagcgggaucaugccguggucguggguguuuaccgcccaccgcccaaagugaagaauuga

SEQ ID NO: 56140 - RNA, 945 nt, Artificial Sequence
  derived and/or modified sequence opt3 from FBLIM1__Homo_sapiens__XP_011539920
auggccagcaagcccgagaaaagaguggcuuccucugucuucaucacccuggcaccuccaaggcgggacguugccguggcggaagagguacgccaggcugugugcgaagcccgacguggcagaccgugggaggcacccgccccuaugaagacaccagaagcugggcucgcaggaaggcccucaccuuggacuacgccaggucgggccgcugccaccguccccgcggcaccuaugcaacuuuuuaacggcggguguccaccgcccccuccagugcuggauggagaggacguuuugcccgauuuagaccugcuaccuccacccccgccucccccaccugugcuccugcccagugaggaagaggccccagcucccaugggcgccagccuuauugcagaucuggaacaguugcaccucuccccuccaccgcccccuccacaggcucccgccgaggguccuucuguccagccagggccccugcgcccgauggaggaggaacugccuccacccccugcggaacccguggagaaaggagccucgacagacauaugcgcauucugucauaagacuguaucaccaagagaacucgcuguugaggccaugaaaaggcaauaccacgcucagugcuuuaccugucggacaugccgccgacaguuagccggccagagcuucuaucaaaaggauggcagaccucugugugagcccugcuaccaggacacccuugaaaggugugggaagugcggagaggugguccgggaucauaucauucgugcauugggucaggccuuucacccaaguuguuucacuugcgugacaugcgcucgcuguaucggcgacgaauccuuugcgcuggggucucagaaugagguguauugccuagaugacuucuacagaaccgcaggaagcuccugucucucaaguccgaggacgaaagccgcuacuccuuga

SEQ ID NO: 56141 - RNA, 2052 nt, Artificial Sequence
  derived and/or modified sequence opt3 from FBLN1__Homo_sapiens__NP_001987
auggagagagccgcucccagcaggcgggugccucugccacuccuucuguugggcggguuagcacugcuagccgcgggagucgacgcugauguucuccuggaagccugcugugcagacggucaccgcauggccacccaucagaaggauugcucccuuccguacgcuacagagucuaaagaaugucgaauggugcaagagcagugcugucacucacagcuggaagaguugcauugcgcaacuggcaucagucucgccaacgagcaggaccguugugcuacgccccacggggauaaugccagccuggaagcgaccuucguaaagagaugcugucauugcugucugcucggaagggcagcccaagcucagggccaguccugcgaguauucuuuaaugguggguuaccagugcgggcaagucuuucgggccuguugcgugaaaucgcaggaaacaggagaccuggauguuggcggccuucaggagacugacaagauuauagagguggaagaggaacaggaggauccuuauuugaacgaccgcuguagagggggagguccaugcaaacaacaguguagggauaccggcgacgaagucgugugcucauguuucguaggguaccagcugcuaagcgauggaguuaguugcgaggacgugaaugaguguaucacaggcucccacucuugccggcucggugaaagcuguauuaacaccgucggguccuuucgcugccaacgagacucaaguugcggaacuggcuaugagcugacagaagauaauagcuguaaggacaucgaugagugcgaaucuggcauucacaacugucuucccgacuucaucugccagaauacccugggguccuuuagauguaggccuaaguugcagugcaaaucaggauucauacaggaugcacucgguaacuguaucgacauuaaugagugccugagcaucagugcuccaugucccauuggccauacgugcaucaacacugaggggucuuacaccugucaaaagaaugugccuaacugcggacggggcuaucacuuaaaugaagaggguacacguugcguggaugucgacgaaugugccccaccggcggagcccugcgggaaaggccaucgcuguguuaacuccccuggaucauuuagaugcgaauguaagacuggcuacuacuucgaugggauaucgaggaugugcguggacguaaaugagugucagcgguauccaggacgacugugcggucacaaaugugagaacacccucggcucuuaccuuugcuccuguucagugggguuucgccugagugucgauggaagaagcugcgaagacauuaacgagugcuccucuagccccuguucacaggaaugcgccaauguguauggcaguuaccaguguuauugcaggcgggguuaccaauuguccgacguugauggggugacaugugaggacaucgaugagugcgcacuaccuaccggcggacacauuuguagcuaucgcugcaucaacaucccaggcucuuuccaguguucaugccccaguagcggguacagacuggcuccgaauggaaggaacugucaggacauugaugaaugcgucacggguauacauaauugcuccaucaacgagacuuguuuuaauauucagggcggguuccguugccucgccuuugaauguccugagaacuaccggcgaucugcugccacaagaugcgaaaggcugcccugucacgagaaucgcgagugcucgaaacuuccacugcggaucaccuauuaccauuugagcuucccuacuaacauacaagcacccgccgugguauucagaaugggaccauccucagcuguucccggcgacaguaugcagcucgcgauuacaggugggaaugaagagggcuuuuucaccacgaggaaggugucuccucacagcggagucguggcacugaccaagccagucccggaaccccgcgauuuacugcuaacagugaagauggaccucucccgacauggcacuguuagcagcuuuguggccaaacuguucaucuuuguaucugcugagcuuuga

SEQ ID NO: 56142 - RNA, 3696 nt, Artificial Sequence
  derived and/or modified sequence opt3 from FBLN2__Homo_sapiens__NP_001158507
auggugcugcucugggagcccgccggcgcuuggcuugcacugggguuggccuuagcgcugggaccuagcgucgcugccgcagccccaagacaggacugcaccgguguugaauguccgccccuagagaacugcaucgaagaggcucucgaaccuggcgcauguugcgccacaugugugcaacaggggugcgcuugugagggauaccaguauuacgauugccugcagggcgguuucguaagggggcgggugccagccggacaauccuauuuugucgacuucggcucuacugaguguucaugcccgccuggcgggggaaagauuaguugucaguuuaugcuuugcccagaacugcccccuaauugcauagaggcggugguuguggcagauagcuguccacagugcggucaggucggcugugugcacgccgggcauaaauacgcugccggacacacgguacauuugccgcccugccgcgcaugucacugcccugacgcuggcggugaacucaucuguuaucaacugccagggugccauggaaacuucuccgaugccgaggagggcgaccccgaacgacacuacgaggauccuuauucuuacgaccaggaaguugcggagguggaagccgcaaccgcucugggcggggagguccaggccggagcugugcaggccggugcaggcgggccacccgccgcucucggaggcgguucgcaaccguuaucaacaauucaggcgccucccuggccagcagugcugccucgucccacugccgcugccgcacuugggccacccgccccuguccaggcuaaggccagaaggguuaccgaggauagcgaagaggaagaggaagaggaggaagaacgggaagagauggcagugacagaacaauuggcggcuggcggacaccgcggccuggacgggcuaccaaccacugccccggcaggacccagucucccuauccaggaggagagagccgaagcuggugccagggcagaggcuggcgcccggccagaagagaaucugauucuugaugcgcaggccacaucccgcucuaccgggcccgagggaguaacgcaugcuccuagccugggcaaagcagccuuggugccaacucaggcuguccccgguuccccgcgagacccugugaagccaucaccccacaacauccucaguaccagccugccugaugccgcauggauacccccaacaagagaaguuccuaggaaaccccaaguguuaccacauucucacgucgaggaagacacugaccccaauuccgugcacucaaucccucggagcagucccgaggggucuaccaaggaucugauugaaacauguugcgcggccggccagcagugggcuaucgacaacgaugagugucucgagauuccagaauccggaaccgaggacaauguaugccguacggcccagcgccauugcuguguuagcuaccuucaagaaaagucgugcauggcaggcgugcugggggcuaaagagggagaaacuuguggugccgaggauaacgacucuugcggcaucuccuuguauaagcaguguugcgauuguugcgggcuaggacugagagucagggcagagggccagucaugugaaaguaaucccaaccucgguuacccuugcaaucacgugaugcugagcuguugcgagggggaggagccacuuauaguccccgaagugcggcgaccuccggagccagccgcugcgccccgcagaguuuccgaggccgaaauggcaggcagggaggcucugucuuugggaacagaagccgagcucccuaacagccugccaggcgacgaucaggacgagugcuuacugcuacccggggaacucugucaacaucugugcauuaauaccgugggaucauaucacugugccugcuuuccuggcuucagucuucaggaugacggucggacuugucgcccggaggggcaucccccacagccugaagcuccccaggagccagcauugaaauccgaauuuagccaaguagccucuaacacaaucccucugccccucccacagccgaauaccugcaaggacaacggaccuuguaaacaggucugcucaacggugggcgguagugcgauuuguagcugcuuccccggcuacgcuaucauggccgaugggguuuccugugaggaccaagaugagugccugaugggagcacacgacugcucuagaaggcaguuuugugugaacacccuuggcucguucuauugcgucaaucacacagugcugugugccgauggguacaucuugaacgcucaucguaagugcguagacauuaaugaaugugugacugaucuccacacuugcagccggggagagcauuguguuaacacacugggcuccuuucacugcuauaaggcauuaacuugugaaccagguuacgcccugaaagacggggagugcgaagaugucgacgagugugcgaugggaacccacacaugccagcccggcuuccuaugccagaauaccaaggguucauuuuacugucaagcucgacagagaugcauggauggcuuccuccaggacccugaggggaacuguguggauauaaaugaaugcaccagucugucugagccauguaggcccggauucagcugcaucaacacggugggcuccuauacaugucagcgcaauccucuuauuugcgcccggggguaccaugcaucagacgacggaaccaaaugugucgauguuaacgaaugcgagacuggcgugcacagauguggugaagggcaagugugccauaauuugccgggaagcuauaggugcgacuguaaggccggcuuucagcgcgaugcuuucggucgaggcugcaucgacguaaacgaguguugggccucuccagggcggcugugccagcacaccugugagaauacacucggauccuaccguugcaguugugcaagcggcuuucuguuagcugccgaugggaaaagaugcgaagacgucaacgagugugaagcgcagaggugcucucaagagugugccaauauauauggauccuaccagugcuauugucgccagggcuaccaacuggcagaggauggucauaccugcacugacauugaugaaugcgcucagggggccggaauccuuuguacauuccggugcuugaacgugcccggcucauaccagugugcuugcccugagcagggcuauacgaugaccgcaaacgggagaaguuguaaggacguugaugaaugcgcccucggaacucacaauuguagcgaggccgaaacaugccacaacauccaagguucguuuaggugucugcgauucgagugucccccaaauuacgugcaggucuccaaaaccaagugcgagcgcacaacuugccaugacuuucuagaaugccagaacucuccugcucggauuacccacuaucagcugaauuuccaaacgggccuccuggugcccgcgcauaucuuuagaauugggccagccccugcauucaccggagauacaauagcucuuaacaucauuaagggcaaugaggaagguuacuuugggacuaggcguuugaacgccuauaccggaguuguguaccugcagcgcgcaguauuagagccgcgggacuucgcccucgacgucgaaaugaaacuguggagacagggcagcgugacaacuuuucuugcuaagaugcacaucuucuucaccacguuugcgcuguga

SEQ ID NO: 56143 - RNA, 1347 nt, Artificial Sequence
  derived and/or modified sequence opt3 from FBLN5__Homo_sapiens__NP_006320
augcccggcaucaagaggauucugaccgugacaauacucgcccuuugccugccuagcccagggaacgcucaggcacaauguacuaauggauucgacuuggauagacaguccggucagugcuuagacaucgaugagugucggacgauuccggaagccugccgcggcgacaugaugugugucaaccagaaugggggauaccugugcaucccccgaaccaacccuguuuaucguggcccauacucuaaucccuauucaacaccuuacagugguccauaucccgcggcugccccuccacuaagcgcaccgaacuaccccacuauuuccagaccucucaucuguagguuuggguaucaaauggaugagucuaaucagugcguggacguagaugaaugugccaccgacucgcaccagugcaacccaacacagauauguaucaauaccgagggaggcuacacuugcucaugcacagauggcuacuggcugcuugaagggcaaugucuggacauugaugagugccgguauggauacugucagcaguugugcgcuaacgugcccgguagcuauaguuguaccugcaauccuggcuucacgcucaacgaggacgggcgcuccugucaggaugucaaugaaugcgcaacugagaacccaugugugcaaaccugcguuaauacauacggaucuuuuaucuguagaugcgaccccggcuaugaacuggaggaggacggugugcacugcagcgauauggacgaauguuccuucucagaguuucugugccagcacgaaugugucaaccagccggggacuuacuucugcaguuguccucccggauauauucucuuagaugacaacaggagcugccaagauaucaaugagugugaacaucggaaccauaccugcaaucugcagcagacauguuacaaccuucagggcggcuuuaaaugcauagacccaauucgcugugaggagccuuacuugcgaaucucugauaauagaugcaugugccccgccgaaaacccaggguguagggaccaacccuucaccauucuguaucgggauauggacgugguauccggacguucaguuccugcugauaucuuucagaugcaggccacgacucgcuacccaggugcguauuacaucuuccagauuaagagcggcaaugaggggagagaauuuuauaugaggcaaacaggaccgauaagugcaacccuagugaugacucggcccaucaaaggcccucgagagauucagcucgaccuggaaaugaucacagucaacaccgugauaaauuuccgcgguucuuccgugauuagacuuaggaucuacgucagccaguauccauuuuga

SEQ ID NO: 56144 - RNA, 8616 nt, Artificial Sequence
  derived and/or modified sequence opt3 from FBN1__Homo_sapiens__NP_000129
augagaaggggccggcugcucgagaucgcccuuggguucaccgugcuguuggcuagcuacaccucccacggagcagacgccaacuuagaagcggguaaugucaaggagacucgcgcuucucgagccaaacguagaggcgggggaggccaugaugcacugaagggucccaacguuugcgggucaagguauaaugccuacuguugcccuggauggaaaacgcuaccaggcggcaaccaguguauugugccgauaugccggcacaguuguggggacggauuuugcagccgccccaauauguguaccugcccuuccggucaaaucgcuccaucuuguggcucgagaucaauucagcauugcaacaucagguguaugaaugggggaagcugcagugaugaccacugccucugucagaagggcuauauugguacacauugcgggcagcccguaugugaauccggaugccugaacggcggccgguguguggcaccuaaucgcugcgccuguacuuacggguucaccggaccacaaugcgagcgagauuauagaacaggucccuguuuuaccgucaucucuaaccagaugugccagggccagcuuagcgggauaguguguacuaaaacacugugcugcgcuaccguuggaagggccuggggccacccuugugaaaugugcccagcgcaaccgcaccccugucggcgugguuucaucccuaauauucgcacgggggcaugccaggacguggaugagugucaggccaucccaggcuugugccagggaggcaacuguauuaauacugucggguccuuugagugcaagugucccgcuggacauaagcucaacgaagugucacaaaaaugcgaggacaucgaugaauguaguaccauaccugguauuugcgagggcggggagugcacaaauacuguaagcucuuacuucuguaagugcccacccggauuuuauaccuccccggacggcacaagauguaucgauguuaggccugguuacugcuacaccgcccugacgaacgggcgguguucaaaccagcugccccagagcauuacuaaaaugcaaugcuguugcgacgcaggccgauguuggaguccaggagugacagucgcuccugaaaugugccccauccgcgccaccgaggauuucaauaagcucuguucugugccaauggugauccccggcagaccugaauauccaccgcccccuuuagggccaauucccccuguccugccaguucccccgggauuuccuccagguccccagauaccugugcccaggccaccuguagaguaccuuuaucccucccgggaaccaccgcgcguguugccugucaacgugacugacuacugccagcugguuagauaucuaugccagaaugggaggugcauccccacaccaggcagcuaccguugcgaguguaacaaaggauuccaacucgaccugcggggcgagugcauugauguggacgaaugugagaagaaucccugcgcggguggggaauguaucaacaaucagggcucguauaccugccagugucgagccggauaccagucuacgcuuaccagaacagagugcagggauauagacgaaugucugcaaaacggccgcauuugcaauaacgggcggugcaucaauacugauggauccuuucacugugucugcaacgcaggcuuccaugugaccagagacgguaagaauugugaggauauggacgagugcucaaucaggaacauguguuugaaugggaugugcauuaacgaagauggaaguuuuaaauguaucugcaagccuggcuuccagcucgcuagcgacggucgcuacuguaaagauauuaacgagugcgaaacaccaggcauauguaugaaugggcgaugcguaaacacugacggauccuaucggugcgaguguuuccccggccuggccguuggguuagacggacgugugugcgucgauacccacaugagaucuacauguuacggcgguuauaagagggggcagugcaucaaaccucuguuuggagcugugaccaagagcgaauguugcugugccucaacugaguacgcauucggcgagccgugccagccaugucccgcccaaaauagugcugaauaucaggcgcucugcuccagcgguccuggcaugacgucugcagggucagacauuaacgagugugcccuugauccagacaucugccccaauggaaucugugaaaaccugcgcggcacauacaaaugcauuugcaauaguggguaugaggucgauagcaccggaaagaacuguguggacauaaaugagugcguuuugaacucccuacugugugauaauggccagugccggaacacuccugguucuuuuguguguaccugcccgaagggguucaucuacaaacccgaccucaagacaugugaagauauugacgagugcgaaucgagcccauguaucaauggaguaugcaaaaacuccccuggcucauuuauuugugagugcaguucugaaagcacccuggaucccacuaagacaaucugcauagagacgaucaaagguaccuguuggcagacugucauugacggcagaugcgagaucaauauuaacggggcuacacuuaagucccaauguugcucaagccugggagccgcauggggcucuccauguaccuugugccagguggauccuaucugugggaagggauacuccaggauaaaaggcacacagugcgaagacauugacgagugugaaguuuuccccggugugugcaagaacgggcucugugucaauacucgaggaaguuuuaaaugccaaugcccaagcggcaugacccuggaugccacgggccgcaucuguuuagacauucggcuggagaccugcuuccuaagauaugaagaugaggaguguacacucccgaucgcugggaggcaccguauggacgccugcuguugcucugugggagcagcgugggguacugaagagugugaagagugcccuaugcgcaacacccccgaauacgaggagcuguguccacggggccccggguuugcuacaaaggaaauaacuaauggaaaaccuuucuuuaaggauaucaacgagugcaagaugauuccaucccuuuguacccauggcaaaugcagaaauacgaucgguucauucaaguguaggugcgacaguggguuugccuuggauagcgaagaacgaaacugcacagacauugaugagugucggaucucgcccgaccugugcggacgcggccaguguguaaauaccccuggcgauuucgaaugcaaaugugacgagggguaugaauccggauucaugaugaugaagaacugcauggauauagacgagugucagagagacccgcuccugugcagggguggcgugugucacaauacugaagggucuuaccggugcgagugcccacccggacaucagcuuagcccuaacauuucagcauguaucgauaucaaugagugcgaacugagugcccacuugugucccaacggccgaugcguuaaucucauugguaaauaucaaugugcuugcaacccaggguaccauuccacaccugacagacuguuuugugucgauaucgacgagugcucuauuaugaauggaggcugugaaaccuucugcacuaacagcgagggcuccuaugaauguucaugccagcccggguuugccuuaaugccagaucagcgcagcugcaccgacauagaugagugugaggacaacccuaauaucugcgauggaggucaguguacaaacauuccgggcgaauacaggugccuguguuacgacggguucauggcaagugaggauaugaagacgugcguggacgugaaugaaugugaccuaaaccccaauaucugccucucuggaaccugugagaacacuaagggcuccuuuauuugccacugugauauggguuauagcgggaaaaagggaaaaacaggcugcaccgacaucaaugaaugcgagauaggcgcucacaacugugggaagcaugccgucugcacaaauacugcgggaucguucaaauguucaugcucuccagguuggaucggcgaugggauuaaguguaccgaccuggaugagugcaguaacggaacgcacauguguucccaacaugccgacugcaaaaauacaaugggcagcuaccguugucuuugcaaggaagguuauaccggggauggauuuacuuguaccgacuuggaugagugcucugaaaaccugaaucucugcggcaacggccagugucugaaugcuccugggggauaccggugcgagugugacauggguuucguucccagcgcagauggcaaggccugcgaggacaucgaugaauguuccuuaccaaacauuugcguguuugggacaugucacaaucugccuggacuuuucagaugcgagugugaaaucggcuaugaguuggacaggucaggugggaacugcacugacgugaacgaaugucucgaucccaccacaugcauaaguggcaauugcguaaacacgccgggaagcuacauuugugacugcccaccugauuuugagcugaaucccacccgcgucggcuguguggacacucgaucugggaacugcuaucuagauaucagaccacggggagacaauggugauacagcuuguuccaacgagaucggcguuggggugucaaaagccaguugcuguugcagccugggaaaggcauggggcacccccugugaaaugugcccugcggucaauacuuccgaguacaaaauucucuguccggguggggaaggcuucaggcccaacccaauaacagugauccuggaggacauugaugaaugccaggagcuuccuggauugugccagggcgggaaguguaucaauaccuuuggaucuuuccaaugccgcugucccacggguuacuaucugaacgaggacacucguguuugcgaugacgugaaugaaugugagaccccuggcauuugcgggccaggaacauguuacaacaccguaggcaauuauacuugcaucugucccccugauuacaugcaggucaacggugggaauaacugcauggacaugagacggucguuauguuauaggaacuacuaugccgacaaucagacaugcgauggcgaacuccuguucaacaugaccaaaaagaugugcuguugcagcuacaauauaggacgcgcuuggaacaagccaugugagcaaugccccaucccgucaacagacgaauuugccacucuuuguggcucccagcgaccuggguucgugauugauaucuacaccggacugccaguggacauugaugagugcagagagauccccggcgucugugaaaaugguguuugcauaaacaugguggggaguuuucggugugagugcccuguaggauucuuuuauaaugacaaauugcucgugugugaagauauugacgagugccagaacggcccagucugccagaggaaugcagaguguaucaacacggcugguucuuaccgcugcgauuguaagcccggcuauagauucacaagcaccgggcaaugcaaugacaggaacgaaugucaggagaucccgaauauuugcucccacggacaguguaucgauacugugggcucauuuuacugccugugucauaccggguucaaaacaaacgacgaccagacuaugugccuagauauaaaugaaugugagcgggacgccugcggaaacggcaccugucguaacacgauugguucuuuuaauugccgcugcaaccacggguucauccugagccauaauaacgauuguauugacguugaugaaugcgcaaguggaaauggcaaccucugucgaaauggucaaugcaucaacacagugggcuccuuucagugucagugcaaugagggguaugaggucgccccugacggaagaaccuguguggauauaaacgaaugccugcuugagcccaggaagugugcuccaggcacuugccagaauuuggacgggagcuaccgguguauuugcccucccggauauucucugcaaaacgaaaaaugcgaggauaucgacgaauguguugaggagccagaaaucugcgcguuaggcacauguucaaauaccgaggguuccuucaagugccucugucccgaaggguucagucugagcucgucuggacgcagaugccaggaucuuaggauguccuacuguuacgccaaguuugagggcggcaaaugcagcucaccuaagagucggaaccacucuaaacaggaauguugcugugcacugaagggggagggauggggugacccaugcgagcuaugcccgacugaacccgaugaggcuuuccgacagauuuguccuuauggcuccgggaucauugugggaccagacgacagcgccgucgauauggacgaaugcaaagagcccgauguauguaagcauggccaaugcauaaauacagacgguucauacagaugugagugcccuuuuggguauauccucgccggaaacgaauguguggauaccgacgagugcaguguuggcaacccauguggcaaugggacgugcaagaacgugauuggagguuucgaauguacuugcgaggaaggcuuugagcccgggccuaugaugaccugcgaggauaucaaugaaugugcucagaacccgcuguugugcgcauuccgcugugucaauacauacggaagcuaugagugcaaauguccagugggcuacguacugagggaagaccggcguaugugcaaggaugaggacgaaugugaggaggguaaacacgauugcaccgaaaagcagauggaguguaaaaacuuaaucgggacauauaugugcauuuguggacccggcuaccaaagaaggccugacggcgaagggugcguggacgagaaugaaugccagacuaagcccggaauaugugagaacggucgcugccucaauacccggggcuccuacacgugugagugcaacgauggguuuacagccucuccaaaucaggacgaaugucuggauaaccgagagggauauugcuucacugaaguccuucagaauaugugucaaaucggcagcuccaacagaaauccuguuaccaaaucagagugcuguugcgacggugggaggggauggggcccccacugugagauuugcccauuucagggcacaguggcguucaagaagcugugcccgcaugggcgcggauuuaugaccaacggugcugauaucgacgaauguaaagugauucacgaugucugccggaacggcgagugugugaaugacagagggucuuaccauugcaucuguaagacuggauauaccccugauauaacaggcacgaguugcguugacuugaacgaauguaaucaggcccccaaaccaugcaacuucaucuguaagaauacugaggguucguaccagugcagcugucccaaaggguauauucuccaagaagauggacguuccugcaaggaccuggaugagugcgcaaccaagcagcacaacugucaguuucuaugcguaaauacaaucggcggcuucaccuguaaaugcccuccaggguucacucagcaucacacaucuuguauugacaacaaugagugcaccucagacaucaaccuguguggaagcaaggguauaugccaaaauacgcccggcuccuuuacuugugaaugccagaggggguucagucuugaucagacaggaucuagcugugaggacguggaugaaugcgagggcaaccaccggugccaacaugguugucagaauauuaucgggggauaccgcugcucauguccucagggcuaucuccagcacuaccaauggaaccagugcgucgacgaaaaugagugucuguccgcccauauuugcggcggggcuaguugucacaacaccuugggaagcuacaaaugcauguguccggcagguuuucaguaugagcaguucucuggcgggugccaagauaucaacgaauguggauccgcccaggcgccaugcucauacggcugcagcaauaccgaggguggguaucuguguggcugucccccuggauacuuucgaauaggccaggggcacugugugucgggaauggguaugggcagagggaacccagaacccccuguuucuggagagauggacgauaauaguuuaucccccgaggcuugcuaugaguguaagaucaacggcuacccaaaaaggggucggaagcgcagaagcacuaaugagacagacgccucaaacauugaagaucaguccgagaccgaagcaaaugugucucucgccagcugggacgucgagaagacagcuaucuucgccuuuaacauuagucauguguccaauaaaguaaggauccuggagcuucugccggcauugacuacgcucaccaaccacaaucgauaucugauagaaagcgggaacgaggauggcuucuuuaagauuaaucaaaaagaaggaaucucuuaccuacauuucacaaagaaaaagccugucgcuggcacuuacucacugcagaucaguuccacaccccuuuauaagaaaaaggagcucaaccagcuggaagacaaauacgauaaggacuauuugagcggggaguuaggagacaaucugaaaaugaagauucaggugcuccugcacuga

SEQ ID NO: 56145 - RNA, 8739 nt, Artificial Sequence
  derived and/or modified sequence opt3 from FBN2__Homo_sapiens__NP_001990
augggcagaaggcggcgccugugccuccagcuuuacuuccugugguuggggugcguggucuuaugggcccagggaaccgcuggucagccccagccuccaccgcccaaaccuccacgaccccagccuccaccccagcagguucguagcgcuacagccggcuccgaagggggauuucuggcgccugaauauagagaggaaggcgcugccguggcaucuaggguacggcgcagaggucagcaggacguguuaagggggccaaacgucugcggaucacgguuccacaguuacugcugcccgggcuggaaaacucuccccggcgggaaucaauguaucgugccuauuugccgcaacagcuguggagaugguuuuugcucccgaccaaauauguguacguguucuucgggccagauaucaagcaccugugggaguaaguccauccagcagugcucuguuagaugcaugaacggaggcacaugugccgacgaucauugccaaugucagaaagguuauauugggacuuacugcggacagcccgugugugagaauggcugccaaaacggcgggagguguaucggaccuaaucggugcgcuugugucuaugguuucaccggcccacagugcgaacgugacuaccgcacagggcccuguuuuacccaggugaacaaucagaugugccaaggacagcugacuggcauuguaugcacaaagacccuuuguugcgcaacgaucgguagagccugggggcacccgugugagaugugcccugcucagccccagccauguaggcggggcuucauaccuaacauccgaacuggagccugccaagauguugacgagugucaggcgauucccggcaucugccaagggggaaauuguauuaacaccguggguagcuuugaaugccgcuguccagcaggccauaaacaguccgagacaacucaaaagugcgaagauaucgacgagugcucaauaauucccgggaucugugagaccggagaaugcaguaauacagucggcagcuauuucugugugugcccuagagguuacgugaccucuacggauggguccagguguauugaccagcggacuggcaugugcuuuucaggacuggucaacggccgcugugcccaggaguugccagggagaaugacaaagaugcagugcuguugcgaaccgggaagguguugggguaucggcaccauccccgaggcuugcccuguucgugggagcgaagaguaccggcgacucugcauggauggacugccaaugggcgguauucccgggagugccggcucuagaccuggaggcacugggggaaauggcuucgcaccauccgguaacgggaacggauauggccccgguggcacaggguuuauaccgaucccuggaggcaauggguucagcccaggagugggcggugcugggguaggagccggcggucaaggccccauuaucaccgggcugacgauacucaaccagaccauugacaucuguaaacaccaugcgaauuuaugccugaacggaagguguaucccuacagugucgucuuaccgcugcgaguguaauaugggcuauaagcaggaugccaacggggacugcauugacgucgaugaauguacuuccaaucccugcaccaacggagacugugugaauacaccaggcucauacuauugcaaaugucacgcagguuuucaacggacuccuaccaagcaggcuugcaucgauauugacgagugcauacagaacgggguucuuuguaaaaauggaagaugcgugaacacagauggcaguuuccaguguaucugcaaugccgguuucgaauugaccacugacggcaagaacugugucgaucacgacgagugcacgacaaccaauaugugucugaacgggaugugcauuaacgaagauggcagcuuuaaguguaucugcaaacccggcuucgugcuggcuccaaaugggagguacuguacugacguagaugagugccaaaccccgggaaucugcaugaacggccauuguauuaauuccgaggguucuuuucgcugcgacuguccucccgggcucgccguuggaauggacggccgagugugcgucgauacacacaugcggagcaccuguuauggcgggauaaagaaaggagugugcguccguccauuccccggugcagugacuaagucagaauguugcugugccaacccugacuacggcuuuggggagccaugccagcccuguccugcuaaaaauagugcggaguuccauggacugugcuccagcggcguugguaucacaguggaugggagagacauuaacgagugugcacuugauccggacaucugcgccaauggaauuugcgaaaaccugaggggcucuuaccgcuguaauugcaacucaggcuaugagccagaugcuagugggcggaauuguaucgacauagaugagugcuugguaaacagacuccugugugacaauggauuaugcaggaacacgcccgguagcuacuccuguaccugcccuccaggcuaugucuuucgaacugaaacagagaccugugaagauaucaaugagugcgagucuaaccccugugugaacggggccugccgcaauaaccugggaucguucaauugcgaauguagcccuggcuccaagcucucaaguacaggucuuauuugcaucgacucucugaaagggacuuguugguugaacauucaggauagccggugcgagguuaauaucaacggagcaacccuaaaguccgaauguugcgccacgcugggcgcugccuggggcucaccgugugagagaugcgaacucgacaccgcaugucccagggggcuggcgcguauaaagggagugacaugcgaggacgucaaugagugugaaguguuuccagguguaugcccuaacggccgcugcgugaauagcaaagggucuuuccacugugagugccccgaaggacuuacucuggauggcaccggucggguuuguuuggacauuagaauggagcagugcuaccucaagugggaugaagacgaguguauccacccagucccugggaaauuuaggauggaugcuugcuguugcgccgugggagcagccuggggcacagagugugaagagugccccaagccaggcacuaaagaauaugagacccuguguccgcgaggggcuggauucgccaaccggggugacguguuaacgggccgcccuuuuuacaaggauauuaaugaaugcaaggcauuccccgggaugugcacauauggaaaauguagaaacaccaucggcuccuucaaguguaggugcaauagugguuuugcucuggacauggaggagcggaacugcacugauauagacgaaugccgaaucagcccagaucuaugcgggucuggaauuugugucaauacacccggcuccuucgagugcgaauguuuugagggcuacgagucaggguucaugaugaugaaaaacugcauggacaucgaugaaugugagagaaacccucuccugugccgcggagguaccugcguuaauacugaaggcaguuuucaaugugacugcccacuugggcaugaguugagccccucgagggaagacuguguggauauuaacgagugcucccugucugacaaucucugucguaacggaaagugcgugaauaugaucggcaccuaccaguguagcugcaacccugguuaucaggccacaccggaucggcagggguguacggacauagaugagugcaugauuaugaauggcggaugugacacccaaugcacuaacucagaaggcaguuacgagugcuccuguucugaaggguaugcgcugaugccagauggaagaagcugcgccgacaucgaugagugugaaaauaaccccgacaucugcgaugguggccaguguacaaauauuccuggggaguacaggugccuuuguuaugacggauucauggcuuccauggacaugaaaaccugcaucgauguaaacgagugugaccuaaauucaaacauuugcauguuuggcgaaugugagaauacaaaggguagcuucauaugccacugccaguugggguacagugucaagaaaggcacuaccggauguacggauguggacgaaugcgagaucggcgcacauaacugugauaugcacgccucuugccucaauauucccggguccuuuaaguguagcugccgcgaaggauggaucgguaacggcauuaaauguaucgaccuggaugagugcucgaacgggacacaucaauguucaauaaaugcucagugcguuaacaccccaggaucuuaucgaugugccugcagugagggcuucacuggugacggguuuaccugcuccgauguggacgaaugugcagagaauaucaacuuaugcgaaaauggccagugucugaacgucccuggagcguacagaugcgagugugagaugggcuucacacccgccagcgauucucggagcugccaggacauugaugaauguuccuuucaaaauaucugcguguucgggacuuguaacaaucuaccaggaauguuccacugcauuugugacgacggcuacgagcucgauaggaccggugggaacugcacagacaucgaugaaugcgcugacccuauaaauuguguuaacggacugugcgugaauacgccgggccgcuaugaguguaacugucccccagauuuucagcuuaauccuaccgguguaggcugugucgacaaccguguggggaacugcuacuugaaguucggacccagaggcgaugggucacugaguuguaauacugaaauuggagugggcgucagccggucuuccugcuguugcucacucgguaaagccugggggaacccaugugagacaugcccucccguuaauaguaccgaguauuacacucugugcccgggaggcgaagguuuuaggccaaacccuaucacaaucauuuuagaggacauagaugaaugucaggagcugcccggccuuugccaagggggaaauuguaucaacaccuucggcagcuuucaaugcgaauguccacagggguauuacuuguccgaggacacgcgcauuugcgaggauaucgacgaauguuucgcacaccccggagugugcggcccugguacuuguuauaauacccucgggaacuacacaugcauuuguccgcccgaguacaugcagguaaauggaggccauaacugcauggauaugcgaaagucuuuuugcuauagaucguacaauggcaccacuugugaaaacgagcugccauucaaugugacaaagcggaugugcuguugcaccuauaacgucgggaaggcuuggaauaagccuugugaacccugcccuacaccaggaacugccgacuuuaaaaccaucugugguaacauacccggcuucacguuugacauccacacagggaaggcaguggauauugacgagugcaaagagaucccuggaauuugugccaacggcguuugcaucaaucagauagguagcuucaggugugaaugcccaaccggguucucauacaacgaucuacugcucgugugcgaggacauugaugaauguuccaauggagacaaccugugccaacgcaaugcugauuguaucaacagucccggcucuuauagaugcgagugugcggccggcuuuaaacuuagcccgaauggggcaugcgucgacaggaacgaguguuuggaaaucccuaaugugugcucccauggacuguguguugauuuacaggguucauaccagugcauuugucacaacggcuucaaggcuucucaggaccaaacuaugugcauggauguggacgagugugaacggcacccaugcgggaauggaaccugcaagaacacagucggcagcuauaauugucucugcuaccccgguuuugagcugacucauaacaaugacugucuugauaucgacgaaugcaguuccuucuuugggcagguaugucguaacggacgcugcuucaacgagauaggcagcuuuaagugucugugcaaugagggcuacgaauugaccccugaugggaaaaacuguauugacacgaaugagugcguggcccucccaggaucuuguucacccgguacaugccagaaccuggaaggcuccuuccgaugcaucuguccgccuggguaugagguuaagagugaaaauugcauugauaucaacgagugugacgaggaucccaauauaugccuauuuggaagcuguaccaacacuccaggcgguuuccaaugccuguguccucccggguuugugcucucggacaauggaagaaggugcuucgauacacggcagucuuuuuguuucaccaacuucgaaaauggcaaaugcuccgucccaaaggccuuuaacacuacaaaagcuaaguguugcugcagcaagaugcccggcgagggguggggagacccuugugaacugugcccaaaagaugacgagguggcauuccaggaucuuuguccguacggucacggcaccguacccucauugcaugacacgcgcgaagacgugaaugagugccuggagaguccugggauuuguucuaacggacagugcaucaauacugauggcuccuuuagaugugaaugcccaauggguuauaacuuagacuacaccggggucagguguguugauacagacgagugcagcaucggaaaccccuguggcaauggaaccugcacaaacgugauugggucauucgaaugcaauuguaacgagggauuugagccugguccaaugaugaauugcgaagauaucaacgagugugcccaaaauccccuccugugcgcguuccgguguaugaacacuuuuggcaguuaugaaugcaccuguccuauuggguacgcacuucgagaggaccagaagaugugcaaagaucuggacgaaugugccgagggacuacacgauugcgagagcagaggcaugauguguaagaaucucauagguacguucaugugcaucugcccgccagggauggcacgcaggcccgacggagaaggcuguguggaugagaacgaaugccggacaaaaccuggcauuugugagaaugggcguugcgucaacaucaucggauccuauagaugugaaugcaaugaggguuuucagucuagcuccucaggcacugagugucuggacaacaggcagggguugugcuucgccgaagugcugcaaaccauuugucagauggcuucuaguucgcgcaauuuaguuacaaagagcgagugcuguugcgacggaggccgggguugggggcaucagugcgaacucuguccccugccaggcaccgcacaguacaagaaaauaugcccucacggacccggcuacacuaccgaugggcgagacaucgaugaguguaagguaaugccaaaccuuugcacaaacggacaauguauuaauacgauggguuccuuuagaugcuucuguaaagugggcuauacuaccgacaucucugggacaucaugcauugaucuggacgaauguagccaguccccgaagccuugcaacuacaucuguaaaaauaccgagggaaguuaucagugcucuugccccaggggcuacgucuugcaagaggaugguaagacuuguaaggaccucgaugaaugccagacaaaacagcacaacugucaguuucugugcgugaauacccuagggggcuucacguguaagugcccacccggauucacucaacaucacacagccuguauagacaacaaugagugcggcagccagccuucacuguguggggcgaaaggaaucugccagaacaccccagguuccuuuaguugugaaugccagcgcggcuucagccuugaugcuaccgggcucaauugcgaggacguugaugagugugacggaaaccaucggugccaacacggcugucagaauauucuggguggcuauagaugcggguguccccagggauacauccagcauuaucaauggaaccagugcguggacgaaaaugaguguucuaacccuaaugccugcggcuccgcaucauguuacaacacuuuggggagcuacaagugcgccuguccgucgggauuuucuuucgaucaguuuaguuccgcuugccacgacgucaacgaaugcagcucauccaaaaauccauguaacuauggcugcucuaauacagaggguggguaccuguguggaugucccccuggcuauuaccgugugggucagggccacuguguaagcgggaugggauucaacaagggccaauauuuaagucucgauaccgaagucgacgaggagaaugcccuguccccagaagcaugcuacgaguguaaaauuaacggguauagcaagaaggauucuaggcagaaacggucaauccaugaacccgacccuacagcuguggagcagauaagucuugaauccguugauauggacagccccgugaauaugaaguuuaaccugucucacuugggaucgaaagagcauauucucgagcugcgcccagccauccaaccgcuaaauaaccacauucgauacgucaucucacagggcaaugaugacagcguguucagaauacaccagaggaacggucuguccuaccuucauacugcgaagaaaaagcucaugccugggacguauacccuggaaaucacaaguauucccuuguacaagaaaaaggagcuaaagaaacuggaagagucuaaugaagaugacuaucuccugggagagcuuggcgaggcccugcggaugcgcuugcagauccaacuauacuga

SEQ ID NO: 56146 - RNA, 8430 nt, Artificial Sequence
  derived and/or modified sequence opt3 from FBN3__Homo_sapiens__NP_115823
augacccuggagggccucuaccuugccagagggccccuggcuagguuguuacuggcauggagcgcccuacucugcauggcgggaggucagggccggugggacggggcucuggaagccgcaggaccuggccgcgugcgacguagagguuccccagggauccuucaaggaccgaacgucuguggcucuagguuccacgccuauugcugucccggcuggcggacauuuccugggcgcucacagugcguugugccaauuuguagaagggcuugcggagaggguuucuguagucagcccaaucugugcacuugugcagauggcacguuggccccuagcugcgggguaucccggggaucuggcuguucggugucaugcaugaacggugggaccugccgcggagcuagcugucucugccagaagggcuacacaggcacugucugugggcaaccaauaugcgaccgaggaugucauaaugguggcagaugcaucgggcccaacaggugugccugcguguauggauuuaugggcccucagugugaacgggauuaccguaccgguccaugcuucgggcagguuggcccggagggaugucagcaccaacugacaggccuggugugcaccaaagcgcucugcugugcaacugucgggcgcgccuggggauuacccugcgaacuguguccugcucagccacaucccugcagaagggguuuuauuccuaauauccacacaggcgccugucaggacguggaugagugccaggcaguaccagggcuuugucaaggaggcaguugcguuaacaugguggguuccuuccauugucggugccccgucgggcaccgauugucugacagcuccgcugccugugaggauuaucgcgcgggcgccugcuuuucagugcuguucggaggcagaugcgcaggggaccuagcuggacacuacaccaggcggcaguguugcugugaucgcgguagaugcugggccgcuggcccggugccugaacucugucccccaagggggaguaaugaguuucagcaacugugcgcccagcgucuuccucuguugcccggacauccaggccucuuccccggucuguuaggguuuggcagcaacggaaugggcccuccacuggggccggcacggcucaauccccacggaucugacgcccgaggcauuccuucccuugguccagggaacucaaauaucggaacggcuacucugaaccagaccauagauaucuguagacauuucacaaauuugugccuaaacggcaggugucugcccacuccuagcaguuaucgcugcgaauguaaugucgguuacacccaggacguucggggcgagugcauugauguggacgagugcacaucuuccccaugucaccacggggacugcguaaacauccccggaaccuaccauuguagaugcuauccgggcuuucaagcgacgccuacuaggcaggcauguguggaugucgacgaaugcauugugagcgggggacucugucaccugggccgcugcguuaacacagaggguucguuccagugugugugcaaugccggguucgaacuuucuccagauggaaagaacugugucgaccauaaugagugcgcuaccuccacuaugugcgugaacggcguaugucugaaugaagaugguucauuuaguugcuuguguaaacccggcuuccuccuggccccugggggacacuacugcauggacaucgaugagugucagacacccggcauaugcguuaacgggcauuguaccaauacggagggaagcuuucgaugccaauguuuaggcggucuggcaguggggaccgacggacgggucugcguggauacacacguccguuccacuuguuauggcgccauugaaaaggguucuugcgcuagaccauucccuggcaccgugacaaaaagcgagugcuguugcgccaaccccgaccacggguuuggagaaccaugucagcuaugcccggcaaaggauucagcggaguuccaggcucucuguaguuccggccuggggaucacuaccgacggaagggacauuaaugaaugcgcccuugauccugagguuugugcaaacggcgugugcgagaauuugcgcgguagcuaccgguguguaugcaaccugggguaugaagccggagcuucuggcaaggacuguacagaugucgacgagugcgcccucaauucacugcuuugugauaacggcuggugccagaauagucccgggagcuacuccugcucuuguccacccggauuucauuucuggcaagacaccgaaaucugcaaagauguggacgagugucugucgagcccuugcguuuccgguguguguagaaacuuggcaggcucauauacuugcaagugugggccaggaaguaggcucgaucccucuggcacguuuugccuggacagcacaaaagguaccuguugguuaaagauccaggaaucccgaugcgaggucaaccugcagggggcuucacuacgcagcgaguguugcgccacucucggagcggccuggggcucuccuugcgaacggugugagauugauccggcuugcgcaagaggcuucgccaggaugaccggggugacaugugacgauguaaaugaaugcgaguccuuuccaggagugugucccaacggucguugcguuaauaccgcuggcaguuuccgcugugagugcccugaagggcugaugcuugacgccagcggacgguugugugucgacgugagacuggagccaugcuuucucaggugggaugaagacgaguguggcgugacucugcccgguaaauaccgaauggaugucugcugcuguucuauaggggcaguuuggggaguggaaugcgaggcguguccugacccggaguccuuagaauucgccucacugugcccccggggccuuggcuucgcuagucgcgauuuuuugagcgggagaccauucuacaaggacgugaacgaguguaagguauuuccuggacucugcacacacgguacguguaggaauaccgucggcucguuccauugcgccugugcagggggauuugcucuggaugcccaggaacggaacugcacugacaucgaugagugucgaauuucccccgaccuaugcggccaagguacaugcgugaauaccccagggucuuucgaaugugagugcuuuccuggauaugagagcggcuucaugcugaugaaaaacuguauggauguugacgaaugcgcaagagauccccuccugugucgcggcgggacaugcacuaauaccgacggaucauacaagugucagugcccaccgggucacgagcuuacggccaaaggcaccgcuugugaagacaucgaugagugcaguuuguccgacgggcuguguccucacggacagugcgugaacgucauaggcgcguuucaaugcucuugucaugccgguuuccagagcacacccgauaggcaggggugcguggacauuaaugaaugucguguucagaacggaggcugcgaugugcacuguaucaauacugagggcuccuaucggugcucaugugggcaaggauacagcuuaaugccagacgguagagcaugcgcugauguagacgagugugaagagaaccccagggucugcgaucagggccauuguaccaauaugccugggggacaccgcugccucugcuaugacggcuuuauggccacaccagauaugcgaacuuguguggacguggacgaaugcgaucugaacccccauaucugucuucacggugacugcgagaacaccaaggggaguuucgucugucacugccagcugggcuacaugguuagaaaaggagccacgggcuguucugauguggacgagugcgaaguagggggacauaauugugauucccacgcuagcugcuugaacauuccugguucguuuucaugucggugccucccgggcugggugggggacggauucgagugccaugaucuggacgaaugugucucucaggagcacaggugcaguccacgcggcgauugucuaaaugugcccgguuccuaucguugcacauguagacaaggguucgcaggcgacggauuuuucugcgaagaucgggacgagugugccgagaacguugaucugugcgacaauggccagugucucaacgcgccugggggauacaggugcgaaugugagauggguuuugaccccaccgaagaucaucgcgcuugccaggacguggaugagugcgcccagggcaaucugugugcauucgggagcugcgaaaaccuuccaggaauguuucgauguaucugcaauggcgguuacgaguuggacagagggggcggaaacuguacugauauuaaugagugcgccgacccugucaacuguauaaauggcgugugcaucaacacacccgggucuuaucuguguagcugcccacaagauuucgaauuaaauccuuccggaguuggcuguguggacacccgggcugguaacugcuuucucgagacucacgauaggggggacucaggaauuaguugcagcgcagaaaucggcgucgguguaacccgcgccucuuguugcuguucccugggcagagcgugggggaacccgugcgagcuuugucccauggcuaauacaacggaauacaggacccugugcccaggaggcgagggguuccagccuaaccggaucacugugauucuagaggauauagacgaaugucaggagcuccccggacugugccaaggcggugauuguguuaauacauuugggucauuccagugcgaauguccaccuggauaucacuugagugagcauacccguaucugcgaggacauugacgaaugcagcacacacuccggcaucuguggucccggcacuugcuacaacacccuggggaauuauacgugugugugcccggccgaguacuuacaggucaacggaggcaauaacuguauggauaugcgcaagucugugugcuuucgacauuauaaugggacaugucagaacgaacucgcauucaauguaaccagaaaaaugugcuguugcucguacaacauuggacaagccuggaauaggccaugugaggcuugcccuacucccaucagcccagacuaccagauacugugcggcaaccaggcccccgguuuccuuaccgauauccacacagggaagccucuggacauugaugaauguggagagaucccggcaauuugcgcuaauggcaucuguauaaaccagauuggcucauuucggugcgagugucccgccggguucaauuauaacuccaucuugcucgcgugcgaagacguggaugaguguggaagucgcgaaucuccaugccaacagaacgccgacuguauuaauaucccugguagcuacagaugcaaguguacuaggggcuauaaacugucccccgggggagcaugcgucggccggaacgagugccgagaaauaccuaauguuuguucacacggugauugcauggacaccgaggggucuuacaugugucuaugccauagaggauuucaggcuagcgccgaucagacacuguguauggacaucgacgagugcgaucgccaaccauguggcaacggcacgugcaagaauauuaucgggaguuauaacugucuuugcuuccccggauuuguggugacccacaauggugacugugucgauuucgacgaaugcacuacacucgugggccagguuuguagguuugggcauugccugaacaccgcuggauccuuccacugcuugugucaggauggcuuugagcugacugcagacgguaaaaauugcguagauacaaacgaauguuuaagccucgccgggaccugccugccuggaacgugucagaaucuugagggcucuuuccggugcauuuguccacccggcuuucaagugcagucagaccauugcaucgauauagacgaauguuccgaggagccgaaccugugcuuguucgggacuuguaccaauaguccuggaagcuuucagugccucugcccacccgguuucguccugucggauaacggccaccguuguuucgacacaagacaaucuuuuugcuucaccagguuugaagccgggaaguguuccgugccuaaagcuuucaauacuacaaagacccgcugcuguugcagcaagcggccaggagagggcuggggugaucccugugaacuaugcccgcaggaggggucagcggcauuucaggagcuguguccuuucggacacggcgccguucccggcccagacgacagucgagaagaugugaacgagugcgcugaaaacccuggggucuguacaaauggagugugcguaaacacugacgguucuuuuagaugcgagugucccuucggcuacucccuugauuuuaccgggauuaauugcgucgacacggaugaauguagcgugggacauccaugcggccaggguacauguaccaacguuaucgggggauucgagugcgccugugcagacggcuuugagcccggccucaugaugacuugcgaagauaucgacgaguguucacugaauccuuuguuaugcgccuucaggugucacaacaccgaagggaguuaucugugcacaugcccagcuggauacacucuccgcgaggauggugcgaugugucgggacguggaugaaugcgccgacggccaacaggacugucaugcaagagggauggagugcaaaaaucugauuggaaccuuugcuugugucugcccgcccggcaugcguccucuuccagguagcggggagggauguacggaugacaacgaaugccacgcccagcccgaucugugugugaauggcaggugcguuaacacagcaggcuccuuccggugugacugcgaugagggguuccagccuucuccaaccuugacugaaugccacgacauccgccaaggacccuguuuugccgaggugcuacagacaaugugccgaagccuguccucaucuagugaagcugucaccagagccgaguguugcugugguggcgggaggggauggggcccucggugcgagcucuguccgcugccagguacuucggcguaccgcaagcuuugcccccaugggagcggcuauacagcagaaggaagagauguggacgaguguaggauguuagcccaccugugcgcucauggcgaauguauuaauucccucgggucuuuccgaugccacugccaggccggauacaccccugaugcuacggcaacuaccuguuuggacauggaugagugcucacagguacccaaaccauguacauuucugugcaagaacaccaaagguagcuuccucuguuccugcccucggggcuaucugcuugaggaagacgggcguacauguaaggaucuggacgagugcacuaguagacaacauaauugucaguuuuugugcgugaacaccguuggagccuucacgugucgcugccccccaggcuuuacacagcaccaccaagcuugcuucgacaaugaugaauguucugcccagccggguccuugcggggcacauggccacugucauaacacucccggaagcuuuaggugcgagugucaccagggcuucacccuagucucauccgggcacggaugcgaagacgugaacgagugugaugguccacaucggugccagcacggcugucaaaaucagcuggggggauacagaugcaguuguccccagggcuuuacacagcauagccaaugggcgcagugcguggacgagaacgaaugcgcccucucuccuccaaccugugguuccgcuucaugccgcaauacuuuaggcggguucaggugugucugccccagcggauuugauuucgaccaggcccugggcgggugucaggagguagaugaaugcgcaggacgacggggcccuuguucguauucuugcgcuaacaccccggguggguuccuuuguggaugcccacaaggcuacuuuagagccggucagggccacugugugagugggcugggauucucccccggcccucaggacacaccagauaaggaggaacucuugagcucagaggcaugcuaugagugcaaaauaaaugggcugucccccagggaccgcccucgucggucugcccauagagaucaccagguuaaccucgcuacgcuggacagcgaagcgcuucuaacucugggauugaauuuaagucaccugggcagggccgagcgcauccucgaacugcgacccgcacuugagggucuggaagggcggauuagauacgugaucgucaggggaaacgagcaaggcuuuuuccgcaugcaucaccucagagguguguccagcuugcagcugggccggaggcguccagggccgggaaccuaccgacuagagguugugucucauauggcuggcccuugggggguccagcccgaaggacaaccaggcccuuggggucaggcccugcgccucaaggugcagcuucagcuguuauga

SEQ ID NO: 56147 - RNA, 1017 nt, Artificial Sequence
  derived and/or modified sequence opt3 from FBP1__Homo_sapiens__NP_000498
auggccgaccaggcucccuucgauaccgacgugaacacacugacuagauuugucauggaggaaggcaggaaggcacgggggacgggagagcucacccaacuucugaauagcuugugcacagccguuaaagcgaucuccucugcugugcgcaaggccgguauugcacacuuauacggcauagccgggucaacuaacguaaccggagaucaggugaaaaagcuggacguccuaaguaaugaucucgugaugaacaugcugaaaagcuccuucgcuacauguguucuugugucugaagaggacaagcaugcaaucauugucgaaccugagaagcgaggcaaauaugugguaugcuuugauccacuggacgguucgucaaauaucgauuguuugguuagcguggggaccauuuucggaaucuaccguaagaaaaguacugacgagccguccgaaaaggaugcccuccagcccggcagaaaccuggucgcugccggcuaugcgcuguacgggucugcaacaaugcucguguuagccauggacugcggagugaauuguuuuaugcuggauccugcuauaggugaguucauccuugucgacaaagacguuaagauuaagaaaaagggcaaaaucuauagcuugaacgaaggguacgccagggauuuugacccagcagugaccgaguauauucagcggaagaaauuucccccugauaauuccgcuccauacggagcccgcuacguaggcucaaugguggcggacguccacagaacgcugguguauggugggaucuuccuauaccccgccaacaagaaaaguccuaauggaaagcucaggcugcuuuaugagugcaacccaauggcauacguuauggaaaaggcuggcggcauggccacuaccgggaaagaggcugugcuggaugucauaccgacagacauucaucaacgggcccccgugaucuugggaagcccugaugacguacucgaguuccugaagguuuaugaaaaacacucugcacaguga

SEQ ID NO: 56148 - RNA, 1020 nt, Artificial Sequence
  derived and/or modified sequence opt3 from FBP2__Homo_sapiens__NP_003828
augaccgacagaagccccuucgagacagauaugcugacucucacgagguacgugauggaaaagggccggcaggccaaagggaccggagagcuuacacaacuguugaacuccauguuaacugcuaucaaggcaauuucuucagccguccgcaaagcgggucuggcucaccuauauggcauagccgggaguguuaaugugaccggagacgaaguaaagaaacucgaugugcugagcaacucccuugucaucaauauggugcagucuucguacucaacaugcguucuggugagcgaggaaaacaaggacgcaauuaucaccgccaaggagaaacgaggcaaguaugucguguguuuugauccuuuggacgguaguuccaauauugauugccucgcuucuaucgggacuauauucgcaaucuaccguaaaacaagcgaggacgaaccauccgagaaggaugcccugcaguguggaagaaacauuguagcugccggcuaugcgcuguacggcucagcaacccucguugccuuaaguacggggcagggaguggaccuguuuaugcuugauccggcuuugggugaguucguccugguggaaaaagacgugaagaucaagaaaaagggcaaaauuuauagccuaaaugagggguacgccaaguacuuugaugcagcuacuaccgaauauguccagaaaaagaaauuccccgaggacggaucugccccuuacggcgcgagguauguugguuccaugguggccgacguacaucggacacucguguacgggggaaucuuucuguauccagcaaaccaaaagucacccaagggcaaacuucgccuguuguacgaaugcaauccugucgcuuauauaauugagcaggccggcgggcucgcuacuaccggaacacagccagugcuggauguuaagcccgaagccauccaccaaagagugccuuuaauucuggguagcccagaggacguccaggaguaccucaccugugugcagaaaaaccaggcaggcaguuga

SEQ ID NO: 56149 - RNA, 2943 nt, Artificial Sequence
  derived and/or modified sequence opt3 from FBRS__Homo_sapiens__NP_001098549
auggagaccgccgcugcagccgcgcccggcccugggugggcugccgaaggagagagaaggcggcgccgaugcagccguagagacagggaucgggaacagcgcagaaggcgggguccaggcggggacgcaccgcgcgcccugcucgcugcaccccgaggauccucuucaaguagcuccccuccacccccugccagaccauggucuucggcuucaagcggcgagaggcccggugggccucggcgucgcagaccaaggccgcggccccgaccuccacgccccagagccaggaagcggccugcgggaaguggcucccgcggcgaagaggaggaagaggaagaggaggaagggggagcagaugacggugaggccgaagaggaaccagaggaggaagaggaagaggaagaggaucuuaucgacggcuucgcuauugccucuuuugcaacacuggaggcuuugcaaaaagaugccagcuuacagcccccggaaagacuggagcacaggcuaaagcauuccgggaaacguaagcggggaggcucaaguggugcgacuggggaaccuggagacagcucugaucgagagcccggcagaccaccuggcgacagggcccgcaaauggcccaacaagcggagaaggaaggaagcauccucacgccacagccucgaggcuggguacauaugugaugccgagagugaccuggaugaacgagugucugacgacgaucuugacccauccuucacggucagcaccucgaaagccucuggaccccauggugccuuuaauggcaacugcgaggcaaagcuguccguugugccuaaaguaucaggguuggaacggagucaggagcagccaccgggacccgauccucuccuggugccauucccuccuaaggagccacccccgccuccagucccccguccucccgugagcccacccgcuccccugccagcuacaccgucccucccucccccaccccaaccucaguuacagcugagaguuucuccauuuggccuuaggacuagccccuaugguucaaguuuggaccuguccaccgggucuagcucacgcccuccgccaaaagcgcccgcaccuccaguggcccagcccccuccgaguagcuccucuucgagcuccucaaguucuagcgcuuccucaagcucugcccaacuaacacaccggcccccaaccccuucccucccccugccacuuaguacucauagcuucccucccccaggccugagaccgccucccccaccccaccacccuucuuuguuuuccccaggacccacacucccuccgccacccccucuguuacagguccccggccauccaggggcaucagccgcuaaugcccugagugaacaggaucucaucggacaggaccuuaacagcagguaccugaaugcacaagguggcccugaggugguaggggcgggaggcucggcucgacccuuggccuuccaguuucaccagcauaaccaccaacaccagcauacccaccagcauacgcaccagcauuucacuccauauccuccgggucuacugcccccacacgggccucacauguuugaaaaguaccccggcaagauggagggacucuuccgccauaauccauauaccgcauuuccucccgccguuccgggccugccaccugggcuucccccagcuguguccuucggaucucugcaaggugccuuccagcccaaaagcacaaacccugaauugccgccccggcucggcccagucccuucagggcugagucagaagggaacucagauucccgaucacuuuagaccuccauuaaggaaacccggcaaguggugugcaaugcaugugcguguggcuuacaugauccugcgccaccaagagaaaaugaagggugacucccacaaacuagauuuccggaaugaccuccugccuugccuuccagggcccuauggcgccuugccgccuggacaggagcugucucauccagcgagccucuuuaccgccacaggcgcuguccacgcagccgcuaaccccuucaccgccgcaccuggggcgcauggaccauuucugucccccucaacgcacauugauccguucggcagaccuacuagcuuugccagucuugcugcccugucuaauggugcauucgggggauugggcucccccacauuuaacagcggugcuguuuucgcccagaaggaaucgccaggcgcaccucccgccuuugcuucaccacccgacccuugggggaggcuccaucgaucuccacugaccuucccggcgugggugcggcccccugaggccgcacgcacuccaggaagugacaaggaaagacccguagagaggcgggaaccuuccaucacaaaagaggagaaggaucgagacuuaccauuuagcagaccccagcugcgcgugucuccugcuaccccgaaagccagggccggcgaagaggggccacgucccacgaaggaaagcguccgggugaaagaggaaagaaaggaggaggcugcagccgcggcugccgcagccgcugcagccgcggcugccgcagccgcugccgcaaccggaccucaaggccuacaccuccuguucgaaaggccccgcccaccucccuuccuugguccauccccgccugaucgaugugcuggguuuuuggagcccacauggcuggccgcgccacccagacucgcccggccuccaagguucuacgaagcaggagaggagcugacuggccccggugcuguugccgcugcacgcuuauacggccuggaaccugcccacccgcuuuuguauucacgucucgccccacccccuccacccgcugcggcaccugggacaccccaucugcuaaguaagaccccaccgggagcccugcucggcgcuccucccccacuggugccugcccccagaccaagcucuccuccccgggggccgggaccagcaagggccgaccgcuga

SEQ ID NO: 56150 - RNA, 903 nt, Artificial Sequence
  derived and/or modified sequence opt3 from FBXL15__Homo_sapiens__NP_077302
auggagcccccuauggaaccaagcggcggggagcaggaaccgggagccgugagauuccuggaccuccccugggaggauguccuucugccucacguuuugaacagggugccauuacggcaacugcuacgccuccagcgaguaucccgugcuuuuagaucucuggugcagcuucaucuggcagguuugaggcgguucgacgccgcgcaggucggcccccaaaucccucgcgcugcccucgcaagacugcugagggaugccgaagggcuccaggaguuagcucuggcaccaugccacgaguggcuuucagacgaagauuuggugcccguucuggcccggaauccucagcuacgcaguguggcucucggaggcuguggucagcugagccggagagcccuuggggcgcuggcagagggaugcccaagguugcaacggcucucccuggcccauugugacugggucgauggcuuagcucugcguggccucgccgaccgcugcccggcacuugaggaacuggauuugaccgcuuguagacagcuaaaggacgaggccauuguguaccuggcgcagaggcgaggggccggacuccgaucucugucgcuugcaguaaacgcuaauguuggugaugccgcugugcaggaacuggcccgcaacugccccgaguugcaccaucucgaccugacaggcuguuuaagagucgggucagauggagugaggacucuggcagaauauugcccugugcuacggagccuccgcgucagacacugucaccauguugccgagaguucccugucuaggcuucguaaacggggcguggacauagacguagaaccacccuugcaccaagcucuggugcuccugcaggauauggcggguuuugcaccuuucgucaaucuucagguguga

SEQ ID NO: 56151 - RNA, 2106 nt, Artificial Sequence
  derived and/or modified sequence opt3 from FBXL17__Homo_sapiens__NP_001156787
augggccaccuucucagcaaggagcccagaaacaggccuucccagaaacggccacgcugcuguucuuggugccgacguagaaggccgcuucugcgguugccccgcagaaccccugccaaggugccaccccaaccugcugcaccaaggucacgggacuguuucuuucgcgggcccugcauguuauguuucaucguccauaguccuggagccccagcgccggcuggucccgaagaggaaccuccacugagucccccuccacgagauggcgccuacgcagccgcuuccucuucgcagcaccuagcaagaagguaugccgcucucgccgcggaggacugcgcagccgcugcccggcguuuucugcuuucaagcgcagcugccgcggccgcagcugccgcuagugccuccucucccgcaagcuguugcaaagaacugggguuggccgcugcggcagccugggagcagcagggacgcucccucuuccuggcuucacugggcccgguuagauuucucgguccucccgccgcagugcaauuauucagggggccaacaccuagucccgccgagcugccaacucccccugaaaugguauguaagcggaaaggagcuggcgugccagccugcacgccguguaagcagccccgaugcggcgggggagguugcggcgggggaggcggugggggaggcggcgggggaccugcggguggcggggcaagcccaccccgcccuccagaugcuggauguugccaggcccccgagcagccgccucaaccacuuugucccccucccucuuccccaaccucagaaggcgcaccuacagaggccgguggggacgcugucagagccggcggaacugcacccuugagcgcucagcagcagcaugagugcggcgaugccgacuguagggaaaguccagagaauccgugcgauugucaccgggaaccucccccagagacccccgacauuaaccaacugccuccaucuauacuacucaagaucuuuuccaaucugagccuugaugaacgcugccugucggcgucuuugguguguaaauacuggagagaccucugccuggauuuccaguuuuggaagcaguuagaccuguccucaaggcaacagguuacagaugagcuccuugagaaaauugccagucguagccagaacaucauugaaaucaauauauccgacugucggucuaugagcgacaacggggugugcguccuggcuuucaagugccccggauugcuacgauauaccgcauacagauguaaacagcugucagauacuagcaucauugccguggcuucccauugcccucuccugcaaaagguacacguugguaaucaggacaagcugacagaugagggccugaaacaguuggggagcaaguguagggaacucaaagacauccacuuuggacagugcuauaagauuucugaugagggcaugaucgugauagccaaagguugucugaaguuacaacgcauuuacaugcaggaaaacaaacuggucaccgaccagucagugaaggcauucgcggagcauugcccggagcuacaguaugugggguuuaugggcuguagugucacgagcaagggaguuauccaccucacuaaacugcggaaucuuuccucuuuggaucugagacauauuaccgaacucgacaacgagacagugauggaaaucguaaagaggugcaaaaaucugucgagccuuaaccuguguuugaauuggaucauuaacgaucgcugcguggaggucauagccaaggaaggccaaaaucucaaagagcuguacuuaguguccuguaagaucacugacuacgcucugauugccaucgggcgauauucaaugaccauagagacaguugaugugggauggugcaaggaaauuaccgaccagggugcaacgcuaaucgcucagaguucuaaaagccuccgguaccugggccuuaugcguugcgacaaggucaacgaggugacuguagaacaguugguucaacaguauccacacaucacauucuccaccgugcugcaggauuguaaaagaacucucgagagggccuaccaaaugggguggacacccaacaugucagcagccagcucuuga

SEQ ID NO: 56152 - RNA, 2085 nt, Artificial Sequence
  derived and/or modified sequence opt3 from FBXL19__Homo_sapiens__NP_001093254
augggcaugaaggugcccgggaaaggagagagcgguccuuccgcccugcucaccccaccgaugucuucaaguagcagaggccccggggcuggagcaaggcggcgccgaacacguugcagaaggugucgggccugcguccgcacugaauguggcgacugccacuucuguagagauaugaagaaauuuggugggccuggaaggaugaagcaguccugccuucugcggcaauguacggcgccaguuuugccccauaccgcugugugcuuacuguguggcgaggccggcaaagaagacacaguagagggggaagaggagaaguucggacuaucucucauggaaugcacuaucuguaacgagauugugcacccugguugccugaagaugggcaaagcagaaggggucauaaaugccgagaucccaaacugcugggaguguccccgcugcacccaggaaggacgaacaucgaaggauucaggcgaggguccugggagaaggcgggcugacaauggagaagagggcgcaagccuuggcaguggguggaaacugaccgaggaaccaccguugcccccuccacccccucgucgcaagggaccacuccccgccgguccgccucccgaggaugugccaggcccucccaaaagaaaggaaagggaggcugggaacgaaccacccacuccucggaagaaaguuaagggaggccgagagcgccaucugaaaaagguggguggggacgccugucugcucagaggcuccgauccaggaggcccgggguuacugcccccuaggguccuuaauccaucucaggcguuuagcuccugccaccccggauugccuccagaaaacugggagaaacccaagccgccucuggcaucagccgaggguccagcugugcccaguccuagcccccagcgggaaaaacuagagcgcuucaagagaaugugucaacuccuggaaaggguaccagacacaucuuccucaagcagugauucugacuccgauagcgacucgucuggcaccucccuuucagaggaugaagccccuggggaggcacguaauggacggcgacccgcuagaggcaguagcggugagaaggaaaacaggggcgggcgccgggccguuagaccaggauccggcgggccgcuguugucuuggccucucggacccgcgccacccccuaggccaccccagcuggagcgccaugugguccgaccuccgccacggagccccgaaccugacacguuaccacuggccgcagguucagaccacccccucccucgugcugccuggcuuagaguguuucagcaccugggcccgagggaguugugcauuuguaugcgcgugugccggacuuggaguagaugguguuacgauaaaaggcuauggccccgaauggaccugucccgcagaaagagccucaccccaccuaugcugucuggggucguucggaggcagccccgugcucuugaucugucauggacaggagugaguaaaaagcaauugauguggcuccugaaucgcuuacagggccugcaggagcuaguacucagcgguugcuccuggcugucugugucggcccuugggagcgcaccauugccugcccugcggcuccuggaccuuagauggaucgaagaugucaaagacucccagcugagggaguugcuccugcccccaccggauacuaagccuggccaaaccgaaucacgaggacgguuacagggcguggcugagcugcgccuagcggggcucgaacugacagacgcaagucuuagauugcugcucaggcaugcuccccagcugucugccuuagaucugagccacugugcccauguuggagacccauccgugcaccuuuugaccgcacccacgucaccucuccgggagacucugguccaccuaaaccuggccggcugccaucgacucacagaucacugccugccacuuuucagacgcugucccagguugcgucggcuggacuuaagaagcugcaggcaacucucuccugaggcuugugcccgccuggcagcggcugguccgccagggcccuuucgaugcccugaagagaaacuucuguugaaggacuccuga

SEQ ID NO: 56153 - RNA, 1215 nt, Artificial Sequence
  derived and/or modified sequence opt3 from FBXL20__Homo_sapiens__NP_001171835
augagaagggacgugaacggcgucaccaagagccgguucgagauguuuuccaauucugaugaagccguuaucaacaaaaagcugcccaaagagcuccuucugcgcauuuucucauuuuuggacgugguaacauuaugccgaugugcucaggugagucgugcauggaauguccuggcccuagaugggagcaacuggcaaagaauagaccucuucgauuuucagagggacaucgaaggacgggugguugagaauauuuccaagcgcugcgguggcuuccugagaaaacuuucucugaggggguguuugggagugggcgauaacgcgcuccggacuuuugcucagaauugccgcaacaucgaaguccugaaucugaacgguuguacgaagaccacagacgccgaggggugcccucucuuagagcagcugaauauuucguggugugaucaagugacuaaggacggaauccaggcacuuguacgaggcugcggcggguugaaagcccuguuccuaaagggauguacccagcucgaagaugaggcucugaaauacauaggugcacacugcccagaacuuguuacacugaacuugcagaccugucuccaaaucacugacgagggccugauuacaaucugcagagggugccauaaguuacagucacugugugccagcggaugcaguaauauuaccgaugcuauccucaacgcccuuggccagaauuguccgaggcugcggauauuggagguggcgcguugcucccagcuaacggacgucgguuuuacuacccuggcacgcaacugucacgaacucgagaaaauggaccuggaagagugcgugcaaauuacagauucuacucuuauccagcugagcauucauugucccagacuccagguguugucccugucacacugcgaauuaaucaccgacgaugggaucaggcaucugggaaacggcgccugugcucacgaccaacuagaggucauugagcucgauaauugcccucugauaacagacgccagucuugaacacuugaaaagcugucauucucuggagcggaucgaacucuaugauugccagcagauuacccgagcaggcaucaagcgccugagaacgcaccuuccaaacauaaagguucaugcuuacuucgcccccgugacuccuccacccuccguagggggaucaaggcagcgguuuugccgcuguugcauuauccuguga

SEQ ID NO: 56154 - RNA, 1068 nt, Artificial Sequence
  derived and/or modified sequence opt3 from FBXL2__Homo_sapiens__NP_001165184
augguguucagcaacaaugacgagggccugaucaacaagaaacuccccaaggaacuucuguugagaauauuuuccuucuuagauauugucacccuguguaggugcgcccagaucucuaaggcuuggaauauucuagcacucgacgggucaaacuggcaacggaucgaucuguuuaauuuccagacagacguugagggacgcgugguagaaaacauuaguaaacgaugcgguggcuuucuucguaaacugagcuugagaggguguaucggagugggcgauuccucucucaagacuuucgcccagaauugcaggaacauagagcaccugaaucugaacgguuguacgaagaucaccgacucgacaugcuacucacucagccgguuuuguaguaaauuaaagcauauucagaauuauugccacgaacuggucucccuuaacuugcaaucuuguagccgcaucacugaugagggggugguucagauuugcagaggaugucauaggcugcaggcgcuaugccucuccggcugcucaaaucugaccgacgcuagucuuacagcccugggcuugaacuguccucggcuccagauccuggaggcagcccgcugcagccacuuaaccgaugcuggguucacucugcucgcacgaaauugucaugaacuugagaaaauggaccuggaagagugcauauugauuacagauucuacccuaauccaacuguccauucacuguccaaagcuccaggcccugucacuuagccacugcgagcugaucacggacgauggaaucuugcaucucaguaacucuacuuguggucacgaaagacugaggguguuagagcuggacaacugccuacucauuaccgacgucgcucuggaacaucuugagaauugucggggcuuggaacgucuggagcucuacgauugccaacaggugacacgcgccgggauaaaaagaaugagggcgcagcugccgcacguaaagguucacgcauauuuugcccccgugacuccuccaaccgcugucgccggauccggccagcggcuuugucgaugcugcgugauccuguga

SEQ ID NO: 56155 - RNA, 1287 nt, Artificial Sequence
  derived and/or modified sequence opt3 from FBXL3__Homo_sapiens__NP_036290
augaagagaggcgggagggacagcgaucggaacuccucugaggaaggaaccgccgagaaaucaaagaaacugcgcacaacuaaugaacacagucagacgugcgacugggguaaccuccuucaagauaucauucugcaaguguucaaguacuugcccuuacuggaccgagcucaugcaagccaggucugucguaauuggaaccagguuuuucacaugccugaucuauggagaugcuucgaguuugaacucaaucagccagccaccuccuaucugaaagcgacacauccggagcuuauaaagcagaucauuaagaggcacucuaaccaucugcaguacgugucguucaaaguagacucaagcaaggagagugcugaagccgcaugugauaucuugucccagcucgugaauugcucucugaaaacucugggccucauuagcaccgcccggcccuccuuuauggacuuaccuaagucacacuucaucagugcucugacagucguguuuguuaacagcaaaucucuuuccucauugaagauagaugacaccccaguggaugaccccagccugaagguccuaguggcaaauaacagugauacucucaaacugcuuaagaugucuuccuguccucacguaagcccagccgggauccugugcguugcugaccaaugucauggauugcgcgagcucgcccugaauuaucacuuacugucggacgaacuccuucuggcguugucuuccgagaaacaugugagacuagagcaccugaggauugaugucgugucagaaaaccccggccagacacacuuccauaccauccagaagaguagcugggacgcauuuauucggcacuccccuaaagugaaucucgucauguacuucuuucuguaugaggaagaguucgauccauuuuuccgcuacgaaaucccggccacgcaucuuuauuucggucgaucuguuagcaaggacgugcuggggagaguaggaaugacuugccccagguugguggagcucgucgugugugcuaacggccugcggccuuuagaugaggaacugauacguauugccgagcgcugcaaaaaucuaucagcaaucggccucggggaaugugagguuaguugcuccgcuuuuguggaguucgucaagaugugcggagguagacugagccagcuuucuauuauggaagagguguugaucccagaccaaaaguacucacuggaacagauccacugggagguaaguaaacaucucggcaggguuugguuucccgauaugaugccuaccugguga

SEQ ID NO: 56156 - RNA, 1866 nt, Artificial Sequence
  derived and/or modified sequence opt3 from FBXL4__Homo_sapiens__NP_001265645
augagccccguguucccuaugcugaccguccucacaauguuuuacuauaucugccuuagaaggcgggcccgcacugcuacgcgaggcgagaugaugaacacccaccgugcaauugaauccaauucucagacaucaccacugaacgccgagguugugcaauacgcgaaggaaguaguggacuucaguagccauuauggguccgaaaauucuaugucguacacuauguggaacuuggcuggagucccgaauguguuucccucaagcggugauuucacccagacagccguuuuuagaaccuauggcacuuggugggaccaguguccuagugcauccuuaccauucaaaaggacacccccuaacuuucagucucaagauuacguggagcugaccuucgagcagcaggucuauccaacggccgugcacguacuagagacuuaccaucccggggcuguuauacggauccucgcaugcagcgccaauccuuacuccccaaacccgcccgcugaagugcgcugggagauucuguggucagaaagaccuaccaaggucaaugccagucaggcgaggcaauuuaaaccauguaucaagcagauuaacuuccccacaaaucuuauccggcuggaggugaacagcucuuugcucgaguauuacacugaacuggacgcagugguccugcacggaguuaaagauaagccugugcucuccuuaaagaccucacugauagacaugaaugauaucgaggacgaugccuaugcugaaaaagacggcugcgguauggauagccuuaacaagaaauuuaguucugccguauugggggagggaccaaauaacggcuacuucgacaagcugcccuaugaacuaauucagcucauccugaaccaucuuacacugccggauuugugucgccucgcacagaccugcaaacuguuaucccaacacuguugcgacccucugcaguacauucaccucaaucuucagcccuauugggcuaagcuggacgauacgagcuuggaguuucuacaaucgcgauguacucuggugcaguggcucaaccugucuuggacaggcaauagaggguucaucuccgucgccggauucucaagguuucuuaaggugugcgguagugagcugguucgguuggaacucagcuguucccauuuccugaacgagaccugcuuagaagugauaucugagaugugcccaaaucugcaggcgcuaaaccucagcucaugugacaaacugccuccccaggccuuuaaucacauugcaaaacuuugcaguuugaagcgucugguccucuaccgcacuaagguggaacaaacagcucugcuuuccauccugaacuucuguagcgaguugcagcaucucucucugggcucaugcguaaugauugaggauuacgacguuaucgccaguaugaucggggcuaaauguaagaaauuaagaacccuggaucuauggaggugcaagaauauuacggaaaacggaauagccgagcucgcaagcggcuguccacugcuugaagaguuggaccuggguuggugccccacccuccaguccucuacaggguguuuuacucggcuggcccaccaguuaccuaaucugcaaaaacuuuucuugaccgcuaaccgaucggugugcgauacagacaucgaugaacucgcguguaauugcacucgccugcagcagcuagacauucugggaaccagaauggucagcccagcaucccucaggaagcugcuugagucaugcaaggauuugagucuguuagacgugucuuuuuguagccagaucgacaaccgggccguccucgagcugaaugcuuccuucccgaaaguguuuauaaagaaaucauucacacaauga

SEQ ID NO: 56157 - RNA, 2025 nt, Artificial Sequence
  derived and/or modified sequence opt3 from FBXL5__Homo_sapiens__NP_001180464
auggcccccuucccugaggaaguggacgucuuuaccgcuccacacuggagaaugaagcagcugguuggccucuacugcgauaaaagccuuuaugcaacauucaaggaguuuaaaaugcaugaacaaaucgagaacgaauacauuauagggcuguugcagcagaggucccagacuaucuauaaugugcacucugacaacaaguuaucagagaugcugagucuauucgagaaaggacucaagaauguaaagaacgaauacgagcaacugaauuaugccaaacagcuuaaggaacggcuggaggcguuuacgcgcgauuucuugccgcauaugaaagaggaagaggaaguguuucagcccaugcucauggaguacuucaccuaugaagaacugaaggacauuaaaaagaaggucaucgcucagcacuguagccaaaaagauacagccgagcugcuccgagguuuaucccuguggaaccaugcagaggagcgucagaaguuuuucaaauacucuguggacgaaaagucggauaaagaggccgaaguuucagagcacagcacuggcauuacccaccuuccuccagaggugauguugaguaucuuuuccuaccugaauccccaggaacuaugcagauguucucaggucagcaugaaguggucccaacucacaaaaaccgggucacuguggaagcaucuuuauccugugcacugggcuaggggagacugguacaguggcccagcaacugagcuggauacagaacccgacgaugaguggguaaagaaccggaaagacgaaagccgcgccuuccaugagugggaugaggacgcugacauagaugaaucugaggaauccgccgaggagucaaucgcgauuagcaucgcacagauggaaaagagauugcuccacggucugauucacaauguuuuaccuuauguggggaccagugucaaaacgcuggugcucgccuacucuuccgcugugagcucgaagauggucaggcagauccuugagcugugcccaaacuuggaacaucuagaccugacucaaaccgauauaucugacuccgccuuugauucauggaguuggcucggauguugccagagccugcggcaccuugaccuguccggcugugagaaaauuacagauguugcauuggaaaagaucucucgcgcucucggcauucugacuagccaucagucaggguucuuaaagaccaguacauccaaaaucaccagcacggccuggaagaauaaagacaucacuaugcagucuacaaagcaauaugcgugccugcacgaucuaaccaacaaaggaauuggugaggagauagacaaugaacauccguggacuaagcccgugucaagugagaacuucacaagcccuuacguauggaugcucgaugccgaagaccuggcagacaucgaggauaccguggaauggcgacacagaaaugucgagucccuuugugugauggagacggcuucuaacuuuucgugcagcaccuccggcuguuucucaaaggacauuguuggguugaggacaagugugugcuggcagcagcacugcgccucuccagcuuuugccuauuguggacauagcuucugcuguacuggcaccgcacugcggacaauguccucacuccccgaaagcucugccaugugccguaaagcugcgcgcacuagacugccuagggguaaggaucuuaucuacuuuggguccgagaaaagugaccaggaaaccggacggguccuguuguuccucagccugucuggcuguuaccaaauaacagaucacggcuuacgagugcugacccuagggggaggucucccauaucuggagcaucuuaacuuguccggcugccugacuauuacgggggcaggacuccaggaccugguaucagccugucccaguuuaaaugaugaauacuuuuauuacugcgacaacaucaauggcccgcacgcugauacagccagcgguugucagaaccugcagugcggguuccgcgcauguugcagaucgggcgaguga

SEQ ID NO: 56158 - RNA, 1476 nt, Artificial Sequence
  derived and/or modified sequence opt3 from FBXL7__Homo_sapiens__NP_036436
augggcgccaacaaugggaagcaguacggaagcgaggguaaaggcuccucuucaaucaguagcgacguguccucuucgaccgaucacacacccacuaaggcucagaaaaacgucgcaacgucagaagacagcgaucugaguaugagaacccucuccacaccuucuccagcccuuauuugcccgcccaaucugccuggguuccaaaacggaaggggcagcuccacuucaaguagcucuauaaccggugagacaguugcgauggugcauuccccacccccuacccgguugacucacccauuaauccgccuggcuucacgaccccagaaggaacaggccagcauugaccgucuaccugaucauaguaugguacaaaucuuuucuuuccucccaacaaaucagcuguguagaugcgcaagggugugucggcgcugguauaaccuugccugggacccgagacuguggaggaccauucgguugacgggggagacuaucaaugucgaucgcgcucucaaagugcugacccgaagacugugccaggacacacccaacguuugucucauguuagaaacugugaccgucuccggaugcaggcggcugacagaucguggccuuuacaccauagcacaguguugcccugaguugcgcagacuggaggugagcggcuguuauaauaucucgaacgaagccguauuugacguugugucucuaugcccaaaucucgagcaccuggaugucuccggguguucaaaggugacgugcauuagucuuacuagggaagcuagcaucaagcugucccccuugcauggaaaacaaauuucuauccgguaccucgacaugacagauugcuucgugcuggaggacgaggguuuacacaccauagccgcgcacuguacucagcugacacaucucuaucuucgacgcugcgucagacugaccgacgaaggcuugagguaccuaguuauuuauugugcaagcaucaaggagcugucagugagugauugccgguuuguauccgacuucgggcuccgcgaaauugccaaacuggagagcagacuuagguaccugucuaucgcucacuguggacgugugacggaugucggcauccgguacguggccaaguauugcucaaaauugcgauaccucaacgcaagagguugugaagggauuaccgaccauggaguugaguaucuggcuaagaauugcacaaaguuaaaaagucuggauauaggcaaguguccucuagugagcgacacuggccucgagugccuggcccuuaacuguuuuaauuugaaaaggcugucccucaagucuugcgaaucgaucaccgggcagggacugcagauugucgcggccaacugcuucgaucuucaaacacugaacgugcaggacugugagguaagcguugaagcauugcgcuuugugaaacggcacugcaagagaugugucaucgagcacacuaauccagcuuucuuuuga

SEQ ID NO: 56159 - RNA, 1962 nt, Artificial Sequence
  derived and/or modified sequence opt3 from FBXO10__Homo_sapiens__XP_005251496
auggaggccggcgggcugccccucgaacuuuggagaaugauccuggcuuacuugcacuuaccugaccugggaaggugcagccuagugugucgggcaugguaugagcucauucugucccuugauucuacccgcuggcgacagcugugcuuggguuguacagaaugccgucauccaaacuggccgaaucaacccgacgucgagccugaaucauggagagaggccuucaagcagcacuaccucgcgaguaaaacuuggacgaagaacgcucuggaucuggagagcuccauauguuuuucucucuucaggcggcgcagagaaaggcggaccuuaucgguuggcccagggcgcgaguuugacucacugggaagcgcccuugcaauggccaguuuguaugaucgaaucgugcuguuccccggcguauacgaagaacagggugagauuauccuaaaagugccugucgaaauuguggggcagggaaagcucggcgagguugcucugcuugcauccaucgaccaacauugcucuacaacuagacuguguaauuugguguuuaccccagccugguucagccccauaauguauaaaacaaccuccggccacguccaguuugauaacugcaauuucgaaaacgggcauauccaggugcacggaccugguacuugucagguaaaguuuugcacauucaagaauacccacauuuuucuccauaacguuccacuguguguguuagagaauugcgaguucgucggcucagagaacaauagugugacgguggaggggcacccgagcgcugacaaaaacugggccuacaaguaucugcucggacuuaucaaaucuucccccacuuuucugccuaccgaagauucagacuucuugaugagccuagaucuggagaguagggaccaagcguggucuccaaagacaugcgauauugucaucgaaggcucccagagccccacuucgccugcaucuuccucaccaaaacccgguaguaaggccgggagccaggaggcugaaguuggauccgacggcgagcggguggcccagaccccggacucuagcgauggcgggcucucaccuaguggagaggacgaagaugaggaccaacugauguaccgucuuuccuaccagguacaggguccccgcccagugcugggcgggagcuucuugggaccuccccucccaggcgcaucuauacaacugcccucauguuuaguccugaauagucuacagcaggaacuccagaaggauaaagaggcuauggcccuggcgaacagcgugcaagguugccuuauuagaaaguguuuguuuagggacgggaaaggcggaguuuucgugugcucccauggccgggccaagauggaagggaauaucuuucgaaaccugacauaugcaguccgcuguauucacaacucuaaaaucaucaugcucagaaaugauauuuacaggugccgggcuucgggaauauuccugcgccuugaggguggcgggcugaucgccggaaacaauauuuaucacaacgcugaggccggcguggacaucagaaagaaaagcaauccuuugauacucuguaaccagauucaucacggucugagguccgggaucguaguuuuaggcaauggaaagggcaucauucguaacaaucagaucuuuucaaacaaggaagcagggauuuacauacuguaucauggaaauccaguggucagugguaaccacaucuucaaaggccgggccgcugggauugcggugaaugagaacggaaagggccuaaucaccgaaaaugucauccgagagaaccaguggggugggguggauauuagaaggggcggaauaccgguucuccgcucuaaccugaucugcuuuggcuacagcgacggggugguagucggagaugagggcaaaggucuuauugaagggaauacgaucuaugagaacggaaaguacaauggcaaaacucgguga

SEQ ID NO: 56160 - RNA, 2784 nt, Artificial Sequence
  derived and/or modified sequence opt3 from FBXO11__Homo_sapiens__NP_001177203
augaacagcgugagagccgcuaauaggcggccccgccgagucucccguccuagaccaguucagcaacagcagcagcaaccgccccagcagccuccaccccagccuccacaacagcagcccccucagcaacagccaccgcccccuccacagcaacagcagcagcaacagcccccuccacccccgccucccccaccuccccugccacaggagaggaacaaugugggcgaacgggacgaugacguacccgcagauaugguggccgaggaaucugggccuggagcgcagaacucaccauaccaacuccgcagaaagacccuucugccgaaaaggacagcuugccccacuaagaauaguauggagggugccagcacguccaccacagaaaacuucggccaccgggcaaaacgcgcccgagucucugggaagucgcaggacuugucagcugccccugccgagcaguauuuacaggagaaacugccagaugaagugguucuaaagaucuuuagcuaccuccuggagcaagaccuuuguagagcugccugcguguguaagagguucagugaacuggcgaaugaucccauuuuguggaaacggcucuauauggaggucuuugaguacacucguccuaugaugcauccagaacccggaaaguucuaucagauaaacccggaggaauacgagcacccuaauccauggaaagaauccuuucagcagcuguauaagggcgcacaugugaaacccgguuucgccgagcacuuuuacucuaacccugcucgcuacaaggggagagagaauaugcuguauuacgacaccaucgaagaugcccucggaggcguacaagaggcacauuucgacggcuuaauuuuuguucacagcgggaucuauacagaugaauggauuuacaucgagucccccauaaccaugaucggagcugccccagguaagguggcggacaaagucauuaucgaaaacacuagggauucaacauucguguuuauggagggcagugaggacgccuaugugggguacaugaccauucgguucaauccugacgauaagagcgcacagcaccauaacgcucaccauugccuggaaaucacggucaauuguucucccauaauugaccacugcaucauucgauccacuuguaccguuggaucagccgugugcguaagcggccagggugcuuguccaacaaucaaacacugcaacaucagugauugugagaacguggggcuuuauauuacugaccaugcccaaggaauauacgaagauaaugagaucucuaacaaugcauuggccggcauuugggucaagaaccacggcaauccgaucauacgcagaaaccauauucaccaugggagggacgugggaguuuuuaccuucgaucacgguaugggcuacuucgaauccugcaauauccaccggaaccgcaucgcuggguuugaggugaaagcguaugcaaauccuacagucgugagaugcgagauucaucacggacagaccggcgguaucuacguacaugaaaaggggaggggccaguucauugagaacaaaauauaugccaauaacuuugcuggaguuuggaucacgagcaauucggaccccacuauucguggcaacucuaucuucaaugggaaccagggagguguguacaucuuuggcgaugggcggggacugauugaaggcaacgacauauaugguaaugcccuagcagggauccaaauucgaacaaacuccuguccaaucgucagacacaauaagauucacgauggccagcauggaggcaucuacgugcacgagaaggggcagggagucauagaggaaaacgagguguauucaaauacccucgccgguguuugggugacuacaggcaguacccccguacugaggcgcaaccggauccauagcgggaaacaggucggaguguacuucuacgacaauggccacgguguucuugaagacaacgauauuuauaaucauauguacuccggggugcaaaucagaacgggcucuaacccuaagauuaggcgcaauaaaaucuggggaggccagaacgggggaauacuggucuauaauagcggcuuggguugcauugaggacaacgaaaucuuugauaaugcuauggccgggguguggauuaagaccgacucaaacccaacacuccgacggaacaaaauccacgauggacgugacggcgguauauguaucuucaauggcgggagaggacuguuagaggagaacgauauuuuuaggaaugcacaggcgggcguacugaucaguacuaacucccaccccauucuccgcaagaaucggaucuucgacggguuugcugccggaauagaaauuaccaaccaugcaacagccacucuugagggcaaucagaucuucaacaauagauuuggugggcuguucuuggcuagcggagugaacguuaccaugaaggauaauaaaaucaugaacaaucaagacgccauugaaaaggcagucucuaggggccagugccuauacaaaaucucaaguuauacaagcuacccuaugcacgauuucuaucgaugucauaccugcaacacuacggaccgcaaugcuauuugugugaacugcauaaagaaaugucaccagggucaugauguggaguuuauccggcacgacagauucuuuugcgacuguggcgccgggacacuguccaacccgugcacccucgcgggagaaccaacucacgauaccgacacacuguacgauucugcacccccuauugagucgaauacccuucaacauaacuga

SEQ ID NO: 56161 - RNA, 1533 nt, Artificial Sequence
  derived and/or modified sequence opt3 from FBXO15__Homo_sapiens__NP_001136430
auggccaccggcagagggaggauccugcagcaacacuggcucggacuucagacacugcggggucccagccgcggcgggggagcugcacgaggccgugccagagcguucgguugcaggaaggggccuggagugaaauuguccgcuggcucugccgcauuacggugucaugccggcgggggacagcacugggagucaaguuuuagcugcuguuccgguuuccuggacggcaugccaucugaaauucuacucaagauauuuucguaccuggaugcugucucacuucugugcacuggguguguuagccgcagauucuaucauuuggcaaacgacaauuuuaucuggauuggaaucuacaguacggccuucuccccggcuaggucuaacuggaaauuuaauagcguggagaagauugccauguccaugucauuccucaguguacaggauaaagaagcgggcuauuggaagaaggaguacaucaccaaacaaauagcaagcgugaaggccgcucuggccgacauccugaaacccgucaacccuuauacaggucucccagugaagacuaaagaagcauuacggauuuuugggcugggaugggcuaucauucuuaaggagaagggcggcaaagaguacaucauggaacacguugauuugucuauaaaugacaccuccgugacagucauuugguaugggaagaaauggcccugccuggccucacuaagcacccucgaucuguguggaaugacuccuguguucacagacugguacaagaccccaacgaaacaucgccuucgauggcacagucugaucgcgaaguacaacuugucucaccucacuauuuccaccaugaucgguugcgauagacugaucaggauauuuuguuuacaucccggccugcucguagggguuuggaaaaaggaggaggaacuugccuucgugauggcaaaucugcacuuucaucacuuggucgagcggagcacacuaggaucggcuacuauuccuuaugaacugccaccgcacucucccuuccucgacgauuccccugaguacggccugcaugguuaucagcuucacguggaccugcauucagggggcguguucuacuugugcggaaccuuucguaaccucuucacaaagcgcggcaauaucgaaaacgggcacgucaaacugauuguuauccauuuaaagaauaacagagagcaucugccacuaauaggaaaagugggucucaguuggaagaccgauauuuuugacggcuguaucaaaagcugcuccaugauggacguaacgcugcuugaugaacacgggaagcccuucuggugcuuuucuagcccuguguguuugaggucaccagccacucccagugacuccagcucuuuccugggacagacauauaaugucgauuacguggacgcugagggccggguucacguggagcucgucuggauccgagaaaccgaggaauaucugauugugaaccuuguacuguacuugucaaucgccaagauuaaucacugguuugguacugaguacuga

SEQ ID NO: 56162 - RNA, 837 nt, Artificial Sequence
  derived and/or modified sequence opt3 from FBXO17__Homo_sapiens__NP_079183
augggcgccagacugagcaggcggcgccuccccgcugacccuucccuugcacuggaugccuugccaccggaguuacuggugcagguccuaucucacguucccccucgaucacucgugacccguugcagaccaguauguagggcguggcgggacaucguggaugggcccacagucuggcugcuucaacuggcucgcgacagaagugccgaaggaagggcauuguacgccguggcucagcggugccucccuagcaacgaggauaaggaagaguucccacugugugcacuggcccgcuauugccuccgagcucccuuugguagaaauuuaauuuucaacuccuguggcgaacagggguuuaggggaugggagguugagcauggcgguaaugggugggccauagagaaaaaccugacuccugugccaggagcgccgucucagacgugcuucgucaccucguuugaaugguguucaaagcggcaacuuguggacuugguaauggaaggcguuuggcaggagcugcuagauagcgcacagaucgagauuugcguggccgacugguggggcgcucgugaaaauugugggugcgucuaccagcuccgcgugagacugcuugauguguaugagaaagaagucguuaaguucagugccucccccgacccugugcugcaauggacagagaggggaugucggcagguaucucacguguuuacuaacuucgguaaaggcauccgauacgucagcuuugaacaguaugggcgcgauguguccucauggguuggacauuacggcgcauuggugacccacaguagcgucagagugaggauucggcucucuuga

SEQ ID NO: 56163 - RNA, 2961 nt, Artificial Sequence
  derived and/or modified sequence opt3 from FBXO18__Homo_sapiens__NP_001245381
auggccaagagcaacuccgugggccaggacucuugccaagauucagagggggacaugaucuuccccgcugaaaguagcugugcacugccucaggagggauccgccgguccaggcucuccggggucggcgcccccuucaagaaaaaggagcuggaguuccgaagaggaaucuaaucaggcuaccggaacaagccggugggauggcgucuccaagaaagccccacgccaccaucucucaguucccugcacucgaccucgugaggcaagacaggaggccgaagacaguacgagcaggcuuucugcugaguccggugaaaccgaucaagacgcaggggaugugggaccagaccccauuccugauucauacuauggccuguugggcacauuaccaugucaggaggcccugagccacauaugcagucuaccgucugagguacuccggcauguguuugcuuuccugcccgucgaagaccuuuacuggaaccuguccuuggugugucaccucuggcgcgagaucauuagcgauccucuguuuaucccauggaagaaacuguaucauagauaccucaugaaugaggaacaggccguuucgaagguggacgggauuuuaucuaacugcggaaucgaaaaggaguccgaucuguguguccuuaauuugauaagguauacugcgaccacaaaaugcucacccaguguggacccugagcggguacuguggagccuacgcgaccacccacuccugcccgaagcagaggccuguguucgacagcaccuuccggaucuguacgcugccgcugguggcgugaacaucugggcauuggucgccgcgguggugcuccuguccucuagcgucaaugacauucaaagauuacuguucugccucaggcggccuucaaguaccguuacuaugcccgaugugacagaaacccuuuauuguaucgccguacuguuguacgcaaugcgugagaaggggauuaacaucuccaaucgcauacauuacaacaucuuuuauugccuauaccugcaggaaaauagcugcacgcaggcuacuaaagugaaggaggagccaucugucuggccuggaaagaagaccauucagcucacacacgaacaacagcugauucuuaaccauaagauggagccccugcaagugguuaaaaucauggccuucgcuggcacugguaagaccucaacauuggugaaauaugccgaaaaguggagucagagcagauuucucuacgucaccuucaauaaauccaucgcaaagcaggccgagaggguguuuccaucuaacguaauuuguaaaacguuccacucgauggcuuaugggcacauaggacggaaguaccagagcaagaaaaagcugaauuuauuuaaacugacucccuucaugguuaacuccgugcuagcggaaggcaagggcggguuuauccgagcaaaacucgucugcaagacacuggagaacuucuucgccucagcugacgaggaacuuaccauugaucaugugccuaucugguguaagaauagucagggacaacgcgucaugguggagcagucugaaaaauugaacgguguucuggaggccagcagacucugggacaauaugaggaagcugggcgagugcacugaagaggcacaccagaugacacaugauggguaucuuaaacuguggcaguuguccaagccaucacucgccagcuuugacgcuauauucguggaugaagcccaagacuguaccccggcaauuaugaacaucguacugucucagcccugcggaaaaaucuuugucggcgauccucaccagcagauuuacacguuccggggugcggugaaugcuuuauuuaccguuccacauacacacguguucuaccugacucaauccuuucgcuucggggucgagaucgccuaugugggcgcaaccauucuagacguauguaagagagugaggaagaaaacacucguuggaggcaaccaccagagugggauacguggagacgccaagggucaggucgcucugcuuagccggacuaaugccaacguguuugaugaagcagugcgagucaccgagggcgaguuccccucuagaauccauuugauugggggaaucaaauccuuuggccuggacaggaucauugauauauggauccuccugcagccugaagaggaacgccggaagcaaaauuuaguuauuaaagacaaguucaucagaaggugggugcacaaggaggguuuuucaggguucaaacgcuacgugacagcugccgaagauaaggagcuggaggcgaaaauugccguagucgaaaaguauaacauccgaauaccagagcuugugcagcggaucgaaaaaugccauauugaggacuuggauuucgcugaaauggagagucaccacguuggccaggcaggacucgagcugcccaccagcgaauacauccuaggcacugugcauaaggccaaagggcuggaguuugacacgguccacgugcucgaugacuucguuaaggugccgugugcucgucauaaucugccucaacuuccacacuuuagaguagaaucguucuccgaggaugaguggaacuugcuguaugucgccgugacaagggcaaagaaacgcuuaauuaugaccaagucucucgaaaauauccugacucuugcgggagaguacuuucugcaggccgaauugaccagcaacgugcucaaaacaggugucguucggugcugugugggccagugcaauaacgcuauacccguagacaccgugcugacuaugaagaaacuaccuauuacauauucaaacagaaaggagaauaaagggggauaccugugccauaguugugccgaacagaggaucggcccccucgcauuccugacggcuuccccagagcaaguccgagccauggagcgcaccguggaaaacauuguucuuccucggcacgaggcauugcuguuuuuaguguucuga

SEQ ID NO: 56164 - RNA, 540 nt, Artificial Sequence
  derived and/or modified sequence opt3 from FBXO28__Homo_sapiens__NP_001129587
auggccgcugcagccgaggaaagaauggcggaggaaggcgggggaggucagggcgacgggggaagcucccuggcuucuggcucaacccaaaggcagcccccuccaccggcaccccagcacccucagccagguagucaagcccuccccgccccugcucuugcaccagaucagcugccccagaacaauacauugguggccuuaccuaucgucgcuauugagaacauacugagcuucauguccuacgacgaaaucucucagcuacggcucguuugcaagcgcauggaucuggugugucaacgaaugcuuaaucagggguuucugaaaguagagcguuaucauaacuugugccagaaacaggugaaggcccaacucccaagaagggagucggaacggcgcaaucacucacuggcgagacaugcagacauucuggccgcugucgagacuaggcucagcuuacugaacaugacguucaugaaguacguggauaguaaucuuuguugcuuuaucccgggaaaauuccaggaccgguugcagcccuga

SEQ ID NO: 56165 - RNA, 2238 nt, Artificial Sequence
  derived and/or modified sequence opt3 from FBXO30__Homo_sapiens__XP_005267216
auggaggaagaacugcagcacagccauugcgugaacugugucuccagaaggugcaugacccggcccgaaccuggcaucucuugugaccucauugggugcccacuuguuuguggagccguguuccacucaugcaaggcugaugagcaucgccuguuguguccguuugaacgaguacccugcuuaaauagugacuucgguuguccuuuuacaauggcacguaacaaaguggccgagcaccuggagaugugcccagcgagcgucguguguugcacuauggaauggaauagauggcccguuuccuacgcugauaggaagucuuaugagaaccuaucgcgggacguggaugaagucgcccaacucgacauggcacuggcccuucaggaucagcgcaugcuguuggagucacucaaaguggcuacgaugaugagcaaggcaaccgacaaaguaaguaagccuagagagcagauauccguuaagucuagcgugccagaaaucccccaugccaauggccuggucuccguggaugaggaaucauacggggcucuguaucaagccacaguggagacuaccaggagucucgcggcagccuuagacauucugaacacagcuacccgggauaucggaaugcuuaauacuagcgucccuaacgacauggaugaacagcagaaugcccgcgagucuuuggaggaccagaaccugaaagaccaagaucaccuauacgaagaggaaauuggcgcaguuggugggaucgacuauaaugauacaaaccagaaugcucaguccgagcagaacggaucaagcgaccuccugugcgaucuuaauaccaguucuuacgacacguccgcccuguguaacggcuucccauuggaaaacauaugcacucaagugaucgaucagaaucagaaccuccacggcgacagcaagcaaucgaaucugaccaacggggauuguguagcgucuuccgacggaacaucaaaaccgaguagcuccuuagccguggcagcucagcugcgagagauuauccccucuagcgcccucccuaaugguacuguccagcauauucuuaugccagaugacgagggcgaaggggagcugugcuggaagaaaguggacuugggagauguuaagaacguggacguccuaucauuuagucacgcucccuccuucaauuuucugagcaacucuuguuggucaaagccuaaagaagauaaggccguggacaccagugaucucgagguagcagaagacccaaugggccugcaggguaucgaucuuauaacagccgcucuguuguucugccucggggacagccccggaggcagaggcauuuccgauucuaggauggcggacaucuaucauauugauguugggacccaaacguuuucgcugccgagcgcaaucuuagccacuuccacaauggugggagagaucgcuucagccagugcaugugaccacgccaauccucagcugucuaaccccagcccauuccagacccuaggucucgaucugguccuugagugcguggcucgguaccagccuaaacaacguuccauguuuacuuucgucuguggccaguuguuucgcagaaaggaguucucaagccacuucaaaaaugugcauggggacauucacgccggacugaacggcuggauggagcagaggugcccccucgcauacuaugguuguacauacucucagcggcgauuuugcccauccauacaaggggcgaagaucauucaugaccgccaccugagaaguuucggcguucagcccugcgugagcaccguacuugucgaaccugcuaggaauugugugcugggauugcauaacgaucaccucucuucccugccauuugagguuuuacagcacaucgccggcuuccuggacggguuuucacuaugccagcucaguugugugagcaaacugaugcgggaugucugcggaucgcuuuugcaaucccgcgguauggugauacugcaguggggcaagagaaaguauccggagggaaauucuagcuggcagauuaaagaaaagguauggagguucucaacggcauuuuguagugugaacgaguggaaauucgccgacauccucuccauggcugaucaucugaagaaaugcucuuacaacguugucgaaaagcgugaggaagccauccccuuaccuuguaugugcgugacccgggagcugacaaaggaggggcgaagccuuagauccguguugaaaccaguccucuga

SEQ ID NO: 56166 - RNA, 1104 nt, Artificial Sequence
  derived and/or modified sequence opt3 from FBXO31__Homo_sapiens__NP_001269612
auguaccugcccccucacgacccacauguggaugacccgaugagauucaagccccucuuuaggauccaccuuauggagcggaaagccgcuaccgucgaaugcauguauggccauaaggggccucaccauggacacauucagauaguuaaaaaggaugaguucagcacaaaauguaaccaaacugaccaccaucgcauguccgguggccgacaggaagaguuucguacguggcugagagaagagugggggaggaccuuggaggauaucuuccacgaacauaugcaggaguuaauucugaugaaguuuaucuacacaucucaguaugacaauugccuaacuuaccggcgcauuuaucucccacccucaagaccugaugaccugaucaagccaggacuuuucaaaggcaccuacgguagucacgggcuggaaauagugauguugagcuuucacggaaggcgggcacgcggcacaaagaucaccggcgaucccaacauuccugccgggcaacagacuguagagaucgaccuccgacauaggauucagcugccagaucuggagaaucagagaaacuucaaugaacucucccggaucguguuagagguccgugaacgcgugagacaagagcagcaggaaggaggucacgaggcgggcgaggggaggggacggcagggcccgcgagaaucucaacccucgccugcucagccacgcgccgaggcacccucaaaagguccugacgggacaccaggagaagauggcggcgagcccggggacgccguugcugcagccgaacagccggcucaauguggacagggucagccuuuugugcugcccgucggcgugagcaguagaaacgaggacuauccaaggaccugccggauguguuucuacgggacgggacuuauagccggccaugguuuuacuuccccugagcgcacccccgggguauucauuuuguuugaugaagacagauucggcuucguuuggcuggagcuaaagucuuuuagccucuacuccagggugcaggcgacauuccguaaugcagaugccccaucaccccaggcuuuugacgaaaugcugaaaaacauccaaagucuuacuagcuga

SEQ ID NO: 56167 - RNA, 789 nt, Artificial Sequence
  derived and/or modified sequence opt3 from FBXO32__Homo_sapiens__NP_001229392
augcccuuccugggccaggacuggagaagcccugggcaaaacugggugaagaccgccgauggauggaaaagguuucucgacgagaaguccgguucuuucgucucagaucuuaguagcuacugcaauaaagaaguuuauaacaaggagaaucuguuuaacuccuugaauuacgacguggcugccaaaaagcggaagaaagauauguuaaacucuaagacaaaaacucaguauuuccaccaggaaaaguggaucuacguacauaaaggcucgacgaaggagcgccacggguauuguacccugggagaagcauuuaaucgacuagacuucucaacagcgauucucgauagccguagauuuaacuacguggucaggccagcuuucaagggccugacuuuuaccgaccuuccgcugugcuugcagcucaauauaaugcaacggcugagugauggucgcgaccuggugucccucgggcaggccgcacccgauuuacauguucugucugaggacagacuuuuguggaaaaagcugugucaguaucacuucagcgagaggcagauccggaaacgccuaauucucuccgauaagggacaacuggacuggaaaaagauguacuuuaaacuugugcgaugcuacccuagaaaggaacaguauggcgacacacugcaguuguguaagcauugccacauccucucauggaaaggcaccgaucacccauguacugccaacaaucccgagaguugcagcgucucucuguccccucaggacuucauuaacuuauuuaaguucuga

SEQ ID NO: 56168 - RNA, 1668 nt, Artificial Sequence
  derived and/or modified sequence opt3 from FBXO33__Homo_sapiens__NP_976046
augcuguuguuccuuagcgugccccagccuagaccaccgggcgccaggacccgggcuggggcagcccgcgucgcgcgauggcguagacugagguugcaacaguuacggcgccugagaggacuacucaggguucugcggggucgccccggcgcugggucccgaagaaggggacggauggcccuuugcggccaggcagccggugcugcaucucugccuucagaguugaucgugcacauuuuuaguuuccucccagcccccgaccgucugcgcgcuagcgccuccuguucucauuggagagaaugccuguuuuacccugcgcucuggccacaguuaaggauaugucugcggguaucgcccgcagagcaaccucgacuugaguucuugaugcgcaagugcgggugguuugugagagaacugagggucgaguucgccgcugaaaacuaucuaucaggaggcggcccaggggauggagguggcgccgacacagggacuggaggcgaggaaguggaggcacuccagcugagcgcucgguggcuugaaguucugcgcacguacuuggagcucgugcugugugucuuagugaguaucagaaauaacaggaaucugcagaaauuuucccucuucggugauauuucuguacuucagcaacaggggagccuguccaacaccuauuugucaaagguugacccggauggcaaaaagaucaaacagauucagcaacuauuugaggaaauccugaguaauagccgucagcucaaguggcugucuugcggauucaugcuugagauagugacacccacuucccugucaagccucaguaacgccgucgcgaauaccauggaacaccucucucuguuagacaacaauaucccuggcaacuccacacugauuaccgccguggagcuagaacgguuugugaaucuccauagccuggcacuugauuucugugacuuuacugcugagauggcccgagucuugacagauucgaaccacguuccacugcagagacucucucugcuugugcauaauguauccgugaugcacaagucacuggacaacaugcccaaugaugagcacuggaaggcuuugagucgcaaaagcaccuccuucagggucuacaucauggccuucgacauuaaaucugaagauaugcucaagauccugaaaccuagcauaccauuagagcggauucauuuugacucauauaucacgugcgugaguggggcaauuguugaccugaucuccagacaauacgauaaguuccuaacucacuuuauccucaugaacgacgugauugauaccagcggauuccccgaccugucugauaacaggaaugaagacccgcuugucuugcuggccuggcgcuguacaaagcucucacuguuagcuauacaugguuauacugugugggcgcacaaccugaucgcaauugcccgacuucggggcagugauuugaaaguacucgagguuaccgaagagagcaucgacuuugaucagggggagcuggcugaccaggauguggacccuguccacaaucuaauagaacaggugucccugggacucggccaacccuggcaugccgucauggacauugagucucugucgguguucacagaaccaaaccgucacuuuuacagagagaugcagagcuucuccgaagauaucuga

SEQ ID NO: 56169 - RNA, 2832 nt, Artificial Sequence
  derived and/or modified sequence opt3 from FBXO38__Homo_sapiens__NP_001258652
augggccccagaaagaaaagcgugaagaccugcaucaugaacaaugagauuccugaagagaugacagccgacgaaacuaaagauuacaugaaccagcugucccacgagguccucugucauauauucagguaucuuccacugcaagacaucaugugcauggaauguuugucucggaaguuaaaagaggcuguuacgcuguaccuacgcgugguacgaguggucgaucucugcgcagggcguuggugggaguauaugccgucaggauuuaccgacgccaguuuccugacacuucugaagaagaugcccgauguggaacaguuguacggucuccacccuagauaucuggagaggcggcgcguuagaggccaugaagcguuuagcauuccaggggugcuggaggcucuccaggccugucccaauuuagucggaguggagacuucccaccuggaacuuguagagucuaucuggaccuacaugccucauguucacauuuugggcaaauucaggaaccggaauggugcauuuccaauacccccugaaaacaagcugaaaaucccaaucggggccaagauucagacacuacaccucgugggagucaaugugccggagauccccugcauuccuaugcugcgccaucuuuauaugaaaugggugcgacugaccaagccacaacccuucaaggacuuuuuguguaucucgcucagaacuuucgucaugaggaacugcgcuggcccuacaaauucacugaaauacguuccauuagugaccggccuggcaagcgcccggaaccucgaacaccuugagaugguacgugugcccuuucugggaggguugauacagcaugucguggaggauaguuggcgcuccgguggcuucagaaaucuacacacgauuguucugggggcuuguaagaacgcccucgaaguggaccugggauaccuuaucauuacugcggcaaggcggcugcacgagguccgaauccagccgucuuugaccaaagauggcguguuuagcgcccucaagauggcugaacuggaguucccucaguuugaaacauuacaucuggguuauguagacgaguuccuacuccaaucccgcauggccaaugcagaucugguuaaauacgggcuugcugacguggucgagaaccccggaaucauuacugauauaggcaugaaggccgugaaugaagucuucucaugcaucaaauauuuggcgauuuacaacuguccacaucugcacaacccuuauaauuggaucagugaccacagcagauggaccaggcucguggacauaaaccugguucggugccaugcccuuaagcuggauucuuuuggccaguucauugaguugcuccccucccuggaauuuaucucauuagaccagauguuccgcgagccacccaaggggugcgcaagagugggacugagcgcugguacaggcaucgggguaaguucugcccuagucuccaaucagaacagcaauaacgaugacaauaacgcucaaaauaacaaugccaacauucacgauaauaaccaccaucacccugacgauucggacgaagagaaugauuuuaggcaggaccuccagccaggagagcaacaguucgcagccgaugcucugaacgaaauggaggacaucgugcaggaagacggcgagguuguggcggagucugguaacaauaccccggcacauucccaggccauuauacccgucgauguggacgaagaacaagcugggccuucaggccuucagcguguagugaaaccaacgaguaucacuguucacgauagcgaauccgacgaugaggaagacucuuuggagcugcaggaggucuggauucccaagaacggaacacggcgauacagcgaaagagaggagaaaaccggcgagucagugcagaguagggaacucuccgagguggccaagacuaaaccucgccacgcaaugaagcggaagagaacagccgauaaaagcaccucuacgucagacccagucaucgaggaugaccauguucaagugcugguguuaaagaguaaaaaucugguaggggucaccaugacaaacuguggaaucacugaucuuguguugaaggacugccccaaaaugauguuuauucacgcuaccaggugucgcguucucaagcaucugaagguggaaaaugccccgauagucaaccgauucgauuaugcacagugcaaaaagcuaaauauggaccaggugcuggaccagauccuccggaugccuccagagcguaacagaauuaucuaccugaggcccaugcaacagguugauacacuuacuuuggaacagaaacuguuuagcgguccuuaccccuaucacauuuguaucauacaugaguucuccaauccaccuaacgugcgcaauaagguacggaucagaucuuggauggacaccauugcgaacaucaaucaggaauuaauuaaauacgaguuuuuccccgaggcuacaaggucggaagaggaucucaagaaguauccaaaauacccguggggccgagaaaucuauacccuggagggggucguggacggagccccuuacagcaugauauccgauuuucccuggcuucgcucacugcgggcagccgagccaaacaguuucgcuagauaugacuucgaagaugacgaggaaucuacuauuuacgcccccaggcguaagggccaauugagcgcagauaucugcauggagacgauuggugaagagaucuccgagaugcgccagaugaaaaaggggguguuucagcgggucguugcuauauucauccacuacugugacgugaauggcgaaccuguagaggaugacuauauuuga

SEQ ID NO: 56170 - RNA, 1416 nt, Artificial Sequence
  derived and/or modified sequence opt3 from FBXO3__Homo_sapiens__NP_036307
auggccgcuauggagaccgaaacagcaccccugacucucgagagccuuccuacggacccacuguuguuaauccuguccuuccuagauuacagagaccucauuaacugcuguuaugugucuaggcggcugucacagcuuaguagccacgauccgcuguggcgccgacauugcaagaaauacugguugauauccgaagaggaaaagacccagaaaaaucaauguuggaagucucucuuuaucgacacauauucggaugucggccguuacauugaccacuaugccgcgaucaaaaaggcuugggaugaccugaagaaauaccuggagcccagaugcccuaggaugguucucucauuaaaggagggggcccgggaagaggaucuggacgcaguggaagcccagauuggauguaaacuuccagaugacuaucgcugcagcuacagaauccauaacggucagaaguugguagugcccggccugcuagggaguauggcucucuccaaucacuacaggucugaggaucugcuugacgucgacacugcagccggaggcuuccaacagcggcagggucugaaauauuguuugccucucaccuuuugcauacauacagggcugagccaguacaucgcuguggaggccgcggaaggacgcaacaagaaugagguuuucuaucaauguccagaucagauggcacgaaaccccgccgcuauugacauguuuaucauuggcgccaccuucacugauugguuuacauccuacgugaagaaugucgugucaggcggguucccuaucauaagagaccagauuuuuagguauguacacgauccagaaugcguugcaaccacgggagacaucacugugagugucagcaccucuuucuuaccggagcuguccucagugcaucccccucacuacuuuuucacauaucggauucguaucgaaaugagcaaagaugcucucccagagaaggccugucagcuugacagucgcuacuggagaaucacuaacgcgaaaggugauguggaggaaguccaaggccccgggguugugggagaguuuccuauuauaucuccaggcaggguauacgaauauaccuccugcacaaccuucagcacgacuucggguuacauggagggguauuacacauuccacuuucuguauuucaaggacaaaaucuuuaauguggccauuccccgguuccauauggcaugcccgaccuuucgagucucuaucgcucgcuuggaaaugggaccugaugaguacgaggaaauggaggaagaggaagaggaggaagaggaagaggacgaggacgaugacuccgccgauauggacgaaucagaugaggacgaugaagaggaaagaaggcggcgcguguucgacguucccauaagaaggcgucgguguagucgacuauuuuga

SEQ ID NO: 56171 - RNA, 2130 nt, Artificial Sequence
  derived and/or modified sequence opt3 from FBXO40__Homo_sapiens__NP_057382
augggcaaggccagaaggucacccccugggcaccaucggcacugcgagggauguuucaaccgccauugccacaucccaguggaaccgaauaccuccugucuggucauuucuugccaucuccuuuguggugcuacauuucacaugugcaaagaggcagaacaccagcuguugugucccuuagagcaaguuccuugccugaacucagaauacggcuguccacuaaguaugagccgacauaagcucgccaaacaccuucaggugugccccgcguccguaguguguugcucuauggaguggaaucguuggccuaacgucgacucggagacuacgcugcaugaaaauauaaugaaggagaccccaucagaagagugccuggauacagcuuuggcccuccaggaccagaaagugcuguucagaagccugaagaugguugagcucuuucccgaaacuagggaggcaaccgaagaggaaccuacaaugaacggggagaccaguguggaggaaaugggaggcgccgucggugggguggauaucggauuaguaccacacggccuguccgcuacuaauggcgagauggcagaacuuucucaagaggaacgggagguuuuggccaagacaaaagaggggauggaccuggugaaguucggacagugggaaaacauuuuuagcaaagagcacgcugccuccgcgcuaaccaauucaagugcaagcugugaaucuaagaacaaaaaugauuccgagaaggaacagaucucaagcggucauaacauggucgagggcgagggggccccgaagaaaaaggaaccccaggagaaucaaaaacagcaggacgugcgcacggcuauggaaacuaccggacucgccccuuggcaggauggcgugcuggagagacuuaagacagcagucgacgcuaaagauuauaacauguaccugguucacaaugguaggauguugauucauuucgggcaaaugccagccugcacucccaaggagcgggacuuuguguauggaaaacucgaagcgcaggagguaaagaccguguacacauucaaggucccugugaguuauuguggcaaacgcgcccgacugggcgaugcaauguuaucuugcaagccauccgaacacaaagcuguugacaccagcgaucuggggaucacgguggaggaccuccccaagucggaccuuauaaaaacuacacugcagugugccuuggaaagagagcuaaagggacaugucaucucugaguccaggucaauugauggucuguuuauggacuucgcuacccaaacuuacaacuuugaaccggagcaguucaguagcggcacagugcucgccgaucugaccgcagccacgccugggggacuucacguagaacugcacuccgagugcguuacccggcgucauaacaagucuagcucagcuuuuacauucacuuguaauaaauucuuucgcagagacgaguuccccuugcacuuuaagaacgugcauaccgauauccagaguugccucaauggcugguuccagcacagguguccacuggcguauuuagguugcacauuuguccaaaaccacuuccggccucccgggcagaaagcaaaggugauuuacucccaggaacugaaaacuuuugccaucaagccagaggucgcucccgaacuaagcgagggccgaaagaauaaccaucuccugggacacggcgggaaaucucagaauagccuuaccaguuugccucuggaaauacucaaguacauugccggauuccuggacagcgugucccuugcacaacugucucagguuucgguguugaugcgcaacaucugugccacacuccugcaggagagagguaugguauuacugcaguggaaaaagaaaagguauagccauggcgggaccuccuggcggguccaccgcgaaauuuggcaauuuucaagucuauucucuaagaucaagagcugggaguuuaaugaggugacuuccaugucagaacaucucaaaagcugcccauucaacaucguugagcacaagacggauccgauucugcuuacaucuaugugccagcccagagaacaggcuagggaguccuuggugaguaccuuucguauacggccucgaggaagauacgucagcuga

SEQ ID NO: 56172 - RNA, 1359 nt, Artificial Sequence
  derived and/or modified sequence opt3 from FBXO47__Homo_sapiens__XP_011523166
auggccagcagaaucaacaccaauuucacacugauucccaaccagaagcucaggcgguccaaucgccaaacuucuugcuacucaaaaacgcuuggcaguggguuucagccuauaagcaccuucggaaacuuuaaggcucugccauuggagaucuuccagauuaucuuaaaauaucuguccgugaaggacauuucuaugcuaucgauggucucaaaaacaguuagccagcacaucauaaauuacaucaguacuuccucugguagcaagcgacuccugcuucaagauuuucauaaccuggaauugccggaccguagacaggauuccgcaauucucgagcacuauaggucacugggccuccuguucaagcgguguaccuuacugcuucccacaaaagaacgcuugaaguacauccauaaaauucugaccgaggugaguugcuuuaaguucaaugggugugccgcgccuaugcagugccuaggacucacuuguuauggcauguuucugcagacacuuaccgcugguugggacgaacuggagugccacagaguauacaacuucuugugugagcucacgaaucugugcaggaaaauccaaauggccguguguagcaagccagggucugcacagaaguuagaacugcggauacgccucuuuugccgaaacguccuucuggaucauuggacucacagauccgacucagccuucugguugaccaggauucuaaaacccuggccuauggugaaucaggcucggcugcucuauaucauuuuuggaccaaucagcccccaggauggccaaguuguguggcaggagaugaucgaggaaccuacagacgaguucagucugaagggccuugcagaugccauuaaacuguuguacgacgcuucuacuaaggaauggaccgccgaugacgucauaucccucguggaugagcugagcguaguuccacgugaaugguuacuggagaacaaugcgcgccuacucaugcugucggggaacaauaucuguuucucuuuuauggcauccaaagccgugaacggaagaacaauugaacuugcuagguuggucguguuccuggcccucgugugcgagaaggagcuguacugcauggacuggaccgucaaaaugaugcagaagguuuguaagguguuuucaacgccgguagaacggaaaaacuuccuucaaaauguggcaaacgcuuuugccugcgucaucauggagaugcugcagaguauaaugagcggugaccgagaugaagacgaucgcuccuucuugaaucucuuucaccuggugcaugcgcaggccaacuuccacaaggagguuuuauaucugacuaugaauacaccccuaucuaccuga

SEQ ID NO: 56173 - RNA, 1164 nt, Artificial Sequence
  derived and/or modified sequence opt3 from FBXO4__Homo_sapiens__NP_036308
auggccggcagcgagcccagauccgggaccaacucuccuccaccgcccuucucagacuggggaaggcuggaagcugcaauccucagugguuggaagacauuuuggcagagcguguccaaagagcgggucgcccgcacuacgucucgagaagagguugaugaagcggcuucgacccuuacacgucugccuauugacgugcaauuguacauauuaucauuccugagcccacacgaucuaugccagcucggcaguacuaaucauuauuggaacgagaccguaagagaccccauccuguggagguacuuucuucugcgggauuugccuuccuggucuagcguggacuggaagucccucccagaucuggagauucugaaaaagcccaucucagaagucacagacggggccuucuuugauuauauggcaguguaccgcauguguugcccuuauaccagaagggccaguaaaagcucucggccaauguacggagcuguuacuuccuuccuccacucauuaauuauccagaaugagccgcgcuuugcaauguucggccccggucuggaagaacuuaacaccagcuuggugcugagucuaaugucuuccgaggaacucuguccuacagccgggcugccacagcgacaaauagacggaaucggcagcggcgucaauuuucagcuuaacaaucagcauaaguucaacauucugaucuuguauucgacgacuagaaaggagagggaucgggcucgugaggagcacaccucugccgugaauaaaauguuuucccgccauaacgaaggggacgaucagcaaggaucaagauacaguguaauuccccagauccagaagguuugcgagguggucgacgguuucauauacguggcgaaugcagaggcccacaaaaggcacgaauggcaggacgaguuuagccauauuauggcuaugacagauccugccuucggcuccucugggcggccacuccugguguuaagcuguaucucacaaggagacgucaagcgaaugcccugcuucuaucuggcacacgaacuccaucuuaaccuguugaaucacccguggcuaguucaggauacugaggcugaaacccugacaggcuuucucaacgguauugaguggauccuggaggaaguggagaguaaacgcgccagauga

SEQ ID NO: 56174 - RNA, 1206 nt, Artificial Sequence
  derived and/or modified sequence opt3 from FBXO5__Homo_sapiens__NP_001135994
augaagugcgacuucaacuguaaucacgugcauagcggccugaaacucgucaagcccgaugacaucgggagacuuguuuccuacaccccugccuaucuggagggaucuugcaaagauuguauuaaggacuacgaaagguugucaugcauagguaguccaaucgugagcccgcggauuguacaguuagagacagaauccaaacgccugcacaacaaggagaaucaacaugugcagcagacucuaaacucuacgaaugaaaucgaggcucucgagaccucgcgacuguaugaagauucaggcuacagcaguuuuucccuucagucugggcugagcgagcacgaagagggauccuugcucgaggaaaacuucggcgacucacugcaaaguugucugcuccagauucagagccccgaucaguauccuaauaagaacuuacugccaguccuucauuuugagaaagugguuugcucuacauugaagaaaaaugcaaagcguaaccccaaaguggacagagaaaugcugaaggagaucauagccagggguaauuuccggcuacaaaacaucauugggcgcaagaugggacucgaaugugucgauauccuguccgagcuuuuuagaaggggccugcggcacguguuggcgacuauucucgcucagcugucagacauggauuuaaucaauguaagcaaaguuaguaccacauggaagaaaauacuggaggacgauaagggcgccuuccagcucuacucuaaagcaauucagcgcgugaccgaaaacaauaacaaguuuuccccucacgccagcacucgagaguaugucauguucagaacaccacuugcuucggugcaaaaaucugcagcccagaccucccugaagaaggacgcucagacgaaauugucaaaccaaggggaccagaagggaaguacuuacagcaggcauaaugaauuuuccgagguggccaaaacccuaaagaaaaacgaaucucugaaggcgugcauccgguguaauagccccgcaaaguacgauugcuaucuccagcgugccacauguaaacgcgaggguugcggcuucgacuacugcacuaagugucugugcaacuaucacaccacaaaagauuguucagacgggaaacuucugaaggcuaguugcaagauuggaccuuugccaggcaccaagaaauccaagaaaaaucucagaaggcuguga

SEQ ID NO: 56175 - RNA, 1332 nt, Artificial Sequence
  derived and/or modified sequence opt3 from FBXO7__Homo_sapiens__NP_001028196
auggccagacccccuggcgggagcggaccacugcucgacuccgagcacucuucacuucagaacaaugaacaaccgagucuggcuaccagcuccaaccagacaucuaugcaggaugagcagcccucggacucauuccaaggucaggcagcccagagcggcguguggaaugaugacaguauguuggggccuucccagaacuuugaagcggagucuauccaagauaaugcucauauggccgaaggaacuggcuucuacccaagcgagcccauguuaugcuccgagucagucgaaggucagguuccucacagucuggagacgcuauaucagagcgcagacuguucugaugccaacgacgcucucauugugcugauacaucuucugauguuggaauccggguacaucccacagggaaccgaggcaaaggcccucucaaugcccgagaaauggaagcugagcggcguauauaaacugcaauacaugcacccucucugcgaaggcaguucugcuacauuaacuugugugccacuggggaaucuuauugucgugaacgccaccuugaagaucaauaacgagauuagguccguuaaacggcugcagcuacucccggagagcuuuaucugcaaggaaaagcugggagaaaauguggcgaacauauauaaagaucuucagaagcugucgcgcuuguucaaagaccaacucgucuacccccuguuagcauuuacacgacaggcccugaaucucccugauguguucggucuuguaguucugccauuggagcuaaagcugcguaucuuuagacuccuggacgugaggucuguccuuucccugucagcugugugucgggauuuguucaccgccaguaacgacccccuccuguggcgcuuuuuauaucugagagacuucagggauaauacugugcggguccaggacacagauuggaaagagcuauaccgcaagcgacauauucagagaaaggaaagcccuaaaggcagguuuguuaugcuccugccauccucuacccacacgauccccuucuacccgaacccucuucacccccggccauuuccuagcucacguuugcccccagggauuaucggaggcgaguaugaccaacgccccacucugccuuacgugggugauccaauaaguucccucauuccggggcccggagaaaccccuagccaguucccaccccugagaccuagguucgacccaguaggcccccuuccgggcccuaacccaauccugcccgggcggggagguccuaaugaucgauuucccuuccgcccaucuagaggcaggccuacagacgggcgguugucauuuauguga

SEQ ID NO: 56176 - RNA, 960 nt, Artificial Sequence
  derived and/or modified sequence opt3 from FBXO8__Homo_sapiens__NP_036312
augggccaggggcuguggagaguggucaggaaccaacagcuccagcaggagggauacagcgaacaagguuaucuuacccgggagcagucccgccgaauggccgcuucuaauaucucaaacacaaaucaccguaagcagguucagggcgggauugacauauaccaucuguugaaagcaagaaagaguaaagaacaagagggauucaucaacuuagaaaugcugcccccugagcucagcuuuacuauucuauccuaucugaaugccacggaucuuugccuggcgucuuguguguggcaggacuuggcuaacgaugagcuccuguggcagggccugugcaagucgaccuggggucacuguucaaucuacaauaaaaacccaccgcucggguucagcuuuaggaaguuauauaugcagcuggacgaaggaagucuuacauucaaugccaaccccgaugagggcguaaauuacuuuauguccaagggcauuuuggacgauucuccuaaagaaaucgcaaaguucauauuuugcacucggacccugaacuggaaaaagcuacgcaucuaucucgacgagagaagggaugugcuggacgaucuugucacacugcauaauuuccggaaccaauuuuugccaaaugcccuccgcgaguucuuucgacacauucaugcucccgaagagagaggggaauaccuggagaccuuaaucacuaaauucagccacagguuuugugcaugcaacccugaccugaugcgggaacucggacuuuccccagaugccguguacguucuguguuauucauugauucuacugaguaucgaccucacaagcccccacgugaagaacaagaugucuaaacgugaguucauacgcaauaccagaagggcugcccagaacauuuccgaggacuucgucggucaucuguacgauaauaucuaucuuauuggccacguggcggcauga

SEQ ID NO: 56177 - RNA, 1344 nt, Artificial Sequence
  derived and/or modified sequence opt3 from FBXO9__Homo_sapiens__NP_036479
augcccgacaucauuuggguguucccuccacaggccgaggcugaagaggauugccacagcgacaccgucagagcagaugacgaugaagagaacgaauccccggccgagacagaccugcaagcgcagcuccagauguuuagggcucaguggauguucgagcuugcccccggcguuucuucaaguaaucuggaaaaccggccuugucgcgcagcccgagggagcuugcaaaagacuuccgcugauacgaaaggaaagcaggagcaggcaaaagaagagaaggcccgugaguuauuucugaaagcuguggaagaggaacagaauggugcccuauacgaggcgauaaaguucuauagaagggcaaugcaacucguaccagacaucgaauuuaagauuaccuacacacggucucccgauggcgacggggugggaaacucguauaucgaggauaaugacgaugacucaaaaauggccgaccugcuuagcuacuuccagcagcagcugacuuuucaagagagugucuugaagcucugccagccugaacuggaguccucucagauucauaucagcgugcugccaauggaaguucucauguauauauuccgcuggguggucuccucagauuuagaccugagaagucuugagcaauugagccugguguguaggggcuuuuacaucugcgcucgggaucccgaaauuuggcgccuagccugucucaaaguauggggucgaucuugcaucaagcugguuccuuauaccuccuggagagagauguuccuugagaggccacgggugcguuuugacggggucuacauuucaaaaacaaccuacauccgccagggagaacagagccuggauggcuucuauagagcauggcaccagguggaguacuauagguacauacgguuuuucccggacggccaugugaugauguugacuacacccgaggaaccucaaaguauugucccacgacuccgcaccagaaacacgaggacugaugcuauccuguuagggcacuaucggcugucucaggacaccgauaaucagacaaagguuuucgccgugauuacuaagaaaaaggaagagaaaccccucgacuacaaguaucgcuacuuuagaaggguaccugugcaggaggcggaucaauccuuccaugucggacuucagcuguguagcucgggucaccagcguuuuaacaaauugaucuggauccaccauucuugccacauuaccuacaaguccacaggcgaaaccgccgugucagcauucgagauagacaaaauguauacgccacuauuuuucgcucggguucgaaguuacacugccuuuagcgaaagaccccuguga

SEQ ID NO: 56178 - RNA, 1629 nt, Artificial Sequence
  derived and/or modified sequence opt3 from FBXW11__Homo_sapiens__NP_036432
auggagcccgacagcgugaucgaagauaagaccauugagcugaugugcuccgucccuagaucucucuggcuuggcugugccaaccugguugaaucaaugugcgcuuugaguuguuuacagagcaugccauccgugaggugccugcaaauaucuaaugggacaucgucaguaaucgugagccggaaacgcccgagugagggaaacuaccagaaggaaaaagaccuauguauuaaguauuucgaucagugguccgagucugaccaggucgaguuuguggaacaccucaucagccgaaugugccauuaccaacacggucauauuaauuccuaucugaaacccaugcuucagcgugauuucaucacugcacugccugagcagggcuuggaccacauagccgaaaacauccucucauaccuggaugcgagaagucugugugcugccgagcucguuugcaaggaguggcagagggugauuagcgaagggauguuauggaagaaacugaucgagcggaugguccgcacggacccacuuuggaagggauugucugaaagaaggggcugggaucaauaucuguuuaaaaaucggcccaccgacgguccuccaaacuccuucuaccgcucacuauaucccaagauuauccaggauauagagacaauugaaagcaauuggcgaugugggagacauaaccuccagaggauccagugccggagugaaaauucuaaaggaguguacugucugcaauacgacgaugagaagauuaucuccggccuucgugacaacagcaucaagauuugggacaaaacuucgcuggaaugcuugaagguacucaccggccacacagggucuguucugugcuuacaguaugaugagcgcgugauagucaccggauccucagacaguacugugagagugugggaugucaauacaggugaaguucugaacacccucauccaccauaaugaggcagugcuucaccugagguuuagcaacggcuugaugguaacguguuccaaagaccggucuauugccgugugggauauggcuagcgcaacugacaucacccuacgacgcguccugguggggcauagagccgcuguuaauguggucgauuucgacgauaaguacauagugucagccaguggagacaggacaauuaaaguaugguccacuucuaccugcgaauuuguucggacacucaacggccacaagcgcgguaucgcgugucugcaguauagagauaggcuuguggucagcgggucaagugacaacaccauccgucugugggacauugagugcggagcauguuugcgggugcucgagggccacgaggagcugguccgaugcaucagauucgauaauaaaaggauugugagcggcgccuacgacgggaagauaaagguuugggauuuacaagcugcccuggacccucgcgcaccagcuuccacgcuaugucuccggacucugguggaacauucuggaagaguauuuaggcuucaguucgaugaguuucagaucauuucgagcucccacgacgauacaaucuugaucugggacuuccugaacgucccgcccucagcccagaaugaaacccgcaguccuucucgaacuuauacauacauuagccgguga

SEQ ID NO: 56179 - RNA, 1239 nt, Artificial Sequence
  derived and/or modified sequence opt3 from FBXW4__Homo_sapiens__NP_071322
auggccgcugcagccggcgaggaagaggaagaggaagaggcggcuagagagagcgccgcaaggcccgccgcugggccugcacuguggcggcucccagaggaacuucuguuguuaaucugcuccuaccuggacaugcgcgcccuaggacgacucgcucaggugugucguuggcugagaagguucaccucuugcgaucuucuguggcggcgcauugccagagcgucauugaacagugguuuuacaaggcucggcacugaccugaugacgagcgucccgguuaaggaacgggugaaaguaucccaaaauuggcgccuggggcgauguagagagggaauacucuuaaaguggaggugcucucagaugcccuggaugcagcuggaggaugacucgcuuuauaucucacaggcaaacuucauuuuggccuaccaauuucggccugauggcgcuagccugaaucgucgcccacuagguguguucgccgggcacgacgaagaugucugucauuuugugcucgcaaacagucacaucguuuccgcuggaggcgacggcaaaauugggauccauaagauacacucuaccuucacagugaaauauagcgcccaugagcaggaagucaauugcguggauuguaagggagguaucauuguauccggcucaagagacaggacugcgaagguuuggccccuggccagugggcggcuuggacagugccugcacaccauccagacagaggaucgaguguggagcauugcaaucucuccuuugcucuccucauuugucaccggcacugcuuguugcggucacuucagcccacugcgcauaugggacuuaaacagugggcaacugaugacacaucucggaucugauuuucccccuggcgccggcgugcuugacgugauguacgaauccccauucacccuguugagcuguggguaugacacguacgucagauauugggaucuaaggacuucgguucggaaaugcgugauggagugggaggaaccgcacgacucuacccuguacugccuccagacagauggaaaucaucugcuugcuacugguuccucauacuauggcguagugcgccugugggacagaaggcagcgugccuguuugcacgcauuuccccucaccaguacaccucugagcuccccagucuacugcuuacggcugaccacgaagcaccuauaugccgcucucucuuacaaccugcaugugcuugauuuccagaaucccuga

SEQ ID NO: 56180 - RNA, 1884 nt, Artificial Sequence
  derived and/or modified sequence opt3 from FBXW7__Homo_sapiens__NP_060785
augugcgugcccagaagcggccugauccucuccuguauuugccuuuacugugggguccuguugccuguuuuacugccaaaccuaccguuccuuaccugccugucuaugucaacacuugagagugugacuuaucugcccgaaaagggauuguacugucagaggcucccuagcucccggacgcacgguggcaccgagucucugaaagggaagaauacagaaaacaugggauuuuauggcacucugaaaaugauauucuacaagaugaaacgcaagcucgaccaugguucggagguacgaucauuuagcuuagggaagaaaccaugcaaggugagugaauauaccuccacaaccggacugguccccuguucugccacuccuacaaccuucggcgaucuucgugcugcaaauggccaagggcagcagagaaggcggaucacgagcgugcagccacccacuggauugcaagaguggcugaaaauguuucaguccuggucagguccugagaagcuacucgcccuggacgaacuuauugauaguugcgagccaacccagguuaaacacaugaugcaggucaucgaaccgcaauuccagcgcgacuuuauuagccuguugcccaaggagcucgcgcuguacgucuuaucuuuccuggagccuaaggaucuccuucaggcugcccagacauguagauauuggaggauccuggcagaagacaacuugcuauggcgggagaaaugcaaggaagagggcauagaugaaccacugcauaucaaacgccgaaaggugauuaaacccggguuuauccacuccccuuggaagucagccuacauuagacaacauaggaucgacacuaauuggcggcguggagagcucaaaagcccaaagguacugaagggccacgaugaccacguuauaaccugucuucaguucugcgguaaccgcauugugagugggucugaugacaauacacugaaagucugguccgcugugaccggaaagugcuugagaacgcucgugggccauacuggcggggucuggagcucgcagaugagggauaacaucauuaucucuggauccacagaccggacccugaaaguuuggaaugcagagacuggugaauguauccacacauuauacggccauaccucaacggugcgaugcaugcaucugcacgagaagcgcguagugagugggagcagagacgccacccuaagggucugggauauugaaacaggacaaugucuccacgugcugaugggccacguugcugccgugcggugcguccaguaugacggucgcagagugguauccggggcguacgauuuuaugguuaaagugugggaccccgagacugaaaccugucuucauacauugcagggccacacuaacagggucuauucucugcaguucgauggaauacauguggucagcggcucacucgacaccaguauccgugugugggauguugagacagggaauugcauucacacccugacuggacaccaaucccuuacgagcgguauggagcugaaggacaacaucuuggugucuggcaaugcagauucaacaguaaagauaugggacauuaaaaccgggcagugucuccagacucugcagggaccgaacaagcaucaaagugccgugaccugcuuacaguuuaauaaaaacuucgugaucacaagcuccgaugacggcaccguuaagcugugggaccuaaaaacuggugaguucauccggaaccucgugacacuggaaucugggggcucgggaggcgucguguggcgaauuagagcuagcaauacgaagcucguaugugccgugggguccaggaacggaaccgaagagacuaaguugcugguucucgauuuugacgucgauaugaaauga

SEQ ID NO: 56181 - RNA, 1599 nt, Artificial Sequence
  derived and/or modified sequence opt3 from FBXW8__Homo_sapiens__NP_036306
auggacgauuacagccuggacgaguucagaaggcgguggcaggaggaacucgcccaagcucaggcacccaagaaacgccgacguccugaagccgcggagagaagggcucggcgcccagaaaacgagaugaaugaugugccguuuuucgacauccagcuucccuaugagcuggccauuaacauauuucaguacuuggauagaaaggaauuagggaggugcgcacaagucuccaaaaccuggaagguuaucgccgaggacgaagugcugugguaucggcuaugucagcaggaggggcaccucccugauucuucaauuagugacuacagcugcuggaaacugaucuuccaggagugucgcgcuaaggaacauaugcuucgaacaaauuggaagaacagaaaaggagcaguauccgagcuggaacacgugccagauacugucuugugcgacgugcauucucacgaugguguugugauugccggcuauacgucgggggacgucagggugugggauacccggacaugggacuacguagcucccuuucucgagucagaagacgaggaggaugaaccuggaaugcaaccaaauguuagcuucgugcguaucaacaguucccuggccgucgcggcauaugaggacggcuuucugaauauaugggaucuccgcacugguaaguaccccgugcauagauucgaacacgacgccaggauccaggcuuuagcccugucucaggaugacgcaaccguggcuacagccagcgcguuugaugucguuaugcuuuccccuaacgaggaaggguacuggcagauugccgcagaguucgaggugccaaaauugguacaauaucuggaaaucgugccggagacccggcgauaccccgucgcuguggccgcugccggagaccuaauguaucuccugaaggcagaagauucagcccgcacucuucuguacgcucacggcccuccaguuacauguuuggacgugagugcgaaucaggucgcauuuggcgugcaggggcucggauggguauaugaggguagcaaaauucugguuuacucuuuagaagccggcagaaggcugcucaaacuugggaacgugcugcgggauuuuaccugcgucaauuuguccgacucacccccuaaccuaauggugagcggaaauauggacggccgcgucagaauccaugaucugaggagugguaacauagcucucucucuguccgcccaccaacuucgugugagcgcaguucagauggacgauuggaagauugugucgggcggagaggagggccugguaucugucugggacuaucggaugaaucagaaguugugggaaguguacuccggccauccaguucagcacaucucauucaguagccacucccucauuacggccaacgugcccuaccaaacugucaugcgaaacgcugaucuggacucuuucaccacacauagaaggcaccgcggguuaauccgggccuaugaguucgcaguggaucagcuggcguuucagagcccgcuaccuguauguagaucaaguugcgacgcuauggccacucauuacuaugaucucgcacuggccuuccccuacaaucacguguga

SEQ ID NO: 56182 - RNA, 864 nt, Artificial Sequence
  derived and/or modified sequence opt3 from FCAR__Homo_sapiens__NP_001991
auggaccccaagcagaccacacugcucugccuugugcuguguuugggccaaagaauccaggcccaggagggggauuucccuaugccauuuauuagcgcuaaauccucuccggucauacccuuagacggaucaguuaagauccagugccaagcaauuagggaagccuaccugacucagcuaaugaucauuaaaaacaguacguaucgggagaucggucgccgacucaaguucuggaaugaaaccgauccugaguuugugauagaccacauggaugcgaacaaagcuggccguuaccagugucaguauagaaucgggcauuacagguuccgguauagcgacacacuggaacuuguagugacuggacuguacggcaagccauuuuuguccgccgaucgcggucucguccugaugcccggggagaauauuucucugaccugcucgucagcacacaucccuuucgacagauuuagccucgccaaggagggagaauuaagucugccacaacaucaguccggcgagcaccccgcuaacuucucucuuggcccuguggauuugaauguuagcgggauuuauagguguuacggaugguacaaccgguccccauaucuguggucauuuccgaguaaugcacuagaacucguggucacagacagcauccaucaggauuacaccacucagaaccugauacgcauggccguggcuggucuuguacugguugccuugcucgcgauucugguggagaauuggcacucucacacagcauuaaacaaagaggccuccgcugacgucgccgaacccucauggagccaacagaugugccagccuggccugaccuucgcacgaacgccaaguguguguaaguga

SEQ ID NO: 56183 - RNA, 774 nt, Artificial Sequence
  derived and/or modified sequence opt3 from FCER1A__Homo_sapiens__NP_001992
auggcccccgcuauggagagcccuacccugcucugcguggcacuucuguucuuugccccagacggcgucuuggcgguuccgcagaagcccaaaguguccuuaaacccuccauggaauagaaucuucaagggggaaaacguaacacugacuuguaauggaaacaacuuuuucgaggugucuucaacgaaaugguuucacaaugguagucuaagcgaagagaccaauuccucucucaacauugucaaugcuaaguucgaagauucgggcgaguacaaaugccaacaucaacaggugaacgagucagaacccguuuaucuggagguguuuagcgacuggcuucuguugcaggccagugcagaagucgugauggaggggcagccucucuuccugaggugucacggauggcggaauugggauguauacaagguuauauauuacaaggacggcgaggcccugaaauauugguacgaaaaccauaauaucuccauuacaaacgcuacuguggaggauucugguaccuauuacugcacagggaaggucuggcagcucgacuacgaaagcgagccauuaaauaucaccgugauuaaagcaccccgcgaaaaguauuggcugcaguuuuucaucccucuuuugguggucauacuguuugccguugauacuggacuauucaucuccacacagcaacaggugaccuuucuccugaaaauuaagcgaacgcguaagggcuucagacuucugaacccacacccgaaacccaacccuaagaauaacuga

SEQ ID NO: 56184 - RNA, 261 nt, Artificial Sequence
  derived and/or modified sequence opt3 from FCER1G__Homo_sapiens__NP_004097
augauccccgccgugguccugcuccuucuguuguuaguugagcaggcugcagcccugggcgaaccucaacuaugcuacauucucgacgcgauacuguuccuuuaugggaucgugcugaccuugcucuacuguagacugaagauucagguaaggaaagcugccaucacaagcuaugagaaguccgauggaguguacacuggucugucuacgcggaaccaggaaaccuaugagacacucaaacacgaaaagccaccgcaguga

SEQ ID NO: 56185 - RNA, 963 nt, Artificial Sequence
  derived and/or modified sequence opt3 from FCER2__Homo_sapiens__NP_001193948
augaaucccccuagccaggagaucgaagaacugccaagaaggcggugcugucgccgaggcacccaaauugugcuccuugggcuggucacagccgcuuugugggcaggauuacugacucuacuccugcuuuggcacugggacacgacccagucccugaagcaguuggaggagcgugccgcgagaaacguuucucaggugucaaagaaccucgaaagucaucacggugaucaaauggcucagaaaagccaguccacacagauaucucaagagcuggaggaacugagggccgagcagcagcggcucaaaucgcaggacuuagaacugucauggaaucuuaacggcuugcaagcagaucugagcaguuucaagucccaggagcuaaaugagcgcaacgaagccucugaccuccuggagagacuuagggaagagguaacuaaacugcggauggaacuacaggugagcuccggguuugucugcaauaccuguccggagaaguggaucaacuuccaacgcaagugcuacuauuuuggaaaaggcacaaagcagugggugcaugcucgauacgcaugugaugacauggagggucagcucguuucaauucacagucccgaggaacaggauuuccugaccaaacaugccagccacacugggucuuggaucggauuaagaaaucuggaccucaagggcgaauuuauuuggguggauggcucccacgucgacuauucaaacugggcuccuggggagccaacaagcaggagucaaggagaagauugcgugaugaugcgggguucuggccguuggaaugacgccuucugugaucgcaaacuuggggcguggguaugcgacagacuggcaaccuguacgcccccugccuccgagggaagcgcugagucgaugggcccagacucuaggcccgauccugacggucgguugccaacuccguccgcccccuugcauucauga

SEQ ID NO: 56186 - RNA, 16218 nt, Artificial Sequence
  derived and/or modified sequence opt3 from FCGBP__Homo_sapiens__NP_003881
augggcgcacuguggagcugguggauccucugggcuggggcaacccuucuguggggauugacucaggaagccuccguggaccugaaaaacacugguagagaagaguucuuaacggcguuucugcaaaauuaccagcucgcuuauucuaaagccuaccccaggcugcuuauuucaagucugagcgaauccccugcaucugucucgaucuugucacaggccgauaacaccagcaagaaaguuacagugcggccaggcgaaagugucauggugaauaucuccgcuaaggcagaaaugauugggucuaaaaucuuccagcacgccgucgugauucacagcgacuaugcuaucuccguucaagcccucaacgcgaagccggauacugcagaacugacccugcuccgccccauacaggccuuaggaacagaauacuuugugcugaccccuccaggcacuucagcucgaaaugucaaggaguucgccgugguggccggugcugccggggcgaguguuagcgugacacuuaaaggaucugucaccuuuaacggcaaguucuaucccgccggcgacguguugcgugugacgcugcagccuuacaaugucgcacagcuacaauccucaguugaucucagcgggaguaaagugacugcuucuuccccaguagccgugcugagcggacacucgugcgcucagaagcauaccacaugcaaccacgucguggagcagcuucugcccacuucugccugggguacccauuauguugugccuacauuggcaucccagucaagauacgaccucgccuuugucguggcuagucaagcgaccaaacugacguacaaucacggcgggaucacuggaagcaggggcuuacaggccggugauguaguugaguucgaggugcggccauccuggccgcuguaucucucugccaacgucgggauucaggugcuucuguuuggaacaggcgcuauccgcaaugaggucaccuacgaccccuauuuggugcuaauuccugauguugccgcauacugcccagccuaugugguaaagagcguccccggcugcgaagggguggcucugguuguggcccaaacuaaggcaaucucaggacucacaauagacggucacgcggucggcgcuaaacugaccugggaggccgugccugggagugaguucuccuacgcagagguagaacuuggaacggccgauaugauucauaccgcugaggccacaacuaaccugggcuugcucaccuuuggucuggcaaaggcuaucggguaugccacagcggccgacugcggcagaacuguguuaagcccaguugagcccucuugcgaaggaaugcagugcgcugcaggccagaggugucaggucgucgggggcaaagccgguugcguggcugagucaaccgccgugugucgggcacaaggcgauccgcacuacacaaccuucgacgggcgccgauacgacaugaugggaacuugcaguuauacgaugguugaacuguguagcgaggaugacacacuaccugcguuuuccguggaagccaagaaugagcauagaggcucuaggcgggugucguacguaggucucgucaccgugcgugcuuauagccacuccguuucacugacucgcggggaggugggcuucguccuuguggauaaccagagaaguagguugcccguuucucugagcgaaggacggcuccgaguguaccaguccggcccacgcgccguagucgagcugguguucgggcuuguggucaccuaugacugggauugccagcuggcauugucacucccugcuagauuucaagaccagguuugcggacugugugguaauuacaacggcgaucccgccgacgauuucuuaacaccagacggggcacuggcccccgaugcuguggaauuugcgagcucuuggaaacuagacgacggagauuaucucugcgaggacggcugucagaacaauugcccugccuguaccccaggucaggcacaacacuacgaaggggauaggcugugcggcaugcuuacuaaguuggacggaccguucgcuguaugucaugauacacuggacccccggccuuuucucgagcagugcguguacgaucugugugucgugggcggggagcgcuuaucccugugcagaggacuuagugccuaugcccaggcuuguuuggaacucggcauuagcguuggugacuggaggucuccagcaaacugcccccuguccugcccugccaauucacguuacgagcuaugugggccagcgugccccacgaguuguaacggagcugccgcaccgagcaauugcucgggccggccuuguguggaagguugcgucugucugccaggcuucguggccuccgggggagcuugcguucccgcaucuagcuguggcugcaccuuucaggggcuccaacuggccccuggacaggaggugugggcggaugagcuuugucagcgaagaugcacuugcaacggcgcuacacaccaagucaccuguagggacaaacagucaugccccgccggugaacgcuguaguguacagaauggguugcugggaugcuauccagaucgguucggcacaugucaggguuccggcgacccucauuacgugucuuuugaugggagaagguucgacuuuaugggaacuugcaccuauuuacucguuggcagcugugggcaaaacgcagcccugcccgcuuuccgcgugcuugucgagaaugaacaccgaggaucccagacggugucauacacccgggccguacguguggaggcaagaggcgucaagguugcugugaggcgcgaauauccaggucaggugcuggucgacgauguguugcaguaccucccguuucaagccgcggacgggcagguucagguauuccggcagggaagagaugccguggucaggacagacuucggccugacugugaccuacgauuggaacgcacgaguuacagcuaaggugccuagcaguuaugccgaggcucuaugcggucuguguggcaauuuuaacggggaccccgcagaugaccucgcccugcgcggaggcgggcaagccgcuaaugcgcuugcauucggaaacucuuggcaggaggaaacucggccaggcugcggugccaccgagcccggggauuguccuaaauuggacucccuggucgcucagcaauuacagagcaagaaugaaugcggaauccucgccgauccaaaaggccccuuuagagagugccauucgaagcuggacccucagggcgcagugagggauuguguauacgaccguugccuucugccggggcagucaggaccacuaugugacgcccucgcuacguaugcggccgcaugccaagcugccggugcaacaguccaccccuggcgcucugaagaacuguguccuuugaguugcccaccccacucccauuacgaggccuguagcuauggcugcccucugucuuguggggauuuaccggugcccggaggcugcgguagcgaaugucacgaggggugcguuugcgacgaaggauucgcucucuccggcgagucaugucugccacuugccaguugcggcugugugcaucaggggaccuaccacccucccggacagacuuuuuauccagguccuggcugcgauagccugugucacugccaggaagggggauuggucucuugugaguccucaaguugcggcccccaugaggcgugucaaccaagcggugggucccucggaugcguggcaguuggaucuucgacaugucaggccagcggcgacccgcacuacaccacuuucgaugggcggagauuugacuucaugggaaccugcguguacguccuggcucagacaugcgguacgaggccuggccuacaucgauuugccgugcugcaggaaaacguagcuugggggaacggacgggugucaguuacccgcgucaucacugugcaaguggcaaauuucacacuuagacucgagcagaggcaguggaaagucaccguaaacggcguggauaugaagcugcccguuguguuggccaauggucagauucgggcuucccaacacgggagugacgucgugauagaaacagauuuuggacugcgaguugccuaugacuuaguguacuaugucagagugacuguaccaggcaacuacuaucagcagauguguggccucugcgggaauuacaacggagaucccaaggacgacuuccaaaaaccuaaugguucucaggcaggcaacgcgaaugaguuugggaacagcugggaggaagugguuccagauucccccugucugccuccgaccccaugucccccuggaucagaggacuguauccccucucauaagugcccaccugaacuugagaaaaaguaucagaaagaagaguucuguggccuguugagcagucccacggguccacucuccagcugccacaagcuggucgauccucaggggccgcuaaaggacuguauuuucgaucugugccuuggaggcggcaaucucucuauccuguguucaaacauacacgccuacguguccgcuugccaagccgcagggggacauguggagcccuggcgcacagaaaccuuuuguccaauggagugcccucccaauagucacuacgaauugugcgcugacacuuguagcuuagguugcucggcccugucugcaccaccucagugucaggauggcugcgccgaggggugucagugcgacuccggauuccucuauaacggccaggcuugcguccccauucagcagugcgguuguuaccauaaugggguuuauuacgaaccggagcagaccgugcugaucgauaacugcaggcaacaguguacaugccacgcgggcaaaggaaugguaugccaggagcauagcuguaagccaggccaagugugccagccuucagggggaauccuuaguugugucacuaaagaccccugccacggugugaccugucguccacaggaaacaugcaaggagcagggcgggcaaggaguuugucugcccaacuaugaagccacgugcugguuguggggcgauccucacuaccauucuuuugacggucggaaauucgauuuucaggggaccuguaauuaugugcuagcaacuacaggcugcccgggagucuccacccagggccugacucccuucacaguaaccacgaagaaccagaauagagggaacccagcugugagcuacguuaggguggucacuguggccgcccucggaaccaauauuucaauccacaaggacgagauugguaaaguccgcgugaacggcguucugacagcacuuccugugaguguagcugacgggcgaauaagcgugacccaaggagccuccaaggcguuacuggucgcugauuuuggccuccagguuucuuacgacuggaauuggagaguggaugucacuuugcccagcuccuaucauggugccgugugugggcugugcggcaacauggaccggaauccuaacaaugaucagguauucccaaacggaacacucgcacccucaaucccuauuuggggcgggucuuggagggccccaggaugggacccccugugcugggaugaaugucgcggcaguugcccgaccuguccugaggaccgucuugagcaguacgaagguccaggguuuugcggaccccuggcuccuggcacagguggcccauucacuaccugucacgcacacgugcccccggagucguuuuucaaagggugcguuuuggauguguguaugggaggcggggacagagauauccuaugcaaggcccuggcgagcuaugucgcugccugucaagcagccggaguggucaucgaagacuggcgggcucaggugggcugcgagauuacguguccugaaaauucccauuacgaaguuugcgguucucccugcccagccucauguccuagccccgcaccacucacaacccccgcuguaugcgaggggccuuguguggaaggaugccagugugaugccggcuucgucuuauccgcggacaggugcgugccacugaacaaugguuguggcugcugggccaacgggacuuaucacgaggcaggaagugaauuuugggcugacggcaccuguucucaguggugccgcugugggccgggaggcgguagccuuguuugcacacccgccucaugcgggcugggagagguguguggccucuugccuuccggccaacaugggugccagccagucaguacugcagagugucaggcuuggggagauccccacuacgugacccuggacggucaucgauucaacuuucaaggcacgugcgaauaucuccugagcgccccuugucacgggccaccccuuggagccgagaauuucacaguaaccguggcgaacgaacacagaggcucucaggcuguuuccuacacucggucagucacacuacagauauacaaucauagccugaccuugucggcaagguggccucgcaaauuacagguggaugguguguuugucacucugccguuccaacucgacucucugcuucacgcccaucugaguggggcugauguugugguaacaaccacguccggacucagcuuggccuuugacggcgauucauucgugagacugagggucccagcagccuaugcuggcucccuaugcgggcuguguggaaacuacaaucaggaccccgcggaugaccucaaggccguggguggcaaaccugcaggguggcagguuggaggcgcucaggguugcggggagugugugucuaagcccugcccaagcccuuguacucccgaacaacaggagaguuuuggaggcccagaugccugcggcgucaucuccgcaaccgacgggccgcuugccccuugccacggacuggugcccccagcucaguauuuccaggguuguuuauuggacgccugccaaguacagggccaccccgggggacuguguccugcgguugcaacauacguggccgcuugccaggccgcaggcgcucaacuccgggaguggcgucgcccagauuuuugucccuuccagugcccugcccauagccacuaugaacuguguggugacucuugcccggggucauguccaagucuuuccgcucccgagggaugcgaaagcgccugucgagagggcugcgucugcgaugcaggcuuugugcugucuggggacaccugugugccugucggacagugcgguugucuccaugaugacagauacuauccauugggccagacauucuaccccgggccuggaugcgauucgcuguguaggugccgggaaggcggugagguuucaugugagcccagcuccugcgggccacacgaaacuugucgcccgaguggaggcucuuuaggcugcguggcgguagggagcaccacgugucaagccuccggagacccucauuacacaacuuucgaugguagaagguuugacuucaugggaaccugcguguauguccuagcucagacaugcgggacccggcccggacugcaccgauuugccgugcuccaggagaacguugcauggggcaaugguagagugucagucacucgcgugauuaccguacagguugcuaacuucacacuuaggcuggaacaacggcaguggaaggugacggucaaugggguggauaugaaauugccaguugugcuggccaacggacagauccgugcaagucagcacggcucugacgucgugauugagacugauuuuggccucagaguagccuacgaccugguguauuacgucaggguuaccgugccugggaauuauuaccaacuuauguguggacucugcgguaacuauaauggcgaccccaaggaugacuuccagaaaccaaacgggagccaggcgggaaaugcuaacgaguuuggcaauuccugggaagaggucgugccugauucacccugucugccgccaccuacauguccucccgguagcgaaggguguauccccucugaggaaugucccccggaguuggagaagaaauaccaaaaggaagaguucugcggccuguuauccaguccaaccggaccccuaagcucgugccauaagcugguagacccucagggcccccucaaagauuguauauuugaccuuugccuagggggugggaacuuguccauccuguguucuaacauucacgccuacgugucagcaugccaggccgcuggcgggcagguugaaccauggcgcaaugagacuuucugcccuauggaauguccccaaaacagccauuaugagcucugcgccgauacauguagucugggaugcuccgcacuuucugcuccauuacaguguccugacggcugcgccgaggguugucagugcgauagcggguuucuguacaauggccaggcgugugugccgauccaacagugcggauguuaucacaacggcgcuuacuaugaacccgagcagaccguccucauugacaauugccggcagcaaugcacgugucacguggggaagguugucgugugccaggaacauucauguaaaccaggacaggugugccagccuuccgguggcaucuugaguuguguaaacaaggaucccugccacggggucacuugucgaccacaagagacaugcaaagaacagggaggccagggugugugucugccuaauuacgaggcaaccugcuggcuauggggcgacccccauuaucacagcuucgacgggagaaaguuugauuuccaaggaaccuguaacuacguucuggcaacuacaggcugcccgggggugucuacccagggacucacaccauucacugucacgaccaagaaucagaacaggggcaauccugccgugucauacguucgcgugguaacagucgcugcacuugguacuaacauauccauucauaaagacgagaucgggaaggugcgggugaauggaguucugaccgccuugcccgucagcguggcggauggcagaauuucuguaacacagggugccaguaaagcucugcucguggcagacuuuggccugcaagucucguaugauuggaacuggcguguggacguuaccuuaccauccagcuaccacggggccgugugcggacuuuguggcaauauggauaggaaccccaacaaugaccaggucuucccuaacgggacucuggcucccucaaucccaauauggggaggcucuuggcgggccccugguugggauccgcucugcugggacgaaugucgcgggagcugccccacguguccagaggaucgacuagaacaguaugagggaccuggcuuuugcgguccccuggcaccaggcaccgggggaccuuucacaacuugucacgcucaugugcccccggaguccuuuuucaagggcugcguuuuggacguguguaugggaggcggcgauagagacauccugugcaaagcccucgcgaguuacguagccgcaugucaggcugccggugucgugauugaagacuggagggcacaaguugggugcgagauaaccugcccugaaaauucacacuaugagguguguggaccacccugcccugccucuuguccaagccccgcuccucuuacaaccccagccgucugcgaaggccccuguguggagggcugccagugugaugcgggguuuguacuguccgcugaccggugcgugccguugaacaauggaugugguugcugggcaaacggcacuuaccaugaggccgggagugaguucugggcugauggaacauguagccaguggugccgcuguggcccuggugggggaucccuggucugcacgcccgccucuugcggccucggcgagguuuguggguuacugccaucaggacagcacgguugccaacccgugagcaccgcagaaugucaggccuggggcgacccucauuaugugacucuugaugggcacagauuugacuuccagggaacaugcgaguaccugcuaucggcuccaugucacggacccccucucggugcggaaaauuuuaccgucaccguggccaacgagcauagggggucccaagcaguuaguuacacacgaucuguaacucugcagauuuauaaucacagcuugacgcugucagcccgguggccacguaagcuccagguggauggagucuucgugacccuuccguuucagcuggacuccuuacugcaugcucacuugucuggcgcagauguuguggucacaacuaccaguggccucagccuggccuucgacggggauuccuucgugagacuacgcguacccgcugccuacgcgggaucacuuugcggucuguguggcaacuauaaucaagacccugcagaugaccucaaggccguagggggaaaaccagcuggcuggcaggucgguggggcccagggaugcggcgaguguguuagcaagcccugcccuucuccauguacacccgaacagcaagagaguuuuggcgggccggacgcaugcggagugaucuccgcuaccgaugguccucuggccccaugccacggcuugguacccccugcgcaguacuuccaggggugucugcucgacgccugccaggugcaaggacaucccggcggucuuuguccagcuguugcaacuuauguggccgcuugccaggcagccggggcucagcugagggaauggcggagaccggauuuuuguccuuuccagugccccgcccacagccauuacgaguuauguggagacucaugcccaggcucuugucccucccugucggcaccugaaggcugcgagagcgccugucgcgaggggugcguaugcgaugcgggauuuguguugaguggugacacgugugucccagugggccaaugcgggugucuccacgaugacagguauuacccccugggacagacauucuacccuggcccagguugcgauucucuaugucgaugccgggaagggggcgagguuuccugugaaccgagcucaugcggaccccaugagaccuguagaccuaguggcgggucccuuggaugcgucgcuguggguagcacuaccugucaggccucuggcgacccacacuauacaacuuuugaugggcacagguucgacuuuaugggaaccugcguguacguacuggcacaaacaugcggcacgcgccccggucuccaucguuucgccguccugcaggagaacguggcuugggggaauggccggguuucagugaccagagucauaacugugcagguugccaacuuuacauugagguuagaacagcgccaauggaaagugaccgucaauggaguggacaugaagcugccuguagugcucgcaaacggccagauucgagcuagccagcacggguccgauguugucaucgagacugacuucggacuucggguggccuaugaucugguguacuaugucagaguuacagugccagguaacuacuaucagcuaauguguggccugugcgggaauuacaacggagaccccaaagaugacuuucaaaagccuaauggcucucaggcggguaacgcaaaugaguucgggaacaguugggaggaaguagugccggauucgcccugucucccaccuccaaccugcccaccuggcagcgccggauguauccccuccgacaaaugcccaccggaguuggagaagaaguaccagaaagaagaguucuguggccugcuuucaucuccuacggggccccugagcaguugccauaagcucgucgauccacagggacccuuaaaagacuguauuuuugaucugugcuuggguggcgggaaucuguccauccucuguucaaacauucacgcuuaugugucugccugccaagcugcaggaggccacguugaaccuuggaggaaugagaccuucugcccaauggaauguccccagaacagccauuacgagcuuugcgccgacacauguucccuggguugcagugcgcuaagcgccccucugcaguguccggauggcugcgcugaggggugucaaugcgacucuggauuucucuauaauggccaggcaugugugcccauacagcagugcggguguuaccacaacggagucuauuacgaaccagagcaaacuguauugaucgacaauugccgccagcagugcaccugucaugugggcaagguuguggucugccaggaacacucauguaaaccuggucaagugugccagcccuccgggggcauucugagcugugugacaaaggauccaugccauggcgucacuuguagaccucaggagaccugcaaggaacaggguggccaagggguuugucuucccaacuacgaggccacaugcuggcuguggggagacccacacuaucacaguuucgauggccggaaauuugacuuccaggggaccuguaauuacguguuagcuacuacgggaugcccgggcguaucuacacagggucucaccccuuuuacugugaccacaaagaaccaaaacagggggaaucccgccgucuccuauguucguguggugacggucgcagcccugggaaccaacaucucgauucauaaagaugagaucggcaagguacgagugaaugguguuuugacugcucugccagugagcgucgcggacggccgcauaucaguggcccagggggcauccaaagcucuccuuguugccgauuucggacugcaagugucuuacgacuggaacuggagagucgauguaacacuaccuaguagcuaucacggcgcagugugcgggcuguguggaaauauggaccggaaccccaauaacgaucaggucuuuccaaauggcacccucgccccuucaauccccauuugggguggguccuggagggcuccgggaugggacccauugugcugggaugaaugucgcggcagcugccccacuuguccugaggacagacuggaacaauacgagggcccaggguucugcggacccuuaucuagugguacaggcgggccuuuuaccacaugucaugcgcacgugccgcccgaguccuucuuuaagggaugcguucuugacguguguaugggcgguggggaucgggacauccugugcaaggcccucgcaagcuaugucgcugccugucaggccgcuggagugguaauugaagauuggagggcacaggugggcugcgagaucacuugcccagaaaacucacauuacgagguuuguggcccucccugcccagccucuuguccuucgcccgcuccacugaccacgccugcggugugcgaagggcccugugucgagggaugccagugugacgccgguuucguguugagcgcagaucgaugcguuccgcugaauaacggcugugggugcugggccaauggaaccuaccacgaggcuggcuccgaguucugggcagacgguacauguagucaauggugccguugcgggccuggaggcggcucucucgucuguacuccagccucaugcgggcuuggagagguguguggucugcuacccagcggccagcacgggugccagccuguauccaccgcugaaugucaggccuggggagauccacauuaugugacacuggacggccacagauuugauuuccaagguacuugcgaguacuuacucagugcacccugucaugggccgccucugggagcggaaaacuuuaccgucacgguggccaaugagcaccgcggcucucaggcuguuagcuauacacgguccgugaccuugcagauauacaaccacucacuuacucugagcgccagguggcccagaaaacuccaggucgacggcguguucguagcacugccauuucaauuggauucucugcuacaugcucaccucuccggggccgacguuguggucacaaccacaaguggacuuucacuggcguucgacggugauagcuuugugcgcuuacgggugcccgccgcuuaugcagccucgcugugcggccucugugggaacuacaaucaggacccugcugaugaccugaaggcaguuggaggcaaaccagccgguuggcaggucgggggagcccaaggcugcggcgaguguguguccaagcccugcccuucuccaugcaccccggaacagcaggagaguuucgggggacccgaugcuugugguguaauuagcgcaacagacggcccuuuggccccaugccaugggcuugugcccccugcgcaguauuuucaaggaugucugcucgaugcuugccagguccagggccacccaggugggcugugucccgccguggcaacguacguugccgcuugccaggccgcaggcgcucaacuaggagaauggaggcgaccggacuucuguccuuugcagugcccagcccauucacacuacgagcuguguggcgauuccugccccgugucuuguccuagccucagugcgcccgaagggugcgaguccgcaugcagagagggaugugucugcgacgccgguuuugugcuuagcggcgauaccuguguaccaguugggcagugcggaugucugcacgacggccgguauuacccuuuaggugaaguguucuaucccgggccagagugcgaaaggcgcugugagugcggcccgggaggccaugucacuugucaggagggggcugccugcggaccccacgaagagugucgucuggaagauggugugcaggcuugccaugcaacaggcugcgggagaugucucgccaacggaggcauccacuacaucacccuggacggucgaguuuaugacuugcacgggucuugcucauacgugcuugcgcaggucugucauccuaaaccaggcgaugaggacuuuuccauugugcuggaaaagaaugccgcuggagaucuccagaggcugcuaguaacuguggcaggccaagucguuagcuuagcccaggggcaacaggugacaguggacggagaggcugucgcccugcccguggcaguuggccggguacgcgugaccgccgaggguagaaacauggucuugcaaacgacaaaggggcucaggcugcuuuucgauggagacgcucaucugcucaugaguauaccuucuccauuccggggccgccugugcgguuuguguggcaauuuuaacgggaauuggucagaugacuucgugcuucccaacggauccgcggccagcucgguugaaaccuuuggcgcagcuuggagagccccugggucuaguaaaggaugcggcgaggguugugggccgcagggaugcccagugugucuggcagaagagacugcccccuaugaauccaaugaggcuugcggccagcuacgaaacccucaggguccauucgcgaccugucaagccguccucagccccucagaguacuuuaggcagugcguguacgaucugugcgcacagaagggcgacaaggcuuucuuaugucggucucuggccgccuauacagcugcaugccaggccgcggggguagcugucaagccuuggcguacugauagcuuuugucccuugcauugcccagcccacucccauuacaguaucuguacccgcacaugccaaggaucaugugcagcccucagcggccugacggggugcacuaccagauguuucgaaggaugcgagugugacgauagguuucuucugucccagggcgugugcauuccgguucaggacugugguugcacacacaaugggcgguaucucccugugaacucuaguuugcugaccagcgacugcuccgaaagauguucauguucuucgagcuccggacuuacuugucaggcugcaggcugucccccaggucgcgucugugaggugaaagccgaagcucgaaauugcugggccacaaggggccuguguguuuuaagugugggggcgaaccuaaccacguucgauggagcacggggcgccacuaccucuccugggguauacgagcucagcucaagaugccccggacugcaaaauacaaucccaugguaucguguggucgcugaggugcagauuugucacggcaagaccgaagccguuggucagguccauaucuuuuuccaagacgggauggugacucugacaccgaacaagggaguguggguaaacggcuugcgcgucgaucucccugcagagaaacuggcuuccgugagcguuucuaggacccccgacggcagucuucuggugcggcagaaggccgggguccaggugugguuaggagcgaaugguaaaguugccgugauaguauccaacgaucacgcaggcaagcucugcggggcuuguggaaauuucgacggcgaucagacaaacgacuggcaugauucacaagaaaaaccagccauggagaaguggagagcucaggacuuuagccccugcuacgguuga

SEQ ID NO: 56187 - RNA, 954 nt, Artificial Sequence
  derived and/or modified sequence opt3 from FCGR2A__Homo_sapiens__NP_001129691
augaccauggagacacagaugagccaaaacgugugccccagaaaucuguggcuccuucagccucugacugucuuguuacugcuagccuccgcugacucucaggcagccgcgccaccgaaggcuguucucaaacuggaacccccuuggaucaacgugcuucaggaggauucaguaacgcugaccugucaaggcgccaggaguccagaaagcgacuccauucagugguuccacaaugggaacuugauacccacacauacucagccuucuuaccgguuuaaggcaaauaacaaugauucgggagaguauaccugccagacaggucaaaccucacucagcgacccagugcaccugacuguccugagugaauggcucguguuacagacaccccaucuggaguuccaggagggcgaaaccaucaugcuucgcugucacuccuggaaagauaagccuuugguuaaagugacguuuuuccagaacgggaagucucaaaaguuuagccaucuggacccaacuuucuccauuccgcaggccaaucacucacacaguggagauuaccauugcaccggcaacaucgguuauacacuauuuagcucuaaacccgucacuauuaccgugcagguaccuuccauggggucaagcaguccaaugggaaucauaguugcuguggucaucgcaacagccguggcugccauuguggcggcagucguugcccucaucuacugucgaaagaaacguauuucugcuaauuccaccgaccccgugaaggccgcacaauucgagccuccaggcagacagaugaucgcuauaaggaaacggcagcuggaagagacgaacaaugauuaugagacugccgacggcggguacaugacacuuaacccccgcgcgccgaccgaugacgauaagaauauuuaucugacuuugccucccaacgaccacguaaacagcaauaacuga

SEQ ID NO: 56188 - RNA, 873 nt, Artificial Sequence
  derived and/or modified sequence opt3 from FCGR2B__Homo_sapiens__NP_001002273
augggcauccugagcuuccuccccgugcuugccaccgaguccgacugggcugauugcaagucuccucagccaugggggcacaugcuguuguggacagcagucuuauuucuggccccgguugcgggaacucccgcuccuccaaaagccgugcuaaagcucgaaccccaauggauuaacguacugcaggaggacucagugacgcuuaccuguagagguacacauaguccugaaagcgauuccauacagugguuccacaauggcaaccugaucccaacucauacccagcccucuuacagguuuaaagcaaauaacaaugacucgggggaguauacaugccaaaccggacagacuucauugagcgauccuguccaccucacagugcugagugaauggcugguucuccagaccccacauuuagaguuccaggagggcgaaacgauugugcugcggugucacuccuggaaggacaaaccgcuugucaaggugaccuuuuuccaaaacgguaagucuaaaaaguuuagccgcuccgaucccaauuucucaaucccucaggccaaccacagucauagcggggacuaccacugcacuggaaauauuggcuauacauuguacucuuccaaaccaguaacuaucaccguucaggcucccucaagcaguccuaugggcauaaucguggcagucgugacagggauugccguggcugccaucgucgcggcaguuguggcccugauuuauugucgaaagaaacguaucucugcuaacccaaccaaucccgaugaggccgacaagguaggagcagaaaacacgauaacuuacucccuacucaugcauccggaugcucuggaggagccugacgaucagaauagaauuuga

SEQ ID NO: 56189 - RNA, 873 nt, Artificial Sequence
  derived and/or modified sequence opt3 from FCGR3A__Homo_sapiens__NP_000560
augggcgggggagccggugagagacuguucaccagcuccugccucgugggccuugucccccugggguugaggaucucuuuaguuacauguccucugcagugcggaauuauguggcaacuacuccugccaacugcccuucuguugcucgugucagcaggcaugcggacggaagaccugccgaaggccguaguguuucuggagccccagugguaccgcguccucgaaaaagauagugugaccuuaaagugucagggugcguauagcccugaggacaacuccacacagugguuccacaaugaaucucugauaucgucacaagcuagcaguuacuuuaucgaugccgcaacuguugacgauuccggggaguaucgaugccagaccaaccuuucuacauugagcgacccagugcagcuggagguccauauuggauggcuacuccugcaggcuccccguuggguguucaaagaagaggauccuauccaccuuagaugucauuccuggaagaauaccgcucugcacaaaguaacuuacuugcaaaacggcaagggcaggaaguauuuucaucacaauucagacuucuacauuccaaaagcaacacucaaggauagugggagcuauuuuugccggggacuguucgguucuaaaaacguuuccucagaaaccgugaauaucacgauaacucagggcuuagccgucagcaccaucaguucuuucuuucccccuggguaccagguguccuuuugucuggugaugguccuccuuuucgcuguugacacaggacuguacuuuagcgugaagacuaacauucgcucgucuaccagagauuggaaagaccacaaguucaaguggaggaaagauccacaggacaaguga

SEQ ID NO: 56190 - RNA, 702 nt, Artificial Sequence
  derived and/or modified sequence opt3 from FCGR3B__Homo_sapiens__NP_000561
auguggcagcugcuccuucccaccgcccuguuguuacuggugagcgcuggcaugagaacagaggaccuaccuaaggcagucguuuuccucgaaccacaaugguacuccgugcuggagaaagauucuguaacucuuaagugccagggggccuauucaccggaagacaacaguacgcagugguuucacaaugagaaccugaucagcucccaggcgucuucguacuucauugaugcugccaccgugaaugacucaggagaauauaggugucaaacaaacuugagcacucucagugaucccguccagcuggaggugcauauagguuggcugcucuuacaggcaccucgguggguuuuuaaagaggaagacccaauccaccuacgcugccauuccuggaagaauaccgcccuucacaaagugacauacuugcagaacggcaaggaucgaaaguauuuccaucacaauucugacuuucacauucccaaagcuacccugaaggauagcggguccuacuucugucguggacuggucggcaguaaaaacgugucaagcgagacuguaaauaucacaauuacccaaggucucgcaguuucuacgaucuccucauuuagcccuccaggguaucaggugaguuucugccuggucauggugcuucuguuugccguggacacuggauuguacuucucugucaagaccaacauauga

SEQ ID NO: 56191 - RNA, 1098 nt, Artificial Sequence
  derived and/or modified sequence opt3 from FCGRT__Homo_sapiens__NP_001129491
augggcgugcccagaccucagccaugggcccuggggcuccuucuguucuuguuaccgggaagccugggugcugagucccaccuaucucuccuguaccaucuuaccgcagucucaagucccgccccuggcacaccagcguuuuggguuagcggguggcugggaccccaacaguauuuguccuacaacucucucaggggcgaagcugagccuugcggugccugggugugggaaaaucagguaucgugguauugggagaaggaaacuacggaccugcggaucaaagagaagcuguuccucgaggcauuuaaagccuuagggggaaagggcccauacacccugcagggccuuuuggggugugaacugggacccgauaacacaucagugccuacugcuaaauucgcacuaaauggugaggaauuuaugaacuucgaccucaagcaaggcaccuggggaggggauuggccagaggcccuggcuauuagccagcgcuggcagcagcaagacaaggccgcgaauaaagagcuuacauuucuguuguucaguugcccgcaccgacuccgugaacaucuggagagaggcagggguaacuuagaauggaaggagcccccuuccaugcggcugaaagcacgcccaucuagccccggguuuuccguccucaccuguucagccuucaguuuuuauccuccagaacuucagcugagauucuugaggaauggacuagcugccggcacuggccagggggauuuuggacccaacagcgacgguucuuuccacgcauccucaagccugacagugaagaguggcgaugagcaucacuacugcuguauaguucagcacgcugggcucgcccaaccgcugcggguggagcuugaaucuccugcgaaauccagcguccuggugguaggaaucguuauuggcguguugcuccugaccgccgcagcugucgguggggccuuacuguggcgccgaaugagaucgggccuacccgcuccauggaucucucucaggggagacgauacgggcgugcugcuuccuacucccggggaggcccaggacgcagauuugaaggacgugaaugucauuccagccaccgcuuga

SEQ ID NO: 56192 - RNA, 2676 nt, Artificial Sequence
  derived and/or modified sequence opt3 from FCHO1__Homo_sapiens__NP_001154829
augagcuacuucggcgagcacuuuuggggagaaaagaaccauggguucgaggugcuguaucacuccgucaaacagggucccaucucuaccaaggaacucgccgacuuuauuagagagagggcuacaauagaagagacuuacucaaaagcaauggccaaacuuaguaagcuggcgagcaauggcacgccuauggggaccuucgcuccauugugggagguuuuucggguguccucugauaaguuagcccugugccaucuagaacucacacgcaagcugcaagaccuuaucaaagauguacugcgauauggagaggaacaguugaagacucacaaaaaguguaaagaggagguggucucgacccucgacgcagugcagguucugucaggcgugagccagcugcucccgaagagucgugaaaacuacuuaaauagaugcauggaucaagagaggcugcggcgcgaauccacaucucagaaggagauggacaaagccgaaaccaagacuaaaaaggcugcagagagccuuagaagguccgucgagaaauauaacucagcccgggcugauuucgaacagaagauguuggacagugcccugcgcuuucaggcgauggaggaaacacaucuacgacacaugaaagcacuccuggguagcuacgcccacucuguggaggauacccauguacaaauugggcagguucacgaagaguucaagcagaauaucgagaacguguccgucgaaaugcuucugagaaaguuugcugagucaaaaggaacgggcagggaaaagcccggcccuuuggacuucgaggccuauagcgcagcugcccuccaggaagcgaugaaacggcugcguggggccaaggcauuucgcuuaccaggacugaguagaagggagcgggagcccgaaccuccagcugccguggauuuccucgagcccgacucugguacuuguccugaaguggaugaggagggcuuuaccguccgaccagacguuacacaaaauuccacugcugaaccgagccgcuucucgucuuccgacucagauuucgacgaugaggaacccagaaaauuuuacgugcauauuaagccugccccagcaagggcccccgcuugcaguccugaggcggcagccgcucagcuucgggccaccgcagggagccugaucuugccacccggaccgggcgguacaaugaagcgccacuccucuagagacgccgcugggaaaccucagaggccccguagcgccccacggaccucaaguugugcagaacgacuacaauccgaggagcagguaagcaagaaccuguucggaccuccccucgaaucugcguuugaucacgaggacuucacgggcucaaguagccugggcuuuacuuccucuccaucgcccuucagcuccucaaguccugaaaauguggaggauucugggcuugacagcccaucccaugcugccccgggacccucaccugauagcugggucccaagacccgguacaccucagucuccacccuccugcagggcaccgccuccagaagcccgcggcauacgggcucccccucugcccgacaguccacagccuuuggccagcucucccgggccauggggacucgaggcacuggcuggcggugauuuaaugccggccccugcggaccccaccgccagagaggggcuggcugcaccacccaggcgccuacgaucccggaaagugucauguccucucacucguaguaacggcgaccugagcagaucgcuuuccccaucucccuugggaagcucagccgcuaguacagcccuggaaaggccuuccuuucucucucaaaccggccacgggguuagccgcggaccguccccagugguccuggguucacaggaugcacuucccaucgcgacggccuucaccgaguacgugcaugcuuauuuucggggccacagcccuaguugccuggccagaguaacaggggaauugacuaugaccuucccagcaggaauuguuaggguguuuucuggcacacccccuccgcccguccucuccuuccgacuggugcauacuaccgcuaucgagcacuuucagccaaaugccgacuuacuguucagcgauccuucgcagucagaccccgaaacaaaggauuucuggcuaaacauggcagcccucaccgaggcucugcaacgccaggcggagcagaauccaacugccucuuacuauaacgucgugcuuuugcgguaccaguuuaguagaccugguccccaauccguuccacugcagcucagcgcacacuggcaguguggggcuacgcugacacaggugucuguagaauauggcuacaggccgggagccaccgccgucccuacucccuuaaccaaugugcaaauucugcuuccaguuggcgagcccgugacaaacguccguuugcagccugcugcaaccuggaaccucgaagagaaacgccugacuuggcggcuaccagacgugagcgaggccgggggauccgguagacugucagcgaguugggaaccccucagcggcccuucuacaccguccccaguagcugcccaguucacgucagaggggaccacucugaguggaguggaucuugaauugguuggcagcgguuauaggaugucccuggucaagcgacgguuugcaacagccgcucccccucaagggugcaccugguga

SEQ ID NO: 56193 - RNA, 2334 nt, Artificial Sequence
  derived and/or modified sequence opt3 from FCHO2__Homo_sapiens__NP_001139504
auggugauggccuacuucgucgagaacuuuuggggcgaaaagaauagcggguucgacguucuguaucacaacaugaaacauggacagaucuccaccaaggagcucgcugauuuugugagagaaagggcaacaauugaggaagccuacucucggucaaugacuaaacuugcgaagagugcuagcaauuauucccaacuggguacguucgcccccguaugggacguguuuaaaaccucuacagagaaguuggcaaacugccacuuagaucugguccgcaagcuacaggagcucauaaaagaagugcagaaguacggcgaggaacagguuaaaucgcauaagaaaacuaaggaggagguggccgggacccuggaagcuguccaaacaauccagucaauuacccaggcacuucagaaguccaaagagaauuauaacgccaaguguguggaacaagagcgacugaaaaaggaaggagcuacucagcgugagaucgagaaagccgcgguaaagaguaaaaaggcaacagacaccuacaaguuguauguugaaaaauacgcccucgcuaaggccgauuucgagcagaaaaugacggaaacugcacaggugcacgaggaauuuauuaauaacauggcuaauaccacagucgagucccugauccaaaaguucgccgagucuaaaggcacugguaaggaaagaccugggcugauagaguuugaagagugcgacaccgcgagcgccguggaaggaaucaagccaaggaaacggaagacauucgcacucccgggcauuaucaaaaaggagaaagaugcugaguccguggaaugucccgacgccgauucauuaaacauuccugacgucgaugaggaaggcuacaguaucaagccagagaccaaucagaacgacacgaaggagaaucauuuuuauagcucuagcgauucagacagcgaagacgaggaacccaaaaaguaccgcauagagauuaaaccuaugcacccaaacaauagucaccauacuauggcuucucuggaugaacuuaagguuuccaucgggaacauuacauugagccccgccaucucgagacacucuccugugcagaugaacaggaaucuguccaacgaggagcuaaccaaaucaaagccaagugcaccgcccaaugaaaagggaacuagcgaccuccuggccugggauccucuuuucgguccaucccuggacucuagcucaaguuccagcuugacaucuucaaguagcgcucggcccaccacgccucucuccguaggcaccaucgugccacccccgcgcccugcgucucgacccaaacugacaucggggaaguuaagcggaauuaacgagauaccaagaccuuuuucucccccagucacuucaaauaccagucccccuccagcagccccgcuggcuagggccgaaucuagcuccucaaucagcuccuccgcaagucucagcgccgcuaacacacccacugugggcguuucucgggguccuuccccagugucacuugggaaucaagauacccugcccgucgccguggcauugacagagaguguaaacgcguauuucaaaggagcugacccuaccaagugcauuguuaaaaucacuggcgauaugacgaugagcuucccaucgggcauaauuaagguguuuacauccaaucccaccccggccguccuauguuuccgugugaaaaacaucucucgccuggaacagauccucccuaaugcacagcuggucuuuagcgacccaucacagugcgauaguaacacuaaggacuucuggaugaauaugcaagccgugaccguuuaccuuaagaaacuguccgagcagaaccccgcugccucuuauuacaauguggauguauugaaguaucaggucagcuccaacgggauucagucaacaccucucaaccuggcaaccuacuggaaauguagcgcuaguacuacagacuuaagaguggacuacaaguauaaucccgaggccaugguugcgccaucugugcuguccaacauccaagucgugguaccuguggauggagguguuacgaauaugcagagccuacccccagccauuuggaacgcugaacagaugaaagcauuuuggaagcucucgucaauaucugagaagagugaaaauggcggguccggaagccugagggccaaauucgaccuuucugagggcccgagcaagccuaccacuuuggcuguccaguuucuguccgaagguucaacacucagugggguggauuucgagcuggugggcaccggauaccggcuuagccugaucaaaaagcgauuugccacaggccgcuauuuggcagacugcuga

SEQ ID NO: 56194 - RNA, 2223 nt, Artificial Sequence
  derived and/or modified sequence opt3 from FCHSD2__Homo_sapiens__NP_055639
augcagcccccuccaagaaaggugaaagucacccaagagcugaagaacauccagguugaacagaugacaaaacuccaggccaagcaccaagcugagugcgaccuucuggaagauaugaggacuuucagccagaaaaaggcagccauugagcgggaauacgcgcagggcaugcagaaguuggcuucccaauauuuaaaacgcgacuggccgggggugaaggccgaugaccgaaaugauuaccguucuauguaucccguauggaaaucauuucuggagggaacgaugcaaguggcacagaguagaaugaacauaugugagaauuacaagaacuucaucagcgaaccugccaggaccguccggucccuaaaagagcagcagcucaagcgcugcguggaccagcugacaaagauucagacugaacuucaagagaccguuaaagaucuggcuaaggguaaaaagaaauauuuugagacagaacagauggcacaugccgugagagagaaggcugacaucgaagccaaaucuaaguugucucucuuccagucaaggauuagccugcagaaggcgagugucaaacugaaggcacggcgcuccgaguguaauucuaaagccacccacgcucgaaacgauuaccucuuaacucuggccgcagcuaaugcccaucaagacagauauuaccagacagaucuugugaacaucaugaaggcguuggacggcaauguauacgaucaccugaaagacuaucuaauagccuuuagcaggaccgaacucgagacgugccaggcaguucagaacacuuuccaauuucugcuugaaaauuccucaaaggugguccgggacuacaaccugcaguuguuccuccaggaaaaugcuguguuucauaagccacagcccuuccaauuucagccuugugauagugacaccagccgucagcuggagucugaaacagggacuaccgaggaacacuccuuaaacaaagaggcccgcaagugggcuacaagaguggccagggagcacaaaaauaucguccaucagcaacggguucugaacgaucucgaaugccacggagcagccgugucagagcagagccgagcugaacuugagcagaagauugacgaagcgcgcgagaacaucagaaaagcagagauuaucaagcugaaggccgaagcuagguuggaucuacugaaacaaauaggcguaaguguggacaccuggcucaagucugccaugaaucaggucauggaggaacuggagaacgagcggugggcacgcccacccgccgugacguccaaugguacucuucauagccugaacgcugauacagaaagagaggaaggggaggaguucgaggacaauauggauguuuuugacgauucgucuuccucaccuaguggaaccuugaggaacuauccacucacuuguaaaguggucuacagcuauaaggccucccagccggacgagcugacaauugaggaacacgaaguguuagagguaaucgaagacggcgauauggaggacuggguuaaagcacguaauaaggugggccaggucggguacgugcccgagaaguaucugcaauucccuaccucuaacagccuacucucaaugcugcagagucuugcggcuuuggauucccggagccacacgucuucaaauaguaccgaagccgagcuggucagcggaucccucaacggugacgcaucugugugcuucguuaaagcccuguacgauuacgaaggccagacagacgaugagcuuucguuuccagaaggggcuauuauccgaauccugaauaaggagaaccaggacgaugacggauucugggagggcgaauuuaaugguagaauugggguguuccccagcguauuggucgaggaacucuccgccucagagaacggagauacuccuuggaugagggagauacaaaucaguccaucucccaaaccgcaugcaagccugccucccuuaccacuguaugaccagccucccuccucaccauaccccagcccugauaagcgcucgucccuauauuuuccacggaguccgagcgcuaaugaaaaaucucuccacgccgagucccccggcuucucacaggcgaguagacauaccccugaaacaagcuacggcaagcugaggccagugcgcgccgcucccccuccacccacucagaaccaccgacggccggcagagaaaauugaagacguugagaucacccuuguguga

SEQ ID NO: 56195 - RNA, 981 nt, Artificial Sequence
  derived and/or modified sequence opt3 from FCN1__Homo_sapiens__NP_001994
auggagcugagcggcgccaccauggcuagagggcucgcagugcuucuggucuuguucuuacacaucaagaaccugcccgcccaggcggcugacacaugcccugaaguuaaagugguaggacuagaggguuccgauaagcucacuauucugaggggcuguccagggcuuccgggagcccccggcccuaaaggugaagcaggggugauaggagagcggggcgaacgcggccugccaggggcccccggaaaggcugguccugucggcccaaaaggggaccgaggagagaagggcaugcguggugagaagggggaugcaggacaaucucagucaugcgccacgggccccagaaauuguaaagacuugcucgauaggggcuacuuucugaguggguggcauaccaucuaucugccugacugccggccacucacaguguuaugugauauggacacugauggagguggcuggaccguuuuccagcgcagaauggacgggagcguggauuuuuacagggacugggcugccuauaagcagggauucggcucccaacugggugaauuuuggcuugggaacgauaauauucacgcguugacagcacaggggucuucggagcugcgggucgaccuaguggacuucgaaggaaaccaucaguuugccaaauacaagucauucaaaguagcugaugaggccgagaaguauaagcucguucugggcgcauuugugggcggaagcgcugguaauagucuuaccggccacaacaauaacuucuuuuccacuaaagaccaggauaaugacgucucuagcuccaacugcgccgaaaaguuccaaggggcguggugguacgccgauugucaugcaucaaaucugaacggauuguaucucaugggcccgcacgagaguuacgcuaaugguaucaacuggagcgccgcuaaaggguacaaguauucuuacaaaguguccgaaaugaaggugcgccccgccuga

SEQ ID NO: 56196 - RNA, 942 nt, Artificial Sequence
  derived and/or modified sequence opt3 from FCN2__Homo_sapiens__NP_004099
auggagcuggacagagccgugggcguccucggggcugcaacccuucuguugagcuucuuaggaauggccugggcgcugcaggcugccgauacaugccccgaaguuaagauggugggucuagagggcuccgacaaacucacuauccugaggggguguccuggacuuccaggcgcaccgggucccaagggggaagccggaacgaacggcaaacggggcgagcgcgggccuccaggacccccugguaaggcuggcccacccgggccuaauggagcaccaggcgaaccgcaacccugccugaccgguccucgaacauguaaagauuugcucgaccgugggcacuuucugucuggauggcauacuauuuaccugccagauugcagaccccucaccguauuaugugacauggauacagacggcggcggguggaccguguuccagaggcgggucgauggaucaguggacuuuuaucgcgauugggccacuuacaagcaggguuucggcaguagacugggggaguuuuggcuuggaaacgacaauauacacgcuuugacagcccagggcaccagcgagcugaggguugaucuaguggacuucgaagacaacuaucaauuugcgaaguaccgguccuucaaagucgcagaugaggccgaaaaguauaaucucgugcugggugcuuuuguagaggggucugccggcgacucgcuuacguuccauaacaaucagucauuuagcacuaaagaucaggacaacgaucugaauaccggaaacugcgcaguuauguuccagggcgcuuggugguacaagaauugucacgugaguaacuugaaugggcgcuaucuccgaggaacacaugguuccuuugccaacggcaucaauuggaaaucugggaagggauacaacuacagcuauaaggucuccgagaugaaagugagaccugcguga

SEQ ID NO: 56197 - RNA, 1101 nt, Artificial Sequence
  derived and/or modified sequence opt3 from FCRL1__Homo_sapiens__NP_001152869
augcugcccagacuccuucuguugaucugcgccccuuuaugugagccagcugaacuguuccuaauugcaagcccgucccaccccaccgagggcucuccugugacacucacuugcaagaugccauuucugcagucaagugacgcccaauuccaguuuuguuucuuuagggauacgcgggcgcuugggcccggauggagcuccucuccuaaacugcagauagcugccauguggaaggaagacaccgguucguacuggugcgaggcacagacaauggccucaaaagucuugcgcagccgacguagucaaaucaacguucauagagugccaguagcugaugugucccucgaaacucagcccccuggcgggcaggucauggagggagacaggcuggugcugauuuguucuguugcaaugggcaccggugauaucacauuccucugguauaagggggccgugggauuaaaucugcagagcaaaacccaacggucccuuacugcugaguacgaaauuccaucaguccgcgagagugacgccgaacaguauuacugcguggcggagaacggcuauggcccgagccccucuggguugguauccaucacaguuagaauaccugugucaaggccaauccugaugcuacgggcaccccgcgcccaggcugccgucgaggaugugcucgaacugcacugugaggcacuucgaggaagcccuccaauucuguacugguuuuaucaugaagacaucaccuuggguaguagaucugcucccuccggcgggggagccagcuucaaucucucgcugacggaggaacacucuggcaacuacuccugcgaggcgaauaacgguuuaggggcccagaggucagaggcagugacucugaauuuuaccggacggcguagugcucgcgauccgcucagaagccuuccuucuccccugccacaagaguucacauacuugaacuccccuacucccggccagcuacagccaauuuaugaaaaugaacccagggagcaaagcgucgccguucauggccggcagcagcacucaagugaacagaaggcucaaaagccuugggggcacaucuggcgaacccgcuuuccauga

SEQ ID NO: 56198 - RNA, 1335 nt, Artificial Sequence
  derived and/or modified sequence opt3 from FCRL2__Homo_sapiens__NP_001152960
augcugcucuggagccuucuggugaucuucgacgccgucaccgagcaggcugauuccuugacauuaguugcacccucuucaguguuugaaggcgacaguauuguacugaagugccaaggggagcagaacuggaaaauacagaagauggccuaccacaaagauaauaaggaacuaagcguguucaaaaaguuuuccgacuuccucauccagucugcgguccugucggauucaggaaacuauuuuuguagcacuaagggucaacuuuuccugugggacaaaacgaguaauauugugaagaucaaaguucaggaguuguuucagagaccugugcucaccgcuuccucuuuccagccaauugaaggcgggccggucagccugaagugcgagacaaggcugucaccccaacggcucgaugugcaguuacaguuuuguuucuuucgcgagaaccagguacugggauccggcuggaguagcucuccugaacuucaaaucuccgccguuuggucagaggacacugguagcuacuggugcaaagcagaaaccgugacacaucgaauacguaagcagaguuugcagucucaaauccacguccagaggauuccaaucuccaaugugagccuggagauuagagcccccgggggacaggugaccgagggccagaagcuaauccuccuguguucggucgcuggcgggacuggaaacguuacauucucuugguaucgggaagcaaccgguacguccaugggcaaaaagacucaacgcucacuuagugccgagcuggaaauaccugcugugaaagagagcgaugccgggaaguacuauugcagagcggacaauggacauguaccaauucaguccaaaguggucaacauccccgugaggauuccuguuucucggccaguguugacccuccgcagcccgggcgcacaggccgcugucggugaucuguuagaacugcacugugaggcccuccgagggucacccccuauccuuuaccaguuuuaucaugaggacgugacacugggaaauaguuccgcaccaagcggcggcggggcuucuuucaacuugucacuaacugccgaacacaguggaaauuacagcugcgaggcgaacaauggucugggcgcccaauguuccgaagcaguacccguuucuaucucggggccugauggauacagaagggaccucaugaccgcuggcgugcuguggggucuuuucgggguccugggcuuuacaggaguggccuugcuccuguaugcuuuauuccacaagauuagcggcgaguccucagccaccaacgaaccacggacgcccaaaaguucuacucugcuauga

SEQ ID NO: 56199 - RNA, 2205 nt, Artificial Sequence
  derived and/or modified sequence opt3 from FCRL3__Homo_sapiens__XP_006711208
augcugcucuggcuucuguuguuaauccugacccccggaagagagcagagcgggguggccccuaaggcuguccuacuccugaacccaccgugguccacagcauucaaaggagaaaagguugcccuuauuuguucuucaauaagucacagccuggcgcaaggugacacuuacugguaucaugaugagaaauugcucaagaucaaacacgacaagauucagaucacggaacccggcaauuaccagugcaagaccaggggguccucucugucggaugcugugcauguagaguuuucaccugacuggcugauucuccaggccuuacacccaguguucgaaggagauaacgucauccugcggugccaaggcaaagacaauaagaacacacaucagaaaguguauuacaaggaugguaaacagcuucccaauagcuauaacuuggagaagauaacuguuaauagugugucccgcgacaacucuaaguaccacuguaccgcauaucgaaaauuuuacauccuggauauugaggucacaagcaagccucuaaauauccaggugcaagaacucuuccugcacccaguacuucgugccuccucaaguacccccauugaggggagcccuaugacucugacaugcgaaacccaguugucuccacagagaccggacguucagcuccaauuuucccuguucagggauucacagacguuaggacugggcuggagccggaguccccgccuccagaucccugcuauguggacugaggacucuggcuccuacuggugugagguggaaaccgucacacauagcauuaaaaagagaucgcuuaggucucaaauacgggugcagcgcgugccagucuccaacguuaaucuggagauccgacccacugggggacaguugauugaaggugagaacauggugcuaaucugcucaguagcacagggcagugggaccgugacauuuagcuggcacaaagaaggaagagucaggucccugggccggaagacccaacguucucuccuggccgagcuucaugugcugacgguuaaagagagcgaugcuggucgcuauuacugugccgcggacaaugugcacucaccuaucuugaguacuuggauuagagucacagugaggauaccaguaucccaccccguucucaccuuccgggcaccgcgagcccauacuguggucggggaccuguuagaacugcacugcgagagccuacgcggaucuccucccauccucuauagauuuuaccaugaagaugugacacugggcaacucaagugcuccaagcggcgggggagccuccuucaaucuuucuuugaccgcagagcacucggguaacuauagcugugacgcugauaacggccugggggcccagcauucccacggagucucacucagggugacgguuccugugagucggcccguacugacccuucgcgcgccaggcgcccaggcagucgugggugaccuguuggaacuccacugcgagucucugagagggagcuuucccauuuuauacugguucuaucaugaggaugacacacugggcaauaucuccgcucacucaggaggcggggccagcuuuaaccuaucucucacuaccgaacauuccggaaauuacaguugugaggcugauaacggucugggcgcccagcacagcaagguugugacacuuaaugucacugggaccucuaggaaccguacaggauugaccgcagccggcauaacuggucuggugcucuccauucugguauuagcugcggcagccgcucugcuucacuacgcccgggcacgaagaaagccugggggcuugucagccacgggaacaaguagccauucgccauccgaaugccaagagccgucuagcucaaggcccagucgcaucgacccucaggaaccaacccacuccaaaccccucgcuccuauggagcuggagccaauguauucuaaugugaaccccggcgauagcaauccgaucuacucccagauuuggucaauccagcauacuaaggaaaacagcgccaauugcccuaugaugcaccaagagcaugaggaacuaaccguucuguauagugagcucaaaaagacacacccagacgauucugcaggggaagcguccagccggggcagagcucacgaggaagacgacgaggaaaacuacgagaauguccccagggugcugcuugccucggaucauuga

SEQ ID NO: 56200 - RNA, 1548 nt, Artificial Sequence
  derived and/or modified sequence opt3 from FCRL4__Homo_sapiens__NP_112572
augcugcucugggccagccuucuggcuuucgcacccgugugcggccaguccgccgcggcucacaagccugucaucucuguucauccaccguggaccacauuuuucaaaggggagagagugacuuugacguguaacggauuucaauucuacgccaccgaaaagacaacuugguaucacaggcauuacuggggugagaaauuaacccugacacccggcaauacccuagaaguacgggagucagggcucuaucgcugccaggcacgaggaaguccucguagcaacccagugagacugcuguuuuccucugacucgcuuauuuugcaggcccccuacucagucuucgaaggcgauacucucgugcugaggugucaccggcgcagaaaggagaaacugacagcuguuaaguauaccuggaaugguaacauacucagcaucaguaauaaguccugggacuuacugauuccucaggcaucuagcaacaauaacgggaauuacaggugcaucggauauggcgaugagaacgacguguuucgguccaauuucaaaauuaucaagauacaagaacuuuuuccacaucccgaguugaaagccacggauucacagccuacugaaggcaacagugucaaucugagcugugagacccagcuaccaccggagcgcucugacacaccccuccacuucaacuuuuuccgagauggggaagugauccuguccgacuggucaacuuacccugagcuucagcugccaaccguauggagagaaaauagcggaaguuacuggugcggugcugagacaguuaggggcaacauucacaagcauucucccuccuugcaaauccacgugcagcggauuccugucagcggggugcuccuggaaacccagccaucgggaggccaggccguggagggugagauguuaguccugguuuguucuguggcggaagggacgggagauacuacauuuuccuggcaucgugaggacaugcaagaaucacucggccgcaaaacccagagaagucuuagggcagagcuggaauugcccgccauccggcagagccacgcuggcggguauuacugcacugccgauaacuccuauggaccgguacaaucuauggugcuaaaugucacagugcgagagaccccugguaaccgcgacggccugguugcagcuggggccacgggaggccuccugagcgcgcuucuguuggccguggcacuccuguuccacuguuggagaaggcggaagucaggugucggguucuuaggcgaugagacccgccugcccccagcuccuggacccggcgaaaguucccauagcauaugcccagcccagguggagcuacagucucucuacguagacguucaccccaagaaaggggaccugguguauucagaaauucagacaacucaacuuggagaggaagaggaggcuaauaccaguagaacauugcuggaagauaaggacgucagcguggucuacuccgaggugaaaacucagcauccugauaacucugccgguaagaucucgagcaaagacgaagaguccuga

SEQ ID NO: 56201 - RNA, 2934 nt, Artificial Sequence
  derived and/or modified sequence opt3 from FCRL5__Homo_sapiens__NP_112571
augcugcucugggugauccuucuggucuuggcccccguuagcggccaguucgcuagaaccccuaggccaauuauauuuuuacaaccgcccuggacaacuguguuccagggggagcggguaacgcugaccugcaagggauuucgcuucuacuccccucagaaaacaaagugguaucaccgauaccuagguaaagaaauccuccgugagacuccagacaacauucuggaagugcaggagucuggcgaauauagaugucaagcacaggggucaccccuuaguagcccuguccaccuggauuuuuccucugccucguugauccuccaggcgccacugucaguguucgagggagacagcguugugcugaggugccgggcuaaggccgaggucacccucaauaacacaauuuacaaaaaugauaacguguuagcauuucugaauaagcgcaccgacuuccacaucccccaugccugucuuaaggauaacggcgcuuauagaugcacugguuacaaagaaaguuguugcccuguauccucuaauacaguuaagauacaggugcaagagccauuuaccaggccggucuugcgggcaagcuccuuccagcccaucucagggaacccugugacgcugacuugugaaacccagcuaagucucgagcgcagcgacgugccacugcgauuuagauucuuuagggaugaccagacacuuggacugggcuggucuuugucccccaauuuccaaauuacugccauguggucaaaagauagcggcuucuauuggugcaaggcugccaccaugccuuacagugucaucucugacuccccacggagcuggauucagguucagauccccgcgucgcacccggugcucacacugucuccugagaaagcauuaaacuuugaagggaccaagguaacgcugcauugugagacucaagaagauucccuccguacacuuuaccgcuucuaucacgagggagugccccugagacacaagucagucaggugcgaacggggugccaguauauccuuuuccuugaccacugaaaauucuggcaacuacuauuguacagcugacaaugggcuaggagccaaaccaagcaaggcagugucacugaguguuaccgugccugucucccaucccgugcucaaccugagcucuccagaggaucuuauuuucgagggcgcuaaaguaacgcugcacugcgaggcccagcgagguucauugcccauccucuaccaguuucaucacgaaggggcggcccuggagcgcagaagugcaaauagcgcuggaggcguugccauuuccuucucuuuaaccgcugaacacucgggcaacuauuacugcacagccgacaacggguuuggaccucagaggagcaaggcagugucccugucagucacugugccagucagucauccggugcuaacccucucuagcgccgaggcucugacauucgagggugcgacuguuacccuucacugugaagugcaacggggcagcccccagaucuuguaucaguuuuaccaugaggacaugccucuguggucaagcucuacaccauccguagggcgcgucaguuucagcuuuucucucaccgaaggacacuccggcaauuacuauugcacugcagauaacgguuucgggccccagagaucagaggugguuagucuguuugugacggucccugugagcaggccaauccuuacacugcguguaccccgggcccaagcugugguuggcgacuugcucgaacugcauugugaggccccgcgaggaucgccuccaauuuuauacugguucuaucacgaggaugucacccugggcuccucuagcgcacccucagggggagaagccaguuucaaucuaucccucacugcugagcacucugguaacuacagcugcgaagccaauaacggccugguggcacagcauuccgacaccauaucacuuagcgugaucgucccuguuaguagacccauuuugacauuuagggcgccacgcgcucaggccguggugggggaucugcucgagcugcacugugaggcauuacggggaucuuccccuauccuguauugguucuaccaugaagacguaacccuuggcaaaauaagcgcccccucgggugggggcgcuucauuuaauuugucucucacuacagagcacaguggaauuuauuccugcgaagccgauaacggccuggaggcacagagaagcgaaauggucacgcuaaagguggcuguuccagugucuaggccgguccugacccuccgcgccccugggacucacgcggccgugggagaccugcuugaguugcauugugaggcucugcgagguagccccuuaauccucuaccgguucuuucacgaagauguuacacugggcaaucguuccucaccaagugggggagcaagccuuaaccugucuuugaccgccgagcauuccggcaauuacucaugcgaagcugacaacggucucggggcccaaagaagugagacagugacucuguauaucaccggccuaacggcaaauaggagcggacccuucgcgaccggcguagccgggggacugcucuccauugcuggccuggccgcuggugcacuuuugcuguacuguugguuaucucgcaaagccgggcggaagccugcaucggauccagccagaagccccucagacuccgacagucaggaaccuacauaucacaacgucccggcuugggaggagcuccagccaguguacacuaaugcgaaccccaggggagaaaacguggucuauucugagguucgaaucauucaggaaaagaaaaagcaugccguggcaagcgauccucgccaucugcggaauaaaggcuccccaauaaucuacucagagguaaagguggcuucuacccccgucagcgguagucuuuuucuggccuccagcgccccucacagauga

SEQ ID NO: 56202 - RNA, 1242 nt, Artificial Sequence
  derived and/or modified sequence opt3 from FCRL6__Homo_sapiens__NP_001271146
augcugcccagccucggcccuaugcuucuguggaccgccguguuguuauucgucccaugcguugggaagacaguguggcuguaccuacaggcuuggccgaaccccguauuugagggagacgcacucacucugagaugucaagguuggaaaaauacgccucuuucccaggugaaguucuauagggauggcaaauuucugcacuucucuaaggaaaaccagaccuugucaaugggggccgcgacaguccagagucggggacaauacagcugcuccggccaggugauguauaucccacagacuuuuacccagacaucugagaccgcuaugguucaagugcaggaacucuuucccccuccaguccugucggccauucccucaccugagccacgcgaagguagccuggugacucuccgaugucagacaaaauuacauccgcugcguagugcacuuagauugcuguucuccuuccacaaggacgggcauacccuacaggauaggggaccccacccugagcucugcauaccaggcgccaaggagggcgacucugggcuguacuggugugaaguagcucccgagggaggucaaguucagaaacagagcccucaacuugaagugcggguccaggcaccagugucccgccccgugcugacguugcaucacggcccggccgauccugcugucggggacaugguucagcuccugugcgaggcccagagaggaucacccccaaucuuauauaguuuuuaccuggaugagaagauugugggcaaucacagcgcgccuuguggugggacuaccucucuccuuuuccccguaaaauccgaacaagacgcaggaaacuauucaugcgaggccgaaaauagcgugaguagggagcggucugaaccaaagaaacuguccuugaagggcagccagguccuauuuacacccgcuucgaacuggcuggugccuuggcucccagccucucugcuuggccugaugguuaucgcagcugccuugcucguguacguccgcuccuggcgaaaggcggggccgcugcccucacagauuccuccaacugcccccggaggugagcaguguccuuuauacgcaaaugugcaucaccaaaaaggcaaggaugaggggguaguuuauagugugguccauagaaccagcaaaagguccgaagcucggucugccgaguucacagugggacguaaguuuuaccaccugugcggcggugaaaugccagcugcccaguga

SEQ ID NO: 56203 - RNA, 1149 nt, Artificial Sequence
  derived and/or modified sequence opt3 from FCRLA__Homo_sapiens__NP_001171795
augcugaagaaaaucagcgugggcgucgccggggaccucaacaccguuacaaugaaacuuggaugcgugcugauggcuugggcauuguacuuaucccuggguguacuauggguggcccagaugcuccuggcggcuggcugucacgccgcagccucuuucgagacucuucaaugcgaagggcccgucuguacggaggaaucaaguugccauaccgaggaugaccugacagaugcuagagaagcaggauuucaggugaaggccuauacuuucagcgagccuuuucacuugauuguuuccuacgacuggcucauacugcagggcccagcuaagccgguguucgagggugaucugcucgucuuaaggugucaggccuggcaagacuggccccugacccaggugacauuuuaucgggaugggucugcgcuuggaccuccaggccccaaucgcgaguucucgaucaccguaguucagaaagcagacucaggccauuaccacugcagcgggauuuuucagaguccuggaccagguauccccgaaacugccuccguggucgcuauuacagugcaagaauuguucccugccccaauccugcgagcagugccgucugcugagccccaggccggcagcccuaugacccuauccugucagacgaagcucccacugcagcguucagcggccagacuucuguuuaguuucuauaaggaugggaggauaguccaaagccggggauugucuuccgaguuucagauccccacugcaucagaagaccauagcggcaguuacuggugcgaggcugccaccgaagauaaccagguuuggaaacaaucuccucagcucgagauucgcgugcagggugcuuccagcucggccgcaccacccacacugaauccggccccucagaagucugcugcgcccgggacugcaccagaagaggccccuggacccuuaccacccccuccaaccccguccucagaggaccccggcuucaguagcccucugggcaugccagauccccaccucuaucaccaaauggggcuucuguugaaacauaugcaggacguaagagugcuacugggacaccuccugauggaacuuagggagcuguccggucaucggaagccuggcacaaccaaagcuacggccgaauga

SEQ ID NO: 56204 - RNA, 957 nt, Artificial Sequence
  derived and/or modified sequence opt3 from FCRLB__Homo_sapiens__NP_001275758
auguggccccugaccgcccuccuucuguuggugccuagcuccggccaggcugcaacauuagagaagccaauccugucucuacacccgcccuggacuacgauuuucaaaggggaaagagucacccucaagugcgacggauaccauccucugcuucuggaguugcaaccaauaucaacacucugguaucugggucaucugcucuuacccagucacaaaaagagcaucgaaguucagacuccuggcguguacaggugucagacccgcggggccccaguauccgaucccauucaccugucugugucgaacgacuggcuuaucuugcaggucccuuaugcgccaguguuugagggagaaccgcugguucuacggugccgaggcugguacgauaaaguggucuauaagcuccauuacuaucacgacggucaagcugugcguuacuuccacucaagcgccaauuacacaguacugcaggcaagagccagugauuccgggagguaucaguguucuggaaccaugcggauucccguugagagcgcuccuauguuuuccgcaaagguggccgucacugugcaggcugcccgcugcgcggcaucaacaggcgccccaaguacccaaagcagaucucccaggucccggucaagcaaccgcacgggcgcucgaagacuuccuccacccgccgugagugggaaugcagucaggggauguucuucccggggucguguucugccguggacucgcccucccccaccuccccaguugcauggcccacagcccuggcuccuggugaucgggagauucccuagcgagucgccaaggugcccggaccggucucgauggucacccccuuccggaaccccacccccuccaggcuguaguagccgcagagcugcccccagguuacggggucacccgccugcgcugcgcagaaggccauggaacaaucgucucgaacccuga

SEQ ID NO: 56205 - RNA, 1254 nt, Artificial Sequence
  derived and/or modified sequence opt3 from FDFT1__Homo_sapiens__NP_001274672
auggaguucgugaagugccugggccaccccgaagaguuuuacaaccucgucagauucaggaucgggggaaaacggaagguuaugccuaaaauggaccaggauagccuuuccucuucacugaagaccuguuauaaauacuugaaucaaacaagucgcagcuuugccgcugugauucaggcauuagacggugaaaugcgaaacgccguaugcauauucuaucuggugcuacgugcgcucgauacucuggaggacgauaugacgaucuccgucgaaaagaaggugccacuucugcauaauuuucacucuuucuuguaccagccggacuggagauuuauggagucgaaagagaaggauaggcagguucucgaagacuuccccaccauuucacuggaguuucggaaccuggcugaaaaauaucaaacagugaucgccgauauuugucgcagaaugggcaucgggauggcagaguuccucgacaagcaugucacuagcgagcaggaaugggauaaauacugccacuauguggccggauuaguaggcauaggucugaguagguuguuuuccgcuucugaguucgaagacccucuuguuggggaggauaccgaacgggcaaauagcaugggacuguuucuacagaagacaaacaucauucgcgacuaccucgaggaccagcaaggcggccgagaguucuggccacaggaagugugguccagauacgucaagaaacugggggauuucgccaagcccgagaauaucgaccuugcugugcagugucugaacgaauugauuaccaaugcccuccaucacaucccugaugugauaacuuaucugucaagguuacggaaccagagugucuuuaauuucugcgcgauuccacaaguuauggcaaucgccacacuggcugccuguuacaacaaucaacagguguuuaaaggagcaguaaagauucguaaaggucaggcugugacccucaugauggacgccacgaacaugcccgcggucaaggccaucaucuaucaguacauggaggaaauuuaucaccgcauaccugauagcgacccaucuuccucaaaaacuagacagaucauuagcaccaucaggacacagaaucuuccgaacugccaacugauaagucggucucauuacucccccauuuauuugagcuucgugaugcuacuggcagcucucucguggcaguaccugacuacccuuucucagguuacagaggauuacgugcagaccggcgagcacuga

SEQ ID NO: 56206 - RNA, 1260 nt, Artificial Sequence
  derived and/or modified sequence opt3 from FDPS__Homo_sapiens__NP_001129293
augccccugagcagauggcucagguccgugggcgucuuccuucugccugccccauacugggcuccgcgggagcgcugguuggggucuuuacgacgucccucacugguucacggauauccugugcuagcauggcauagugccagaugcuggugucaggcguggaccgaagaaccaagggcucucugcagcucccugcggaugaacggugaccaaaauucugauguauacgcccaggaaaagcaggacuuugugcagcacuucucgcaaaucguccgcgugcuuacagaggaugaaaugggccaucccgagauuggggacgcaauagccagacugaaagagguuuuggaauauaacgcuaucggaggcaaguacaauaggggucucacuguggucguggcauuucgggagcugguagaaccucgcaaacaggaugccgacucacugcagcgagcuuggacgguugggugguguguggagcucuuacaggccuucuuucuggucgcggaugacauuauggauagcagucuuaccagaaggggacaaaucugcugguaucagaagccaggcgugggcuuggacgcaauuaacgaugccaaucugcuagaggcuuguaucuaccggcuccugaaacuuuauugccgugaacagcccuacuaccugaacuugauagaguuauuccugcaguccucuuaucaaacagaaaucgggcagacuuuagaccugcucaccgccccucagggaaauguggaucuuguccgcuuuacagagaagagauacaagagcauuguuaaauauaagaccgcauucuacuccuuuuaucugccaaucgcugccgcgauguacauggccgguauugacggcgaaaaagagcacgcaaacgcuaagaaaaucuugcuagagaugggggaguucuuucaaauacaggacgauuaucuggaccucuucggagauccgucagugacuggcaagauugguacagacauccaggauaauaaguguaguuggcugguagugcagugccuucaaagggccacccccgagcaguaccagauucugaaagaaaacuacgggcagaaggaggcugaaaaagucgcccgggugaaggcauuguaugaggagcucgaccugccugccguuuuucuccaauacgaagaggauagcuauucucauaucauggcucugaucgaacaguacgcggcaccacuacccccugccguguuccucggacuggcucgaaaaauuuauaagcgcagaaaauga

SEQ ID NO: 56207 - RNA, 555 nt, Artificial Sequence
  derived and/or modified sequence opt3 from FDX1__Homo_sapiens__NP_004100
auggccgcugcaggcggggccagacugcucagggcggcuagcgccgugcuuggaggucccgcaggccgguggcugcaccaugccgggucccgcgcuggaucuucaggcuuguuacgaaaccgugguccugggggaagugcagaggccagcagaucccugucugucucggcuagggcccggucaagcagugaagacaagaucaccguucacuucauuaaucgcgauggcgagacacuaacuacgaaaggcaaggugggggacucccuccuggauguaguggucgaaaacaaucuugacauagauggauuuggugcgugcgagggcacccuggcauguucuacaugccauuugaucuucgaagaccacauuuacgagaaacucgaugccaucacugacgaggaaaacgauaugcuggaccuggcuuaugggcucaccgauagaagcagguuaggaugucagauuugccugacaaaguccauggacaauaugaccgugcggguuccagagacuguggccgaugcacgccaaucaaucgacgucggcaaaacaaguuga

SEQ ID NO: 56208 - RNA, 561 nt, Artificial Sequence
  derived and/or modified sequence opt3 from FDX1L__Homo_sapiens__NP_001026904
augcacgugauggccgcuagcauggcaagaggcggggucuccgccaggguucugcuccaggcggcucggggaaccugguggaaccgccccgguggcacaucugggucaggagaaggcguggcccuugguacuacgcgaaaguuccaagcaaccgggagucguccugccggagaagaggacgcuggcggcccagaaagaccgggggauguagugaaugucguguuuguugacaggagcggacagcggauccccguguccggucgcgucggcgauaacgugcugcauuuggcacagagacacgggguagacuuagagggagccugcgaggcuucucuggccuguucgacaugccauguuuacgugucagaagaucaccuagaccuccugccuccacccgaggaaagggaggaugacaugcuugauauggcgccucuguugcaggaaaauagccggcucggcugucaaauuguccugacuccagagcuggagggugcagaguucacccuccccaaaauaacacgcaacuuuuauguggacgggcaugugccuaagccacacuga

SEQ ID NO: 56209 - RNA, 1605 nt, Artificial Sequence
  derived and/or modified sequence opt3 from FDXR__Homo_sapiens__NP_001244941
auggccagcagaugcuggaggugguggggcugguccgcuuggccccggacccgccugccuccagcagggucuacaccgucauucugucaccauuuuaguacucaggagaagacgccccaaaucugcguggucggaagcgguccugccggcuucuacaccgcgcagcaccuccuuaaacgaguugaagcucuguguucccagccacguguguugaacucucccgccuuaucgggggagggagaagaccugggcgcaucacagccucuaagccucgguccaacaaguugccaucccguaccucaacagcacccacaggcccauguggauauuuaugagaagcagccgguccccuuugggcuggugagauucggaguugcuccugaccacccagaagugaaaaaugucauaaacacuuuuacccaaacagcacacuccgggaggugugccuucuggggcaauguggagguaggccgggauguuaccgugcccgagcuucaggaggcuuaccaugccgucgugcugucuuauggagcggaagaccaccgcgcauuggaaaucccuggugaggagcucccaggcgugugcagcgccagagcuuuugucgggugguacaacggacugcccgaaaaucaggagcuggaaccggaucucuccugugacacugccguuauuuuaggccaggguaacguggcacuggauguagcuaggauccuuuugacaccucccgagcaucuggaacggaccgacauuacgaaggccgcgcuaggggugcuccgccaaucacgagucaaaacuguguggcugguuggaagaaggggcccacuucagguggccuucaccaucaaggagcugcgggagaugauacaguugccuggcgcacgucccauccucgauccagucgacuuucugggguuacaagauaagauuaaagaagugccccgcccuagaaagaggcugacagagcuccuucugcggacugcuaccgaaaaaccaggaccggccgaggcugcccgacaggcaagugccagccgcgcuugggguuugagauucuuuaggucuccccagcagguacuaccuuccccagacggccggcgcgcggcagggguuagacuggccgugacaaggcucgaaggagucgaugaggcuacccgugccgugcccacgggcgacauggaggaccugccuugcggucuuguccugucaagcaucggguauaagagucggccaguggaucccucuguuccguucgacuccaaauugggcgugauuccuaauguagaaggacgagucauggaugugccaggccucuacuguagcggguggguuaagagaggacccacuggugugaucgcaacaaccaugacugacucguuucugacaggccaaauguuacugcaggaucuaaaggccgggcuccugccuucuggacccaggccaggcuaugcugccauacaggcacuuuuguccucacgcgguguccggccugugaguuucagcgacugggagaaacuggaugcggaagagguagcuagagggcagggcaccggaaagcccagggaaaaacucguggacccacaagagaugcugcgccuucugggccacuga

SEQ ID NO: 56210 - RNA, 1272 nt, Artificial Sequence
  derived and/or modified sequence opt3 from FECH__Homo_sapiens__NP_000131
augagaagccugggcgccaacauggcugcagcccucagggcggcuggggugcuucugcgggaccccuuggccuccucuucauggcgcgucugccagccuuggcgauggaagaguggagcagccgcugcagccguuaccacagagacugcucaacacgcccagggugcgaaaccacaggugcagccgcaaaagcguaaacccaagacgggcaucuuaaugcugaauaugggagggccugaaacccuaggcgauguacaugacuuccuccugagacuuuuucuggauagggacuugaugacacucccaauucagaacaaacuggcacccuucauagccaagcggcgcacuccuaagauccaggagcaguacagaaggauuggugggggaagcccaaucaaaauuuggaccuccaagcaaggcgaaggcauggugaaacugcucgaugaguuaucucccaauacagcuccucacaaguauuacaucggguuucgguauguccauccacugaccgaagaggccauagaggaaauggagcgcgacggacuugaacgagcaaucgcuuucacucaguacccgcaguauucguguucaacaaccgguagcaguuugaacgccauuuacagauauuacaaucaggugggcaggaaacccacgaugaagugguccacuaucgaucgguggccuacccaccaucugcuaauucaaugcuuugcggaccacauccucaaggagcuggaucacuucccacuugagaaacguucugaaguugugauacuguuuagcgcccauuccuugcccaugucagucgugaaccgcggggacccuuacccacaggagguaagugcaacaguucagaaggugauggaaagacucgaguauuguaaucccuacaggcuggucuggcaaagcaaagugggaccgaugccuugguuaggcccccagacugaugaaucuauuaagggucugugcgagcgggggcgaaagaacauccuccuugugccaauugcuuucaccuccgaccacaucgagacacuguaugaauuggauaucgaguacucacagguccuagccaaagaauguggaguugagaauauucgcagagcugaaagccugaacggcaauccucucuuuaguaaagcccuggcagaccuugugcauucucacauacaguccaacgagcugugcagcaagcaauugacccucucguguccccugugcguaaauccaguguguagggagacgaagucuuucuuuacuucccagcaguuauga

SEQ ID NO: 56211 - RNA, 2010 nt, Artificial Sequence
  derived and/or modified sequence opt3 from FEM1A__Homo_sapiens__NP_061178
auggaccugagaaccgccguguacaacgcugcaagggauggcaagcuccagcuucugcaaaaauuguuaagcgggcggucccgcgaggaacuggacgagcuaacaggagaagucgccgguggcgggacuccccuccugaucgcggcucgauauggacaccuugauguuguggaguaccugguagaccguugcggcgccucuguggaagccggugggucaguccauuucgauggagagacgauugagggcgcaccuccauugugggcugcaagugccgcuggccaccucgacgugguuagaagccugcugaggcggggagccuccgugaaucgcaccacaagaacuaacucuaccccgcucagggcggcauguuuugaugggcauuuagaagucgugcgguaucugguaggugagcaccaggccgaccuugaaguugcuaaucgccauggccacacaugcuugaugauaucguguuacaaggggcaccgagagaucgccagauaucugcuagagcagggagcacaggugaacaggcggucagcuaaaggcaauaccgcccuccaugauugcgcggaaagcgguagucuggagauucuucaacuguugcucggguguaaggcccguauggaacgcgacggauacggcaugacuccccuguuagcagcuuccgucacaggccacaccaacaucguggaguaucugauucaggaacagccugggcaggagcaaguggccggaggugaggcucagccaggccucccccaggaagauccuucuacgagccaggggugcgcccaaccacagggagcacccuguugcuccucaaguccugaggaaccacuuaauggcgagagcuacgaaucuuguugcccgacuuccagagaggccgcugucgaggcgcuggaauugcuaggugcaaccuacguugacaaaaagagggaucugcucggggcccugaagcauuggcggcgagcuauggagcuucgccaccagggcggagaauaucugcccaaaccugagccaccccaauuggugcucgccuacgacuauucaagagaaguaaacacaacugaggagcuggaagcauuaaucaccgacccugaugagaugaggaugcaggcccugcuaauacgggaacgcauccucggcccaagccaccccgacacaaguuacuauauuagauaccguggggcuguguaugccgauucuggaaauuucgagagguguauccggcuguggaaguacgcacuugacaugcagcaguccaacuuggagccgcugagcccuaugaccgcgucgucuuuucucuccuucgcugaacuguuuucauacguccuucaagaucgagccgcaaaagguagucugggcacgcagauuggguucgccgacuugaugggagugcucacuaagggcguuagagagguggaaagggcucugcaguuaccccgcgagccaggugauagcgcccaguuuacaaaagcacuggcuaucauacuacaucuccuguaucuuuuggaaaaggucgagugcaccccuucccaagagcaccugaagcaucagacuguguaccggcuccugaaaugcgcccccagagggaagaauggcuucacaccauuacacauggcgguagacaaagauaccacgaacguuggaagguaucccgugggccgcuuuccuucucugcaugucgugaagguccuuuuggacuguggggccgauccagacagccgagacuucgauaauaacaccccgcuccacauugcugcacagaauaacugccccgccaucaugaacgcucugauugaagccggagcacacauggacgcgacaaaugccuuuaaaaagacugcuuacgagcuacuggaugaaaaacuccuggcccgggguaccaugcagccuuucaacuaugugacacuucaauguuuggcagcucgugcccuggacaagaauaagaucccauacaaaggcuuuauccccgaggauuuagaagcauucauugagcuccauuga

SEQ ID NO: 56212 - RNA, 1884 nt, Artificial Sequence
  derived and/or modified sequence opt3 from FEM1B__Homo_sapiens__NP_056137
auggagggccuggccggguacguguauaaggcugcaagcgaaggaaaaguccucacccuugccgcgcuguuguuaaacagauccgagucugacaucagguaccugcuagguuauguuucacagcaaggcgggcagcggaguacaccccucauuauagcugcccgcaauggacacgcaaaggugguacgacugcuucuggaacauuaccgugugcagacucagcaaacgggcaccgucagauucgaugguuaugugaucgacggggccacagcuuuguggugcgcagccggagcuggccacuuugagguugugaaacuccuggucagccauggcgccaacgugaaucacacuaccguaacaaacuccaccccucugagggcggcauguuucgaugggcggcucgacauuguuaaguacuuaguggaaaauaacgccaauaucucuauugcuaacaaauaugauaauacuugccugaugaucgccgcauacaagggacauacagacgucgugcgcuaccuuuuggagcagagagcugauccaaacgccaaggcgcacuguggugccaccgcacugcacuuugcugccgaggcuggccauauagacaucgugaaagaacuaauuaaguggagggccgcaaucgucguuaaugggcacggaaugacgccgcucaaaguggccgcugagucgugcaaggcggauguaguggaacugcuucugucacaugcagacugugaucggcgcagccgaauugaggccuuggagcuccugggcgcuaguuucgccaacgacagagaaaauuaugauaucauaaaaacuuaccacuauuuauaccuggcaaugcucgagagguuucaggacggugacaacauucuugaaaaggagguccugcccccuauccacgccuaugggaaucggaccgaaugccguaacccacaggaguuggaguccauucgccaagauagagacgcucuacauauggaaggacugaucgugagggagcggauccucggcgccgauaacauugacguuucucaccccauaaucuaccgaggcgcaguguaugcggauaauauggaguucgaacaguguauuaagcuguggcuucaugcucugcacuugcgccagaaagggaacagaaauacacauaaggaccuccugagguuugcccaggucuucagccaaaugauccacuuaaacgaaacugugaaagcaccugauauagagugcguacugcgguguuccguucuagagauugaacagucaaugaaucgcgugaagaacaucagugacgccgauguccacaaugcuauggacaacuacgagugcaaucucuacaccuuucuguaucuuguguguaucagcacaaaaacccagugcucugaagaggaucaaugcaagauuaacaaacagaucuacaauuugauucaucuggacccaagaacgagggaaggauucacucuccugcaccuugccgucaacuccaauacacccguggacgauuuucauaccaacgacguuuguucauucccuaaugcacuggugacuaaguugcuccuggauugcggugcugagguaaacgccgucgacaacgagggcaauagcgcguuacacauaaucgugcaguauaaccguccaauuagugauuuucugacacuacacucuaucaucauuucccucguugaagccggggcucauaccgacaugacgaauaagcagaacaaaaccccgcuggauaagagcacaacuggagugucggagauacuuuugaaaacccaaaugaagaugucucugaaaugucucgcagcccgggcuguccgagccaaugacaucaacuaccaggaucagauucccagaacacuggaagaguucgugggcuuccacuga

SEQ ID NO: 56213 - RNA, 1854 nt, Artificial Sequence
  derived and/or modified sequence opt3 from FEM1C__Homo_sapiens__NP_064562
auggaccugaagaccgccguguucaacgcugcaagagauggcaagcucaggcuucugacaaaguuguuagccagcaaauccaaggaggaagucucuucacugaucagugagaaaacuaauggggcgacgccccuacucauggcugcccgguacggacaccuggacaugguugaauuucuucuggagcagugcagcgcauccauugaaguggguggcucuguaaacuucgauggggagaccauagagggagccccuccauugugggcugcaucggccgcuggccaucucaaggugguccaaucacugcugaaucacggugccagcgugaacaauacaacucucaccaacaguacaccguuacgcgcggcauguuuugacgggcaucuggaaaucguuaaguaucuuguggagcacaaagccgauuuggaagucuccaaucgacauggacauaccugccugaugauuucuuguuacaagggccacaaagagaucgcucaguaucuacucgagaagggcgccgacgugaaccguaaaagcguaaaggggaauacugcacugcacgauugcgcugaauccggaucacuugacauuaugaagaugcuguugauguacugugccaaaauggagaaggaugguuauggcaugacaccccuccugagugcgagcguuaccgggcacacgaacaucguggacuucuuaacucaucacgcccagaccucuaaaacagaaagaauaaaugcacuggagcuccuuggagcuacuuuugucgauaagaaaagggaccuguugggcgcccuaaaguacuggaaaaaggcuaugaacaugcgguauuccgaucgcaccaauaucauuucaaagccugugccacagacacugaucauggccuacgacuacgcaaaagaagugaacagcgccgaggagcucgaaggucugauugcugaccccgaugagaugagaaugcaagcgcuucugaucagggaacggauauuggggccuagucacccagacaccucuuauuacauucgcuaucgaggagcagucuacgccgauuccggcaauuucaagagaugcaucaaccucuggaaauaugcucuggacaugcagcagagcaacuuagauccccugucgccuaugacggccucuucccuacucucauuugcagagcuguucaguuuuaugcuucaggacagggccaagggcuugcuggggacuacaguuaccuucgaugaccucauggguauucuguguaaaagcgugcuugaaaucgagcgggcuaucaagcaaacucagugcccagccgauccgcugcaguugaauaaggcacucuccauuauacugcauuuaaucugucugcuagagaaaguacccugcacacucgaacaggaccacuuuaagaaacaaaccauuuaccguuuccugaaacuucauccucgcggaaagaacaauuuuucuccauugcaccuggcgguggauaagaacacgaccugugucggcagauaucccgugugcaaguucccuagccuccagguuacagcuauccugauagagugcggggccgacgugaaugucagggacucagaugacaacaguccauuacauauugcagcccugaauaaccaccccgauaucaugaaucuuuugaucaaauccggagcucacuucgacgccacuaaccuccauaagcagaccgcaagcgaucugcuagacgaaaaagagauugcuaagaaucugauccaaccgauuaaccacacaacucuccagugucuggccgcgcgggugauaguaaaucaucgaaucuacuacaaaggccacauuccugaaaaacuugagaccuuuguuucuuugcaccgcuga

SEQ ID NO: 56214 - RNA, 1143 nt, Artificial Sequence
  derived and/or modified sequence opt3 from FEN1__Homo_sapiens__NP_004102
augggcauccaggggcuggccaagcucauugcugacguggcacccagcgccauaagagagaacgauaucaaauccuacuucggaaggaaggucgcgauugacgcuucuaugucaaucuaucaauuucuuauugccguucggcaggguggcgaugugcugcagaaugaagagggggaaaccacaagucacuugaugggaauguucuaccgcacuauccgaaugauggagaacggcauaaaaccuguauauguguuugacgguaagccaccgcaguuaaaaagcggggaacuggcaaagcguuccgagagaagggccgaggcugaaaagcaacuacagcaggcacaggccgcuggagccgagcaagaagucgagaaauucacgaagcggcucgugaaaguuaccaagcagcauaaugaugagugcaaacaucugcuuucucugaugggcauccccuacuuggacgcgccuucggaagcagaggccucaugugcugcccucgugaaggcaggcaaggucuaugcugccgcgacagaagauauggacugccugacuuuugggagcccagugcugaugcgccaccucaccgccagugaggcuaaaaaguuacccauucaggaguuccaccuguccagaauccuucaggaguugggacugaaccaagagcaguuuguagaucuauguauucuccuggguucugacuacugcgaaagcaucaggggcauagggccuaaacgggcaguugaucuuauucagaagcauaaauccaucgaggaaauugugcgccgacuggacccaaauaaguaucccgucccugagaacugguugcacaaagaagcccaccaacucuuccuggagccagagguguuagauccggaaucaguggagcugaaguggagugaacccaaugaggaagaacucaucaaguuuauguguggagagaaacaguucagcgaagagagaaucaggucuggcgucaagcggcuuuccaaaucacgucaggguagcacacaggggcgccuggacgacuuuuucaagguuaccggaaguuugucuuccgcuaaaagaaaggaaccugagccaaagggcagcacuaaaaagaaagccaagacaggcgcagccgggaaauuuaagaggggaaaguga

SEQ ID NO: 56215 - RNA, 501 nt, Artificial Sequence
  derived and/or modified sequence opt3 from FERD3L__Homo_sapiens__NP_690862
auggccgcuuaccccgagagcugcguggacaccacaguccuggauuucguugcagaccucucccuugccucuccuagaaggccacuguugugugauuuugcgccgggcgugucauuaggggaccccgcucuggcccuacgggaaggacgcccucgacguauggcaagauucgaggaaggugauccagaggaagaggagugcgaaguagaccagggcgauggggaggaagaggaggaagaggaaaggggacggggcgugagucuccugggucgccccaagagaaaaagggucaucacuuaugcccaacggcaggcugcaaacauucgcgagcgaaagagaauguuuaaucuuaacgaagccuucgaccagcugaggcggaaagugccuacguuugcuuacgagaagcguuugagccgcauagagacccucagacuggccaucguuuauauuuccuucaugacagaacugcucgagucuugugagaaaaaggaaucgggguga
